United States Patent 11,640,849 (METHODS FOR HISTOLOGICAL DIAGNOSIS AND TREATMENT OF DISEASES) - sequence listing, part 56

SEQ ID NO: 2142702 - protein, 9 aa, Cryptosporidium hominis
GEDNRNSDY

SEQ ID NO: 2142703 - protein, 9 aa, Cryptosporidium hominis
GEDPEEPNN

SEQ ID NO: 2142704 - protein, 8 aa, Cryptosporidium hominis
GEDQTNKD

SEQ ID NO: 2142705 - protein, 7 aa, Cryptosporidium hominis
GEDSDVK

SEQ ID NO: 2142706 - protein, 21 aa, Cryptosporidium hominis
GEDTSTDSENDNQSDDGMEEE

SEQ ID NO: 2142707 - protein, 10 aa, Cryptosporidium hominis
GEEAITNKSA

SEQ ID NO: 2142708 - protein, 8 aa, Cryptosporidium hominis
GEEDSRHD

SEQ ID NO: 2142709 - protein, 12 aa, Cryptosporidium hominis
GEEEDEAAARSR

SEQ ID NO: 2142710 - protein, 11 aa, Cryptosporidium hominis
GEEEEEYTVDG

SEQ ID NO: 2142711 - protein, 7 aa, Cryptosporidium hominis
GEEEEKD

SEQ ID NO: 2142712 - protein, 7 aa, Cryptosporidium hominis
GEEEGDW

SEQ ID NO: 2142713 - protein, 7 aa, Cryptosporidium hominis
GEEEMKE

SEQ ID NO: 2142714 - protein, 5 aa, Cryptosporidium hominis
GEEEY

SEQ ID NO: 2142715 - protein, 9 aa, Cryptosporidium hominis
GEEKLSKNR

SEQ ID NO: 2142716 - protein, 6 aa, Cryptosporidium hominis
GEELPA

SEQ ID NO: 2142717 - protein, 4 aa, Cryptosporidium hominis
GEES

SEQ ID NO: 2142718 - protein, 12 aa, Cryptosporidium hominis
GEESNSFWNYFY

SEQ ID NO: 2142719 - protein, 4 aa, Cryptosporidium hominis
GEEV

SEQ ID NO: 2142720 - protein, 5 aa, Cryptosporidium hominis
GEEYG

SEQ ID NO: 2142721 - protein, 8 aa, Cryptosporidium hominis
GEFERSSN

SEQ ID NO: 2142722 - protein, 13 aa, Cryptosporidium hominis
GEFGISSSTCSSK

SEQ ID NO: 2142723 - protein, 36 aa, Cryptosporidium hominis
GEFQNSAQSSNGFENVDPKSEPLSEIETKNEEGGIK

SEQ ID NO: 2142724 - protein, 6 aa, Cryptosporidium hominis
GEGADT

SEQ ID NO: 2142725 - protein, 35 aa, Cryptosporidium hominis
GEGEGVEEGERIEGEGIEGEGTEEGAKGGIGEKEN

SEQ ID NO: 2142726 - protein, 5 aa, Cryptosporidium hominis
GEGEI

SEQ ID NO: 2142727 - protein, 8 aa, Cryptosporidium hominis
GEGELGEH

SEQ ID NO: 2142728 - protein, 7 aa, Cryptosporidium hominis
GEGEVNK

SEQ ID NO: 2142729 - protein, 10 aa, Cryptosporidium hominis
GEGGIKDSEI

SEQ ID NO: 2142730 - protein, 6 aa, Cryptosporidium hominis
GEGGYG

SEQ ID NO: 2142731 - protein, 5 aa, Cryptosporidium hominis
GEGPR

SEQ ID NO: 2142732 - protein, 5 aa, Cryptosporidium hominis
GEGSR

SEQ ID NO: 2142733 - protein, 5 aa, Cryptosporidium hominis
GEGTY

SEQ ID NO: 2142734 - protein, 7 aa, Cryptosporidium hominis
GEHEGVN

SEQ ID NO: 2142735 - protein, 6 aa, Cryptosporidium hominis
GEHNKK

SEQ ID NO: 2142736 - protein, 20 aa, Cryptosporidium hominis
GEIDPNPETKPSKPDSIDMD

SEQ ID NO: 2142737 - protein, 5 aa, Cryptosporidium hominis
GEIDS

SEQ ID NO: 2142738 - protein, 14 aa, Cryptosporidium hominis
GEIDSRSSSQITQI

SEQ ID NO: 2142739 - protein, 59 aa, Cryptosporidium hominis
GEIESHTTEGKERVSKSTTNANEDSPLPPRPIRRQTSEKMQEKGENRVEEVEGGEQTPI

SEQ ID NO: 2142740 - protein, 13 aa, Cryptosporidium hominis
GEIGSYQEQKKIE

SEQ ID NO: 2142741 - protein, 8 aa, Cryptosporidium hominis
GEIKNGYS

SEQ ID NO: 2142742 - protein, 6 aa, Cryptosporidium hominis
GEIKPS

SEQ ID NO: 2142743 - protein, 5 aa, Cryptosporidium hominis
GEIPT

SEQ ID NO: 2142744 - protein, 6 aa, Cryptosporidium hominis
GEIPYE

SEQ ID NO: 2142745 - protein, 18 aa, Cryptosporidium hominis
GEIRNKNAKDEKNTEKRL

SEQ ID NO: 2142746 - protein, 13 aa, Cryptosporidium hominis
GEKDDSDNSQRFE

SEQ ID NO: 2142747 - protein, 15 aa, Cryptosporidium hominis
GEKDNQIDMNSNNGI

SEQ ID NO: 2142748 - protein, 11 aa, Cryptosporidium hominis
GEKDPKPYIGG

SEQ ID NO: 2142749 - protein, 6 aa, Cryptosporidium hominis
GEKFNR

SEQ ID NO: 2142750 - protein, 8 aa, Cryptosporidium hominis
GEKGESKK

SEQ ID NO: 2142751 - protein, 9 aa, Cryptosporidium hominis
GEKGISQNG

SEQ ID NO: 2142752 - protein, 6 aa, Cryptosporidium hominis
GEKHTR

SEQ ID NO: 2142753 - protein, 5 aa, Cryptosporidium hominis
GEKIS

SEQ ID NO: 2142754 - protein, 28 aa, Cryptosporidium hominis
GEKKKKKKSKEHKTGVSEVESSYVDGSG

SEQ ID NO: 2142755 - protein, 4 aa, Cryptosporidium hominis
GEKL

SEQ ID NO: 2142756 - protein, 44 aa, Cryptosporidium hominis
GEKNTSFGRNANSNPSSVSSKRKARNGSQAGRNSCPVRGPRENL

SEQ ID NO: 2142757 - protein, 11 aa, Cryptosporidium hominis
GEKRKSEKARL

SEQ ID NO: 2142758 - protein, 5 aa, Cryptosporidium hominis
GEKSI

SEQ ID NO: 2142759 - protein, 18 aa, Cryptosporidium hominis
GEKSRSNGELSKSSKGIS

SEQ ID NO: 2142760 - protein, 5 aa, Cryptosporidium hominis
GEKTH

SEQ ID NO: 2142761 - protein, 5 aa, Cryptosporidium hominis
GELDQ

SEQ ID NO: 2142762 - protein, 23 aa, Cryptosporidium hominis
GELESRREEAKQMEEESQKELTR

SEQ ID NO: 2142763 - protein, 6 aa, Cryptosporidium hominis
GELGDT

SEQ ID NO: 2142764 - protein, 4 aa, Cryptosporidium hominis
GELP

SEQ ID NO: 2142765 - protein, 6 aa, Cryptosporidium hominis
GELPDT

SEQ ID NO: 2142766 - protein, 7 aa, Cryptosporidium hominis
GELQKKR

SEQ ID NO: 2142767 - protein, 8 aa, Cryptosporidium hominis
GELQQNKA

SEQ ID NO: 2142768 - protein, 7 aa, Cryptosporidium hominis
GELSGGE

SEQ ID NO: 2142769 - protein, 8 aa, Cryptosporidium hominis
GENDQQFE

SEQ ID NO: 2142770 - protein, 13 aa, Cryptosporidium hominis
GENENDDKRGGKE

SEQ ID NO: 2142771 - protein, 14 aa, Cryptosporidium hominis
GENEQKENEKLLDS

SEQ ID NO: 2142772 - protein, 7 aa, Cryptosporidium hominis
GENFKNK

SEQ ID NO: 2142773 - protein, 8 aa, Cryptosporidium hominis
GENGRKPI

SEQ ID NO: 2142774 - protein, 7 aa, Cryptosporidium hominis
GENGSKL

SEQ ID NO: 2142775 - protein, 4 aa, Cryptosporidium hominis
GENH

SEQ ID NO: 2142776 - protein, 13 aa, Cryptosporidium hominis
GENHSSSCPSAEN

SEQ ID NO: 2142777 - protein, 13 aa, Cryptosporidium hominis
GENIQGEKDSIEI

SEQ ID NO: 2142778 - protein, 12 aa, Cryptosporidium hominis
GENKSITGSQTV

SEQ ID NO: 2142779 - protein, 4 aa, Cryptosporidium hominis
GENL

SEQ ID NO: 2142780 - protein, 5 aa, Cryptosporidium hominis
GENNL

SEQ ID NO: 2142781 - protein, 6 aa, Cryptosporidium hominis
GENNLN

SEQ ID NO: 2142782 - protein, 15 aa, Cryptosporidium hominis
GENNNNIENYGNGGY

SEQ ID NO: 2142783 - protein, 4 aa, Cryptosporidium hominis
GENQ

SEQ ID NO: 2142784 - protein, 4 aa, Cryptosporidium hominis
GENR

SEQ ID NO: 2142785 - protein, 6 aa, Cryptosporidium hominis
GENRLP

SEQ ID NO: 2142786 - protein, 6 aa, Cryptosporidium hominis
GENSAI

SEQ ID NO: 2142787 - protein, 6 aa, Cryptosporidium hominis
GENSEL

SEQ ID NO: 2142788 - protein, 7 aa, Cryptosporidium hominis
GEPGKEK

SEQ ID NO: 2142789 - protein, 6 aa, Cryptosporidium hominis
GEPINP

SEQ ID NO: 2142790 - protein, 8 aa, Cryptosporidium hominis
GEPKKIHK

SEQ ID NO: 2142791 - protein, 12 aa, Cryptosporidium hominis
GEPPFPSNQGHN

SEQ ID NO: 2142792 - protein, 7 aa, Cryptosporidium hominis
GEPQSAE

SEQ ID NO: 2142793 - protein, 5 aa, Cryptosporidium hominis
GEPRI

SEQ ID NO: 2142794 - protein, 7 aa, Cryptosporidium hominis
GEPSPGC

SEQ ID NO: 2142795 - protein, 25 aa, Cryptosporidium hominis
GEQDIPGLTDGEKPRRLGPKRASKI

SEQ ID NO: 2142796 - protein, 20 aa, Cryptosporidium hominis
GEQEFTKTSYSCSQTNNQSK

SEQ ID NO: 2142797 - protein, 9 aa, Cryptosporidium hominis
GERAKGGKR

SEQ ID NO: 2142798 - protein, 13 aa, Cryptosporidium hominis
GERDEFSANDADE

SEQ ID NO: 2142799 - protein, 5 aa, Cryptosporidium hominis
GERIS

SEQ ID NO: 2142800 - protein, 8 aa, Cryptosporidium hominis
GERLTDQE

SEQ ID NO: 2142801 - protein, 9 aa, Cryptosporidium hominis
GERPMTKDN

SEQ ID NO: 2142802 - protein, 14 aa, Cryptosporidium hominis
GERQSNASNSKYQY

SEQ ID NO: 2142803 - protein, 9 aa, Cryptosporidium hominis
GERQTAKVD

SEQ ID NO: 2142804 - protein, 4 aa, Cryptosporidium hominis
GERS

SEQ ID NO: 2142805 - protein, 4 aa, Cryptosporidium hominis
GERV

SEQ ID NO: 2142806 - protein, 14 aa, Cryptosporidium hominis
GERVNWGNSSTDEY

SEQ ID NO: 2142807 - protein, 18 aa, Cryptosporidium hominis
GESASKTLKSISKSNPEF

SEQ ID NO: 2142808 - protein, 5 aa, Cryptosporidium hominis
GESCS

SEQ ID NO: 2142809 - protein, 9 aa, Cryptosporidium hominis
GESDQNALN

SEQ ID NO: 2142810 - protein, 6 aa, Cryptosporidium hominis
GESEKA

SEQ ID NO: 2142811 - protein, 9 aa, Cryptosporidium hominis
GESEKNRKL

SEQ ID NO: 2142812 - protein, 7 aa, Cryptosporidium hominis
GESEKSI

SEQ ID NO: 2142813 - protein, 19 aa, Cryptosporidium hominis
GESENYGTQLERASDNSMG

SEQ ID NO: 2142814 - protein, 6 aa, Cryptosporidium hominis
GESETK

SEQ ID NO: 2142815 - protein, 4 aa, Cryptosporidium hominis
GESF

SEQ ID NO: 2142816 - protein, 5 aa, Cryptosporidium hominis
GESFT

SEQ ID NO: 2142817 - protein, 11 aa, Cryptosporidium hominis
GESGAGKTETA

SEQ ID NO: 2142818 - protein, 11 aa, Cryptosporidium hominis
GESGAGKTETT

SEQ ID NO: 2142819 - protein, 8 aa, Cryptosporidium hominis
GESISDDE

SEQ ID NO: 2142820 - protein, 15 aa, Cryptosporidium hominis
GESKLNKNKDSDIEW

SEQ ID NO: 2142821 - protein, 8 aa, Cryptosporidium hominis
GESKLTNN

SEQ ID NO: 2142822 - protein, 19 aa, Cryptosporidium hominis
GESKNSKHLESKSKSGSNC

SEQ ID NO: 2142823 - protein, 9 aa, Cryptosporidium hominis
GESLTKNEK

SEQ ID NO: 2142824 - protein, 4 aa, Cryptosporidium hominis
GESN

SEQ ID NO: 2142825 - protein, 30 aa, Cryptosporidium hominis
GESNLENEEDSVGQSSENNRNIDDSNTNKL

SEQ ID NO: 2142826 - protein, 4 aa, Cryptosporidium hominis
GESP

SEQ ID NO: 2142827 - protein, 6 aa, Cryptosporidium hominis
GESPHD

SEQ ID NO: 2142828 - protein, 7 aa, Cryptosporidium hominis
GESPYSK

SEQ ID NO: 2142829 - protein, 5 aa, Cryptosporidium hominis
GESSC

SEQ ID NO: 2142830 - protein, 32 aa, Cryptosporidium hominis
GESVSVDETNGGGNSSNSNGSENASSNEENDL

SEQ ID NO: 2142831 - protein, 4 aa, Cryptosporidium hominis
GETC

SEQ ID NO: 2142832 - protein, 7 aa, Cryptosporidium hominis
GETDPME

SEQ ID NO: 2142833 - protein, 7 aa, Cryptosporidium hominis
GETDTET

SEQ ID NO: 2142834 - protein, 4 aa, Cryptosporidium hominis
GETL

SEQ ID NO: 2142835 - protein, 7 aa, Cryptosporidium hominis
GETPKKK

SEQ ID NO: 2142836 - protein, 26 aa, Cryptosporidium hominis
GETPRENSSPASPIEPNTYSPPSSDK

SEQ ID NO: 2142837 - protein, 24 aa, Cryptosporidium hominis
GETQTLGNNNASKQGASITTSSGE

SEQ ID NO: 2142838 - protein, 4 aa, Cryptosporidium hominis
GETT

SEQ ID NO: 2142839 - protein, 5 aa, Cryptosporidium hominis
GETTD

SEQ ID NO: 2142840 - protein, 6 aa, Cryptosporidium hominis
GEVGAT

SEQ ID NO: 2142841 - protein, 28 aa, Cryptosporidium hominis
GEVREKNNVSIENSSSDYTAQNANGSLA

SEQ ID NO: 2142842 - protein, 8 aa, Cryptosporidium hominis
GEVSTSPE

SEQ ID NO: 2142843 - protein, 15 aa, Cryptosporidium hominis
GEVTLDSNGNSDPIL

SEQ ID NO: 2142844 - protein, 13 aa, Cryptosporidium hominis
GEWGKPPLDDHGK

SEQ ID NO: 2142845 - protein, 13 aa, Cryptosporidium hominis
GEYHPPHLGGGGG

SEQ ID NO: 2142846 - protein, 6 aa, Cryptosporidium hominis
GEYISP

SEQ ID NO: 2142847 - protein, 7 aa, Cryptosporidium hominis
GEYISPE

SEQ ID NO: 2142848 - protein, 12 aa, Cryptosporidium hominis
GEYSKIESSSIK

SEQ ID NO: 2142849 - protein, 12 aa, Cryptosporidium hominis
GFASNQNNTVYS

SEQ ID NO: 2142850 - protein, 20 aa, Cryptosporidium hominis
GFDENGGQNSFVDPETTDQG

SEQ ID NO: 2142851 - protein, 5 aa, Cryptosporidium hominis
GFDES

SEQ ID NO: 2142852 - protein, 11 aa, Cryptosporidium hominis
GFDNEGSWSER

SEQ ID NO: 2142853 - protein, 6 aa, Cryptosporidium hominis
GFDQES

SEQ ID NO: 2142854 - protein, 6 aa, Cryptosporidium hominis
GFEHPS

SEQ ID NO: 2142855 - protein, 26 aa, Cryptosporidium hominis
GFEQNNHDSHEETFNKNNSGKLPNTD

SEQ ID NO: 2142856 - protein, 9 aa, Cryptosporidium hominis
GFERGDTMN

SEQ ID NO: 2142857 - protein, 11 aa, Cryptosporidium hominis
GFESKPDKDGI

SEQ ID NO: 2142858 - protein, 6 aa, Cryptosporidium hominis
GFESTQ

SEQ ID NO: 2142859 - protein, 8 aa, Cryptosporidium hominis
GFGGEPEY

SEQ ID NO: 2142860 - protein, 16 aa, Cryptosporidium hominis
GFGGGNNDPLKSSDDL

SEQ ID NO: 2142861 - protein, 5 aa, Cryptosporidium hominis
GFGGT

SEQ ID NO: 2142862 - protein, 11 aa, Cryptosporidium hominis
GFGKQRAKKGV

SEQ ID NO: 2142863 - protein, 4 aa, Cryptosporidium hominis
GFGP

SEQ ID NO: 2142864 - protein, 10 aa, Cryptosporidium hominis
GFGQKYGSAI

SEQ ID NO: 2142865 - protein, 13 aa, Cryptosporidium hominis
GFKEGKESKIATE

SEQ ID NO: 2142866 - protein, 16 aa, Cryptosporidium hominis
GFKKLDDNEEIKKGGK

SEQ ID NO: 2142867 - protein, 22 aa, Cryptosporidium hominis
GFNESSRSSRGFSRSRGSRLSP

SEQ ID NO: 2142868 - protein, 13 aa, Cryptosporidium hominis
GFNNNNNSTSTRI

SEQ ID NO: 2142869 - protein, 5 aa, Cryptosporidium hominis
GFNPK

SEQ ID NO: 2142870 - protein, 9 aa, Cryptosporidium hominis
GFNRPSKIQ

SEQ ID NO: 2142871 - protein, 17 aa, Cryptosporidium hominis
GFPENGYPITEKNNEVP

SEQ ID NO: 2142872 - protein, 11 aa, Cryptosporidium hominis
GFPGKSKRGEL

SEQ ID NO: 2142873 - protein, 7 aa, Cryptosporidium hominis
GFPNQNA

SEQ ID NO: 2142874 - protein, 6 aa, Cryptosporidium hominis
GFPPDT

SEQ ID NO: 2142875 - protein, 7 aa, Cryptosporidium hominis
GFPTQQP

SEQ ID NO: 2142876 - protein, 28 aa, Cryptosporidium hominis
GFQSSSSSTCATSPYYKSNSTSAGEGFN

SEQ ID NO: 2142877 - protein, 13 aa, Cryptosporidium hominis
GFSDGDKNKITVD

SEQ ID NO: 2142878 - protein, 11 aa, Cryptosporidium hominis
GFSETNNNTIN

SEQ ID NO: 2142879 - protein, 10 aa, Cryptosporidium hominis
GFSGEGSEAL

SEQ ID NO: 2142880 - protein, 15 aa, Cryptosporidium hominis
GFSGGGGGNGGNGVM

SEQ ID NO: 2142881 - protein, 6 aa, Cryptosporidium hominis
GFSPKY

SEQ ID NO: 2142882 - protein, 6 aa, Cryptosporidium hominis
GFSSDD

SEQ ID NO: 2142883 - protein, 4 aa, Cryptosporidium hominis
GFTF

SEQ ID NO: 2142884 - protein, 6 aa, Cryptosporidium hominis
GFTSEE

SEQ ID NO: 2142885 - protein, 5 aa, Cryptosporidium hominis
GGAAD

SEQ ID NO: 2142886 - protein, 20 aa, Cryptosporidium hominis
GGAAGVGVGGATGATGVGYP

SEQ ID NO: 2142887 - protein, 21 aa, Cryptosporidium hominis
GGAANLGFSSNDSDFDSRTRF

SEQ ID NO: 2142888 - protein, 36 aa, Cryptosporidium hominis
GGAASYSPSLKRYKSQEKSETDENPPSNNDSSSAVF

SEQ ID NO: 2142889 - protein, 8 aa, Cryptosporidium hominis
GGAIPSGT

SEQ ID NO: 2142890 - protein, 22 aa, Cryptosporidium hominis
GGAKKKKKNFTKPKKIKHKKKK

SEQ ID NO: 2142891 - protein, 9 aa, Cryptosporidium hominis
GGALSESTQ

SEQ ID NO: 2142892 - protein, 7 aa, Cryptosporidium hominis
GGAPLGR

SEQ ID NO: 2142893 - protein, 9 aa, Cryptosporidium hominis
GGCDGKPWQ

SEQ ID NO: 2142894 - protein, 5 aa, Cryptosporidium hominis
GGDAN

SEQ ID NO: 2142895 - protein, 4 aa, Cryptosporidium hominis
GGDC

SEQ ID NO: 2142896 - protein, 35 aa, Cryptosporidium hominis
GGDDEKNDLNSASESENESDYSDSEDEEEDETMGR

SEQ ID NO: 2142897 - protein, 9 aa, Cryptosporidium hominis
GGDKNKTIS

SEQ ID NO: 2142898 - protein, 5 aa, Cryptosporidium hominis
GGDKS

SEQ ID NO: 2142899 - protein, 18 aa, Cryptosporidium hominis
GGDKSLEDRSQSQDSEMK

SEQ ID NO: 2142900 - protein, 5 aa, Cryptosporidium hominis
GGDNC

SEQ ID NO: 2142901 - protein, 14 aa, Cryptosporidium hominis
GGDPTGTGKGGESI

SEQ ID NO: 2142902 - protein, 9 aa, Cryptosporidium hominis
GGDPTLNNS

SEQ ID NO: 2142903 - protein, 10 aa, Cryptosporidium hominis
GGDRDGNPYV

SEQ ID NO: 2142904 - protein, 4 aa, Cryptosporidium hominis
GGDY

SEQ ID NO: 2142905 - protein, 15 aa, Cryptosporidium hominis
GGDYSDDDDDDDDID

SEQ ID NO: 2142906 - protein, 6 aa, Cryptosporidium hominis
GGEGGD

SEQ ID NO: 2142907 - protein, 10 aa, Cryptosporidium hominis
GGEHGTESPY

SEQ ID NO: 2142908 - protein, 12 aa, Cryptosporidium hominis
GGEHKNSNSTDV

SEQ ID NO: 2142909 - protein, 12 aa, Cryptosporidium hominis
GGEKDTDEEADT

SEQ ID NO: 2142910 - protein, 14 aa, Cryptosporidium hominis
GGEKLNNENQEELE

SEQ ID NO: 2142911 - protein, 6 aa, Cryptosporidium hominis
GGEKPI

SEQ ID NO: 2142912 - protein, 4 aa, Cryptosporidium hominis
GGEL

SEQ ID NO: 2142913 - protein, 16 aa, Cryptosporidium hominis
GGELPENKPSGDKGGS

SEQ ID NO: 2142914 - protein, 7 aa, Cryptosporidium hominis
GGEMESS

SEQ ID NO: 2142915 - protein, 10 aa, Cryptosporidium hominis
GGENGKSPNR

SEQ ID NO: 2142916 - protein, 8 aa, Cryptosporidium hominis
GGENTNNE

SEQ ID NO: 2142917 - protein, 5 aa, Cryptosporidium hominis
GGESM

SEQ ID NO: 2142918 - protein, 7 aa, Cryptosporidium hominis
GGESVGK

SEQ ID NO: 2142919 - protein, 4 aa, Cryptosporidium hominis
GGET

SEQ ID NO: 2142920 - protein, 5 aa, Cryptosporidium hominis
GGETL

SEQ ID NO: 2142921 - protein, 18 aa, Cryptosporidium hominis
GGEYSENKDSEVGGASET

SEQ ID NO: 2142922 - protein, 6 aa, Cryptosporidium hominis
GGFESS

SEQ ID NO: 2142923 - protein, 10 aa, Cryptosporidium hominis
GGFSDRPGNV

SEQ ID NO: 2142924 - protein, 6 aa, Cryptosporidium hominis
GGFSQG

SEQ ID NO: 2142925 - protein, 10 aa, Cryptosporidium hominis
GGGADPPYSP

SEQ ID NO: 2142926 - protein, 19 aa, Cryptosporidium hominis
GGGAGGSGNTAVNNNTSGN

SEQ ID NO: 2142927 - protein, 7 aa, Cryptosporidium hominis
GGGDTAS

SEQ ID NO: 2142928 - protein, 5 aa, Cryptosporidium hominis
GGGEF

SEQ ID NO: 2142929 - protein, 13 aa, Cryptosporidium hominis
GGGESSRADARNS

SEQ ID NO: 2142930 - protein, 21 aa, Cryptosporidium hominis
GGGFQQEDNISSTVKDSGDVS

SEQ ID NO: 2142931 - protein, 7 aa, Cryptosporidium hominis
GGGGATN

SEQ ID NO: 2142932 - protein, 14 aa, Cryptosporidium hominis
GGGGNGNTHDHIII

SEQ ID NO: 2142933 - protein, 55 aa, Cryptosporidium hominis
GGGIEGNSTTVLDGGSTCRNTTDDHSSSMTISGTNINSNSGSSSSLTTALNGGGV

SEQ ID NO: 2142934 - protein, 18 aa, Cryptosporidium hominis
GGGIGNTSGFGVASNGAG

SEQ ID NO: 2142935 - protein, 20 aa, Cryptosporidium hominis
GGGINSANAGVGGGNNNAGF

SEQ ID NO: 2142936 - protein, 7 aa, Cryptosporidium hominis
GGGIPNQ

SEQ ID NO: 2142937 - protein, 64 aa, Cryptosporidium hominis
GGGISRGGGNRDGSDSKRGGRGYQGSGGESVGNNHSNASRGAGSGSNSGGVSESRVSSGSKGKV

SEQ ID NO: 2142938 - protein, 19 aa, Cryptosporidium hominis
GGGKKTTRKTMSNSAKAGL

SEQ ID NO: 2142939 - protein, 17 aa, Cryptosporidium hominis
GGGKKVSNSSNSSNSGF

SEQ ID NO: 2142940 - protein, 4 aa, Cryptosporidium hominis
GGGL

SEQ ID NO: 2142941 - protein, 14 aa, Cryptosporidium hominis
GGGLGVDGSGISEP

SEQ ID NO: 2142942 - protein, 24 aa, Cryptosporidium hominis
GGGLSSSSINNHGNKNDKNKSNMR

SEQ ID NO: 2142943 - protein, 10 aa, Cryptosporidium hominis
GGGNGGSAHN

SEQ ID NO: 2142944 - protein, 5 aa, Cryptosporidium hominis
GGGPC

SEQ ID NO: 2142945 - protein, 19 aa, Cryptosporidium hominis
GGGQHEESSPSINKSDNIA

SEQ ID NO: 2142946 - protein, 7 aa, Cryptosporidium hominis
GGGSHPS

SEQ ID NO: 2142947 - protein, 6 aa, Cryptosporidium hominis
GGGSNA

SEQ ID NO: 2142948 - protein, 15 aa, Cryptosporidium hominis
GGGSSFSVGGPGKGI

SEQ ID NO: 2142949 - protein, 8 aa, Cryptosporidium hominis
GGGSSMGI

SEQ ID NO: 2142950 - protein, 8 aa, Cryptosporidium hominis
GGGTGAGL

SEQ ID NO: 2142951 - protein, 9 aa, Cryptosporidium hominis
GGGTNAAAA

SEQ ID NO: 2142952 - protein, 19 aa, Cryptosporidium hominis
GGGTVSQGFSHGANPNGLS

SEQ ID NO: 2142953 - protein, 32 aa, Cryptosporidium hominis
GGGYAEEDRRRGEEEDDDSDNSSGEDGDDDYW

SEQ ID NO: 2142954 - protein, 6 aa, Cryptosporidium hominis
GGGYTS

SEQ ID NO: 2142955 - protein, 4 aa, Cryptosporidium hominis
GGHG

SEQ ID NO: 2142956 - protein, 5 aa, Cryptosporidium hominis
GGHPF

SEQ ID NO: 2142957 - protein, 5 aa, Cryptosporidium hominis
GGHPK

SEQ ID NO: 2142958 - protein, 11 aa, Cryptosporidium hominis
GGHTSSAVTGV

SEQ ID NO: 2142959 - protein, 21 aa, Cryptosporidium hominis
GGIASGTKNVGTASSNNNNGF

SEQ ID NO: 2142960 - protein, 4 aa, Cryptosporidium hominis
GGID

SEQ ID NO: 2142961 - protein, 11 aa, Cryptosporidium hominis
GGIEAASEDSK

SEQ ID NO: 2142962 - protein, 11 aa, Cryptosporidium hominis
GGIEDNNSDCS

SEQ ID NO: 2142963 - protein, 34 aa, Cryptosporidium hominis
GGIGGTGGIGGTGGTGGTGGTGGTGGIAGTGLGG

SEQ ID NO: 2142964 - protein, 4 aa, Cryptosporidium hominis
GGIL

SEQ ID NO: 2142965 - protein, 30 aa, Cryptosporidium hominis
GGIMASSSASTVPPSSSSSSSSSSAPSMPL

SEQ ID NO: 2142966 - protein, 6 aa, Cryptosporidium hominis
GGIPGI

SEQ ID NO: 2142967 - protein, 4 aa, Cryptosporidium hominis
GGIQ

SEQ ID NO: 2142968 - protein, 13 aa, Cryptosporidium hominis
GGIRNPDKVLDEN

SEQ ID NO: 2142969 - protein, 4 aa, Cryptosporidium hominis
GGIS

SEQ ID NO: 2142970 - protein, 10 aa, Cryptosporidium hominis
GGISDGKDLS

SEQ ID NO: 2142971 - protein, 6 aa, Cryptosporidium hominis
GGISKE

SEQ ID NO: 2142972 - protein, 27 aa, Cryptosporidium hominis
GGIVGGSNYTAGITTSPNLTSVNNSTI

SEQ ID NO: 2142973 - protein, 6 aa, Cryptosporidium hominis
GGKDSS

SEQ ID NO: 2142974 - protein, 10 aa, Cryptosporidium hominis
GGKHAGNALA

SEQ ID NO: 2142975 - protein, 7 aa, Cryptosporidium hominis
GGKIPQS

SEQ ID NO: 2142976 - protein, 12 aa, Cryptosporidium hominis
GGKNISQNEKKK

SEQ ID NO: 2142977 - protein, 9 aa, Cryptosporidium hominis
GGKNSTIIT

SEQ ID NO: 2142978 - protein, 14 aa, Cryptosporidium hominis
GGKPDDITVSIGVV

SEQ ID NO: 2142979 - protein, 16 aa, Cryptosporidium hominis
GGKPTNNQNRPQAPVQ

SEQ ID NO: 2142980 - protein, 9 aa, Cryptosporidium hominis
GGKSREVSS

SEQ ID NO: 2142981 - protein, 15 aa, Cryptosporidium hominis
GGKTRQRKDGNTHSS

SEQ ID NO: 2142982 - protein, 14 aa, Cryptosporidium hominis
GGKVNSNSISNDIN

SEQ ID NO: 2142983 - protein, 8 aa, Cryptosporidium hominis
GGLAPSTI

SEQ ID NO: 2142984 - protein, 28 aa, Cryptosporidium hominis
GGLASNGALPGNGQAGLIGNSSSNSIAL

SEQ ID NO: 2142985 - protein, 24 aa, Cryptosporidium hominis
GGLASTGSSTGTGCPLSSQRPCEA

SEQ ID NO: 2142986 - protein, 14 aa, Cryptosporidium hominis
GGLDSQEANEMRNA

SEQ ID NO: 2142987 - protein, 10 aa, Cryptosporidium hominis
GGLEPPQVSQ

SEQ ID NO: 2142988 - protein, 19 aa, Cryptosporidium hominis
GGLGGGSGSNLGGNGIGNS

SEQ ID NO: 2142989 - protein, 4 aa, Cryptosporidium hominis
GGLQ

SEQ ID NO: 2142990 - protein, 9 aa, Cryptosporidium hominis
GGMSPEEHE

SEQ ID NO: 2142991 - protein, 24 aa, Cryptosporidium hominis
GGMSSSSSSSFSSNKISAKSTKIP

SEQ ID NO: 2142992 - protein, 4 aa, Cryptosporidium hominis
GGNC

SEQ ID NO: 2142993 - protein, 11 aa, Cryptosporidium hominis
GGNDFGSRISN

SEQ ID NO: 2142994 - protein, 11 aa, Cryptosporidium hominis
GGNELEGTELQ

SEQ ID NO: 2142995 - protein, 10 aa, Cryptosporidium hominis
GGNGKINPNF

SEQ ID NO: 2142996 - protein, 8 aa, Cryptosporidium hominis
GGNGRARN

SEQ ID NO: 2142997 - protein, 9 aa, Cryptosporidium hominis
GGNGSGKTT

SEQ ID NO: 2142998 - protein, 5 aa, Cryptosporidium hominis
GGNKK

SEQ ID NO: 2142999 - protein, 8 aa, Cryptosporidium hominis
GGNKSTII

SEQ ID NO: 2143000 - protein, 11 aa, Cryptosporidium hominis
GGNLNKRVNGS

SEQ ID NO: 2143001 - protein, 20 aa, Cryptosporidium hominis
GGNNAGNIDNTGLSSMRSGA

SEQ ID NO: 2143002 - protein, 6 aa, Cryptosporidium hominis
GGNNQQ

SEQ ID NO: 2143003 - protein, 4 aa, Cryptosporidium hominis
GGNQ

SEQ ID NO: 2143004 - protein, 4 aa, Cryptosporidium hominis
GGNR

SEQ ID NO: 2143005 - protein, 8 aa, Cryptosporidium hominis
GGNSGSQI

SEQ ID NO: 2143006 - protein, 9 aa, Cryptosporidium hominis
GGNSNNINN

SEQ ID NO: 2143007 - protein, 8 aa, Cryptosporidium hominis
GGNSNSNE

SEQ ID NO: 2143008 - protein, 8 aa, Cryptosporidium hominis
GGNSPTSK

SEQ ID NO: 2143009 - protein, 12 aa, Cryptosporidium hominis
GGNTKTKYEKNT

SEQ ID NO: 2143010 - protein, 5 aa, Cryptosporidium hominis
GGNTR

SEQ ID NO: 2143011 - protein, 10 aa, Cryptosporidium hominis
GGNTSKTEYA

SEQ ID NO: 2143012 - protein, 4 aa, Cryptosporidium hominis
GGNV

SEQ ID NO: 2143013 - protein, 6 aa, Cryptosporidium hominis
GGNWPK

SEQ ID NO: 2143014 - protein, 8 aa, Cryptosporidium hominis
GGPAPGGH

SEQ ID NO: 2143015 - protein, 9 aa, Cryptosporidium hominis
GGPGGTQAL

SEQ ID NO: 2143016 - protein, 6 aa, Cryptosporidium hominis
GGPHLG

SEQ ID NO: 2143017 - protein, 9 aa, Cryptosporidium hominis
GGPNKEEDL

SEQ ID NO: 2143018 - protein, 7 aa, Cryptosporidium hominis
GGPNKTG

SEQ ID NO: 2143019 - protein, 7 aa, Cryptosporidium hominis
GGPNVKN

SEQ ID NO: 2143020 - protein, 9 aa, Cryptosporidium hominis
GGPSEEFKS

SEQ ID NO: 2143021 - protein, 24 aa, Cryptosporidium hominis
GGPSSPAGIPVAGGATQVTYTQTN

SEQ ID NO: 2143022 - protein, 7 aa, Cryptosporidium hominis
GGPTGVE

SEQ ID NO: 2143023 - protein, 6 aa, Cryptosporidium hominis
GGPTVP

SEQ ID NO: 2143024 - protein, 9 aa, Cryptosporidium hominis
GGQASGGHN

SEQ ID NO: 2143025 - protein, 9 aa, Cryptosporidium hominis
GGQGEKGQA

SEQ ID NO: 2143026 - protein, 6 aa, Cryptosporidium hominis
GGQIKV

SEQ ID NO: 2143027 - protein, 6 aa, Cryptosporidium hominis
GGQKSR

SEQ ID NO: 2143028 - protein, 20 aa, Cryptosporidium hominis
GGQPGNDSSLLDKGQQSQTR

SEQ ID NO: 2143029 - protein, 9 aa, Cryptosporidium hominis
GGQSEEEAS

SEQ ID NO: 2143030 - protein, 5 aa, Cryptosporidium hominis
GGQTI

SEQ ID NO: 2143031 - protein, 5 aa, Cryptosporidium hominis
GGQVI

SEQ ID NO: 2143032 - protein, 11 aa, Cryptosporidium hominis
GGQYHTGTTDV

SEQ ID NO: 2143033 - protein, 9 aa, Cryptosporidium hominis
GGRASDSRC

SEQ ID NO: 2143034 - protein, 15 aa, Cryptosporidium hominis
GGREQENNQKNVELN

SEQ ID NO: 2143035 - protein, 7 aa, Cryptosporidium hominis
GGREREI

SEQ ID NO: 2143036 - protein, 19 aa, Cryptosporidium hominis
GGREVEESVSSSSSSKENL

SEQ ID NO: 2143037 - protein, 8 aa, Cryptosporidium hominis
GGRGDDVS

SEQ ID NO: 2143038 - protein, 10 aa, Cryptosporidium hominis
GGRGRNSRGT

SEQ ID NO: 2143039 - protein, 5 aa, Cryptosporidium hominis
GGRID

SEQ ID NO: 2143040 - protein, 6 aa, Cryptosporidium hominis
GGRLDE

SEQ ID NO: 2143041 - protein, 24 aa, Cryptosporidium hominis
GGRNASTKQNIPQNAAKLDEDTGD

SEQ ID NO: 2143042 - protein, 10 aa, Cryptosporidium hominis
GGRPQYDNNG

SEQ ID NO: 2143043 - protein, 10 aa, Cryptosporidium hominis
GGSASGKTSV

SEQ ID NO: 2143044 - protein, 17 aa, Cryptosporidium hominis
GGSCIGNNTSMGNANGS

SEQ ID NO: 2143045 - protein, 4 aa, Cryptosporidium hominis
GGSD

SEQ ID NO: 2143046 - protein, 6 aa, Cryptosporidium hominis
GGSGIS

SEQ ID NO: 2143047 - protein, 7 aa, Cryptosporidium hominis
GGSGNFN

SEQ ID NO: 2143048 - protein, 27 aa, Cryptosporidium hominis
GGSGSISSSSSSSTGNVKPSKSDNPTL

SEQ ID NO: 2143049 - protein, 11 aa, Cryptosporidium hominis
GGSIGRGGGPQ

SEQ ID NO: 2143050 - protein, 5 aa, Cryptosporidium hominis
GGSLQ

SEQ ID NO: 2143051 - protein, 10 aa, Cryptosporidium hominis
GGSNGKNKYI

SEQ ID NO: 2143052 - protein, 6 aa, Cryptosporidium hominis
GGSNPN

SEQ ID NO: 2143053 - protein, 14 aa, Cryptosporidium hominis
GGSNSSPLHSNQST

SEQ ID NO: 2143054 - protein, 8 aa, Cryptosporidium hominis
GGSPEYPQ

SEQ ID NO: 2143055 - protein, 8 aa, Cryptosporidium hominis
GGSPIGSS

SEQ ID NO: 2143056 - protein, 7 aa, Cryptosporidium hominis
GGSPMDA

SEQ ID NO: 2143057 - protein, 5 aa, Cryptosporidium hominis
GGSQA

SEQ ID NO: 2143058 - protein, 10 aa, Cryptosporidium hominis
GGSQREDDIE

SEQ ID NO: 2143059 - protein, 13 aa, Cryptosporidium hominis
GGSRGGGKSLTRK

SEQ ID NO: 2143060 - protein, 8 aa, Cryptosporidium hominis
GGSRQRRD

SEQ ID NO: 2143061 - protein, 8 aa, Cryptosporidium hominis
GGSSLDRQ

SEQ ID NO: 2143062 - protein, 8 aa, Cryptosporidium hominis
GGSSPAPC

SEQ ID NO: 2143063 - protein, 9 aa, Cryptosporidium hominis
GGSSPLQSP

SEQ ID NO: 2143064 - protein, 32 aa, Cryptosporidium hominis
GGSVPNGPGNKSGSEGGNANSNVNTNRGISGA

SEQ ID NO: 2143065 - protein, 5 aa, Cryptosporidium hominis
GGSYG

SEQ ID NO: 2143066 - protein, 8 aa, Cryptosporidium hominis
GGTDPNVE

SEQ ID NO: 2143067 - protein, 17 aa, Cryptosporidium hominis
GGTFSNGRLNGNNNINH

SEQ ID NO: 2143068 - protein, 5 aa, Cryptosporidium hominis
GGTGD

SEQ ID NO: 2143069 - protein, 7 aa, Cryptosporidium hominis
GGTGGIG

SEQ ID NO: 2143070 - protein, 5 aa, Cryptosporidium hominis
GGTNF

SEQ ID NO: 2143071 - protein, 18 aa, Cryptosporidium hominis
GGTNQDKGNKSLKSAIPT

SEQ ID NO: 2143072 - protein, 4 aa, Cryptosporidium hominis
GGTP

SEQ ID NO: 2143073 - protein, 6 aa, Cryptosporidium hominis
GGTPGR

SEQ ID NO: 2143074 - protein, 8 aa, Cryptosporidium hominis
GGTPLEES

SEQ ID NO: 2143075 - protein, 6 aa, Cryptosporidium hominis
GGTPTG

SEQ ID NO: 2143076 - protein, 4 aa, Cryptosporidium hominis
GGTQ

SEQ ID NO: 2143077 - protein, 15 aa, Cryptosporidium hominis
GGTQGSSGENSHTKS

SEQ ID NO: 2143078 - protein, 17 aa, Cryptosporidium hominis
GGTRATRSFNPKEHGTV

SEQ ID NO: 2143079 - protein, 54 aa, Cryptosporidium hominis
GGTSIENSTAGTSGQGVAHTPGALGNMGTSSSLPNGGDAQTVSRAEDDQSSIGE

SEQ ID NO: 2143080 - protein, 9 aa, Cryptosporidium hominis
GGTSLTTGI

SEQ ID NO: 2143081 - protein, 5 aa, Cryptosporidium hominis
GGTST

SEQ ID NO: 2143082 - protein, 17 aa, Cryptosporidium hominis
GGTTTTSSSSGNSIENL

SEQ ID NO: 2143083 - protein, 7 aa, Cryptosporidium hominis
GGTVEDT

SEQ ID NO: 2143084 - protein, 6 aa, Cryptosporidium hominis
GGTVSD

SEQ ID NO: 2143085 - protein, 5 aa, Cryptosporidium hominis
GGTVT

SEQ ID NO: 2143086 - protein, 12 aa, Cryptosporidium hominis
GGVDDSNSSDLT

SEQ ID NO: 2143087 - protein, 5 aa, Cryptosporidium hominis
GGVDG

SEQ ID NO: 2143088 - protein, 36 aa, Cryptosporidium hominis
GGVDGNNTLGSRFDGQDDSVTADVDTEGSEESHNQY

SEQ ID NO: 2143089 - protein, 18 aa, Cryptosporidium hominis
GGVESVSGTEVASGSGSG

SEQ ID NO: 2143090 - protein, 8 aa, Cryptosporidium hominis
GGVGGGHG

SEQ ID NO: 2143091 - protein, 6 aa, Cryptosporidium hominis
GGVGGN

SEQ ID NO: 2143092 - protein, 18 aa, Cryptosporidium hominis
GGVGGSAASEGLFVKSYV

SEQ ID NO: 2143093 - protein, 6 aa, Cryptosporidium hominis
GGVGSN

SEQ ID NO: 2143094 - protein, 16 aa, Cryptosporidium hominis
GGVKSKTMGPGAQSAL

SEQ ID NO: 2143095 - protein, 5 aa, Cryptosporidium hominis
GGVNT

SEQ ID NO: 2143096 - protein, 11 aa, Cryptosporidium hominis
GGVPGSTNYSN

SEQ ID NO: 2143097 - protein, 15 aa, Cryptosporidium hominis
GGVPPQMTGGPQMTA

SEQ ID NO: 2143098 - protein, 7 aa, Cryptosporidium hominis
GGVPSQQ

SEQ ID NO: 2143099 - protein, 8 aa, Cryptosporidium hominis
GGVPVTSE

SEQ ID NO: 2143100 - protein, 18 aa, Cryptosporidium hominis
GGVRTTGNSKLASSPSIG

SEQ ID NO: 2143101 - protein, 6 aa, Cryptosporidium hominis
GGYDSA

SEQ ID NO: 2143102 - protein, 6 aa, Cryptosporidium hominis
GGYNTK

SEQ ID NO: 2143103 - protein, 15 aa, Cryptosporidium hominis
GGYPTEDSTRLKSPG

SEQ ID NO: 2143104 - protein, 18 aa, Cryptosporidium hominis
GGYTGTGNATKYQQQNQF

SEQ ID NO: 2143105 - protein, 10 aa, Cryptosporidium hominis
GHAKGGGALS

SEQ ID NO: 2143106 - protein, 10 aa, Cryptosporidium hominis
GHEEVDQNDM

SEQ ID NO: 2143107 - protein, 4 aa, Cryptosporidium hominis
GHEG

SEQ ID NO: 2143108 - protein, 5 aa, Cryptosporidium hominis
GHETA

SEQ ID NO: 2143109 - protein, 6 aa, Cryptosporidium hominis
GHGDSI

SEQ ID NO: 2143110 - protein, 7 aa, Cryptosporidium hominis
GHHPPTT

SEQ ID NO: 2143111 - protein, 5 aa, Cryptosporidium hominis
GHIST

SEQ ID NO: 2143112 - protein, 5 aa, Cryptosporidium hominis
GHITK

SEQ ID NO: 2143113 - protein, 7 aa, Cryptosporidium hominis
GHLPGTN

SEQ ID NO: 2143114 - protein, 4 aa, Cryptosporidium hominis
GHNH

SEQ ID NO: 2143115 - protein, 5 aa, Cryptosporidium hominis
GHNSD

SEQ ID NO: 2143116 - protein, 24 aa, Cryptosporidium hominis
GHNSGNIQNNQNLSHSNSGSNHSA

SEQ ID NO: 2143117 - protein, 9 aa, Cryptosporidium hominis
GHPNGANSV

SEQ ID NO: 2143118 - protein, 15 aa, Cryptosporidium hominis
GHPNYSSKTAENVEH

SEQ ID NO: 2143119 - protein, 15 aa, Cryptosporidium hominis
GHPSTVSRSAPPGQK

SEQ ID NO: 2143120 - protein, 7 aa, Cryptosporidium hominis
GHQKDEI

SEQ ID NO: 2143121 - protein, 4 aa, Cryptosporidium hominis
GHQM

SEQ ID NO: 2143122 - protein, 8 aa, Cryptosporidium hominis
GHRTSSLS

SEQ ID NO: 2143123 - protein, 6 aa, Cryptosporidium hominis
GHSDTV

SEQ ID NO: 2143124 - protein, 4 aa, Cryptosporidium hominis
GHSK

SEQ ID NO: 2143125 - protein, 5 aa, Cryptosporidium hominis
GHSNH

SEQ ID NO: 2143126 - protein, 4 aa, Cryptosporidium hominis
GHSS

SEQ ID NO: 2143127 - protein, 7 aa, Cryptosporidium hominis
GHTGQIT

SEQ ID NO: 2143128 - protein, 4 aa, Cryptosporidium hominis
GHTL

SEQ ID NO: 2143129 - protein, 8 aa, Cryptosporidium hominis
GHTSGNIQ

SEQ ID NO: 2143130 - protein, 5 aa, Cryptosporidium hominis
GHTSP

SEQ ID NO: 2143131 - protein, 9 aa, Cryptosporidium hominis
GHTSTAEGI

SEQ ID NO: 2143132 - protein, 9 aa, Cryptosporidium hominis
GHYGKTASH

SEQ ID NO: 2143133 - protein, 7 aa, Cryptosporidium hominis
GIADPEP

SEQ ID NO: 2143134 - protein, 7 aa, Cryptosporidium hominis
GIAPSTL

SEQ ID NO: 2143135 - protein, 10 aa, Cryptosporidium hominis
GIASPNPVDP

SEQ ID NO: 2143136 - protein, 9 aa, Cryptosporidium hominis
GIDKKETSF

SEQ ID NO: 2143137 - protein, 5 aa, Cryptosporidium hominis
GIDNI

SEQ ID NO: 2143138 - protein, 5 aa, Cryptosporidium hominis
GIDNK

SEQ ID NO: 2143139 - protein, 8 aa, Cryptosporidium hominis
GIDPNNNT

SEQ ID NO: 2143140 - protein, 6 aa, Cryptosporidium hominis
GIDPPS

SEQ ID NO: 2143141 - protein, 16 aa, Cryptosporidium hominis
GIDQRKNDIQHFHFKQ

SEQ ID NO: 2143142 - protein, 11 aa, Cryptosporidium hominis
GIDSESSISYN

SEQ ID NO: 2143143 - protein, 11 aa, Cryptosporidium hominis
GIDSNQEPSLE

SEQ ID NO: 2143144 - protein, 5 aa, Cryptosporidium hominis
GIEDN

SEQ ID NO: 2143145 - protein, 13 aa, Cryptosporidium hominis
GIENGIENGIENG

SEQ ID NO: 2143146 - protein, 11 aa, Cryptosporidium hominis
GIEPIGDGKGK

SEQ ID NO: 2143147 - protein, 4 aa, Cryptosporidium hominis
GIES

SEQ ID NO: 2143148 - protein, 14 aa, Cryptosporidium hominis
GIESNSIQKGSLPA

SEQ ID NO: 2143149 - protein, 7 aa, Cryptosporidium hominis
GIESSQE

SEQ ID NO: 2143150 - protein, 15 aa, Cryptosporidium hominis
GIESSSRDDLYSPDL

SEQ ID NO: 2143151 - protein, 6 aa, Cryptosporidium hominis
GIETGS

SEQ ID NO: 2143152 - protein, 11 aa, Cryptosporidium hominis
GIGAQQTQTIN

SEQ ID NO: 2143153 - protein, 4 aa, Cryptosporidium hominis
GIGD

SEQ ID NO: 2143154 - protein, 4 aa, Cryptosporidium hominis
GIGE

SEQ ID NO: 2143155 - protein, 7 aa, Cryptosporidium hominis
GIGGDKT

SEQ ID NO: 2143156 - protein, 10 aa, Cryptosporidium hominis
GIGGNPSTSM

SEQ ID NO: 2143157 - protein, 8 aa, Cryptosporidium hominis
GIGGPKDA

SEQ ID NO: 2143158 - protein, 12 aa, Cryptosporidium hominis
GIGGSSSQSSIQ

SEQ ID NO: 2143159 - protein, 10 aa, Cryptosporidium hominis
GIGNISKDYR

SEQ ID NO: 2143160 - protein, 19 aa, Cryptosporidium hominis
GIGNNRGYSDNQSYQQGSF

SEQ ID NO: 2143161 - protein, 4 aa, Cryptosporidium hominis
GIGP

SEQ ID NO: 2143162 - protein, 8 aa, Cryptosporidium hominis
GIGRSTNY

SEQ ID NO: 2143163 - protein, 8 aa, Cryptosporidium hominis
GIGTADDM

SEQ ID NO: 2143164 - protein, 10 aa, Cryptosporidium hominis
GIGTDASMPT

SEQ ID NO: 2143165 - protein, 5 aa, Cryptosporidium hominis
GIHPD

SEQ ID NO: 2143166 - protein, 12 aa, Cryptosporidium hominis
GIKDKNEDDEER

SEQ ID NO: 2143167 - protein, 6 aa, Cryptosporidium hominis
GIKESN

SEQ ID NO: 2143168 - protein, 12 aa, Cryptosporidium hominis
GIKGEGDSYSNS

SEQ ID NO: 2143169 - protein, 27 aa, Cryptosporidium hominis
GIKGGNKVKDKDRVSEEENMSEDETKN

SEQ ID NO: 2143170 - protein, 7 aa, Cryptosporidium hominis
GIKPSKD

SEQ ID NO: 2143171 - protein, 23 aa, Cryptosporidium hominis
GIKSNNASFESLNNKNSNINSRK

SEQ ID NO: 2143172 - protein, 13 aa, Cryptosporidium hominis
GIKSSDDEYDEKI

SEQ ID NO: 2143173 - protein, 10 aa, Cryptosporidium hominis
GINGEYGKRA

SEQ ID NO: 2143174 - protein, 41 aa, Cryptosporidium hominis
GINNTTQTKTDNTQNIPVTGRKEEAKKEKVTEKNDINECNG

SEQ ID NO: 2143175 - protein, 6 aa, Cryptosporidium hominis
GINSEW

SEQ ID NO: 2143176 - protein, 9 aa, Cryptosporidium hominis
GINTETTGN

SEQ ID NO: 2143177 - protein, 6 aa, Cryptosporidium hominis
GIPEDV

SEQ ID NO: 2143178 - protein, 6 aa, Cryptosporidium hominis
GIPGES

SEQ ID NO: 2143179 - protein, 5 aa, Cryptosporidium hominis
GIPGM

SEQ ID NO: 2143180 - protein, 4 aa, Cryptosporidium hominis
GIPK

SEQ ID NO: 2143181 - protein, 5 aa, Cryptosporidium hominis
GIPKG

SEQ ID NO: 2143182 - protein, 33 aa, Cryptosporidium hominis
GIPKGSTKNAKSIIDGSSALEPPKKIQNTGKNI

SEQ ID NO: 2143183 - protein, 10 aa, Cryptosporidium hominis
GIPPAPRGVP

SEQ ID NO: 2143184 - protein, 6 aa, Cryptosporidium hominis
GIPQGK

SEQ ID NO: 2143185 - protein, 14 aa, Cryptosporidium hominis
GIPQNHTGRPGEKT

SEQ ID NO: 2143186 - protein, 9 aa, Cryptosporidium hominis
GIPSAVPTQ

SEQ ID NO: 2143187 - protein, 12 aa, Cryptosporidium hominis
GIQQQQNTGNEM

SEQ ID NO: 2143188 - protein, 21 aa, Cryptosporidium hominis
GIRNKSGKNNQVSSKLSPIKN

SEQ ID NO: 2143189 - protein, 10 aa, Cryptosporidium hominis
GIRRKTGELV

SEQ ID NO: 2143190 - protein, 4 aa, Cryptosporidium hominis
GISD

SEQ ID NO: 2143191 - protein, 17 aa, Cryptosporidium hominis
GISESSDSSEDFTPKPI

SEQ ID NO: 2143192 - protein, 26 aa, Cryptosporidium hominis
GISGNSNASNDTTDDDPSKKLTVGGY

SEQ ID NO: 2143193 - protein, 10 aa, Cryptosporidium hominis
GISHSSGSDQ

SEQ ID NO: 2143194 - protein, 12 aa, Cryptosporidium hominis
GISNANSSAQVT

SEQ ID NO: 2143195 - protein, 9 aa, Cryptosporidium hominis
GISNGSNKY

SEQ ID NO: 2143196 - protein, 13 aa, Cryptosporidium hominis
GISNPPIAPHRAV

SEQ ID NO: 2143197 - protein, 12 aa, Cryptosporidium hominis
GISNSDDPNSNL

SEQ ID NO: 2143198 - protein, 7 aa, Cryptosporidium hominis
GISPPHG

SEQ ID NO: 2143199 - protein, 21 aa, Cryptosporidium hominis
GISPRPSVGKESGSQSGSSYD

SEQ ID NO: 2143200 - protein, 11 aa, Cryptosporidium hominis
GISQEKKLESG

SEQ ID NO: 2143201 - protein, 16 aa, Cryptosporidium hominis
GISSFEEQKSLDTSEI

SEQ ID NO: 2143202 - protein, 6 aa, Cryptosporidium hominis
GISSPQ

SEQ ID NO: 2143203 - protein, 38 aa, Cryptosporidium hominis
GISSSNSIGVNGKVSSGGGFSSGFTSTSSFSSSGRNNF

SEQ ID NO: 2143204 - protein, 26 aa, Cryptosporidium hominis
GISSTEASEYCKSQGSSQNPSPLGGC

SEQ ID NO: 2143205 - protein, 5 aa, Cryptosporidium hominis
GISTE

SEQ ID NO: 2143206 - protein, 5 aa, Cryptosporidium hominis
GISTN

SEQ ID NO: 2143207 - protein, 5 aa, Cryptosporidium hominis
GISVE

SEQ ID NO: 2143208 - protein, 4 aa, Cryptosporidium hominis
GITK

SEQ ID NO: 2143209 - protein, 5 aa, Cryptosporidium hominis
GITKI

SEQ ID NO: 2143210 - protein, 44 aa, Cryptosporidium hominis
GITQSNSNTGSLAGSQSSIGSQSYQSHSLNSSSTSLPNSNSNSN

SEQ ID NO: 2143211 - protein, 10 aa, Cryptosporidium hominis
GITSESSTCF

SEQ ID NO: 2143212 - protein, 5 aa, Cryptosporidium hominis
GITTN

SEQ ID NO: 2143213 - protein, 7 aa, Cryptosporidium hominis
GITTTLN

SEQ ID NO: 2143214 - protein, 12 aa, Cryptosporidium hominis
GIYSNEDTTSAN

SEQ ID NO: 2143215 - protein, 8 aa, Cryptosporidium hominis
GKAAGVEA

SEQ ID NO: 2143216 - protein, 16 aa, Cryptosporidium hominis
GKAKRIAKNTDFGNRM

SEQ ID NO: 2143217 - protein, 4 aa, Cryptosporidium hominis
GKAS

SEQ ID NO: 2143218 - protein, 5 aa, Cryptosporidium hominis
GKASE

SEQ ID NO: 2143219 - protein, 11 aa, Cryptosporidium hominis
GKASQKNKGRI

SEQ ID NO: 2143220 - protein, 8 aa, Cryptosporidium hominis
GKASSKGD

SEQ ID NO: 2143221 - protein, 29 aa, Cryptosporidium hominis
GKATISALSSSPSIVGSGTTAQSSVGRRM

SEQ ID NO: 2143222 - protein, 9 aa, Cryptosporidium hominis
GKATPHPCM

SEQ ID NO: 2143223 - protein, 8 aa, Cryptosporidium hominis
GKAYTGPE

SEQ ID NO: 2143224 - protein, 7 aa, Cryptosporidium hominis
GKCGQLG

SEQ ID NO: 2143225 - protein, 9 aa, Cryptosporidium hominis
GKCKNSDSC

SEQ ID NO: 2143226 - protein, 8 aa, Cryptosporidium hominis
GKCYSENS

SEQ ID NO: 2143227 - protein, 16 aa, Cryptosporidium hominis
GKDEFDNSKEKFTLDE

SEQ ID NO: 2143228 - protein, 5 aa, Cryptosporidium hominis
GKDFE

SEQ ID NO: 2143229 - protein, 10 aa, Cryptosporidium hominis
GKDKRVPASQ

SEQ ID NO: 2143230 - protein, 8 aa, Cryptosporidium hominis
GKDKSEWK

SEQ ID NO: 2143231 - protein, 4 aa, Cryptosporidium hominis
GKDN

SEQ ID NO: 2143232 - protein, 8 aa, Cryptosporidium hominis
GKDQFEKQ

SEQ ID NO: 2143233 - protein, 4 aa, Cryptosporidium hominis
GKDR

SEQ ID NO: 2143234 - protein, 7 aa, Cryptosporidium hominis
GKDSPQV

SEQ ID NO: 2143235 - protein, 13 aa, Cryptosporidium hominis
GKDSQGKSIGDKK

SEQ ID NO: 2143236 - protein, 21 aa, Cryptosporidium hominis
GKDTKLTNKSVKQSEQQKRAE

SEQ ID NO: 2143237 - protein, 7 aa, Cryptosporidium hominis
GKDTSID

SEQ ID NO: 2143238 - protein, 8 aa, Cryptosporidium hominis
GKDVPNPI

SEQ ID NO: 2143239 - protein, 12 aa, Cryptosporidium hominis
GKDVSKNNDNEQ

SEQ ID NO: 2143240 - protein, 8 aa, Cryptosporidium hominis
GKEAINTN

SEQ ID NO: 2143241 - protein, 5 aa, Cryptosporidium hominis
GKEDA

SEQ ID NO: 2143242 - protein, 8 aa, Cryptosporidium hominis
GKEEERAG

SEQ ID NO: 2143243 - protein, 8 aa, Cryptosporidium hominis
GKEGNTRR

SEQ ID NO: 2143244 - protein, 10 aa, Cryptosporidium hominis
GKEKVAETSH

SEQ ID NO: 2143245 - protein, 13 aa, Cryptosporidium hominis
GKENRDLNQGDVT

SEQ ID NO: 2143246 - protein, 9 aa, Cryptosporidium hominis
GKENSGEIG

SEQ ID NO: 2143247 - protein, 13 aa, Cryptosporidium hominis
GKEPNRGINPDEA

SEQ ID NO: 2143248 - protein, 4 aa, Cryptosporidium hominis
GKET

SEQ ID NO: 2143249 - protein, 5 aa, Cryptosporidium hominis
GKEYV

SEQ ID NO: 2143250 - protein, 11 aa, Cryptosporidium hominis
GKFDPNKHGRR

SEQ ID NO: 2143251 - protein, 4 aa, Cryptosporidium hominis
GKFQ

SEQ ID NO: 2143252 - protein, 7 aa, Cryptosporidium hominis
GKFQQRK

SEQ ID NO: 2143253 - protein, 6 aa, Cryptosporidium hominis
GKFRRG

SEQ ID NO: 2143254 - protein, 5 aa, Cryptosporidium hominis
GKFSP

SEQ ID NO: 2143255 - protein, 6 aa, Cryptosporidium hominis
GKFSYD

SEQ ID NO: 2143256 - protein, 20 aa, Cryptosporidium hominis
GKFTTTSRNSATPKPSESST

SEQ ID NO: 2143257 - protein, 4 aa, Cryptosporidium hominis
GKGA

SEQ ID NO: 2143258 - protein, 9 aa, Cryptosporidium hominis
GKGATGETL

SEQ ID NO: 2143259 - protein, 10 aa, Cryptosporidium hominis
GKGCAQGLSG

SEQ ID NO: 2143260 - protein, 7 aa, Cryptosporidium hominis
GKGCRNP

SEQ ID NO: 2143261 - protein, 6 aa, Cryptosporidium hominis
GKGEHP

SEQ ID NO: 2143262 - protein, 5 aa, Cryptosporidium hominis
GKGEY

SEQ ID NO: 2143263 - protein, 34 aa, Cryptosporidium hominis
GKGFRQEKAKKKRCSWKGNGTISTGVSSIQFSDS

SEQ ID NO: 2143264 - protein, 7 aa, Cryptosporidium hominis
GKGFSGV

SEQ ID NO: 2143265 - protein, 9 aa, Cryptosporidium hominis
GKGGAKRHR

SEQ ID NO: 2143266 - protein, 7 aa, Cryptosporidium hominis
GKGINPS

SEQ ID NO: 2143267 - protein, 6 aa, Cryptosporidium hominis
GKGKAY

SEQ ID NO: 2143268 - protein, 9 aa, Cryptosporidium hominis
GKGNENVTG

SEQ ID NO: 2143269 - protein, 9 aa, Cryptosporidium hominis
GKGNKIGEH

SEQ ID NO: 2143270 - protein, 7 aa, Cryptosporidium hominis
GKGNNNI

SEQ ID NO: 2143271 - protein, 10 aa, Cryptosporidium hominis
GKGNPGHGDL

SEQ ID NO: 2143272 - protein, 7 aa, Cryptosporidium hominis
GKGPNKN

SEQ ID NO: 2143273 - protein, 47 aa, Cryptosporidium hominis
GKGSDNNKSTISRTTSSMEKNEKKEKENSRMSSKPNRRLKRSDLDNV

SEQ ID NO: 2143274 - protein, 8 aa, Cryptosporidium hominis
GKGSTAKG

SEQ ID NO: 2143275 - protein, 7 aa, Cryptosporidium hominis
GKGTDLE

SEQ ID NO: 2143276 - protein, 7 aa, Cryptosporidium hominis
GKGTPIQ

SEQ ID NO: 2143277 - protein, 15 aa, Cryptosporidium hominis
GKGYPVKEREIGERR

SEQ ID NO: 2143278 - protein, 5 aa, Cryptosporidium hominis
GKHDE

SEQ ID NO: 2143279 - protein, 9 aa, Cryptosporidium hominis
GKHGPNTIK

SEQ ID NO: 2143280 - protein, 6 aa, Cryptosporidium hominis
GKHHGK

SEQ ID NO: 2143281 - protein, 6 aa, Cryptosporidium hominis
GKHHNS

SEQ ID NO: 2143282 - protein, 8 aa, Cryptosporidium hominis
GKHKEQFE

SEQ ID NO: 2143283 - protein, 5 aa, Cryptosporidium hominis
GKHNS

SEQ ID NO: 2143284 - protein, 6 aa, Cryptosporidium hominis
GKHQNA

SEQ ID NO: 2143285 - protein, 5 aa, Cryptosporidium hominis
GKHTG

SEQ ID NO: 2143286 - protein, 4 aa, Cryptosporidium hominis
GKIA

SEQ ID NO: 2143287 - protein, 9 aa, Cryptosporidium hominis
GKIDAKKTS

SEQ ID NO: 2143288 - protein, 12 aa, Cryptosporidium hominis
GKIETSSSSNNI

SEQ ID NO: 2143289 - protein, 7 aa, Cryptosporidium hominis
GKIGNED

SEQ ID NO: 2143290 - protein, 12 aa, Cryptosporidium hominis
GKIISDNKTAIQ

SEQ ID NO: 2143291 - protein, 6 aa, Cryptosporidium hominis
GKINGY

SEQ ID NO: 2143292 - protein, 4 aa, Cryptosporidium hominis
GKIQ

SEQ ID NO: 2143293 - protein, 11 aa, Cryptosporidium hominis
GKISSKKEDDD

SEQ ID NO: 2143294 - protein, 6 aa, Cryptosporidium hominis
GKITQH

SEQ ID NO: 2143295 - protein, 7 aa, Cryptosporidium hominis
GKKAFNK

SEQ ID NO: 2143296 - protein, 13 aa, Cryptosporidium hominis
GKKDSSNIDESGL

SEQ ID NO: 2143297 - protein, 8 aa, Cryptosporidium hominis
GKKGQGLR

SEQ ID NO: 2143298 - protein, 19 aa, Cryptosporidium hominis
GKKHDRKLAKDEKKLESEL

SEQ ID NO: 2143299 - protein, 7 aa, Cryptosporidium hominis
GKKHEAS

SEQ ID NO: 2143300 - protein, 14 aa, Cryptosporidium hominis
GKKKKDKQSKGSLK

SEQ ID NO: 2143301 - protein, 27 aa, Cryptosporidium hominis
GKKLQSDKQEFENPFENDENIEAPDSQ

SEQ ID NO: 2143302 - protein, 11 aa, Cryptosporidium hominis
GKKLSRPEQVS

SEQ ID NO: 2143303 - protein, 12 aa, Cryptosporidium hominis
GKKNDKDEYDDD

SEQ ID NO: 2143304 - protein, 9 aa, Cryptosporidium hominis
GKKNLEPSL

SEQ ID NO: 2143305 - protein, 9 aa, Cryptosporidium hominis
GKKPDLNNH

SEQ ID NO: 2143306 - protein, 4 aa, Cryptosporidium hominis
GKKS

SEQ ID NO: 2143307 - protein, 8 aa, Cryptosporidium hominis
GKKVTASQ

SEQ ID NO: 2143308 - protein, 14 aa, Cryptosporidium hominis
GKLASQNVPDSPPT

SEQ ID NO: 2143309 - protein, 16 aa, Cryptosporidium hominis
GKLEEDDESAENEAAS

SEQ ID NO: 2143310 - protein, 8 aa, Cryptosporidium hominis
GKLNPGGK

SEQ ID NO: 2143311 - protein, 13 aa, Cryptosporidium hominis
GKLPEDSSLSNND

SEQ ID NO: 2143312 - protein, 8 aa, Cryptosporidium hominis
GKLPEEVA

SEQ ID NO: 2143313 - protein, 9 aa, Cryptosporidium hominis
GKLPSPRAA

SEQ ID NO: 2143314 - protein, 5 aa, Cryptosporidium hominis
GKLSD

SEQ ID NO: 2143315 - protein, 11 aa, Cryptosporidium hominis
GKLSEHGSNGD

SEQ ID NO: 2143316 - protein, 4 aa, Cryptosporidium hominis
GKME

SEQ ID NO: 2143317 - protein, 18 aa, Cryptosporidium hominis
GKMEENQLEDDKSVSECS

SEQ ID NO: 2143318 - protein, 6 aa, Cryptosporidium hominis
GKNDLT

SEQ ID NO: 2143319 - protein, 6 aa, Cryptosporidium hominis
GKNFKP

SEQ ID NO: 2143320 - protein, 7 aa, Cryptosporidium hominis
GKNGALG

SEQ ID NO: 2143321 - protein, 7 aa, Cryptosporidium hominis
GKNGIGK

SEQ ID NO: 2143322 - protein, 14 aa, Cryptosporidium hominis
GKNGMTAPTDPQQI

SEQ ID NO: 2143323 - protein, 10 aa, Cryptosporidium hominis
GKNGSNNVGP

SEQ ID NO: 2143324 - protein, 43 aa, Cryptosporidium hominis
GKNGTSSSSIDISGTGTGTGTGAVAGTGASGVPDFGQRSTSSV

SEQ ID NO: 2143325 - protein, 9 aa, Cryptosporidium hominis
GKNHSGKNI

SEQ ID NO: 2143326 - protein, 6 aa, Cryptosporidium hominis
GKNISN

SEQ ID NO: 2143327 - protein, 14 aa, Cryptosporidium hominis
GKNKKDKKKHSQEI

SEQ ID NO: 2143328 - protein, 46 aa, Cryptosporidium hominis
GKNKKSASNNQSSQNSSSSKSAKTPKKHSQASSSSYGAKGITEPER

SEQ ID NO: 2143329 - protein, 9 aa, Cryptosporidium hominis
GKNLTGTAR

SEQ ID NO: 2143330 - protein, 7 aa, Cryptosporidium hominis
GKNNENN

SEQ ID NO: 2143331 - protein, 30 aa, Cryptosporidium hominis
GKNNHENANQYMDGENSDMEENNEQIREKN

SEQ ID NO: 2143332 - protein, 11 aa, Cryptosporidium hominis
GKNNTKPDVNQ

SEQ ID NO: 2143333 - protein, 14 aa, Cryptosporidium hominis
GKNQAKNFRSESEE

SEQ ID NO: 2143334 - protein, 47 aa, Cryptosporidium hominis
GKNQEDREVTQNKPLERIGPNNTDFRNSKSTSTTASSHSGSSLSHPH

SEQ ID NO: 2143335 - protein, 4 aa, Cryptosporidium hominis
GKNT

SEQ ID NO: 2143336 - protein, 9 aa, Cryptosporidium hominis
GKNTIEDSN

SEQ ID NO: 2143337 - protein, 12 aa, Cryptosporidium hominis
GKNVNNNNSEHS

SEQ ID NO: 2143338 - protein, 40 aa, Cryptosporidium hominis
GKPAGSGSSNTGSGTPNGTSGNSAPGNPSGAVNGATVGSG

SEQ ID NO: 2143339 - protein, 6 aa, Cryptosporidium hominis
GKPEQI

SEQ ID NO: 2143340 - protein, 12 aa, Cryptosporidium hominis
GKPFSKQQKGVS

SEQ ID NO: 2143341 - protein, 5 aa, Cryptosporidium hominis
GKPHL

SEQ ID NO: 2143342 - protein, 4 aa, Cryptosporidium hominis
GKPI

SEQ ID NO: 2143343 - protein, 8 aa, Cryptosporidium hominis
GKPKNQGI

SEQ ID NO: 2143344 - protein, 4 aa, Cryptosporidium hominis
GKPL

SEQ ID NO: 2143345 - protein, 5 aa, Cryptosporidium hominis
GKPLI

SEQ ID NO: 2143346 - protein, 14 aa, Cryptosporidium hominis
GKPPGLGTQLTPTQ

SEQ ID NO: 2143347 - protein, 6 aa, Cryptosporidium hominis
GKPPYY

SEQ ID NO: 2143348 - protein, 16 aa, Cryptosporidium hominis
GKPQETFKEASERAKR

SEQ ID NO: 2143349 - protein, 11 aa, Cryptosporidium hominis
GKPQNKIKSSK

SEQ ID NO: 2143350 - protein, 6 aa, Cryptosporidium hominis
GKPRKW

SEQ ID NO: 2143351 - protein, 4 aa, Cryptosporidium hominis
GKPS

SEQ ID NO: 2143352 - protein, 7 aa, Cryptosporidium hominis
GKPSPFI

SEQ ID NO: 2143353 - protein, 9 aa, Cryptosporidium hominis
GKPSSGKST

SEQ ID NO: 2143354 - protein, 9 aa, Cryptosporidium hominis
GKPTELNPH

SEQ ID NO: 2143355 - protein, 7 aa, Cryptosporidium hominis
GKPYPKS

SEQ ID NO: 2143356 - protein, 8 aa, Cryptosporidium hominis
GKQAEPGA

SEQ ID NO: 2143357 - protein, 5 aa, Cryptosporidium hominis
GKQDE

SEQ ID NO: 2143358 - protein, 11 aa, Cryptosporidium hominis
GKQEYYSPYTN

SEQ ID NO: 2143359 - protein, 15 aa, Cryptosporidium hominis
GKQKWEDASTSDEIQ

SEQ ID NO: 2143360 - protein, 13 aa, Cryptosporidium hominis
GKQPSNGSQNPPL

SEQ ID NO: 2143361 - protein, 9 aa, Cryptosporidium hominis
GKQREQGTL

SEQ ID NO: 2143362 - protein, 12 aa, Cryptosporidium hominis
GKQRNQSEMERV

SEQ ID NO: 2143363 - protein, 10 aa, Cryptosporidium hominis
GKQSDTDTRN

SEQ ID NO: 2143364 - protein, 24 aa, Cryptosporidium hominis
GKQSLDERNSSIDSFNKNNVSCNV

SEQ ID NO: 2143365 - protein, 14 aa, Cryptosporidium hominis
GKRFSQGTSADREI

SEQ ID NO: 2143366 - protein, 7 aa, Cryptosporidium hominis
GKRGING

SEQ ID NO: 2143367 - protein, 5 aa, Cryptosporidium hominis
GKRGL

SEQ ID NO: 2143368 - protein, 58 aa, Cryptosporidium hominis
GKRGRPPSNPTSNSRGDTGLSSSSIRNTQLSSSSLGNFEDSTETQTNTQANVGTGSSV

SEQ ID NO: 2143369 - protein, 7 aa, Cryptosporidium hominis
GKRGSYQ

SEQ ID NO: 2143370 - protein, 7 aa, Cryptosporidium hominis
GKRITSE

SEQ ID NO: 2143371 - protein, 5 aa, Cryptosporidium hominis
GKRNI

SEQ ID NO: 2143372 - protein, 8 aa, Cryptosporidium hominis
GKRQKKSW

SEQ ID NO: 2143373 - protein, 12 aa, Cryptosporidium hominis
GKRQKNTDSNWE

SEQ ID NO: 2143374 - protein, 13 aa, Cryptosporidium hominis
GKRRGTKDARRPE

SEQ ID NO: 2143375 - protein, 16 aa, Cryptosporidium hominis
GKRSAKMRQAGTQQYQ

SEQ ID NO: 2143376 - protein, 10 aa, Cryptosporidium hominis
GKRSTSSSQI

SEQ ID NO: 2143377 - protein, 9 aa, Cryptosporidium hominis
GKRTFNNNE

SEQ ID NO: 2143378 - protein, 6 aa, Cryptosporidium hominis
GKSDAL

SEQ ID NO: 2143379 - protein, 8 aa, Cryptosporidium hominis
GKSDDISN

SEQ ID NO: 2143380 - protein, 9 aa, Cryptosporidium hominis
GKSDSNLVK

SEQ ID NO: 2143381 - protein, 4 aa, Cryptosporidium hominis
GKSG

SEQ ID NO: 2143382 - protein, 29 aa, Cryptosporidium hominis
GKSGKTQSSSSSSSSSASSSSQGNGISSK

SEQ ID NO: 2143383 - protein, 5 aa, Cryptosporidium hominis
GKSGL

SEQ ID NO: 2143384 - protein, 4 aa, Cryptosporidium hominis
GKSI

SEQ ID NO: 2143385 - protein, 13 aa, Cryptosporidium hominis
GKSIGKKEQRKNL

SEQ ID NO: 2143386 - protein, 7 aa, Cryptosporidium hominis
GKSIRDV

SEQ ID NO: 2143387 - protein, 5 aa, Cryptosporidium hominis
GKSKD

SEQ ID NO: 2143388 - protein, 9 aa, Cryptosporidium hominis
GKSKNGKNY

SEQ ID NO: 2143389 - protein, 36 aa, Cryptosporidium hominis
GKSKRKGRSITRKKANNLVPNKANSCTNNEDNTSFK

SEQ ID NO: 2143390 - protein, 10 aa, Cryptosporidium hominis
GKSLSSKTSY

SEQ ID NO: 2143391 - protein, 6 aa, Cryptosporidium hominis
GKSNPT

SEQ ID NO: 2143392 - protein, 5 aa, Cryptosporidium hominis
GKSNV

SEQ ID NO: 2143393 - protein, 9 aa, Cryptosporidium hominis
GKSPEERNK

SEQ ID NO: 2143394 - protein, 32 aa, Cryptosporidium hominis
GKSQLNDGKIGNDEHTNSSNQLANKNNIAEKN

SEQ ID NO: 2143395 - protein, 11 aa, Cryptosporidium hominis
GKSRSVTPNQV

SEQ ID NO: 2143396 - protein, 109 aa, Cryptosporidium hominis
GKSRTGSDSDPDSDSDSDTSSDSDSDSDSDSDSDSDSNSDSDPSSGSGGLGGTGGREAGTGGLGGGEGGGTRGGGGGGRGRGGRGGGGGGRGRGGEAGVGTAMGRGAGR

SEQ ID NO: 2143397 - protein, 7 aa, Cryptosporidium hominis
GKSTLTD

SEQ ID NO: 2143398 - protein, 4 aa, Cryptosporidium hominis
GKSV

SEQ ID NO: 2143399 - protein, 7 aa, Cryptosporidium hominis
GKSVKEN

SEQ ID NO: 2143400 - protein, 5 aa, Cryptosporidium hominis
GKSVP

SEQ ID NO: 2143401 - protein, 1036 aa, Cryptosporidium hominis
GKSVSSSLKSPSISASKNSSAILSNKEQNLSSANPKDNSIDLNSSNSKASETIKSTLESNEPSLISKKDAPAAPPAKKDAPVVPPTKKEAPAGPLKKDAPAAPTAPPAKKDAPATPLKKDVPAAPLKKDAPATPAAPPAKKDAPTAPLKKDAPAAPAAPPAKKDAPAAPLKKDAPTAPASPPAKKDAPVAPLKKDAPAAPAAPPAKKDAPAVPAAPPAKKDAPVAPLKKDAPAAPAAPPAKKDAPVAPLKKDAPAASVAPPAKKDAPTAPLKKDAPAAPAAPPAKKDAPAAPLKKDAPTAPASPPAKKDAPVAPLKKDAPAAPAAPPAKKDAPAVPAAPPAKKDAPVAPLKKDAPAAPAAPPAKKDAPVAPLKKDAPAASVAPPAKKDAPAAPLKKDAPAVPAAPPAKKDAPVAPLKKDAPAAPAVPPMKKDAPAAPAVPPAKKDAPVAPLKKDAPAAPAAPPMKKDAPAAPAVPPMKKDAPAAPAVPPAKKDAPVAPLKKDAPAAPAAPPAKKDAPAAPASPPAKKDAPAPPPMKKDAPAAPAVPPMKKDAPAAPAVPPAKKDAPVAPLKKDAPAAPAAPPAKKDAPAAPPMKKDAPAVPAAPPAKKDAPVAPLKKDAPAAPTALPAKKDAPAVPAAPPAKKDAPAAPPAKKDAPVAPPMKKDAPAAPPMKKDAPPAPEPPAKDAPAAPPAKKDAPAAPPMKKDVPAAPPMKKDTPAAPPAKKDAPAAPPMKKDAPAVPAAPPMKKDAPSVPPMKDAPPAPESPAKDTPAPPPTKKDAPPAPPMKKDAPAAPPMKKDAPTAPPMKKDAPAAAPPAKKDAPVAPASPPTKKDAPAPSPMKKDAPTAPPAMKDAPAAPPAKKDAPAAPPMKKDAPPAPESPAKDAPASPPAKKDAPAAPPMKKDAPTAPPAKKDAPAAPASPPAKKDAPAAPPMKKDAPAAPPAKKDALAAPPMKKEAPPAPESPAKDAPAPPPAKKDAPAAPPMKKDAPAPPAKDAPAAPPAKKDAPAAPASPPAKKDAPAPPPMKKDAPTVPPMK

SEQ ID NO: 2143402 - protein, 7 aa, Cryptosporidium hominis
GKSYPKK

SEQ ID NO: 2143403 - protein, 6 aa, Cryptosporidium hominis
GKTGLP

SEQ ID NO: 2143404 - protein, 9 aa, Cryptosporidium hominis
GKTKKYKYS

SEQ ID NO: 2143405 - protein, 13 aa, Cryptosporidium hominis
GKTKSSENLSKQP

SEQ ID NO: 2143406 - protein, 6 aa, Cryptosporidium hominis
GKTLTG

SEQ ID NO: 2143407 - protein, 11 aa, Cryptosporidium hominis
GKTPGNKREEY

SEQ ID NO: 2143408 - protein, 7 aa, Cryptosporidium hominis
GKTPGSS

SEQ ID NO: 2143409 - protein, 5 aa, Cryptosporidium hominis
GKTPH

SEQ ID NO: 2143410 - protein, 6 aa, Cryptosporidium hominis
GKTQRE

SEQ ID NO: 2143411 - protein, 5 aa, Cryptosporidium hominis
GKTRL

SEQ ID NO: 2143412 - protein, 8 aa, Cryptosporidium hominis
GKTRMTKN

SEQ ID NO: 2143413 - protein, 8 aa, Cryptosporidium hominis
GKTTNSGH

SEQ ID NO: 2143414 - protein, 5 aa, Cryptosporidium hominis
GKTTP

SEQ ID NO: 2143415 - protein, 14 aa, Cryptosporidium hominis
GKTTQISNLGGSVD

SEQ ID NO: 2143416 - protein, 6 aa, Cryptosporidium hominis
GKVETT

SEQ ID NO: 2143417 - protein, 4 aa, Cryptosporidium hominis
GKVG

SEQ ID NO: 2143418 - protein, 31 aa, Cryptosporidium hominis
GKVGGKVGGKGKAGSGKGSKKQPTSRAARAG

SEQ ID NO: 2143419 - protein, 16 aa, Cryptosporidium hominis
GKVNGKGTLTYSRGDK

SEQ ID NO: 2143420 - protein, 13 aa, Cryptosporidium hominis
GKVNKSLKKDEQL

SEQ ID NO: 2143421 - protein, 7 aa, Cryptosporidium hominis
GKVPEKY

SEQ ID NO: 2143422 - protein, 20 aa, Cryptosporidium hominis
GKVQETKNVTSLSKSNNIRK

SEQ ID NO: 2143423 - protein, 4 aa, Cryptosporidium hominis
GKYD

SEQ ID NO: 2143424 - protein, 6 aa, Cryptosporidium hominis
GKYDNA

SEQ ID NO: 2143425 - protein, 7 aa, Cryptosporidium hominis
GKYGEDS

SEQ ID NO: 2143426 - protein, 6 aa, Cryptosporidium hominis
GKYGPK

SEQ ID NO: 2143427 - protein, 5 aa, Cryptosporidium hominis
GKYGS

SEQ ID NO: 2143428 - protein, 7 aa, Cryptosporidium hominis
GKYLQKG

SEQ ID NO: 2143429 - protein, 8 aa, Cryptosporidium hominis
GKYNGYEN

SEQ ID NO: 2143430 - protein, 5 aa, Cryptosporidium hominis
GKYNH

SEQ ID NO: 2143431 - protein, 5 aa, Cryptosporidium hominis
GKYQD

SEQ ID NO: 2143432 - protein, 7 aa, Cryptosporidium hominis
GLAPDIP

SEQ ID NO: 2143433 - protein, 6 aa, Cryptosporidium hominis
GLDATK

SEQ ID NO: 2143434 - protein, 12 aa, Cryptosporidium hominis
GLDDTGKNAVRQ

SEQ ID NO: 2143435 - protein, 7 aa, Cryptosporidium hominis
GLDPNSE

SEQ ID NO: 2143436 - protein, 4 aa, Cryptosporidium hominis
GLEN

SEQ ID NO: 2143437 - protein, 26 aa, Cryptosporidium hominis
GLESKEKSNLEQRHPNKAKKSSNNLK

SEQ ID NO: 2143438 - protein, 4 aa, Cryptosporidium hominis
GLFG

SEQ ID NO: 2143439 - protein, 7 aa, Cryptosporidium hominis
GLGDDEK

SEQ ID NO: 2143440 - protein, 12 aa, Cryptosporidium hominis
GLGGSDRGGAAA

SEQ ID NO: 2143441 - protein, 6 aa, Cryptosporidium hominis
GLGRTG

SEQ ID NO: 2143442 - protein, 8 aa, Cryptosporidium hominis
GLKDQEVR

SEQ ID NO: 2143443 - protein, 4 aa, Cryptosporidium hominis
GLKG

SEQ ID NO: 2143444 - protein, 9 aa, Cryptosporidium hominis
GLKGDDPLK

SEQ ID NO: 2143445 - protein, 12 aa, Cryptosporidium hominis
GLKIGRNSDCDF

SEQ ID NO: 2143446 - protein, 4 aa, Cryptosporidium hominis
GLKN

SEQ ID NO: 2143447 - protein, 7 aa, Cryptosporidium hominis
GLKNSGY

SEQ ID NO: 2143448 - protein, 35 aa, Cryptosporidium hominis
GLKPNSSSERLSPNIEEGSRGRTKFQGNHHSRAAT

SEQ ID NO: 2143449 - protein, 61 aa, Cryptosporidium hominis
GLKPPKRKKTINQAIGTSEEKAQVNDKTKKKKGSKSNDDTEGSDKPPQVANDDMRFAAKMV

SEQ ID NO: 2143450 - protein, 4 aa, Cryptosporidium hominis
GLKS

SEQ ID NO: 2143451 - protein, 21 aa, Cryptosporidium hominis
GLKTNSGDDSTHADGASGSDF

SEQ ID NO: 2143452 - protein, 11 aa, Cryptosporidium hominis
GLNDNTDPSSL

SEQ ID NO: 2143453 - protein, 9 aa, Cryptosporidium hominis
GLNESIGRD

SEQ ID NO: 2143454 - protein, 30 aa, Cryptosporidium hominis
GLNGGDITGEIGDEINDGNSSGNANGGNLN

SEQ ID NO: 2143455 - protein, 10 aa, Cryptosporidium hominis
GLNGSGKSNI

SEQ ID NO: 2143456 - protein, 11 aa, Cryptosporidium hominis
GLNNSNIGQTT

SEQ ID NO: 2143457 - protein, 7 aa, Cryptosporidium hominis
GLNPQNL

SEQ ID NO: 2143458 - protein, 12 aa, Cryptosporidium hominis
GLNSKKASRSEL

SEQ ID NO: 2143459 - protein, 13 aa, Cryptosporidium hominis
GLNTSNKISSTKI

SEQ ID NO: 2143460 - protein, 5 aa, Cryptosporidium hominis
GLPIQ

SEQ ID NO: 2143461 - protein, 11 aa, Cryptosporidium hominis
GLPPITEAEGD

SEQ ID NO: 2143462 - protein, 12 aa, Cryptosporidium hominis
GLPPKPAETSLK

SEQ ID NO: 2143463 - protein, 6 aa, Cryptosporidium hominis
GLQDPR

SEQ ID NO: 2143464 - protein, 5 aa, Cryptosporidium hominis
GLQQK

SEQ ID NO: 2143465 - protein, 12 aa, Cryptosporidium hominis
GLQQNKDNFSKF

SEQ ID NO: 2143466 - protein, 8 aa, Cryptosporidium hominis
GLRKPSNS

SEQ ID NO: 2143467 - protein, 10 aa, Cryptosporidium hominis
GLRNTNNNIG

SEQ ID NO: 2143468 - protein, 8 aa, Cryptosporidium hominis
GLRSYSDD

SEQ ID NO: 2143469 - protein, 8 aa, Cryptosporidium hominis
GLSAQGPN

SEQ ID NO: 2143470 - protein, 11 aa, Cryptosporidium hominis
GLSDKDTGTIS

SEQ ID NO: 2143471 - protein, 8 aa, Cryptosporidium hominis
GLSDTEIR

SEQ ID NO: 2143472 - protein, 12 aa, Cryptosporidium hominis
GLSEDDSKLDPV

SEQ ID NO: 2143473 - protein, 9 aa, Cryptosporidium hominis
GLSEREKEL

SEQ ID NO: 2143474 - protein, 10 aa, Cryptosporidium hominis
GLSGGESKDS

SEQ ID NO: 2143475 - protein, 12 aa, Cryptosporidium hominis
GLSKGKPTERGI

SEQ ID NO: 2143476 - protein, 9 aa, Cryptosporidium hominis
GLSKTSEEF

SEQ ID NO: 2143477 - protein, 15 aa, Cryptosporidium hominis
GLSNNNNNSTEGSQP

SEQ ID NO: 2143478 - protein, 6 aa, Cryptosporidium hominis
GLSPDV

SEQ ID NO: 2143479 - protein, 6 aa, Cryptosporidium hominis
GLSPGA

SEQ ID NO: 2143480 - protein, 8 aa, Cryptosporidium hominis
GLSRNNYS

SEQ ID NO: 2143481 - protein, 9 aa, Cryptosporidium hominis
GLSRRRDSG

SEQ ID NO: 2143482 - protein, 7 aa, Cryptosporidium hominis
GLSSDSW

SEQ ID NO: 2143483 - protein, 7 aa, Cryptosporidium hominis
GLSSDTR

SEQ ID NO: 2143484 - protein, 7 aa, Cryptosporidium hominis
GLSSTPE

SEQ ID NO: 2143485 - protein, 13 aa, Cryptosporidium hominis
GLSSTSPNTVGPI

SEQ ID NO: 2143486 - protein, 10 aa, Cryptosporidium hominis
GLSTGSQIRN

SEQ ID NO: 2143487 - protein, 24 aa, Cryptosporidium hominis
GLSTNSRNSKQALGRGGVDQSGIG

SEQ ID NO: 2143488 - protein, 7 aa, Cryptosporidium hominis
GLSTSGF

SEQ ID NO: 2143489 - protein, 16 aa, Cryptosporidium hominis
GLTKSTEIKENISANQ

SEQ ID NO: 2143490 - protein, 12 aa, Cryptosporidium hominis
GLTNSGNNIRDN

SEQ ID NO: 2143491 - protein, 4 aa, Cryptosporidium hominis
GLTP

SEQ ID NO: 2143492 - protein, 31 aa, Cryptosporidium hominis
GLTPKSEINNSSISKGLTSTRSVNGQQSEVQ

SEQ ID NO: 2143493 - protein, 8 aa, Cryptosporidium hominis
GLTSKGTK

SEQ ID NO: 2143494 - protein, 11 aa, Cryptosporidium hominis
GLTSKSNSNIC

SEQ ID NO: 2143495 - protein, 10 aa, Cryptosporidium hominis
GLTSSSSTNS

SEQ ID NO: 2143496 - protein, 11 aa, Cryptosporidium hominis
GLVESNDKSAV

SEQ ID NO: 2143497 - protein, 13 aa, Cryptosporidium hominis
GLVTKSEQKKKGK

SEQ ID NO: 2143498 - protein, 4 aa, Cryptosporidium hominis
GMAS

SEQ ID NO: 2143499 - protein, 9 aa, Cryptosporidium hominis
GMGQEQNSQ

SEQ ID NO: 2143500 - protein, 28 aa, Cryptosporidium hominis
GMKEHKSDIDSGDSSKSDNYSKTNPEKF

SEQ ID NO: 2143501 - protein, 27 aa, Cryptosporidium hominis
GMKNNRKSKNNGKDEKKKLESAPPPME

SEQ ID NO: 2143502 - protein, 7 aa, Cryptosporidium hominis
GMKPEQK

SEQ ID NO: 2143503 - protein, 8 aa, Cryptosporidium hominis
GMKSKSCP

SEQ ID NO: 2143504 - protein, 11 aa, Cryptosporidium hominis
GMNPPTSIPGV

SEQ ID NO: 2143505 - protein, 5 aa, Cryptosporidium hominis
GMNVG

SEQ ID NO: 2143506 - protein, 4 aa, Cryptosporidium hominis
GMTG

SEQ ID NO: 2143507 - protein, 15 aa, Cryptosporidium hominis
GNAARDAKKTRITPR

SEQ ID NO: 2143508 - protein, 10 aa, Cryptosporidium hominis
GNALKKSYGH

SEQ ID NO: 2143509 - protein, 9 aa, Cryptosporidium hominis
GNAPTGSGK

SEQ ID NO: 2143510 - protein, 7 aa, Cryptosporidium hominis
GNASKDL

SEQ ID NO: 2143511 - protein, 6 aa, Cryptosporidium hominis
GNATGK

SEQ ID NO: 2143512 - protein, 11 aa, Cryptosporidium hominis
GNAVPTNPRNC

SEQ ID NO: 2143513 - protein, 7 aa, Cryptosporidium hominis
GNAYDRS

SEQ ID NO: 2143514 - protein, 7 aa, Cryptosporidium hominis
GNCAPTD

SEQ ID NO: 2143515 - protein, 6 aa, Cryptosporidium hominis
GNCNNG

SEQ ID NO: 2143516 - protein, 34 aa, Cryptosporidium hominis
GNCNNSLKNNNLGNSGINPNIAPKPKNKNNKKGM

SEQ ID NO: 2143517 - protein, 7 aa, Cryptosporidium hominis
GNDDDTL

SEQ ID NO: 2143518 - protein, 10 aa, Cryptosporidium hominis
GNDGLDGIEG

SEQ ID NO: 2143519 - protein, 9 aa, Cryptosporidium hominis
GNDGTYKSI

SEQ ID NO: 2143520 - protein, 4 aa, Cryptosporidium hominis
GNDI

SEQ ID NO: 2143521 - protein, 6 aa, Cryptosporidium hominis
GNDKLQ

SEQ ID NO: 2143522 - protein, 10 aa, Cryptosporidium hominis
GNDKVSDERR

SEQ ID NO: 2143523 - protein, 11 aa, Cryptosporidium hominis
GNDLNRDSAVK

SEQ ID NO: 2143524 - protein, 10 aa, Cryptosporidium hominis
GNDNSQSFGS

SEQ ID NO: 2143525 - protein, 13 aa, Cryptosporidium hominis
GNDQSSQSPKNSA

SEQ ID NO: 2143526 - protein, 9 aa, Cryptosporidium hominis
GNDSNNSRN

SEQ ID NO: 2143527 - protein, 8 aa, Cryptosporidium hominis
GNDYANDD

SEQ ID NO: 2143528 - protein, 8 aa, Cryptosporidium hominis
GNEAPSYC

SEQ ID NO: 2143529 - protein, 7 aa, Cryptosporidium hominis
GNEDIGT

SEQ ID NO: 2143530 - protein, 6 aa, Cryptosporidium hominis
GNEDSS

SEQ ID NO: 2143531 - protein, 6 aa, Cryptosporidium hominis
GNEEDT

SEQ ID NO: 2143532 - protein, 8 aa, Cryptosporidium hominis
GNEEGGLK

SEQ ID NO: 2143533 - protein, 6 aa, Cryptosporidium hominis
GNEEIS

SEQ ID NO: 2143534 - protein, 16 aa, Cryptosporidium hominis
GNEGDSIDYGENESSL

SEQ ID NO: 2143535 - protein, 5 aa, Cryptosporidium hominis
GNEGI

SEQ ID NO: 2143536 - protein, 7 aa, Cryptosporidium hominis
GNEGSGR

SEQ ID NO: 2143537 - protein, 12 aa, Cryptosporidium hominis
GNEKVTQSYNED

SEQ ID NO: 2143538 - protein, 15 aa, Cryptosporidium hominis
GNELNSSNSPLNTTV

SEQ ID NO: 2143539 - protein, 6 aa, Cryptosporidium hominis
GNELYK

SEQ ID NO: 2143540 - protein, 5 aa, Cryptosporidium hominis
GNEMV

SEQ ID NO: 2143541 - protein, 9 aa, Cryptosporidium hominis
GNENDAQGL

SEQ ID NO: 2143542 - protein, 8 aa, Cryptosporidium hominis
GNEPVSSC

SEQ ID NO: 2143543 - protein, 4 aa, Cryptosporidium hominis
GNEQ

SEQ ID NO: 2143544 - protein, 8 aa, Cryptosporidium hominis
GNEQVEET

SEQ ID NO: 2143545 - protein, 5 aa, Cryptosporidium hominis
GNESF

SEQ ID NO: 2143546 - protein, 26 aa, Cryptosporidium hominis
GNESKSVRNSENSRRLDGKSDNQVSP

SEQ ID NO: 2143547 - protein, 11 aa, Cryptosporidium hominis
GNESQPEEEEA

SEQ ID NO: 2143548 - protein, 23 aa, Cryptosporidium hominis
GNESQVEKSKTPLNNSDNSEFEN

SEQ ID NO: 2143549 - protein, 15 aa, Cryptosporidium hominis
GNETTSNINNSNHGN

SEQ ID NO: 2143550 - protein, 8 aa, Cryptosporidium hominis
GNEWPGLT

SEQ ID NO: 2143551 - protein, 16 aa, Cryptosporidium hominis
GNFDKSEEGATFRSED

SEQ ID NO: 2143552 - protein, 5 aa, Cryptosporidium hominis
GNFEE

SEQ ID NO: 2143553 - protein, 13 aa, Cryptosporidium hominis
GNFNDETSIEKKE

SEQ ID NO: 2143554 - protein, 13 aa, Cryptosporidium hominis
GNFSSASQCSKGE

SEQ ID NO: 2143555 - protein, 5 aa, Cryptosporidium hominis
GNFTS

SEQ ID NO: 2143556 - protein, 11 aa, Cryptosporidium hominis
GNGANTSPQNL

SEQ ID NO: 2143557 - protein, 5 aa, Cryptosporidium hominis
GNGEE

SEQ ID NO: 2143558 - protein, 9 aa, Cryptosporidium hominis
GNGEEPKSA

SEQ ID NO: 2143559 - protein, 4 aa, Cryptosporidium hominis
GNGG

SEQ ID NO: 2143560 - protein, 14 aa, Cryptosporidium hominis
GNGNPGRSGSINRV

SEQ ID NO: 2143561 - protein, 9 aa, Cryptosporidium hominis
GNGNTMSEA

SEQ ID NO: 2143562 - protein, 9 aa, Cryptosporidium hominis
GNGQERSDL

SEQ ID NO: 2143563 - protein, 18 aa, Cryptosporidium hominis
GNGSGASETASNHPQEEV

SEQ ID NO: 2143564 - protein, 7 aa, Cryptosporidium hominis
GNGSKEY

SEQ ID NO: 2143565 - protein, 10 aa, Cryptosporidium hominis
GNGSRSKAFR

SEQ ID NO: 2143566 - protein, 6 aa, Cryptosporidium hominis
GNGTEQ

SEQ ID NO: 2143567 - protein, 36 aa, Cryptosporidium hominis
GNGTNGGGASGNCGGGGIGGGLEASNSVSSSTTATS

SEQ ID NO: 2143568 - protein, 7 aa, Cryptosporidium hominis
GNHETKN

SEQ ID NO: 2143569 - protein, 10 aa, Cryptosporidium hominis
GNHTRQESMA

SEQ ID NO: 2143570 - protein, 5 aa, Cryptosporidium hominis
GNIGQ

SEQ ID NO: 2143571 - protein, 7 aa, Cryptosporidium hominis
GNIGTTV

SEQ ID NO: 2143572 - protein, 4 aa, Cryptosporidium hominis
GNIN

SEQ ID NO: 2143573 - protein, 45 aa, Cryptosporidium hominis
GNINNNNNNNNNNNNNNSNNSGNNNSNNNNNNLGNSVGNYTNTGV

SEQ ID NO: 2143574 - protein, 4 aa, Cryptosporidium hominis
GNIP

SEQ ID NO: 2143575 - protein, 5 aa, Cryptosporidium hominis
GNIPT

SEQ ID NO: 2143576 - protein, 17 aa, Cryptosporidium hominis
GNIRGGGISSTGGMTVN

SEQ ID NO: 2143577 - protein, 16 aa, Cryptosporidium hominis
GNISRNSKDVSESSHE

SEQ ID NO: 2143578 - protein, 9 aa, Cryptosporidium hominis
GNKANEKTF

SEQ ID NO: 2143579 - protein, 4 aa, Cryptosporidium hominis
GNKD

SEQ ID NO: 2143580 - protein, 16 aa, Cryptosporidium hominis
GNKEKKNTVNETKLSS

SEQ ID NO: 2143581 - protein, 6 aa, Cryptosporidium hominis
GNKENF

SEQ ID NO: 2143582 - protein, 10 aa, Cryptosporidium hominis
GNKGPGDTDI

SEQ ID NO: 2143583 - protein, 5 aa, Cryptosporidium hominis
GNKGY

SEQ ID NO: 2143584 - protein, 4 aa, Cryptosporidium hominis
GNKI

SEQ ID NO: 2143585 - protein, 14 aa, Cryptosporidium hominis
GNKNGDELSRSKKE

SEQ ID NO: 2143586 - protein, 8 aa, Cryptosporidium hominis
GNKPSSVN

SEQ ID NO: 2143587 - protein, 9 aa, Cryptosporidium hominis
GNKPTEKEI

SEQ ID NO: 2143588 - protein, 8 aa, Cryptosporidium hominis
GNKQKPSL

SEQ ID NO: 2143589 - protein, 9 aa, Cryptosporidium hominis
GNKSRFTGQ

SEQ ID NO: 2143590 - protein, 21 aa, Cryptosporidium hominis
GNKSSSGTSRYQNAISQSRKK

SEQ ID NO: 2143591 - protein, 10 aa, Cryptosporidium hominis
GNKTSKNHAR

SEQ ID NO: 2143592 - protein, 4 aa, Cryptosporidium hominis
GNLG

SEQ ID NO: 2143593 - protein, 7 aa, Cryptosporidium hominis
GNLHDTD

SEQ ID NO: 2143594 - protein, 6 aa, Cryptosporidium hominis
GNLKRS

SEQ ID NO: 2143595 - protein, 4 aa, Cryptosporidium hominis
GNLP

SEQ ID NO: 2143596 - protein, 14 aa, Cryptosporidium hominis
GNLSNNNNKLNVST

SEQ ID NO: 2143597 - protein, 10 aa, Cryptosporidium hominis
GNLTRNNGER

SEQ ID NO: 2143598 - protein, 8 aa, Cryptosporidium hominis
GNLTTKPV

SEQ ID NO: 2143599 - protein, 13 aa, Cryptosporidium hominis
GNMGESNRSKNSF

SEQ ID NO: 2143600 - protein, 7 aa, Cryptosporidium hominis
GNMTNSR

SEQ ID NO: 2143601 - protein, 6 aa, Cryptosporidium hominis
GNNASK

SEQ ID NO: 2143602 - protein, 22 aa, Cryptosporidium hominis
GNNDGKSLNRSKNDEVSSFSRG

SEQ ID NO: 2143603 - protein, 8 aa, Cryptosporidium hominis
GNNETNEG

SEQ ID NO: 2143604 - protein, 4 aa, Cryptosporidium hominis
GNNF

SEQ ID NO: 2143605 - protein, 11 aa, Cryptosporidium hominis
GNNFQSINSQD

SEQ ID NO: 2143606 - protein, 9 aa, Cryptosporidium hominis
GNNGDLEGN

SEQ ID NO: 2143607 - protein, 7 aa, Cryptosporidium hominis
GNNIGPK

SEQ ID NO: 2143608 - protein, 6 aa, Cryptosporidium hominis
GNNKDF

SEQ ID NO: 2143609 - protein, 11 aa, Cryptosporidium hominis
GNNKDKDESKI

SEQ ID NO: 2143610 - protein, 11 aa, Cryptosporidium hominis
GNNKDPDNVES

SEQ ID NO: 2143611 - protein, 12 aa, Cryptosporidium hominis
GNNKELNGPIET

SEQ ID NO: 2143612 - protein, 12 aa, Cryptosporidium hominis
GNNMSADNKSEL

SEQ ID NO: 2143613 - protein, 24 aa, Cryptosporidium hominis
GNNNNSNNNNTNNNTGTNNSSYNG

SEQ ID NO: 2143614 - protein, 6 aa, Cryptosporidium hominis
GNNNRT

SEQ ID NO: 2143615 - protein, 7 aa, Cryptosporidium hominis
GNNPDQI

SEQ ID NO: 2143616 - protein, 8 aa, Cryptosporidium hominis
GNNPQKME

SEQ ID NO: 2143617 - protein, 21 aa, Cryptosporidium hominis
GNNQETSNKSSAIQASEQGHL

SEQ ID NO: 2143618 - protein, 5 aa, Cryptosporidium hominis
GNNRD

SEQ ID NO: 2143619 - protein, 4 aa, Cryptosporidium hominis
GNNS

SEQ ID NO: 2143620 - protein, 9 aa, Cryptosporidium hominis
GNNSEPSDI

SEQ ID NO: 2143621 - protein, 6 aa, Cryptosporidium hominis
GNNSKC

SEQ ID NO: 2143622 - protein, 5 aa, Cryptosporidium hominis
GNNSL

SEQ ID NO: 2143623 - protein, 8 aa, Cryptosporidium hominis
GNNTAAQE

SEQ ID NO: 2143624 - protein, 12 aa, Cryptosporidium hominis
GNNTGQHQQLRP

SEQ ID NO: 2143625 - protein, 8 aa, Cryptosporidium hominis
GNNTNNDV

SEQ ID NO: 2143626 - protein, 7 aa, Cryptosporidium hominis
GNNTTLD

SEQ ID NO: 2143627 - protein, 9 aa, Cryptosporidium hominis
GNPDEEKRS

SEQ ID NO: 2143628 - protein, 8 aa, Cryptosporidium hominis
GNPDELQE

SEQ ID NO: 2143629 - protein, 6 aa, Cryptosporidium hominis
GNPEGA

SEQ ID NO: 2143630 - protein, 18 aa, Cryptosporidium hominis
GNPGTGMGQIQGSSNALG

SEQ ID NO: 2143631 - protein, 19 aa, Cryptosporidium hominis
GNPHDKKNNLKRDKSDHAY

SEQ ID NO: 2143632 - protein, 4 aa, Cryptosporidium hominis
GNPI

SEQ ID NO: 2143633 - protein, 9 aa, Cryptosporidium hominis
GNPIDGKPS

SEQ ID NO: 2143634 - protein, 5 aa, Cryptosporidium hominis
GNPIK

SEQ ID NO: 2143635 - protein, 6 aa, Cryptosporidium hominis
GNPKQN

SEQ ID NO: 2143636 - protein, 5 aa, Cryptosporidium hominis
GNPLD

SEQ ID NO: 2143637 - protein, 10 aa, Cryptosporidium hominis
GNPLGNNNRQ

SEQ ID NO: 2143638 - protein, 5 aa, Cryptosporidium hominis
GNPLN

SEQ ID NO: 2143639 - protein, 5 aa, Cryptosporidium hominis
GNPNE

SEQ ID NO: 2143640 - protein, 7 aa, Cryptosporidium hominis
GNPNHSN

SEQ ID NO: 2143641 - protein, 12 aa, Cryptosporidium hominis
GNPNIEADESLT

SEQ ID NO: 2143642 - protein, 17 aa, Cryptosporidium hominis
GNPNMSTRIQESGEFST

SEQ ID NO: 2143643 - protein, 6 aa, Cryptosporidium hominis
GNPPRG

SEQ ID NO: 2143644 - protein, 6 aa, Cryptosporidium hominis
GNPQEK

SEQ ID NO: 2143645 - protein, 7 aa, Cryptosporidium hominis
GNPRQPL

SEQ ID NO: 2143646 - protein, 7 aa, Cryptosporidium hominis
GNPTTNN

SEQ ID NO: 2143647 - protein, 14 aa, Cryptosporidium hominis
GNPVPNSDEERSLG

SEQ ID NO: 2143648 - protein, 5 aa, Cryptosporidium hominis
GNQEL

SEQ ID NO: 2143649 - protein, 14 aa, Cryptosporidium hominis
GNQGNKQTNIASNS

SEQ ID NO: 2143650 - protein, 11 aa, Cryptosporidium hominis
GNQLNEQQLED

SEQ ID NO: 2143651 - protein, 5 aa, Cryptosporidium hominis
GNQNI

SEQ ID NO: 2143652 - protein, 6 aa, Cryptosporidium hominis
GNQNIT

SEQ ID NO: 2143653 - protein, 22 aa, Cryptosporidium hominis
GNQQETVNKTTSLTNDDFRKLF

SEQ ID NO: 2143654 - protein, 8 aa, Cryptosporidium hominis
GNQRGIED

SEQ ID NO: 2143655 - protein, 7 aa, Cryptosporidium hominis
GNQSGTH

SEQ ID NO: 2143656 - protein, 9 aa, Cryptosporidium hominis
GNQSQRLSI

SEQ ID NO: 2143657 - protein, 4 aa, Cryptosporidium hominis
GNQY

SEQ ID NO: 2143658 - protein, 4 aa, Cryptosporidium hominis
GNRD

SEQ ID NO: 2143659 - protein, 9 aa, Cryptosporidium hominis
GNRDTDYRS

SEQ ID NO: 2143660 - protein, 6 aa, Cryptosporidium hominis
GNRGNC

SEQ ID NO: 2143661 - protein, 4 aa, Cryptosporidium hominis
GNRS

SEQ ID NO: 2143662 - protein, 12 aa, Cryptosporidium hominis
GNRSCLGRNLIP

SEQ ID NO: 2143663 - protein, 19 aa, Cryptosporidium hominis
GNSAKNRDHDHDGKKGIRD

SEQ ID NO: 2143664 - protein, 9 aa, Cryptosporidium hominis
GNSAPQNAA

SEQ ID NO: 2143665 - protein, 7 aa, Cryptosporidium hominis
GNSDFTS

SEQ ID NO: 2143666 - protein, 13 aa, Cryptosporidium hominis
GNSDGTSTKSRQE

SEQ ID NO: 2143667 - protein, 10 aa, Cryptosporidium hominis
GNSDNNNELR

SEQ ID NO: 2143668 - protein, 8 aa, Cryptosporidium hominis
GNSEEEKV

SEQ ID NO: 2143669 - protein, 4 aa, Cryptosporidium hominis
GNSF

SEQ ID NO: 2143670 - protein, 6 aa, Cryptosporidium hominis
GNSGDF

SEQ ID NO: 2143671 - protein, 18 aa, Cryptosporidium hominis
GNSGQENKRLEDKNKTSN

SEQ ID NO: 2143672 - protein, 19 aa, Cryptosporidium hominis
GNSHFSTYNGGGISSIGNS

SEQ ID NO: 2143673 - protein, 6 aa, Cryptosporidium hominis
GNSHGF

SEQ ID NO: 2143674 - protein, 10 aa, Cryptosporidium hominis
GNSHSRTHGY

SEQ ID NO: 2143675 - protein, 15 aa, Cryptosporidium hominis
GNSLSSSSSAESLNL

SEQ ID NO: 2143676 - protein, 18 aa, Cryptosporidium hominis
GNSNDDTGRDEEDEKDLE

SEQ ID NO: 2143677 - protein, 39 aa, Cryptosporidium hominis
GNSNQSNSGGHAPSLGNPRVRTNPALAAASTTANSNYAD

SEQ ID NO: 2143678 - protein, 8 aa, Cryptosporidium hominis
GNSNSESM

SEQ ID NO: 2143679 - protein, 9 aa, Cryptosporidium hominis
GNSQDPSQV

SEQ ID NO: 2143680 - protein, 12 aa, Cryptosporidium hominis
GNSQSYDQQRDE

SEQ ID NO: 2143681 - protein, 12 aa, Cryptosporidium hominis
GNSSKYRRHSSL

SEQ ID NO: 2143682 - protein, 8 aa, Cryptosporidium hominis
GNSSLESG

SEQ ID NO: 2143683 - protein, 9 aa, Cryptosporidium hominis
GNSSNSIEP

SEQ ID NO: 2143684 - protein, 6 aa, Cryptosporidium hominis
GNSSTN

SEQ ID NO: 2143685 - protein, 8 aa, Cryptosporidium hominis
GNSTHQSN

SEQ ID NO: 2143686 - protein, 8 aa, Cryptosporidium hominis
GNSTNKTG

SEQ ID NO: 2143687 - protein, 19 aa, Cryptosporidium hominis
GNSTNNRNDGNSNSDNNVN

SEQ ID NO: 2143688 - protein, 7 aa, Cryptosporidium hominis
GNSTSND

SEQ ID NO: 2143689 - protein, 6 aa, Cryptosporidium hominis
GNSTYG

SEQ ID NO: 2143690 - protein, 7 aa, Cryptosporidium hominis
GNSVNTR

SEQ ID NO: 2143691 - protein, 10 aa, Cryptosporidium hominis
GNSYSGSSTH

SEQ ID NO: 2143692 - protein, 23 aa, Cryptosporidium hominis
GNTAHIPGKTPVPFNPPQQPPQN

SEQ ID NO: 2143693 - protein, 28 aa, Cryptosporidium hominis
GNTEYEKNVNQHNHPLENTNNKSGGDSF

SEQ ID NO: 2143694 - protein, 9 aa, Cryptosporidium hominis
GNTNDYAEN

SEQ ID NO: 2143695 - protein, 15 aa, Cryptosporidium hominis
GNTNEKGEYTTNYNP

SEQ ID NO: 2143696 - protein, 11 aa, Cryptosporidium hominis
GNTNHKKISES

SEQ ID NO: 2143697 - protein, 8 aa, Cryptosporidium hominis
GNTNINTN

SEQ ID NO: 2143698 - protein, 31 aa, Cryptosporidium hominis
GNTNQKDQISQTQSPNKKKKVSDKVSVQPNT

SEQ ID NO: 2143699 - protein, 5 aa, Cryptosporidium hominis
GNTPL

SEQ ID NO: 2143700 - protein, 4 aa, Cryptosporidium hominis
GNTR

SEQ ID NO: 2143701 - protein, 13 aa, Cryptosporidium hominis
GNTSGDDRDRQIS

SEQ ID NO: 2143702 - protein, 9 aa, Cryptosporidium hominis
GNTSNGRGY

SEQ ID NO: 2143703 - protein, 13 aa, Cryptosporidium hominis
GNTSNYSSFRPNT

SEQ ID NO: 2143704 - protein, 8 aa, Cryptosporidium hominis
GNVERSKD

SEQ ID NO: 2143705 - protein, 5 aa, Cryptosporidium hominis
GNVGS

SEQ ID NO: 2143706 - protein, 4 aa, Cryptosporidium hominis
GNVK

SEQ ID NO: 2143707 - protein, 12 aa, Cryptosporidium hominis
GNVNNAAHGYGK

SEQ ID NO: 2143708 - protein, 6 aa, Cryptosporidium hominis
GNVPQS

SEQ ID NO: 2143709 - protein, 4 aa, Cryptosporidium hominis
GNVS

SEQ ID NO: 2143710 - protein, 12 aa, Cryptosporidium hominis
GNWGKDKDGKII

SEQ ID NO: 2143711 - protein, 21 aa, Cryptosporidium hominis
GNYDDNNNNNKRITGRDRKYN

SEQ ID NO: 2143712 - protein, 19 aa, Cryptosporidium hominis
GNYESDRNNDIVPTFPSSF

SEQ ID NO: 2143713 - protein, 4 aa, Cryptosporidium hominis
GNYI

SEQ ID NO: 2143714 - protein, 15 aa, Cryptosporidium hominis
GNYKSPKKVQQQSNS

SEQ ID NO: 2143715 - protein, 5 aa, Cryptosporidium hominis
GNYNN

SEQ ID NO: 2143716 - protein, 8 aa, Cryptosporidium hominis
GNYQNSDI

SEQ ID NO: 2143717 - protein, 8 aa, Cryptosporidium hominis
GPASSGRT

SEQ ID NO: 2143718 - protein, 5 aa, Cryptosporidium hominis
GPCVE

SEQ ID NO: 2143719 - protein, 16 aa, Cryptosporidium hominis
GPDGQPIQKEQTKTSQ

SEQ ID NO: 2143720 - protein, 4 aa, Cryptosporidium hominis
GPDN

SEQ ID NO: 2143721 - protein, 5 aa, Cryptosporidium hominis
GPDVG

SEQ ID NO: 2143722 - protein, 5 aa, Cryptosporidium hominis
GPDYD

SEQ ID NO: 2143723 - protein, 7 aa, Cryptosporidium hominis
GPEDGIT

SEQ ID NO: 2143724 - protein, 10 aa, Cryptosporidium hominis
GPEEDLDENE

SEQ ID NO: 2143725 - protein, 5 aa, Cryptosporidium hominis
GPEKT

SEQ ID NO: 2143726 - protein, 8 aa, Cryptosporidium hominis
GPESSNSF

SEQ ID NO: 2143727 - protein, 4 aa, Cryptosporidium hominis
GPFG

SEQ ID NO: 2143728 - protein, 36 aa, Cryptosporidium hominis
GPFGGGGSGAIGVGNSSFGGGATSNPFGGGNTSTTG

SEQ ID NO: 2143729 - protein, 12 aa, Cryptosporidium hominis
GPFSPRKSKQPP

SEQ ID NO: 2143730 - protein, 10 aa, Cryptosporidium hominis
GPFSQSNHTS

SEQ ID NO: 2143731 - protein, 6 aa, Cryptosporidium hominis
GPGEKY

SEQ ID NO: 2143732 - protein, 4 aa, Cryptosporidium hominis
GPGM

SEQ ID NO: 2143733 - protein, 5 aa, Cryptosporidium hominis
GPGNI

SEQ ID NO: 2143734 - protein, 16 aa, Cryptosporidium hominis
GPGNNSTVHASHGGRV

SEQ ID NO: 2143735 - protein, 5 aa, Cryptosporidium hominis
GPGNV

SEQ ID NO: 2143736 - protein, 6 aa, Cryptosporidium hominis
GPGPSE

SEQ ID NO: 2143737 - protein, 5 aa, Cryptosporidium hominis
GPGQR

SEQ ID NO: 2143738 - protein, 10 aa, Cryptosporidium hominis
GPGSAPTSAP

SEQ ID NO: 2143739 - protein, 11 aa, Cryptosporidium hominis
GPGTGKTATLT

SEQ ID NO: 2143740 - protein, 7 aa, Cryptosporidium hominis
GPHEWPG

SEQ ID NO: 2143741 - protein, 7 aa, Cryptosporidium hominis
GPHPKSS

SEQ ID NO: 2143742 - protein, 4 aa, Cryptosporidium hominis
GPIS

SEQ ID NO: 2143743 - protein, 7 aa, Cryptosporidium hominis
GPKDTFW

SEQ ID NO: 2143744 - protein, 12 aa, Cryptosporidium hominis
GPKEVEGKNDSV

SEQ ID NO: 2143745 - protein, 14 aa, Cryptosporidium hominis
GPLDDRSDPSTTGY

SEQ ID NO: 2143746 - protein, 21 aa, Cryptosporidium hominis
GPLGMSPKKVGDDIAKGTAAW

SEQ ID NO: 2143747 - protein, 9 aa, Cryptosporidium hominis
GPLKNEEEN

SEQ ID NO: 2143748 - protein, 5 aa, Cryptosporidium hominis
GPMDQ

SEQ ID NO: 2143749 - protein, 4 aa, Cryptosporidium hominis
GPMI

SEQ ID NO: 2143750 - protein, 7 aa, Cryptosporidium hominis
GPNDHSI

SEQ ID NO: 2143751 - protein, 6 aa, Cryptosporidium hominis
GPNGGQ

SEQ ID NO: 2143752 - protein, 10 aa, Cryptosporidium hominis
GPNGSGKSNL

SEQ ID NO: 2143753 - protein, 10 aa, Cryptosporidium hominis
GPNGSGKSNV

SEQ ID NO: 2143754 - protein, 7 aa, Cryptosporidium hominis
GPNHPKV

SEQ ID NO: 2143755 - protein, 14 aa, Cryptosporidium hominis
GPNKPYATVRDAEK

SEQ ID NO: 2143756 - protein, 8 aa, Cryptosporidium hominis
GPNMGGKS

SEQ ID NO: 2143757 - protein, 9 aa, Cryptosporidium hominis
GPNMGGKST

SEQ ID NO: 2143758 - protein, 7 aa, Cryptosporidium hominis
GPNNSSV

SEQ ID NO: 2143759 - protein, 7 aa, Cryptosporidium hominis
GPNSERL

SEQ ID NO: 2143760 - protein, 11 aa, Cryptosporidium hominis
GPNSETSKSYY

SEQ ID NO: 2143761 - protein, 8 aa, Cryptosporidium hominis
GPNSNSMT

SEQ ID NO: 2143762 - protein, 9 aa, Cryptosporidium hominis
GPNSSISPG

SEQ ID NO: 2143763 - protein, 9 aa, Cryptosporidium hominis
GPNYRSRHG

SEQ ID NO: 2143764 - protein, 4 aa, Cryptosporidium hominis
GPPF

SEQ ID NO: 2143765 - protein, 6 aa, Cryptosporidium hominis
GPPGCS

SEQ ID NO: 2143766 - protein, 8 aa, Cryptosporidium hominis
GPPGSGKT

SEQ ID NO: 2143767 - protein, 8 aa, Cryptosporidium hominis
GPPGTGKS

SEQ ID NO: 2143768 - protein, 11 aa, Cryptosporidium hominis
GPPGTGKTLTA

SEQ ID NO: 2143769 - protein, 11 aa, Cryptosporidium hominis
GPPGTGKTSTI

SEQ ID NO: 2143770 - protein, 9 aa, Cryptosporidium hominis
GPPGTGKTT

SEQ ID NO: 2143771 - protein, 12 aa, Cryptosporidium hominis
GPPGTGKTTSAK

SEQ ID NO: 2143772 - protein, 6 aa, Cryptosporidium hominis
GPPPED

SEQ ID NO: 2143773 - protein, 16 aa, Cryptosporidium hominis
GPQKCDPKTLPKGEES

SEQ ID NO: 2143774 - protein, 5 aa, Cryptosporidium hominis
GPQTF

SEQ ID NO: 2143775 - protein, 27 aa, Cryptosporidium hominis
GPQVPQNINGTSGPSGLAVTGSTGTIS

SEQ ID NO: 2143776 - protein, 8 aa, Cryptosporidium hominis
GPRASEKK

SEQ ID NO: 2143777 - protein, 11 aa, Cryptosporidium hominis
GPREGETKGRL

SEQ ID NO: 2143778 - protein, 6 aa, Cryptosporidium hominis
GPRNQS

SEQ ID NO: 2143779 - protein, 10 aa, Cryptosporidium hominis
GPRRTGRTTR

SEQ ID NO: 2143780 - protein, 5 aa, Cryptosporidium hominis
GPSDE

SEQ ID NO: 2143781 - protein, 5 aa, Cryptosporidium hominis
GPSGC

SEQ ID NO: 2143782 - protein, 11 aa, Cryptosporidium hominis
GPSKNRQQKSF

SEQ ID NO: 2143783 - protein, 10 aa, Cryptosporidium hominis
GPSKQSATIS

SEQ ID NO: 2143784 - protein, 7 aa, Cryptosporidium hominis
GPSKSRS

SEQ ID NO: 2143785 - protein, 6 aa, Cryptosporidium hominis
GPSLQR

SEQ ID NO: 2143786 - protein, 8 aa, Cryptosporidium hominis
GPSPPLGF

SEQ ID NO: 2143787 - protein, 11 aa, Cryptosporidium hominis
GPSPSDIKQTA

SEQ ID NO: 2143788 - protein, 9 aa, Cryptosporidium hominis
GPSQTIDTA

SEQ ID NO: 2143789 - protein, 16 aa, Cryptosporidium hominis
GPSQTQNQPQTQINPQ

SEQ ID NO: 2143790 - protein, 8 aa, Cryptosporidium hominis
GPSSWSET

SEQ ID NO: 2143791 - protein, 9 aa, Cryptosporidium hominis
GPSTNVARQ

SEQ ID NO: 2143792 - protein, 4 aa, Cryptosporidium hominis
GPTN

SEQ ID NO: 2143793 - protein, 5 aa, Cryptosporidium hominis
GPVAT

SEQ ID NO: 2143794 - protein, 5 aa, Cryptosporidium hominis
GPVKE

SEQ ID NO: 2143795 - protein, 7 aa, Cryptosporidium hominis
GPYISSE

SEQ ID NO: 2143796 - protein, 15 aa, Cryptosporidium hominis
GPYNEDESLGTEHSE

SEQ ID NO: 2143797 - protein, 6 aa, Cryptosporidium hominis
GQADAT

SEQ ID NO: 2143798 - protein, 20 aa, Cryptosporidium hominis
GQAGGAAGHAGGDDYSGHDE

SEQ ID NO: 2143799 - protein, 10 aa, Cryptosporidium hominis
GQAPPQPQGV

SEQ ID NO: 2143800 - protein, 7 aa, Cryptosporidium hominis
GQAPTSI

SEQ ID NO: 2143801 - protein, 4 aa, Cryptosporidium hominis
GQAV

SEQ ID NO: 2143802 - protein, 8 aa, Cryptosporidium hominis
GQDGHDLG

SEQ ID NO: 2143803 - protein, 16 aa, Cryptosporidium hominis
GQDGKINQYSVKDEAT

SEQ ID NO: 2143804 - protein, 7 aa, Cryptosporidium hominis
GQDHYDR

SEQ ID NO: 2143805 - protein, 5 aa, Cryptosporidium hominis
GQDQE

SEQ ID NO: 2143806 - protein, 4 aa, Cryptosporidium hominis
GQDT

SEQ ID NO: 2143807 - protein, 11 aa, Cryptosporidium hominis
GQEPRQTTSNI

SEQ ID NO: 2143808 - protein, 10 aa, Cryptosporidium hominis
GQERGMRSGT

SEQ ID NO: 2143809 - protein, 6 aa, Cryptosporidium hominis
GQFGNT

SEQ ID NO: 2143810 - protein, 8 aa, Cryptosporidium hominis
GQGDENQE

SEQ ID NO: 2143811 - protein, 9 aa, Cryptosporidium hominis
GQGESDQGE

SEQ ID NO: 2143812 - protein, 4 aa, Cryptosporidium hominis
GQGG

SEQ ID NO: 2143813 - protein, 5 aa, Cryptosporidium hominis
GQGGI

SEQ ID NO: 2143814 - protein, 8 aa, Cryptosporidium hominis
GQGGRPFA

SEQ ID NO: 2143815 - protein, 15 aa, Cryptosporidium hominis
GQGLGFGGGSTSNFS

SEQ ID NO: 2143816 - protein, 8 aa, Cryptosporidium hominis
GQGTYGKV

SEQ ID NO: 2143817 - protein, 23 aa, Cryptosporidium hominis
GQHSSSSNNNNSGNGISSSYGGV

SEQ ID NO: 2143818 - protein, 19 aa, Cryptosporidium hominis
GQHTKTTGRGSRAAAAAKK

SEQ ID NO: 2143819 - protein, 12 aa, Cryptosporidium hominis
GQIDDEEHISRE

SEQ ID NO: 2143820 - protein, 5 aa, Cryptosporidium hominis
GQIGG

SEQ ID NO: 2143821 - protein, 11 aa, Cryptosporidium hominis
GQINGQEKEDR

SEQ ID NO: 2143822 - protein, 15 aa, Cryptosporidium hominis
GQINTQEKDSLESKI

SEQ ID NO: 2143823 - protein, 6 aa, Cryptosporidium hominis
GQIQSV

SEQ ID NO: 2143824 - protein, 16 aa, Cryptosporidium hominis
GQKAGTAPIQSQKPEV

SEQ ID NO: 2143825 - protein, 7 aa, Cryptosporidium hominis
GQKKGLF

SEQ ID NO: 2143826 - protein, 28 aa, Cryptosporidium hominis
GQKNNSLKSSIANSKKCSKKISSTPKNE

SEQ ID NO: 2143827 - protein, 4 aa, Cryptosporidium hominis
GQKT

SEQ ID NO: 2143828 - protein, 11 aa, Cryptosporidium hominis
GQLNDSRINNK

SEQ ID NO: 2143829 - protein, 4 aa, Cryptosporidium hominis
GQLP

SEQ ID NO: 2143830 - protein, 8 aa, Cryptosporidium hominis
GQLPSKKS

SEQ ID NO: 2143831 - protein, 9 aa, Cryptosporidium hominis
GQLQSEKSD

SEQ ID NO: 2143832 - protein, 15 aa, Cryptosporidium hominis
GQLSSLDEKSKGMKS

SEQ ID NO: 2143833 - protein, 5 aa, Cryptosporidium hominis
GQMEG

SEQ ID NO: 2143834 - protein, 8 aa, Cryptosporidium hominis
GQNDGGLL

SEQ ID NO: 2143835 - protein, 6 aa, Cryptosporidium hominis
GQNEEA

SEQ ID NO: 2143836 - protein, 17 aa, Cryptosporidium hominis
GQNKEGRGVTEDSVEAR

SEQ ID NO: 2143837 - protein, 11 aa, Cryptosporidium hominis
GQNKTQSPTHF

SEQ ID NO: 2143838 - protein, 7 aa, Cryptosporidium hominis
GQNPTEA

SEQ ID NO: 2143839 - protein, 4 aa, Cryptosporidium hominis
GQNR

SEQ ID NO: 2143840 - protein, 25 aa, Cryptosporidium hominis
GQNSQIEDNHQQKNIGKKNNKLIQK

SEQ ID NO: 2143841 - protein, 17 aa, Cryptosporidium hominis
GQNTNDLRTNGGVKTRK

SEQ ID NO: 2143842 - protein, 4 aa, Cryptosporidium hominis
GQNV

SEQ ID NO: 2143843 - protein, 6 aa, Cryptosporidium hominis
GQNVQR

SEQ ID NO: 2143844 - protein, 7 aa, Cryptosporidium hominis
GQPFNSE

SEQ ID NO: 2143845 - protein, 8 aa, Cryptosporidium hominis
GQPGTGKT

SEQ ID NO: 2143846 - protein, 12 aa, Cryptosporidium hominis
GQPLNPYISPTD

SEQ ID NO: 2143847 - protein, 26 aa, Cryptosporidium hominis
GQQGEADIQTEQTEKKIVPDSTCPNN

SEQ ID NO: 2143848 - protein, 4 aa, Cryptosporidium hominis
GQQI

SEQ ID NO: 2143849 - protein, 11 aa, Cryptosporidium hominis
GQQNNNNNKNY

SEQ ID NO: 2143850 - protein, 13 aa, Cryptosporidium hominis
GQQRALEKQKQKI

SEQ ID NO: 2143851 - protein, 19 aa, Cryptosporidium hominis
GQRAGSGEFGSSLSPPTPF

SEQ ID NO: 2143852 - protein, 15 aa, Cryptosporidium hominis
GQREIRGNKNQSTGF

SEQ ID NO: 2143853 - protein, 21 aa, Cryptosporidium hominis
GQRGFSGSSGSTSVSSTGAIA

SEQ ID NO: 2143854 - protein, 4 aa, Cryptosporidium hominis
GQRK

SEQ ID NO: 2143855 - protein, 17 aa, Cryptosporidium hominis
GQRQQVGLTGKRSSDKL

SEQ ID NO: 2143856 - protein, 9 aa, Cryptosporidium hominis
GQRRRSKTF

SEQ ID NO: 2143857 - protein, 4 aa, Cryptosporidium hominis
GQRS

SEQ ID NO: 2143858 - protein, 10 aa, Cryptosporidium hominis
GQSAPKLKGK

SEQ ID NO: 2143859 - protein, 8 aa, Cryptosporidium hominis
GQSDSIEG

SEQ ID NO: 2143860 - protein, 7 aa, Cryptosporidium hominis
GQSEENI

SEQ ID NO: 2143861 - protein, 8 aa, Cryptosporidium hominis
GQSEGNLA

SEQ ID NO: 2143862 - protein, 9 aa, Cryptosporidium hominis
GQSGDRLTR

SEQ ID NO: 2143863 - protein, 28 aa, Cryptosporidium hominis
GQSGTLNSHNNTNNHQNSTTNQANNSVN

SEQ ID NO: 2143864 - protein, 35 aa, Cryptosporidium hominis
GQSKNSPSSRKRSGTRRQDESQASLQSNSEGNDDI

SEQ ID NO: 2143865 - protein, 6 aa, Cryptosporidium hominis
GQSLSS

SEQ ID NO: 2143866 - protein, 10 aa, Cryptosporidium hominis
GQSNKIEYSS

SEQ ID NO: 2143867 - protein, 15 aa, Cryptosporidium hominis
GQSSYLSRSSEDNRR

SEQ ID NO: 2143868 - protein, 6 aa, Cryptosporidium hominis
GQTEQA

SEQ ID NO: 2143869 - protein, 8 aa, Cryptosporidium hominis
GQTGSGKT

SEQ ID NO: 2143870 - protein, 9 aa, Cryptosporidium hominis
GQTGSGKTY

SEQ ID NO: 2143871 - protein, 10 aa, Cryptosporidium hominis
GQTKETISDQ

SEQ ID NO: 2143872 - protein, 7 aa, Cryptosporidium hominis
GQTPAGR

SEQ ID NO: 2143873 - protein, 22 aa, Cryptosporidium hominis
GQTQGQSYLQNSSSSHHSPSSF

SEQ ID NO: 2143874 - protein, 9 aa, Cryptosporidium hominis
GQTQNPTGV

SEQ ID NO: 2143875 - protein, 7 aa, Cryptosporidium hominis
GQTRSSA

SEQ ID NO: 2143876 - protein, 9 aa, Cryptosporidium hominis
GQTSSGKTF

SEQ ID NO: 2143877 - protein, 15 aa, Cryptosporidium hominis
GQVKSGSKSGDAKEE

SEQ ID NO: 2143878 - protein, 10 aa, Cryptosporidium hominis
GQVSEGFDDT

SEQ ID NO: 2143879 - protein, 13 aa, Cryptosporidium hominis
GQYKARSVAKNTE

SEQ ID NO: 2143880 - protein, 5 aa, Cryptosporidium hominis
GQYNS

SEQ ID NO: 2143881 - protein, 21 aa, Cryptosporidium hominis
GQYSRDMRNGQGTSRYTDGSV

SEQ ID NO: 2143882 - protein, 16 aa, Cryptosporidium hominis
GRAEAKFKGNMEINDT

SEQ ID NO: 2143883 - protein, 9 aa, Cryptosporidium hominis
GRAGRSQEA

SEQ ID NO: 2143884 - protein, 7 aa, Cryptosporidium hominis
GRAGRTG

SEQ ID NO: 2143885 - protein, 5 aa, Cryptosporidium hominis
GRAGV

SEQ ID NO: 2143886 - protein, 7 aa, Cryptosporidium hominis
GRANKTG

SEQ ID NO: 2143887 - protein, 5 aa, Cryptosporidium hominis
GRARS

SEQ ID NO: 2143888 - protein, 6 aa, Cryptosporidium hominis
GRAVSA

SEQ ID NO: 2143889 - protein, 9 aa, Cryptosporidium hominis
GRCKSSSVT

SEQ ID NO: 2143890 - protein, 12 aa, Cryptosporidium hominis
GRDGASKQNLAA

SEQ ID NO: 2143891 - protein, 6 aa, Cryptosporidium hominis
GRDKTL

SEQ ID NO: 2143892 - protein, 5 aa, Cryptosporidium hominis
GRDNE

SEQ ID NO: 2143893 - protein, 6 aa, Cryptosporidium hominis
GRDPID

SEQ ID NO: 2143894 - protein, 16 aa, Cryptosporidium hominis
GREAGQGSENIKSSLY

SEQ ID NO: 2143895 - protein, 4 aa, Cryptosporidium hominis
GRED

SEQ ID NO: 2143896 - protein, 12 aa, Cryptosporidium hominis
GREGTKLGSNDR

SEQ ID NO: 2143897 - protein, 4 aa, Cryptosporidium hominis
GREH

SEQ ID NO: 2143898 - protein, 7 aa, Cryptosporidium hominis
GRENISE

SEQ ID NO: 2143899 - protein, 13 aa, Cryptosporidium hominis
GREPSKGVNPDEA

SEQ ID NO: 2143900 - protein, 24 aa, Cryptosporidium hominis
GRESEEAKKLAQEKMNRSEALGDD

SEQ ID NO: 2143901 - protein, 4 aa, Cryptosporidium hominis
GRFG

SEQ ID NO: 2143902 - protein, 5 aa, Cryptosporidium hominis
GRFPE

SEQ ID NO: 2143903 - protein, 18 aa, Cryptosporidium hominis
GRFPTSSSLEKKGGFSAF

SEQ ID NO: 2143904 - protein, 5 aa, Cryptosporidium hominis
GRGDD

SEQ ID NO: 2143905 - protein, 9 aa, Cryptosporidium hominis
GRGEHPKSG

SEQ ID NO: 2143906 - protein, 12 aa, Cryptosporidium hominis
GRGEKRGDNGIR

SEQ ID NO: 2143907 - protein, 6 aa, Cryptosporidium hominis
GRGETR

SEQ ID NO: 2143908 - protein, 4 aa, Cryptosporidium hominis
GRGG

SEQ ID NO: 2143909 - protein, 52 aa, Cryptosporidium hominis
GRGGGGRGGGRGGGGRSPGGGRGGGGRSPGGGRGRGGGKGGRGGGGGMKGGS

SEQ ID NO: 2143910 - protein, 6 aa, Cryptosporidium hominis
GRGGGS

SEQ ID NO: 2143911 - protein, 4 aa, Cryptosporidium hominis
GRGI

SEQ ID NO: 2143912 - protein, 18 aa, Cryptosporidium hominis
GRGNPNSNSWQKKRNGKK

SEQ ID NO: 2143913 - protein, 7 aa, Cryptosporidium hominis
GRGPRST

SEQ ID NO: 2143914 - protein, 12 aa, Cryptosporidium hominis
GRGRSSSYNGFG

SEQ ID NO: 2143915 - protein, 6 aa, Cryptosporidium hominis
GRGSRN

SEQ ID NO: 2143916 - protein, 7 aa, Cryptosporidium hominis
GRGTSTF

SEQ ID NO: 2143917 - protein, 10 aa, Cryptosporidium hominis
GRGTSTFDGT

SEQ ID NO: 2143918 - protein, 4 aa, Cryptosporidium hominis
GRHD

SEQ ID NO: 2143919 - protein, 5 aa, Cryptosporidium hominis
GRHFT

SEQ ID NO: 2143920 - protein, 25 aa, Cryptosporidium hominis
GRHPPYPGGVPGQVHQNTKPKGPTL

SEQ ID NO: 2143921 - protein, 10 aa, Cryptosporidium hominis
GRIEGRNGSI

SEQ ID NO: 2143922 - protein, 18 aa, Cryptosporidium hominis
GRIGKGTYGSVKSGTNRL

SEQ ID NO: 2143923 - protein, 11 aa, Cryptosporidium hominis
GRIKSDKENLN

SEQ ID NO: 2143924 - protein, 10 aa, Cryptosporidium hominis
GRINGEQDLE

SEQ ID NO: 2143925 - protein, 12 aa, Cryptosporidium hominis
GRIPDEHDEQTK

SEQ ID NO: 2143926 - protein, 13 aa, Cryptosporidium hominis
GRISRSPSPVRGN

SEQ ID NO: 2143927 - protein, 10 aa, Cryptosporidium hominis
GRKAGKDANL

SEQ ID NO: 2143928 - protein, 5 aa, Cryptosporidium hominis
GRKDK

SEQ ID NO: 2143929 - protein, 6 aa, Cryptosporidium hominis
GRKDPI

SEQ ID NO: 2143930 - protein, 9 aa, Cryptosporidium hominis
GRKGGRKKV

SEQ ID NO: 2143931 - protein, 39 aa, Cryptosporidium hominis
GRKPSPPSESLATNMNSNSKASPSNKAPQSVISSSNSNV

SEQ ID NO: 2143932 - protein, 16 aa, Cryptosporidium hominis
GRKQRNGTARNHSAVA

SEQ ID NO: 2143933 - protein, 10 aa, Cryptosporidium hominis
GRKSTSSGVG

SEQ ID NO: 2143934 - protein, 9 aa, Cryptosporidium hominis
GRKYNLDNR

SEQ ID NO: 2143935 - protein, 13 aa, Cryptosporidium hominis
GRLHPAEEQVQRQ

SEQ ID NO: 2143936 - protein, 14 aa, Cryptosporidium hominis
GRLKAPSSSEAGGA

SEQ ID NO: 2143937 - protein, 19 aa, Cryptosporidium hominis
GRLPSKASYKTSKVNRSSV

SEQ ID NO: 2143938 - protein, 4 aa, Cryptosporidium hominis
GRMG

SEQ ID NO: 2143939 - protein, 4 aa, Cryptosporidium hominis
GRMQ

SEQ ID NO: 2143940 - protein, 15 aa, Cryptosporidium hominis
GRNCKGNYPLAKEDN

SEQ ID NO: 2143941 - protein, 4 aa, Cryptosporidium hominis
GRNG

SEQ ID NO: 2143942 - protein, 12 aa, Cryptosporidium hominis
GRNRTNKKRLRK

SEQ ID NO: 2143943 - protein, 12 aa, Cryptosporidium hominis
GRNTHKENPIGT

SEQ ID NO: 2143944 - protein, 6 aa, Cryptosporidium hominis
GRNTTN

SEQ ID NO: 2143945 - protein, 4 aa, Cryptosporidium hominis
GRPD

SEQ ID NO: 2143946 - protein, 9 aa, Cryptosporidium hominis
GRPDGQRKM

SEQ ID NO: 2143947 - protein, 4 aa, Cryptosporidium hominis
GRPF

SEQ ID NO: 2143948 - protein, 9 aa, Cryptosporidium hominis
GRPGNALEP

SEQ ID NO: 2143949 - protein, 5 aa, Cryptosporidium hominis
GRPIN

SEQ ID NO: 2143950 - protein, 5 aa, Cryptosporidium hominis
GRPIP

SEQ ID NO: 2143951 - protein, 4 aa, Cryptosporidium hominis
GRPK

SEQ ID NO: 2143952 - protein, 4 aa, Cryptosporidium hominis
GRPR

SEQ ID NO: 2143953 - protein, 4 aa, Cryptosporidium hominis
GRPS

SEQ ID NO: 2143954 - protein, 4 aa, Cryptosporidium hominis
GRPV

SEQ ID NO: 2143955 - protein, 6 aa, Cryptosporidium hominis
GRQFAR

SEQ ID NO: 2143956 - protein, 6 aa, Cryptosporidium hominis
GRQNHQ

SEQ ID NO: 2143957 - protein, 4 aa, Cryptosporidium hominis
GRQS

SEQ ID NO: 2143958 - protein, 16 aa, Cryptosporidium hominis
GRRAGSRGGGKRRGED

SEQ ID NO: 2143959 - protein, 13 aa, Cryptosporidium hominis
GRRHKQNSSESAI

SEQ ID NO: 2143960 - protein, 7 aa, Cryptosporidium hominis
GRRLEPT

SEQ ID NO: 2143961 - protein, 8 aa, Cryptosporidium hominis
GRRSCSPS

SEQ ID NO: 2143962 - protein, 13 aa, Cryptosporidium hominis
GRRSLGKGPFPQY

SEQ ID NO: 2143963 - protein, 15 aa, Cryptosporidium hominis
GRRSRTRGGAPEHHI

SEQ ID NO: 2143964 - protein, 4 aa, Cryptosporidium hominis
GRRY

SEQ ID NO: 2143965 - protein, 9 aa, Cryptosporidium hominis
GRSATGTNI

SEQ ID NO: 2143966 - protein, 7 aa, Cryptosporidium hominis
GRSDSFA

SEQ ID NO: 2143967 - protein, 8 aa, Cryptosporidium hominis
GRSGRFGQ

SEQ ID NO: 2143968 - protein, 8 aa, Cryptosporidium hominis
GRSKELSE

SEQ ID NO: 2143969 - protein, 5 aa, Cryptosporidium hominis
GRSKI

SEQ ID NO: 2143970 - protein, 22 aa, Cryptosporidium hominis
GRSLPSNTATNDKNNNSSYSNA

SEQ ID NO: 2143971 - protein, 9 aa, Cryptosporidium hominis
GRSLYRDDE

SEQ ID NO: 2143972 - protein, 40 aa, Cryptosporidium hominis
GRSQDQGQVQDQGQIQNQGQIQNQNQTQDHGQNRDQSLTL

SEQ ID NO: 2143973 - protein, 15 aa, Cryptosporidium hominis
GRSRSPNQRNFKKKE

SEQ ID NO: 2143974 - protein, 4 aa, Cryptosporidium hominis
GRSS

SEQ ID NO: 2143975 - protein, 45 aa, Cryptosporidium hominis
GRSSGRGGGSGRGGSSRGGSSRGGSGIGRLTGRGELGSGTTNHSN

SEQ ID NO: 2143976 - protein, 5 aa, Cryptosporidium hominis
GRSSI

SEQ ID NO: 2143977 - protein, 11 aa, Cryptosporidium hominis
GRSSSGRSGRK

SEQ ID NO: 2143978 - protein, 4 aa, Cryptosporidium hominis
GRST

SEQ ID NO: 2143979 - protein, 11 aa, Cryptosporidium hominis
GRTARAGQHGR

SEQ ID NO: 2143980 - protein, 10 aa, Cryptosporidium hominis
GRTARASRQG

SEQ ID NO: 2143981 - protein, 9 aa, Cryptosporidium hominis
GRTDSDATH

SEQ ID NO: 2143982 - protein, 8 aa, Cryptosporidium hominis
GRTDSEIG

SEQ ID NO: 2143983 - protein, 11 aa, Cryptosporidium hominis
GRTGRGGSVGV

SEQ ID NO: 2143984 - protein, 30 aa, Cryptosporidium hominis
GRTNSETSINSNSNNGNELESSSNISRNSS

SEQ ID NO: 2143985 - protein, 9 aa, Cryptosporidium hominis
GRTSESKAS

SEQ ID NO: 2143986 - protein, 6 aa, Cryptosporidium hominis
GRTTGL

SEQ ID NO: 2143987 - protein, 8 aa, Cryptosporidium hominis
GRVEPNNS

SEQ ID NO: 2143988 - protein, 6 aa, Cryptosporidium hominis
GRVEVS

SEQ ID NO: 2143989 - protein, 4 aa, Cryptosporidium hominis
GRVR

SEQ ID NO: 2143990 - protein, 7 aa, Cryptosporidium hominis
GRYAKRI

SEQ ID NO: 2143991 - protein, 7 aa, Cryptosporidium hominis
GRYCGGN

SEQ ID NO: 2143992 - protein, 4 aa, Cryptosporidium hominis
GRYG

SEQ ID NO: 2143993 - protein, 6 aa, Cryptosporidium hominis
GRYPPI

SEQ ID NO: 2143994 - protein, 7 aa, Cryptosporidium hominis
GSAADTQ

SEQ ID NO: 2143995 - protein, 4 aa, Cryptosporidium hominis
GSAE

SEQ ID NO: 2143996 - protein, 9 aa, Cryptosporidium hominis
GSAIPSPYR

SEQ ID NO: 2143997 - protein, 12 aa, Cryptosporidium hominis
GSAIRDDESREK

SEQ ID NO: 2143998 - protein, 7 aa, Cryptosporidium hominis
GSAPNAF

SEQ ID NO: 2143999 - protein, 12 aa, Cryptosporidium hominis
GSARDDNHNQVE

SEQ ID NO: 2144000 - protein, 6 aa, Cryptosporidium hominis
GSASAQ

SEQ ID NO: 2144001 - protein, 9 aa, Cryptosporidium hominis
GSASKRIST

SEQ ID NO: 2144002 - protein, 8 aa, Cryptosporidium hominis
GSASTAKR

SEQ ID NO: 2144003 - protein, 5 aa, Cryptosporidium hominis
GSATF

SEQ ID NO: 2144004 - protein, 27 aa, Cryptosporidium hominis
GSATNKTTSFGNSQTISNYSNGKVDEK

SEQ ID NO: 2144005 - protein, 7 aa, Cryptosporidium hominis
GSCGNHE

SEQ ID NO: 2144006 - protein, 65 aa, Cryptosporidium hominis
GSCVSDPTKLVSKNKSRSNRSSINGTQKNKRNSNVQSNFEDGDSGHSNNNKSQQSTQSATSNSSM

SEQ ID NO: 2144007 - protein, 9 aa, Cryptosporidium hominis
GSDALQPAI

SEQ ID NO: 2144008 - protein, 9 aa, Cryptosporidium hominis
GSDAQETVR

SEQ ID NO: 2144009 - protein, 5 aa, Cryptosporidium hominis
GSDAS

SEQ ID NO: 2144010 - protein, 6 aa, Cryptosporidium hominis
GSDDAT

SEQ ID NO: 2144011 - protein, 8 aa, Cryptosporidium hominis
GSDDGQVR

SEQ ID NO: 2144012 - protein, 7 aa, Cryptosporidium hominis
GSDENGI

SEQ ID NO: 2144013 - protein, 10 aa, Cryptosporidium hominis
GSDGGMSSGA

SEQ ID NO: 2144014 - protein, 8 aa, Cryptosporidium hominis
GSDGTMNK

SEQ ID NO: 2144015 - protein, 5 aa, Cryptosporidium hominis
GSDGV

SEQ ID NO: 2144016 - protein, 4 aa, Cryptosporidium hominis
GSDH

SEQ ID NO: 2144017 - protein, 10 aa, Cryptosporidium hominis
GSDNNTGNGN

SEQ ID NO: 2144018 - protein, 4 aa, Cryptosporidium hominis
GSDP

SEQ ID NO: 2144019 - protein, 4 aa, Cryptosporidium hominis
GSDQ

SEQ ID NO: 2144020 - protein, 7 aa, Cryptosporidium hominis
GSDQIEA

SEQ ID NO: 2144021 - protein, 16 aa, Cryptosporidium hominis
GSDQTPLSSKFESRAD

SEQ ID NO: 2144022 - protein, 10 aa, Cryptosporidium hominis
GSDSAESAKR

SEQ ID NO: 2144023 - protein, 26 aa, Cryptosporidium hominis
GSDSIPGAPKLTDEEALEKAKELQRR

SEQ ID NO: 2144024 - protein, 7 aa, Cryptosporidium hominis
GSDSTGN

SEQ ID NO: 2144025 - protein, 10 aa, Cryptosporidium hominis
GSDTSQGKGQ

SEQ ID NO: 2144026 - protein, 4 aa, Cryptosporidium hominis
GSDY

SEQ ID NO: 2144027 - protein, 8 aa, Cryptosporidium hominis
GSEEPLKR

SEQ ID NO: 2144028 - protein, 13 aa, Cryptosporidium hominis
GSEGSQNRTKDDI

SEQ ID NO: 2144029 - protein, 8 aa, Cryptosporidium hominis
GSEIQQGP

SEQ ID NO: 2144030 - protein, 6 aa, Cryptosporidium hominis
GSEKEC

SEQ ID NO: 2144031 - protein, 13 aa, Cryptosporidium hominis
GSEKETSTSLGPN

SEQ ID NO: 2144032 - protein, 14 aa, Cryptosporidium hominis
GSEKISKTGAEGLT

SEQ ID NO: 2144033 - protein, 8 aa, Cryptosporidium hominis
GSELRNKG

SEQ ID NO: 2144034 - protein, 22 aa, Cryptosporidium hominis
GSENIQRSGANAVKDRAKEAGM

SEQ ID NO: 2144035 - protein, 5 aa, Cryptosporidium hominis
GSEPD

SEQ ID NO: 2144036 - protein, 8 aa, Cryptosporidium hominis
GSEPRRLQ

SEQ ID NO: 2144037 - protein, 10 aa, Cryptosporidium hominis
GSEQSDKSEL

SEQ ID NO: 2144038 - protein, 12 aa, Cryptosporidium hominis
GSERASATQNRG

SEQ ID NO: 2144039 - protein, 23 aa, Cryptosporidium hominis
GSERGADTVHSTRQTQQDGAGIN

SEQ ID NO: 2144040 - protein, 13 aa, Cryptosporidium hominis
GSERRRGSGRYKF

SEQ ID NO: 2144041 - protein, 13 aa, Cryptosporidium hominis
GSERVNKSGVLGE

SEQ ID NO: 2144042 - protein, 44 aa, Cryptosporidium hominis
GSESEHNLTTNVEQRQKNQPISQQQPQAQSQKPSHSQQSNNSDF

SEQ ID NO: 2144043 - protein, 10 aa, Cryptosporidium hominis
GSESEYENKQ

SEQ ID NO: 2144044 - protein, 20 aa, Cryptosporidium hominis
GSESIKRTQLEGDRRKEGMS

SEQ ID NO: 2144045 - protein, 7 aa, Cryptosporidium hominis
GSESQRN

SEQ ID NO: 2144046 - protein, 23 aa, Cryptosporidium hominis
GSETEDSKAGDSSKKSELDEKSI

SEQ ID NO: 2144047 - protein, 6 aa, Cryptosporidium hominis
GSETQF

SEQ ID NO: 2144048 - protein, 50 aa, Cryptosporidium hominis
GSETSLDSNSNPISKSSSSPSSNSSSNSTSSSNSNSNSNSNSNSNSNFNT

SEQ ID NO: 2144049 - protein, 4 aa, Cryptosporidium hominis
GSEV

SEQ ID NO: 2144050 - protein, 6 aa, Cryptosporidium hominis
GSEVRA

SEQ ID NO: 2144051 - protein, 8 aa, Cryptosporidium hominis
GSFANDGS

SEQ ID NO: 2144052 - protein, 14 aa, Cryptosporidium hominis
GSFATENNSEESSQ

SEQ ID NO: 2144053 - protein, 8 aa, Cryptosporidium hominis
GSFEDPLD

SEQ ID NO: 2144054 - protein, 21 aa, Cryptosporidium hominis
GSFEEQQFNEKSTSDCQKVKN

SEQ ID NO: 2144055 - protein, 6 aa, Cryptosporidium hominis
GSFGSR

SEQ ID NO: 2144056 - protein, 15 aa, Cryptosporidium hominis
GSFKPLNTDSVPLNG

SEQ ID NO: 2144057 - protein, 49 aa, Cryptosporidium hominis
GSFSPHNSGTIDSSHKKRRKRANSGWDAQSNNSCNSPNLAPVPGNPHGH

SEQ ID NO: 2144058 - protein, 13 aa, Cryptosporidium hominis
GSFSQNSHLGSTG

SEQ ID NO: 2144059 - protein, 7 aa, Cryptosporidium hominis
GSFSSNA

SEQ ID NO: 2144060 - protein, 5 aa, Cryptosporidium hominis
GSFST

SEQ ID NO: 2144061 - protein, 10 aa, Cryptosporidium hominis
GSGALASSQD

SEQ ID NO: 2144062 - protein, 9 aa, Cryptosporidium hominis
GSGANASVF

SEQ ID NO: 2144063 - protein, 16 aa, Cryptosporidium hominis
GSGASISSSSTSFATQ

SEQ ID NO: 2144064 - protein, 5 aa, Cryptosporidium hominis
GSGAY

SEQ ID NO: 2144065 - protein, 14 aa, Cryptosporidium hominis
GSGFPQNQPSKPIL

SEQ ID NO: 2144066 - protein, 19 aa, Cryptosporidium hominis
GSGGIGTGTGQAGTGIGTG

SEQ ID NO: 2144067 - protein, 5 aa, Cryptosporidium hominis
GSGGN

SEQ ID NO: 2144068 - protein, 9 aa, Cryptosporidium hominis
GSGGSGGIE

SEQ ID NO: 2144069 - protein, 6 aa, Cryptosporidium hominis
GSGHRR

SEQ ID NO: 2144070 - protein, 9 aa, Cryptosporidium hominis
GSGKSTYCS

SEQ ID NO: 2144071 - protein, 6 aa, Cryptosporidium hominis
GSGKYS

SEQ ID NO: 2144072 - protein, 18 aa, Cryptosporidium hominis
GSGLGGSSSIEAALGSSG

SEQ ID NO: 2144073 - protein, 11 aa, Cryptosporidium hominis
GSGLGNSELNN

SEQ ID NO: 2144074 - protein, 7 aa, Cryptosporidium hominis
GSGLPPM

SEQ ID NO: 2144075 - protein, 21 aa, Cryptosporidium hominis
GSGNGSSSGITTGDDSSLKIS

SEQ ID NO: 2144076 - protein, 7 aa, Cryptosporidium hominis
GSGPNLE

SEQ ID NO: 2144077 - protein, 11 aa, Cryptosporidium hominis
GSGRKHERSLS

SEQ ID NO: 2144078 - protein, 5 aa, Cryptosporidium hominis
GSGSF

SEQ ID NO: 2144079 - protein, 6 aa, Cryptosporidium hominis
GSGSIE

SEQ ID NO: 2144080 - protein, 11 aa, Cryptosporidium hominis
GSGSRDTARNA

SEQ ID NO: 2144081 - protein, 21 aa, Cryptosporidium hominis
GSGSVYSSNPTLLSGNSGMNY

SEQ ID NO: 2144082 - protein, 4 aa, Cryptosporidium hominis
GSGT

SEQ ID NO: 2144083 - protein, 6 aa, Cryptosporidium hominis
GSGTFA

SEQ ID NO: 2144084 - protein, 9 aa, Cryptosporidium hominis
GSGTSGHVQ

SEQ ID NO: 2144085 - protein, 6 aa, Cryptosporidium hominis
GSGTTV

SEQ ID NO: 2144086 - protein, 6 aa, Cryptosporidium hominis
GSGTYG

SEQ ID NO: 2144087 - protein, 25 aa, Cryptosporidium hominis
GSGYGEGGGANGGDQIGGGNSLPPI

SEQ ID NO: 2144088 - protein, 6 aa, Cryptosporidium hominis
GSHGNT

SEQ ID NO: 2144089 - protein, 8 aa, Cryptosporidium hominis
GSHRAQRS

SEQ ID NO: 2144090 - protein, 6 aa, Cryptosporidium hominis
GSIDGA

SEQ ID NO: 2144091 - protein, 12 aa, Cryptosporidium hominis
GSIEKSTSSEKI

SEQ ID NO: 2144092 - protein, 4 aa, Cryptosporidium hominis
GSIG

SEQ ID NO: 2144093 - protein, 4 aa, Cryptosporidium hominis
GSIK

SEQ ID NO: 2144094 - protein, 8 aa, Cryptosporidium hominis
GSIKAREA

SEQ ID NO: 2144095 - protein, 9 aa, Cryptosporidium hominis
GSIKSNLSK

SEQ ID NO: 2144096 - protein, 10 aa, Cryptosporidium hominis
GSIRGTDRNA

SEQ ID NO: 2144097 - protein, 16 aa, Cryptosporidium hominis
GSISNSISNSNSSSIK

SEQ ID NO: 2144098 - protein, 6 aa, Cryptosporidium hominis
GSITSE

SEQ ID NO: 2144099 - protein, 15 aa, Cryptosporidium hominis
GSKCSGISNSIPQAT

SEQ ID NO: 2144100 - protein, 12 aa, Cryptosporidium hominis
GSKDESSGIQNN

SEQ ID NO: 2144101 - protein, 5 aa, Cryptosporidium hominis
GSKDV

SEQ ID NO: 2144102 - protein, 20 aa, Cryptosporidium hominis
GSKEFSQSELPKHTQNGNSK

SEQ ID NO: 2144103 - protein, 17 aa, Cryptosporidium hominis
GSKELDRDGGHRGRGWS

SEQ ID NO: 2144104 - protein, 5 aa, Cryptosporidium hominis
GSKGF

SEQ ID NO: 2144105 - protein, 8 aa, Cryptosporidium hominis
GSKGSTIN

SEQ ID NO: 2144106 - protein, 8 aa, Cryptosporidium hominis
GSKINSDI

SEQ ID NO: 2144107 - protein, 9 aa, Cryptosporidium hominis
GSKKDSVGR

SEQ ID NO: 2144108 - protein, 7 aa, Cryptosporidium hominis
GSKKIDQ

SEQ ID NO: 2144109 - protein, 5 aa, Cryptosporidium hominis
GSKNI

SEQ ID NO: 2144110 - protein, 10 aa, Cryptosporidium hominis
GSKNSKSNSK

SEQ ID NO: 2144111 - protein, 5 aa, Cryptosporidium hominis
GSKRI

SEQ ID NO: 2144112 - protein, 8 aa, Cryptosporidium hominis
GSKRTRTR

SEQ ID NO: 2144113 - protein, 4 aa, Cryptosporidium hominis
GSKS

SEQ ID NO: 2144114 - protein, 23 aa, Cryptosporidium hominis
GSKSGKSIKPNNRSSIGGNSCVS

SEQ ID NO: 2144115 - protein, 9 aa, Cryptosporidium hominis
GSKSNSHIK

SEQ ID NO: 2144116 - protein, 10 aa, Cryptosporidium hominis
GSKSPNVSTK

SEQ ID NO: 2144117 - protein, 5 aa, Cryptosporidium hominis
GSKTR

SEQ ID NO: 2144118 - protein, 12 aa, Cryptosporidium hominis
GSKYNGKELKSN

SEQ ID NO: 2144119 - protein, 11 aa, Cryptosporidium hominis
GSLGESSENSI

SEQ ID NO: 2144120 - protein, 4 aa, Cryptosporidium hominis
GSLK

SEQ ID NO: 2144121 - protein, 9 aa, Cryptosporidium hominis
GSLKATSIE

SEQ ID NO: 2144122 - protein, 4 aa, Cryptosporidium hominis
GSLQ

SEQ ID NO: 2144123 - protein, 8 aa, Cryptosporidium hominis
GSLSENNS

SEQ ID NO: 2144124 - protein, 8 aa, Cryptosporidium hominis
GSLSESSA

SEQ ID NO: 2144125 - protein, 10 aa, Cryptosporidium hominis
GSLTVNGPFS

SEQ ID NO: 2144126 - protein, 19 aa, Cryptosporidium hominis
GSMNYGGAGDSVKDSNQSI

SEQ ID NO: 2144127 - protein, 36 aa, Cryptosporidium hominis
GSNDESDLSDENNDDCDTNNSDIDEDDSHSPVRSSR

SEQ ID NO: 2144128 - protein, 6 aa, Cryptosporidium hominis
GSNDGY

SEQ ID NO: 2144129 - protein, 12 aa, Cryptosporidium hominis
GSNESAINKNRE

SEQ ID NO: 2144130 - protein, 6 aa, Cryptosporidium hominis
GSNGET

SEQ ID NO: 2144131 - protein, 5 aa, Cryptosporidium hominis
GSNGI

SEQ ID NO: 2144132 - protein, 7 aa, Cryptosporidium hominis
GSNGQRL

SEQ ID NO: 2144133 - protein, 9 aa, Cryptosporidium hominis
GSNGYRTIG

SEQ ID NO: 2144134 - protein, 5 aa, Cryptosporidium hominis
GSNKS

SEQ ID NO: 2144135 - protein, 6 aa, Cryptosporidium hominis
GSNKSS

SEQ ID NO: 2144136 - protein, 18 aa, Cryptosporidium hominis
GSNLAQNSISGSGIGEHP

SEQ ID NO: 2144137 - protein, 13 aa, Cryptosporidium hominis
GSNLTENKLENRD

SEQ ID NO: 2144138 - protein, 5 aa, Cryptosporidium hominis
GSNMI

SEQ ID NO: 2144139 - protein, 4 aa, Cryptosporidium hominis
GSNN

SEQ ID NO: 2144140 - protein, 9 aa, Cryptosporidium hominis
GSNNGNNRF

SEQ ID NO: 2144141 - protein, 13 aa, Cryptosporidium hominis
GSNNNIGNQSQRS

SEQ ID NO: 2144142 - protein, 10 aa, Cryptosporidium hominis
GSNNSSPNRN

SEQ ID NO: 2144143 - protein, 32 aa, Cryptosporidium hominis
GSNPNAVNGTGGNSAGNGVKSVGGNNPDVDNL

SEQ ID NO: 2144144 - protein, 8 aa, Cryptosporidium hominis
GSNQKGGN

SEQ ID NO: 2144145 - protein, 6 aa, Cryptosporidium hominis
GSNQTS

SEQ ID NO: 2144146 - protein, 16 aa, Cryptosporidium hominis
GSNSGGTLNIQTDETR

SEQ ID NO: 2144147 - protein, 9 aa, Cryptosporidium hominis
GSNSNLDAN

SEQ ID NO: 2144148 - protein, 15 aa, Cryptosporidium hominis
GSNSRYNTELSQSSA

SEQ ID NO: 2144149 - protein, 9 aa, Cryptosporidium hominis
GSNTNEATE

SEQ ID NO: 2144150 - protein, 6 aa, Cryptosporidium hominis
GSNTQI

SEQ ID NO: 2144151 - protein, 9 aa, Cryptosporidium hominis
GSPDREGTV

SEQ ID NO: 2144152 - protein, 7 aa, Cryptosporidium hominis
GSPDVTG

SEQ ID NO: 2144153 - protein, 4 aa, Cryptosporidium hominis
GSPE

SEQ ID NO: 2144154 - protein, 8 aa, Cryptosporidium hominis
GSPESTKA

SEQ ID NO: 2144155 - protein, 6 aa, Cryptosporidium hominis
GSPGTI

SEQ ID NO: 2144156 - protein, 6 aa, Cryptosporidium hominis
GSPGTK

SEQ ID NO: 2144157 - protein, 4 aa, Cryptosporidium hominis
GSPI

SEQ ID NO: 2144158 - protein, 12 aa, Cryptosporidium hominis
GSPKVNDSENFS

SEQ ID NO: 2144159 - protein, 6 aa, Cryptosporidium hominis
GSPMNP

SEQ ID NO: 2144160 - protein, 5 aa, Cryptosporidium hominis
GSPMQ

SEQ ID NO: 2144161 - protein, 4 aa, Cryptosporidium hominis
GSPR

SEQ ID NO: 2144162 - protein, 35 aa, Cryptosporidium hominis
GSPSMQTNDSGNLSNINNQNGASNNGNDNGGQNYN

SEQ ID NO: 2144163 - protein, 6 aa, Cryptosporidium hominis
GSPYTN

SEQ ID NO: 2144164 - protein, 9 aa, Cryptosporidium hominis
GSQAQGKKT

SEQ ID NO: 2144165 - protein, 5 aa, Cryptosporidium hominis
GSQDI

SEQ ID NO: 2144166 - protein, 6 aa, Cryptosporidium hominis
GSQGEE

SEQ ID NO: 2144167 - protein, 10 aa, Cryptosporidium hominis
GSQGSSSGFI

SEQ ID NO: 2144168 - protein, 4 aa, Cryptosporidium hominis
GSQH

SEQ ID NO: 2144169 - protein, 13 aa, Cryptosporidium hominis
GSQKDLDKTPESL

SEQ ID NO: 2144170 - protein, 13 aa, Cryptosporidium hominis
GSQLSREYDHDSS

SEQ ID NO: 2144171 - protein, 12 aa, Cryptosporidium hominis
GSQNIPKNSANT

SEQ ID NO: 2144172 - protein, 7 aa, Cryptosporidium hominis
GSQNKNN

SEQ ID NO: 2144173 - protein, 14 aa, Cryptosporidium hominis
GSQQPNASGNSLQN

SEQ ID NO: 2144174 - protein, 5 aa, Cryptosporidium hominis
GSQRS

SEQ ID NO: 2144175 - protein, 8 aa, Cryptosporidium hominis
GSQSSSLV

SEQ ID NO: 2144176 - protein, 9 aa, Cryptosporidium hominis
GSQSTDKRK

SEQ ID NO: 2144177 - protein, 7 aa, Cryptosporidium hominis
GSQTCSY

SEQ ID NO: 2144178 - protein, 5 aa, Cryptosporidium hominis
GSRGL

SEQ ID NO: 2144179 - protein, 8 aa, Cryptosporidium hominis
GSRIPSIS

SEQ ID NO: 2144180 - protein, 17 aa, Cryptosporidium hominis
GSRLSSGSKDCIVKIWR

SEQ ID NO: 2144181 - protein, 4 aa, Cryptosporidium hominis
GSRM

SEQ ID NO: 2144182 - protein, 58 aa, Cryptosporidium hominis
GSRNGEGRGGFGGGGRDGFGGGRDGFGGGRGGRGGFGGDGLTGGRGRTGDYRGDPGHH

SEQ ID NO: 2144183 - protein, 7 aa, Cryptosporidium hominis
GSRPGDE

SEQ ID NO: 2144184 - protein, 5 aa, Cryptosporidium hominis
GSRPI

SEQ ID NO: 2144185 - protein, 13 aa, Cryptosporidium hominis
GSRPSKRKSGGIE

SEQ ID NO: 2144186 - protein, 62 aa, Cryptosporidium hominis
GSRRPIEECSSNHNEDNSNRNKSRNNSENNERSVNGGGISVNNENSDRRNVSSDVNRNNGNP

SEQ ID NO: 2144187 - protein, 10 aa, Cryptosporidium hominis
GSRSQASKTY

SEQ ID NO: 2144188 - protein, 4 aa, Cryptosporidium hominis
GSSA

SEQ ID NO: 2144189 - protein, 8 aa, Cryptosporidium hominis
GSSCTDPV

SEQ ID NO: 2144190 - protein, 4 aa, Cryptosporidium hominis
GSSD

SEQ ID NO: 2144191 - protein, 4 aa, Cryptosporidium hominis
GSSE

SEQ ID NO: 2144192 - protein, 8 aa, Cryptosporidium hominis
GSSEADIS

SEQ ID NO: 2144193 - protein, 11 aa, Cryptosporidium hominis
GSSEAKNTSQV

SEQ ID NO: 2144194 - protein, 7 aa, Cryptosporidium hominis
GSSGKTS

SEQ ID NO: 2144195 - protein, 11 aa, Cryptosporidium hominis
GSSGSSINVEN

SEQ ID NO: 2144196 - protein, 10 aa, Cryptosporidium hominis
GSSGTNGGRQ

SEQ ID NO: 2144197 - protein, 5 aa, Cryptosporidium hominis
GSSIA

SEQ ID NO: 2144198 - protein, 7 aa, Cryptosporidium hominis
GSSIEEY

SEQ ID NO: 2144199 - protein, 22 aa, Cryptosporidium hominis
GSSIGTGNTSGNSVSNNSTYQD

SEQ ID NO: 2144200 - protein, 6 aa, Cryptosporidium hominis
GSSIST

SEQ ID NO: 2144201 - protein, 6 aa, Cryptosporidium hominis
GSSKKK

SEQ ID NO: 2144202 - protein, 12 aa, Cryptosporidium hominis
GSSLGGSPIGGN

SEQ ID NO: 2144203 - protein, 10 aa, Cryptosporidium hominis
GSSNINDQSS

SEQ ID NO: 2144204 - protein, 9 aa, Cryptosporidium hominis
GSSNSGKST

SEQ ID NO: 2144205 - protein, 12 aa, Cryptosporidium hominis
GSSNVDGNDNIG

SEQ ID NO: 2144206 - protein, 13 aa, Cryptosporidium hominis
GSSNYNYRSTNKD

SEQ ID NO: 2144207 - protein, 9 aa, Cryptosporidium hominis
GSSPDSRFD

SEQ ID NO: 2144208 - protein, 5 aa, Cryptosporidium hominis
GSSQG

SEQ ID NO: 2144209 - protein, 29 aa, Cryptosporidium hominis
GSSQINSQERDQDHARNEGNSNNATSSNF

SEQ ID NO: 2144210 - protein, 10 aa, Cryptosporidium hominis
GSSQPSLNPK

SEQ ID NO: 2144211 - protein, 6 aa, Cryptosporidium hominis
GSSQTS

SEQ ID NO: 2144212 - protein, 9 aa, Cryptosporidium hominis
GSSQTSNED

SEQ ID NO: 2144213 - protein, 4 aa, Cryptosporidium hominis
GSSR

SEQ ID NO: 2144214 - protein, 5 aa, Cryptosporidium hominis
GSSSA

SEQ ID NO: 2144215 - protein, 16 aa, Cryptosporidium hominis
GSSSDQSNSSLINRPQ

SEQ ID NO: 2144216 - protein, 12 aa, Cryptosporidium hominis
GSSSDSWPRQPA

SEQ ID NO: 2144217 - protein, 7 aa, Cryptosporidium hominis
GSSSGIS

SEQ ID NO: 2144218 - protein, 11 aa, Cryptosporidium hominis
GSSSKEDSNAI

SEQ ID NO: 2144219 - protein, 18 aa, Cryptosporidium hominis
GSSSKKKSKLYAPKHPNF

SEQ ID NO: 2144220 - protein, 10 aa, Cryptosporidium hominis
GSSSKWVPKE

SEQ ID NO: 2144221 - protein, 9 aa, Cryptosporidium hominis
GSSSNEGYN

SEQ ID NO: 2144222 - protein, 5 aa, Cryptosporidium hominis
GSSSR

SEQ ID NO: 2144223 - protein, 18 aa, Cryptosporidium hominis
GSSSSIEWNPSGVEQSQE

SEQ ID NO: 2144224 - protein, 14 aa, Cryptosporidium hominis
GSSSTGTRSGLSNY

SEQ ID NO: 2144225 - protein, 18 aa, Cryptosporidium hominis
GSSTKNTNSNAGNSSGTN

SEQ ID NO: 2144226 - protein, 12 aa, Cryptosporidium hominis
GSSTPPSHLGPN

SEQ ID NO: 2144227 - protein, 5 aa, Cryptosporidium hominis
GSSTS

SEQ ID NO: 2144228 - protein, 4 aa, Cryptosporidium hominis
GSSV

SEQ ID NO: 2144229 - protein, 23 aa, Cryptosporidium hominis
GSTATNHTIKDTGNYNIDQPSKG

SEQ ID NO: 2144230 - protein, 7 aa, Cryptosporidium hominis
GSTGSNV

SEQ ID NO: 2144231 - protein, 4 aa, Cryptosporidium hominis
GSTK

SEQ ID NO: 2144232 - protein, 25 aa, Cryptosporidium hominis
GSTMPSKDVSSVKPGIDEDAKSSLD

SEQ ID NO: 2144233 - protein, 8 aa, Cryptosporidium hominis
GSTNGSLN

SEQ ID NO: 2144234 - protein, 5 aa, Cryptosporidium hominis
GSTNK

SEQ ID NO: 2144235 - protein, 9 aa, Cryptosporidium hominis
GSTPGIERQ

SEQ ID NO: 2144236 - protein, 7 aa, Cryptosporidium hominis
GSTPLPS

SEQ ID NO: 2144237 - protein, 4 aa, Cryptosporidium hominis
GSTR

SEQ ID NO: 2144238 - protein, 13 aa, Cryptosporidium hominis
GSTRPGEAAPGTI

SEQ ID NO: 2144239 - protein, 9 aa, Cryptosporidium hominis
GSTRSTGPN

SEQ ID NO: 2144240 - protein, 16 aa, Cryptosporidium hominis
GSTSESKTKFRTGESI

SEQ ID NO: 2144241 - protein, 7 aa, Cryptosporidium hominis
GSTSITR

SEQ ID NO: 2144242 - protein, 9 aa, Cryptosporidium hominis
GSTSNQTKN

SEQ ID NO: 2144243 - protein, 4 aa, Cryptosporidium hominis
GSTT

SEQ ID NO: 2144244 - protein, 12 aa, Cryptosporidium hominis
GSTVGQCSKEES

SEQ ID NO: 2144245 - protein, 7 aa, Cryptosporidium hominis
GSVDNTA

SEQ ID NO: 2144246 - protein, 9 aa, Cryptosporidium hominis
GSVGKGPGV

SEQ ID NO: 2144247 - protein, 5 aa, Cryptosporidium hominis
GSVNN

SEQ ID NO: 2144248 - protein, 6 aa, Cryptosporidium hominis
GSVPHS

SEQ ID NO: 2144249 - protein, 7 aa, Cryptosporidium hominis
GSVPNKS

SEQ ID NO: 2144250 - protein, 4 aa, Cryptosporidium hominis
GSVS

SEQ ID NO: 2144251 - protein, 6 aa, Cryptosporidium hominis
GSVSKR

SEQ ID NO: 2144252 - protein, 26 aa, Cryptosporidium hominis
GSVSQHNGNNNNKSLLSSSSSSIKSM

SEQ ID NO: 2144253 - protein, 5 aa, Cryptosporidium hominis
GSVSS

SEQ ID NO: 2144254 - protein, 8 aa, Cryptosporidium hominis
GSYIENKG

SEQ ID NO: 2144255 - protein, 24 aa, Cryptosporidium hominis
GSYKRKNKSLAEYSESCDSIKTEE

SEQ ID NO: 2144256 - protein, 8 aa, Cryptosporidium hominis
GSYPNGYR

SEQ ID NO: 2144257 - protein, 7 aa, Cryptosporidium hominis
GSYSAAK

SEQ ID NO: 2144258 - protein, 5 aa, Cryptosporidium hominis
GSYSP

SEQ ID NO: 2144259 - protein, 10 aa, Cryptosporidium hominis
GSYSTSSLPA

SEQ ID NO: 2144260 - protein, 5 aa, Cryptosporidium hominis
GSYYD

SEQ ID NO: 2144261 - protein, 20 aa, Cryptosporidium hominis
GSYYDNPKFDGAPRNYRNDR

SEQ ID NO: 2144262 - protein, 8 aa, Cryptosporidium hominis
GTAEYEKP

SEQ ID NO: 2144263 - protein, 15 aa, Cryptosporidium hominis
GTALESDDKTVSQNE

SEQ ID NO: 2144264 - protein, 5 aa, Cryptosporidium hominis
GTANG

SEQ ID NO: 2144265 - protein, 5 aa, Cryptosporidium hominis
GTAQI

SEQ ID NO: 2144266 - protein, 5 aa, Cryptosporidium hominis
GTASD

SEQ ID NO: 2144267 - protein, 4 aa, Cryptosporidium hominis
GTAY

SEQ ID NO: 2144268 - protein, 4 aa, Cryptosporidium hominis
GTCE

SEQ ID NO: 2144269 - protein, 11 aa, Cryptosporidium hominis
GTCSGTPKNLN

SEQ ID NO: 2144270 - protein, 8 aa, Cryptosporidium hominis
GTDDESFS

SEQ ID NO: 2144271 - protein, 11 aa, Cryptosporidium hominis
GTDKRISGNEI

SEQ ID NO: 2144272 - protein, 12 aa, Cryptosporidium hominis
GTDNTSKQIGKE

SEQ ID NO: 2144273 - protein, 7 aa, Cryptosporidium hominis
GTDSDDF

SEQ ID NO: 2144274 - protein, 12 aa, Cryptosporidium hominis
GTDSQSSSNNIE

SEQ ID NO: 2144275 - protein, 9 aa, Cryptosporidium hominis
GTDTNQVPN

SEQ ID NO: 2144276 - protein, 6 aa, Cryptosporidium hominis
GTEDDR

SEQ ID NO: 2144277 - protein, 7 aa, Cryptosporidium hominis
GTEGFNG

SEQ ID NO: 2144278 - protein, 8 aa, Cryptosporidium hominis
GTEGNKRE

SEQ ID NO: 2144279 - protein, 10 aa, Cryptosporidium hominis
GTEGSIAGDG

SEQ ID NO: 2144280 - protein, 4 aa, Cryptosporidium hominis
GTEI

SEQ ID NO: 2144281 - protein, 13 aa, Cryptosporidium hominis
GTEIDSSTEDKDL

SEQ ID NO: 2144282 - protein, 10 aa, Cryptosporidium hominis
GTEKEKIGNL

SEQ ID NO: 2144283 - protein, 5 aa, Cryptosporidium hominis
GTENI

SEQ ID NO: 2144284 - protein, 9 aa, Cryptosporidium hominis
GTESQRMET

SEQ ID NO: 2144285 - protein, 10 aa, Cryptosporidium hominis
GTESTTEDIY

SEQ ID NO: 2144286 - protein, 5 aa, Cryptosporidium hominis
GTETA

SEQ ID NO: 2144287 - protein, 5 aa, Cryptosporidium hominis
GTFDP

SEQ ID NO: 2144288 - protein, 17 aa, Cryptosporidium hominis
GTFSSRKKSSFTRKRSK

SEQ ID NO: 2144289 - protein, 8 aa, Cryptosporidium hominis
GTFTGTSI

SEQ ID NO: 2144290 - protein, 5 aa, Cryptosporidium hominis
GTGDI

SEQ ID NO: 2144291 - protein, 10 aa, Cryptosporidium hominis
GTGEGLKENN

SEQ ID NO: 2144292 - protein, 15 aa, Cryptosporidium hominis
GTGGCNNNASSNTQD

SEQ ID NO: 2144293 - protein, 42 aa, Cryptosporidium hominis
GTGGDPNKTTRSDLTNEDLGSSTTNEQNTVQEYNSPKSNDIP

SEQ ID NO: 2144294 - protein, 6 aa, Cryptosporidium hominis
GTGKGL

SEQ ID NO: 2144295 - protein, 7 aa, Cryptosporidium hominis
GTGMPAS

SEQ ID NO: 2144296 - protein, 8 aa, Cryptosporidium hominis
GTGNDLSR

SEQ ID NO: 2144297 - protein, 11 aa, Cryptosporidium hominis
GTGNKSNNDIR

SEQ ID NO: 2144298 - protein, 48 aa, Cryptosporidium hominis
GTGNTPSSNNKSKPTKLEKVPENEESGDSSTKNESESLSKTIKPSNAG

SEQ ID NO: 2144299 - protein, 17 aa, Cryptosporidium hominis
GTGRATNKITNLGAKGH

SEQ ID NO: 2144300 - protein, 23 aa, Cryptosporidium hominis
GTGRGREAPGGVGGRRKGGGGEC

SEQ ID NO: 2144301 - protein, 17 aa, Cryptosporidium hominis
GTGSGSGSGSGSESDGV

SEQ ID NO: 2144302 - protein, 5 aa, Cryptosporidium hominis
GTGSI

SEQ ID NO: 2144303 - protein, 6 aa, Cryptosporidium hominis
GTGSVG

SEQ ID NO: 2144304 - protein, 20 aa, Cryptosporidium hominis
GTGTGSLSRTTSNLSPAQQN

SEQ ID NO: 2144305 - protein, 5 aa, Cryptosporidium hominis
GTGTY

SEQ ID NO: 2144306 - protein, 17 aa, Cryptosporidium hominis
GTHGFEENGEKNKKQKF

SEQ ID NO: 2144307 - protein, 19 aa, Cryptosporidium hominis
GTHKKDEARNINNTKDIDL

SEQ ID NO: 2144308 - protein, 9 aa, Cryptosporidium hominis
GTHPTHGRG

SEQ ID NO: 2144309 - protein, 10 aa, Cryptosporidium hominis
GTHSTLTTKQ

SEQ ID NO: 2144310 - protein, 6 aa, Cryptosporidium hominis
GTIDYN

SEQ ID NO: 2144311 - protein, 4 aa, Cryptosporidium hominis
GTIE

SEQ ID NO: 2144312 - protein, 6 aa, Cryptosporidium hominis
GTIPEE

SEQ ID NO: 2144313 - protein, 6 aa, Cryptosporidium hominis
GTIPQS

SEQ ID NO: 2144314 - protein, 15 aa, Cryptosporidium hominis
GTISDTGNKSGAMNT

SEQ ID NO: 2144315 - protein, 11 aa, Cryptosporidium hominis
GTITTSETAHN

SEQ ID NO: 2144316 - protein, 16 aa, Cryptosporidium hominis
GTKAQTLKRGFLDYSK

SEQ ID NO: 2144317 - protein, 10 aa, Cryptosporidium hominis
GTKEREGNNA

SEQ ID NO: 2144318 - protein, 7 aa, Cryptosporidium hominis
GTKGGEN

SEQ ID NO: 2144319 - protein, 6 aa, Cryptosporidium hominis
GTKITS

SEQ ID NO: 2144320 - protein, 6 aa, Cryptosporidium hominis
GTKNVE

SEQ ID NO: 2144321 - protein, 11 aa, Cryptosporidium hominis
GTKPSTKNETL

SEQ ID NO: 2144322 - protein, 11 aa, Cryptosporidium hominis
GTLANNENQLS

SEQ ID NO: 2144323 - protein, 5 aa, Cryptosporidium hominis
GTLDS

SEQ ID NO: 2144324 - protein, 19 aa, Cryptosporidium hominis
GTLEGSKENFKNSEENSPI

SEQ ID NO: 2144325 - protein, 4 aa, Cryptosporidium hominis
GTLP

SEQ ID NO: 2144326 - protein, 5 aa, Cryptosporidium hominis
GTLPE

SEQ ID NO: 2144327 - protein, 6 aa, Cryptosporidium hominis
GTLSEK

SEQ ID NO: 2144328 - protein, 5 aa, Cryptosporidium hominis
GTLTP

SEQ ID NO: 2144329 - protein, 7 aa, Cryptosporidium hominis
GTMGKEL

SEQ ID NO: 2144330 - protein, 12 aa, Cryptosporidium hominis
GTMPSQELNKED

SEQ ID NO: 2144331 - protein, 5 aa, Cryptosporidium hominis
GTNEI

SEQ ID NO: 2144332 - protein, 4 aa, Cryptosporidium hominis
GTNI

SEQ ID NO: 2144333 - protein, 8 aa, Cryptosporidium hominis
GTNIPKNS

SEQ ID NO: 2144334 - protein, 14 aa, Cryptosporidium hominis
GTNNNDKEKSSKKA

SEQ ID NO: 2144335 - protein, 5 aa, Cryptosporidium hominis
GTNNS

SEQ ID NO: 2144336 - protein, 7 aa, Cryptosporidium hominis
GTNQQKI

SEQ ID NO: 2144337 - protein, 10 aa, Cryptosporidium hominis
GTNRTSTVPS

SEQ ID NO: 2144338 - protein, 4 aa, Cryptosporidium hominis
GTNS

SEQ ID NO: 2144339 - protein, 11 aa, Cryptosporidium hominis
GTNSQQASSLR

SEQ ID NO: 2144340 - protein, 7 aa, Cryptosporidium hominis
GTNTNDI

SEQ ID NO: 2144341 - protein, 11 aa, Cryptosporidium hominis
GTNTNNISPGN

SEQ ID NO: 2144342 - protein, 5 aa, Cryptosporidium hominis
GTPEK

SEQ ID NO: 2144343 - protein, 5 aa, Cryptosporidium hominis
GTPGR

SEQ ID NO: 2144344 - protein, 4 aa, Cryptosporidium hominis
GTPI

SEQ ID NO: 2144345 - protein, 14 aa, Cryptosporidium hominis
GTPKKLRRSSRLKS

SEQ ID NO: 2144346 - protein, 8 aa, Cryptosporidium hominis
GTPPDIKK

SEQ ID NO: 2144347 - protein, 5 aa, Cryptosporidium hominis
GTPQY

SEQ ID NO: 2144348 - protein, 24 aa, Cryptosporidium hominis
GTPRRVNSNSSKEGQSKKKRDLEV

SEQ ID NO: 2144349 - protein, 8 aa, Cryptosporidium hominis
GTPSPNIT

SEQ ID NO: 2144350 - protein, 18 aa, Cryptosporidium hominis
GTPTYEYGDPREGEHKQW

SEQ ID NO: 2144351 - protein, 14 aa, Cryptosporidium hominis
GTQNNTPNKPTNTY

SEQ ID NO: 2144352 - protein, 17 aa, Cryptosporidium hominis
GTQPKVLENSEGMRTTP

SEQ ID NO: 2144353 - protein, 20 aa, Cryptosporidium hominis
GTQPSAGQNTGLKSPNSGGI

SEQ ID NO: 2144354 - protein, 22 aa, Cryptosporidium hominis
GTQSINEEDGNIHSTGSYSPFG

SEQ ID NO: 2144355 - protein, 6 aa, Cryptosporidium hominis
GTRFGG

SEQ ID NO: 2144356 - protein, 19 aa, Cryptosporidium hominis
GTRKYHSENIDNPTNLSIG

SEQ ID NO: 2144357 - protein, 4 aa, Cryptosporidium hominis
GTRN

SEQ ID NO: 2144358 - protein, 6 aa, Cryptosporidium hominis
GTRQGS

SEQ ID NO: 2144359 - protein, 8 aa, Cryptosporidium hominis
GTRTEPNE

SEQ ID NO: 2144360 - protein, 8 aa, Cryptosporidium hominis
GTSAQDAP

SEQ ID NO: 2144361 - protein, 7 aa, Cryptosporidium hominis
GTSCEPP

SEQ ID NO: 2144362 - protein, 12 aa, Cryptosporidium hominis
GTSDPSQEVSPE

SEQ ID NO: 2144363 - protein, 16 aa, Cryptosporidium hominis
GTSDQSIQEKKLENKL

SEQ ID NO: 2144364 - protein, 10 aa, Cryptosporidium hominis
GTSEEKESKI

SEQ ID NO: 2144365 - protein, 10 aa, Cryptosporidium hominis
GTSERGEPVD

SEQ ID NO: 2144366 - protein, 10 aa, Cryptosporidium hominis
GTSGYEYKDG

SEQ ID NO: 2144367 - protein, 13 aa, Cryptosporidium hominis
GTSIERNKKHVRS

SEQ ID NO: 2144368 - protein, 18 aa, Cryptosporidium hominis
GTSIKSDNSQENGGFQQG

SEQ ID NO: 2144369 - protein, 37 aa, Cryptosporidium hominis
GTSKKDSSSNKNTCKRARQQKAPSGLHSSQKKKSHLS

SEQ ID NO: 2144370 - protein, 11 aa, Cryptosporidium hominis
GTSLRPANPPI

SEQ ID NO: 2144371 - protein, 6 aa, Cryptosporidium hominis
GTSLTP

SEQ ID NO: 2144372 - protein, 14 aa, Cryptosporidium hominis
GTSNSNQSQGTGLN

SEQ ID NO: 2144373 - protein, 6 aa, Cryptosporidium hominis
GTSSRE

SEQ ID NO: 2144374 - protein, 5 aa, Cryptosporidium hominis
GTSTD

SEQ ID NO: 2144375 - protein, 4 aa, Cryptosporidium hominis
GTSV

SEQ ID NO: 2144376 - protein, 8 aa, Cryptosporidium hominis
GTSVRDDM

SEQ ID NO: 2144377 - protein, 6 aa, Cryptosporidium hominis
GTSWNS

SEQ ID NO: 2144378 - protein, 5 aa, Cryptosporidium hominis
GTTGF

SEQ ID NO: 2144379 - protein, 12 aa, Cryptosporidium hominis
GTTGSEAAKSIA

SEQ ID NO: 2144380 - protein, 4 aa, Cryptosporidium hominis
GTTH

SEQ ID NO: 2144381 - protein, 17 aa, Cryptosporidium hominis
GTTIGGPGIGQNGQINM

SEQ ID NO: 2144382 - protein, 36 aa, Cryptosporidium hominis
GTTINSSNDNSGIKTPNRRNYSNSNATTATPATPIT

SEQ ID NO: 2144383 - protein, 11 aa, Cryptosporidium hominis
GTTKKSQKELN

SEQ ID NO: 2144384 - protein, 14 aa, Cryptosporidium hominis
GTTLSSSSTTPNLS

SEQ ID NO: 2144385 - protein, 11 aa, Cryptosporidium hominis
GTTNGSNNDID

SEQ ID NO: 2144386 - protein, 5 aa, Cryptosporidium hominis
GTTNS

SEQ ID NO: 2144387 - protein, 11 aa, Cryptosporidium hominis
GTTPNTGAHSG

SEQ ID NO: 2144388 - protein, 24 aa, Cryptosporidium hominis
GTTQVGGKGTARRKKRAQKPTGVD

SEQ ID NO: 2144389 - protein, 7 aa, Cryptosporidium hominis
GTVEGSI

SEQ ID NO: 2144390 - protein, 10 aa, Cryptosporidium hominis
GTVENGRVDG

SEQ ID NO: 2144391 - protein, 9 aa, Cryptosporidium hominis
GTVKTENNP

SEQ ID NO: 2144392 - protein, 8 aa, Cryptosporidium hominis
GTVSTTGQ

SEQ ID NO: 2144393 - protein, 4 aa, Cryptosporidium hominis
GTYD

SEQ ID NO: 2144394 - protein, 28 aa, Cryptosporidium hominis
GTYESFTNSAHKNCGKKSGYKLPKGNVP

SEQ ID NO: 2144395 - protein, 5 aa, Cryptosporidium hominis
GTYGS

SEQ ID NO: 2144396 - protein, 34 aa, Cryptosporidium hominis
GTYPINNSKQDGSSNSENNNNSQKNESIQQNSTE

SEQ ID NO: 2144397 - protein, 5 aa, Cryptosporidium hominis
GVAPS

SEQ ID NO: 2144398 - protein, 13 aa, Cryptosporidium hominis
GVEDCPNNPGNSH

SEQ ID NO: 2144399 - protein, 4 aa, Cryptosporidium hominis
GVEK

SEQ ID NO: 2144400 - protein, 10 aa, Cryptosporidium hominis
GVENGEPIED

SEQ ID NO: 2144401 - protein, 8 aa, Cryptosporidium hominis
GVEPQSNS

SEQ ID NO: 2144402 - protein, 7 aa, Cryptosporidium hominis
GVFSPRS

SEQ ID NO: 2144403 - protein, 29 aa, Cryptosporidium hominis
GVGAGGIGAGIGADEDLNAENENSSEKER

SEQ ID NO: 2144404 - protein, 11 aa, Cryptosporidium hominis
GVGAGSGAISG

SEQ ID NO: 2144405 - protein, 5 aa, Cryptosporidium hominis
GVGER

SEQ ID NO: 2144406 - protein, 5 aa, Cryptosporidium hominis
GVGGG

SEQ ID NO: 2144407 - protein, 5 aa, Cryptosporidium hominis
GVGKG

SEQ ID NO: 2144408 - protein, 5 aa, Cryptosporidium hominis
GVGQP

SEQ ID NO: 2144409 - protein, 11 aa, Cryptosporidium hominis
GVGRTAKANEF

SEQ ID NO: 2144410 - protein, 11 aa, Cryptosporidium hominis
GVGSGSPTGGF

SEQ ID NO: 2144411 - protein, 6 aa, Cryptosporidium hominis
GVGSTY

SEQ ID NO: 2144412 - protein, 6 aa, Cryptosporidium hominis
GVGTRE

SEQ ID NO: 2144413 - protein, 24 aa, Cryptosporidium hominis
GVGVGGNNSTSGNISSSGGGIGGV

SEQ ID NO: 2144414 - protein, 7 aa, Cryptosporidium hominis
GVGYNSS

SEQ ID NO: 2144415 - protein, 7 aa, Cryptosporidium hominis
GVKKGNV

SEQ ID NO: 2144416 - protein, 12 aa, Cryptosporidium hominis
GVKNSGKGTATV

SEQ ID NO: 2144417 - protein, 13 aa, Cryptosporidium hominis
GVKQNSGKQNSNL

SEQ ID NO: 2144418 - protein, 6 aa, Cryptosporidium hominis
GVKSPK

SEQ ID NO: 2144419 - protein, 9 aa, Cryptosporidium hominis
GVNDPLNNE

SEQ ID NO: 2144420 - protein, 6 aa, Cryptosporidium hominis
GVNEKE

SEQ ID NO: 2144421 - protein, 9 aa, Cryptosporidium hominis
GVNKDRKAI

SEQ ID NO: 2144422 - protein, 7 aa, Cryptosporidium hominis
GVNNGVG

SEQ ID NO: 2144423 - protein, 12 aa, Cryptosporidium hominis
GVNNNDDPILGD

SEQ ID NO: 2144424 - protein, 7 aa, Cryptosporidium hominis
GVNPPIV

SEQ ID NO: 2144425 - protein, 4 aa, Cryptosporidium hominis
GVNR

SEQ ID NO: 2144426 - protein, 5 aa, Cryptosporidium hominis
GVNTS

SEQ ID NO: 2144427 - protein, 6 aa, Cryptosporidium hominis
GVPESQ

SEQ ID NO: 2144428 - protein, 14 aa, Cryptosporidium hominis
GVPFRSADSDPSTL

SEQ ID NO: 2144429 - protein, 49 aa, Cryptosporidium hominis
GVPGVPATATTTTDAPAPTPAPSSSSALGAPSDSNSLPETENVSRTAIN

SEQ ID NO: 2144430 - protein, 7 aa, Cryptosporidium hominis
GVPNPLP

SEQ ID NO: 2144431 - protein, 13 aa, Cryptosporidium hominis
GVPSEKFKTTCSS

SEQ ID NO: 2144432 - protein, 10 aa, Cryptosporidium hominis
GVPSSGNSNM

SEQ ID NO: 2144433 - protein, 12 aa, Cryptosporidium hominis
GVPTTSSTGYDD

SEQ ID NO: 2144434 - protein, 7 aa, Cryptosporidium hominis
GVPVPPS

SEQ ID NO: 2144435 - protein, 5 aa, Cryptosporidium hominis
GVQDA

SEQ ID NO: 2144436 - protein, 11 aa, Cryptosporidium hominis
GVQGKGSGTMP

SEQ ID NO: 2144437 - protein, 26 aa, Cryptosporidium hominis
GVQNTNFEYSESDISDFSDPSGVDDA

SEQ ID NO: 2144438 - protein, 5 aa, Cryptosporidium hominis
GVQPK

SEQ ID NO: 2144439 - protein, 44 aa, Cryptosporidium hominis
GVQQQQQQQQKQQQQQQQQQQQQQQQQQQQQQQQQINGNGQLPG

SEQ ID NO: 2144440 - protein, 5 aa, Cryptosporidium hominis
GVRPE

SEQ ID NO: 2144441 - protein, 36 aa, Cryptosporidium hominis
GVSDTSSSSGNSSSSSSSSSSSSSEYGESSGNDDRI

SEQ ID NO: 2144442 - protein, 20 aa, Cryptosporidium hominis
GVSGGSNGSSIGGNNGMNSN

SEQ ID NO: 2144443 - protein, 11 aa, Cryptosporidium hominis
GVSGQSSSEIM

SEQ ID NO: 2144444 - protein, 5 aa, Cryptosporidium hominis
GVSPH

SEQ ID NO: 2144445 - protein, 9 aa, Cryptosporidium hominis
GVSRDDQTI

SEQ ID NO: 2144446 - protein, 14 aa, Cryptosporidium hominis
GVSRSMPTSTSLNN

SEQ ID NO: 2144447 - protein, 6 aa, Cryptosporidium hominis
GVSRSS

SEQ ID NO: 2144448 - protein, 8 aa, Cryptosporidium hominis
GVSSRKRR

SEQ ID NO: 2144449 - protein, 6 aa, Cryptosporidium hominis
GVSTSI

SEQ ID NO: 2144450 - protein, 6 aa, Cryptosporidium hominis
GVTNER

SEQ ID NO: 2144451 - protein, 11 aa, Cryptosporidium hominis
GVTNIETNTDF

SEQ ID NO: 2144452 - protein, 4 aa, Cryptosporidium hominis
GVTP

SEQ ID NO: 2144453 - protein, 8 aa, Cryptosporidium hominis
GVTPPEPK

SEQ ID NO: 2144454 - protein, 7 aa, Cryptosporidium hominis
GVTSIKE

SEQ ID NO: 2144455 - protein, 7 aa, Cryptosporidium hominis
GVTTTPE

SEQ ID NO: 2144456 - protein, 14 aa, Cryptosporidium hominis
GVTYTNGAISNGAN

SEQ ID NO: 2144457 - protein, 18 aa, Cryptosporidium hominis
GVVPNEEAKDQADKGKDG

SEQ ID NO: 2144458 - protein, 7 aa, Cryptosporidium hominis
GWKKNSA

SEQ ID NO: 2144459 - protein, 13 aa, Cryptosporidium hominis
GYANSKSNNNGNE

SEQ ID NO: 2144460 - protein, 9 aa, Cryptosporidium hominis
GYAPSTSNF

SEQ ID NO: 2144461 - protein, 4 aa, Cryptosporidium hominis
GYDD

SEQ ID NO: 2144462 - protein, 9 aa, Cryptosporidium hominis
GYDQNNSNA

SEQ ID NO: 2144463 - protein, 11 aa, Cryptosporidium hominis
GYDSEEKGLDY

SEQ ID NO: 2144464 - protein, 4 aa, Cryptosporidium hominis
GYDT

SEQ ID NO: 2144465 - protein, 9 aa, Cryptosporidium hominis
GYESGSSGN

SEQ ID NO: 2144466 - protein, 9 aa, Cryptosporidium hominis
GYESSGGLS

SEQ ID NO: 2144467 - protein, 6 aa, Cryptosporidium hominis
GYGKKE

SEQ ID NO: 2144468 - protein, 25 aa, Cryptosporidium hominis
GYGPNMNTNNLPASSSINPPPPGSL

SEQ ID NO: 2144469 - protein, 5 aa, Cryptosporidium hominis
GYGSR

SEQ ID NO: 2144470 - protein, 9 aa, Cryptosporidium hominis
GYHENPEYE

SEQ ID NO: 2144471 - protein, 32 aa, Cryptosporidium hominis
GYKGQNDRNSSGGDYNSSRNYGNFGNKKFKYS

SEQ ID NO: 2144472 - protein, 4 aa, Cryptosporidium hominis
GYKN

SEQ ID NO: 2144473 - protein, 5 aa, Cryptosporidium hominis
GYKPN

SEQ ID NO: 2144474 - protein, 5 aa, Cryptosporidium hominis
GYKYS

SEQ ID NO: 2144475 - protein, 8 aa, Cryptosporidium hominis
GYNEGSRE

SEQ ID NO: 2144476 - protein, 38 aa, Cryptosporidium hominis
GYNNSSESNNGQMNITENGSQFQSNGDPSQASTLTTGV

SEQ ID NO: 2144477 - protein, 7 aa, Cryptosporidium hominis
GYNPSEL

SEQ ID NO: 2144478 - protein, 7 aa, Cryptosporidium hominis
GYNPSNT

SEQ ID NO: 2144479 - protein, 11 aa, Cryptosporidium hominis
GYPEKSPPEIN

SEQ ID NO: 2144480 - protein, 17 aa, Cryptosporidium hominis
GYPPSLGSGPGSGTGTM

SEQ ID NO: 2144481 - protein, 34 aa, Cryptosporidium hominis
GYPPSQMEGGSAHHYPSAPEPYESSFQGNYRYSR

SEQ ID NO: 2144482 - protein, 6 aa, Cryptosporidium hominis
GYQGTD

SEQ ID NO: 2144483 - protein, 12 aa, Cryptosporidium hominis
GYQHDHDDEFSQ

SEQ ID NO: 2144484 - protein, 33 aa, Cryptosporidium hominis
GYRASGPSEQMPGSAGPISGRDGMQSSGPGSMN

SEQ ID NO: 2144485 - protein, 7 aa, Cryptosporidium hominis
GYRDYNK

SEQ ID NO: 2144486 - protein, 5 aa, Cryptosporidium hominis
GYRET

SEQ ID NO: 2144487 - protein, 28 aa, Cryptosporidium hominis
GYRQSGGSRGGGSGSMGSRGGFSRGGRR

SEQ ID NO: 2144488 - protein, 4 aa, Cryptosporidium hominis
GYRT

SEQ ID NO: 2144489 - protein, 9 aa, Cryptosporidium hominis
GYSAPYGSA

SEQ ID NO: 2144490 - protein, 9 aa, Cryptosporidium hominis
GYSDTEISE

SEQ ID NO: 2144491 - protein, 5 aa, Cryptosporidium hominis
GYSKD

SEQ ID NO: 2144492 - protein, 7 aa, Cryptosporidium hominis
GYSKGQS

SEQ ID NO: 2144493 - protein, 8 aa, Cryptosporidium hominis
GYSNEPRL

SEQ ID NO: 2144494 - protein, 7 aa, Cryptosporidium hominis
GYSPFTD

SEQ ID NO: 2144495 - protein, 24 aa, Cryptosporidium hominis
GYSSKSNNFPEKLSNGSNSANELS

SEQ ID NO: 2144496 - protein, 18 aa, Cryptosporidium hominis
GYSSPPSLNNDKNSSQSN

SEQ ID NO: 2144497 - protein, 10 aa, Cryptosporidium hominis
GYSSSLNDKE

SEQ ID NO: 2144498 - protein, 12 aa, Cryptosporidium hominis
GYTESTKRKHEV

SEQ ID NO: 2144499 - protein, 6 aa, Cryptosporidium hominis
GYTGDG

SEQ ID NO: 2144500 - protein, 23 aa, Cryptosporidium hominis
GYTGNSLPKQSQASNTQGSNPIN

SEQ ID NO: 2144501 - protein, 6 aa, Cryptosporidium hominis
GYTPSR

SEQ ID NO: 2144502 - protein, 9 aa, Cryptosporidium hominis
GYVAGGGAV

SEQ ID NO: 2144503 - protein, 6 aa, Cryptosporidium hominis
GYVDDG

SEQ ID NO: 2144504 - protein, 8 aa, Cryptosporidium hominis
GYYDSSDN

SEQ ID NO: 2144505 - protein, 8 aa, Cryptosporidium hominis
HAAKENRL

SEQ ID NO: 2144506 - protein, 30 aa, Cryptosporidium hominis
HADPSRQKKPARKVTKTRVGNTIKTEKSQY

SEQ ID NO: 2144507 - protein, 9 aa, Cryptosporidium hominis
HAENGGELY

SEQ ID NO: 2144508 - protein, 7 aa, Cryptosporidium hominis
HAGDDES

SEQ ID NO: 2144509 - protein, 6 aa, Cryptosporidium hominis
HAGIAT

SEQ ID NO: 2144510 - protein, 4 aa, Cryptosporidium hominis
HAGN

SEQ ID NO: 2144511 - protein, 11 aa, Cryptosporidium hominis
HANDESDFQKG

SEQ ID NO: 2144512 - protein, 9 aa, Cryptosporidium hominis
HANNKGSIE

SEQ ID NO: 2144513 - protein, 57 aa, Cryptosporidium hominis
HANTDSNAESQKKVSSSTAANTSNTSSNHASTSAPTTSNNAAANTSSASSPSPLDPV

SEQ ID NO: 2144514 - protein, 5 aa, Cryptosporidium hominis
HAPRN

SEQ ID NO: 2144515 - protein, 7 aa, Cryptosporidium hominis
HAQIPNP

SEQ ID NO: 2144516 - protein, 4 aa, Cryptosporidium hominis
HASF

SEQ ID NO: 2144517 - protein, 9 aa, Cryptosporidium hominis
HASNSSNNI

SEQ ID NO: 2144518 - protein, 17 aa, Cryptosporidium hominis
HAVSEGTKAVTKYTSAS

SEQ ID NO: 2144519 - protein, 7 aa, Cryptosporidium hominis
HCKSKKS

SEQ ID NO: 2144520 - protein, 13 aa, Cryptosporidium hominis
HCYSSEKNKTGIP

SEQ ID NO: 2144521 - protein, 6 aa, Cryptosporidium hominis
HDASQN

SEQ ID NO: 2144522 - protein, 4 aa, Cryptosporidium hominis
HDDI

SEQ ID NO: 2144523 - protein, 8 aa, Cryptosporidium hominis
HDDKSESL

SEQ ID NO: 2144524 - protein, 6 aa, Cryptosporidium hominis
HDDPDL

SEQ ID NO: 2144525 - protein, 5 aa, Cryptosporidium hominis
HDDYP

SEQ ID NO: 2144526 - protein, 17 aa, Cryptosporidium hominis
HDEATNKNNELKETFSE

SEQ ID NO: 2144527 - protein, 8 aa, Cryptosporidium hominis
HDEESDDN

SEQ ID NO: 2144528 - protein, 6 aa, Cryptosporidium hominis
HDETNN

SEQ ID NO: 2144529 - protein, 6 aa, Cryptosporidium hominis
HDGPVK

SEQ ID NO: 2144530 - protein, 4 aa, Cryptosporidium hominis
HDGT

SEQ ID NO: 2144531 - protein, 12 aa, Cryptosporidium hominis
HDGYNQSASYGT

SEQ ID NO: 2144532 - protein, 32 aa, Cryptosporidium hominis
HDHSNAHKDQEEKNSEKDLCPPSGGRSRKSIR

SEQ ID NO: 2144533 - protein, 10 aa, Cryptosporidium hominis
HDIKGENEQC

SEQ ID NO: 2144534 - protein, 7 aa, Cryptosporidium hominis
HDKGAGS

SEQ ID NO: 2144535 - protein, 6 aa, Cryptosporidium hominis
HDKKSD

SEQ ID NO: 2144536 - protein, 6 aa, Cryptosporidium hominis
HDKTES

SEQ ID NO: 2144537 - protein, 11 aa, Cryptosporidium hominis
HDNDEDSDDDI

SEQ ID NO: 2144538 - protein, 6 aa, Cryptosporidium hominis
HDNDLR

SEQ ID NO: 2144539 - protein, 8 aa, Cryptosporidium hominis
HDNIESNS

SEQ ID NO: 2144540 - protein, 4 aa, Cryptosporidium hominis
HDNP

SEQ ID NO: 2144541 - protein, 6 aa, Cryptosporidium hominis
HDNYAG

SEQ ID NO: 2144542 - protein, 29 aa, Cryptosporidium hominis
HDPNPPKKETSKSIYSEKKYDTLESRNPN

SEQ ID NO: 2144543 - protein, 5 aa, Cryptosporidium hominis
HDPSN

SEQ ID NO: 2144544 - protein, 5 aa, Cryptosporidium hominis
HDQDA

SEQ ID NO: 2144545 - protein, 6 aa, Cryptosporidium hominis
HDQDEH

SEQ ID NO: 2144546 - protein, 6 aa, Cryptosporidium hominis
HDQKNE

SEQ ID NO: 2144547 - protein, 6 aa, Cryptosporidium hominis
HDQSKG

SEQ ID NO: 2144548 - protein, 11 aa, Cryptosporidium hominis
HDRNNGVTKQK

SEQ ID NO: 2144549 - protein, 5 aa, Cryptosporidium hominis
HDSDP

SEQ ID NO: 2144550 - protein, 9 aa, Cryptosporidium hominis
HDSNSEKIR

SEQ ID NO: 2144551 - protein, 17 aa, Cryptosporidium hominis
HDSRIPPIDTNNNNTGL

SEQ ID NO: 2144552 - protein, 8 aa, Cryptosporidium hominis
HDSSGQPL

SEQ ID NO: 2144553 - protein, 13 aa, Cryptosporidium hominis
HDYTQVSASNTLP

SEQ ID NO: 2144554 - protein, 20 aa, Cryptosporidium hominis
HEAKTSAGRNQLSQEDKSKI

SEQ ID NO: 2144555 - protein, 6 aa, Cryptosporidium hominis
HEARRN

SEQ ID NO: 2144556 - protein, 11 aa, Cryptosporidium hominis
HEASAAEITGE

SEQ ID NO: 2144557 - protein, 11 aa, Cryptosporidium hominis
HEAVKESHQRY

SEQ ID NO: 2144558 - protein, 5 aa, Cryptosporidium hominis
HEDAS

SEQ ID NO: 2144559 - protein, 10 aa, Cryptosporidium hominis
HEDEGVPATS

SEQ ID NO: 2144560 - protein, 12 aa, Cryptosporidium hominis
HEDNKDKNYKPK

SEQ ID NO: 2144561 - protein, 4 aa, Cryptosporidium hominis
HEDP

SEQ ID NO: 2144562 - protein, 4 aa, Cryptosporidium hominis
HEDQ

SEQ ID NO: 2144563 - protein, 6 aa, Cryptosporidium hominis
HEDVDK

SEQ ID NO: 2144564 - protein, 4 aa, Cryptosporidium hominis
HEEE

SEQ ID NO: 2144565 - protein, 19 aa, Cryptosporidium hominis
HEEEQRRKEEEAKREEEEA

SEQ ID NO: 2144566 - protein, 4 aa, Cryptosporidium hominis
HEFP

SEQ ID NO: 2144567 - protein, 14 aa, Cryptosporidium hominis
HEGEKKNKDLDSKN

SEQ ID NO: 2144568 - protein, 10 aa, Cryptosporidium hominis
HEGPGSLTSA

SEQ ID NO: 2144569 - protein, 7 aa, Cryptosporidium hominis
HEGRGET

SEQ ID NO: 2144570 - protein, 9 aa, Cryptosporidium hominis
HEHGEKQAT

SEQ ID NO: 2144571 - protein, 4 aa, Cryptosporidium hominis
HEKE

SEQ ID NO: 2144572 - protein, 21 aa, Cryptosporidium hominis
HEKELPSPKKRKKCSKACNEK

SEQ ID NO: 2144573 - protein, 23 aa, Cryptosporidium hominis
HEKKSGSYHEKCTRKDPKNKSVK

SEQ ID NO: 2144574 - protein, 4 aa, Cryptosporidium hominis
HEKS

SEQ ID NO: 2144575 - protein, 16 aa, Cryptosporidium hominis
HEKSGNNEKKGFSSPV

SEQ ID NO: 2144576 - protein, 10 aa, Cryptosporidium hominis
HEKSVESELE

SEQ ID NO: 2144577 - protein, 6 aa, Cryptosporidium hominis
HELNSD

SEQ ID NO: 2144578 - protein, 7 aa, Cryptosporidium hominis
HENDNTD

SEQ ID NO: 2144579 - protein, 9 aa, Cryptosporidium hominis
HENKGDAGI

SEQ ID NO: 2144580 - protein, 8 aa, Cryptosporidium hominis
HENPTKNP

SEQ ID NO: 2144581 - protein, 4 aa, Cryptosporidium hominis
HEPK

SEQ ID NO: 2144582 - protein, 15 aa, Cryptosporidium hominis
HEPNELKTENSKDPQ

SEQ ID NO: 2144583 - protein, 7 aa, Cryptosporidium hominis
HEPRYTS

SEQ ID NO: 2144584 - protein, 4 aa, Cryptosporidium hominis
HEQN

SEQ ID NO: 2144585 - protein, 24 aa, Cryptosporidium hominis
HEQWGGSNIRDNNSNNNSAINSDI

SEQ ID NO: 2144586 - protein, 15 aa, Cryptosporidium hominis
HERPEERSKSEANIE

SEQ ID NO: 2144587 - protein, 10 aa, Cryptosporidium hominis
HERPTPNIQK

SEQ ID NO: 2144588 - protein, 9 aa, Cryptosporidium hominis
HERRSRNRK

SEQ ID NO: 2144589 - protein, 5 aa, Cryptosporidium hominis
HERTV

SEQ ID NO: 2144590 - protein, 11 aa, Cryptosporidium hominis
HESEHASNSTY

SEQ ID NO: 2144591 - protein, 6 aa, Cryptosporidium hominis
HESFPT

SEQ ID NO: 2144592 - protein, 5 aa, Cryptosporidium hominis
HESGG

SEQ ID NO: 2144593 - protein, 15 aa, Cryptosporidium hominis
HESGNTSSNRSHDFN

SEQ ID NO: 2144594 - protein, 8 aa, Cryptosporidium hominis
HESHSSRR

SEQ ID NO: 2144595 - protein, 14 aa, Cryptosporidium hominis
HESNANSKSRAESI

SEQ ID NO: 2144596 - protein, 14 aa, Cryptosporidium hominis
HESPLEEKKENFSV

SEQ ID NO: 2144597 - protein, 7 aa, Cryptosporidium hominis
HESPTQP

SEQ ID NO: 2144598 - protein, 6 aa, Cryptosporidium hominis
HESQNG

SEQ ID NO: 2144599 - protein, 6 aa, Cryptosporidium hominis
HESRQI

SEQ ID NO: 2144600 - protein, 10 aa, Cryptosporidium hominis
HESSSGPMVG

SEQ ID NO: 2144601 - protein, 10 aa, Cryptosporidium hominis
HESSSSSSQL

SEQ ID NO: 2144602 - protein, 5 aa, Cryptosporidium hominis
HETRQ

SEQ ID NO: 2144603 - protein, 5 aa, Cryptosporidium hominis
HEVSE

SEQ ID NO: 2144604 - protein, 21 aa, Cryptosporidium hominis
HFHSPSKSLPLSSSSSSSYIT

SEQ ID NO: 2144605 - protein, 10 aa, Cryptosporidium hominis
HFSQNDSEGV

SEQ ID NO: 2144606 - protein, 32 aa, Cryptosporidium hominis
HFSRENSKYTGLPNEEKDRLREESLERDKSIA

SEQ ID NO: 2144607 - protein, 6 aa, Cryptosporidium hominis
HFSSNT

SEQ ID NO: 2144608 - protein, 7 aa, Cryptosporidium hominis
HFTDPDK

SEQ ID NO: 2144609 - protein, 15 aa, Cryptosporidium hominis
HGDGGLISGVLSSCC

SEQ ID NO: 2144610 - protein, 17 aa, Cryptosporidium hominis
HGDQCSRNHYKPTSSPT

SEQ ID NO: 2144611 - protein, 7 aa, Cryptosporidium hominis
HGEESKF

SEQ ID NO: 2144612 - protein, 4 aa, Cryptosporidium hominis
HGEF

SEQ ID NO: 2144613 - protein, 14 aa, Cryptosporidium hominis
HGERQHGSDVRSNN

SEQ ID NO: 2144614 - protein, 5 aa, Cryptosporidium hominis
HGESI

SEQ ID NO: 2144615 - protein, 7 aa, Cryptosporidium hominis
HGESSLQ

SEQ ID NO: 2144616 - protein, 4 aa, Cryptosporidium hominis
HGFT

SEQ ID NO: 2144617 - protein, 34 aa, Cryptosporidium hominis
HGGGRAAGSTESQGNHNEKPKSSKKLQKEHASEF

SEQ ID NO: 2144618 - protein, 4 aa, Cryptosporidium hominis
HGGI

SEQ ID NO: 2144619 - protein, 15 aa, Cryptosporidium hominis
HGGKRQGSTTRSTTT

SEQ ID NO: 2144620 - protein, 7 aa, Cryptosporidium hominis
HGGQTVD

SEQ ID NO: 2144621 - protein, 4 aa, Cryptosporidium hominis
HGGS

SEQ ID NO: 2144622 - protein, 14 aa, Cryptosporidium hominis
HGGSPINKNLSEKD

SEQ ID NO: 2144623 - protein, 13 aa, Cryptosporidium hominis
HGGSSSGGSNTKV

SEQ ID NO: 2144624 - protein, 6 aa, Cryptosporidium hominis
HGKGLS

SEQ ID NO: 2144625 - protein, 10 aa, Cryptosporidium hominis
HGKKKQTSRM

SEQ ID NO: 2144626 - protein, 12 aa, Cryptosporidium hominis
HGKKSDGYSNNN

SEQ ID NO: 2144627 - protein, 6 aa, Cryptosporidium hominis
HGKPEY

SEQ ID NO: 2144628 - protein, 11 aa, Cryptosporidium hominis
HGNIGSKLNTS

SEQ ID NO: 2144629 - protein, 11 aa, Cryptosporidium hominis
HGNKLKPGSKF

SEQ ID NO: 2144630 - protein, 24 aa, Cryptosporidium hominis
HGNKSTNHKGKGNAAKSNYQESKE

SEQ ID NO: 2144631 - protein, 5 aa, Cryptosporidium hominis
HGNTL

SEQ ID NO: 2144632 - protein, 7 aa, Cryptosporidium hominis
HGPDSDL

SEQ ID NO: 2144633 - protein, 5 aa, Cryptosporidium hominis
HGPHG

SEQ ID NO: 2144634 - protein, 22 aa, Cryptosporidium hominis
HGQAGNAAVRSDQSSEEKASPL

SEQ ID NO: 2144635 - protein, 14 aa, Cryptosporidium hominis
HGSCDGSKSYSGIS

SEQ ID NO: 2144636 - protein, 9 aa, Cryptosporidium hominis
HGSKGSGKI

SEQ ID NO: 2144637 - protein, 7 aa, Cryptosporidium hominis
HGSKNRS

SEQ ID NO: 2144638 - protein, 4 aa, Cryptosporidium hominis
HGSP

SEQ ID NO: 2144639 - protein, 10 aa, Cryptosporidium hominis
HGSQKERRQI

SEQ ID NO: 2144640 - protein, 10 aa, Cryptosporidium hominis
HGSRKPNKAI

SEQ ID NO: 2144641 - protein, 14 aa, Cryptosporidium hominis
HGTPKDKLRRERER

SEQ ID NO: 2144642 - protein, 6 aa, Cryptosporidium hominis
HGTSQN

SEQ ID NO: 2144643 - protein, 9 aa, Cryptosporidium hominis
HGTSRGKSC

SEQ ID NO: 2144644 - protein, 10 aa, Cryptosporidium hominis
HGVASGGNYH

SEQ ID NO: 2144645 - protein, 6 aa, Cryptosporidium hominis
HGYSSS

SEQ ID NO: 2144646 - protein, 18 aa, Cryptosporidium hominis
HHDEESIEKTQEKVRELE

SEQ ID NO: 2144647 - protein, 9 aa, Cryptosporidium hominis
HHDGDNRTH

SEQ ID NO: 2144648 - protein, 6 aa, Cryptosporidium hominis
HHHDQQ

SEQ ID NO: 2144649 - protein, 15 aa, Cryptosporidium hominis
HHHKHDHKNDIDYND

SEQ ID NO: 2144650 - protein, 16 aa, Cryptosporidium hominis
HHLTDDDLKTPLPRTY

SEQ ID NO: 2144651 - protein, 16 aa, Cryptosporidium hominis
HHNQPKKEVNTPQDRE

SEQ ID NO: 2144652 - protein, 25 aa, Cryptosporidium hominis
HHNSNNSSSNSAHSYSKHPSLKKRS

SEQ ID NO: 2144653 - protein, 58 aa, Cryptosporidium hominis
HHPPFNGDNSSSSSTSTSSTSTSTSTSTSTTSTSTSTSTSTTTTTTTTTTTTTNEEVN

SEQ ID NO: 2144654 - protein, 19 aa, Cryptosporidium hominis
HHPTVTPGTGINPQSFPSG

SEQ ID NO: 2144655 - protein, 6 aa, Cryptosporidium hominis
HHQNEE

SEQ ID NO: 2144656 - protein, 22 aa, Cryptosporidium hominis
HHSASNSPVLSRDGEKNELSSV

SEQ ID NO: 2144657 - protein, 10 aa, Cryptosporidium hominis
HHSGSPHPTR

SEQ ID NO: 2144658 - protein, 6 aa, Cryptosporidium hominis
HIDSGN

SEQ ID NO: 2144659 - protein, 19 aa, Cryptosporidium hominis
HIQTDGNSTHIQEHETATT

SEQ ID NO: 2144660 - protein, 7 aa, Cryptosporidium hominis
HISKSSM

SEQ ID NO: 2144661 - protein, 9 aa, Cryptosporidium hominis
HITGGNDEY

SEQ ID NO: 2144662 - protein, 4 aa, Cryptosporidium hominis
HKDN

SEQ ID NO: 2144663 - protein, 8 aa, Cryptosporidium hominis
HKDQKVDN

SEQ ID NO: 2144664 - protein, 30 aa, Cryptosporidium hominis
HKDSIGKGGPHGGHQKDNNDASLKESRTIS

SEQ ID NO: 2144665 - protein, 10 aa, Cryptosporidium hominis
HKEGNTVRED

SEQ ID NO: 2144666 - protein, 4 aa, Cryptosporidium hominis
HKEN

SEQ ID NO: 2144667 - protein, 12 aa, Cryptosporidium hominis
HKENDSEERRVT

SEQ ID NO: 2144668 - protein, 10 aa, Cryptosporidium hominis
HKENYTREEN

SEQ ID NO: 2144669 - protein, 7 aa, Cryptosporidium hominis
HKEQSRD

SEQ ID NO: 2144670 - protein, 12 aa, Cryptosporidium hominis
HKERDDKSQDFE

SEQ ID NO: 2144671 - protein, 4 aa, Cryptosporidium hominis
HKET

SEQ ID NO: 2144672 - protein, 6 aa, Cryptosporidium hominis
HKGGEG

SEQ ID NO: 2144673 - protein, 11 aa, Cryptosporidium hominis
HKGKRGRKRKN

SEQ ID NO: 2144674 - protein, 18 aa, Cryptosporidium hominis
HKGRSGSGFGSSSSYENR

SEQ ID NO: 2144675 - protein, 4 aa, Cryptosporidium hominis
HKGT

SEQ ID NO: 2144676 - protein, 4 aa, Cryptosporidium hominis
HKHN

SEQ ID NO: 2144677 - protein, 6 aa, Cryptosporidium hominis
HKHNKN

SEQ ID NO: 2144678 - protein, 13 aa, Cryptosporidium hominis
HKITGTKNGKYEE

SEQ ID NO: 2144679 - protein, 23 aa, Cryptosporidium hominis
HKKDKKVKLDEDDNIRDNKSQTF

SEQ ID NO: 2144680 - protein, 8 aa, Cryptosporidium hominis
HKKPDKQN

SEQ ID NO: 2144681 - protein, 11 aa, Cryptosporidium hominis
HKLNGKNFKTE

SEQ ID NO: 2144682 - protein, 4 aa, Cryptosporidium hominis
HKNA

SEQ ID NO: 2144683 - protein, 7 aa, Cryptosporidium hominis
HKNEVSD

SEQ ID NO: 2144684 - protein, 8 aa, Cryptosporidium hominis
HKNGYFNN

SEQ ID NO: 2144685 - protein, 9 aa, Cryptosporidium hominis
HKNSEQTKY

SEQ ID NO: 2144686 - protein, 21 aa, Cryptosporidium hominis
HKNSSSINNDISNNEKCSLSS

SEQ ID NO: 2144687 - protein, 7 aa, Cryptosporidium hominis
HKPELPL

SEQ ID NO: 2144688 - protein, 8 aa, Cryptosporidium hominis
HKPPGRAD

SEQ ID NO: 2144689 - protein, 12 aa, Cryptosporidium hominis
HKQASKDLTSEF

SEQ ID NO: 2144690 - protein, 6 aa, Cryptosporidium hominis
HKQKRN

SEQ ID NO: 2144691 - protein, 8 aa, Cryptosporidium hominis
HKRFKKEK

SEQ ID NO: 2144692 - protein, 9 aa, Cryptosporidium hominis
HKRNSTYNS

SEQ ID NO: 2144693 - protein, 8 aa, Cryptosporidium hominis
HKRQEGRS

SEQ ID NO: 2144694 - protein, 10 aa, Cryptosporidium hominis
HKRTRTRSLE

SEQ ID NO: 2144695 - protein, 9 aa, Cryptosporidium hominis
HKSGGSLDN

SEQ ID NO: 2144696 - protein, 18 aa, Cryptosporidium hominis
HKSNSSHNSSPSSNSSLA

SEQ ID NO: 2144697 - protein, 9 aa, Cryptosporidium hominis
HKSQNDNEA

SEQ ID NO: 2144698 - protein, 6 aa, Cryptosporidium hominis
HKSSEC

SEQ ID NO: 2144699 - protein, 4 aa, Cryptosporidium hominis
HKST

SEQ ID NO: 2144700 - protein, 6 aa, Cryptosporidium hominis
HKTGKT

SEQ ID NO: 2144701 - protein, 8 aa, Cryptosporidium hominis
HKTLRGPR

SEQ ID NO: 2144702 - protein, 7 aa, Cryptosporidium hominis
HKTNLDP

SEQ ID NO: 2144703 - protein, 8 aa, Cryptosporidium hominis
HKTPRGAA

SEQ ID NO: 2144704 - protein, 6 aa, Cryptosporidium hominis
HKTSGF

SEQ ID NO: 2144705 - protein, 12 aa, Cryptosporidium hominis
HKTSKKTSKRRY

SEQ ID NO: 2144706 - protein, 10 aa, Cryptosporidium hominis
HKVSDGTDHK

SEQ ID NO: 2144707 - protein, 9 aa, Cryptosporidium hominis
HKYNQDDEL

SEQ ID NO: 2144708 - protein, 6 aa, Cryptosporidium hominis
HKYSPE

SEQ ID NO: 2144709 - protein, 13 aa, Cryptosporidium hominis
HLEDNERTTTRIY

SEQ ID NO: 2144710 - protein, 13 aa, Cryptosporidium hominis
HLEEQEGNSYSNY

SEQ ID NO: 2144711 - protein, 5 aa, Cryptosporidium hominis
HLESQ

SEQ ID NO: 2144712 - protein, 10 aa, Cryptosporidium hominis
HLNDSSNNEH

SEQ ID NO: 2144713 - protein, 10 aa, Cryptosporidium hominis
HLNNEKEREL

SEQ ID NO: 2144714 - protein, 11 aa, Cryptosporidium hominis
HLPPTEKDGLS

SEQ ID NO: 2144715 - protein, 5 aa, Cryptosporidium hominis
HLPQL

SEQ ID NO: 2144716 - protein, 9 aa, Cryptosporidium hominis
HLQSSDKER

SEQ ID NO: 2144717 - protein, 24 aa, Cryptosporidium hominis
HLRNEAAGSRNANANFNSKDSQYL

SEQ ID NO: 2144718 - protein, 15 aa, Cryptosporidium hominis
HLSPTKEDLLESEGE

SEQ ID NO: 2144719 - protein, 9 aa, Cryptosporidium hominis
HLTPTSSNV

SEQ ID NO: 2144720 - protein, 6 aa, Cryptosporidium hominis
HMSTNP

SEQ ID NO: 2144721 - protein, 15 aa, Cryptosporidium hominis
HNARIGNENLKNSRN

SEQ ID NO: 2144722 - protein, 6 aa, Cryptosporidium hominis
HNDGIT

SEQ ID NO: 2144723 - protein, 16 aa, Cryptosporidium hominis
HNDGSPGLYQTDPSGI

SEQ ID NO: 2144724 - protein, 5 aa, Cryptosporidium hominis
HNDSI

SEQ ID NO: 2144725 - protein, 8 aa, Cryptosporidium hominis
HNEAPSPR

SEQ ID NO: 2144726 - protein, 10 aa, Cryptosporidium hominis
HNEDEKTTGE

SEQ ID NO: 2144727 - protein, 9 aa, Cryptosporidium hominis
HNEDGSRIK

SEQ ID NO: 2144728 - protein, 9 aa, Cryptosporidium hominis
HNEDGTREK

SEQ ID NO: 2144729 - protein, 16 aa, Cryptosporidium hominis
HNEKNYDRSDSDRQMS

SEQ ID NO: 2144730 - protein, 7 aa, Cryptosporidium hominis
HNESSLT

SEQ ID NO: 2144731 - protein, 6 aa, Cryptosporidium hominis
HNGDEQ

SEQ ID NO: 2144732 - protein, 4 aa, Cryptosporidium hominis
HNGE

SEQ ID NO: 2144733 - protein, 17 aa, Cryptosporidium hominis
HNGEIKKGAKKTKSGVP

SEQ ID NO: 2144734 - protein, 6 aa, Cryptosporidium hominis
HNGNSK

SEQ ID NO: 2144735 - protein, 11 aa, Cryptosporidium hominis
HNGSDAEADQI

SEQ ID NO: 2144736 - protein, 9 aa, Cryptosporidium hominis
HNGSGKTAT

SEQ ID NO: 2144737 - protein, 8 aa, Cryptosporidium hominis
HNGSRKSR

SEQ ID NO: 2144738 - protein, 4 aa, Cryptosporidium hominis
HNGT

SEQ ID NO: 2144739 - protein, 8 aa, Cryptosporidium hominis
HNHGHGHG

SEQ ID NO: 2144740 - protein, 5 aa, Cryptosporidium hominis
HNHPA

SEQ ID NO: 2144741 - protein, 13 aa, Cryptosporidium hominis
HNKHHKHAKSDLF

SEQ ID NO: 2144742 - protein, 12 aa, Cryptosporidium hominis
HNKNESKNGVYR

SEQ ID NO: 2144743 - protein, 7 aa, Cryptosporidium hominis
HNKPSLE

SEQ ID NO: 2144744 - protein, 12 aa, Cryptosporidium hominis
HNLPGPNPKKEY

SEQ ID NO: 2144745 - protein, 4 aa, Cryptosporidium hominis
HNNN

SEQ ID NO: 2144746 - protein, 28 aa, Cryptosporidium hominis
HNNPENTKLKDGRRSNTADFGKRGSESL

SEQ ID NO: 2144747 - protein, 17 aa, Cryptosporidium hominis
HNNQKKNKYTEKNQNSI

SEQ ID NO: 2144748 - protein, 5 aa, Cryptosporidium hominis
HNNSM

SEQ ID NO: 2144749 - protein, 14 aa, Cryptosporidium hominis
HNNTVTNTNSSQIY

SEQ ID NO: 2144750 - protein, 7 aa, Cryptosporidium hominis
HNPIQDN

SEQ ID NO: 2144751 - protein, 7 aa, Cryptosporidium hominis
HNPKNNL

SEQ ID NO: 2144752 - protein, 18 aa, Cryptosporidium hominis
HNPRKSKWTKAYRKTRGK

SEQ ID NO: 2144753 - protein, 32 aa, Cryptosporidium hominis
HNQGGSGGQTKPSGGLGVTQTSDQYKSGYKGV

SEQ ID NO: 2144754 - protein, 20 aa, Cryptosporidium hominis
HNQSCSYSQGSIQKNPTGGY

SEQ ID NO: 2144755 - protein, 11 aa, Cryptosporidium hominis
HNQTSKSISTN

SEQ ID NO: 2144756 - protein, 5 aa, Cryptosporidium hominis
HNRGS

SEQ ID NO: 2144757 - protein, 10 aa, Cryptosporidium hominis
HNRSSPQNIN

SEQ ID NO: 2144758 - protein, 6 aa, Cryptosporidium hominis
HNSDRN

SEQ ID NO: 2144759 - protein, 10 aa, Cryptosporidium hominis
HNSEGESTNP

SEQ ID NO: 2144760 - protein, 5 aa, Cryptosporidium hominis
HNSGV

SEQ ID NO: 2144761 - protein, 25 aa, Cryptosporidium hominis
HNSKGDSELDDDLNSGGSTYDGEIE

SEQ ID NO: 2144762 - protein, 8 aa, Cryptosporidium hominis
HNSKKNLT

SEQ ID NO: 2144763 - protein, 6 aa, Cryptosporidium hominis
HNSKPI

SEQ ID NO: 2144764 - protein, 5 aa, Cryptosporidium hominis
HNSNP

SEQ ID NO: 2144765 - protein, 8 aa, Cryptosporidium hominis
HNSPDFKR

SEQ ID NO: 2144766 - protein, 6 aa, Cryptosporidium hominis
HNSQYR

SEQ ID NO: 2144767 - protein, 10 aa, Cryptosporidium hominis
HNSSPPKALS

SEQ ID NO: 2144768 - protein, 7 aa, Cryptosporidium hominis
HNSSTQQ

SEQ ID NO: 2144769 - protein, 12 aa, Cryptosporidium hominis
HNSTQHTSRKHK

SEQ ID NO: 2144770 - protein, 8 aa, Cryptosporidium hominis
HNTGKSRK

SEQ ID NO: 2144771 - protein, 7 aa, Cryptosporidium hominis
HNTNTNK

SEQ ID NO: 2144772 - protein, 10 aa, Cryptosporidium hominis
HNTNVQSSIQ

SEQ ID NO: 2144773 - protein, 7 aa, Cryptosporidium hominis
HNTPNNF

SEQ ID NO: 2144774 - protein, 10 aa, Cryptosporidium hominis
HNTQTDEDRA

SEQ ID NO: 2144775 - protein, 5 aa, Cryptosporidium hominis
HNTSS

SEQ ID NO: 2144776 - protein, 4 aa, Cryptosporidium hominis
HNTT

SEQ ID NO: 2144777 - protein, 19 aa, Cryptosporidium hominis
HNTTKSSNKYFNNQSSRMK

SEQ ID NO: 2144778 - protein, 14 aa, Cryptosporidium hominis
HNVNNGSDNNNDGF

SEQ ID NO: 2144779 - protein, 7 aa, Cryptosporidium hominis
HNYDRKS

SEQ ID NO: 2144780 - protein, 4 aa, Cryptosporidium hominis
HPDI

SEQ ID NO: 2144781 - protein, 7 aa, Cryptosporidium hominis
HPDIDDS

SEQ ID NO: 2144782 - protein, 12 aa, Cryptosporidium hominis
HPDKGGDQEKFK

SEQ ID NO: 2144783 - protein, 6 aa, Cryptosporidium hominis
HPDNTG

SEQ ID NO: 2144784 - protein, 4 aa, Cryptosporidium hominis
HPDR

SEQ ID NO: 2144785 - protein, 4 aa, Cryptosporidium hominis
HPDS

SEQ ID NO: 2144786 - protein, 25 aa, Cryptosporidium hominis
HPDSENKLGVPTRIQKESDKIKSKL

SEQ ID NO: 2144787 - protein, 5 aa, Cryptosporidium hominis
HPEIE

SEQ ID NO: 2144788 - protein, 9 aa, Cryptosporidium hominis
HPEKRVEAS

SEQ ID NO: 2144789 - protein, 5 aa, Cryptosporidium hominis
HPENE

SEQ ID NO: 2144790 - protein, 7 aa, Cryptosporidium hominis
HPETGIS

SEQ ID NO: 2144791 - protein, 10 aa, Cryptosporidium hominis
HPETGISKKS

SEQ ID NO: 2144792 - protein, 12 aa, Cryptosporidium hominis
HPFSGRSRAETR

SEQ ID NO: 2144793 - protein, 9 aa, Cryptosporidium hominis
HPGNSKNRE

SEQ ID NO: 2144794 - protein, 33 aa, Cryptosporidium hominis
HPGPISTRSQLRQDDNHNETSHRKSSSTDNNHY

SEQ ID NO: 2144795 - protein, 4 aa, Cryptosporidium hominis
HPGQ

SEQ ID NO: 2144796 - protein, 6 aa, Cryptosporidium hominis
HPKDGK

SEQ ID NO: 2144797 - protein, 4 aa, Cryptosporidium hominis
HPNG

SEQ ID NO: 2144798 - protein, 8 aa, Cryptosporidium hominis
HPNGWDPN

SEQ ID NO: 2144799 - protein, 26 aa, Cryptosporidium hominis
HPNNTNNSNVYPSEKPLPSARAKDDY

SEQ ID NO: 2144800 - protein, 16 aa, Cryptosporidium hominis
HPNPISEKATDSSNNA

SEQ ID NO: 2144801 - protein, 6 aa, Cryptosporidium hominis
HPNPNK

SEQ ID NO: 2144802 - protein, 13 aa, Cryptosporidium hominis
HPNSGSSVAPSEL

SEQ ID NO: 2144803 - protein, 5 aa, Cryptosporidium hominis
HPNTS

SEQ ID NO: 2144804 - protein, 18 aa, Cryptosporidium hominis
HPPPPPPPPPPPPPPPHT

SEQ ID NO: 2144805 - protein, 8 aa, Cryptosporidium hominis
HPPPTIAT

SEQ ID NO: 2144806 - protein, 6 aa, Cryptosporidium hominis
HPQPHT

SEQ ID NO: 2144807 - protein, 6 aa, Cryptosporidium hominis
HPRDNP

SEQ ID NO: 2144808 - protein, 5 aa, Cryptosporidium hominis
HPRFT

SEQ ID NO: 2144809 - protein, 5 aa, Cryptosporidium hominis
HPRKY

SEQ ID NO: 2144810 - protein, 9 aa, Cryptosporidium hominis
HPRTARSSI

SEQ ID NO: 2144811 - protein, 16 aa, Cryptosporidium hominis
HPSADKLEQEHSGSVK

SEQ ID NO: 2144812 - protein, 18 aa, Cryptosporidium hominis
HPSAPISSNQTREKIGSQ

SEQ ID NO: 2144813 - protein, 8 aa, Cryptosporidium hominis
HPSAQRMG

SEQ ID NO: 2144814 - protein, 6 aa, Cryptosporidium hominis
HPSGRK

SEQ ID NO: 2144815 - protein, 6 aa, Cryptosporidium hominis
HPSTFT

SEQ ID NO: 2144816 - protein, 8 aa, Cryptosporidium hominis
HPSYSKVD

SEQ ID NO: 2144817 - protein, 4 aa, Cryptosporidium hominis
HPTF

SEQ ID NO: 2144818 - protein, 6 aa, Cryptosporidium hominis
HPTQAQ

SEQ ID NO: 2144819 - protein, 29 aa, Cryptosporidium hominis
HPTQPSAIPKQGVQAAAPPSGGNKPGVPL

SEQ ID NO: 2144820 - protein, 12 aa, Cryptosporidium hominis
HPTRPDKARRLG

SEQ ID NO: 2144821 - protein, 4 aa, Cryptosporidium hominis
HPTV

SEQ ID NO: 2144822 - protein, 5 aa, Cryptosporidium hominis
HPYEE

SEQ ID NO: 2144823 - protein, 12 aa, Cryptosporidium hominis
HPYPAYAPDGAS

SEQ ID NO: 2144824 - protein, 5 aa, Cryptosporidium hominis
HQAPS

SEQ ID NO: 2144825 - protein, 8 aa, Cryptosporidium hominis
HQAPTGVG

SEQ ID NO: 2144826 - protein, 5 aa, Cryptosporidium hominis
HQDSA

SEQ ID NO: 2144827 - protein, 14 aa, Cryptosporidium hominis
HQDSMNSQITPPQH

SEQ ID NO: 2144828 - protein, 4 aa, Cryptosporidium hominis
HQGA

SEQ ID NO: 2144829 - protein, 4 aa, Cryptosporidium hominis
HQGL

SEQ ID NO: 2144830 - protein, 11 aa, Cryptosporidium hominis
HQHQHQQHQQL

SEQ ID NO: 2144831 - protein, 10 aa, Cryptosporidium hominis
HQHSPSYHPY

SEQ ID NO: 2144832 - protein, 15 aa, Cryptosporidium hominis
HQHTNSAGGAGGSNF

SEQ ID NO: 2144833 - protein, 17 aa, Cryptosporidium hominis
HQIQSNTNSTSNINQSY

SEQ ID NO: 2144834 - protein, 9 aa, Cryptosporidium hominis
HQKNPDLGK

SEQ ID NO: 2144835 - protein, 8 aa, Cryptosporidium hominis
HQKNTGDH

SEQ ID NO: 2144836 - protein, 6 aa, Cryptosporidium hominis
HQKSSV

SEQ ID NO: 2144837 - protein, 6 aa, Cryptosporidium hominis
HQKTVS

SEQ ID NO: 2144838 - protein, 6 aa, Cryptosporidium hominis
HQNEEI

SEQ ID NO: 2144839 - protein, 12 aa, Cryptosporidium hominis
HQNETVSESSKP

SEQ ID NO: 2144840 - protein, 7 aa, Cryptosporidium hominis
HQNIGKE

SEQ ID NO: 2144841 - protein, 4 aa, Cryptosporidium hominis
HQNL

SEQ ID NO: 2144842 - protein, 21 aa, Cryptosporidium hominis
HQNQQQQQQFQRQNYGQNQLQ

SEQ ID NO: 2144843 - protein, 34 aa, Cryptosporidium hominis
HQNSGNSSSGVETTSTIEDSSSSSSTSAKPVESH

SEQ ID NO: 2144844 - protein, 9 aa, Cryptosporidium hominis
HQNSVKPPH

SEQ ID NO: 2144845 - protein, 18 aa, Cryptosporidium hominis
HQNVQNPNTAVSNPRVNR

SEQ ID NO: 2144846 - protein, 4 aa, Cryptosporidium hominis
HQPP

SEQ ID NO: 2144847 - protein, 47 aa, Cryptosporidium hominis
HQPTPPSIPASEPSAKEVVTEESQKKEFSPESPPSEESEVEGTSTNE

SEQ ID NO: 2144848 - protein, 5 aa, Cryptosporidium hominis
HQQEP

SEQ ID NO: 2144849 - protein, 12 aa, Cryptosporidium hominis
HQQQQQQQQQQL

SEQ ID NO: 2144850 - protein, 23 aa, Cryptosporidium hominis
HQQRQQQQHQKQQQQHQQQHQQQ

SEQ ID NO: 2144851 - protein, 6 aa, Cryptosporidium hominis
HQSSTM

SEQ ID NO: 2144852 - protein, 16 aa, Cryptosporidium hominis
HQTETTQKNRTEYDKS

SEQ ID NO: 2144853 - protein, 8 aa, Cryptosporidium hominis
HQTGRHNS

SEQ ID NO: 2144854 - protein, 4 aa, Cryptosporidium hominis
HQTK

SEQ ID NO: 2144855 - protein, 4 aa, Cryptosporidium hominis
HQTN

SEQ ID NO: 2144856 - protein, 5 aa, Cryptosporidium hominis
HQTNA

SEQ ID NO: 2144857 - protein, 8 aa, Cryptosporidium hominis
HQTNNSQV

SEQ ID NO: 2144858 - protein, 4 aa, Cryptosporidium hominis
HRDG

SEQ ID NO: 2144859 - protein, 7 aa, Cryptosporidium hominis
HRDPDQG

SEQ ID NO: 2144860 - protein, 6 aa, Cryptosporidium hominis
HRDSET

SEQ ID NO: 2144861 - protein, 8 aa, Cryptosporidium hominis
HREENDLG

SEQ ID NO: 2144862 - protein, 7 aa, Cryptosporidium hominis
HREERNK

SEQ ID NO: 2144863 - protein, 46 aa, Cryptosporidium hominis
HRENKYSKKHKNYYSESGSSSDSEIDRSGHKRRHEPDNYDWKDRSK

SEQ ID NO: 2144864 - protein, 15 aa, Cryptosporidium hominis
HRGENKGSNFSTSET

SEQ ID NO: 2144865 - protein, 6 aa, Cryptosporidium hominis
HRGEPD

SEQ ID NO: 2144866 - protein, 7 aa, Cryptosporidium hominis
HRGRTAD

SEQ ID NO: 2144867 - protein, 5 aa, Cryptosporidium hominis
HRIEG

SEQ ID NO: 2144868 - protein, 9 aa, Cryptosporidium hominis
HRKSKPEQI

SEQ ID NO: 2144869 - protein, 10 aa, Cryptosporidium hominis
HRKSTNNVTW

SEQ ID NO: 2144870 - protein, 8 aa, Cryptosporidium hominis
HRLPPSGG

SEQ ID NO: 2144871 - protein, 19 aa, Cryptosporidium hominis
HRNDDDNNSNANSNNFVDD

SEQ ID NO: 2144872 - protein, 8 aa, Cryptosporidium hominis
HRNNKTAT

SEQ ID NO: 2144873 - protein, 13 aa, Cryptosporidium hominis
HRNNQVPQYTQRA

SEQ ID NO: 2144874 - protein, 27 aa, Cryptosporidium hominis
HRNSRHHDSRYNDKGDNSGSLESQRFE

SEQ ID NO: 2144875 - protein, 6 aa, Cryptosporidium hominis
HRPDYV

SEQ ID NO: 2144876 - protein, 6 aa, Cryptosporidium hominis
HRPERN

SEQ ID NO: 2144877 - protein, 5 aa, Cryptosporidium hominis
HRPTL

SEQ ID NO: 2144878 - protein, 8 aa, Cryptosporidium hominis
HRQSIEDY

SEQ ID NO: 2144879 - protein, 10 aa, Cryptosporidium hominis
HRQSSARSIF

SEQ ID NO: 2144880 - protein, 7 aa, Cryptosporidium hominis
HRRDPGI

SEQ ID NO: 2144881 - protein, 5 aa, Cryptosporidium hominis
HRRTT

SEQ ID NO: 2144882 - protein, 8 aa, Cryptosporidium hominis
HRSGRDLT

SEQ ID NO: 2144883 - protein, 7 aa, Cryptosporidium hominis
HRSKGAK

SEQ ID NO: 2144884 - protein, 7 aa, Cryptosporidium hominis
HRTGRSK

SEQ ID NO: 2144885 - protein, 6 aa, Cryptosporidium hominis
HRTGTK

SEQ ID NO: 2144886 - protein, 15 aa, Cryptosporidium hominis
HRTQEKRGKNESDSG

SEQ ID NO: 2144887 - protein, 13 aa, Cryptosporidium hominis
HRTRSHRQSRTQN

SEQ ID NO: 2144888 - protein, 10 aa, Cryptosporidium hominis
HRYDTSEKVE

SEQ ID NO: 2144889 - protein, 15 aa, Cryptosporidium hominis
HSAASNDSKIPTFDE

SEQ ID NO: 2144890 - protein, 6 aa, Cryptosporidium hominis
HSAGNI

SEQ ID NO: 2144891 - protein, 4 aa, Cryptosporidium hominis
HSDH

SEQ ID NO: 2144892 - protein, 7 aa, Cryptosporidium hominis
HSDMSSI

SEQ ID NO: 2144893 - protein, 15 aa, Cryptosporidium hominis
HSDQPGSNSFTPKGS

SEQ ID NO: 2144894 - protein, 12 aa, Cryptosporidium hominis
HSDSQDSPKGDI

SEQ ID NO: 2144895 - protein, 4 aa, Cryptosporidium hominis
HSDT

SEQ ID NO: 2144896 - protein, 11 aa, Cryptosporidium hominis
HSDTTERRDHE

SEQ ID NO: 2144897 - protein, 12 aa, Cryptosporidium hominis
HSDTTYTNTPSW

SEQ ID NO: 2144898 - protein, 6 aa, Cryptosporidium hominis
HSDYTR

SEQ ID NO: 2144899 - protein, 17 aa, Cryptosporidium hominis
HSEEEEEKEEEEKTERM

SEQ ID NO: 2144900 - protein, 6 aa, Cryptosporidium hominis
HSEIRE

SEQ ID NO: 2144901 - protein, 24 aa, Cryptosporidium hominis
HSENKVCNTNNETKKTQESEYLTE

SEQ ID NO: 2144902 - protein, 5 aa, Cryptosporidium hominis
HSEPQ

SEQ ID NO: 2144903 - protein, 4 aa, Cryptosporidium hominis
HSER

SEQ ID NO: 2144904 - protein, 4 aa, Cryptosporidium hominis
HSET

SEQ ID NO: 2144905 - protein, 5 aa, Cryptosporidium hominis
HSETR

SEQ ID NO: 2144906 - protein, 7 aa, Cryptosporidium hominis
HSETSQE

SEQ ID NO: 2144907 - protein, 10 aa, Cryptosporidium hominis
HSGKSSSPKF

SEQ ID NO: 2144908 - protein, 4 aa, Cryptosporidium hominis
HSGP

SEQ ID NO: 2144909 - protein, 33 aa, Cryptosporidium hominis
HSGRSSSSAFSANNSKGGGGRLGAKTNQNINRN

SEQ ID NO: 2144910 - protein, 6 aa, Cryptosporidium hominis
HSGVGK

SEQ ID NO: 2144911 - protein, 11 aa, Cryptosporidium hominis
HSIKGQQNHPV

SEQ ID NO: 2144912 - protein, 5 aa, Cryptosporidium hominis
HSITE

SEQ ID NO: 2144913 - protein, 6 aa, Cryptosporidium hominis
HSKEGY

SEQ ID NO: 2144914 - protein, 8 aa, Cryptosporidium hominis
HSKELGKQ

SEQ ID NO: 2144915 - protein, 14 aa, Cryptosporidium hominis
HSKGQKLSGKTEAE

SEQ ID NO: 2144916 - protein, 8 aa, Cryptosporidium hominis
HSKGSQIE

SEQ ID NO: 2144917 - protein, 34 aa, Cryptosporidium hominis
HSKPKHDHEVQNSEASTSTNEPPKPKLKASDISV

SEQ ID NO: 2144918 - protein, 10 aa, Cryptosporidium hominis
HSKSSGLNAS

SEQ ID NO: 2144919 - protein, 20 aa, Cryptosporidium hominis
HSKSTASNTENIQNEISNNS

SEQ ID NO: 2144920 - protein, 7 aa, Cryptosporidium hominis
HSKSTIQ

SEQ ID NO: 2144921 - protein, 6 aa, Cryptosporidium hominis
HSKSVD

SEQ ID NO: 2144922 - protein, 9 aa, Cryptosporidium hominis
HSKTDKGAQ

SEQ ID NO: 2144923 - protein, 22 aa, Cryptosporidium hominis
HSKTSTSAAEGSKLGKETNQNA

SEQ ID NO: 2144924 - protein, 15 aa, Cryptosporidium hominis
HSLGGSSEIKSSEDN

SEQ ID NO: 2144925 - protein, 14 aa, Cryptosporidium hominis
HSLKDSEKTNLNEQ

SEQ ID NO: 2144926 - protein, 5 aa, Cryptosporidium hominis
HSLTS

SEQ ID NO: 2144927 - protein, 11 aa, Cryptosporidium hominis
HSNDGAYTKEN

SEQ ID NO: 2144928 - protein, 10 aa, Cryptosporidium hominis
HSNESSQGRE

SEQ ID NO: 2144929 - protein, 4 aa, Cryptosporidium hominis
HSNL

SEQ ID NO: 2144930 - protein, 14 aa, Cryptosporidium hominis
HSNNENEHGNSITE

SEQ ID NO: 2144931 - protein, 7 aa, Cryptosporidium hominis
HSNQSYK

SEQ ID NO: 2144932 - protein, 9 aa, Cryptosporidium hominis
HSNRAWPSN

SEQ ID NO: 2144933 - protein, 6 aa, Cryptosporidium hominis
HSNSNE

SEQ ID NO: 2144934 - protein, 8 aa, Cryptosporidium hominis
HSNSNSCQ

SEQ ID NO: 2144935 - protein, 9 aa, Cryptosporidium hominis
HSNSQSVKQ

SEQ ID NO: 2144936 - protein, 4 aa, Cryptosporidium hominis
HSNT

SEQ ID NO: 2144937 - protein, 11 aa, Cryptosporidium hominis
HSNTKNNYKTF

SEQ ID NO: 2144938 - protein, 16 aa, Cryptosporidium hominis
HSNYNSNTNSNPAFGS

SEQ ID NO: 2144939 - protein, 5 aa, Cryptosporidium hominis
HSPKK

SEQ ID NO: 2144940 - protein, 18 aa, Cryptosporidium hominis
HSPKNTISTQPPNNLQPV

SEQ ID NO: 2144941 - protein, 11 aa, Cryptosporidium hominis
HSPNRDSNYRH

SEQ ID NO: 2144942 - protein, 9 aa, Cryptosporidium hominis
HSPNTSQQL

SEQ ID NO: 2144943 - protein, 15 aa, Cryptosporidium hominis
HSPPPTAQGASQQGE

SEQ ID NO: 2144944 - protein, 23 aa, Cryptosporidium hominis
HSPSSSSRSIGNNANMNPPKSPS

SEQ ID NO: 2144945 - protein, 6 aa, Cryptosporidium hominis
HSQNSH

SEQ ID NO: 2144946 - protein, 6 aa, Cryptosporidium hominis
HSQSMD

SEQ ID NO: 2144947 - protein, 6 aa, Cryptosporidium hominis
HSRGIP

SEQ ID NO: 2144948 - protein, 5 aa, Cryptosporidium hominis
HSRNR

SEQ ID NO: 2144949 - protein, 20 aa, Cryptosporidium hominis
HSRSGTPGKESCLENESERS

SEQ ID NO: 2144950 - protein, 21 aa, Cryptosporidium hominis
HSRTLNSDSRATTSSRNSGVC

SEQ ID NO: 2144951 - protein, 16 aa, Cryptosporidium hominis
HSRYDGKPNEGPRITT

SEQ ID NO: 2144952 - protein, 5 aa, Cryptosporidium hominis
HSSED

SEQ ID NO: 2144953 - protein, 17 aa, Cryptosporidium hominis
HSSEENDSISPSITSGV

SEQ ID NO: 2144954 - protein, 6 aa, Cryptosporidium hominis
HSSEYK

SEQ ID NO: 2144955 - protein, 7 aa, Cryptosporidium hominis
HSSGYTH

SEQ ID NO: 2144956 - protein, 6 aa, Cryptosporidium hominis
HSSIVG

SEQ ID NO: 2144957 - protein, 6 aa, Cryptosporidium hominis
HSSKIG

SEQ ID NO: 2144958 - protein, 4 aa, Cryptosporidium hominis
HSSL

SEQ ID NO: 2144959 - protein, 12 aa, Cryptosporidium hominis
HSSNAKSNSKKK

SEQ ID NO: 2144960 - protein, 18 aa, Cryptosporidium hominis
HSSNNQSPITMGGNSAHN

SEQ ID NO: 2144961 - protein, 9 aa, Cryptosporidium hominis
HSSNPPINK

SEQ ID NO: 2144962 - protein, 11 aa, Cryptosporidium hominis
HSSNSKESNIN

SEQ ID NO: 2144963 - protein, 6 aa, Cryptosporidium hominis
HSSQSN

SEQ ID NO: 2144964 - protein, 4 aa, Cryptosporidium hominis
HSSS

SEQ ID NO: 2144965 - protein, 18 aa, Cryptosporidium hominis
HSSSSRKANNSGAPANSN

SEQ ID NO: 2144966 - protein, 10 aa, Cryptosporidium hominis
HSSSSTNGTK

SEQ ID NO: 2144967 - protein, 4 aa, Cryptosporidium hominis
HSST

SEQ ID NO: 2144968 - protein, 6 aa, Cryptosporidium hominis
HSSTGY

SEQ ID NO: 2144969 - protein, 13 aa, Cryptosporidium hominis
HSSVEKSGSISET

SEQ ID NO: 2144970 - protein, 17 aa, Cryptosporidium hominis
HSTQKSTSKKKGLNTSF

SEQ ID NO: 2144971 - protein, 9 aa, Cryptosporidium hominis
HSTVGTPQY

SEQ ID NO: 2144972 - protein, 8 aa, Cryptosporidium hominis
HSVSGRNK

SEQ ID NO: 2144973 - protein, 4 aa, Cryptosporidium hominis
HSYN

SEQ ID NO: 2144974 - protein, 10 aa, Cryptosporidium hominis
HSYSENPTIH

SEQ ID NO: 2144975 - protein, 8 aa, Cryptosporidium hominis
HTAESASV

SEQ ID NO: 2144976 - protein, 12 aa, Cryptosporidium hominis
HTAQEDLPVYNS

SEQ ID NO: 2144977 - protein, 6 aa, Cryptosporidium hominis
HTDRVN

SEQ ID NO: 2144978 - protein, 4 aa, Cryptosporidium hominis
HTEE

SEQ ID NO: 2144979 - protein, 12 aa, Cryptosporidium hominis
HTENSGDEKSIS

SEQ ID NO: 2144980 - protein, 5 aa, Cryptosporidium hominis
HTGEP

SEQ ID NO: 2144981 - protein, 4 aa, Cryptosporidium hominis
HTGG

SEQ ID NO: 2144982 - protein, 6 aa, Cryptosporidium hominis
HTGPVH

SEQ ID NO: 2144983 - protein, 5 aa, Cryptosporidium hominis
HTGRA

SEQ ID NO: 2144984 - protein, 10 aa, Cryptosporidium hominis
HTHADEKTPS

SEQ ID NO: 2144985 - protein, 10 aa, Cryptosporidium hominis
HTKDDTEENI

SEQ ID NO: 2144986 - protein, 8 aa, Cryptosporidium hominis
HTKNKNQV

SEQ ID NO: 2144987 - protein, 8 aa, Cryptosporidium hominis
HTKSSGSL

SEQ ID NO: 2144988 - protein, 5 aa, Cryptosporidium hominis
HTNIS

SEQ ID NO: 2144989 - protein, 6 aa, Cryptosporidium hominis
HTNNKK

SEQ ID NO: 2144990 - protein, 35 aa, Cryptosporidium hominis
HTNNSNDDGIISTEGVGGGVVSTSSATVTSSTSLE

SEQ ID NO: 2144991 - protein, 32 aa, Cryptosporidium hominis
HTNSNVSEFSSKSGAKKINSTEKIDSPMTTRR

SEQ ID NO: 2144992 - protein, 7 aa, Cryptosporidium hominis
HTNTGAV

SEQ ID NO: 2144993 - protein, 15 aa, Cryptosporidium hominis
HTPAPGEVAPAGRPS

SEQ ID NO: 2144994 - protein, 29 aa, Cryptosporidium hominis
HTPKSTGSEDYDNNTNETGHETTGNHSHS

SEQ ID NO: 2144995 - protein, 9 aa, Cryptosporidium hominis
HTQNPTKME

SEQ ID NO: 2144996 - protein, 43 aa, Cryptosporidium hominis
HTQPNNNIQPPSHPRTQPLPHPYSQGNSGHQVSSQNSSSSSIH

SEQ ID NO: 2144997 - protein, 21 aa, Cryptosporidium hominis
HTQRENSTGNNFQSRNTRYGG

SEQ ID NO: 2144998 - protein, 10 aa, Cryptosporidium hominis
HTQTRMQNGS

SEQ ID NO: 2144999 - protein, 12 aa, Cryptosporidium hominis
HTRDSSSVTDED

SEQ ID NO: 2145000 - protein, 5 aa, Cryptosporidium hominis
HTRKP

SEQ ID NO: 2145001 - protein, 5 aa, Cryptosporidium hominis
HTSAY

SEQ ID NO: 2145002 - protein, 8 aa, Cryptosporidium hominis
HTSDQEPN

SEQ ID NO: 2145003 - protein, 5 aa, Cryptosporidium hominis
HTSIS

SEQ ID NO: 2145004 - protein, 5 aa, Cryptosporidium hominis
HTSNN

SEQ ID NO: 2145005 - protein, 6 aa, Cryptosporidium hominis
HTSQGH

SEQ ID NO: 2145006 - protein, 14 aa, Cryptosporidium hominis
HTSTAQLTADEFEN

SEQ ID NO: 2145007 - protein, 4 aa, Cryptosporidium hominis
HTTL

SEQ ID NO: 2145008 - protein, 6 aa, Cryptosporidium hominis
HTTLRK

SEQ ID NO: 2145009 - protein, 8 aa, Cryptosporidium hominis
HTYPSDTV

SEQ ID NO: 2145010 - protein, 5 aa, Cryptosporidium hominis
HVDEA

SEQ ID NO: 2145011 - protein, 6 aa, Cryptosporidium hominis
HVENTS

SEQ ID NO: 2145012 - protein, 8 aa, Cryptosporidium hominis
HVNDNKTC

SEQ ID NO: 2145013 - protein, 10 aa, Cryptosporidium hominis
HVNNSENEQS

SEQ ID NO: 2145014 - protein, 8 aa, Cryptosporidium hominis
HVNSNESL

SEQ ID NO: 2145015 - protein, 5 aa, Cryptosporidium hominis
HVPNA

SEQ ID NO: 2145016 - protein, 9 aa, Cryptosporidium hominis
HVPNRPDEL

SEQ ID NO: 2145017 - protein, 12 aa, Cryptosporidium hominis
HVPPPQISSNQS

SEQ ID NO: 2145018 - protein, 8 aa, Cryptosporidium hominis
HVPSDNDK

SEQ ID NO: 2145019 - protein, 8 aa, Cryptosporidium hominis
HVPTGDIP

SEQ ID NO: 2145020 - protein, 10 aa, Cryptosporidium hominis
HWSSSNEPQP

SEQ ID NO: 2145021 - protein, 12 aa, Cryptosporidium hominis
HYEDDIEAKRRA

SEQ ID NO: 2145022 - protein, 5 aa, Cryptosporidium hominis
HYGGE

SEQ ID NO: 2145023 - protein, 4 aa, Cryptosporidium hominis
HYKN

SEQ ID NO: 2145024 - protein, 13 aa, Cryptosporidium hominis
HYKNSKKESHMAG

SEQ ID NO: 2145025 - protein, 12 aa, Cryptosporidium hominis
HYRNKNLSSSIG

SEQ ID NO: 2145026 - protein, 12 aa, Cryptosporidium hominis
HYSAQKEEKRSL

SEQ ID NO: 2145027 - protein, 12 aa, Cryptosporidium hominis
HYSKSNRKPVEN

SEQ ID NO: 2145028 - protein, 7 aa, Cryptosporidium hominis
HYSSSSN

SEQ ID NO: 2145029 - protein, 6 aa, Cryptosporidium hominis
HYTEGA

SEQ ID NO: 2145030 - protein, 21 aa, Cryptosporidium hominis
IAAERAARKLAKEAKKVQKNN

SEQ ID NO: 2145031 - protein, 18 aa, Cryptosporidium hominis
IAAPSANRSGHISPTSPL

SEQ ID NO: 2145032 - protein, 4 aa, Cryptosporidium hominis
IAAT

SEQ ID NO: 2145033 - protein, 16 aa, Cryptosporidium hominis
IADTSIQDSPINAAST

SEQ ID NO: 2145034 - protein, 5 aa, Cryptosporidium hominis
IAERE

SEQ ID NO: 2145035 - protein, 9 aa, Cryptosporidium hominis
IAERQQDGS

SEQ ID NO: 2145036 - protein, 7 aa, Cryptosporidium hominis
IAESTLD

SEQ ID NO: 2145037 - protein, 9 aa, Cryptosporidium hominis
IAETGAGQH

SEQ ID NO: 2145038 - protein, 4 aa, Cryptosporidium hominis
IAGE

SEQ ID NO: 2145039 - protein, 4 aa, Cryptosporidium hominis
IAGG

SEQ ID NO: 2145040 - protein, 9 aa, Cryptosporidium hominis
IAGKADSDI

SEQ ID NO: 2145041 - protein, 6 aa, Cryptosporidium hominis
IAGRSY

SEQ ID NO: 2145042 - protein, 8 aa, Cryptosporidium hominis
IAGSSSGS

SEQ ID NO: 2145043 - protein, 6 aa, Cryptosporidium hominis
IAGTTT

SEQ ID NO: 2145044 - protein, 6 aa, Cryptosporidium hominis
IAHSDS

SEQ ID NO: 2145045 - protein, 12 aa, Cryptosporidium hominis
IAKDEDDADEDE

SEQ ID NO: 2145046 - protein, 8 aa, Cryptosporidium hominis
IAKEDPNR

SEQ ID NO: 2145047 - protein, 14 aa, Cryptosporidium hominis
IAKESQNREAADDD

SEQ ID NO: 2145048 - protein, 36 aa, Cryptosporidium hominis
IAKKESKKSEIDEIKDEKTDGQDYKNEQDEDKDFCR

SEQ ID NO: 2145049 - protein, 8 aa, Cryptosporidium hominis
IAKKRPAY

SEQ ID NO: 2145050 - protein, 18 aa, Cryptosporidium hominis
IAKSISKSFSKSSMKSFQ

SEQ ID NO: 2145051 - protein, 9 aa, Cryptosporidium hominis
IAKSSYGSI

SEQ ID NO: 2145052 - protein, 9 aa, Cryptosporidium hominis
IANDQEQAK

SEQ ID NO: 2145053 - protein, 12 aa, Cryptosporidium hominis
IANESEEELGED

SEQ ID NO: 2145054 - protein, 8 aa, Cryptosporidium hominis
IANKGDIS

SEQ ID NO: 2145055 - protein, 8 aa, Cryptosporidium hominis
IANRPQKP

SEQ ID NO: 2145056 - protein, 20 aa, Cryptosporidium hominis
IANSNVNTADVSASKLTPAQ

SEQ ID NO: 2145057 - protein, 15 aa, Cryptosporidium hominis
IAPGVGANPPTVASG

SEQ ID NO: 2145058 - protein, 13 aa, Cryptosporidium hominis
IAPKREKTNGEVE

SEQ ID NO: 2145059 - protein, 5 aa, Cryptosporidium hominis
IAPRN

SEQ ID NO: 2145060 - protein, 4 aa, Cryptosporidium hominis
IAPT

SEQ ID NO: 2145061 - protein, 7 aa, Cryptosporidium hominis
IAQDEES

SEQ ID NO: 2145062 - protein, 4 aa, Cryptosporidium hominis
IAQR

SEQ ID NO: 2145063 - protein, 20 aa, Cryptosporidium hominis
IAQSPLSENLSKSSPKIEKE

SEQ ID NO: 2145064 - protein, 7 aa, Cryptosporidium hominis
IARDTEK

SEQ ID NO: 2145065 - protein, 7 aa, Cryptosporidium hominis
IARSGTK

SEQ ID NO: 2145066 - protein, 10 aa, Cryptosporidium hominis
IASEKSANIN

SEQ ID NO: 2145067 - protein, 8 aa, Cryptosporidium hominis
IASGNNSP

SEQ ID NO: 2145068 - protein, 23 aa, Cryptosporidium hominis
IASGNTELSGNSNNCSGNTQNGT

SEQ ID NO: 2145069 - protein, 4 aa, Cryptosporidium hominis
IASI

SEQ ID NO: 2145070 - protein, 5 aa, Cryptosporidium hominis
IASKG

SEQ ID NO: 2145071 - protein, 10 aa, Cryptosporidium hominis
IASKNQGTKL

SEQ ID NO: 2145072 - protein, 8 aa, Cryptosporidium hominis
IASQSKPV

SEQ ID NO: 2145073 - protein, 9 aa, Cryptosporidium hominis
IASQSSQNL

SEQ ID NO: 2145074 - protein, 8 aa, Cryptosporidium hominis
IASSSDSG

SEQ ID NO: 2145075 - protein, 8 aa, Cryptosporidium hominis
IASSSPLG

SEQ ID NO: 2145076 - protein, 6 aa, Cryptosporidium hominis
IASTSY

SEQ ID NO: 2145077 - protein, 12 aa, Cryptosporidium hominis
IATETHGWNGSD

SEQ ID NO: 2145078 - protein, 7 aa, Cryptosporidium hominis
IATGGRN

SEQ ID NO: 2145079 - protein, 9 aa, Cryptosporidium hominis
IATPRTKAT

SEQ ID NO: 2145080 - protein, 18 aa, Cryptosporidium hominis
ICGDSKGLKANESEIGVG

SEQ ID NO: 2145081 - protein, 63 aa, Cryptosporidium hominis
ICKTASKSCNSKSSKISVKKETPKSTSLSSSKSRKSSLSKSSIATTKASNSHPIKKEQGTVKP

SEQ ID NO: 2145082 - protein, 10 aa, Cryptosporidium hominis
IDAKKRLNAD

SEQ ID NO: 2145083 - protein, 11 aa, Cryptosporidium hominis
IDASDDNYSKQ

SEQ ID NO: 2145084 - protein, 6 aa, Cryptosporidium hominis
IDCGSR

SEQ ID NO: 2145085 - protein, 6 aa, Cryptosporidium hominis
IDDDNI

SEQ ID NO: 2145086 - protein, 19 aa, Cryptosporidium hominis
IDDDVESKSNISSSAPVTV

SEQ ID NO: 2145087 - protein, 12 aa, Cryptosporidium hominis
IDDEEDDNEEDE

SEQ ID NO: 2145088 - protein, 9 aa, Cryptosporidium hominis
IDDGKSSGV

SEQ ID NO: 2145089 - protein, 7 aa, Cryptosporidium hominis
IDDGQPL

SEQ ID NO: 2145090 - protein, 9 aa, Cryptosporidium hominis
IDDKNETYR

SEQ ID NO: 2145091 - protein, 9 aa, Cryptosporidium hominis
IDDNGELER

SEQ ID NO: 2145092 - protein, 6 aa, Cryptosporidium hominis
IDDPAN

SEQ ID NO: 2145093 - protein, 7 aa, Cryptosporidium hominis
IDDPEKK

SEQ ID NO: 2145094 - protein, 9 aa, Cryptosporidium hominis
IDDPSASNP

SEQ ID NO: 2145095 - protein, 5 aa, Cryptosporidium hominis
IDDSI

SEQ ID NO: 2145096 - protein, 5 aa, Cryptosporidium hominis
IDDSK

SEQ ID NO: 2145097 - protein, 6 aa, Cryptosporidium hominis
IDDSNS

SEQ ID NO: 2145098 - protein, 43 aa, Cryptosporidium hominis
IDEDEEEEEEEEEEEEEEEEEEKLEMTSDSDSAQSDERPEFER

SEQ ID NO: 2145099 - protein, 21 aa, Cryptosporidium hominis
IDEDNSDSKTDATLSGTTNIP

SEQ ID NO: 2145100 - protein, 9 aa, Cryptosporidium hominis
IDEENEDDL

SEQ ID NO: 2145101 - protein, 11 aa, Cryptosporidium hominis
IDEENSNKSNF

SEQ ID NO: 2145102 - protein, 5 aa, Cryptosporidium hominis
IDEET

SEQ ID NO: 2145103 - protein, 24 aa, Cryptosporidium hominis
IDEIEQDKNHDKNLESDYQHQDQN

SEQ ID NO: 2145104 - protein, 4 aa, Cryptosporidium hominis
IDEK

SEQ ID NO: 2145105 - protein, 29 aa, Cryptosporidium hominis
IDEKEKKNKKLKETKDANNKECSTISSDI

SEQ ID NO: 2145106 - protein, 11 aa, Cryptosporidium hominis
IDEKPSPDINP

SEQ ID NO: 2145107 - protein, 5 aa, Cryptosporidium hominis
IDEKS

SEQ ID NO: 2145108 - protein, 11 aa, Cryptosporidium hominis
IDEKSSQKNFN

SEQ ID NO: 2145109 - protein, 10 aa, Cryptosporidium hominis
IDENASTRSQ

SEQ ID NO: 2145110 - protein, 8 aa, Cryptosporidium hominis
IDENEKDL

SEQ ID NO: 2145111 - protein, 4 aa, Cryptosporidium hominis
IDEP

SEQ ID NO: 2145112 - protein, 10 aa, Cryptosporidium hominis
IDEPQSSTCY

SEQ ID NO: 2145113 - protein, 6 aa, Cryptosporidium hominis
IDEQHP

SEQ ID NO: 2145114 - protein, 8 aa, Cryptosporidium hominis
IDESENER

SEQ ID NO: 2145115 - protein, 12 aa, Cryptosporidium hominis
IDESQETSSMQI

SEQ ID NO: 2145116 - protein, 4 aa, Cryptosporidium hominis
IDET

SEQ ID NO: 2145117 - protein, 10 aa, Cryptosporidium hominis
IDEYSKKDNF

SEQ ID NO: 2145118 - protein, 7 aa, Cryptosporidium hominis
IDGAATS

SEQ ID NO: 2145119 - protein, 18 aa, Cryptosporidium hominis
IDGDDENDYEESEEGSDT

SEQ ID NO: 2145120 - protein, 4 aa, Cryptosporidium hominis
IDGE

SEQ ID NO: 2145121 - protein, 4 aa, Cryptosporidium hominis
IDGM

SEQ ID NO: 2145122 - protein, 4 aa, Cryptosporidium hominis
IDGQ

SEQ ID NO: 2145123 - protein, 5 aa, Cryptosporidium hominis
IDGTD

SEQ ID NO: 2145124 - protein, 14 aa, Cryptosporidium hominis
IDGTSSNSNNTSSY

SEQ ID NO: 2145125 - protein, 7 aa, Cryptosporidium hominis
IDIDGRG

SEQ ID NO: 2145126 - protein, 21 aa, Cryptosporidium hominis
IDKENQSNLNISNTSQTTSLK

SEQ ID NO: 2145127 - protein, 13 aa, Cryptosporidium hominis
IDKKRSDNNNFHK

SEQ ID NO: 2145128 - protein, 4 aa, Cryptosporidium hominis
IDKP

SEQ ID NO: 2145129 - protein, 10 aa, Cryptosporidium hominis
IDKPKKPRDL

SEQ ID NO: 2145130 - protein, 8 aa, Cryptosporidium hominis
IDKQPTGI

SEQ ID NO: 2145131 - protein, 47 aa, Cryptosporidium hominis
IDNESELSDESLSEFGQTSKMQKTRERSNRNKGGKSRSQSQKSEDLD

SEQ ID NO: 2145132 - protein, 4 aa, Cryptosporidium hominis
IDNF

SEQ ID NO: 2145133 - protein, 5 aa, Cryptosporidium hominis
IDNID

SEQ ID NO: 2145134 - protein, 7 aa, Cryptosporidium hominis
IDNIDPS

SEQ ID NO: 2145135 - protein, 10 aa, Cryptosporidium hominis
IDNIENPNNK

SEQ ID NO: 2145136 - protein, 35 aa, Cryptosporidium hominis
IDNKQNNKKKKKKKKKKGKENLYEDKDDTYDPDLP

SEQ ID NO: 2145137 - protein, 5 aa, Cryptosporidium hominis
IDNPA

SEQ ID NO: 2145138 - protein, 12 aa, Cryptosporidium hominis
IDNQSESSSYKN

SEQ ID NO: 2145139 - protein, 6 aa, Cryptosporidium hominis
IDNRQD

SEQ ID NO: 2145140 - protein, 4 aa, Cryptosporidium hominis
IDNS

SEQ ID NO: 2145141 - protein, 8 aa, Cryptosporidium hominis
IDNSASSN

SEQ ID NO: 2145142 - protein, 7 aa, Cryptosporidium hominis
IDNSERK

SEQ ID NO: 2145143 - protein, 9 aa, Cryptosporidium hominis
IDNSGTNNV

SEQ ID NO: 2145144 - protein, 18 aa, Cryptosporidium hominis
IDNSNDEKKIKSPGNNQI

SEQ ID NO: 2145145 - protein, 22 aa, Cryptosporidium hominis
IDNSSEPKSIIRSSNNKSVPGW

SEQ ID NO: 2145146 - protein, 18 aa, Cryptosporidium hominis
IDNSTSNTGNTSNTEGGV

SEQ ID NO: 2145147 - protein, 9 aa, Cryptosporidium hominis
IDNTNESVE

SEQ ID NO: 2145148 - protein, 9 aa, Cryptosporidium hominis
IDPEGTDTI

SEQ ID NO: 2145149 - protein, 5 aa, Cryptosporidium hominis
IDPER

SEQ ID NO: 2145150 - protein, 9 aa, Cryptosporidium hominis
IDPESKALQ

SEQ ID NO: 2145151 - protein, 9 aa, Cryptosporidium hominis
IDPESPPDL

SEQ ID NO: 2145152 - protein, 6 aa, Cryptosporidium hominis
IDPINN

SEQ ID NO: 2145153 - protein, 6 aa, Cryptosporidium hominis
IDPKSI

SEQ ID NO: 2145154 - protein, 5 aa, Cryptosporidium hominis
IDPNG

SEQ ID NO: 2145155 - protein, 9 aa, Cryptosporidium hominis
IDPNPTNGG

SEQ ID NO: 2145156 - protein, 7 aa, Cryptosporidium hominis
IDPPAVA

SEQ ID NO: 2145157 - protein, 5 aa, Cryptosporidium hominis
IDPPT

SEQ ID NO: 2145158 - protein, 12 aa, Cryptosporidium hominis
IDPSLSGSQAEA

SEQ ID NO: 2145159 - protein, 8 aa, Cryptosporidium hominis
IDPSNFND

SEQ ID NO: 2145160 - protein, 13 aa, Cryptosporidium hominis
IDPSNLNQKQLNN

SEQ ID NO: 2145161 - protein, 5 aa, Cryptosporidium hominis
IDPTK

SEQ ID NO: 2145162 - protein, 7 aa, Cryptosporidium hominis
IDPTLTR

SEQ ID NO: 2145163 - protein, 6 aa, Cryptosporidium hominis
IDPTQD

SEQ ID NO: 2145164 - protein, 7 aa, Cryptosporidium hominis
IDQEPIE

SEQ ID NO: 2145165 - protein, 6 aa, Cryptosporidium hominis
IDQERR

SEQ ID NO: 2145166 - protein, 96 aa, Cryptosporidium hominis
IDQESYSEISSPQKPKIEGKEETGYDQDLDKEQDQNLEQDQEQEQEQEQEQEQDQDREQEQDQEGAASERSEGKTYSQKTDGDASSVITQTSQNAV

SEQ ID NO: 2145167 - protein, 14 aa, Cryptosporidium hominis
IDQGTGGASDDSQY

SEQ ID NO: 2145168 - protein, 4 aa, Cryptosporidium hominis
IDQK

SEQ ID NO: 2145169 - protein, 11 aa, Cryptosporidium hominis
IDQKRSASTNV

SEQ ID NO: 2145170 - protein, 5 aa, Cryptosporidium hominis
IDQNK

SEQ ID NO: 2145171 - protein, 10 aa, Cryptosporidium hominis
IDQNNSSRQI

SEQ ID NO: 2145172 - protein, 10 aa, Cryptosporidium hominis
IDQRDLENGT

SEQ ID NO: 2145173 - protein, 25 aa, Cryptosporidium hominis
IDQSSDIKETQKTNNIITTENDNNR

SEQ ID NO: 2145174 - protein, 7 aa, Cryptosporidium hominis
IDQTKKG

SEQ ID NO: 2145175 - protein, 6 aa, Cryptosporidium hominis
IDRSSG

SEQ ID NO: 2145176 - protein, 11 aa, Cryptosporidium hominis
IDSANTNNNQK

SEQ ID NO: 2145177 - protein, 9 aa, Cryptosporidium hominis
IDSDDEALQ

SEQ ID NO: 2145178 - protein, 11 aa, Cryptosporidium hominis
IDSEDSQQSLV

SEQ ID NO: 2145179 - protein, 6 aa, Cryptosporidium hominis
IDSESN

SEQ ID NO: 2145180 - protein, 5 aa, Cryptosporidium hominis
IDSET

SEQ ID NO: 2145181 - protein, 6 aa, Cryptosporidium hominis
IDSEYN

SEQ ID NO: 2145182 - protein, 5 aa, Cryptosporidium hominis
IDSNK

SEQ ID NO: 2145183 - protein, 6 aa, Cryptosporidium hominis
IDSNNE

SEQ ID NO: 2145184 - protein, 10 aa, Cryptosporidium hominis
IDSNNSQNQI

SEQ ID NO: 2145185 - protein, 10 aa, Cryptosporidium hominis
IDSNQSSGAE

SEQ ID NO: 2145186 - protein, 13 aa, Cryptosporidium hominis
IDSNSEGISESSK

SEQ ID NO: 2145187 - protein, 11 aa, Cryptosporidium hominis
IDSNSITDSET

SEQ ID NO: 2145188 - protein, 11 aa, Cryptosporidium hominis
IDSNTNSRPNI

SEQ ID NO: 2145189 - protein, 16 aa, Cryptosporidium hominis
IDSNTSSNVGNGGPSC

SEQ ID NO: 2145190 - protein, 7 aa, Cryptosporidium hominis
IDSRPNW

SEQ ID NO: 2145191 - protein, 5 aa, Cryptosporidium hominis
IDSSD

SEQ ID NO: 2145192 - protein, 17 aa, Cryptosporidium hominis
IDSSINPSSQPTESSCP

SEQ ID NO: 2145193 - protein, 8 aa, Cryptosporidium hominis
IDSSSNEH

SEQ ID NO: 2145194 - protein, 6 aa, Cryptosporidium hominis
IDSTES

SEQ ID NO: 2145195 - protein, 8 aa, Cryptosporidium hominis
IDSVEQKK

SEQ ID NO: 2145196 - protein, 11 aa, Cryptosporidium hominis
IDTKNPTEKTE

SEQ ID NO: 2145197 - protein, 7 aa, Cryptosporidium hominis
IDTNRDG

SEQ ID NO: 2145198 - protein, 4 aa, Cryptosporidium hominis
IDTP

SEQ ID NO: 2145199 - protein, 4 aa, Cryptosporidium hominis
IDTQ

SEQ ID NO: 2145200 - protein, 16 aa, Cryptosporidium hominis
IDTSDLSDSEEGEVVE

SEQ ID NO: 2145201 - protein, 9 aa, Cryptosporidium hominis
IDTSGEGSV

SEQ ID NO: 2145202 - protein, 10 aa, Cryptosporidium hominis
IDTSPSIKGN

SEQ ID NO: 2145203 - protein, 10 aa, Cryptosporidium hominis
IDTSSDEDKS

SEQ ID NO: 2145204 - protein, 17 aa, Cryptosporidium hominis
IDYDTNKASSNKESKIH

SEQ ID NO: 2145205 - protein, 31 aa, Cryptosporidium hominis
IEADERRKTITHQQEEERATSQYKAKLETEA

SEQ ID NO: 2145206 - protein, 9 aa, Cryptosporidium hominis
IEAKPGSKI

SEQ ID NO: 2145207 - protein, 4 aa, Cryptosporidium hominis
IEAS

SEQ ID NO: 2145208 - protein, 9 aa, Cryptosporidium hominis
IEASNETIK

SEQ ID NO: 2145209 - protein, 7 aa, Cryptosporidium hominis
IEATDTT

SEQ ID NO: 2145210 - protein, 16 aa, Cryptosporidium hominis
IEDDDSNNSKNTNNLY

SEQ ID NO: 2145211 - protein, 10 aa, Cryptosporidium hominis
IEDDKSELTC

SEQ ID NO: 2145212 - protein, 8 aa, Cryptosporidium hominis
IEDERDVS

SEQ ID NO: 2145213 - protein, 4 aa, Cryptosporidium hominis
IEDG

SEQ ID NO: 2145214 - protein, 16 aa, Cryptosporidium hominis
IEDGSEIVEGADEDVE

SEQ ID NO: 2145215 - protein, 15 aa, Cryptosporidium hominis
IEDKSSPQAQTSSPL

SEQ ID NO: 2145216 - protein, 17 aa, Cryptosporidium hominis
IEDNPNNQKSINKSSDL

SEQ ID NO: 2145217 - protein, 5 aa, Cryptosporidium hominis
IEDPT

SEQ ID NO: 2145218 - protein, 8 aa, Cryptosporidium hominis
IEDQNETL

SEQ ID NO: 2145219 - protein, 22 aa, Cryptosporidium hominis
IEDSTSNNSSEKQQEETSGRKE

SEQ ID NO: 2145220 - protein, 8 aa, Cryptosporidium hominis
IEDTKDAE

SEQ ID NO: 2145221 - protein, 6 aa, Cryptosporidium hominis
IEEDSG

SEQ ID NO: 2145222 - protein, 11 aa, Cryptosporidium hominis
IEEDSKKSSEL

SEQ ID NO: 2145223 - protein, 7 aa, Cryptosporidium hominis
IEEENSL

SEQ ID NO: 2145224 - protein, 4 aa, Cryptosporidium hominis
IEEG

SEQ ID NO: 2145225 - protein, 9 aa, Cryptosporidium hominis
IEEGGDPIE

SEQ ID NO: 2145226 - protein, 12 aa, Cryptosporidium hominis
IEEGRGEIKERR

SEQ ID NO: 2145227 - protein, 7 aa, Cryptosporidium hominis
IEEKENE

SEQ ID NO: 2145228 - protein, 36 aa, Cryptosporidium hominis
IEEKNNKVGDNASEENITTTTLNNNSETNNESQALE

SEQ ID NO: 2145229 - protein, 10 aa, Cryptosporidium hominis
IEEKQNPLRT

SEQ ID NO: 2145230 - protein, 6 aa, Cryptosporidium hominis
IEENDE

SEQ ID NO: 2145231 - protein, 8 aa, Cryptosporidium hominis
IEENDESK

SEQ ID NO: 2145232 - protein, 28 aa, Cryptosporidium hominis
IEENKDSESSTVENTPSLQTKSPEHTMR

SEQ ID NO: 2145233 - protein, 6 aa, Cryptosporidium hominis
IEENNP

SEQ ID NO: 2145234 - protein, 19 aa, Cryptosporidium hominis
IEENNTANNSVNPEPGQKR

SEQ ID NO: 2145235 - protein, 18 aa, Cryptosporidium hominis
IEEPNSKEFSKLKNNPTQ

SEQ ID NO: 2145236 - protein, 5 aa, Cryptosporidium hominis
IEEQP

SEQ ID NO: 2145237 - protein, 35 aa, Cryptosporidium hominis
IEERRKMESEIKKRERDMENGTIDEQNLQDSGNIT

SEQ ID NO: 2145238 - protein, 9 aa, Cryptosporidium hominis
IEESEEQPK

SEQ ID NO: 2145239 - protein, 9 aa, Cryptosporidium hominis
IEESGVTNR

SEQ ID NO: 2145240 - protein, 14 aa, Cryptosporidium hominis
IEESNDSIKRNVGG

SEQ ID NO: 2145241 - protein, 9 aa, Cryptosporidium hominis
IEESPKTNH

SEQ ID NO: 2145242 - protein, 5 aa, Cryptosporidium hominis
IEESQ

SEQ ID NO: 2145243 - protein, 8 aa, Cryptosporidium hominis
IEESSKKA

SEQ ID NO: 2145244 - protein, 25 aa, Cryptosporidium hominis
IEETEKSRSEIQSETSQESPSNQAD

SEQ ID NO: 2145245 - protein, 5 aa, Cryptosporidium hominis
IEETK

SEQ ID NO: 2145246 - protein, 14 aa, Cryptosporidium hominis
IEETKNEQENCGSE

SEQ ID NO: 2145247 - protein, 5 aa, Cryptosporidium hominis
IEETT

SEQ ID NO: 2145248 - protein, 19 aa, Cryptosporidium hominis
IEETTKNSQLSNYTSNDDK

SEQ ID NO: 2145249 - protein, 6 aa, Cryptosporidium hominis
IEEVGE

SEQ ID NO: 2145250 - protein, 9 aa, Cryptosporidium hominis
IEGDGVEGS

SEQ ID NO: 2145251 - protein, 9 aa, Cryptosporidium hominis
IEGEEGKSF

SEQ ID NO: 2145252 - protein, 9 aa, Cryptosporidium hominis
IEGGKPDDI

SEQ ID NO: 2145253 - protein, 16 aa, Cryptosporidium hominis
IEGGNDNKNGSHSSGY

SEQ ID NO: 2145254 - protein, 12 aa, Cryptosporidium hominis
IEGKEKTKAPKI

SEQ ID NO: 2145255 - protein, 7 aa, Cryptosporidium hominis
IEGPATY

SEQ ID NO: 2145256 - protein, 16 aa, Cryptosporidium hominis
IEGRDMKEKYKTLSAT

SEQ ID NO: 2145257 - protein, 8 aa, Cryptosporidium hominis
IEGRGNGI

SEQ ID NO: 2145258 - protein, 8 aa, Cryptosporidium hominis
IEHPNTSE

SEQ ID NO: 2145259 - protein, 5 aa, Cryptosporidium hominis
IEIND

SEQ ID NO: 2145260 - protein, 12 aa, Cryptosporidium hominis
IEKDGDSLSNQI

SEQ ID NO: 2145261 - protein, 19 aa, Cryptosporidium hominis
IEKDNKNLISSKNSQSPYD

SEQ ID NO: 2145262 - protein, 5 aa, Cryptosporidium hominis
IEKDS

SEQ ID NO: 2145263 - protein, 12 aa, Cryptosporidium hominis
IEKENEKVKNSD

SEQ ID NO: 2145264 - protein, 53 aa, Cryptosporidium hominis
IEKEPSKYKESIENTQRSSELSNSLEKKSDISLSSGSLGQGSESSQKEMSSES

SEQ ID NO: 2145265 - protein, 12 aa, Cryptosporidium hominis
IEKESKKKIKQT

SEQ ID NO: 2145266 - protein, 8 aa, Cryptosporidium hominis
IEKETETS

SEQ ID NO: 2145267 - protein, 7 aa, Cryptosporidium hominis
IEKFPSD

SEQ ID NO: 2145268 - protein, 5 aa, Cryptosporidium hominis
IEKPL

SEQ ID NO: 2145269 - protein, 23 aa, Cryptosporidium hominis
IEKPSKKYYTSKNNSSNNKSTID

SEQ ID NO: 2145270 - protein, 61 aa, Cryptosporidium hominis
IEKRKKSNNNIENEEDNEDCNNDDKNKNKNNNNSDSNDESDKDSIDENNNDNNELSESEKK

SEQ ID NO: 2145271 - protein, 9 aa, Cryptosporidium hominis
IEKRRGASV

SEQ ID NO: 2145272 - protein, 25 aa, Cryptosporidium hominis
IEKRRKEREELEKRDGGKNESLQKR

SEQ ID NO: 2145273 - protein, 4 aa, Cryptosporidium hominis
IEKS

SEQ ID NO: 2145274 - protein, 21 aa, Cryptosporidium hominis
IEKSDDNQQVEVKEKQNHSTN

SEQ ID NO: 2145275 - protein, 8 aa, Cryptosporidium hominis
IEKSSNEI

SEQ ID NO: 2145276 - protein, 5 aa, Cryptosporidium hominis
IENDD

SEQ ID NO: 2145277 - protein, 7 aa, Cryptosporidium hominis
IENDPNY

SEQ ID NO: 2145278 - protein, 4 aa, Cryptosporidium hominis
IENE

SEQ ID NO: 2145279 - protein, 8 aa, Cryptosporidium hominis
IENEDDKA

SEQ ID NO: 2145280 - protein, 8 aa, Cryptosporidium hominis
IENEQNKR

SEQ ID NO: 2145281 - protein, 24 aa, Cryptosporidium hominis
IENGLKGGKGGFGATIKSQKRKVN

SEQ ID NO: 2145282 - protein, 5 aa, Cryptosporidium hominis
IENKD

SEQ ID NO: 2145283 - protein, 18 aa, Cryptosporidium hominis
IENNDESNSSNNNNNNMN

SEQ ID NO: 2145284 - protein, 10 aa, Cryptosporidium hominis
IENNDNNNHQ

SEQ ID NO: 2145285 - protein, 7 aa, Cryptosporidium hominis
IENNGGT

SEQ ID NO: 2145286 - protein, 7 aa, Cryptosporidium hominis
IENNSNK

SEQ ID NO: 2145287 - protein, 8 aa, Cryptosporidium hominis
IENNSQNI

SEQ ID NO: 2145288 - protein, 26 aa, Cryptosporidium hominis
IENNTSTATITSTATTSPSVATPNIT

SEQ ID NO: 2145289 - protein, 47 aa, Cryptosporidium hominis
IENPETPKKQTRASGESNGQSSKRSRSKVEANSKLNQKSRSPKNVIK

SEQ ID NO: 2145290 - protein, 8 aa, Cryptosporidium hominis
IENPKNHC

SEQ ID NO: 2145291 - protein, 13 aa, Cryptosporidium hominis
IENPNSSLSDDQF

SEQ ID NO: 2145292 - protein, 9 aa, Cryptosporidium hominis
IENRRRKNV

SEQ ID NO: 2145293 - protein, 4 aa, Cryptosporidium hominis
IENS

SEQ ID NO: 2145294 - protein, 7 aa, Cryptosporidium hominis
IENSHSK

SEQ ID NO: 2145295 - protein, 7 aa, Cryptosporidium hominis
IENSTRK

SEQ ID NO: 2145296 - protein, 24 aa, Cryptosporidium hominis
IEPEDVGGGVEGSRIADSSRESFN

SEQ ID NO: 2145297 - protein, 10 aa, Cryptosporidium hominis
IEPEESNELT

SEQ ID NO: 2145298 - protein, 5 aa, Cryptosporidium hominis
IEPER

SEQ ID NO: 2145299 - protein, 4 aa, Cryptosporidium hominis
IEPF

SEQ ID NO: 2145300 - protein, 4 aa, Cryptosporidium hominis
IEPG

SEQ ID NO: 2145301 - protein, 6 aa, Cryptosporidium hominis
IEPGHV

SEQ ID NO: 2145302 - protein, 8 aa, Cryptosporidium hominis
IEPISKDE

SEQ ID NO: 2145303 - protein, 9 aa, Cryptosporidium hominis
IEPKDKRYK

SEQ ID NO: 2145304 - protein, 7 aa, Cryptosporidium hominis
IEPQDQN

SEQ ID NO: 2145305 - protein, 10 aa, Cryptosporidium hominis
IEPSEGSSTY

SEQ ID NO: 2145306 - protein, 5 aa, Cryptosporidium hominis
IEPTN

SEQ ID NO: 2145307 - protein, 5 aa, Cryptosporidium hominis
IEQEK

SEQ ID NO: 2145308 - protein, 8 aa, Cryptosporidium hominis
IEQESRPI

SEQ ID NO: 2145309 - protein, 35 aa, Cryptosporidium hominis
IEQGQSTQTESIESIESSEYSSLNDKKKSPEPDIS

SEQ ID NO: 2145310 - protein, 12 aa, Cryptosporidium hominis
IEQKSTDKETNS

SEQ ID NO: 2145311 - protein, 6 aa, Cryptosporidium hominis
IEQNRR

SEQ ID NO: 2145312 - protein, 8 aa, Cryptosporidium hominis
IEQQQTSR

SEQ ID NO: 2145313 - protein, 8 aa, Cryptosporidium hominis
IEQTTEEE

SEQ ID NO: 2145314 - protein, 11 aa, Cryptosporidium hominis
IEREEGEVENI

SEQ ID NO: 2145315 - protein, 10 aa, Cryptosporidium hominis
IEREERERIE

SEQ ID NO: 2145316 - protein, 18 aa, Cryptosporidium hominis
IEREERERIEREERERIE

SEQ ID NO: 2145317 - protein, 10 aa, Cryptosporidium hominis
IERENRKKLD

SEQ ID NO: 2145318 - protein, 4 aa, Cryptosporidium hominis
IERN

SEQ ID NO: 2145319 - protein, 6 aa, Cryptosporidium hominis
IERNVT

SEQ ID NO: 2145320 - protein, 8 aa, Cryptosporidium hominis
IERRSNKP

SEQ ID NO: 2145321 - protein, 8 aa, Cryptosporidium hominis
IERSGSNL

SEQ ID NO: 2145322 - protein, 4 aa, Cryptosporidium hominis
IESA

SEQ ID NO: 2145323 - protein, 10 aa, Cryptosporidium hominis
IESDNTDIYS

SEQ ID NO: 2145324 - protein, 9 aa, Cryptosporidium hominis
IESDPEIKS

SEQ ID NO: 2145325 - protein, 8 aa, Cryptosporidium hominis
IESDSDQL

SEQ ID NO: 2145326 - protein, 11 aa, Cryptosporidium hominis
IESEDNNSLTF

SEQ ID NO: 2145327 - protein, 11 aa, Cryptosporidium hominis
IESEEDNKVNS

SEQ ID NO: 2145328 - protein, 6 aa, Cryptosporidium hominis
IESERK

SEQ ID NO: 2145329 - protein, 13 aa, Cryptosporidium hominis
IESESDSTPNPEF

SEQ ID NO: 2145330 - protein, 11 aa, Cryptosporidium hominis
IESNESSKNPI

SEQ ID NO: 2145331 - protein, 18 aa, Cryptosporidium hominis
IESPKSQEISGVKQTSVE

SEQ ID NO: 2145332 - protein, 6 aa, Cryptosporidium hominis
IESPSY

SEQ ID NO: 2145333 - protein, 17 aa, Cryptosporidium hominis
IESRSQKALAGKSEDLR

SEQ ID NO: 2145334 - protein, 12 aa, Cryptosporidium hominis
IESSQESYTQNS

SEQ ID NO: 2145335 - protein, 11 aa, Cryptosporidium hominis
IESTQKSQNYF

SEQ ID NO: 2145336 - protein, 5 aa, Cryptosporidium hominis
IETCS

SEQ ID NO: 2145337 - protein, 4 aa, Cryptosporidium hominis
IETD

SEQ ID NO: 2145338 - protein, 16 aa, Cryptosporidium hominis
IETEDKRDTQSNDNDS

SEQ ID NO: 2145339 - protein, 11 aa, Cryptosporidium hominis
IETENENSQNI

SEQ ID NO: 2145340 - protein, 9 aa, Cryptosporidium hominis
IETKSKNIE

SEQ ID NO: 2145341 - protein, 6 aa, Cryptosporidium hominis
IETNPE

SEQ ID NO: 2145342 - protein, 8 aa, Cryptosporidium hominis
IETPSKIG

SEQ ID NO: 2145343 - protein, 5 aa, Cryptosporidium hominis
IETQE

SEQ ID NO: 2145344 - protein, 7 aa, Cryptosporidium hominis
IETRKEL

SEQ ID NO: 2145345 - protein, 14 aa, Cryptosporidium hominis
IETSGDPSEREKIE

SEQ ID NO: 2145346 - protein, 15 aa, Cryptosporidium hominis
IETSKRVEKKVPTNS

SEQ ID NO: 2145347 - protein, 6 aa, Cryptosporidium hominis
IEVDGQ

SEQ ID NO: 2145348 - protein, 5 aa, Cryptosporidium hominis
IEYPS

SEQ ID NO: 2145349 - protein, 5 aa, Cryptosporidium hominis
IEYQR

SEQ ID NO: 2145350 - protein, 11 aa, Cryptosporidium hominis
IEYSGTSPRTV

SEQ ID NO: 2145351 - protein, 11 aa, Cryptosporidium hominis
IFPQKNRNASI

SEQ ID NO: 2145352 - protein, 22 aa, Cryptosporidium hominis
IFPSTNKYKAGKCNMNKKSSYN

SEQ ID NO: 2145353 - protein, 5 aa, Cryptosporidium hominis
IFTTT

SEQ ID NO: 2145354 - protein, 8 aa, Cryptosporidium hominis
IGAGKKSI

SEQ ID NO: 2145355 - protein, 6 aa, Cryptosporidium hominis
IGDDES

SEQ ID NO: 2145356 - protein, 8 aa, Cryptosporidium hominis
IGDDIPAN

SEQ ID NO: 2145357 - protein, 4 aa, Cryptosporidium hominis
IGDG

SEQ ID NO: 2145358 - protein, 11 aa, Cryptosporidium hominis
IGDLSEERSEL

SEQ ID NO: 2145359 - protein, 11 aa, Cryptosporidium hominis
IGDPSGGRGEG

SEQ ID NO: 2145360 - protein, 5 aa, Cryptosporidium hominis
IGDSQ

SEQ ID NO: 2145361 - protein, 5 aa, Cryptosporidium hominis
IGEAS

SEQ ID NO: 2145362 - protein, 9 aa, Cryptosporidium hominis
IGEDSSNFK

SEQ ID NO: 2145363 - protein, 17 aa, Cryptosporidium hominis
IGEETPDYQLNNSFVKA

SEQ ID NO: 2145364 - protein, 16 aa, Cryptosporidium hominis
IGEGGTGLNHNNSGLN

SEQ ID NO: 2145365 - protein, 6 aa, Cryptosporidium hominis
IGEKSN

SEQ ID NO: 2145366 - protein, 9 aa, Cryptosporidium hominis
IGEKSSIEN

SEQ ID NO: 2145367 - protein, 10 aa, Cryptosporidium hominis
IGEKTPNKEG

SEQ ID NO: 2145368 - protein, 4 aa, Cryptosporidium hominis
IGEL

SEQ ID NO: 2145369 - protein, 7 aa, Cryptosporidium hominis
IGEPGKL

SEQ ID NO: 2145370 - protein, 6 aa, Cryptosporidium hominis
IGEPHT

SEQ ID NO: 2145371 - protein, 6 aa, Cryptosporidium hominis
IGEPTY

SEQ ID NO: 2145372 - protein, 20 aa, Cryptosporidium hominis
IGERKELQEGTIPGSEKTTL

SEQ ID NO: 2145373 - protein, 16 aa, Cryptosporidium hominis
IGGARGDESAHGDHEV

SEQ ID NO: 2145374 - protein, 9 aa, Cryptosporidium hominis
IGGDNSTKK

SEQ ID NO: 2145375 - protein, 5 aa, Cryptosporidium hominis
IGGEE

SEQ ID NO: 2145376 - protein, 11 aa, Cryptosporidium hominis
IGGEKTQSSSV

SEQ ID NO: 2145377 - protein, 15 aa, Cryptosporidium hominis
IGGFNNREKSPKYIR

SEQ ID NO: 2145378 - protein, 4 aa, Cryptosporidium hominis
IGGG

SEQ ID NO: 2145379 - protein, 23 aa, Cryptosporidium hominis
IGGGGRSGVLGQTSSVGPNLPDR

SEQ ID NO: 2145380 - protein, 50 aa, Cryptosporidium hominis
IGGGQASSFGGQARQMNTQPSSQVKQPNWTGGKELSQQNSGHTDENSSNH

SEQ ID NO: 2145381 - protein, 15 aa, Cryptosporidium hominis
IGGGQNNLASLSGTH

SEQ ID NO: 2145382 - protein, 26 aa, Cryptosporidium hominis
IGGGVGSSSNNSISGSSGIPSPPPLP

SEQ ID NO: 2145383 - protein, 18 aa, Cryptosporidium hominis
IGGKNKGAQEIKENLIRK

SEQ ID NO: 2145384 - protein, 5 aa, Cryptosporidium hominis
IGGNV

SEQ ID NO: 2145385 - protein, 12 aa, Cryptosporidium hominis
IGGPAADAGLTG

SEQ ID NO: 2145386 - protein, 16 aa, Cryptosporidium hominis
IGGRDASSLVNKDDPD

SEQ ID NO: 2145387 - protein, 9 aa, Cryptosporidium hominis
IGGSESRLN

SEQ ID NO: 2145388 - protein, 13 aa, Cryptosporidium hominis
IGGSTKSIPSTNT

SEQ ID NO: 2145389 - protein, 6 aa, Cryptosporidium hominis
IGGYPK

SEQ ID NO: 2145390 - protein, 10 aa, Cryptosporidium hominis
IGHKKDDGEL

SEQ ID NO: 2145391 - protein, 24 aa, Cryptosporidium hominis
IGHNGERDKESKLDDENPNMGGNY

SEQ ID NO: 2145392 - protein, 6 aa, Cryptosporidium hominis
IGIETK

SEQ ID NO: 2145393 - protein, 4 aa, Cryptosporidium hominis
IGIG

SEQ ID NO: 2145394 - protein, 31 aa, Cryptosporidium hominis
IGITGEKAQINAQNSSSMNNNNNVGGSKSFS

SEQ ID NO: 2145395 - protein, 22 aa, Cryptosporidium hominis
IGITSSSNFRNRTLNSQNSPTL

SEQ ID NO: 2145396 - protein, 9 aa, Cryptosporidium hominis
IGKDDDDEV

SEQ ID NO: 2145397 - protein, 9 aa, Cryptosporidium hominis
IGKEKTSQE

SEQ ID NO: 2145398 - protein, 29 aa, Cryptosporidium hominis
IGKKKKKNKKRKSQQKKNNRGKEKRSGIL

SEQ ID NO: 2145399 - protein, 11 aa, Cryptosporidium hominis
IGKNDKIEGCA

SEQ ID NO: 2145400 - protein, 15 aa, Cryptosporidium hominis
IGKPESIIPKNVIFA

SEQ ID NO: 2145401 - protein, 7 aa, Cryptosporidium hominis
IGKSSSS

SEQ ID NO: 2145402 - protein, 9 aa, Cryptosporidium hominis
IGLGGTPSV

SEQ ID NO: 2145403 - protein, 16 aa, Cryptosporidium hominis
IGLNNNNSNNNNSDDY

SEQ ID NO: 2145404 - protein, 4 aa, Cryptosporidium hominis
IGMS

SEQ ID NO: 2145405 - protein, 12 aa, Cryptosporidium hominis
IGNCTSADTQVR

SEQ ID NO: 2145406 - protein, 5 aa, Cryptosporidium hominis
IGNDI

SEQ ID NO: 2145407 - protein, 11 aa, Cryptosporidium hominis
IGNKGSFSKTV

SEQ ID NO: 2145408 - protein, 8 aa, Cryptosporidium hominis
IGNTAPKE

SEQ ID NO: 2145409 - protein, 5 aa, Cryptosporidium hominis
IGPKA

SEQ ID NO: 2145410 - protein, 5 aa, Cryptosporidium hominis
IGPLE

SEQ ID NO: 2145411 - protein, 5 aa, Cryptosporidium hominis
IGPQR

SEQ ID NO: 2145412 - protein, 12 aa, Cryptosporidium hominis
IGQAQSGTGKTA

SEQ ID NO: 2145413 - protein, 6 aa, Cryptosporidium hominis
IGQGSY

SEQ ID NO: 2145414 - protein, 13 aa, Cryptosporidium hominis
IGQKKKVTALRFI

SEQ ID NO: 2145415 - protein, 11 aa, Cryptosporidium hominis
IGQNKEKVTLS

SEQ ID NO: 2145416 - protein, 8 aa, Cryptosporidium hominis
IGQPQESH

SEQ ID NO: 2145417 - protein, 5 aa, Cryptosporidium hominis
IGQTR

SEQ ID NO: 2145418 - protein, 6 aa, Cryptosporidium hominis
IGREVN

SEQ ID NO: 2145419 - protein, 8 aa, Cryptosporidium hominis
IGRGEKLS

SEQ ID NO: 2145420 - protein, 6 aa, Cryptosporidium hominis
IGRGSW

SEQ ID NO: 2145421 - protein, 6 aa, Cryptosporidium hominis
IGRRPL

SEQ ID NO: 2145422 - protein, 36 aa, Cryptosporidium hominis
IGSAGKLSRTDLGDTARIRGERYASSCNASSLNESE

SEQ ID NO: 2145423 - protein, 6 aa, Cryptosporidium hominis
IGSAPT

SEQ ID NO: 2145424 - protein, 7 aa, Cryptosporidium hominis
IGSASRS

SEQ ID NO: 2145425 - protein, 8 aa, Cryptosporidium hominis
IGSDQGVE

SEQ ID NO: 2145426 - protein, 12 aa, Cryptosporidium hominis
IGSDSQEEFNTQ

SEQ ID NO: 2145427 - protein, 7 aa, Cryptosporidium hominis
IGSDTPF

SEQ ID NO: 2145428 - protein, 5 aa, Cryptosporidium hominis
IGSEV

SEQ ID NO: 2145429 - protein, 4 aa, Cryptosporidium hominis
IGSG

SEQ ID NO: 2145430 - protein, 21 aa, Cryptosporidium hominis
IGSGNEVDPSINSYSNRSTGI

SEQ ID NO: 2145431 - protein, 6 aa, Cryptosporidium hominis
IGSGSF

SEQ ID NO: 2145432 - protein, 7 aa, Cryptosporidium hominis
IGSGSRS

SEQ ID NO: 2145433 - protein, 49 aa, Cryptosporidium hominis
IGSGTLTGSTTGSGSGSVSNSISGSGSGSGSGQILGPGSGTSNFSDGIK

SEQ ID NO: 2145434 - protein, 5 aa, Cryptosporidium hominis
IGSNP

SEQ ID NO: 2145435 - protein, 9 aa, Cryptosporidium hominis
IGSNTDGVN

SEQ ID NO: 2145436 - protein, 17 aa, Cryptosporidium hominis
IGSNTEGTEGQSSCQGI

SEQ ID NO: 2145437 - protein, 8 aa, Cryptosporidium hominis
IGSNTNSI

SEQ ID NO: 2145438 - protein, 6 aa, Cryptosporidium hominis
IGSNTQ

SEQ ID NO: 2145439 - protein, 16 aa, Cryptosporidium hominis
IGSQRTEGESGDSEVQ

SEQ ID NO: 2145440 - protein, 10 aa, Cryptosporidium hominis
IGSSDQKIVS

SEQ ID NO: 2145441 - protein, 7 aa, Cryptosporidium hominis
IGSSGSM

SEQ ID NO: 2145442 - protein, 10 aa, Cryptosporidium hominis
IGSSKFQQTP

SEQ ID NO: 2145443 - protein, 5 aa, Cryptosporidium hominis
IGSTE

SEQ ID NO: 2145444 - protein, 8 aa, Cryptosporidium hominis
IGSTGEKL

SEQ ID NO: 2145445 - protein, 12 aa, Cryptosporidium hominis
IGSTSPKIVGSG

SEQ ID NO: 2145446 - protein, 13 aa, Cryptosporidium hominis
IGTDSISASRANG

SEQ ID NO: 2145447 - protein, 19 aa, Cryptosporidium hominis
IGTEINNTNGNFETRRKSS

SEQ ID NO: 2145448 - protein, 22 aa, Cryptosporidium hominis
IGTEPLNNNSEIDISKNKKPAL

SEQ ID NO: 2145449 - protein, 9 aa, Cryptosporidium hominis
IGTGAGGSI

SEQ ID NO: 2145450 - protein, 6 aa, Cryptosporidium hominis
IGTGIG

SEQ ID NO: 2145451 - protein, 15 aa, Cryptosporidium hominis
IGTGLTREDHPSVSD

SEQ ID NO: 2145452 - protein, 12 aa, Cryptosporidium hominis
IGTGTGKQEGQG

SEQ ID NO: 2145453 - protein, 9 aa, Cryptosporidium hominis
IGTNNTPVE

SEQ ID NO: 2145454 - protein, 18 aa, Cryptosporidium hominis
IGTQRGSSMGDAGGAGDR

SEQ ID NO: 2145455 - protein, 6 aa, Cryptosporidium hominis
IGTSTA

SEQ ID NO: 2145456 - protein, 5 aa, Cryptosporidium hominis
IGTTL

SEQ ID NO: 2145457 - protein, 15 aa, Cryptosporidium hominis
IGVKKKEKRKKKNKY

SEQ ID NO: 2145458 - protein, 10 aa, Cryptosporidium hominis
IGVPEESDKL

SEQ ID NO: 2145459 - protein, 10 aa, Cryptosporidium hominis
IGYSDSGNYN

SEQ ID NO: 2145460 - protein, 9 aa, Cryptosporidium hominis
IHEDNNKRI

SEQ ID NO: 2145461 - protein, 17 aa, Cryptosporidium hominis
IHEGPEEVGREETEQLP

SEQ ID NO: 2145462 - protein, 10 aa, Cryptosporidium hominis
IHEKEEPNIP

SEQ ID NO: 2145463 - protein, 20 aa, Cryptosporidium hominis
IHGQGKASFSSGNTYEGQWE

SEQ ID NO: 2145464 - protein, 6 aa, Cryptosporidium hominis
IHNEES

SEQ ID NO: 2145465 - protein, 7 aa, Cryptosporidium hominis
IHNKEGN

SEQ ID NO: 2145466 - protein, 10 aa, Cryptosporidium hominis
IHNNTQPVND

SEQ ID NO: 2145467 - protein, 18 aa, Cryptosporidium hominis
IHNSEDEDLIGSNEKVHE

SEQ ID NO: 2145468 - protein, 9 aa, Cryptosporidium hominis
IHNSPSLSP

SEQ ID NO: 2145469 - protein, 13 aa, Cryptosporidium hominis
IHNTKSEASQQIK

SEQ ID NO: 2145470 - protein, 6 aa, Cryptosporidium hominis
IHPRKS

SEQ ID NO: 2145471 - protein, 23 aa, Cryptosporidium hominis
IHSTKSPSELDDDRNEDITGTIE

SEQ ID NO: 2145472 - protein, 4 aa, Cryptosporidium hominis
IHTD

SEQ ID NO: 2145473 - protein, 4 aa, Cryptosporidium hominis
IHTK

SEQ ID NO: 2145474 - protein, 4 aa, Cryptosporidium hominis
IIDG

SEQ ID NO: 2145475 - protein, 5 aa, Cryptosporidium hominis
IIEDS

SEQ ID NO: 2145476 - protein, 5 aa, Cryptosporidium hominis
IIENS

SEQ ID NO: 2145477 - protein, 42 aa, Cryptosporidium hominis
IIESEEEEEDREEEDDEIEDQESVSNISSDSLKESDFSEYSD

SEQ ID NO: 2145478 - protein, 5 aa, Cryptosporidium hominis
IINNP

SEQ ID NO: 2145479 - protein, 12 aa, Cryptosporidium hominis
IISEDTKKAVHS

SEQ ID NO: 2145480 - protein, 11 aa, Cryptosporidium hominis
IISNDSETSCI

SEQ ID NO: 2145481 - protein, 9 aa, Cryptosporidium hominis
IISSSDTQG

SEQ ID NO: 2145482 - protein, 6 aa, Cryptosporidium hominis
IKADGG

SEQ ID NO: 2145483 - protein, 13 aa, Cryptosporidium hominis
IKAEEEKKVQVAS

SEQ ID NO: 2145484 - protein, 9 aa, Cryptosporidium hominis
IKAKEKTYT

SEQ ID NO: 2145485 - protein, 12 aa, Cryptosporidium hominis
IKASEEEMATLL

SEQ ID NO: 2145486 - protein, 7 aa, Cryptosporidium hominis
IKASESI

SEQ ID NO: 2145487 - protein, 10 aa, Cryptosporidium hominis
IKDANNIKQS

SEQ ID NO: 2145488 - protein, 8 aa, Cryptosporidium hominis
IKDDEREI

SEQ ID NO: 2145489 - protein, 6 aa, Cryptosporidium hominis
IKDDGN

SEQ ID NO: 2145490 - protein, 8 aa, Cryptosporidium hominis
IKDESSEG

SEQ ID NO: 2145491 - protein, 12 aa, Cryptosporidium hominis
IKDKNSNKKNRQ

SEQ ID NO: 2145492 - protein, 4 aa, Cryptosporidium hominis
IKDP

SEQ ID NO: 2145493 - protein, 5 aa, Cryptosporidium hominis
IKDPD

SEQ ID NO: 2145494 - protein, 28 aa, Cryptosporidium hominis
IKDQDKLSKLNSASLQYNNNDEKYESNE

SEQ ID NO: 2145495 - protein, 9 aa, Cryptosporidium hominis
IKDQSEKSF

SEQ ID NO: 2145496 - protein, 10 aa, Cryptosporidium hominis
IKDSQEKNNL

SEQ ID NO: 2145497 - protein, 10 aa, Cryptosporidium hominis
IKDTSKEEEY

SEQ ID NO: 2145498 - protein, 10 aa, Cryptosporidium hominis
IKEARKQREI

SEQ ID NO: 2145499 - protein, 11 aa, Cryptosporidium hominis
IKEEDNDSEME

SEQ ID NO: 2145500 - protein, 14 aa, Cryptosporidium hominis
IKEEIPALDNYLDK

SEQ ID NO: 2145501 - protein, 6 aa, Cryptosporidium hominis
IKEENR

SEQ ID NO: 2145502 - protein, 11 aa, Cryptosporidium hominis
IKEESQNTQSP

SEQ ID NO: 2145503 - protein, 4 aa, Cryptosporidium hominis
IKEG

SEQ ID NO: 2145504 - protein, 8 aa, Cryptosporidium hominis
IKEGESIE

SEQ ID NO: 2145505 - protein, 4 aa, Cryptosporidium hominis
IKEI

SEQ ID NO: 2145506 - protein, 13 aa, Cryptosporidium hominis
IKEKGKKKSMSRP

SEQ ID NO: 2145507 - protein, 16 aa, Cryptosporidium hominis
IKENGHLNNKGNQNIQ

SEQ ID NO: 2145508 - protein, 102 aa, Cryptosporidium hominis
IKENSEANVSESQRSISTKPNSESENIQGLSNGHEHGYSTDSSITKGEQNNSNSLAQENSPNLDSNSQAEMSSLKSESSLDFGSNTDLSSSDSRSVSGSNSG

SEQ ID NO: 2145509 - protein, 5 aa, Cryptosporidium hominis
IKENT

SEQ ID NO: 2145510 - protein, 15 aa, Cryptosporidium hominis
IKEPNSAANQHTTTK

SEQ ID NO: 2145511 - protein, 25 aa, Cryptosporidium hominis
IKESPYTNSNTRRSPNSYSKARRSF

SEQ ID NO: 2145512 - protein, 8 aa, Cryptosporidium hominis
IKESRKER

SEQ ID NO: 2145513 - protein, 9 aa, Cryptosporidium hominis
IKESSNRFT

SEQ ID NO: 2145514 - protein, 4 aa, Cryptosporidium hominis
IKET

SEQ ID NO: 2145515 - protein, 9 aa, Cryptosporidium hominis
IKETDSITY

SEQ ID NO: 2145516 - protein, 17 aa, Cryptosporidium hominis
IKETEERKQSEKDNVYN

SEQ ID NO: 2145517 - protein, 12 aa, Cryptosporidium hominis
IKETNTSSNAYS

SEQ ID NO: 2145518 - protein, 16 aa, Cryptosporidium hominis
IKGAYEASFKKKNKRN

SEQ ID NO: 2145519 - protein, 4 aa, Cryptosporidium hominis
IKGE

SEQ ID NO: 2145520 - protein, 8 aa, Cryptosporidium hominis
IKGEAGLK

SEQ ID NO: 2145521 - protein, 11 aa, Cryptosporidium hominis
IKGEDDEIDNN

SEQ ID NO: 2145522 - protein, 7 aa, Cryptosporidium hominis
IKGGQSK

SEQ ID NO: 2145523 - protein, 4 aa, Cryptosporidium hominis
IKGK

SEQ ID NO: 2145524 - protein, 14 aa, Cryptosporidium hominis
IKGKNESNSDVAEN

SEQ ID NO: 2145525 - protein, 10 aa, Cryptosporidium hominis
IKGSRPEHTD

SEQ ID NO: 2145526 - protein, 8 aa, Cryptosporidium hominis
IKGTPNGP

SEQ ID NO: 2145527 - protein, 8 aa, Cryptosporidium hominis
IKGYRDDS

SEQ ID NO: 2145528 - protein, 5 aa, Cryptosporidium hominis
IKIDG

SEQ ID NO: 2145529 - protein, 4 aa, Cryptosporidium hominis
IKKD

SEQ ID NO: 2145530 - protein, 8 aa, Cryptosporidium hominis
IKKEEDKF

SEQ ID NO: 2145531 - protein, 17 aa, Cryptosporidium hominis
IKKENEESGPQNNEESL

SEQ ID NO: 2145532 - protein, 10 aa, Cryptosporidium hominis
IKKENENKIT

SEQ ID NO: 2145533 - protein, 8 aa, Cryptosporidium hominis
IKKKGNSH

SEQ ID NO: 2145534 - protein, 13 aa, Cryptosporidium hominis
IKKKKKGSKKKQS

SEQ ID NO: 2145535 - protein, 11 aa, Cryptosporidium hominis
IKKKSEDDFES

SEQ ID NO: 2145536 - protein, 6 aa, Cryptosporidium hominis
IKKQNS

SEQ ID NO: 2145537 - protein, 9 aa, Cryptosporidium hominis
IKKQPKPKL

SEQ ID NO: 2145538 - protein, 16 aa, Cryptosporidium hominis
IKKRDNTLKEKFKEKE

SEQ ID NO: 2145539 - protein, 10 aa, Cryptosporidium hominis
IKKSGAPSEE

SEQ ID NO: 2145540 - protein, 7 aa, Cryptosporidium hominis
IKKSGSL

SEQ ID NO: 2145541 - protein, 9 aa, Cryptosporidium hominis
IKKSNGKDS

SEQ ID NO: 2145542 - protein, 7 aa, Cryptosporidium hominis
IKKSNPE

SEQ ID NO: 2145543 - protein, 11 aa, Cryptosporidium hominis
IKKTDNSGNKM

SEQ ID NO: 2145544 - protein, 26 aa, Cryptosporidium hominis
IKLPATSNPVVSPSVSAAAAAAAAAA

SEQ ID NO: 2145545 - protein, 12 aa, Cryptosporidium hominis
IKNANSKLSQTV

SEQ ID NO: 2145546 - protein, 10 aa, Cryptosporidium hominis
IKNDLNHSNQ

SEQ ID NO: 2145547 - protein, 4 aa, Cryptosporidium hominis
IKNE

SEQ ID NO: 2145548 - protein, 8 aa, Cryptosporidium hominis
IKNEGGRI

SEQ ID NO: 2145549 - protein, 32 aa, Cryptosporidium hominis
IKNETDGSVTETKRTTNENEKESQLKTPPKRP

SEQ ID NO: 2145550 - protein, 8 aa, Cryptosporidium hominis
IKNGESDL

SEQ ID NO: 2145551 - protein, 8 aa, Cryptosporidium hominis
IKNGGVSG

SEQ ID NO: 2145552 - protein, 11 aa, Cryptosporidium hominis
IKNKSGSGRSK

SEQ ID NO: 2145553 - protein, 8 aa, Cryptosporidium hominis
IKNKSTNK

SEQ ID NO: 2145554 - protein, 4 aa, Cryptosporidium hominis
IKNN

SEQ ID NO: 2145555 - protein, 10 aa, Cryptosporidium hominis
IKNNHSDSKK

SEQ ID NO: 2145556 - protein, 11 aa, Cryptosporidium hominis
IKNNNKKGINT

SEQ ID NO: 2145557 - protein, 11 aa, Cryptosporidium hominis
IKNNSDKFKPI

SEQ ID NO: 2145558 - protein, 9 aa, Cryptosporidium hominis
IKNNSSQAM

SEQ ID NO: 2145559 - protein, 6 aa, Cryptosporidium hominis
IKNPNL

SEQ ID NO: 2145560 - protein, 9 aa, Cryptosporidium hominis
IKNQPGQKG

SEQ ID NO: 2145561 - protein, 8 aa, Cryptosporidium hominis
IKNQSDNK

SEQ ID NO: 2145562 - protein, 17 aa, Cryptosporidium hominis
IKNSGDSILEQKNEGIL

SEQ ID NO: 2145563 - protein, 7 aa, Cryptosporidium hominis
IKNSQKK

SEQ ID NO: 2145564 - protein, 10 aa, Cryptosporidium hominis
IKNTSQNDTN

SEQ ID NO: 2145565 - protein, 9 aa, Cryptosporidium hominis
IKNTTEDNL

SEQ ID NO: 2145566 - protein, 4 aa, Cryptosporidium hominis
IKPD

SEQ ID NO: 2145567 - protein, 9 aa, Cryptosporidium hominis
IKPEGSKKI

SEQ ID NO: 2145568 - protein, 23 aa, Cryptosporidium hominis
IKPENVSKKTKIIPESKPKKMKY

SEQ ID NO: 2145569 - protein, 6 aa, Cryptosporidium hominis
IKPGDR

SEQ ID NO: 2145570 - protein, 6 aa, Cryptosporidium hominis
IKPGTP

SEQ ID NO: 2145571 - protein, 6 aa, Cryptosporidium hominis
IKPNNR

SEQ ID NO: 2145572 - protein, 12 aa, Cryptosporidium hominis
IKPPSGGEWSEP

SEQ ID NO: 2145573 - protein, 7 aa, Cryptosporidium hominis
IKPSPFD

SEQ ID NO: 2145574 - protein, 22 aa, Cryptosporidium hominis
IKPTNGPKKGNSGGGNSGGGYR

SEQ ID NO: 2145575 - protein, 10 aa, Cryptosporidium hominis
IKQEREEKKK

SEQ ID NO: 2145576 - protein, 16 aa, Cryptosporidium hominis
IKQESSIEDINGSSFE

SEQ ID NO: 2145577 - protein, 9 aa, Cryptosporidium hominis
IKQGSKISE

SEQ ID NO: 2145578 - protein, 4 aa, Cryptosporidium hominis
IKQK

SEQ ID NO: 2145579 - protein, 8 aa, Cryptosporidium hominis
IKQNDPYG

SEQ ID NO: 2145580 - protein, 14 aa, Cryptosporidium hominis
IKQNKVNDNDDNFN

SEQ ID NO: 2145581 - protein, 19 aa, Cryptosporidium hominis
IKQNPKTDESDETNETDKK

SEQ ID NO: 2145582 - protein, 8 aa, Cryptosporidium hominis
IKQPNNRL

SEQ ID NO: 2145583 - protein, 6 aa, Cryptosporidium hominis
IKQSSI

SEQ ID NO: 2145584 - protein, 5 aa, Cryptosporidium hominis
IKRAE

SEQ ID NO: 2145585 - protein, 15 aa, Cryptosporidium hominis
IKRDDATYDDPNTGF

SEQ ID NO: 2145586 - protein, 12 aa, Cryptosporidium hominis
IKREEEDKAKIQ

SEQ ID NO: 2145587 - protein, 6 aa, Cryptosporidium hominis
IKRNYD

SEQ ID NO: 2145588 - protein, 6 aa, Cryptosporidium hominis
IKRTDE

SEQ ID NO: 2145589 - protein, 9 aa, Cryptosporidium hominis
IKSAAREEI

SEQ ID NO: 2145590 - protein, 7 aa, Cryptosporidium hominis
IKSANTN

SEQ ID NO: 2145591 - protein, 6 aa, Cryptosporidium hominis
IKSARG

SEQ ID NO: 2145592 - protein, 10 aa, Cryptosporidium hominis
IKSEKSPTTI

SEQ ID NO: 2145593 - protein, 45 aa, Cryptosporidium hominis
IKSESKQKKGTSTSKKASTKSKSSVDSKTKSKAKGNAGNKTKSVV

SEQ ID NO: 2145594 - protein, 12 aa, Cryptosporidium hominis
IKSFSQKSLSTR

SEQ ID NO: 2145595 - protein, 4 aa, Cryptosporidium hominis
IKSG

SEQ ID NO: 2145596 - protein, 7 aa, Cryptosporidium hominis
IKSGNPR

SEQ ID NO: 2145597 - protein, 7 aa, Cryptosporidium hominis
IKSKGGN

SEQ ID NO: 2145598 - protein, 6 aa, Cryptosporidium hominis
IKSKGL

SEQ ID NO: 2145599 - protein, 17 aa, Cryptosporidium hominis
IKSNELNQKTLASPKTL

SEQ ID NO: 2145600 - protein, 8 aa, Cryptosporidium hominis
IKSNESQD

SEQ ID NO: 2145601 - protein, 5 aa, Cryptosporidium hominis
IKSNN

SEQ ID NO: 2145602 - protein, 16 aa, Cryptosporidium hominis
IKSNNNDMVGKGTLTQ

SEQ ID NO: 2145603 - protein, 12 aa, Cryptosporidium hominis
IKSNTTTYTIPS

SEQ ID NO: 2145604 - protein, 6 aa, Cryptosporidium hominis
IKSPDL

SEQ ID NO: 2145605 - protein, 10 aa, Cryptosporidium hominis
IKSPKLTTSS

SEQ ID NO: 2145606 - protein, 6 aa, Cryptosporidium hominis
IKSRSN

SEQ ID NO: 2145607 - protein, 4 aa, Cryptosporidium hominis
IKSS

SEQ ID NO: 2145608 - protein, 6 aa, Cryptosporidium hominis
IKSSSD

SEQ ID NO: 2145609 - protein, 8 aa, Cryptosporidium hominis
IKSTGYKS

SEQ ID NO: 2145610 - protein, 22 aa, Cryptosporidium hominis
IKTAKQTKTMDQTKTMNQTKTM

SEQ ID NO: 2145611 - protein, 10 aa, Cryptosporidium hominis
IKTDESGVSR

SEQ ID NO: 2145612 - protein, 13 aa, Cryptosporidium hominis
IKTDNHKYKNNDE

SEQ ID NO: 2145613 - protein, 4 aa, Cryptosporidium hominis
IKTE

SEQ ID NO: 2145614 - protein, 8 aa, Cryptosporidium hominis
IKTKGDPT

SEQ ID NO: 2145615 - protein, 7 aa, Cryptosporidium hominis
IKTQQES

SEQ ID NO: 2145616 - protein, 6 aa, Cryptosporidium hominis
IKTRDE

SEQ ID NO: 2145617 - protein, 9 aa, Cryptosporidium hominis
IKTRSENQS

SEQ ID NO: 2145618 - protein, 10 aa, Cryptosporidium hominis
IKTTSRNARD

SEQ ID NO: 2145619 - protein, 17 aa, Cryptosporidium hominis
IKYPRNNYGNDEDQNPH

SEQ ID NO: 2145620 - protein, 7 aa, Cryptosporidium hominis
ILASPDN

SEQ ID NO: 2145621 - protein, 5 aa, Cryptosporidium hominis
ILESE

SEQ ID NO: 2145622 - protein, 4 aa, Cryptosporidium hominis
ILGG

SEQ ID NO: 2145623 - protein, 7 aa, Cryptosporidium hominis
ILGPTTM

SEQ ID NO: 2145624 - protein, 36 aa, Cryptosporidium hominis
ILGSGKSSSLLNPKQSEGKSSVKNSGKVSKSPAKLG

SEQ ID NO: 2145625 - protein, 5 aa, Cryptosporidium hominis
ILNKK

SEQ ID NO: 2145626 - protein, 10 aa, Cryptosporidium hominis
ILPNNSSNTM

SEQ ID NO: 2145627 - protein, 12 aa, Cryptosporidium hominis
ILPRSSVSTMDR

SEQ ID NO: 2145628 - protein, 8 aa, Cryptosporidium hominis
ILSPPGDT

SEQ ID NO: 2145629 - protein, 8 aa, Cryptosporidium hominis
ILSSSDDR

SEQ ID NO: 2145630 - protein, 10 aa, Cryptosporidium hominis
ILSSTSSDGE

SEQ ID NO: 2145631 - protein, 9 aa, Cryptosporidium hominis
IMSESSDSN

SEQ ID NO: 2145632 - protein, 10 aa, Cryptosporidium hominis
INAGDLRSNA

SEQ ID NO: 2145633 - protein, 4 aa, Cryptosporidium hominis
INAN

SEQ ID NO: 2145634 - protein, 11 aa, Cryptosporidium hominis
INASSSPPNKV

SEQ ID NO: 2145635 - protein, 15 aa, Cryptosporidium hominis
INATSRSENNSYRQE

SEQ ID NO: 2145636 - protein, 8 aa, Cryptosporidium hominis
INDASPNN

SEQ ID NO: 2145637 - protein, 5 aa, Cryptosporidium hominis
INDDN

SEQ ID NO: 2145638 - protein, 5 aa, Cryptosporidium hominis
INDEK

SEQ ID NO: 2145639 - protein, 23 aa, Cryptosporidium hominis
INDENDNDEIDCTETDKDIEERY

SEQ ID NO: 2145640 - protein, 9 aa, Cryptosporidium hominis
INDEPKKGF

SEQ ID NO: 2145641 - protein, 5 aa, Cryptosporidium hominis
INDGN

SEQ ID NO: 2145642 - protein, 6 aa, Cryptosporidium hominis
INDKAK

SEQ ID NO: 2145643 - protein, 24 aa, Cryptosporidium hominis
INDNNNNNIGKEENSYQKRYSSLP

SEQ ID NO: 2145644 - protein, 16 aa, Cryptosporidium hominis
INDNNSNNNSNNNKII

SEQ ID NO: 2145645 - protein, 18 aa, Cryptosporidium hominis
INDQKGEIYSSDSTKGIL

SEQ ID NO: 2145646 - protein, 5 aa, Cryptosporidium hominis
INDSF

SEQ ID NO: 2145647 - protein, 7 aa, Cryptosporidium hominis
INDSGDY

SEQ ID NO: 2145648 - protein, 74 aa, Cryptosporidium hominis
INDSKNSLNNPAQVTSNSSVKRKNKKVLRKSKRGRHKNKSKYKIESTSLGKDGDQIGSQARNFDNRTGKDTYSV

SEQ ID NO: 2145649 - protein, 7 aa, Cryptosporidium hominis
INDSSKN

SEQ ID NO: 2145650 - protein, 8 aa, Cryptosporidium hominis
INDTNDVS

SEQ ID NO: 2145651 - protein, 36 aa, Cryptosporidium hominis
INEAETDKSGQIDPQKSSDSINSNSYNSSNSNFTRT

SEQ ID NO: 2145652 - protein, 6 aa, Cryptosporidium hominis
INEEER

SEQ ID NO: 2145653 - protein, 13 aa, Cryptosporidium hominis
INEENSSKLTSFN

SEQ ID NO: 2145654 - protein, 23 aa, Cryptosporidium hominis
INEKRKSKKRSIKNENKFTKDPE

SEQ ID NO: 2145655 - protein, 10 aa, Cryptosporidium hominis
INEKSSTNDL

SEQ ID NO: 2145656 - protein, 7 aa, Cryptosporidium hominis
INELQEE

SEQ ID NO: 2145657 - protein, 50 aa, Cryptosporidium hominis
INENDHHQINSKRSDLRSGKDNINNDNNNTNNNNNNNVNNNNNFNSSVEE

SEQ ID NO: 2145658 - protein, 17 aa, Cryptosporidium hominis
INENETENVETLSKQSK

SEQ ID NO: 2145659 - protein, 6 aa, Cryptosporidium hominis
INENIG

SEQ ID NO: 2145660 - protein, 8 aa, Cryptosporidium hominis
INEPDQDL

SEQ ID NO: 2145661 - protein, 6 aa, Cryptosporidium hominis
INEPNN

SEQ ID NO: 2145662 - protein, 7 aa, Cryptosporidium hominis
INEQPNK

SEQ ID NO: 2145663 - protein, 4 aa, Cryptosporidium hominis
INES

SEQ ID NO: 2145664 - protein, 8 aa, Cryptosporidium hominis
INESETNK

SEQ ID NO: 2145665 - protein, 10 aa, Cryptosporidium hominis
INESNTSIPN

SEQ ID NO: 2145666 - protein, 4 aa, Cryptosporidium hominis
INEY

SEQ ID NO: 2145667 - protein, 5 aa, Cryptosporidium hominis
INEYS

SEQ ID NO: 2145668 - protein, 29 aa, Cryptosporidium hominis
INGDDNSVNDLSSKINNSDSKLDIPGTEF

SEQ ID NO: 2145669 - protein, 22 aa, Cryptosporidium hominis
INGEKSDGTYLSSSNHETEGKN

SEQ ID NO: 2145670 - protein, 12 aa, Cryptosporidium hominis
INGLSRSSQDLR

SEQ ID NO: 2145671 - protein, 4 aa, Cryptosporidium hominis
INGN

SEQ ID NO: 2145672 - protein, 10 aa, Cryptosporidium hominis
INGPTPDIRT

SEQ ID NO: 2145673 - protein, 5 aa, Cryptosporidium hominis
INGSG

SEQ ID NO: 2145674 - protein, 10 aa, Cryptosporidium hominis
INGSQSKITL

SEQ ID NO: 2145675 - protein, 8 aa, Cryptosporidium hominis
INGSSEKL

SEQ ID NO: 2145676 - protein, 11 aa, Cryptosporidium hominis
INGSSKLGAYS

SEQ ID NO: 2145677 - protein, 9 aa, Cryptosporidium hominis
INGTESNMN

SEQ ID NO: 2145678 - protein, 6 aa, Cryptosporidium hominis
INGTPG

SEQ ID NO: 2145679 - protein, 12 aa, Cryptosporidium hominis
INHYPNSSISRN

SEQ ID NO: 2145680 - protein, 5 aa, Cryptosporidium hominis
INIGR

SEQ ID NO: 2145681 - protein, 11 aa, Cryptosporidium hominis
ININGKPKTNI

SEQ ID NO: 2145682 - protein, 5 aa, Cryptosporidium hominis
INIPK

SEQ ID NO: 2145683 - protein, 22 aa, Cryptosporidium hominis
INKDEKNKVNVNSDIDTKDNEI

SEQ ID NO: 2145684 - protein, 4 aa, Cryptosporidium hominis
INKE

SEQ ID NO: 2145685 - protein, 18 aa, Cryptosporidium hominis
INKEKEMNIKGSEQDKFS

SEQ ID NO: 2145686 - protein, 18 aa, Cryptosporidium hominis
INKEKQSASNWTKEDDEE

SEQ ID NO: 2145687 - protein, 16 aa, Cryptosporidium hominis
INKENSDFSNSKGPNL

SEQ ID NO: 2145688 - protein, 9 aa, Cryptosporidium hominis
INKETPDNI

SEQ ID NO: 2145689 - protein, 8 aa, Cryptosporidium hominis
INKGGNYT

SEQ ID NO: 2145690 - protein, 5 aa, Cryptosporidium hominis
INKGQ

SEQ ID NO: 2145691 - protein, 6 aa, Cryptosporidium hominis
INKKGN

SEQ ID NO: 2145692 - protein, 6 aa, Cryptosporidium hominis
INKKSE

SEQ ID NO: 2145693 - protein, 7 aa, Cryptosporidium hominis
INKNANS

SEQ ID NO: 2145694 - protein, 6 aa, Cryptosporidium hominis
INKNKK

SEQ ID NO: 2145695 - protein, 8 aa, Cryptosporidium hominis
INKNNKEE

SEQ ID NO: 2145696 - protein, 9 aa, Cryptosporidium hominis
INKNSSNYI

SEQ ID NO: 2145697 - protein, 9 aa, Cryptosporidium hominis
INKQYNKRM

SEQ ID NO: 2145698 - protein, 9 aa, Cryptosporidium hominis
INKRAPPII

SEQ ID NO: 2145699 - protein, 8 aa, Cryptosporidium hominis
INKRGKIG

SEQ ID NO: 2145700 - protein, 4 aa, Cryptosporidium hominis
INKS

SEQ ID NO: 2145701 - protein, 21 aa, Cryptosporidium hominis
INKSDNNNNNNINYNKNENEL

SEQ ID NO: 2145702 - protein, 10 aa, Cryptosporidium hominis
INKTHNSERY

SEQ ID NO: 2145703 - protein, 9 aa, Cryptosporidium hominis
INLNGKKKS

SEQ ID NO: 2145704 - protein, 5 aa, Cryptosporidium hominis
INLNN

SEQ ID NO: 2145705 - protein, 5 aa, Cryptosporidium hominis
INLPT

SEQ ID NO: 2145706 - protein, 12 aa, Cryptosporidium hominis
INLSPEKSKLPN

SEQ ID NO: 2145707 - protein, 5 aa, Cryptosporidium hominis
INNDL

SEQ ID NO: 2145708 - protein, 6 aa, Cryptosporidium hominis
INNEPI

SEQ ID NO: 2145709 - protein, 9 aa, Cryptosporidium hominis
INNERNDKE

SEQ ID NO: 2145710 - protein, 8 aa, Cryptosporidium hominis
INNGDTRN

SEQ ID NO: 2145711 - protein, 24 aa, Cryptosporidium hominis
INNGFTKSSTKANSKNSNLQEPIT

SEQ ID NO: 2145712 - protein, 6 aa, Cryptosporidium hominis
INNGNK

SEQ ID NO: 2145713 - protein, 38 aa, Cryptosporidium hominis
INNGNNQDMNENTQFSNSNLSSNPGQNSQETELSNTDQ

SEQ ID NO: 2145714 - protein, 6 aa, Cryptosporidium hominis
INNKNT

SEQ ID NO: 2145715 - protein, 5 aa, Cryptosporidium hominis
INNKP

SEQ ID NO: 2145716 - protein, 6 aa, Cryptosporidium hominis
INNKQD

SEQ ID NO: 2145717 - protein, 14 aa, Cryptosporidium hominis
INNNGKGKNKDELQ

SEQ ID NO: 2145718 - protein, 57 aa, Cryptosporidium hominis
INNNKEESNLSDYGSGNTNTTETKYSRRINKSKEKYINKGDSSCEEDNNNNSTKNVR

SEQ ID NO: 2145719 - protein, 9 aa, Cryptosporidium hominis
INNNKNNNQ

SEQ ID NO: 2145720 - protein, 8 aa, Cryptosporidium hominis
INNQNKKD

SEQ ID NO: 2145721 - protein, 41 aa, Cryptosporidium hominis
INNQSGGTNGGQMSTGHQVGGHPKERPKYVTGDQQKTHNGD

SEQ ID NO: 2145722 - protein, 12 aa, Cryptosporidium hominis
INNQSSLPPQPI

SEQ ID NO: 2145723 - protein, 17 aa, Cryptosporidium hominis
INNQSTINSTEKQNSEI

SEQ ID NO: 2145724 - protein, 7 aa, Cryptosporidium hominis
INNQTKT

SEQ ID NO: 2145725 - protein, 6 aa, Cryptosporidium hominis
INNSAN

SEQ ID NO: 2145726 - protein, 16 aa, Cryptosporidium hominis
INNSNSATNTNANPIS

SEQ ID NO: 2145727 - protein, 7 aa, Cryptosporidium hominis
INNSQLD

SEQ ID NO: 2145728 - protein, 12 aa, Cryptosporidium hominis
INNSSTGLPNPN

SEQ ID NO: 2145729 - protein, 5 aa, Cryptosporidium hominis
INNSV

SEQ ID NO: 2145730 - protein, 6 aa, Cryptosporidium hominis
INNTDE

SEQ ID NO: 2145731 - protein, 9 aa, Cryptosporidium hominis
INNTTNNCN

SEQ ID NO: 2145732 - protein, 20 aa, Cryptosporidium hominis
INNYGKSSAFGNLSNTRNIP

SEQ ID NO: 2145733 - protein, 4 aa, Cryptosporidium hominis
INPC

SEQ ID NO: 2145734 - protein, 9 aa, Cryptosporidium hominis
INPDNSKDF

SEQ ID NO: 2145735 - protein, 10 aa, Cryptosporidium hominis
INPDTTKYRN

SEQ ID NO: 2145736 - protein, 23 aa, Cryptosporidium hominis
INPEGSHNTKKPSECRLTRGKFI

SEQ ID NO: 2145737 - protein, 27 aa, Cryptosporidium hominis
INPETNSTVPGSTSGTTKPKPGIPVNG

SEQ ID NO: 2145738 - protein, 9 aa, Cryptosporidium hominis
INPGLNSHA

SEQ ID NO: 2145739 - protein, 6 aa, Cryptosporidium hominis
INPGSS

SEQ ID NO: 2145740 - protein, 8 aa, Cryptosporidium hominis
INPNNTAG

SEQ ID NO: 2145741 - protein, 59 aa, Cryptosporidium hominis
INPPETNTETVTEVNPDPVIEPEPEPKPENEPKLEPEPKPGNEPGSESKSEPEPSCSAP

SEQ ID NO: 2145742 - protein, 6 aa, Cryptosporidium hominis
INPPSM

SEQ ID NO: 2145743 - protein, 10 aa, Cryptosporidium hominis
INPSKNRTIP

SEQ ID NO: 2145744 - protein, 26 aa, Cryptosporidium hominis
INPSNQSNSSLPLNSSSSNKANKENL

SEQ ID NO: 2145745 - protein, 6 aa, Cryptosporidium hominis
INPSNT

SEQ ID NO: 2145746 - protein, 8 aa, Cryptosporidium hominis
INPSNTRY

SEQ ID NO: 2145747 - protein, 5 aa, Cryptosporidium hominis
INPTS

SEQ ID NO: 2145748 - protein, 7 aa, Cryptosporidium hominis
INQEDDK

SEQ ID NO: 2145749 - protein, 6 aa, Cryptosporidium hominis
INQEER

SEQ ID NO: 2145750 - protein, 5 aa, Cryptosporidium hominis
INQEK

SEQ ID NO: 2145751 - protein, 35 aa, Cryptosporidium hominis
INQEKSKIKQNANGEFQNTNTNTTNNNSNNNNCNI

SEQ ID NO: 2145752 - protein, 5 aa, Cryptosporidium hominis
INQGK

SEQ ID NO: 2145753 - protein, 8 aa, Cryptosporidium hominis
INQGTTNK

SEQ ID NO: 2145754 - protein, 17 aa, Cryptosporidium hominis
INQKNDNEGDQSGSSCN

SEQ ID NO: 2145755 - protein, 18 aa, Cryptosporidium hominis
INQNHSTNVDYSSTKKEN

SEQ ID NO: 2145756 - protein, 15 aa, Cryptosporidium hominis
INQNPEGSKHSEPNI

SEQ ID NO: 2145757 - protein, 38 aa, Cryptosporidium hominis
INQPQAQNFSQNSSKFNNKNSNRQAGNNYHHNSSSNSK

SEQ ID NO: 2145758 - protein, 13 aa, Cryptosporidium hominis
INRGGSNFRSSSS

SEQ ID NO: 2145759 - protein, 4 aa, Cryptosporidium hominis
INRN

SEQ ID NO: 2145760 - protein, 27 aa, Cryptosporidium hominis
INRNTSNSHHSNSSFYQTSNNGVRYDP

SEQ ID NO: 2145761 - protein, 12 aa, Cryptosporidium hominis
INRSGEIHFIQS

SEQ ID NO: 2145762 - protein, 12 aa, Cryptosporidium hominis
INSDENNEPNLG

SEQ ID NO: 2145763 - protein, 7 aa, Cryptosporidium hominis
INSDKNH

SEQ ID NO: 2145764 - protein, 42 aa, Cryptosporidium hominis
INSDSYSKKKNNSIKKATEKSPIESLSDDDSDYVGSGSMDEN

SEQ ID NO: 2145765 - protein, 9 aa, Cryptosporidium hominis
INSEGKSEC

SEQ ID NO: 2145766 - protein, 5 aa, Cryptosporidium hominis
INSEN

SEQ ID NO: 2145767 - protein, 11 aa, Cryptosporidium hominis
INSENNDDFND

SEQ ID NO: 2145768 - protein, 11 aa, Cryptosporidium hominis
INSERSQKNGL

SEQ ID NO: 2145769 - protein, 13 aa, Cryptosporidium hominis
INSESLQNGNLNQ

SEQ ID NO: 2145770 - protein, 6 aa, Cryptosporidium hominis
INSGSN

SEQ ID NO: 2145771 - protein, 15 aa, Cryptosporidium hominis
INSGSNSNDDEHDDI

SEQ ID NO: 2145772 - protein, 4 aa, Cryptosporidium hominis
INSH

SEQ ID NO: 2145773 - protein, 12 aa, Cryptosporidium hominis
INSKDTNSTGLT

SEQ ID NO: 2145774 - protein, 5 aa, Cryptosporidium hominis
INSKL

SEQ ID NO: 2145775 - protein, 9 aa, Cryptosporidium hominis
INSNGRRLT

SEQ ID NO: 2145776 - protein, 14 aa, Cryptosporidium hominis
INSNGTTGIGSSGI

SEQ ID NO: 2145777 - protein, 16 aa, Cryptosporidium hominis
INSNKKKRKADDTVRP

SEQ ID NO: 2145778 - protein, 9 aa, Cryptosporidium hominis
INSNPKKEL

SEQ ID NO: 2145779 - protein, 15 aa, Cryptosporidium hominis
INSNSSKASDISIES

SEQ ID NO: 2145780 - protein, 5 aa, Cryptosporidium hominis
INSPK

SEQ ID NO: 2145781 - protein, 29 aa, Cryptosporidium hominis
INSPKFNKARRGSRSQIRGPTRQQYEEGV

SEQ ID NO: 2145782 - protein, 6 aa, Cryptosporidium hominis
INSPKK

SEQ ID NO: 2145783 - protein, 15 aa, Cryptosporidium hominis
INSPNTTSEHSQNTI

SEQ ID NO: 2145784 - protein, 9 aa, Cryptosporidium hominis
INSPSLNSI

SEQ ID NO: 2145785 - protein, 19 aa, Cryptosporidium hominis
INSQEELNNGSKCSSKLSG

SEQ ID NO: 2145786 - protein, 10 aa, Cryptosporidium hominis
INSQENNSRI

SEQ ID NO: 2145787 - protein, 23 aa, Cryptosporidium hominis
INSQKYPENTIENTNAHYSTNKS

SEQ ID NO: 2145788 - protein, 4 aa, Cryptosporidium hominis
INSR

SEQ ID NO: 2145789 - protein, 38 aa, Cryptosporidium hominis
INSRSGNVLSGTTTSGFGVGGGQFNPFSGSIGKPLGDM

SEQ ID NO: 2145790 - protein, 40 aa, Cryptosporidium hominis
INSSDSEKSFQWEGESDNLASDEDTIHSNSYKEKTASNSI

SEQ ID NO: 2145791 - protein, 22 aa, Cryptosporidium hominis
INSSNATPKSYFSSRTPRNLPD

SEQ ID NO: 2145792 - protein, 6 aa, Cryptosporidium hominis
INSSRS

SEQ ID NO: 2145793 - protein, 9 aa, Cryptosporidium hominis
INSSSNKKL

SEQ ID NO: 2145794 - protein, 15 aa, Cryptosporidium hominis
INSSTEDSEKINSRK

SEQ ID NO: 2145795 - protein, 6 aa, Cryptosporidium hominis
INSTEK

SEQ ID NO: 2145796 - protein, 8 aa, Cryptosporidium hominis
INSTQDLV

SEQ ID NO: 2145797 - protein, 15 aa, Cryptosporidium hominis
INSYEKGKLTPHPGL

SEQ ID NO: 2145798 - protein, 19 aa, Cryptosporidium hominis
INTAQGASSVAKGSKSKAN

SEQ ID NO: 2145799 - protein, 7 aa, Cryptosporidium hominis
INTDSNY

SEQ ID NO: 2145800 - protein, 16 aa, Cryptosporidium hominis
INTEFEEKEKKHNKKS

SEQ ID NO: 2145801 - protein, 11 aa, Cryptosporidium hominis
INTGSNERIND

SEQ ID NO: 2145802 - protein, 10 aa, Cryptosporidium hominis
INTKEEYTPL

SEQ ID NO: 2145803 - protein, 15 aa, Cryptosporidium hominis
INTNSKGSSEYSPQK

SEQ ID NO: 2145804 - protein, 4 aa, Cryptosporidium hominis
INTQ

SEQ ID NO: 2145805 - protein, 4 aa, Cryptosporidium hominis
INTR

SEQ ID NO: 2145806 - protein, 8 aa, Cryptosporidium hominis
INTRSSTQ

SEQ ID NO: 2145807 - protein, 4 aa, Cryptosporidium hominis
INTS

SEQ ID NO: 2145808 - protein, 8 aa, Cryptosporidium hominis
INTSDENI

SEQ ID NO: 2145809 - protein, 8 aa, Cryptosporidium hominis
INTSDGGC

SEQ ID NO: 2145810 - protein, 20 aa, Cryptosporidium hominis
INTTGKHSAIGSDHNQGRNN

SEQ ID NO: 2145811 - protein, 8 aa, Cryptosporidium hominis
INVPNDED

SEQ ID NO: 2145812 - protein, 7 aa, Cryptosporidium hominis
IPAPSGI

SEQ ID NO: 2145813 - protein, 12 aa, Cryptosporidium hominis
IPASTSATAAAA

SEQ ID NO: 2145814 - protein, 14 aa, Cryptosporidium hominis
IPDENSNEKFENSK

SEQ ID NO: 2145815 - protein, 6 aa, Cryptosporidium hominis
IPDGSL

SEQ ID NO: 2145816 - protein, 11 aa, Cryptosporidium hominis
IPDPPPKVPRE

SEQ ID NO: 2145817 - protein, 8 aa, Cryptosporidium hominis
IPDPSGKR

SEQ ID NO: 2145818 - protein, 5 aa, Cryptosporidium hominis
IPDQI

SEQ ID NO: 2145819 - protein, 9 aa, Cryptosporidium hominis
IPDRPQYYN

SEQ ID NO: 2145820 - protein, 5 aa, Cryptosporidium hominis
IPDSI

SEQ ID NO: 2145821 - protein, 5 aa, Cryptosporidium hominis
IPEDH

SEQ ID NO: 2145822 - protein, 8 aa, Cryptosporidium hominis
IPEDSKTN

SEQ ID NO: 2145823 - protein, 5 aa, Cryptosporidium hominis
IPEEE

SEQ ID NO: 2145824 - protein, 6 aa, Cryptosporidium hominis
IPEEEL

SEQ ID NO: 2145825 - protein, 10 aa, Cryptosporidium hominis
IPEEMQSHPS

SEQ ID NO: 2145826 - protein, 14 aa, Cryptosporidium hominis
IPEESSTSGVAEGG

SEQ ID NO: 2145827 - protein, 10 aa, Cryptosporidium hominis
IPEEWSNSTK

SEQ ID NO: 2145828 - protein, 14 aa, Cryptosporidium hominis
IPEKSSKKIRSSSD

SEQ ID NO: 2145829 - protein, 4 aa, Cryptosporidium hominis
IPEL

SEQ ID NO: 2145830 - protein, 4 aa, Cryptosporidium hominis
IPEN

SEQ ID NO: 2145831 - protein, 6 aa, Cryptosporidium hominis
IPENIT

SEQ ID NO: 2145832 - protein, 5 aa, Cryptosporidium hominis
IPENK

SEQ ID NO: 2145833 - protein, 4 aa, Cryptosporidium hominis
IPEQ

SEQ ID NO: 2145834 - protein, 76 aa, Cryptosporidium hominis
IPESESDTDSDSDSDSDSESSGGSIEKPSVEGNLRKERELSGSKTNTGEESVKAPKRVSCTGGTDSGTTGDFDSRS

SEQ ID NO: 2145835 - protein, 16 aa, Cryptosporidium hominis
IPESISKRNTKVTTPV

SEQ ID NO: 2145836 - protein, 6 aa, Cryptosporidium hominis
IPESSF

SEQ ID NO: 2145837 - protein, 12 aa, Cryptosporidium hominis
IPETGSGSDHAP

SEQ ID NO: 2145838 - protein, 14 aa, Cryptosporidium hominis
IPETGSGSDHTPIT

SEQ ID NO: 2145839 - protein, 8 aa, Cryptosporidium hominis
IPETTSQQ

SEQ ID NO: 2145840 - protein, 11 aa, Cryptosporidium hominis
IPEYEDNSNNI

SEQ ID NO: 2145841 - protein, 6 aa, Cryptosporidium hominis
IPGDNL

SEQ ID NO: 2145842 - protein, 4 aa, Cryptosporidium hominis
IPGG

SEQ ID NO: 2145843 - protein, 6 aa, Cryptosporidium hominis
IPGGNI

SEQ ID NO: 2145844 - protein, 9 aa, Cryptosporidium hominis
IPGNSTGNQ

SEQ ID NO: 2145845 - protein, 11 aa, Cryptosporidium hominis
IPGRPKDDRSE

SEQ ID NO: 2145846 - protein, 6 aa, Cryptosporidium hominis
IPGSFS

SEQ ID NO: 2145847 - protein, 8 aa, Cryptosporidium hominis
IPGSPSMS

SEQ ID NO: 2145848 - protein, 6 aa, Cryptosporidium hominis
IPGSSV

SEQ ID NO: 2145849 - protein, 8 aa, Cryptosporidium hominis
IPHNNSSK

SEQ ID NO: 2145850 - protein, 8 aa, Cryptosporidium hominis
IPHPPPGR

SEQ ID NO: 2145851 - protein, 32 aa, Cryptosporidium hominis
IPHSSTAPQQLSPTVSSSISSASTLSTSGIAG

SEQ ID NO: 2145852 - protein, 9 aa, Cryptosporidium hominis
IPIKENQSN

SEQ ID NO: 2145853 - protein, 5 aa, Cryptosporidium hominis
IPKAG

SEQ ID NO: 2145854 - protein, 13 aa, Cryptosporidium hominis
IPKARKSTKVLGM

SEQ ID NO: 2145855 - protein, 4 aa, Cryptosporidium hominis
IPKE

SEQ ID NO: 2145856 - protein, 8 aa, Cryptosporidium hominis
IPKEKSKV

SEQ ID NO: 2145857 - protein, 7 aa, Cryptosporidium hominis
IPKGAKI

SEQ ID NO: 2145858 - protein, 6 aa, Cryptosporidium hominis
IPKINT

SEQ ID NO: 2145859 - protein, 10 aa, Cryptosporidium hominis
IPKKKKVGRF

SEQ ID NO: 2145860 - protein, 10 aa, Cryptosporidium hominis
IPKLEPGQAE

SEQ ID NO: 2145861 - protein, 16 aa, Cryptosporidium hominis
IPKTERLDTDINSPVS

SEQ ID NO: 2145862 - protein, 8 aa, Cryptosporidium hominis
IPKTNTPS

SEQ ID NO: 2145863 - protein, 4 aa, Cryptosporidium hominis
IPKV

SEQ ID NO: 2145864 - protein, 4 aa, Cryptosporidium hominis
IPLP

SEQ ID NO: 2145865 - protein, 8 aa, Cryptosporidium hominis
IPNENDSN

SEQ ID NO: 2145866 - protein, 11 aa, Cryptosporidium hominis
IPNGDEIDEAE

SEQ ID NO: 2145867 - protein, 14 aa, Cryptosporidium hominis
IPNMSKENKNEKIN

SEQ ID NO: 2145868 - protein, 5 aa, Cryptosporidium hominis
IPNNI

SEQ ID NO: 2145869 - protein, 5 aa, Cryptosporidium hominis
IPNNL

SEQ ID NO: 2145870 - protein, 9 aa, Cryptosporidium hominis
IPNPASESL

SEQ ID NO: 2145871 - protein, 5 aa, Cryptosporidium hominis
IPNQA

SEQ ID NO: 2145872 - protein, 6 aa, Cryptosporidium hominis
IPNRNN

SEQ ID NO: 2145873 - protein, 4 aa, Cryptosporidium hominis
IPNS

SEQ ID NO: 2145874 - protein, 12 aa, Cryptosporidium hominis
IPNSENNRLDDS

SEQ ID NO: 2145875 - protein, 13 aa, Cryptosporidium hominis
IPNSGEDSTITKS

SEQ ID NO: 2145876 - protein, 5 aa, Cryptosporidium hominis
IPNSS

SEQ ID NO: 2145877 - protein, 18 aa, Cryptosporidium hominis
IPNSSDDNIQDKEEEERI

SEQ ID NO: 2145878 - protein, 4 aa, Cryptosporidium hominis
IPPA

SEQ ID NO: 2145879 - protein, 9 aa, Cryptosporidium hominis
IPPAPRGVP

SEQ ID NO: 2145880 - protein, 6 aa, Cryptosporidium hominis
IPPDNQ

SEQ ID NO: 2145881 - protein, 14 aa, Cryptosporidium hominis
IPPDSSNPSTSSVH

SEQ ID NO: 2145882 - protein, 4 aa, Cryptosporidium hominis
IPPE

SEQ ID NO: 2145883 - protein, 9 aa, Cryptosporidium hominis
IPPGGQNDT

SEQ ID NO: 2145884 - protein, 11 aa, Cryptosporidium hominis
IPPIPPQSQPP

SEQ ID NO: 2145885 - protein, 4 aa, Cryptosporidium hominis
IPPK

SEQ ID NO: 2145886 - protein, 5 aa, Cryptosporidium hominis
IPPKG

SEQ ID NO: 2145887 - protein, 6 aa, Cryptosporidium hominis
IPPKSL

SEQ ID NO: 2145888 - protein, 15 aa, Cryptosporidium hominis
IPPNDGSDRLPTPNE

SEQ ID NO: 2145889 - protein, 70 aa, Cryptosporidium hominis
IPPNSNKRSSLSSQKGSNNTTSKPQVNSRTRKRERRSSTKTEDKENANNLNNLDDKNPIYAENNEDYSWE

SEQ ID NO: 2145890 - protein, 5 aa, Cryptosporidium hominis
IPPPA

SEQ ID NO: 2145891 - protein, 5 aa, Cryptosporidium hominis
IPPPG

SEQ ID NO: 2145892 - protein, 6 aa, Cryptosporidium hominis
IPPPIP

SEQ ID NO: 2145893 - protein, 16 aa, Cryptosporidium hominis
IPPPPPPPPPKIKQSS

SEQ ID NO: 2145894 - protein, 11 aa, Cryptosporidium hominis
IPPPSQDPPFG

SEQ ID NO: 2145895 - protein, 6 aa, Cryptosporidium hominis
IPPPSV

SEQ ID NO: 2145896 - protein, 6 aa, Cryptosporidium hominis
IPPPTV

SEQ ID NO: 2145897 - protein, 4 aa, Cryptosporidium hominis
IPPQ

SEQ ID NO: 2145898 - protein, 5 aa, Cryptosporidium hominis
IPPRK

SEQ ID NO: 2145899 - protein, 11 aa, Cryptosporidium hominis
IPPSGKQRTLE

SEQ ID NO: 2145900 - protein, 6 aa, Cryptosporidium hominis
IPPSSY

SEQ ID NO: 2145901 - protein, 5 aa, Cryptosporidium hominis
IPPSV

SEQ ID NO: 2145902 - protein, 18 aa, Cryptosporidium hominis
IPPSVPESIPEKDQKIDS

SEQ ID NO: 2145903 - protein, 21 aa, Cryptosporidium hominis
IPPSVSRTGTSKGMSTFTTTT

SEQ ID NO: 2145904 - protein, 16 aa, Cryptosporidium hominis
IPPSYKVSGGPSKHTR

SEQ ID NO: 2145905 - protein, 4 aa, Cryptosporidium hominis
IPPT

SEQ ID NO: 2145906 - protein, 7 aa, Cryptosporidium hominis
IPQDGNS

SEQ ID NO: 2145907 - protein, 10 aa, Cryptosporidium hominis
IPQERRQNSV

SEQ ID NO: 2145908 - protein, 5 aa, Cryptosporidium hominis
IPQGA

SEQ ID NO: 2145909 - protein, 7 aa, Cryptosporidium hominis
IPQGSED

SEQ ID NO: 2145910 - protein, 4 aa, Cryptosporidium hominis
IPQH

SEQ ID NO: 2145911 - protein, 25 aa, Cryptosporidium hominis
IPQSKNVDSNTFTGVSRNDENESRN

SEQ ID NO: 2145912 - protein, 10 aa, Cryptosporidium hominis
IPQSNDKTQA

SEQ ID NO: 2145913 - protein, 5 aa, Cryptosporidium hominis
IPQSP

SEQ ID NO: 2145914 - protein, 9 aa, Cryptosporidium hominis
IPQTERPYK

SEQ ID NO: 2145915 - protein, 7 aa, Cryptosporidium hominis
IPRDSQS

SEQ ID NO: 2145916 - protein, 4 aa, Cryptosporidium hominis
IPRE

SEQ ID NO: 2145917 - protein, 4 aa, Cryptosporidium hominis
IPRG

SEQ ID NO: 2145918 - protein, 8 aa, Cryptosporidium hominis
IPRNNGSC

SEQ ID NO: 2145919 - protein, 4 aa, Cryptosporidium hominis
IPRS

SEQ ID NO: 2145920 - protein, 11 aa, Cryptosporidium hominis
IPRSNQRETIG

SEQ ID NO: 2145921 - protein, 5 aa, Cryptosporidium hominis
IPSDH

SEQ ID NO: 2145922 - protein, 57 aa, Cryptosporidium hominis
IPSGNLTATSTSTFTSSTSGGSSVSSSIQSKGLKQQSGNSKNGSNASYAATAAGSLT

SEQ ID NO: 2145923 - protein, 4 aa, Cryptosporidium hominis
IPSH

SEQ ID NO: 2145924 - protein, 11 aa, Cryptosporidium hominis
IPSKSRADSNE

SEQ ID NO: 2145925 - protein, 4 aa, Cryptosporidium hominis
IPSL

SEQ ID NO: 2145926 - protein, 8 aa, Cryptosporidium hominis
IPSNEGRG

SEQ ID NO: 2145927 - protein, 21 aa, Cryptosporidium hominis
IPSNNKEISKNNNQNHHRNTN

SEQ ID NO: 2145928 - protein, 17 aa, Cryptosporidium hominis
IPSNSVKSVSTIPSNGV

SEQ ID NO: 2145929 - protein, 5 aa, Cryptosporidium hominis
IPSNT

SEQ ID NO: 2145930 - protein, 5 aa, Cryptosporidium hominis
IPSNY

SEQ ID NO: 2145931 - protein, 15 aa, Cryptosporidium hominis
IPSPASNTINSFPNT

SEQ ID NO: 2145932 - protein, 6 aa, Cryptosporidium hominis
IPSQNE

SEQ ID NO: 2145933 - protein, 4 aa, Cryptosporidium hominis
IPSS

SEQ ID NO: 2145934 - protein, 5 aa, Cryptosporidium hominis
IPSSH

SEQ ID NO: 2145935 - protein, 66 aa, Cryptosporidium hominis
IPSSKDSTKISSVTSSTNNNNGLNTGNSQQNECLNSSNSPKLSSISTSGSNQNINNNNPSAGSNPK

SEQ ID NO: 2145936 - protein, 39 aa, Cryptosporidium hominis
IPSSNQSNKKNYSINPNGNGNNNKLGNNISKNSSQIPSY

SEQ ID NO: 2145937 - protein, 6 aa, Cryptosporidium hominis
IPSSSE

SEQ ID NO: 2145938 - protein, 10 aa, Cryptosporidium hominis
IPSSSQTASM

SEQ ID NO: 2145939 - protein, 12 aa, Cryptosporidium hominis
IPSTVSTSTDSI

SEQ ID NO: 2145940 - protein, 19 aa, Cryptosporidium hominis
IPTDPVESTVNGSQITSNI

SEQ ID NO: 2145941 - protein, 32 aa, Cryptosporidium hominis
IPTKDTGSSSQTANQISSGSLGSLGGIPGIGT

SEQ ID NO: 2145942 - protein, 5 aa, Cryptosporidium hominis
IPTSQ

SEQ ID NO: 2145943 - protein, 16 aa, Cryptosporidium hominis
IPTSSGNRDENQMGLS

SEQ ID NO: 2145944 - protein, 10 aa, Cryptosporidium hominis
IPTSSNMSAA

SEQ ID NO: 2145945 - protein, 12 aa, Cryptosporidium hominis
IPTTNNKSIVKT

SEQ ID NO: 2145946 - protein, 6 aa, Cryptosporidium hominis
IPVTPG

SEQ ID NO: 2145947 - protein, 5 aa, Cryptosporidium hominis
IPYDE

SEQ ID NO: 2145948 - protein, 9 aa, Cryptosporidium hominis
IPYEPNTSI

SEQ ID NO: 2145949 - protein, 5 aa, Cryptosporidium hominis
IPYSK

SEQ ID NO: 2145950 - protein, 7 aa, Cryptosporidium hominis
IQADSKA

SEQ ID NO: 2145951 - protein, 13 aa, Cryptosporidium hominis
IQAEKFGKSTGRC

SEQ ID NO: 2145952 - protein, 4 aa, Cryptosporidium hominis
IQAS

SEQ ID NO: 2145953 - protein, 6 aa, Cryptosporidium hominis
IQDGNN

SEQ ID NO: 2145954 - protein, 9 aa, Cryptosporidium hominis
IQDNSLNGT

SEQ ID NO: 2145955 - protein, 9 aa, Cryptosporidium hominis
IQDSQNSSK

SEQ ID NO: 2145956 - protein, 8 aa, Cryptosporidium hominis
IQEDGTPT

SEQ ID NO: 2145957 - protein, 12 aa, Cryptosporidium hominis
IQEDNEKNKSGF

SEQ ID NO: 2145958 - protein, 5 aa, Cryptosporidium hominis
IQEEN

SEQ ID NO: 2145959 - protein, 7 aa, Cryptosporidium hominis
IQEGISS

SEQ ID NO: 2145960 - protein, 6 aa, Cryptosporidium hominis
IQEGRI

SEQ ID NO: 2145961 - protein, 4 aa, Cryptosporidium hominis
IQEK

SEQ ID NO: 2145962 - protein, 8 aa, Cryptosporidium hominis
IQEKAENE

SEQ ID NO: 2145963 - protein, 14 aa, Cryptosporidium hominis
IQEKTKKSSTIEDT

SEQ ID NO: 2145964 - protein, 11 aa, Cryptosporidium hominis
IQENTDVNTNE

SEQ ID NO: 2145965 - protein, 23 aa, Cryptosporidium hominis
IQEPKVKEKLSQSEIDEAEKKIK

SEQ ID NO: 2145966 - protein, 9 aa, Cryptosporidium hominis
IQEQDEAKD

SEQ ID NO: 2145967 - protein, 6 aa, Cryptosporidium hominis
IQEQSE

SEQ ID NO: 2145968 - protein, 15 aa, Cryptosporidium hominis
IQERPSNTNLDTTKT

SEQ ID NO: 2145969 - protein, 16 aa, Cryptosporidium hominis
IQESPGSVPAGRVPRS

SEQ ID NO: 2145970 - protein, 8 aa, Cryptosporidium hominis
IQESSREI

SEQ ID NO: 2145971 - protein, 9 aa, Cryptosporidium hominis
IQESTDKNL

SEQ ID NO: 2145972 - protein, 18 aa, Cryptosporidium hominis
IQETRNQITTNNRVSSPI

SEQ ID NO: 2145973 - protein, 4 aa, Cryptosporidium hominis
IQEY

SEQ ID NO: 2145974 - protein, 8 aa, Cryptosporidium hominis
IQGDSKSM

SEQ ID NO: 2145975 - protein, 12 aa, Cryptosporidium hominis
IQGGGGKSSLVK

SEQ ID NO: 2145976 - protein, 5 aa, Cryptosporidium hominis
IQGTA

SEQ ID NO: 2145977 - protein, 27 aa, Cryptosporidium hominis
IQIPHSGQSINPSEPDRQDALLRSSSV

SEQ ID NO: 2145978 - protein, 15 aa, Cryptosporidium hominis
IQKDENDENQMGNST

SEQ ID NO: 2145979 - protein, 4 aa, Cryptosporidium hominis
IQKE

SEQ ID NO: 2145980 - protein, 13 aa, Cryptosporidium hominis
IQKEKTAKRIEKK

SEQ ID NO: 2145981 - protein, 10 aa, Cryptosporidium hominis
IQKESGNEKL

SEQ ID NO: 2145982 - protein, 7 aa, Cryptosporidium hominis
IQKGGKK

SEQ ID NO: 2145983 - protein, 6 aa, Cryptosporidium hominis
IQKKHN

SEQ ID NO: 2145984 - protein, 9 aa, Cryptosporidium hominis
IQKQDEKEK

SEQ ID NO: 2145985 - protein, 4 aa, Cryptosporidium hominis
IQLE

SEQ ID NO: 2145986 - protein, 24 aa, Cryptosporidium hominis
IQNGGRAPHHPPPSYHKKHEEHEP

SEQ ID NO: 2145987 - protein, 9 aa, Cryptosporidium hominis
IQNGNTTEE

SEQ ID NO: 2145988 - protein, 8 aa, Cryptosporidium hominis
IQNHENKN

SEQ ID NO: 2145989 - protein, 5 aa, Cryptosporidium hominis
IQNND

SEQ ID NO: 2145990 - protein, 12 aa, Cryptosporidium hominis
IQNNKSPLKTGN

SEQ ID NO: 2145991 - protein, 5 aa, Cryptosporidium hominis
IQNNP

SEQ ID NO: 2145992 - protein, 21 aa, Cryptosporidium hominis
IQNPKDTLGEKMEETSTSQNQ

SEQ ID NO: 2145993 - protein, 37 aa, Cryptosporidium hominis
IQNPTSNANINSQGNPNTGNPNSHSKGNSQSAASNFQ

SEQ ID NO: 2145994 - protein, 17 aa, Cryptosporidium hominis
IQNQDNSDKLKESEEEI

SEQ ID NO: 2145995 - protein, 6 aa, Cryptosporidium hominis
IQNQLG

SEQ ID NO: 2145996 - protein, 10 aa, Cryptosporidium hominis
IQNQNTTETF

SEQ ID NO: 2145997 - protein, 14 aa, Cryptosporidium hominis
IQNTSKISQTPRQM

SEQ ID NO: 2145998 - protein, 7 aa, Cryptosporidium hominis
IQNTSNK

SEQ ID NO: 2145999 - protein, 6 aa, Cryptosporidium hominis
IQPEET

SEQ ID NO: 2146000 - protein, 6 aa, Cryptosporidium hominis
IQPETG

SEQ ID NO: 2146001 - protein, 15 aa, Cryptosporidium hominis
IQPKPNQHNNKKGSM

SEQ ID NO: 2146002 - protein, 21 aa, Cryptosporidium hominis
IQPNNNTEESKADDSNQGDLA

SEQ ID NO: 2146003 - protein, 5 aa, Cryptosporidium hominis
IQPNT

SEQ ID NO: 2146004 - protein, 6 aa, Cryptosporidium hominis
IQQEES

SEQ ID NO: 2146005 - protein, 4 aa, Cryptosporidium hominis
IQQG

SEQ ID NO: 2146006 - protein, 7 aa, Cryptosporidium hominis
IQQGSSK

SEQ ID NO: 2146007 - protein, 4 aa, Cryptosporidium hominis
IQQN

SEQ ID NO: 2146008 - protein, 6 aa, Cryptosporidium hominis
IQQNRG

SEQ ID NO: 2146009 - protein, 7 aa, Cryptosporidium hominis
IQQPSEI

SEQ ID NO: 2146010 - protein, 22 aa, Cryptosporidium hominis
IQQSPTQSSSIDSYPSRIGGKL

SEQ ID NO: 2146011 - protein, 5 aa, Cryptosporidium hominis
IQRGE

SEQ ID NO: 2146012 - protein, 9 aa, Cryptosporidium hominis
IQRNGNTSE

SEQ ID NO: 2146013 - protein, 6 aa, Cryptosporidium hominis
IQRPPR

SEQ ID NO: 2146014 - protein, 12 aa, Cryptosporidium hominis
IQSDDDISNLFS

SEQ ID NO: 2146015 - protein, 19 aa, Cryptosporidium hominis
IQSELDSSKQINGNNLSEN

SEQ ID NO: 2146016 - protein, 16 aa, Cryptosporidium hominis
IQSETTHGTGIATHSQ

SEQ ID NO: 2146017 - protein, 8 aa, Cryptosporidium hominis
IQSKDKNM

SEQ ID NO: 2146018 - protein, 11 aa, Cryptosporidium hominis
IQSKSSKSNSC

SEQ ID NO: 2146019 - protein, 12 aa, Cryptosporidium hominis
IQSLPQDDRIPK

SEQ ID NO: 2146020 - protein, 18 aa, Cryptosporidium hominis
IQSPEEYTRNPLYGQSQQ

SEQ ID NO: 2146021 - protein, 5 aa, Cryptosporidium hominis
IQSRG

SEQ ID NO: 2146022 - protein, 5 aa, Cryptosporidium hominis
IQSSD

SEQ ID NO: 2146023 - protein, 5 aa, Cryptosporidium hominis
IQSSN

SEQ ID NO: 2146024 - protein, 8 aa, Cryptosporidium hominis
IQSSNGSL

SEQ ID NO: 2146025 - protein, 6 aa, Cryptosporidium hominis
IQSTPN

SEQ ID NO: 2146026 - protein, 5 aa, Cryptosporidium hominis
IQTEH

SEQ ID NO: 2146027 - protein, 20 aa, Cryptosporidium hominis
IQTNENKTQALTKSLKGEQK

SEQ ID NO: 2146028 - protein, 5 aa, Cryptosporidium hominis
IQTNN

SEQ ID NO: 2146029 - protein, 12 aa, Cryptosporidium hominis
IQTNRNPENPHS

SEQ ID NO: 2146030 - protein, 10 aa, Cryptosporidium hominis
IQTPKDSTRP

SEQ ID NO: 2146031 - protein, 11 aa, Cryptosporidium hominis
IQTSGDIHQTS

SEQ ID NO: 2146032 - protein, 13 aa, Cryptosporidium hominis
IQTSSNDSELNNT

SEQ ID NO: 2146033 - protein, 9 aa, Cryptosporidium hominis
IQVSETERS

SEQ ID NO: 2146034 - protein, 9 aa, Cryptosporidium hominis
IRCGNKSGN

SEQ ID NO: 2146035 - protein, 9 aa, Cryptosporidium hominis
IRDENSKFG

SEQ ID NO: 2146036 - protein, 8 aa, Cryptosporidium hominis
IRDESDLQ

SEQ ID NO: 2146037 - protein, 13 aa, Cryptosporidium hominis
IRDGRTPSRRAPS

SEQ ID NO: 2146038 - protein, 10 aa, Cryptosporidium hominis
IRDPNNINNN

SEQ ID NO: 2146039 - protein, 8 aa, Cryptosporidium hominis
IRDSGSPT

SEQ ID NO: 2146040 - protein, 5 aa, Cryptosporidium hominis
IRDTE

SEQ ID NO: 2146041 - protein, 6 aa, Cryptosporidium hominis
IREKSY

SEQ ID NO: 2146042 - protein, 8 aa, Cryptosporidium hominis
IRESSTYS

SEQ ID NO: 2146043 - protein, 19 aa, Cryptosporidium hominis
IRGANSASSIIKSSSRSSL

SEQ ID NO: 2146044 - protein, 4 aa, Cryptosporidium hominis
IRGE

SEQ ID NO: 2146045 - protein, 6 aa, Cryptosporidium hominis
IRGKYD

SEQ ID NO: 2146046 - protein, 4 aa, Cryptosporidium hominis
IRGP

SEQ ID NO: 2146047 - protein, 10 aa, Cryptosporidium hominis
IRGPEKSRNI

SEQ ID NO: 2146048 - protein, 16 aa, Cryptosporidium hominis
IRKERNKKLKEFNNDG

SEQ ID NO: 2146049 - protein, 20 aa, Cryptosporidium hominis
IRKKDSNIFKGSEENNKTSL

SEQ ID NO: 2146050 - protein, 4 aa, Cryptosporidium hominis
IRKT

SEQ ID NO: 2146051 - protein, 30 aa, Cryptosporidium hominis
IRKYDGNIDEDNDFDDNDYTGNRKGDSILD

SEQ ID NO: 2146052 - protein, 5 aa, Cryptosporidium hominis
IRNAA

SEQ ID NO: 2146053 - protein, 7 aa, Cryptosporidium hominis
IRNATTK

SEQ ID NO: 2146054 - protein, 8 aa, Cryptosporidium hominis
IRNHENSI

SEQ ID NO: 2146055 - protein, 4 aa, Cryptosporidium hominis
IRNS

SEQ ID NO: 2146056 - protein, 10 aa, Cryptosporidium hominis
IRNSTNYYGT

SEQ ID NO: 2146057 - protein, 5 aa, Cryptosporidium hominis
IRPDR

SEQ ID NO: 2146058 - protein, 8 aa, Cryptosporidium hominis
IRQESENY

SEQ ID NO: 2146059 - protein, 14 aa, Cryptosporidium hominis
IRQGKGVMTESNGD

SEQ ID NO: 2146060 - protein, 5 aa, Cryptosporidium hominis
IRQNP

SEQ ID NO: 2146061 - protein, 4 aa, Cryptosporidium hominis
IRQR

SEQ ID NO: 2146062 - protein, 5 aa, Cryptosporidium hominis
IRSCS

SEQ ID NO: 2146063 - protein, 11 aa, Cryptosporidium hominis
IRSDSQKEFEK

SEQ ID NO: 2146064 - protein, 13 aa, Cryptosporidium hominis
IRSETQNPNGSIS

SEQ ID NO: 2146065 - protein, 4 aa, Cryptosporidium hominis
IRSG

SEQ ID NO: 2146066 - protein, 14 aa, Cryptosporidium hominis
IRSLNSKNSNREDF

SEQ ID NO: 2146067 - protein, 10 aa, Cryptosporidium hominis
IRSNNSSNSV

SEQ ID NO: 2146068 - protein, 8 aa, Cryptosporidium hominis
IRSNPSSA

SEQ ID NO: 2146069 - protein, 5 aa, Cryptosporidium hominis
IRSNR

SEQ ID NO: 2146070 - protein, 7 aa, Cryptosporidium hominis
IRSNTEK

SEQ ID NO: 2146071 - protein, 5 aa, Cryptosporidium hominis
IRSPQ

SEQ ID NO: 2146072 - protein, 5 aa, Cryptosporidium hominis
IRSSE

SEQ ID NO: 2146073 - protein, 10 aa, Cryptosporidium hominis
IRSSKNVGYH

SEQ ID NO: 2146074 - protein, 7 aa, Cryptosporidium hominis
IRSSYEK

SEQ ID NO: 2146075 - protein, 6 aa, Cryptosporidium hominis
IRTNSG

SEQ ID NO: 2146076 - protein, 7 aa, Cryptosporidium hominis
IRTSTDD

SEQ ID NO: 2146077 - protein, 10 aa, Cryptosporidium hominis
ISAEAELESE

SEQ ID NO: 2146078 - protein, 7 aa, Cryptosporidium hominis
ISAGEKA

SEQ ID NO: 2146079 - protein, 11 aa, Cryptosporidium hominis
ISAGTATTPDF

SEQ ID NO: 2146080 - protein, 25 aa, Cryptosporidium hominis
ISARRTKAEPESKTAKKRQRKDTIK

SEQ ID NO: 2146081 - protein, 12 aa, Cryptosporidium hominis
ISATKEDVENGM

SEQ ID NO: 2146082 - protein, 11 aa, Cryptosporidium hominis
ISCTGNGAFTG

SEQ ID NO: 2146083 - protein, 5 aa, Cryptosporidium hominis
ISDAS

SEQ ID NO: 2146084 - protein, 5 aa, Cryptosporidium hominis
ISDDN

SEQ ID NO: 2146085 - protein, 4 aa, Cryptosporidium hominis
ISDE

SEQ ID NO: 2146086 - protein, 8 aa, Cryptosporidium hominis
ISDEKKKG

SEQ ID NO: 2146087 - protein, 6 aa, Cryptosporidium hominis
ISDELK

SEQ ID NO: 2146088 - protein, 5 aa, Cryptosporidium hominis
ISDES

SEQ ID NO: 2146089 - protein, 5 aa, Cryptosporidium hominis
ISDET

SEQ ID NO: 2146090 - protein, 4 aa, Cryptosporidium hominis
ISDG

SEQ ID NO: 2146091 - protein, 5 aa, Cryptosporidium hominis
ISDGG

SEQ ID NO: 2146092 - protein, 7 aa, Cryptosporidium hominis
ISDGKEK

SEQ ID NO: 2146093 - protein, 4 aa, Cryptosporidium hominis
ISDI

SEQ ID NO: 2146094 - protein, 11 aa, Cryptosporidium hominis
ISDKPGSVLSS

SEQ ID NO: 2146095 - protein, 6 aa, Cryptosporidium hominis
ISDNIE

SEQ ID NO: 2146096 - protein, 18 aa, Cryptosporidium hominis
ISDPKSSSNTASNPSSSL

SEQ ID NO: 2146097 - protein, 10 aa, Cryptosporidium hominis
ISDPSARKGK

SEQ ID NO: 2146098 - protein, 8 aa, Cryptosporidium hominis
ISDPSETM

SEQ ID NO: 2146099 - protein, 7 aa, Cryptosporidium hominis
ISDPTAY

SEQ ID NO: 2146100 - protein, 7 aa, Cryptosporidium hominis
ISDRSSS

SEQ ID NO: 2146101 - protein, 9 aa, Cryptosporidium hominis
ISDSEDNIS

SEQ ID NO: 2146102 - protein, 12 aa, Cryptosporidium hominis
ISDSEDSELDQD

SEQ ID NO: 2146103 - protein, 8 aa, Cryptosporidium hominis
ISDSETHN

SEQ ID NO: 2146104 - protein, 15 aa, Cryptosporidium hominis
ISDSNNDSDKDLPQG

SEQ ID NO: 2146105 - protein, 22 aa, Cryptosporidium hominis
ISDSRGQISHPITTNSQVSVGR

SEQ ID NO: 2146106 - protein, 9 aa, Cryptosporidium hominis
ISDTGNVES

SEQ ID NO: 2146107 - protein, 9 aa, Cryptosporidium hominis
ISEDGSTNC

SEQ ID NO: 2146108 - protein, 13 aa, Cryptosporidium hominis
ISEEGRKECPEDK

SEQ ID NO: 2146109 - protein, 6 aa, Cryptosporidium hominis
ISEGDG

SEQ ID NO: 2146110 - protein, 7 aa, Cryptosporidium hominis
ISEGETH

SEQ ID NO: 2146111 - protein, 4 aa, Cryptosporidium hominis
ISEI

SEQ ID NO: 2146112 - protein, 10 aa, Cryptosporidium hominis
ISEKGKEKDI

SEQ ID NO: 2146113 - protein, 9 aa, Cryptosporidium hominis
ISEKYSKLR

SEQ ID NO: 2146114 - protein, 4 aa, Cryptosporidium hominis
ISEN

SEQ ID NO: 2146115 - protein, 11 aa, Cryptosporidium hominis
ISENDQGDYKN

SEQ ID NO: 2146116 - protein, 12 aa, Cryptosporidium hominis
ISENGKSQIKPI

SEQ ID NO: 2146117 - protein, 6 aa, Cryptosporidium hominis
ISENKN

SEQ ID NO: 2146118 - protein, 10 aa, Cryptosporidium hominis
ISENKNDQEF

SEQ ID NO: 2146119 - protein, 22 aa, Cryptosporidium hominis
ISENPKQSNSKRSKRKSTNTCD

SEQ ID NO: 2146120 - protein, 20 aa, Cryptosporidium hominis
ISENTQKKISNYTSKIDNQQ

SEQ ID NO: 2146121 - protein, 15 aa, Cryptosporidium hominis
ISENTSGIGSAGVTG

SEQ ID NO: 2146122 - protein, 8 aa, Cryptosporidium hominis
ISENTSKN

SEQ ID NO: 2146123 - protein, 10 aa, Cryptosporidium hominis
ISEPEYSPSS

SEQ ID NO: 2146124 - protein, 6 aa, Cryptosporidium hominis
ISEQKC

SEQ ID NO: 2146125 - protein, 7 aa, Cryptosporidium hominis
ISESEPA

SEQ ID NO: 2146126 - protein, 16 aa, Cryptosporidium hominis
ISESGHDIDGETLTSN

SEQ ID NO: 2146127 - protein, 5 aa, Cryptosporidium hominis
ISESS

SEQ ID NO: 2146128 - protein, 6 aa, Cryptosporidium hominis
ISESTN

SEQ ID NO: 2146129 - protein, 9 aa, Cryptosporidium hominis
ISGAKAEKA

SEQ ID NO: 2146130 - protein, 9 aa, Cryptosporidium hominis
ISGDPEQIP

SEQ ID NO: 2146131 - protein, 7 aa, Cryptosporidium hominis
ISGEEDI

SEQ ID NO: 2146132 - protein, 10 aa, Cryptosporidium hominis
ISGEKNKASL

SEQ ID NO: 2146133 - protein, 9 aa, Cryptosporidium hominis
ISGEKSSEI

SEQ ID NO: 2146134 - protein, 13 aa, Cryptosporidium hominis
ISGELPPSSKSGQ

SEQ ID NO: 2146135 - protein, 13 aa, Cryptosporidium hominis
ISGENKETGKNRE

SEQ ID NO: 2146136 - protein, 10 aa, Cryptosporidium hominis
ISGGSSNNLK

SEQ ID NO: 2146137 - protein, 34 aa, Cryptosporidium hominis
ISGKTYKALPSKTLDSIKDSDKVGKEKTTATVTA

SEQ ID NO: 2146138 - protein, 4 aa, Cryptosporidium hominis
ISGM

SEQ ID NO: 2146139 - protein, 7 aa, Cryptosporidium hominis
ISGNHRA

SEQ ID NO: 2146140 - protein, 10 aa, Cryptosporidium hominis
ISGNKSTKIH

SEQ ID NO: 2146141 - protein, 18 aa, Cryptosporidium hominis
ISGNTNNCISSSSSESNS

SEQ ID NO: 2146142 - protein, 38 aa, Cryptosporidium hominis
ISGPTNTGANNNNNNNNIGASNSSSSSSGLSGTPSAIG

SEQ ID NO: 2146143 - protein, 6 aa, Cryptosporidium hominis
ISGRSE

SEQ ID NO: 2146144 - protein, 10 aa, Cryptosporidium hominis
ISGRSKGDLT

SEQ ID NO: 2146145 - protein, 9 aa, Cryptosporidium hominis
ISGSLSKNI

SEQ ID NO: 2146146 - protein, 9 aa, Cryptosporidium hominis
ISGSNVRGR

SEQ ID NO: 2146147 - protein, 5 aa, Cryptosporidium hominis
ISGTL

SEQ ID NO: 2146148 - protein, 10 aa, Cryptosporidium hominis
ISINSKSIKD

SEQ ID NO: 2146149 - protein, 5 aa, Cryptosporidium hominis
ISIPK

SEQ ID NO: 2146150 - protein, 6 aa, Cryptosporidium hominis
ISIPSN

SEQ ID NO: 2146151 - protein, 16 aa, Cryptosporidium hominis
ISISPSSTDKTAFDSS

SEQ ID NO: 2146152 - protein, 19 aa, Cryptosporidium hominis
ISKASAKQRMGRAGRTKEG

SEQ ID NO: 2146153 - protein, 19 aa, Cryptosporidium hominis
ISKDIESPSKSLSKTLAPP

SEQ ID NO: 2146154 - protein, 12 aa, Cryptosporidium hominis
ISKDSEKEHEND

SEQ ID NO: 2146155 - protein, 9 aa, Cryptosporidium hominis
ISKDSETYN

SEQ ID NO: 2146156 - protein, 28 aa, Cryptosporidium hominis
ISKDSKASSLPSSSTGASSTATTVNGES

SEQ ID NO: 2146157 - protein, 5 aa, Cryptosporidium hominis
ISKEN

SEQ ID NO: 2146158 - protein, 6 aa, Cryptosporidium hominis
ISKGHR

SEQ ID NO: 2146159 - protein, 16 aa, Cryptosporidium hominis
ISKGNPEFSSSHQQDT

SEQ ID NO: 2146160 - protein, 4 aa, Cryptosporidium hominis
ISKI

SEQ ID NO: 2146161 - protein, 18 aa, Cryptosporidium hominis
ISKKNNKYDSKGYEKNNN

SEQ ID NO: 2146162 - protein, 9 aa, Cryptosporidium hominis
ISKKPTVGE

SEQ ID NO: 2146163 - protein, 4 aa, Cryptosporidium hominis
ISKN

SEQ ID NO: 2146164 - protein, 8 aa, Cryptosporidium hominis
ISKNEFSN

SEQ ID NO: 2146165 - protein, 10 aa, Cryptosporidium hominis
ISKNGNYDQS

SEQ ID NO: 2146166 - protein, 21 aa, Cryptosporidium hominis
ISKNNKDLNSKFQELVKLVTN

SEQ ID NO: 2146167 - protein, 16 aa, Cryptosporidium hominis
ISKNSREASTNSPSNV

SEQ ID NO: 2146168 - protein, 8 aa, Cryptosporidium hominis
ISKPADKK

SEQ ID NO: 2146169 - protein, 11 aa, Cryptosporidium hominis
ISKPKTNASLG

SEQ ID NO: 2146170 - protein, 10 aa, Cryptosporidium hominis
ISKPQDARVP

SEQ ID NO: 2146171 - protein, 5 aa, Cryptosporidium hominis
ISKPT

SEQ ID NO: 2146172 - protein, 4 aa, Cryptosporidium hominis
ISKQ

SEQ ID NO: 2146173 - protein, 14 aa, Cryptosporidium hominis
ISKSESENNNCENM

SEQ ID NO: 2146174 - protein, 10 aa, Cryptosporidium hominis
ISKSKDEIGT

SEQ ID NO: 2146175 - protein, 11 aa, Cryptosporidium hominis
ISKSKNSSINK

SEQ ID NO: 2146176 - protein, 39 aa, Cryptosporidium hominis
ISKSNDKKRINKKKGIKNENKKKFSTGKPNSLNKKIIKK

SEQ ID NO: 2146177 - protein, 16 aa, Cryptosporidium hominis
ISKSQSSNSRKSLNNF

SEQ ID NO: 2146178 - protein, 11 aa, Cryptosporidium hominis
ISKSSYKTPID

SEQ ID NO: 2146179 - protein, 4 aa, Cryptosporidium hominis
ISKT

SEQ ID NO: 2146180 - protein, 6 aa, Cryptosporidium hominis
ISKTEQ

SEQ ID NO: 2146181 - protein, 10 aa, Cryptosporidium hominis
ISLSGDGKCR

SEQ ID NO: 2146182 - protein, 20 aa, Cryptosporidium hominis
ISNDIPKQIKKDRNKSNSYI

SEQ ID NO: 2146183 - protein, 11 aa, Cryptosporidium hominis
ISNDKSKVEDI

SEQ ID NO: 2146184 - protein, 12 aa, Cryptosporidium hominis
ISNDQHNFPSET

SEQ ID NO: 2146185 - protein, 21 aa, Cryptosporidium hominis
ISNEEDEEDQEEEKNMSQTKI

SEQ ID NO: 2146186 - protein, 7 aa, Cryptosporidium hominis
ISNETMN

SEQ ID NO: 2146187 - protein, 7 aa, Cryptosporidium hominis
ISNISNN

SEQ ID NO: 2146188 - protein, 8 aa, Cryptosporidium hominis
ISNKSNGS

SEQ ID NO: 2146189 - protein, 11 aa, Cryptosporidium hominis
ISNNAKVSQKN

SEQ ID NO: 2146190 - protein, 16 aa, Cryptosporidium hominis
ISNNSNEFQSRNTISN

SEQ ID NO: 2146191 - protein, 12 aa, Cryptosporidium hominis
ISNPEDSNSNKI

SEQ ID NO: 2146192 - protein, 7 aa, Cryptosporidium hominis
ISNQDND

SEQ ID NO: 2146193 - protein, 15 aa, Cryptosporidium hominis
ISNQNEINYKTFGQN

SEQ ID NO: 2146194 - protein, 10 aa, Cryptosporidium hominis
ISNREDSNKV

SEQ ID NO: 2146195 - protein, 12 aa, Cryptosporidium hominis
ISNSDNKLEGRN

SEQ ID NO: 2146196 - protein, 5 aa, Cryptosporidium hominis
ISNSE

SEQ ID NO: 2146197 - protein, 8 aa, Cryptosporidium hominis
ISNSGREH

SEQ ID NO: 2146198 - protein, 25 aa, Cryptosporidium hominis
ISNSNSNNVNTSSYYYSGGDNHTQI

SEQ ID NO: 2146199 - protein, 11 aa, Cryptosporidium hominis
ISNSSNNSPSM

SEQ ID NO: 2146200 - protein, 19 aa, Cryptosporidium hominis
ISNSSTSPSPSPSPSLETT

SEQ ID NO: 2146201 - protein, 4 aa, Cryptosporidium hominis
ISNT

SEQ ID NO: 2146202 - protein, 7 aa, Cryptosporidium hominis
ISNTEDD

SEQ ID NO: 2146203 - protein, 14 aa, Cryptosporidium hominis
ISNTQKKKSLFIVN

SEQ ID NO: 2146204 - protein, 27 aa, Cryptosporidium hominis
ISNTSKSSSSTTAGGKKGGSSGKSNIA

SEQ ID NO: 2146205 - protein, 10 aa, Cryptosporidium hominis
ISNTSSEPIK

SEQ ID NO: 2146206 - protein, 5 aa, Cryptosporidium hominis
ISNYE

SEQ ID NO: 2146207 - protein, 7 aa, Cryptosporidium hominis
ISPASTF

SEQ ID NO: 2146208 - protein, 17 aa, Cryptosporidium hominis
ISPDANGKSVNKSIKKN

SEQ ID NO: 2146209 - protein, 6 aa, Cryptosporidium hominis
ISPDSN

SEQ ID NO: 2146210 - protein, 4 aa, Cryptosporidium hominis
ISPE

SEQ ID NO: 2146211 - protein, 6 aa, Cryptosporidium hominis
ISPEIS

SEQ ID NO: 2146212 - protein, 6 aa, Cryptosporidium hominis
ISPEKQ

SEQ ID NO: 2146213 - protein, 9 aa, Cryptosporidium hominis
ISPFKNSES

SEQ ID NO: 2146214 - protein, 4 aa, Cryptosporidium hominis
ISPG

SEQ ID NO: 2146215 - protein, 14 aa, Cryptosporidium hominis
ISPHPQQSVNSTGI

SEQ ID NO: 2146216 - protein, 7 aa, Cryptosporidium hominis
ISPITKN

SEQ ID NO: 2146217 - protein, 13 aa, Cryptosporidium hominis
ISPLTKGTSTPLI

SEQ ID NO: 2146218 - protein, 9 aa, Cryptosporidium hominis
ISPLTSEEA

SEQ ID NO: 2146219 - protein, 4 aa, Cryptosporidium hominis
ISPN

SEQ ID NO: 2146220 - protein, 6 aa, Cryptosporidium hominis
ISPNGK

SEQ ID NO: 2146221 - protein, 6 aa, Cryptosporidium hominis
ISPNNS

SEQ ID NO: 2146222 - protein, 5 aa, Cryptosporidium hominis
ISPNS

SEQ ID NO: 2146223 - protein, 13 aa, Cryptosporidium hominis
ISPNSNSNSNSNL

SEQ ID NO: 2146224 - protein, 5 aa, Cryptosporidium hominis
ISPPK

SEQ ID NO: 2146225 - protein, 8 aa, Cryptosporidium hominis
ISPQITTG

SEQ ID NO: 2146226 - protein, 6 aa, Cryptosporidium hominis
ISPQQY

SEQ ID NO: 2146227 - protein, 5 aa, Cryptosporidium hominis
ISPRE

SEQ ID NO: 2146228 - protein, 6 aa, Cryptosporidium hominis
ISPRGA

SEQ ID NO: 2146229 - protein, 5 aa, Cryptosporidium hominis
ISPSP

SEQ ID NO: 2146230 - protein, 6 aa, Cryptosporidium hominis
ISPSPF

SEQ ID NO: 2146231 - protein, 14 aa, Cryptosporidium hominis
ISPSRPIGLPPPLP

SEQ ID NO: 2146232 - protein, 7 aa, Cryptosporidium hominis
ISPTENE

SEQ ID NO: 2146233 - protein, 7 aa, Cryptosporidium hominis
ISPTGNK

SEQ ID NO: 2146234 - protein, 8 aa, Cryptosporidium hominis
ISPTPIPS

SEQ ID NO: 2146235 - protein, 5 aa, Cryptosporidium hominis
ISPTQ

SEQ ID NO: 2146236 - protein, 54 aa, Cryptosporidium hominis
ISPTSQSSQLVSQTPSSSSSSSSSTTANNNTSKSIMEGDNNNGGISDNTIGNEG

SEQ ID NO: 2146237 - protein, 9 aa, Cryptosporidium hominis
ISQAMQTNK

SEQ ID NO: 2146238 - protein, 17 aa, Cryptosporidium hominis
ISQANASQRSGRAGRVS

SEQ ID NO: 2146239 - protein, 42 aa, Cryptosporidium hominis
ISQAQQGNKTDSNPGNFSDDDGTLRNEQSSRMETQARKAPDA

SEQ ID NO: 2146240 - protein, 6 aa, Cryptosporidium hominis
ISQDDK

SEQ ID NO: 2146241 - protein, 5 aa, Cryptosporidium hominis
ISQDG

SEQ ID NO: 2146242 - protein, 10 aa, Cryptosporidium hominis
ISQDTLNDNL

SEQ ID NO: 2146243 - protein, 7 aa, Cryptosporidium hominis
ISQEAKS

SEQ ID NO: 2146244 - protein, 7 aa, Cryptosporidium hominis
ISQEGKN

SEQ ID NO: 2146245 - protein, 11 aa, Cryptosporidium hominis
ISQEKLKKERE

SEQ ID NO: 2146246 - protein, 8 aa, Cryptosporidium hominis
ISQENDFK

SEQ ID NO: 2146247 - protein, 7 aa, Cryptosporidium hominis
ISQEQRI

SEQ ID NO: 2146248 - protein, 10 aa, Cryptosporidium hominis
ISQERQGSKF

SEQ ID NO: 2146249 - protein, 14 aa, Cryptosporidium hominis
ISQFSSSKKDSELY

SEQ ID NO: 2146250 - protein, 17 aa, Cryptosporidium hominis
ISQIGTKSNETKPLSVS

SEQ ID NO: 2146251 - protein, 5 aa, Cryptosporidium hominis
ISQKN

SEQ ID NO: 2146252 - protein, 9 aa, Cryptosporidium hominis
ISQNNEVPQ

SEQ ID NO: 2146253 - protein, 11 aa, Cryptosporidium hominis
ISQNQQEDVSG

SEQ ID NO: 2146254 - protein, 13 aa, Cryptosporidium hominis
ISQNSNAQNNENS

SEQ ID NO: 2146255 - protein, 8 aa, Cryptosporidium hominis
ISQPQSKM

SEQ ID NO: 2146256 - protein, 24 aa, Cryptosporidium hominis
ISQTNDPNNFNKKGINNQNNLKDQ

SEQ ID NO: 2146257 - protein, 16 aa, Cryptosporidium hominis
ISRASKRRRSSTATHI

SEQ ID NO: 2146258 - protein, 4 aa, Cryptosporidium hominis
ISRD

SEQ ID NO: 2146259 - protein, 11 aa, Cryptosporidium hominis
ISRDQSGASRG

SEQ ID NO: 2146260 - protein, 7 aa, Cryptosporidium hominis
ISRERVG

SEQ ID NO: 2146261 - protein, 4 aa, Cryptosporidium hominis
ISRG

SEQ ID NO: 2146262 - protein, 4 aa, Cryptosporidium hominis
ISRK

SEQ ID NO: 2146263 - protein, 8 aa, Cryptosporidium hominis
ISRKEREH

SEQ ID NO: 2146264 - protein, 12 aa, Cryptosporidium hominis
ISRKNNDEVSRR

SEQ ID NO: 2146265 - protein, 21 aa, Cryptosporidium hominis
ISRKSANYGKDRNQLHENNNS

SEQ ID NO: 2146266 - protein, 8 aa, Cryptosporidium hominis
ISRKSNKL

SEQ ID NO: 2146267 - protein, 20 aa, Cryptosporidium hominis
ISRNDNNLVSNSDPAGDSRN

SEQ ID NO: 2146268 - protein, 18 aa, Cryptosporidium hominis
ISRNKNTPTISLEDKLKN

SEQ ID NO: 2146269 - protein, 6 aa, Cryptosporidium hominis
ISRNRR

SEQ ID NO: 2146270 - protein, 9 aa, Cryptosporidium hominis
ISRNSSLSS

SEQ ID NO: 2146271 - protein, 5 aa, Cryptosporidium hominis
ISRPK

SEQ ID NO: 2146272 - protein, 15 aa, Cryptosporidium hominis
ISRQGSKPASGLRSA

SEQ ID NO: 2146273 - protein, 9 aa, Cryptosporidium hominis
ISRRENNAL

SEQ ID NO: 2146274 - protein, 5 aa, Cryptosporidium hominis
ISRSD

SEQ ID NO: 2146275 - protein, 10 aa, Cryptosporidium hominis
ISRSKRLERA

SEQ ID NO: 2146276 - protein, 7 aa, Cryptosporidium hominis
ISRSPSV

SEQ ID NO: 2146277 - protein, 5 aa, Cryptosporidium hominis
ISRTG

SEQ ID NO: 2146278 - protein, 27 aa, Cryptosporidium hominis
ISSCSNSPISYNNTNPTETGSNTNQYY

SEQ ID NO: 2146279 - protein, 4 aa, Cryptosporidium hominis
ISSD

SEQ ID NO: 2146280 - protein, 9 aa, Cryptosporidium hominis
ISSDDKEKY

SEQ ID NO: 2146281 - protein, 12 aa, Cryptosporidium hominis
ISSDEESEKFGS

SEQ ID NO: 2146282 - protein, 12 aa, Cryptosporidium hominis
ISSDEETPKNIV

SEQ ID NO: 2146283 - protein, 15 aa, Cryptosporidium hominis
ISSDSSNKVARSKSL

SEQ ID NO: 2146284 - protein, 4 aa, Cryptosporidium hominis
ISSE

SEQ ID NO: 2146285 - protein, 8 aa, Cryptosporidium hominis
ISSEEPNV

SEQ ID NO: 2146286 - protein, 5 aa, Cryptosporidium hominis
ISSEG

SEQ ID NO: 2146287 - protein, 13 aa, Cryptosporidium hominis
ISSEKHKKHIKED

SEQ ID NO: 2146288 - protein, 14 aa, Cryptosporidium hominis
ISSENQRKKTNARI

SEQ ID NO: 2146289 - protein, 7 aa, Cryptosporidium hominis
ISSEPSA

SEQ ID NO: 2146290 - protein, 6 aa, Cryptosporidium hominis
ISSEQE

SEQ ID NO: 2146291 - protein, 7 aa, Cryptosporidium hominis
ISSESNN

SEQ ID NO: 2146292 - protein, 19 aa, Cryptosporidium hominis
ISSETRDQANDGSNSIPVQ

SEQ ID NO: 2146293 - protein, 12 aa, Cryptosporidium hominis
ISSGQSPNKLGH

SEQ ID NO: 2146294 - protein, 9 aa, Cryptosporidium hominis
ISSGTTEQT

SEQ ID NO: 2146295 - protein, 4 aa, Cryptosporidium hominis
ISSI

SEQ ID NO: 2146296 - protein, 12 aa, Cryptosporidium hominis
ISSIPGGTTIPD

SEQ ID NO: 2146297 - protein, 14 aa, Cryptosporidium hominis
ISSKFNDKNRIQDG

SEQ ID NO: 2146298 - protein, 98 aa, Cryptosporidium hominis
ISSKGNASGGKNPNVINNRNSAGVGNPNNQGGIGPGSVQGGGPNNTNNTNSSGTGNQSFNSNYYSRKTTSGQYNKHKNTSSSSSSVPSSSSMNLRPIR

SEQ ID NO: 2146299 - protein, 9 aa, Cryptosporidium hominis
ISSKGTKIR

SEQ ID NO: 2146300 - protein, 18 aa, Cryptosporidium hominis
ISSKPPSPSTLNNSNNQP

SEQ ID NO: 2146301 - protein, 15 aa, Cryptosporidium hominis
ISSKQGFIKALERIY

SEQ ID NO: 2146302 - protein, 9 aa, Cryptosporidium hominis
ISSKQKPIS

SEQ ID NO: 2146303 - protein, 9 aa, Cryptosporidium hominis
ISSLSTGEV

SEQ ID NO: 2146304 - protein, 6 aa, Cryptosporidium hominis
ISSNAA

SEQ ID NO: 2146305 - protein, 8 aa, Cryptosporidium hominis
ISSNDRNP

SEQ ID NO: 2146306 - protein, 10 aa, Cryptosporidium hominis
ISSNESPNNF

SEQ ID NO: 2146307 - protein, 6 aa, Cryptosporidium hominis
ISSNGQ

SEQ ID NO: 2146308 - protein, 12 aa, Cryptosporidium hominis
ISSNNLNEIDRS

SEQ ID NO: 2146309 - protein, 8 aa, Cryptosporidium hominis
ISSNPNEL

SEQ ID NO: 2146310 - protein, 9 aa, Cryptosporidium hominis
ISSNSGANN

SEQ ID NO: 2146311 - protein, 12 aa, Cryptosporidium hominis
ISSNSGGNYANA

SEQ ID NO: 2146312 - protein, 23 aa, Cryptosporidium hominis
ISSNSSNSSINESNIKSTTTFRK

SEQ ID NO: 2146313 - protein, 7 aa, Cryptosporidium hominis
ISSNTEK

SEQ ID NO: 2146314 - protein, 5 aa, Cryptosporidium hominis
ISSNV

SEQ ID NO: 2146315 - protein, 7 aa, Cryptosporidium hominis
ISSPLSQ

SEQ ID NO: 2146316 - protein, 10 aa, Cryptosporidium hominis
ISSPNTADAT

SEQ ID NO: 2146317 - protein, 20 aa, Cryptosporidium hominis
ISSPSSSSSSSFSSPSSLNE

SEQ ID NO: 2146318 - protein, 6 aa, Cryptosporidium hominis
ISSQTG

SEQ ID NO: 2146319 - protein, 4 aa, Cryptosporidium hominis
ISSR

SEQ ID NO: 2146320 - protein, 6 aa, Cryptosporidium hominis
ISSRES

SEQ ID NO: 2146321 - protein, 5 aa, Cryptosporidium hominis
ISSRN

SEQ ID NO: 2146322 - protein, 8 aa, Cryptosporidium hominis
ISSSDAKT

SEQ ID NO: 2146323 - protein, 13 aa, Cryptosporidium hominis
ISSSDFEDEEVER

SEQ ID NO: 2146324 - protein, 5 aa, Cryptosporidium hominis
ISSSE

SEQ ID NO: 2146325 - protein, 6 aa, Cryptosporidium hominis
ISSSGH

SEQ ID NO: 2146326 - protein, 6 aa, Cryptosporidium hominis
ISSSKN

SEQ ID NO: 2146327 - protein, 10 aa, Cryptosporidium hominis
ISSSNFSSNG

SEQ ID NO: 2146328 - protein, 11 aa, Cryptosporidium hominis
ISSSSNNTGIH

SEQ ID NO: 2146329 - protein, 14 aa, Cryptosporidium hominis
ISSSSSIAEADGSH

SEQ ID NO: 2146330 - protein, 7 aa, Cryptosporidium hominis
ISSSTPI

SEQ ID NO: 2146331 - protein, 18 aa, Cryptosporidium hominis
ISSTCTSTAPSTPNSREF

SEQ ID NO: 2146332 - protein, 5 aa, Cryptosporidium hominis
ISSTE

SEQ ID NO: 2146333 - protein, 24 aa, Cryptosporidium hominis
ISSTSNYSKHSNETSTLNTSKRLQ

SEQ ID NO: 2146334 - protein, 14 aa, Cryptosporidium hominis
ISSTSVSTNNDVSR

SEQ ID NO: 2146335 - protein, 13 aa, Cryptosporidium hominis
ISTAGTEASGTSN

SEQ ID NO: 2146336 - protein, 9 aa, Cryptosporidium hominis
ISTDGSARS

SEQ ID NO: 2146337 - protein, 13 aa, Cryptosporidium hominis
ISTENDVKRIKVD

SEQ ID NO: 2146338 - protein, 10 aa, Cryptosporidium hominis
ISTGKEANVY

SEQ ID NO: 2146339 - protein, 5 aa, Cryptosporidium hominis
ISTGN

SEQ ID NO: 2146340 - protein, 95 aa, Cryptosporidium hominis
ISTGNKKRKPESNLKEKKISKANSKEKKSASTEKATKPKSKTSSSSSKLKKLPASVTSLTARKNSMKVDAKNGGDSSLRTPTRTSRLSYSSTPIS

SEQ ID NO: 2146341 - protein, 13 aa, Cryptosporidium hominis
ISTHNIDSKTESP

SEQ ID NO: 2146342 - protein, 8 aa, Cryptosporidium hominis
ISTKGIPH

SEQ ID NO: 2146343 - protein, 5 aa, Cryptosporidium hominis
ISTKR

SEQ ID NO: 2146344 - protein, 10 aa, Cryptosporidium hominis
ISTKSPDQLK

SEQ ID NO: 2146345 - protein, 19 aa, Cryptosporidium hominis
ISTLEQSEKDESNREASVS

SEQ ID NO: 2146346 - protein, 31 aa, Cryptosporidium hominis
ISTNTQSGETVTKTTTRFASGNVDGVTTRTE

SEQ ID NO: 2146347 - protein, 4 aa, Cryptosporidium hominis
ISTP

SEQ ID NO: 2146348 - protein, 14 aa, Cryptosporidium hominis
ISTPSQPANNSSLN

SEQ ID NO: 2146349 - protein, 7 aa, Cryptosporidium hominis
ISTPTQV

SEQ ID NO: 2146350 - protein, 4 aa, Cryptosporidium hominis
ISTQ

SEQ ID NO: 2146351 - protein, 10 aa, Cryptosporidium hominis
ISTQSQIENE

SEQ ID NO: 2146352 - protein, 4 aa, Cryptosporidium hominis
ISTS

SEQ ID NO: 2146353 - protein, 11 aa, Cryptosporidium hominis
ISTSDSSSNQQ

SEQ ID NO: 2146354 - protein, 7 aa, Cryptosporidium hominis
ISTSNTG

SEQ ID NO: 2146355 - protein, 12 aa, Cryptosporidium hominis
ISTSRKAKIQRK

SEQ ID NO: 2146356 - protein, 34 aa, Cryptosporidium hominis
ISTSSSSSSSLTTSSSIPTSNTGGTVNVGRGETE

SEQ ID NO: 2146357 - protein, 4 aa, Cryptosporidium hominis
ISTT

SEQ ID NO: 2146358 - protein, 7 aa, Cryptosporidium hominis
ISTTPND

SEQ ID NO: 2146359 - protein, 6 aa, Cryptosporidium hominis
ISTVGN

SEQ ID NO: 2146360 - protein, 4 aa, Cryptosporidium hominis
ISTY

SEQ ID NO: 2146361 - protein, 17 aa, Cryptosporidium hominis
ISVENESVKEFNSNPEI

SEQ ID NO: 2146362 - protein, 9 aa, Cryptosporidium hominis
ISVSKDETI

SEQ ID NO: 2146363 - protein, 8 aa, Cryptosporidium hominis
ISYAKDKG

SEQ ID NO: 2146364 - protein, 11 aa, Cryptosporidium hominis
ISYDSQSLENN

SEQ ID NO: 2146365 - protein, 7 aa, Cryptosporidium hominis
ISYNGKQ

SEQ ID NO: 2146366 - protein, 10 aa, Cryptosporidium hominis
ISYNSGIDES

SEQ ID NO: 2146367 - protein, 5 aa, Cryptosporidium hominis
ITDDS

SEQ ID NO: 2146368 - protein, 10 aa, Cryptosporidium hominis
ITDELNSTQY

SEQ ID NO: 2146369 - protein, 14 aa, Cryptosporidium hominis
ITDNDDSENMEERN

SEQ ID NO: 2146370 - protein, 10 aa, Cryptosporidium hominis
ITDSESSDLS

SEQ ID NO: 2146371 - protein, 7 aa, Cryptosporidium hominis
ITEERRH

SEQ ID NO: 2146372 - protein, 31 aa, Cryptosporidium hominis
ITEESTTKNEPEASISGTNSNHIKKNSSNNF

SEQ ID NO: 2146373 - protein, 12 aa, Cryptosporidium hominis
ITEGGINDPKDE

SEQ ID NO: 2146374 - protein, 13 aa, Cryptosporidium hominis
ITEKSEKNGNAEF

SEQ ID NO: 2146375 - protein, 10 aa, Cryptosporidium hominis
ITENSKNQMD

SEQ ID NO: 2146376 - protein, 5 aa, Cryptosporidium hominis
ITEPD

SEQ ID NO: 2146377 - protein, 17 aa, Cryptosporidium hominis
ITEQNSVNNLKNDEQTM

SEQ ID NO: 2146378 - protein, 19 aa, Cryptosporidium hominis
ITEQSNSNKGVDSKLQNES

SEQ ID NO: 2146379 - protein, 9 aa, Cryptosporidium hominis
ITESATEEL

SEQ ID NO: 2146380 - protein, 12 aa, Cryptosporidium hominis
ITESQNKKRKNY

SEQ ID NO: 2146381 - protein, 5 aa, Cryptosporidium hominis
ITETE

SEQ ID NO: 2146382 - protein, 5 aa, Cryptosporidium hominis
ITETS

SEQ ID NO: 2146383 - protein, 4 aa, Cryptosporidium hominis
ITGC

SEQ ID NO: 2146384 - protein, 6 aa, Cryptosporidium hominis
ITGDRE

SEQ ID NO: 2146385 - protein, 14 aa, Cryptosporidium hominis
ITGEEDVVGSPQCG

SEQ ID NO: 2146386 - protein, 11 aa, Cryptosporidium hominis
ITGETISENEQ

SEQ ID NO: 2146387 - protein, 4 aa, Cryptosporidium hominis
ITGK

SEQ ID NO: 2146388 - protein, 6 aa, Cryptosporidium hominis
ITGKER

SEQ ID NO: 2146389 - protein, 8 aa, Cryptosporidium hominis
ITGKGGVG

SEQ ID NO: 2146390 - protein, 7 aa, Cryptosporidium hominis
ITGKKYA

SEQ ID NO: 2146391 - protein, 12 aa, Cryptosporidium hominis
ITGKQSQQLKKD

SEQ ID NO: 2146392 - protein, 5 aa, Cryptosporidium hominis
ITGSS

SEQ ID NO: 2146393 - protein, 4 aa, Cryptosporidium hominis
ITHH

SEQ ID NO: 2146394 - protein, 4 aa, Cryptosporidium hominis
ITHR

SEQ ID NO: 2146395 - protein, 10 aa, Cryptosporidium hominis
ITKDNCNNFS

SEQ ID NO: 2146396 - protein, 4 aa, Cryptosporidium hominis
ITKE

SEQ ID NO: 2146397 - protein, 7 aa, Cryptosporidium hominis
ITKEGKC

SEQ ID NO: 2146398 - protein, 13 aa, Cryptosporidium hominis
ITKGESKFQEEPY

SEQ ID NO: 2146399 - protein, 5 aa, Cryptosporidium hominis
ITKGT

SEQ ID NO: 2146400 - protein, 5 aa, Cryptosporidium hominis
ITKKE

SEQ ID NO: 2146401 - protein, 29 aa, Cryptosporidium hominis
ITKKPNAFVGTSSSQKSDQNNLSNDNQNQ

SEQ ID NO: 2146402 - protein, 5 aa, Cryptosporidium hominis
ITKND

SEQ ID NO: 2146403 - protein, 10 aa, Cryptosporidium hominis
ITKPNSNLHH

SEQ ID NO: 2146404 - protein, 4 aa, Cryptosporidium hominis
ITKQ

SEQ ID NO: 2146405 - protein, 19 aa, Cryptosporidium hominis
ITKRSLTSIKKTAKTSDDP

SEQ ID NO: 2146406 - protein, 6 aa, Cryptosporidium hominis
ITKSTK

SEQ ID NO: 2146407 - protein, 7 aa, Cryptosporidium hominis
ITNDDES

SEQ ID NO: 2146408 - protein, 13 aa, Cryptosporidium hominis
ITNDTSDNKLQRG

SEQ ID NO: 2146409 - protein, 20 aa, Cryptosporidium hominis
ITNEGHKTKSIDEFSDDSTL

SEQ ID NO: 2146410 - protein, 7 aa, Cryptosporidium hominis
ITNKGQK

SEQ ID NO: 2146411 - protein, 20 aa, Cryptosporidium hominis
ITNKNSSKKGNLKGGDATCN

SEQ ID NO: 2146412 - protein, 25 aa, Cryptosporidium hominis
ITNNEDSNCQRNNLNNEDKANTNNG

SEQ ID NO: 2146413 - protein, 9 aa, Cryptosporidium hominis
ITNNKSQLE

SEQ ID NO: 2146414 - protein, 7 aa, Cryptosporidium hominis
ITNPSKI

SEQ ID NO: 2146415 - protein, 9 aa, Cryptosporidium hominis
ITNPSTGSS

SEQ ID NO: 2146416 - protein, 8 aa, Cryptosporidium hominis
ITNQPSMS

SEQ ID NO: 2146417 - protein, 6 aa, Cryptosporidium hominis
ITNSIS

SEQ ID NO: 2146418 - protein, 13 aa, Cryptosporidium hominis
ITNSNDEDATEIG

SEQ ID NO: 2146419 - protein, 29 aa, Cryptosporidium hominis
ITNSTELSNQESKSHEVSNNNMCVEDHIC

SEQ ID NO: 2146420 - protein, 6 aa, Cryptosporidium hominis
ITNYNT

SEQ ID NO: 2146421 - protein, 7 aa, Cryptosporidium hominis
ITPADNI

SEQ ID NO: 2146422 - protein, 26 aa, Cryptosporidium hominis
ITPAPSPELSNDDETAIQKTSESYEF

SEQ ID NO: 2146423 - protein, 7 aa, Cryptosporidium hominis
ITPDISD

SEQ ID NO: 2146424 - protein, 6 aa, Cryptosporidium hominis
ITPGGT

SEQ ID NO: 2146425 - protein, 5 aa, Cryptosporidium hominis
ITPGT

SEQ ID NO: 2146426 - protein, 5 aa, Cryptosporidium hominis
ITPKD

SEQ ID NO: 2146427 - protein, 6 aa, Cryptosporidium hominis
ITPNKS

SEQ ID NO: 2146428 - protein, 19 aa, Cryptosporidium hominis
ITPNQNSPAQSKKQDKNNS

SEQ ID NO: 2146429 - protein, 7 aa, Cryptosporidium hominis
ITPTPYK

SEQ ID NO: 2146430 - protein, 7 aa, Cryptosporidium hominis
ITQEPTK

SEQ ID NO: 2146431 - protein, 14 aa, Cryptosporidium hominis
ITQGQGSPKDVKDT

SEQ ID NO: 2146432 - protein, 8 aa, Cryptosporidium hominis
ITQQNSTH

SEQ ID NO: 2146433 - protein, 9 aa, Cryptosporidium hominis
ITQTSRKGR

SEQ ID NO: 2146434 - protein, 10 aa, Cryptosporidium hominis
ITRDNQSLKN

SEQ ID NO: 2146435 - protein, 6 aa, Cryptosporidium hominis
ITRETY

SEQ ID NO: 2146436 - protein, 13 aa, Cryptosporidium hominis
ITRGGEDDESMTD

SEQ ID NO: 2146437 - protein, 17 aa, Cryptosporidium hominis
ITRGGQNNNNSYKESKN

SEQ ID NO: 2146438 - protein, 8 aa, Cryptosporidium hominis
ITRGKTDE

SEQ ID NO: 2146439 - protein, 6 aa, Cryptosporidium hominis
ITRSNN

SEQ ID NO: 2146440 - protein, 8 aa, Cryptosporidium hominis
ITRTGTLR

SEQ ID NO: 2146441 - protein, 5 aa, Cryptosporidium hominis
ITRTN

SEQ ID NO: 2146442 - protein, 9 aa, Cryptosporidium hominis
ITRTSDVRP

SEQ ID NO: 2146443 - protein, 4 aa, Cryptosporidium hominis
ITSE

SEQ ID NO: 2146444 - protein, 8 aa, Cryptosporidium hominis
ITSGEYSR

SEQ ID NO: 2146445 - protein, 8 aa, Cryptosporidium hominis
ITSGPIGH

SEQ ID NO: 2146446 - protein, 10 aa, Cryptosporidium hominis
ITSIKSGSGK

SEQ ID NO: 2146447 - protein, 4 aa, Cryptosporidium hominis
ITSK

SEQ ID NO: 2146448 - protein, 7 aa, Cryptosporidium hominis
ITSKDQI

SEQ ID NO: 2146449 - protein, 5 aa, Cryptosporidium hominis
ITSNN

SEQ ID NO: 2146450 - protein, 9 aa, Cryptosporidium hominis
ITSNSNGNI

SEQ ID NO: 2146451 - protein, 14 aa, Cryptosporidium hominis
ITSNSTSRSSQNVK

SEQ ID NO: 2146452 - protein, 6 aa, Cryptosporidium hominis
ITSPEM

SEQ ID NO: 2146453 - protein, 7 aa, Cryptosporidium hominis
ITSQEDS

SEQ ID NO: 2146454 - protein, 14 aa, Cryptosporidium hominis
ITSRSSSKAESGKI

SEQ ID NO: 2146455 - protein, 5 aa, Cryptosporidium hominis
ITSSI

SEQ ID NO: 2146456 - protein, 5 aa, Cryptosporidium hominis
ITSST

SEQ ID NO: 2146457 - protein, 4 aa, Cryptosporidium hominis
ITSY

SEQ ID NO: 2146458 - protein, 9 aa, Cryptosporidium hominis
ITTDPGRGC

SEQ ID NO: 2146459 - protein, 4 aa, Cryptosporidium hominis
ITTE

SEQ ID NO: 2146460 - protein, 8 aa, Cryptosporidium hominis
ITTLPTKE

SEQ ID NO: 2146461 - protein, 9 aa, Cryptosporidium hominis
ITTPAGYKI

SEQ ID NO: 2146462 - protein, 7 aa, Cryptosporidium hominis
ITTPSKN

SEQ ID NO: 2146463 - protein, 58 aa, Cryptosporidium hominis
ITTQSSATSNKSSRSEKDLSQDSKISTFESSNKPKSSIKTQKTISKTKINNKTSSKSS

SEQ ID NO: 2146464 - protein, 10 aa, Cryptosporidium hominis
ITTSNDSSVK

SEQ ID NO: 2146465 - protein, 4 aa, Cryptosporidium hominis
ITTY

SEQ ID NO: 2146466 - protein, 15 aa, Cryptosporidium hominis
ITVKEPSKASEGDTN

SEQ ID NO: 2146467 - protein, 5 aa, Cryptosporidium hominis
ITYGS

SEQ ID NO: 2146468 - protein, 7 aa, Cryptosporidium hominis
IVDESNG

SEQ ID NO: 2146469 - protein, 5 aa, Cryptosporidium hominis
IVEDN

SEQ ID NO: 2146470 - protein, 4 aa, Cryptosporidium hominis
IVNS

SEQ ID NO: 2146471 - protein, 18 aa, Cryptosporidium hominis
IVPENSKLSDLDPETRAT

SEQ ID NO: 2146472 - protein, 29 aa, Cryptosporidium hominis
IVPESRSNISNPTTNVNKSSSNLRTSTSV

SEQ ID NO: 2146473 - protein, 26 aa, Cryptosporidium hominis
IVPQNQPTMQPPPGRQVFGYAVVPNI

SEQ ID NO: 2146474 - protein, 11 aa, Cryptosporidium hominis
IVSNNESVTQP

SEQ ID NO: 2146475 - protein, 11 aa, Cryptosporidium hominis
IVSNSSEVNAY

SEQ ID NO: 2146476 - protein, 5 aa, Cryptosporidium hominis
IYDNG

SEQ ID NO: 2146477 - protein, 7 aa, Cryptosporidium hominis
IYDTPNR

SEQ ID NO: 2146478 - protein, 11 aa, Cryptosporidium hominis
IYGSDKKNHYT

SEQ ID NO: 2146479 - protein, 8 aa, Cryptosporidium hominis
IYGSSQTS

SEQ ID NO: 2146480 - protein, 5 aa, Cryptosporidium hominis
IYNNK

SEQ ID NO: 2146481 - protein, 6 aa, Cryptosporidium hominis
IYNRDK

SEQ ID NO: 2146482 - protein, 5 aa, Cryptosporidium hominis
IYPQD

SEQ ID NO: 2146483 - protein, 20 aa, Cryptosporidium hominis
IYPQDGPKEGEYENSKQSFG

SEQ ID NO: 2146484 - protein, 6 aa, Cryptosporidium hominis
IYRNEN

SEQ ID NO: 2146485 - protein, 22 aa, Cryptosporidium hominis
IYSSSSSSSSSSIAKESKQTIT

SEQ ID NO: 2146486 - protein, 15 aa, Cryptosporidium hominis
IYTNNSKSNTKEGHK

SEQ ID NO: 2146487 - protein, 10 aa, Cryptosporidium hominis
KAAAKEKERQ

SEQ ID NO: 2146488 - protein, 18 aa, Cryptosporidium hominis
KAAEAAQGYDNNNNDNVK

SEQ ID NO: 2146489 - protein, 9 aa, Cryptosporidium hominis
KAAEKREKQ

SEQ ID NO: 2146490 - protein, 18 aa, Cryptosporidium hominis
KAAFTQNNPNGVNNPDSV

SEQ ID NO: 2146491 - protein, 7 aa, Cryptosporidium hominis
KAAGQGL

SEQ ID NO: 2146492 - protein, 14 aa, Cryptosporidium hominis
KAAKEKNAHEVERQ

SEQ ID NO: 2146493 - protein, 7 aa, Cryptosporidium hominis
KAANELK

SEQ ID NO: 2146494 - protein, 10 aa, Cryptosporidium hominis
KAAPGYATAK

SEQ ID NO: 2146495 - protein, 16 aa, Cryptosporidium hominis
KAAQAKEEKKKQAQQQ

SEQ ID NO: 2146496 - protein, 6 aa, Cryptosporidium hominis
KAASDD

SEQ ID NO: 2146497 - protein, 21 aa, Cryptosporidium hominis
KACKERDPFSNSGADLESSWG

SEQ ID NO: 2146498 - protein, 7 aa, Cryptosporidium hominis
KADDTPL

SEQ ID NO: 2146499 - protein, 19 aa, Cryptosporidium hominis
KADELDPKNASFAQNKKEL

SEQ ID NO: 2146500 - protein, 7 aa, Cryptosporidium hominis
KADGFTE

SEQ ID NO: 2146501 - protein, 9 aa, Cryptosporidium hominis
KADGSTVTT

SEQ ID NO: 2146502 - protein, 8 aa, Cryptosporidium hominis
KADHTGDV

SEQ ID NO: 2146503 - protein, 13 aa, Cryptosporidium hominis
KADIASSKLREQS

SEQ ID NO: 2146504 - protein, 7 aa, Cryptosporidium hominis
KADKTGG

SEQ ID NO: 2146505 - protein, 16 aa, Cryptosporidium hominis
KADPDSQESSEYSPPI

SEQ ID NO: 2146506 - protein, 5 aa, Cryptosporidium hominis
KADRW

SEQ ID NO: 2146507 - protein, 4 aa, Cryptosporidium hominis
KADS

SEQ ID NO: 2146508 - protein, 15 aa, Cryptosporidium hominis
KADYYRQTNTTKDTD

SEQ ID NO: 2146509 - protein, 12 aa, Cryptosporidium hominis
KAEEKEEKEKEE

SEQ ID NO: 2146510 - protein, 11 aa, Cryptosporidium hominis
KAEEKKNKERM

SEQ ID NO: 2146511 - protein, 6 aa, Cryptosporidium hominis
KAEKTI

SEQ ID NO: 2146512 - protein, 5 aa, Cryptosporidium hominis
KAENF

SEQ ID NO: 2146513 - protein, 7 aa, Cryptosporidium hominis
KAENSGI

SEQ ID NO: 2146514 - protein, 7 aa, Cryptosporidium hominis
KAEQEGI

SEQ ID NO: 2146515 - protein, 4 aa, Cryptosporidium hominis
KAER

SEQ ID NO: 2146516 - protein, 7 aa, Cryptosporidium hominis
KAERERG

SEQ ID NO: 2146517 - protein, 6 aa, Cryptosporidium hominis
KAESHD

SEQ ID NO: 2146518 - protein, 5 aa, Cryptosporidium hominis
KAETT

SEQ ID NO: 2146519 - protein, 13 aa, Cryptosporidium hominis
KAFPKDDSNQPPH

SEQ ID NO: 2146520 - protein, 14 aa, Cryptosporidium hominis
KAFSRKRSIESNEY

SEQ ID NO: 2146521 - protein, 11 aa, Cryptosporidium hominis
KAFTGEEHEET

SEQ ID NO: 2146522 - protein, 27 aa, Cryptosporidium hominis
KAGAQGPIDSDSDSDQEEKKTSAHPTL

SEQ ID NO: 2146523 - protein, 11 aa, Cryptosporidium hominis
KAGEGSNVTGI

SEQ ID NO: 2146524 - protein, 5 aa, Cryptosporidium hominis
KAGGC

SEQ ID NO: 2146525 - protein, 9 aa, Cryptosporidium hominis
KAGGQDYQS

SEQ ID NO: 2146526 - protein, 11 aa, Cryptosporidium hominis
KAGNYQEASRS

SEQ ID NO: 2146527 - protein, 21 aa, Cryptosporidium hominis
KAGPGAAKHVNSDTLAKLFTV

SEQ ID NO: 2146528 - protein, 11 aa, Cryptosporidium hominis
KAGQDITKSCT

SEQ ID NO: 2146529 - protein, 8 aa, Cryptosporidium hominis
KAGSNGEP

SEQ ID NO: 2146530 - protein, 11 aa, Cryptosporidium hominis
KAGTDSDKSPT

SEQ ID NO: 2146531 - protein, 11 aa, Cryptosporidium hominis
KAGVPPGKPSY

SEQ ID NO: 2146532 - protein, 20 aa, Cryptosporidium hominis
KAHENTSNQQESGSDLDSEM

SEQ ID NO: 2146533 - protein, 8 aa, Cryptosporidium hominis
KAHQKRET

SEQ ID NO: 2146534 - protein, 9 aa, Cryptosporidium hominis
KAIDKNSDT

SEQ ID NO: 2146535 - protein, 6 aa, Cryptosporidium hominis
KAIEEG

SEQ ID NO: 2146536 - protein, 19 aa, Cryptosporidium hominis
KAIENEFNADPKSLNDESL

SEQ ID NO: 2146537 - protein, 12 aa, Cryptosporidium hominis
KAIGTEEDRWPG

SEQ ID NO: 2146538 - protein, 18 aa, Cryptosporidium hominis
KAIKEKQDIDNKSAELTQ

SEQ ID NO: 2146539 - protein, 10 aa, Cryptosporidium hominis
KAIKENNNSE

SEQ ID NO: 2146540 - protein, 9 aa, Cryptosporidium hominis
KAIKKTEKE

SEQ ID NO: 2146541 - protein, 9 aa, Cryptosporidium hominis
KAINSEGLG

SEQ ID NO: 2146542 - protein, 14 aa, Cryptosporidium hominis
KAISQTRNKGREIA

SEQ ID NO: 2146543 - protein, 10 aa, Cryptosporidium hominis
KAKAQEQIES

SEQ ID NO: 2146544 - protein, 21 aa, Cryptosporidium hominis
KAKEQEDSKRKSSKQKKESRY

SEQ ID NO: 2146545 - protein, 8 aa, Cryptosporidium hominis
KAKFEKNS

SEQ ID NO: 2146546 - protein, 23 aa, Cryptosporidium hominis
KAKKLESSLPPTLKKTTISRSVK

SEQ ID NO: 2146547 - protein, 9 aa, Cryptosporidium hominis
KAKKNKKDY

SEQ ID NO: 2146548 - protein, 6 aa, Cryptosporidium hominis
KAKLTG

SEQ ID NO: 2146549 - protein, 6 aa, Cryptosporidium hominis
KAKNLK

SEQ ID NO: 2146550 - protein, 7 aa, Cryptosporidium hominis
KAKQHSQ

SEQ ID NO: 2146551 - protein, 7 aa, Cryptosporidium hominis
KAKRSFK

SEQ ID NO: 2146552 - protein, 12 aa, Cryptosporidium hominis
KAKSSNNQSSLN

SEQ ID NO: 2146553 - protein, 14 aa, Cryptosporidium hominis
KAKSTIEQREQNPL

SEQ ID NO: 2146554 - protein, 9 aa, Cryptosporidium hominis
KAKSYRKEF

SEQ ID NO: 2146555 - protein, 29 aa, Cryptosporidium hominis
KALKKQEKQALKEAKKAEAKNNQQQQQQS

SEQ ID NO: 2146556 - protein, 5 aa, Cryptosporidium hominis
KALKN

SEQ ID NO: 2146557 - protein, 9 aa, Cryptosporidium hominis
KALPENKKI

SEQ ID NO: 2146558 - protein, 24 aa, Cryptosporidium hominis
KALSKPSESNSSPSKSILKRRGIN

SEQ ID NO: 2146559 - protein, 10 aa, Cryptosporidium hominis
KALSSDTEQN

SEQ ID NO: 2146560 - protein, 6 aa, Cryptosporidium hominis
KANCES

SEQ ID NO: 2146561 - protein, 15 aa, Cryptosporidium hominis
KANDTVKVDLATGKV

SEQ ID NO: 2146562 - protein, 9 aa, Cryptosporidium hominis
KANEDDNPD

SEQ ID NO: 2146563 - protein, 7 aa, Cryptosporidium hominis
KANEIEA

SEQ ID NO: 2146564 - protein, 5 aa, Cryptosporidium hominis
KANKD

SEQ ID NO: 2146565 - protein, 19 aa, Cryptosporidium hominis
KANKDNNETEQGSEKPINS

SEQ ID NO: 2146566 - protein, 14 aa, Cryptosporidium hominis
KANNRNITGKEEGR

SEQ ID NO: 2146567 - protein, 10 aa, Cryptosporidium hominis
KANNSSKWPR

SEQ ID NO: 2146568 - protein, 7 aa, Cryptosporidium hominis
KANNVDN

SEQ ID NO: 2146569 - protein, 8 aa, Cryptosporidium hominis
KANPERSE

SEQ ID NO: 2146570 - protein, 23 aa, Cryptosporidium hominis
KANQGANNPLTSFQTSARSNSVF

SEQ ID NO: 2146571 - protein, 9 aa, Cryptosporidium hominis
KANSLNSPI

SEQ ID NO: 2146572 - protein, 22 aa, Cryptosporidium hominis
KANSLTEKELEDIAENKGLEDS

SEQ ID NO: 2146573 - protein, 6 aa, Cryptosporidium hominis
KANTNL

SEQ ID NO: 2146574 - protein, 8 aa, Cryptosporidium hominis
KANTYNEY

SEQ ID NO: 2146575 - protein, 4 aa, Cryptosporidium hominis
KANV

SEQ ID NO: 2146576 - protein, 16 aa, Cryptosporidium hominis
KAPDQSEDSNSTNEAI

SEQ ID NO: 2146577 - protein, 8 aa, Cryptosporidium hominis
KAPESESE

SEQ ID NO: 2146578 - protein, 8 aa, Cryptosporidium hominis
KAPFDKQT

SEQ ID NO: 2146579 - protein, 27 aa, Cryptosporidium hominis
KAPFSEATIESTKNNESTEHPKDSNFQ

SEQ ID NO: 2146580 - protein, 8 aa, Cryptosporidium hominis
KAPHAPPL

SEQ ID NO: 2146581 - protein, 7 aa, Cryptosporidium hominis
KAPLESY

SEQ ID NO: 2146582 - protein, 5 aa, Cryptosporidium hominis
KAPLL

SEQ ID NO: 2146583 - protein, 6 aa, Cryptosporidium hominis
KAPPLP

SEQ ID NO: 2146584 - protein, 12 aa, Cryptosporidium hominis
KAPTFKSRTNEY

SEQ ID NO: 2146585 - protein, 5 aa, Cryptosporidium hominis
KAPTN

SEQ ID NO: 2146586 - protein, 6 aa, Cryptosporidium hominis
KAPTPH

SEQ ID NO: 2146587 - protein, 8 aa, Cryptosporidium hominis
KAQEVGDE

SEQ ID NO: 2146588 - protein, 9 aa, Cryptosporidium hominis
KAQGNTDSY

SEQ ID NO: 2146589 - protein, 9 aa, Cryptosporidium hominis
KAQKHAEAE

SEQ ID NO: 2146590 - protein, 9 aa, Cryptosporidium hominis
KAQKTKVKG

SEQ ID NO: 2146591 - protein, 12 aa, Cryptosporidium hominis
KAQMNDSQLDQT

SEQ ID NO: 2146592 - protein, 21 aa, Cryptosporidium hominis
KAQNHSRRAAKKQKLLNSSTN

SEQ ID NO: 2146593 - protein, 4 aa, Cryptosporidium hominis
KARA

SEQ ID NO: 2146594 - protein, 8 aa, Cryptosporidium hominis
KARGAVRS

SEQ ID NO: 2146595 - protein, 5 aa, Cryptosporidium hominis
KARKE

SEQ ID NO: 2146596 - protein, 25 aa, Cryptosporidium hominis
KARKKAQSIADSEEMNEASKSKTIN

SEQ ID NO: 2146597 - protein, 12 aa, Cryptosporidium hominis
KARPKEKKSRDE

SEQ ID NO: 2146598 - protein, 9 aa, Cryptosporidium hominis
KARTTSTAK

SEQ ID NO: 2146599 - protein, 7 aa, Cryptosporidium hominis
KARYSEK

SEQ ID NO: 2146600 - protein, 12 aa, Cryptosporidium hominis
KASAKNKDTSTI

SEQ ID NO: 2146601 - protein, 8 aa, Cryptosporidium hominis
KASERIYR

SEQ ID NO: 2146602 - protein, 8 aa, Cryptosporidium hominis
KASERSQN

SEQ ID NO: 2146603 - protein, 8 aa, Cryptosporidium hominis
KASESQKE

SEQ ID NO: 2146604 - protein, 11 aa, Cryptosporidium hominis
KASGDAMEGSL

SEQ ID NO: 2146605 - protein, 6 aa, Cryptosporidium hominis
KASGFA

SEQ ID NO: 2146606 - protein, 5 aa, Cryptosporidium hominis
KASGH

SEQ ID NO: 2146607 - protein, 4 aa, Cryptosporidium hominis
KASI

SEQ ID NO: 2146608 - protein, 6 aa, Cryptosporidium hominis
KASIDG

SEQ ID NO: 2146609 - protein, 6 aa, Cryptosporidium hominis
KASKEK

SEQ ID NO: 2146610 - protein, 8 aa, Cryptosporidium hominis
KASKNEPI

SEQ ID NO: 2146611 - protein, 6 aa, Cryptosporidium hominis
KASNDF

SEQ ID NO: 2146612 - protein, 8 aa, Cryptosporidium hominis
KASNWPTI

SEQ ID NO: 2146613 - protein, 7 aa, Cryptosporidium hominis
KASRGSK

SEQ ID NO: 2146614 - protein, 4 aa, Cryptosporidium hominis
KASS

SEQ ID NO: 2146615 - protein, 8 aa, Cryptosporidium hominis
KASSGGEV

SEQ ID NO: 2146616 - protein, 8 aa, Cryptosporidium hominis
KASTNYVS

SEQ ID NO: 2146617 - protein, 6 aa, Cryptosporidium hominis
KASYSE

SEQ ID NO: 2146618 - protein, 7 aa, Cryptosporidium hominis
KASYSQR

SEQ ID NO: 2146619 - protein, 5 aa, Cryptosporidium hominis
KATAG

SEQ ID NO: 2146620 - protein, 11 aa, Cryptosporidium hominis
KATEDFSGDDD

SEQ ID NO: 2146621 - protein, 5 aa, Cryptosporidium hominis
KATGA

SEQ ID NO: 2146622 - protein, 20 aa, Cryptosporidium hominis
KATGCNYSYSPGKETTSKNT

SEQ ID NO: 2146623 - protein, 16 aa, Cryptosporidium hominis
KATKSRMEQEKSQDYL

SEQ ID NO: 2146624 - protein, 8 aa, Cryptosporidium hominis
KATPLSSS

SEQ ID NO: 2146625 - protein, 5 aa, Cryptosporidium hominis
KATQL

SEQ ID NO: 2146626 - protein, 12 aa, Cryptosporidium hominis
KATQRTKGVSTT

SEQ ID NO: 2146627 - protein, 11 aa, Cryptosporidium hominis
KATSEKKLYDR

SEQ ID NO: 2146628 - protein, 11 aa, Cryptosporidium hominis
KATSKKDKYDK

SEQ ID NO: 2146629 - protein, 9 aa, Cryptosporidium hominis
KATTRPTDQ

SEQ ID NO: 2146630 - protein, 8 aa, Cryptosporidium hominis
KATTVPKP

SEQ ID NO: 2146631 - protein, 8 aa, Cryptosporidium hominis
KAVASKGA

SEQ ID NO: 2146632 - protein, 9 aa, Cryptosporidium hominis
KAVDNSGTT

SEQ ID NO: 2146633 - protein, 10 aa, Cryptosporidium hominis
KAVGSDKRIG

SEQ ID NO: 2146634 - protein, 13 aa, Cryptosporidium hominis
KAVPNLKNSGSSI

SEQ ID NO: 2146635 - protein, 6 aa, Cryptosporidium hominis
KAVSEV

SEQ ID NO: 2146636 - protein, 4 aa, Cryptosporidium hominis
KAYL

SEQ ID NO: 2146637 - protein, 14 aa, Cryptosporidium hominis
KCDPDNKECNEGLK

SEQ ID NO: 2146638 - protein, 13 aa, Cryptosporidium hominis
KCEGKKSSNRRIT

SEQ ID NO: 2146639 - protein, 10 aa, Cryptosporidium hominis
KCEGLEERDY

SEQ ID NO: 2146640 - protein, 6 aa, Cryptosporidium hominis
KCENKI

SEQ ID NO: 2146641 - protein, 23 aa, Cryptosporidium hominis
KCENNQSQDQNDCNNDKINRSNW

SEQ ID NO: 2146642 - protein, 8 aa, Cryptosporidium hominis
KCESESMD

SEQ ID NO: 2146643 - protein, 6 aa, Cryptosporidium hominis
KCETNK

SEQ ID NO: 2146644 - protein, 20 aa, Cryptosporidium hominis
KCGGTDLRSVGSSKTGSESI

SEQ ID NO: 2146645 - protein, 21 aa, Cryptosporidium hominis
KCGSQNGKPTKSVCITASGVL

SEQ ID NO: 2146646 - protein, 7 aa, Cryptosporidium hominis
KCGYTKS

SEQ ID NO: 2146647 - protein, 6 aa, Cryptosporidium hominis
KCKPGD

SEQ ID NO: 2146648 - protein, 6 aa, Cryptosporidium hominis
KCPHGS

SEQ ID NO: 2146649 - protein, 6 aa, Cryptosporidium hominis
KCPNDD

SEQ ID NO: 2146650 - protein, 5 aa, Cryptosporidium hominis
KCPPK

SEQ ID NO: 2146651 - protein, 5 aa, Cryptosporidium hominis
KCQGS

SEQ ID NO: 2146652 - protein, 14 aa, Cryptosporidium hominis
KCQTKNDKERDRER

SEQ ID NO: 2146653 - protein, 7 aa, Cryptosporidium hominis
KCSAEAS

SEQ ID NO: 2146654 - protein, 11 aa, Cryptosporidium hominis
KCSDSRNSMVS

SEQ ID NO: 2146655 - protein, 11 aa, Cryptosporidium hominis
KCSSPNSGTMG

SEQ ID NO: 2146656 - protein, 8 aa, Cryptosporidium hominis
KCSTKDEK

SEQ ID NO: 2146657 - protein, 6 aa, Cryptosporidium hominis
KCTGQY

SEQ ID NO: 2146658 - protein, 9 aa, Cryptosporidium hominis
KCTKSTLSD

SEQ ID NO: 2146659 - protein, 11 aa, Cryptosporidium hominis
KCTPPAFKSSP

SEQ ID NO: 2146660 - protein, 26 aa, Cryptosporidium hominis
KCTPTEAANELTKEAEKKGSLDDKTA

SEQ ID NO: 2146661 - protein, 19 aa, Cryptosporidium hominis
KCTSENSQSGTSTCADLTS

SEQ ID NO: 2146662 - protein, 13 aa, Cryptosporidium hominis
KCTSYDTETGVDI

SEQ ID NO: 2146663 - protein, 7 aa, Cryptosporidium hominis
KDAEINR

SEQ ID NO: 2146664 - protein, 17 aa, Cryptosporidium hominis
KDAEKINTNSFSRYPQN

SEQ ID NO: 2146665 - protein, 7 aa, Cryptosporidium hominis
KDANDNR

SEQ ID NO: 2146666 - protein, 9 aa, Cryptosporidium hominis
KDAPLPGDS

SEQ ID NO: 2146667 - protein, 7 aa, Cryptosporidium hominis
KDAPTSW

SEQ ID NO: 2146668 - protein, 156 aa, Cryptosporidium hominis
KDAPVPPESSAKDAPAAPPAKKDAPASPPMKKDAPAAPPMKKDAPPAPEPPAKDIPAPPPAKKDVPAMPPVKKDAPAAPPMKKDAPAVPDSPAKEAPAIPPTKKDAPLSPTMKKGAPTSPPMKKDLPPAPPMKKDAPTAPTPIKKSPPIPIKKEAP

SEQ ID NO: 2146669 - protein, 4 aa, Cryptosporidium hominis
KDAQ

SEQ ID NO: 2146670 - protein, 4 aa, Cryptosporidium hominis
KDAS

SEQ ID NO: 2146671 - protein, 12 aa, Cryptosporidium hominis
KDASKNLEATSY

SEQ ID NO: 2146672 - protein, 7 aa, Cryptosporidium hominis
KDASNHY

SEQ ID NO: 2146673 - protein, 9 aa, Cryptosporidium hominis
KDASSDLDI

SEQ ID NO: 2146674 - protein, 7 aa, Cryptosporidium hominis
KDCQEKS

SEQ ID NO: 2146675 - protein, 12 aa, Cryptosporidium hominis
KDCRGLESNRDS

SEQ ID NO: 2146676 - protein, 7 aa, Cryptosporidium hominis
KDCSKED

SEQ ID NO: 2146677 - protein, 13 aa, Cryptosporidium hominis
KDCSNSELNTELT

SEQ ID NO: 2146678 - protein, 4 aa, Cryptosporidium hominis
KDDA

SEQ ID NO: 2146679 - protein, 12 aa, Cryptosporidium hominis
KDDDTEKKDGVS

SEQ ID NO: 2146680 - protein, 19 aa, Cryptosporidium hominis
KDDEAQTLQTNNNDKVPSS

SEQ ID NO: 2146681 - protein, 17 aa, Cryptosporidium hominis
KDDEDEEERDRSGKGKF

SEQ ID NO: 2146682 - protein, 7 aa, Cryptosporidium hominis
KDDEEVC

SEQ ID NO: 2146683 - protein, 8 aa, Cryptosporidium hominis
KDDEKNQC

SEQ ID NO: 2146684 - protein, 8 aa, Cryptosporidium hominis
KDDENDYT

SEQ ID NO: 2146685 - protein, 4 aa, Cryptosporidium hominis
KDDG

SEQ ID NO: 2146686 - protein, 4 aa, Cryptosporidium hominis
KDDH

SEQ ID NO: 2146687 - protein, 9 aa, Cryptosporidium hominis
KDDHDNRRL

SEQ ID NO: 2146688 - protein, 9 aa, Cryptosporidium hominis
KDDIKDNEI

SEQ ID NO: 2146689 - protein, 9 aa, Cryptosporidium hominis
KDDISSNSL

SEQ ID NO: 2146690 - protein, 33 aa, Cryptosporidium hominis
KDDKIEAKQVTNYSKNTSDCGSSSKTTIKSISK

SEQ ID NO: 2146691 - protein, 14 aa, Cryptosporidium hominis
KDDKTVVTGDRTDN

SEQ ID NO: 2146692 - protein, 9 aa, Cryptosporidium hominis
KDDNKTVAL

SEQ ID NO: 2146693 - protein, 10 aa, Cryptosporidium hominis
KDDNSDANLK

SEQ ID NO: 2146694 - protein, 6 aa, Cryptosporidium hominis
KDDRLG

SEQ ID NO: 2146695 - protein, 11 aa, Cryptosporidium hominis
KDDTSNSWKTP

SEQ ID NO: 2146696 - protein, 12 aa, Cryptosporidium hominis
KDDTVTLRERDS

SEQ ID NO: 2146697 - protein, 5 aa, Cryptosporidium hominis
KDDVS

SEQ ID NO: 2146698 - protein, 4 aa, Cryptosporidium hominis
KDDY

SEQ ID NO: 2146699 - protein, 25 aa, Cryptosporidium hominis
KDEADDDITSSDEDLSDEDEKGLGP

SEQ ID NO: 2146700 - protein, 6 aa, Cryptosporidium hominis
KDEDLR

SEQ ID NO: 2146701 - protein, 9 aa, Cryptosporidium hominis
KDEDSKNIE

SEQ ID NO: 2146702 - protein, 19 aa, Cryptosporidium hominis
KDEEIQEKKSRKSISASPI

SEQ ID NO: 2146703 - protein, 21 aa, Cryptosporidium hominis
KDEELGETVSPRKQNITNSAN

SEQ ID NO: 2146704 - protein, 6 aa, Cryptosporidium hominis
KDEEME

SEQ ID NO: 2146705 - protein, 6 aa, Cryptosporidium hominis
KDEFSN

SEQ ID NO: 2146706 - protein, 11 aa, Cryptosporidium hominis
KDEGEKSALPL

SEQ ID NO: 2146707 - protein, 6 aa, Cryptosporidium hominis
KDEIAR

SEQ ID NO: 2146708 - protein, 6 aa, Cryptosporidium hominis
KDEISR

SEQ ID NO: 2146709 - protein, 18 aa, Cryptosporidium hominis
KDEIVENNHEKLSVFSGV

SEQ ID NO: 2146710 - protein, 10 aa, Cryptosporidium hominis
KDEKDENYEA

SEQ ID NO: 2146711 - protein, 10 aa, Cryptosporidium hominis
KDEKSQSMES

SEQ ID NO: 2146712 - protein, 6 aa, Cryptosporidium hominis
KDELDE

SEQ ID NO: 2146713 - protein, 17 aa, Cryptosporidium hominis
KDELEEKVNENNNISAE

SEQ ID NO: 2146714 - protein, 6 aa, Cryptosporidium hominis
KDELEN

SEQ ID NO: 2146715 - protein, 8 aa, Cryptosporidium hominis
KDELQEVS

SEQ ID NO: 2146716 - protein, 6 aa, Cryptosporidium hominis
KDENKL

SEQ ID NO: 2146717 - protein, 6 aa, Cryptosporidium hominis
KDENKV

SEQ ID NO: 2146718 - protein, 8 aa, Cryptosporidium hominis
KDENNKAF

SEQ ID NO: 2146719 - protein, 12 aa, Cryptosporidium hominis
KDENQDSSQLTG

SEQ ID NO: 2146720 - protein, 8 aa, Cryptosporidium hominis
KDENRKRK

SEQ ID NO: 2146721 - protein, 8 aa, Cryptosporidium hominis
KDEQEQEL

SEQ ID NO: 2146722 - protein, 10 aa, Cryptosporidium hominis
KDEQKGLKRE

SEQ ID NO: 2146723 - protein, 7 aa, Cryptosporidium hominis
KDERATV

SEQ ID NO: 2146724 - protein, 8 aa, Cryptosporidium hominis
KDESHSKP

SEQ ID NO: 2146725 - protein, 8 aa, Cryptosporidium hominis
KDESSYTS

SEQ ID NO: 2146726 - protein, 9 aa, Cryptosporidium hominis
KDETNGENI

SEQ ID NO: 2146727 - protein, 5 aa, Cryptosporidium hominis
KDEVI

SEQ ID NO: 2146728 - protein, 19 aa, Cryptosporidium hominis
KDEYNSTSLQSGGGKRIRA

SEQ ID NO: 2146729 - protein, 8 aa, Cryptosporidium hominis
KDFDKPGA

SEQ ID NO: 2146730 - protein, 5 aa, Cryptosporidium hominis
KDFEP

SEQ ID NO: 2146731 - protein, 5 aa, Cryptosporidium hominis
KDFQN

SEQ ID NO: 2146732 - protein, 11 aa, Cryptosporidium hominis
KDFTDKSSNIY

SEQ ID NO: 2146733 - protein, 35 aa, Cryptosporidium hominis
KDFTEPKERDLNPETVPNLESEPGPETKLKPESET

SEQ ID NO: 2146734 - protein, 14 aa, Cryptosporidium hominis
KDFTGGTSWYESPE

SEQ ID NO: 2146735 - protein, 14 aa, Cryptosporidium hominis
KDGADASMSKQPLE

SEQ ID NO: 2146736 - protein, 11 aa, Cryptosporidium hominis
KDGDGSITTKE

SEQ ID NO: 2146737 - protein, 21 aa, Cryptosporidium hominis
KDGEDGKVGESSGGGSLSYNS

SEQ ID NO: 2146738 - protein, 6 aa, Cryptosporidium hominis
KDGELK

SEQ ID NO: 2146739 - protein, 4 aa, Cryptosporidium hominis
KDGF

SEQ ID NO: 2146740 - protein, 5 aa, Cryptosporidium hominis
KDGGF

SEQ ID NO: 2146741 - protein, 8 aa, Cryptosporidium hominis
KDGGPSEI

SEQ ID NO: 2146742 - protein, 5 aa, Cryptosporidium hominis
KDGGY

SEQ ID NO: 2146743 - protein, 5 aa, Cryptosporidium hominis
KDGHV

SEQ ID NO: 2146744 - protein, 5 aa, Cryptosporidium hominis
KDGIE

SEQ ID NO: 2146745 - protein, 21 aa, Cryptosporidium hominis
KDGIEESRKKKDKAEQELSPL

SEQ ID NO: 2146746 - protein, 10 aa, Cryptosporidium hominis
KDGIESKPPH

SEQ ID NO: 2146747 - protein, 8 aa, Cryptosporidium hominis
KDGKSRGY

SEQ ID NO: 2146748 - protein, 8 aa, Cryptosporidium hominis
KDGKSTIA

SEQ ID NO: 2146749 - protein, 5 aa, Cryptosporidium hominis
KDGKV

SEQ ID NO: 2146750 - protein, 4 aa, Cryptosporidium hominis
KDGL

SEQ ID NO: 2146751 - protein, 4 aa, Cryptosporidium hominis
KDGM

SEQ ID NO: 2146752 - protein, 7 aa, Cryptosporidium hominis
KDGNGRN

SEQ ID NO: 2146753 - protein, 4 aa, Cryptosporidium hominis
KDGP

SEQ ID NO: 2146754 - protein, 7 aa, Cryptosporidium hominis
KDGPDVP

SEQ ID NO: 2146755 - protein, 8 aa, Cryptosporidium hominis
KDGQVDGD

SEQ ID NO: 2146756 - protein, 14 aa, Cryptosporidium hominis
KDGRLPQKKEFKGS

SEQ ID NO: 2146757 - protein, 7 aa, Cryptosporidium hominis
KDGSDLP

SEQ ID NO: 2146758 - protein, 5 aa, Cryptosporidium hominis
KDGSF

SEQ ID NO: 2146759 - protein, 9 aa, Cryptosporidium hominis
KDGSGKIST

SEQ ID NO: 2146760 - protein, 11 aa, Cryptosporidium hominis
KDGTISKNKGT

SEQ ID NO: 2146761 - protein, 6 aa, Cryptosporidium hominis
KDGVDD

SEQ ID NO: 2146762 - protein, 6 aa, Cryptosporidium hominis
KDHDDE

SEQ ID NO: 2146763 - protein, 14 aa, Cryptosporidium hominis
KDHLSTNGGTRDDV

SEQ ID NO: 2146764 - protein, 13 aa, Cryptosporidium hominis
KDHNESHDKTNEM

SEQ ID NO: 2146765 - protein, 5 aa, Cryptosporidium hominis
KDHSF

SEQ ID NO: 2146766 - protein, 10 aa, Cryptosporidium hominis
KDHSKGCETQ

SEQ ID NO: 2146767 - protein, 5 aa, Cryptosporidium hominis
KDIDS

SEQ ID NO: 2146768 - protein, 6 aa, Cryptosporidium hominis
KDIDSS

SEQ ID NO: 2146769 - protein, 5 aa, Cryptosporidium hominis
KDIEN

SEQ ID NO: 2146770 - protein, 8 aa, Cryptosporidium hominis
KDINEQSS

SEQ ID NO: 2146771 - protein, 4 aa, Cryptosporidium hominis
KDIP

SEQ ID NO: 2146772 - protein, 15 aa, Cryptosporidium hominis
KDIQKKDDNKRRKID

SEQ ID NO: 2146773 - protein, 4 aa, Cryptosporidium hominis
KDIT

SEQ ID NO: 2146774 - protein, 9 aa, Cryptosporidium hominis
KDKALRAAQ

SEQ ID NO: 2146775 - protein, 8 aa, Cryptosporidium hominis
KDKANSLY

SEQ ID NO: 2146776 - protein, 7 aa, Cryptosporidium hominis
KDKDEVS

SEQ ID NO: 2146777 - protein, 11 aa, Cryptosporidium hominis
KDKDNKPSGGL

SEQ ID NO: 2146778 - protein, 13 aa, Cryptosporidium hominis
KDKDNSPVTTADL

SEQ ID NO: 2146779 - protein, 9 aa, Cryptosporidium hominis
KDKDSPEKL

SEQ ID NO: 2146780 - protein, 8 aa, Cryptosporidium hominis
KDKEICDE

SEQ ID NO: 2146781 - protein, 6 aa, Cryptosporidium hominis
KDKGIR

SEQ ID NO: 2146782 - protein, 13 aa, Cryptosporidium hominis
KDKLDTLLKSCII

SEQ ID NO: 2146783 - protein, 16 aa, Cryptosporidium hominis
KDKLEKSKKETKTCSD

SEQ ID NO: 2146784 - protein, 6 aa, Cryptosporidium hominis
KDKLNK

SEQ ID NO: 2146785 - protein, 17 aa, Cryptosporidium hominis
KDKPLKPGRTYKIPSRN

SEQ ID NO: 2146786 - protein, 7 aa, Cryptosporidium hominis
KDKQQNF

SEQ ID NO: 2146787 - protein, 9 aa, Cryptosporidium hominis
KDKRIASTC

SEQ ID NO: 2146788 - protein, 14 aa, Cryptosporidium hominis
KDKSKEELEEEERN

SEQ ID NO: 2146789 - protein, 10 aa, Cryptosporidium hominis
KDKTINSQAR

SEQ ID NO: 2146790 - protein, 10 aa, Cryptosporidium hominis
KDKVKKRKNW

SEQ ID NO: 2146791 - protein, 12 aa, Cryptosporidium hominis
KDKYNTSDINSS

SEQ ID NO: 2146792 - protein, 4 aa, Cryptosporidium hominis
KDLE

SEQ ID NO: 2146793 - protein, 8 aa, Cryptosporidium hominis
KDLEAARE

SEQ ID NO: 2146794 - protein, 20 aa, Cryptosporidium hominis
KDLEYKKEYKEEDNDEEKDV

SEQ ID NO: 2146795 - protein, 9 aa, Cryptosporidium hominis
KDLEYSGRD

SEQ ID NO: 2146796 - protein, 4 aa, Cryptosporidium hominis
KDLK

SEQ ID NO: 2146797 - protein, 10 aa, Cryptosporidium hominis
KDLKADSEAL

SEQ ID NO: 2146798 - protein, 6 aa, Cryptosporidium hominis
KDLKGQ

SEQ ID NO: 2146799 - protein, 9 aa, Cryptosporidium hominis
KDLNSRPEN

SEQ ID NO: 2146800 - protein, 11 aa, Cryptosporidium hominis
KDLPKHSDESL

SEQ ID NO: 2146801 - protein, 8 aa, Cryptosporidium hominis
KDLSENSR

SEQ ID NO: 2146802 - protein, 9 aa, Cryptosporidium hominis
KDLSKKGIH

SEQ ID NO: 2146803 - protein, 9 aa, Cryptosporidium hominis
KDLSKQKKY

SEQ ID NO: 2146804 - protein, 13 aa, Cryptosporidium hominis
KDLSSTKIENKTH

SEQ ID NO: 2146805 - protein, 7 aa, Cryptosporidium hominis
KDMSNSL

SEQ ID NO: 2146806 - protein, 6 aa, Cryptosporidium hominis
KDMSTD

SEQ ID NO: 2146807 - protein, 13 aa, Cryptosporidium hominis
KDNDDEVRDRTNT

SEQ ID NO: 2146808 - protein, 4 aa, Cryptosporidium hominis
KDNE

SEQ ID NO: 2146809 - protein, 6 aa, Cryptosporidium hominis
KDNEKH

SEQ ID NO: 2146810 - protein, 6 aa, Cryptosporidium hominis
KDNHIT

SEQ ID NO: 2146811 - protein, 19 aa, Cryptosporidium hominis
KDNHQNQITRRTSETEFGY

SEQ ID NO: 2146812 - protein, 9 aa, Cryptosporidium hominis
KDNHTDKSE

SEQ ID NO: 2146813 - protein, 21 aa, Cryptosporidium hominis
KDNIASDNTTIKNSSEYKINT

SEQ ID NO: 2146814 - protein, 7 aa, Cryptosporidium hominis
KDNIPQT

SEQ ID NO: 2146815 - protein, 7 aa, Cryptosporidium hominis
KDNKDAM

SEQ ID NO: 2146816 - protein, 16 aa, Cryptosporidium hominis
KDNKDSVNAQKEKRKK

SEQ ID NO: 2146817 - protein, 10 aa, Cryptosporidium hominis
KDNKHNSLKD

SEQ ID NO: 2146818 - protein, 9 aa, Cryptosporidium hominis
KDNKTEQNI

SEQ ID NO: 2146819 - protein, 8 aa, Cryptosporidium hominis
KDNLGRNG

SEQ ID NO: 2146820 - protein, 10 aa, Cryptosporidium hominis
KDNNKANSEI

SEQ ID NO: 2146821 - protein, 12 aa, Cryptosporidium hominis
KDNNKFNILVSL

SEQ ID NO: 2146822 - protein, 6 aa, Cryptosporidium hominis
KDNNQN

SEQ ID NO: 2146823 - protein, 22 aa, Cryptosporidium hominis
KDNNSDMSCSENNSSNELKPNS

SEQ ID NO: 2146824 - protein, 6 aa, Cryptosporidium hominis
KDNNSK

SEQ ID NO: 2146825 - protein, 6 aa, Cryptosporidium hominis
KDNQGP

SEQ ID NO: 2146826 - protein, 6 aa, Cryptosporidium hominis
KDNSEQ

SEQ ID NO: 2146827 - protein, 13 aa, Cryptosporidium hominis
KDNSNMNESNNNL

SEQ ID NO: 2146828 - protein, 10 aa, Cryptosporidium hominis
KDNSSGDRSF

SEQ ID NO: 2146829 - protein, 16 aa, Cryptosporidium hominis
KDNTIESFNKTTYGQK

SEQ ID NO: 2146830 - protein, 9 aa, Cryptosporidium hominis
KDPAEIPWG

SEQ ID NO: 2146831 - protein, 6 aa, Cryptosporidium hominis
KDPEFS

SEQ ID NO: 2146832 - protein, 7 aa, Cryptosporidium hominis
KDPEIQE

SEQ ID NO: 2146833 - protein, 8 aa, Cryptosporidium hominis
KDPGFSKN

SEQ ID NO: 2146834 - protein, 8 aa, Cryptosporidium hominis
KDPGLSSA

SEQ ID NO: 2146835 - protein, 6 aa, Cryptosporidium hominis
KDPKAR

SEQ ID NO: 2146836 - protein, 9 aa, Cryptosporidium hominis
KDPKSQSSL

SEQ ID NO: 2146837 - protein, 4 aa, Cryptosporidium hominis
KDPN

SEQ ID NO: 2146838 - protein, 8 aa, Cryptosporidium hominis
KDPNTNRK

SEQ ID NO: 2146839 - protein, 13 aa, Cryptosporidium hominis
KDPPEKESEVGNQ

SEQ ID NO: 2146840 - protein, 13 aa, Cryptosporidium hominis
KDPSEVKDEREEL

SEQ ID NO: 2146841 - protein, 17 aa, Cryptosporidium hominis
KDPSVDTKNITRQKVPG

SEQ ID NO: 2146842 - protein, 6 aa, Cryptosporidium hominis
KDPSYI

SEQ ID NO: 2146843 - protein, 8 aa, Cryptosporidium hominis
KDPTHQTE

SEQ ID NO: 2146844 - protein, 4 aa, Cryptosporidium hominis
KDPV

SEQ ID NO: 2146845 - protein, 4 aa, Cryptosporidium hominis
KDPY

SEQ ID NO: 2146846 - protein, 22 aa, Cryptosporidium hominis
KDQAKSKSWASRKGMNPEDAAN

SEQ ID NO: 2146847 - protein, 5 aa, Cryptosporidium hominis
KDQDL

SEQ ID NO: 2146848 - protein, 5 aa, Cryptosporidium hominis
KDQDR

SEQ ID NO: 2146849 - protein, 6 aa, Cryptosporidium hominis
KDQESI

SEQ ID NO: 2146850 - protein, 13 aa, Cryptosporidium hominis
KDQGKSDELGEKR

SEQ ID NO: 2146851 - protein, 7 aa, Cryptosporidium hominis
KDQHDND

SEQ ID NO: 2146852 - protein, 6 aa, Cryptosporidium hominis
KDQISE

SEQ ID NO: 2146853 - protein, 9 aa, Cryptosporidium hominis
KDQNESIPE

SEQ ID NO: 2146854 - protein, 7 aa, Cryptosporidium hominis
KDQNTNL

SEQ ID NO: 2146855 - protein, 15 aa, Cryptosporidium hominis
KDQRLKKRKEEEDKR

SEQ ID NO: 2146856 - protein, 4 aa, Cryptosporidium hominis
KDRE

SEQ ID NO: 2146857 - protein, 7 aa, Cryptosporidium hominis
KDREGES

SEQ ID NO: 2146858 - protein, 16 aa, Cryptosporidium hominis
KDREQPNLKDASTLNT

SEQ ID NO: 2146859 - protein, 34 aa, Cryptosporidium hominis
KDRGYMEKKRSKGYRSKRRSSSVSSDDSDLPPRR

SEQ ID NO: 2146860 - protein, 17 aa, Cryptosporidium hominis
KDRHNPNEMNGNMDGLL

SEQ ID NO: 2146861 - protein, 7 aa, Cryptosporidium hominis
KDRKGEI

SEQ ID NO: 2146862 - protein, 13 aa, Cryptosporidium hominis
KDRLDSSELSQES

SEQ ID NO: 2146863 - protein, 5 aa, Cryptosporidium hominis
KDRPI

SEQ ID NO: 2146864 - protein, 8 aa, Cryptosporidium hominis
KDRPPSLE

SEQ ID NO: 2146865 - protein, 11 aa, Cryptosporidium hominis
KDRPSEYGDKG

SEQ ID NO: 2146866 - protein, 10 aa, Cryptosporidium hominis
KDRTSERSKL

SEQ ID NO: 2146867 - protein, 4 aa, Cryptosporidium hominis
KDSA

SEQ ID NO: 2146868 - protein, 5 aa, Cryptosporidium hominis
KDSAN

SEQ ID NO: 2146869 - protein, 18 aa, Cryptosporidium hominis
KDSDEIEDSSIHDNELSD

SEQ ID NO: 2146870 - protein, 10 aa, Cryptosporidium hominis
KDSDRPRQKG

SEQ ID NO: 2146871 - protein, 8 aa, Cryptosporidium hominis
KDSEEIKT

SEQ ID NO: 2146872 - protein, 6 aa, Cryptosporidium hominis
KDSEKS

SEQ ID NO: 2146873 - protein, 7 aa, Cryptosporidium hominis
KDSENSE

SEQ ID NO: 2146874 - protein, 12 aa, Cryptosporidium hominis
KDSEQENNESMI

SEQ ID NO: 2146875 - protein, 8 aa, Cryptosporidium hominis
KDSESIVD

SEQ ID NO: 2146876 - protein, 5 aa, Cryptosporidium hominis
KDSGF

SEQ ID NO: 2146877 - protein, 9 aa, Cryptosporidium hominis
KDSGPLEDR

SEQ ID NO: 2146878 - protein, 6 aa, Cryptosporidium hominis
KDSGRL

SEQ ID NO: 2146879 - protein, 8 aa, Cryptosporidium hominis
KDSIENGL

SEQ ID NO: 2146880 - protein, 7 aa, Cryptosporidium hominis
KDSKEEN

SEQ ID NO: 2146881 - protein, 5 aa, Cryptosporidium hominis
KDSKI

SEQ ID NO: 2146882 - protein, 6 aa, Cryptosporidium hominis
KDSKNS

SEQ ID NO: 2146883 - protein, 9 aa, Cryptosporidium hominis
KDSKRQRNH

SEQ ID NO: 2146884 - protein, 13 aa, Cryptosporidium hominis
KDSLTKNKDPQAN

SEQ ID NO: 2146885 - protein, 8 aa, Cryptosporidium hominis
KDSNKRQR

SEQ ID NO: 2146886 - protein, 13 aa, Cryptosporidium hominis
KDSNKVIKNSSSL

SEQ ID NO: 2146887 - protein, 6 aa, Cryptosporidium hominis
KDSNNC

SEQ ID NO: 2146888 - protein, 8 aa, Cryptosporidium hominis
KDSNQYRQ

SEQ ID NO: 2146889 - protein, 6 aa, Cryptosporidium hominis
KDSNRF

SEQ ID NO: 2146890 - protein, 19 aa, Cryptosporidium hominis
KDSNSSTGNFTANTTIPAN

SEQ ID NO: 2146891 - protein, 18 aa, Cryptosporidium hominis
KDSPISDNEQSNNEPSLE

SEQ ID NO: 2146892 - protein, 20 aa, Cryptosporidium hominis
KDSPLKKTSATSDPSSGMGN

SEQ ID NO: 2146893 - protein, 9 aa, Cryptosporidium hominis
KDSPPASQL

SEQ ID NO: 2146894 - protein, 8 aa, Cryptosporidium hominis
KDSPSHSL

SEQ ID NO: 2146895 - protein, 19 aa, Cryptosporidium hominis
KDSQESQNKNESNKSNGPI

SEQ ID NO: 2146896 - protein, 8 aa, Cryptosporidium hominis
KDSQGNYG

SEQ ID NO: 2146897 - protein, 10 aa, Cryptosporidium hominis
KDSQKLGKIK

SEQ ID NO: 2146898 - protein, 5 aa, Cryptosporidium hominis
KDSQN

SEQ ID NO: 2146899 - protein, 11 aa, Cryptosporidium hominis
KDSRTSKDPIV

SEQ ID NO: 2146900 - protein, 8 aa, Cryptosporidium hominis
KDSSKNTA

SEQ ID NO: 2146901 - protein, 8 aa, Cryptosporidium hominis
KDSSKTKN

SEQ ID NO: 2146902 - protein, 6 aa, Cryptosporidium hominis
KDSSLS

SEQ ID NO: 2146903 - protein, 12 aa, Cryptosporidium hominis
KDSSTTKNLSSK

SEQ ID NO: 2146904 - protein, 6 aa, Cryptosporidium hominis
KDSTRI

SEQ ID NO: 2146905 - protein, 23 aa, Cryptosporidium hominis
KDSYSCDASQQNDLSSADIDKSR

SEQ ID NO: 2146906 - protein, 5 aa, Cryptosporidium hominis
KDTDD

SEQ ID NO: 2146907 - protein, 8 aa, Cryptosporidium hominis
KDTDTEDE

SEQ ID NO: 2146908 - protein, 4 aa, Cryptosporidium hominis
KDTE

SEQ ID NO: 2146909 - protein, 9 aa, Cryptosporidium hominis
KDTEEMEYA

SEQ ID NO: 2146910 - protein, 13 aa, Cryptosporidium hominis
KDTENRRSELASQ

SEQ ID NO: 2146911 - protein, 6 aa, Cryptosporidium hominis
KDTGEV

SEQ ID NO: 2146912 - protein, 6 aa, Cryptosporidium hominis
KDTGIA

SEQ ID NO: 2146913 - protein, 7 aa, Cryptosporidium hominis
KDTGLSR

SEQ ID NO: 2146914 - protein, 19 aa, Cryptosporidium hominis
KDTKNNITDNQNSQGNCNY

SEQ ID NO: 2146915 - protein, 4 aa, Cryptosporidium hominis
KDTL

SEQ ID NO: 2146916 - protein, 7 aa, Cryptosporidium hominis
KDTNGEP

SEQ ID NO: 2146917 - protein, 12 aa, Cryptosporidium hominis
KDTNVKRSKTQV

SEQ ID NO: 2146918 - protein, 10 aa, Cryptosporidium hominis
KDTSKPKGQV

SEQ ID NO: 2146919 - protein, 8 aa, Cryptosporidium hominis
KDTSTTTG

SEQ ID NO: 2146920 - protein, 6 aa, Cryptosporidium hominis
KDTTVS

SEQ ID NO: 2146921 - protein, 8 aa, Cryptosporidium hominis
KDVAKDSE

SEQ ID NO: 2146922 - protein, 25 aa, Cryptosporidium hominis
KDVEKYDGEIKQDINNNTENAAPRL

SEQ ID NO: 2146923 - protein, 6 aa, Cryptosporidium hominis
KDVESS

SEQ ID NO: 2146924 - protein, 10 aa, Cryptosporidium hominis
KDVKDGKYKH

SEQ ID NO: 2146925 - protein, 7 aa, Cryptosporidium hominis
KDVQSSQ

SEQ ID NO: 2146926 - protein, 13 aa, Cryptosporidium hominis
KDVTDNENRSSKE

SEQ ID NO: 2146927 - protein, 4 aa, Cryptosporidium hominis
KDYE

SEQ ID NO: 2146928 - protein, 5 aa, Cryptosporidium hominis
KDYIR

SEQ ID NO: 2146929 - protein, 5 aa, Cryptosporidium hominis
KDYKI

SEQ ID NO: 2146930 - protein, 8 aa, Cryptosporidium hominis
KDYNYNTQ

SEQ ID NO: 2146931 - protein, 4 aa, Cryptosporidium hominis
KDYQ

SEQ ID NO: 2146932 - protein, 5 aa, Cryptosporidium hominis
KDYRK

SEQ ID NO: 2146933 - protein, 9 aa, Cryptosporidium hominis
KDYSGVQSQ

SEQ ID NO: 2146934 - protein, 20 aa, Cryptosporidium hominis
KDYSPTSSKAIREAPPEECS

SEQ ID NO: 2146935 - protein, 22 aa, Cryptosporidium hominis
KDYTEKEKESKKKHKQTNKEKA

SEQ ID NO: 2146936 - protein, 13 aa, Cryptosporidium hominis
KEAAEVSKKQFEN

SEQ ID NO: 2146937 - protein, 5 aa, Cryptosporidium hominis
KEAAG

SEQ ID NO: 2146938 - protein, 11 aa, Cryptosporidium hominis
KEAEKSSVKEE

SEQ ID NO: 2146939 - protein, 5 aa, Cryptosporidium hominis
KEAER

SEQ ID NO: 2146940 - protein, 11 aa, Cryptosporidium hominis
KEAETYPEGDE

SEQ ID NO: 2146941 - protein, 4 aa, Cryptosporidium hominis
KEAH

SEQ ID NO: 2146942 - protein, 9 aa, Cryptosporidium hominis
KEAKKALSN

SEQ ID NO: 2146943 - protein, 9 aa, Cryptosporidium hominis
KEAKNTTIE

SEQ ID NO: 2146944 - protein, 8 aa, Cryptosporidium hominis
KEANGKLV

SEQ ID NO: 2146945 - protein, 11 aa, Cryptosporidium hominis
KEANKLHQETV

SEQ ID NO: 2146946 - protein, 24 aa, Cryptosporidium hominis
KEAPKRPNVSKSIKKNMSRGKPVM

SEQ ID NO: 2146947 - protein, 8 aa, Cryptosporidium hominis
KEARDKSW

SEQ ID NO: 2146948 - protein, 6 aa, Cryptosporidium hominis
KEARDL

SEQ ID NO: 2146949 - protein, 6 aa, Cryptosporidium hominis
KEASGS

SEQ ID NO: 2146950 - protein, 8 aa, Cryptosporidium hominis
KEASNGPM

SEQ ID NO: 2146951 - protein, 9 aa, Cryptosporidium hominis
KEASNNGDY

SEQ ID NO: 2146952 - protein, 6 aa, Cryptosporidium hominis
KECPKS

SEQ ID NO: 2146953 - protein, 5 aa, Cryptosporidium hominis
KEDAK

SEQ ID NO: 2146954 - protein, 12 aa, Cryptosporidium hominis
KEDDSSEYYSDK

SEQ ID NO: 2146955 - protein, 7 aa, Cryptosporidium hominis
KEDDYDA

SEQ ID NO: 2146956 - protein, 33 aa, Cryptosporidium hominis
KEDEARDLKATELKNKRSSTTKSAIERRKKELS

SEQ ID NO: 2146957 - protein, 10 aa, Cryptosporidium hominis
KEDEEDDYDD

SEQ ID NO: 2146958 - protein, 8 aa, Cryptosporidium hominis
KEDEKEEI

SEQ ID NO: 2146959 - protein, 8 aa, Cryptosporidium hominis
KEDEQAGI

SEQ ID NO: 2146960 - protein, 8 aa, Cryptosporidium hominis
KEDGSKDQ

SEQ ID NO: 2146961 - protein, 5 aa, Cryptosporidium hominis
KEDID

SEQ ID NO: 2146962 - protein, 10 aa, Cryptosporidium hominis
KEDLDDSEDL

SEQ ID NO: 2146963 - protein, 12 aa, Cryptosporidium hominis
KEDLSTILKETW

SEQ ID NO: 2146964 - protein, 20 aa, Cryptosporidium hominis
KEDNEKKATMKNNNNNNNII

SEQ ID NO: 2146965 - protein, 9 aa, Cryptosporidium hominis
KEDNERETK

SEQ ID NO: 2146966 - protein, 4 aa, Cryptosporidium hominis
KEDP

SEQ ID NO: 2146967 - protein, 6 aa, Cryptosporidium hominis
KEDPEI

SEQ ID NO: 2146968 - protein, 18 aa, Cryptosporidium hominis
KEDQDETYSSKKRSIRGS

SEQ ID NO: 2146969 - protein, 6 aa, Cryptosporidium hominis
KEDQSL

SEQ ID NO: 2146970 - protein, 11 aa, Cryptosporidium hominis
KEDSECDDHEI

SEQ ID NO: 2146971 - protein, 9 aa, Cryptosporidium hominis
KEDSGNTEE

SEQ ID NO: 2146972 - protein, 9 aa, Cryptosporidium hominis
KEDTPVSPK

SEQ ID NO: 2146973 - protein, 6 aa, Cryptosporidium hominis
KEEDVG

SEQ ID NO: 2146974 - protein, 32 aa, Cryptosporidium hominis
KEEEDGGGEEDLNNGEKRRKGRVENKDVERKD

SEQ ID NO: 2146975 - protein, 16 aa, Cryptosporidium hominis
KEEEEDKEENLGKEEQ

SEQ ID NO: 2146976 - protein, 14 aa, Cryptosporidium hominis
KEEEEKAVRSTDTV

SEQ ID NO: 2146977 - protein, 10 aa, Cryptosporidium hominis
KEEEEKGDDI

SEQ ID NO: 2146978 - protein, 5 aa, Cryptosporidium hominis
KEEEQ

SEQ ID NO: 2146979 - protein, 7 aa, Cryptosporidium hominis
KEEEREG

SEQ ID NO: 2146980 - protein, 6 aa, Cryptosporidium hominis
KEEERI

SEQ ID NO: 2146981 - protein, 6 aa, Cryptosporidium hominis
KEEERW

SEQ ID NO: 2146982 - protein, 12 aa, Cryptosporidium hominis
KEEEYRRKQGEL

SEQ ID NO: 2146983 - protein, 10 aa, Cryptosporidium hominis
KEEFDEKSNE

SEQ ID NO: 2146984 - protein, 7 aa, Cryptosporidium hominis
KEEGYFP

SEQ ID NO: 2146985 - protein, 6 aa, Cryptosporidium hominis
KEEIDG

SEQ ID NO: 2146986 - protein, 16 aa, Cryptosporidium hominis
KEEIQDSVDDPNPTSE

SEQ ID NO: 2146987 - protein, 7 aa, Cryptosporidium hominis
KEEIQRK

SEQ ID NO: 2146988 - protein, 56 aa, Cryptosporidium hominis
KEEKADEKDDEEKGEEEEEEEEEEEEEEEEEEEEEEEEEEEKEEEEEKEEKEEPTI

SEQ ID NO: 2146989 - protein, 14 aa, Cryptosporidium hominis
KEEKGEKNQSRNLK

SEQ ID NO: 2146990 - protein, 13 aa, Cryptosporidium hominis
KEEKKKSSFSELP

SEQ ID NO: 2146991 - protein, 12 aa, Cryptosporidium hominis
KEEKKPQDDQDL

SEQ ID NO: 2146992 - protein, 7 aa, Cryptosporidium hominis
KEEKSGK

SEQ ID NO: 2146993 - protein, 11 aa, Cryptosporidium hominis
KEEKTATKKNS

SEQ ID NO: 2146994 - protein, 8 aa, Cryptosporidium hominis
KEEKTFEE

SEQ ID NO: 2146995 - protein, 4 aa, Cryptosporidium hominis
KEEN

SEQ ID NO: 2146996 - protein, 7 aa, Cryptosporidium hominis
KEENEDE

SEQ ID NO: 2146997 - protein, 10 aa, Cryptosporidium hominis
KEENFNERTN

SEQ ID NO: 2146998 - protein, 6 aa, Cryptosporidium hominis
KEENIE

SEQ ID NO: 2146999 - protein, 7 aa, Cryptosporidium hominis
KEENNDD

SEQ ID NO: 2147000 - protein, 8 aa, Cryptosporidium hominis
KEENSTNF

SEQ ID NO: 2147001 - protein, 7 aa, Cryptosporidium hominis
KEENTAR

SEQ ID NO: 2147002 - protein, 4 aa, Cryptosporidium hominis
KEEQ

SEQ ID NO: 2147003 - protein, 6 aa, Cryptosporidium hominis
KEEQDF

SEQ ID NO: 2147004 - protein, 6 aa, Cryptosporidium hominis
KEEQNY

SEQ ID NO: 2147005 - protein, 8 aa, Cryptosporidium hominis
KEERASGL

SEQ ID NO: 2147006 - protein, 5 aa, Cryptosporidium hominis
KEERD

SEQ ID NO: 2147007 - protein, 10 aa, Cryptosporidium hominis
KEERREEQNL

SEQ ID NO: 2147008 - protein, 16 aa, Cryptosporidium hominis
KEERSNHTDSGKKKRF

SEQ ID NO: 2147009 - protein, 7 aa, Cryptosporidium hominis
KEERSRH

SEQ ID NO: 2147010 - protein, 4 aa, Cryptosporidium hominis
KEES

SEQ ID NO: 2147011 - protein, 10 aa, Cryptosporidium hominis
KEESAESKIE

SEQ ID NO: 2147012 - protein, 10 aa, Cryptosporidium hominis
KEESFKKNSS

SEQ ID NO: 2147013 - protein, 12 aa, Cryptosporidium hominis
KEESKSSETFGS

SEQ ID NO: 2147014 - protein, 23 aa, Cryptosporidium hominis
KEESYQQTKVKPSISRTALEEQQ

SEQ ID NO: 2147015 - protein, 20 aa, Cryptosporidium hominis
KEETDDKESEDENKNQNYSS

SEQ ID NO: 2147016 - protein, 6 aa, Cryptosporidium hominis
KEETGE

SEQ ID NO: 2147017 - protein, 7 aa, Cryptosporidium hominis
KEETNGL

SEQ ID NO: 2147018 - protein, 4 aa, Cryptosporidium hominis
KEEV

SEQ ID NO: 2147019 - protein, 55 aa, Cryptosporidium hominis
KEEVGEEVEEKEEKKKVKEEEEEEEEGEEEEEEEEEEEEEEEEVKTVSNSSDHED

SEQ ID NO: 2147020 - protein, 29 aa, Cryptosporidium hominis
KEEVKEKEKMDLSEQSPKKEPSADVSPET

SEQ ID NO: 2147021 - protein, 7 aa, Cryptosporidium hominis
KEEYGGD

SEQ ID NO: 2147022 - protein, 4 aa, Cryptosporidium hominis
KEFA

SEQ ID NO: 2147023 - protein, 6 aa, Cryptosporidium hominis
KEFDSS

SEQ ID NO: 2147024 - protein, 7 aa, Cryptosporidium hominis
KEFEDSI

SEQ ID NO: 2147025 - protein, 10 aa, Cryptosporidium hominis
KEFEESTNTV

SEQ ID NO: 2147026 - protein, 6 aa, Cryptosporidium hominis
KEFEKI

SEQ ID NO: 2147027 - protein, 19 aa, Cryptosporidium hominis
KEFESKNGNDNSKYNNEDN

SEQ ID NO: 2147028 - protein, 5 aa, Cryptosporidium hominis
KEFET

SEQ ID NO: 2147029 - protein, 6 aa, Cryptosporidium hominis
KEFKGG

SEQ ID NO: 2147030 - protein, 12 aa, Cryptosporidium hominis
KEFKQESSSPTL

SEQ ID NO: 2147031 - protein, 9 aa, Cryptosporidium hominis
KEFQGRPTP

SEQ ID NO: 2147032 - protein, 14 aa, Cryptosporidium hominis
KEFSSMAPREEEIE

SEQ ID NO: 2147033 - protein, 7 aa, Cryptosporidium hominis
KEGEREK

SEQ ID NO: 2147034 - protein, 5 aa, Cryptosporidium hominis
KEGET

SEQ ID NO: 2147035 - protein, 8 aa, Cryptosporidium hominis
KEGGDEEL

SEQ ID NO: 2147036 - protein, 21 aa, Cryptosporidium hominis
KEGKEREENGEEEERKKKKGL

SEQ ID NO: 2147037 - protein, 16 aa, Cryptosporidium hominis
KEGKETDDEMDYSEDH

SEQ ID NO: 2147038 - protein, 5 aa, Cryptosporidium hominis
KEGKI

SEQ ID NO: 2147039 - protein, 7 aa, Cryptosporidium hominis
KEGKTGI

SEQ ID NO: 2147040 - protein, 6 aa, Cryptosporidium hominis
KEGMKR

SEQ ID NO: 2147041 - protein, 12 aa, Cryptosporidium hominis
KEGNEKENSQEV

SEQ ID NO: 2147042 - protein, 16 aa, Cryptosporidium hominis
KEGPIDSTPIVTNDGA

SEQ ID NO: 2147043 - protein, 5 aa, Cryptosporidium hominis
KEGSE

SEQ ID NO: 2147044 - protein, 5 aa, Cryptosporidium hominis
KEGSI

SEQ ID NO: 2147045 - protein, 17 aa, Cryptosporidium hominis
KEGSNPKIDRPQNHSKQ

SEQ ID NO: 2147046 - protein, 5 aa, Cryptosporidium hominis
KEGTY

SEQ ID NO: 2147047 - protein, 6 aa, Cryptosporidium hominis
KEGYDG

SEQ ID NO: 2147048 - protein, 5 aa, Cryptosporidium hominis
KEHEE

SEQ ID NO: 2147049 - protein, 8 aa, Cryptosporidium hominis
KEHGDPES

SEQ ID NO: 2147050 - protein, 5 aa, Cryptosporidium hominis
KEHGH

SEQ ID NO: 2147051 - protein, 4 aa, Cryptosporidium hominis
KEHR

SEQ ID NO: 2147052 - protein, 5 aa, Cryptosporidium hominis
KEIEK

SEQ ID NO: 2147053 - protein, 7 aa, Cryptosporidium hominis
KEIEKGN

SEQ ID NO: 2147054 - protein, 7 aa, Cryptosporidium hominis
KEIEKRT

SEQ ID NO: 2147055 - protein, 33 aa, Cryptosporidium hominis
KEIEREKEEEREKTRANERNAKELSEKKPATII

SEQ ID NO: 2147056 - protein, 4 aa, Cryptosporidium hominis
KEIG

SEQ ID NO: 2147057 - protein, 13 aa, Cryptosporidium hominis
KEIHDNTSEEDDE

SEQ ID NO: 2147058 - protein, 6 aa, Cryptosporidium hominis
KEIHPK

SEQ ID NO: 2147059 - protein, 35 aa, Cryptosporidium hominis
KEIKAENEVLSNKSSTMELSNTAGQNSQQENNEIN

SEQ ID NO: 2147060 - protein, 9 aa, Cryptosporidium hominis
KEIKEEGNT

SEQ ID NO: 2147061 - protein, 26 aa, Cryptosporidium hominis
KEIKENSPVPVSNSEIPEETNTKKEM

SEQ ID NO: 2147062 - protein, 6 aa, Cryptosporidium hominis
KEIKEQ

SEQ ID NO: 2147063 - protein, 6 aa, Cryptosporidium hominis
KEIKNG

SEQ ID NO: 2147064 - protein, 6 aa, Cryptosporidium hominis
KEIKNM

SEQ ID NO: 2147065 - protein, 19 aa, Cryptosporidium hominis
KEINNKTQKISSKQNNQII

SEQ ID NO: 2147066 - protein, 12 aa, Cryptosporidium hominis
KEINSAKQIGES

SEQ ID NO: 2147067 - protein, 13 aa, Cryptosporidium hominis
KEINSSTGQLDER

SEQ ID NO: 2147068 - protein, 4 aa, Cryptosporidium hominis
KEIQ

SEQ ID NO: 2147069 - protein, 6 aa, Cryptosporidium hominis
KEIQEN

SEQ ID NO: 2147070 - protein, 6 aa, Cryptosporidium hominis
KEISKD

SEQ ID NO: 2147071 - protein, 7 aa, Cryptosporidium hominis
KEISNGK

SEQ ID NO: 2147072 - protein, 26 aa, Cryptosporidium hominis
KEITERSNQPKKESNTEEEDSTEKYL

SEQ ID NO: 2147073 - protein, 10 aa, Cryptosporidium hominis
KEKAKQADSI

SEQ ID NO: 2147074 - protein, 8 aa, Cryptosporidium hominis
KEKAKSQK

SEQ ID NO: 2147075 - protein, 5 aa, Cryptosporidium hominis
KEKDC

SEQ ID NO: 2147076 - protein, 18 aa, Cryptosporidium hominis
KEKDHHNSNQNQNYSSLP

SEQ ID NO: 2147077 - protein, 17 aa, Cryptosporidium hominis
KEKDKLVTDSRISNNTN

SEQ ID NO: 2147078 - protein, 13 aa, Cryptosporidium hominis
KEKDSQGKSFSET

SEQ ID NO: 2147079 - protein, 8 aa, Cryptosporidium hominis
KEKEEKIE

SEQ ID NO: 2147080 - protein, 10 aa, Cryptosporidium hominis
KEKEIQNQRR

SEQ ID NO: 2147081 - protein, 5 aa, Cryptosporidium hominis
KEKEN

SEQ ID NO: 2147082 - protein, 16 aa, Cryptosporidium hominis
KEKENEIAQLKAKTSL

SEQ ID NO: 2147083 - protein, 8 aa, Cryptosporidium hominis
KEKEQERE

SEQ ID NO: 2147084 - protein, 8 aa, Cryptosporidium hominis
KEKEQIEN

SEQ ID NO: 2147085 - protein, 9 aa, Cryptosporidium hominis
KEKERESMQ

SEQ ID NO: 2147086 - protein, 30 aa, Cryptosporidium hominis
KEKEYNKNEKAKNKSPYKEEPSRSDVSNGE

SEQ ID NO: 2147087 - protein, 4 aa, Cryptosporidium hominis
KEKF

SEQ ID NO: 2147088 - protein, 7 aa, Cryptosporidium hominis
KEKFPGQ

SEQ ID NO: 2147089 - protein, 21 aa, Cryptosporidium hominis
KEKFREIENSSPLTSESTQKH

SEQ ID NO: 2147090 - protein, 9 aa, Cryptosporidium hominis
KEKGEYQRD

SEQ ID NO: 2147091 - protein, 11 aa, Cryptosporidium hominis
KEKGSDKSRNF

SEQ ID NO: 2147092 - protein, 4 aa, Cryptosporidium hominis
KEKI

SEQ ID NO: 2147093 - protein, 13 aa, Cryptosporidium hominis
KEKKRIRELNSEK

SEQ ID NO: 2147094 - protein, 43 aa, Cryptosporidium hominis
KEKKYNNNNSSDVASNNQLDENVGDSEESQNKVDETKEKESQM

SEQ ID NO: 2147095 - protein, 10 aa, Cryptosporidium hominis
KEKMYKDAKT

SEQ ID NO: 2147096 - protein, 4 aa, Cryptosporidium hominis
KEKN

SEQ ID NO: 2147097 - protein, 8 aa, Cryptosporidium hominis
KEKNGNEY

SEQ ID NO: 2147098 - protein, 8 aa, Cryptosporidium hominis
KEKNMELD

SEQ ID NO: 2147099 - protein, 6 aa, Cryptosporidium hominis
KEKNNI

SEQ ID NO: 2147100 - protein, 9 aa, Cryptosporidium hominis
KEKNSPNFN

SEQ ID NO: 2147101 - protein, 4 aa, Cryptosporidium hominis
KEKP

SEQ ID NO: 2147102 - protein, 9 aa, Cryptosporidium hominis
KEKPSQKDK

SEQ ID NO: 2147103 - protein, 16 aa, Cryptosporidium hominis
KEKQEINEKRNNENNY

SEQ ID NO: 2147104 - protein, 9 aa, Cryptosporidium hominis
KEKQISELT

SEQ ID NO: 2147105 - protein, 7 aa, Cryptosporidium hominis
KEKQKLE

SEQ ID NO: 2147106 - protein, 10 aa, Cryptosporidium hominis
KEKRDEVNRQ

SEQ ID NO: 2147107 - protein, 5 aa, Cryptosporidium hominis
KEKRI

SEQ ID NO: 2147108 - protein, 4 aa, Cryptosporidium hominis
KEKS

SEQ ID NO: 2147109 - protein, 23 aa, Cryptosporidium hominis
KEKSKDNDSSFQNDESGSYAQAS

SEQ ID NO: 2147110 - protein, 11 aa, Cryptosporidium hominis
KEKSKINSEKP

SEQ ID NO: 2147111 - protein, 6 aa, Cryptosporidium hominis
KEKSKT

SEQ ID NO: 2147112 - protein, 6 aa, Cryptosporidium hominis
KEKTNI

SEQ ID NO: 2147113 - protein, 7 aa, Cryptosporidium hominis
KEKTSKD

SEQ ID NO: 2147114 - protein, 10 aa, Cryptosporidium hominis
KEKYGNIGQR

SEQ ID NO: 2147115 - protein, 8 aa, Cryptosporidium hominis
KEKYKDDY

SEQ ID NO: 2147116 - protein, 9 aa, Cryptosporidium hominis
KEKYNPSQM

SEQ ID NO: 2147117 - protein, 8 aa, Cryptosporidium hominis
KEKYTKST

SEQ ID NO: 2147118 - protein, 10 aa, Cryptosporidium hominis
KELAPDEKMT

SEQ ID NO: 2147119 - protein, 4 aa, Cryptosporidium hominis
KELD

SEQ ID NO: 2147120 - protein, 9 aa, Cryptosporidium hominis
KELDSAQEK

SEQ ID NO: 2147121 - protein, 6 aa, Cryptosporidium hominis
KELEDN

SEQ ID NO: 2147122 - protein, 33 aa, Cryptosporidium hominis
KELERQYNKRDRDSKSERKKAKDAIISGKADLS

SEQ ID NO: 2147123 - protein, 14 aa, Cryptosporidium hominis
KELERSSKNEELEA

SEQ ID NO: 2147124 - protein, 5 aa, Cryptosporidium hominis
KELGE

SEQ ID NO: 2147125 - protein, 4 aa, Cryptosporidium hominis
KELH

SEQ ID NO: 2147126 - protein, 25 aa, Cryptosporidium hominis
KELKDAGNESYKGGNYSDAREKYEK

SEQ ID NO: 2147127 - protein, 7 aa, Cryptosporidium hominis
KELKKQG

SEQ ID NO: 2147128 - protein, 17 aa, Cryptosporidium hominis
KELKSENENFDSESKLE

SEQ ID NO: 2147129 - protein, 4 aa, Cryptosporidium hominis
KELN

SEQ ID NO: 2147130 - protein, 5 aa, Cryptosporidium hominis
KELNT

SEQ ID NO: 2147131 - protein, 7 aa, Cryptosporidium hominis
KELNTKG

SEQ ID NO: 2147132 - protein, 12 aa, Cryptosporidium hominis
KELPSDQNAQEK

SEQ ID NO: 2147133 - protein, 4 aa, Cryptosporidium hominis
KELR

SEQ ID NO: 2147134 - protein, 19 aa, Cryptosporidium hominis
KELSESSKREEAKQRTTGS

SEQ ID NO: 2147135 - protein, 13 aa, Cryptosporidium hominis
KELSFGGKARKEM

SEQ ID NO: 2147136 - protein, 10 aa, Cryptosporidium hominis
KELSNKIETG

SEQ ID NO: 2147137 - protein, 29 aa, Cryptosporidium hominis
KELSNQTKSLKDDNDKNKNNKNNINDNSS

SEQ ID NO: 2147138 - protein, 16 aa, Cryptosporidium hominis
KELSQAAADSNKQKRL

SEQ ID NO: 2147139 - protein, 10 aa, Cryptosporidium hominis
KELSRDPDIK

SEQ ID NO: 2147140 - protein, 7 aa, Cryptosporidium hominis
KELTDND

SEQ ID NO: 2147141 - protein, 7 aa, Cryptosporidium hominis
KELTEKE

SEQ ID NO: 2147142 - protein, 8 aa, Cryptosporidium hominis
KEMDDESQ

SEQ ID NO: 2147143 - protein, 7 aa, Cryptosporidium hominis
KEMENDE

SEQ ID NO: 2147144 - protein, 9 aa, Cryptosporidium hominis
KEMEQNNDK

SEQ ID NO: 2147145 - protein, 7 aa, Cryptosporidium hominis
KENDQDY

SEQ ID NO: 2147146 - protein, 9 aa, Cryptosporidium hominis
KENDSNDNY

SEQ ID NO: 2147147 - protein, 6 aa, Cryptosporidium hominis
KENEIE

SEQ ID NO: 2147148 - protein, 12 aa, Cryptosporidium hominis
KENELSKREGAV

SEQ ID NO: 2147149 - protein, 10 aa, Cryptosporidium hominis
KENESNEKTN

SEQ ID NO: 2147150 - protein, 5 aa, Cryptosporidium hominis
KENEY

SEQ ID NO: 2147151 - protein, 10 aa, Cryptosporidium hominis
KENGKDTFSE

SEQ ID NO: 2147152 - protein, 9 aa, Cryptosporidium hominis
KENGRVKTK

SEQ ID NO: 2147153 - protein, 8 aa, Cryptosporidium hominis
KENGYSAD

SEQ ID NO: 2147154 - protein, 15 aa, Cryptosporidium hominis
KENKARTEVAPGSNI

SEQ ID NO: 2147155 - protein, 9 aa, Cryptosporidium hominis
KENKSRLEN

SEQ ID NO: 2147156 - protein, 5 aa, Cryptosporidium hominis
KENMN

SEQ ID NO: 2147157 - protein, 5 aa, Cryptosporidium hominis
KENNF

SEQ ID NO: 2147158 - protein, 6 aa, Cryptosporidium hominis
KENNFS

SEQ ID NO: 2147159 - protein, 8 aa, Cryptosporidium hominis
KENNSVAD

SEQ ID NO: 2147160 - protein, 6 aa, Cryptosporidium hominis
KENPIE

SEQ ID NO: 2147161 - protein, 8 aa, Cryptosporidium hominis
KENPNSYA

SEQ ID NO: 2147162 - protein, 8 aa, Cryptosporidium hominis
KENPSNKN

SEQ ID NO: 2147163 - protein, 23 aa, Cryptosporidium hominis
KENQDELEDKESGDSKQNNENID

SEQ ID NO: 2147164 - protein, 5 aa, Cryptosporidium hominis
KENQK

SEQ ID NO: 2147165 - protein, 8 aa, Cryptosporidium hominis
KENQKQRI

SEQ ID NO: 2147166 - protein, 17 aa, Cryptosporidium hominis
KENQPPESGGYKHREND

SEQ ID NO: 2147167 - protein, 7 aa, Cryptosporidium hominis
KENQVDD

SEQ ID NO: 2147168 - protein, 6 aa, Cryptosporidium hominis
KENRLD

SEQ ID NO: 2147169 - protein, 8 aa, Cryptosporidium hominis
KENSDDSR

SEQ ID NO: 2147170 - protein, 5 aa, Cryptosporidium hominis
KENSL

SEQ ID NO: 2147171 - protein, 18 aa, Cryptosporidium hominis
KENSQDAKDCNENDPNEL

SEQ ID NO: 2147172 - protein, 9 aa, Cryptosporidium hominis
KENSQDEIR

SEQ ID NO: 2147173 - protein, 7 aa, Cryptosporidium hominis
KENSRMS

SEQ ID NO: 2147174 - protein, 6 aa, Cryptosporidium hominis
KENTEF

SEQ ID NO: 2147175 - protein, 12 aa, Cryptosporidium hominis
KENTEKSTGQSV

SEQ ID NO: 2147176 - protein, 6 aa, Cryptosporidium hominis
KENTKT

SEQ ID NO: 2147177 - protein, 16 aa, Cryptosporidium hominis
KENVSSKDLNSNQVTN

SEQ ID NO: 2147178 - protein, 7 aa, Cryptosporidium hominis
KENYDEN

SEQ ID NO: 2147179 - protein, 13 aa, Cryptosporidium hominis
KEPCKAINPDEAV

SEQ ID NO: 2147180 - protein, 38 aa, Cryptosporidium hominis
KEPEVHASEESKAKSSENDISSSESTLDDVEKSSDSPF

SEQ ID NO: 2147181 - protein, 7 aa, Cryptosporidium hominis
KEPIESN

SEQ ID NO: 2147182 - protein, 8 aa, Cryptosporidium hominis
KEPKLNSI

SEQ ID NO: 2147183 - protein, 10 aa, Cryptosporidium hominis
KEPMNSNNFQ

SEQ ID NO: 2147184 - protein, 5 aa, Cryptosporidium hominis
KEPNL

SEQ ID NO: 2147185 - protein, 7 aa, Cryptosporidium hominis
KEPPQYL

SEQ ID NO: 2147186 - protein, 8 aa, Cryptosporidium hominis
KEPRKGKI

SEQ ID NO: 2147187 - protein, 7 aa, Cryptosporidium hominis
KEPSPFP

SEQ ID NO: 2147188 - protein, 8 aa, Cryptosporidium hominis
KEQASSNE

SEQ ID NO: 2147189 - protein, 7 aa, Cryptosporidium hominis
KEQDKST

SEQ ID NO: 2147190 - protein, 4 aa, Cryptosporidium hominis
KEQE

SEQ ID NO: 2147191 - protein, 6 aa, Cryptosporidium hominis
KEQEEL

SEQ ID NO: 2147192 - protein, 8 aa, Cryptosporidium hominis
KEQEKSSI

SEQ ID NO: 2147193 - protein, 8 aa, Cryptosporidium hominis
KEQESQNA

SEQ ID NO: 2147194 - protein, 14 aa, Cryptosporidium hominis
KEQETFTNGGVSSQ

SEQ ID NO: 2147195 - protein, 6 aa, Cryptosporidium hominis
KEQISK

SEQ ID NO: 2147196 - protein, 11 aa, Cryptosporidium hominis
KEQKAKGNQFE

SEQ ID NO: 2147197 - protein, 26 aa, Cryptosporidium hominis
KEQKIDTTLSGKQKTECKVKSSSKFT

SEQ ID NO: 2147198 - protein, 8 aa, Cryptosporidium hominis
KEQLISTD

SEQ ID NO: 2147199 - protein, 10 aa, Cryptosporidium hominis
KEQLSKTAFG

SEQ ID NO: 2147200 - protein, 12 aa, Cryptosporidium hominis
KEQNRVKKGRSF

SEQ ID NO: 2147201 - protein, 7 aa, Cryptosporidium hominis
KEQNSSF

SEQ ID NO: 2147202 - protein, 5 aa, Cryptosporidium hominis
KEQRE

SEQ ID NO: 2147203 - protein, 11 aa, Cryptosporidium hominis
KEQSGESGGKY

SEQ ID NO: 2147204 - protein, 9 aa, Cryptosporidium hominis
KEQVNNNTI

SEQ ID NO: 2147205 - protein, 5 aa, Cryptosporidium hominis
KERAS

SEQ ID NO: 2147206 - protein, 6 aa, Cryptosporidium hominis
KEREEE

SEQ ID NO: 2147207 - protein, 9 aa, Cryptosporidium hominis
KEREKELNK

SEQ ID NO: 2147208 - protein, 4 aa, Cryptosporidium hominis
KERG

SEQ ID NO: 2147209 - protein, 9 aa, Cryptosporidium hominis
KERGEDDLA

SEQ ID NO: 2147210 - protein, 11 aa, Cryptosporidium hominis
KERGENVKNQR

SEQ ID NO: 2147211 - protein, 7 aa, Cryptosporidium hominis
KERGVGN

SEQ ID NO: 2147212 - protein, 9 aa, Cryptosporidium hominis
KERIQKHSN

SEQ ID NO: 2147213 - protein, 8 aa, Cryptosporidium hominis
KERKDETL

SEQ ID NO: 2147214 - protein, 11 aa, Cryptosporidium hominis
KERKDGRNSIR

SEQ ID NO: 2147215 - protein, 11 aa, Cryptosporidium hominis
KERKISKQELQ

SEQ ID NO: 2147216 - protein, 5 aa, Cryptosporidium hominis
KERKL

SEQ ID NO: 2147217 - protein, 6 aa, Cryptosporidium hominis
KERKNK

SEQ ID NO: 2147218 - protein, 27 aa, Cryptosporidium hominis
KERKSQASCSTSDPTSPLAYRNGNDNY

SEQ ID NO: 2147219 - protein, 15 aa, Cryptosporidium hominis
KERMETSRLESENYS

SEQ ID NO: 2147220 - protein, 8 aa, Cryptosporidium hominis
KERNESDI

SEQ ID NO: 2147221 - protein, 12 aa, Cryptosporidium hominis
KERNKSEKMEIE

SEQ ID NO: 2147222 - protein, 27 aa, Cryptosporidium hominis
KERQSSQGSVLGSRKSKESELRKKEDY

SEQ ID NO: 2147223 - protein, 6 aa, Cryptosporidium hominis
KERQTS

SEQ ID NO: 2147224 - protein, 8 aa, Cryptosporidium hominis
KERRETSD

SEQ ID NO: 2147225 - protein, 7 aa, Cryptosporidium hominis
KERRNPQ

SEQ ID NO: 2147226 - protein, 15 aa, Cryptosporidium hominis
KERRRLSTQSGIEKR

SEQ ID NO: 2147227 - protein, 8 aa, Cryptosporidium hominis
KERTDYQN

SEQ ID NO: 2147228 - protein, 14 aa, Cryptosporidium hominis
KERVEREKEKKNND

SEQ ID NO: 2147229 - protein, 23 aa, Cryptosporidium hominis
KERVTNEAFNQSNYASTNSNNNI

SEQ ID NO: 2147230 - protein, 8 aa, Cryptosporidium hominis
KERYKGRS

SEQ ID NO: 2147231 - protein, 8 aa, Cryptosporidium hominis
KESEAERF

SEQ ID NO: 2147232 - protein, 25 aa, Cryptosporidium hominis
KESEKKTRMGEESDAQYAANESKVE

SEQ ID NO: 2147233 - protein, 6 aa, Cryptosporidium hominis
KESEKY

SEQ ID NO: 2147234 - protein, 9 aa, Cryptosporidium hominis
KESENSSTK

SEQ ID NO: 2147235 - protein, 8 aa, Cryptosporidium hominis
KESEQVTT

SEQ ID NO: 2147236 - protein, 28 aa, Cryptosporidium hominis
KESERKQLNEQVKDAQQSYQQNKEIQSK

SEQ ID NO: 2147237 - protein, 6 aa, Cryptosporidium hominis
KESESL

SEQ ID NO: 2147238 - protein, 19 aa, Cryptosporidium hominis
KESGHISSDNLKDSNSHHS

SEQ ID NO: 2147239 - protein, 8 aa, Cryptosporidium hominis
KESGHPFN

SEQ ID NO: 2147240 - protein, 7 aa, Cryptosporidium hominis
KESGIQT

SEQ ID NO: 2147241 - protein, 7 aa, Cryptosporidium hominis
KESGNLP

SEQ ID NO: 2147242 - protein, 4 aa, Cryptosporidium hominis
KESI

SEQ ID NO: 2147243 - protein, 7 aa, Cryptosporidium hominis
KESIDSE

SEQ ID NO: 2147244 - protein, 7 aa, Cryptosporidium hominis
KESIESC

SEQ ID NO: 2147245 - protein, 7 aa, Cryptosporidium hominis
KESIGGS

SEQ ID NO: 2147246 - protein, 11 aa, Cryptosporidium hominis
KESINKSSSAL

SEQ ID NO: 2147247 - protein, 34 aa, Cryptosporidium hominis
KESITKKTVEKSEQERKLDEKDDYGEKETRKRIK

SEQ ID NO: 2147248 - protein, 6 aa, Cryptosporidium hominis
KESKNY

SEQ ID NO: 2147249 - protein, 8 aa, Cryptosporidium hominis
KESKTGEL

SEQ ID NO: 2147250 - protein, 6 aa, Cryptosporidium hominis
KESLEE

SEQ ID NO: 2147251 - protein, 8 aa, Cryptosporidium hominis
KESLEKTL

SEQ ID NO: 2147252 - protein, 13 aa, Cryptosporidium hominis
KESLEKVSKEYNE

SEQ ID NO: 2147253 - protein, 15 aa, Cryptosporidium hominis
KESLNSKKRNHEGGS

SEQ ID NO: 2147254 - protein, 13 aa, Cryptosporidium hominis
KESLQSKSSLLSG

SEQ ID NO: 2147255 - protein, 7 aa, Cryptosporidium hominis
KESLREV

SEQ ID NO: 2147256 - protein, 10 aa, Cryptosporidium hominis
KESMEEDETI

SEQ ID NO: 2147257 - protein, 17 aa, Cryptosporidium hominis
KESNGEEKGIPKESSND

SEQ ID NO: 2147258 - protein, 10 aa, Cryptosporidium hominis
KESNIKAKAP

SEQ ID NO: 2147259 - protein, 20 aa, Cryptosporidium hominis
KESNKGAKKLDINDQDTKSM

SEQ ID NO: 2147260 - protein, 7 aa, Cryptosporidium hominis
KESNLAS

SEQ ID NO: 2147261 - protein, 13 aa, Cryptosporidium hominis
KESNSNLEKKNKL

SEQ ID NO: 2147262 - protein, 22 aa, Cryptosporidium hominis
KESNTHKSQSYLSEDESTEIDE

SEQ ID NO: 2147263 - protein, 9 aa, Cryptosporidium hominis
KESPDPKSF

SEQ ID NO: 2147264 - protein, 8 aa, Cryptosporidium hominis
KESPTPDE

SEQ ID NO: 2147265 - protein, 16 aa, Cryptosporidium hominis
KESPVASLKPNSDPFR

SEQ ID NO: 2147266 - protein, 5 aa, Cryptosporidium hominis
KESQL

SEQ ID NO: 2147267 - protein, 8 aa, Cryptosporidium hominis
KESQLTKQ

SEQ ID NO: 2147268 - protein, 42 aa, Cryptosporidium hominis
KESQQNETREKISSNDNNHIEEDSDYEEFKPAARKKISRKED

SEQ ID NO: 2147269 - protein, 18 aa, Cryptosporidium hominis
KESQTKEAEIKEENNQDN

SEQ ID NO: 2147270 - protein, 4 aa, Cryptosporidium hominis
KESR

SEQ ID NO: 2147271 - protein, 8 aa, Cryptosporidium hominis
KESRQCPI

SEQ ID NO: 2147272 - protein, 5 aa, Cryptosporidium hominis
KESRV

SEQ ID NO: 2147273 - protein, 8 aa, Cryptosporidium hominis
KESSESEM

SEQ ID NO: 2147274 - protein, 8 aa, Cryptosporidium hominis
KESSFNTK

SEQ ID NO: 2147275 - protein, 5 aa, Cryptosporidium hominis
KESSK

SEQ ID NO: 2147276 - protein, 7 aa, Cryptosporidium hominis
KESSTLG

SEQ ID NO: 2147277 - protein, 6 aa, Cryptosporidium hominis
KESTKS

SEQ ID NO: 2147278 - protein, 10 aa, Cryptosporidium hominis
KESTLQSPLS

SEQ ID NO: 2147279 - protein, 47 aa, Cryptosporidium hominis
KESTSVPPPAPPAPPAPPAPPAPSAPPAPPSPPTLSKSEAQESPSVL

SEQ ID NO: 2147280 - protein, 6 aa, Cryptosporidium hominis
KESVAG

SEQ ID NO: 2147281 - protein, 7 aa, Cryptosporidium hominis
KESVNRR

SEQ ID NO: 2147282 - protein, 5 aa, Cryptosporidium hominis
KESYN

SEQ ID NO: 2147283 - protein, 8 aa, Cryptosporidium hominis
KETDEVKY

SEQ ID NO: 2147284 - protein, 6 aa, Cryptosporidium hominis
KETDTI

SEQ ID NO: 2147285 - protein, 6 aa, Cryptosporidium hominis
KETEDS

SEQ ID NO: 2147286 - protein, 6 aa, Cryptosporidium hominis
KETEER

SEQ ID NO: 2147287 - protein, 10 aa, Cryptosporidium hominis
KETEGPSTRE

SEQ ID NO: 2147288 - protein, 7 aa, Cryptosporidium hominis
KETEPNE

SEQ ID NO: 2147289 - protein, 8 aa, Cryptosporidium hominis
KETERRKL

SEQ ID NO: 2147290 - protein, 6 aa, Cryptosporidium hominis
KETGAI

SEQ ID NO: 2147291 - protein, 13 aa, Cryptosporidium hominis
KETGDGETHSRQN

SEQ ID NO: 2147292 - protein, 14 aa, Cryptosporidium hominis
KETHPTSNKSNNVY

SEQ ID NO: 2147293 - protein, 9 aa, Cryptosporidium hominis
KETHTGTVY

SEQ ID NO: 2147294 - protein, 4 aa, Cryptosporidium hominis
KETK

SEQ ID NO: 2147295 - protein, 10 aa, Cryptosporidium hominis
KETKPPPILS

SEQ ID NO: 2147296 - protein, 9 aa, Cryptosporidium hominis
KETNEPKEE

SEQ ID NO: 2147297 - protein, 8 aa, Cryptosporidium hominis
KETNIDGE

SEQ ID NO: 2147298 - protein, 12 aa, Cryptosporidium hominis
KETNKDGITKSE

SEQ ID NO: 2147299 - protein, 7 aa, Cryptosporidium hominis
KETNRIN

SEQ ID NO: 2147300 - protein, 7 aa, Cryptosporidium hominis
KETNSDI

SEQ ID NO: 2147301 - protein, 7 aa, Cryptosporidium hominis
KETNTNN

SEQ ID NO: 2147302 - protein, 7 aa, Cryptosporidium hominis
KETRSRN

SEQ ID NO: 2147303 - protein, 9 aa, Cryptosporidium hominis
KETSVDGGS

SEQ ID NO: 2147304 - protein, 5 aa, Cryptosporidium hominis
KETTE

SEQ ID NO: 2147305 - protein, 9 aa, Cryptosporidium hominis
KETVTGTGT

SEQ ID NO: 2147306 - protein, 36 aa, Cryptosporidium hominis
KEVAGNKSYSSSPLLDNSSQNLSESSNFNSSETDNL

SEQ ID NO: 2147307 - protein, 9 aa, Cryptosporidium hominis
KEVDEDSVE

SEQ ID NO: 2147308 - protein, 4 aa, Cryptosporidium hominis
KEVG

SEQ ID NO: 2147309 - protein, 9 aa, Cryptosporidium hominis
KEVNDRQKS

SEQ ID NO: 2147310 - protein, 14 aa, Cryptosporidium hominis
KEVNEKKKNELTAE

SEQ ID NO: 2147311 - protein, 12 aa, Cryptosporidium hominis
KEVNPNTKAIPP

SEQ ID NO: 2147312 - protein, 23 aa, Cryptosporidium hominis
KEVQSQTEKQDEEEISTKQNESH

SEQ ID NO: 2147313 - protein, 9 aa, Cryptosporidium hominis
KEVSDTNSN

SEQ ID NO: 2147314 - protein, 9 aa, Cryptosporidium hominis
KEWDGDNER

SEQ ID NO: 2147315 - protein, 6 aa, Cryptosporidium hominis
KEWGGS

SEQ ID NO: 2147316 - protein, 65 aa, Cryptosporidium hominis
KEWNRSKSRSVSRSRHSSRSKHISESQNKYKSKSNPRTRSYSCSDEEYISNSNTKTSRNRSQYYR

SEQ ID NO: 2147317 - protein, 4 aa, Cryptosporidium hominis
KEYE

SEQ ID NO: 2147318 - protein, 10 aa, Cryptosporidium hominis
KEYEGPRDTW

SEQ ID NO: 2147319 - protein, 4 aa, Cryptosporidium hominis
KEYG

SEQ ID NO: 2147320 - protein, 8 aa, Cryptosporidium hominis
KEYGKNKV

SEQ ID NO: 2147321 - protein, 6 aa, Cryptosporidium hominis
KEYKQI

SEQ ID NO: 2147322 - protein, 13 aa, Cryptosporidium hominis
KEYNEAKSKLNEI

SEQ ID NO: 2147323 - protein, 7 aa, Cryptosporidium hominis
KEYNNSV

SEQ ID NO: 2147324 - protein, 4 aa, Cryptosporidium hominis
KEYP

SEQ ID NO: 2147325 - protein, 4 aa, Cryptosporidium hominis
KEYQ

SEQ ID NO: 2147326 - protein, 7 aa, Cryptosporidium hominis
KEYRSKD

SEQ ID NO: 2147327 - protein, 10 aa, Cryptosporidium hominis
KEYSGANGGY

SEQ ID NO: 2147328 - protein, 6 aa, Cryptosporidium hominis
KEYSGT

SEQ ID NO: 2147329 - protein, 7 aa, Cryptosporidium hominis
KFATQEH

SEQ ID NO: 2147330 - protein, 18 aa, Cryptosporidium hominis
KFDSGETERKSSDIYTRT

SEQ ID NO: 2147331 - protein, 5 aa, Cryptosporidium hominis
KFEDN

SEQ ID NO: 2147332 - protein, 7 aa, Cryptosporidium hominis
KFEEKDD

SEQ ID NO: 2147333 - protein, 8 aa, Cryptosporidium hominis
KFESSRNE

SEQ ID NO: 2147334 - protein, 15 aa, Cryptosporidium hominis
KFETGDVVSIICDGD

SEQ ID NO: 2147335 - protein, 5 aa, Cryptosporidium hominis
KFGGD

SEQ ID NO: 2147336 - protein, 5 aa, Cryptosporidium hominis
KFGGN

SEQ ID NO: 2147337 - protein, 8 aa, Cryptosporidium hominis
KFGNEEVA

SEQ ID NO: 2147338 - protein, 20 aa, Cryptosporidium hominis
KFGPPTTPKDLAKNNHGQNN

SEQ ID NO: 2147339 - protein, 13 aa, Cryptosporidium hominis
KFGSDSIDKPFEG

SEQ ID NO: 2147340 - protein, 8 aa, Cryptosporidium hominis
KFKKDDSR

SEQ ID NO: 2147341 - protein, 7 aa, Cryptosporidium hominis
KFKSEDN

SEQ ID NO: 2147342 - protein, 11 aa, Cryptosporidium hominis
KFKTKEYIENK

SEQ ID NO: 2147343 - protein, 19 aa, Cryptosporidium hominis
KFKTRERKSNLSSESAGID

SEQ ID NO: 2147344 - protein, 10 aa, Cryptosporidium hominis
KFNDTSNPYE

SEQ ID NO: 2147345 - protein, 5 aa, Cryptosporidium hominis
KFNEN

SEQ ID NO: 2147346 - protein, 7 aa, Cryptosporidium hominis
KFNESLE

SEQ ID NO: 2147347 - protein, 6 aa, Cryptosporidium hominis
KFNSTD

SEQ ID NO: 2147348 - protein, 7 aa, Cryptosporidium hominis
KFPDNND

SEQ ID NO: 2147349 - protein, 5 aa, Cryptosporidium hominis
KFPGR

SEQ ID NO: 2147350 - protein, 9 aa, Cryptosporidium hominis
KFPPLPNSN

SEQ ID NO: 2147351 - protein, 7 aa, Cryptosporidium hominis
KFPPPIP

SEQ ID NO: 2147352 - protein, 7 aa, Cryptosporidium hominis
KFPRKSS

SEQ ID NO: 2147353 - protein, 5 aa, Cryptosporidium hominis
KFPTT

SEQ ID NO: 2147354 - protein, 10 aa, Cryptosporidium hominis
KFQAKTRNVA

SEQ ID NO: 2147355 - protein, 18 aa, Cryptosporidium hominis
KFQDGGYESTSKPDNGYY

SEQ ID NO: 2147356 - protein, 11 aa, Cryptosporidium hominis
KFQESDSNGKE

SEQ ID NO: 2147357 - protein, 5 aa, Cryptosporidium hominis
KFQTS

SEQ ID NO: 2147358 - protein, 6 aa, Cryptosporidium hominis
KFRPRK

SEQ ID NO: 2147359 - protein, 20 aa, Cryptosporidium hominis
KFSASNPYGVRDKNDNRQFV

SEQ ID NO: 2147360 - protein, 11 aa, Cryptosporidium hominis
KFSASRKTGAF

SEQ ID NO: 2147361 - protein, 14 aa, Cryptosporidium hominis
KFSEENNQNNEEVN

SEQ ID NO: 2147362 - protein, 5 aa, Cryptosporidium hominis
KFSKN

SEQ ID NO: 2147363 - protein, 8 aa, Cryptosporidium hominis
KFSKSDNL

SEQ ID NO: 2147364 - protein, 17 aa, Cryptosporidium hominis
KFSKSGNSGALLGQTSG

SEQ ID NO: 2147365 - protein, 4 aa, Cryptosporidium hominis
KFSN

SEQ ID NO: 2147366 - protein, 6 aa, Cryptosporidium hominis
KFSPAN

SEQ ID NO: 2147367 - protein, 10 aa, Cryptosporidium hominis
KFSPASPQKM

SEQ ID NO: 2147368 - protein, 5 aa, Cryptosporidium hominis
KFSPQ

SEQ ID NO: 2147369 - protein, 10 aa, Cryptosporidium hominis
KFSQNSSFEG

SEQ ID NO: 2147370 - protein, 12 aa, Cryptosporidium hominis
KFSSEISNSSDA

SEQ ID NO: 2147371 - protein, 53 aa, Cryptosporidium hominis
KFSSNSSKEKPWEGRSSGGGGSSGNNGSRGSKNSYRESRSLAERGGWERRSNR

SEQ ID NO: 2147372 - protein, 8 aa, Cryptosporidium hominis
KFSSSERD

SEQ ID NO: 2147373 - protein, 7 aa, Cryptosporidium hominis
KFSTRSF

SEQ ID NO: 2147374 - protein, 12 aa, Cryptosporidium hominis
KFTEASKNISNK

SEQ ID NO: 2147375 - protein, 6 aa, Cryptosporidium hominis
KFTESK

SEQ ID NO: 2147376 - protein, 5 aa, Cryptosporidium hominis
KFTKD

SEQ ID NO: 2147377 - protein, 5 aa, Cryptosporidium hominis
KFTKT

SEQ ID NO: 2147378 - protein, 6 aa, Cryptosporidium hominis
KFTNDR

SEQ ID NO: 2147379 - protein, 8 aa, Cryptosporidium hominis
KFTNSTSS

SEQ ID NO: 2147380 - protein, 4 aa, Cryptosporidium hominis
KFTR

SEQ ID NO: 2147381 - protein, 22 aa, Cryptosporidium hominis
KFYGSPELDNTDLEDGNNSELD

SEQ ID NO: 2147382 - protein, 5 aa, Cryptosporidium hominis
KGADD

SEQ ID NO: 2147383 - protein, 6 aa, Cryptosporidium hominis
KGADIP

SEQ ID NO: 2147384 - protein, 14 aa, Cryptosporidium hominis
KGADSSSQNDGYFK

SEQ ID NO: 2147385 - protein, 8 aa, Cryptosporidium hominis
KGAECPKC

SEQ ID NO: 2147386 - protein, 8 aa, Cryptosporidium hominis
KGAIPDWS

SEQ ID NO: 2147387 - protein, 9 aa, Cryptosporidium hominis
KGANSPCSH

SEQ ID NO: 2147388 - protein, 9 aa, Cryptosporidium hominis
KGAQEYRQA

SEQ ID NO: 2147389 - protein, 52 aa, Cryptosporidium hominis
KGASQKAAESQQNKQNNTSNESNTNTDPAASATTSNIQTQSGNSDPSIDSRA

SEQ ID NO: 2147390 - protein, 17 aa, Cryptosporidium hominis
KGASSSTKKVTKSEVAK

SEQ ID NO: 2147391 - protein, 7 aa, Cryptosporidium hominis
KGATDGG

SEQ ID NO: 2147392 - protein, 10 aa, Cryptosporidium hominis
KGATGDPNIS

SEQ ID NO: 2147393 - protein, 11 aa, Cryptosporidium hominis
KGDASNVPAAQ

SEQ ID NO: 2147394 - protein, 8 aa, Cryptosporidium hominis
KGDDNTIG

SEQ ID NO: 2147395 - protein, 10 aa, Cryptosporidium hominis
KGDDSGMDHS

SEQ ID NO: 2147396 - protein, 8 aa, Cryptosporidium hominis
KGDEPLVQ

SEQ ID NO: 2147397 - protein, 7 aa, Cryptosporidium hominis
KGDEYEF

SEQ ID NO: 2147398 - protein, 5 aa, Cryptosporidium hominis
KGDGN

SEQ ID NO: 2147399 - protein, 8 aa, Cryptosporidium hominis
KGDISESG

SEQ ID NO: 2147400 - protein, 7 aa, Cryptosporidium hominis
KGDNANS

SEQ ID NO: 2147401 - protein, 5 aa, Cryptosporidium hominis
KGDPD

SEQ ID NO: 2147402 - protein, 6 aa, Cryptosporidium hominis
KGDPDT

SEQ ID NO: 2147403 - protein, 7 aa, Cryptosporidium hominis
KGDPETC

SEQ ID NO: 2147404 - protein, 8 aa, Cryptosporidium hominis
KGDSFKSK

SEQ ID NO: 2147405 - protein, 10 aa, Cryptosporidium hominis
KGDSSNDPMG

SEQ ID NO: 2147406 - protein, 5 aa, Cryptosporidium hominis
KGDSV

SEQ ID NO: 2147407 - protein, 5 aa, Cryptosporidium hominis
KGDTA

SEQ ID NO: 2147408 - protein, 5 aa, Cryptosporidium hominis
KGDTN

SEQ ID NO: 2147409 - protein, 4 aa, Cryptosporidium hominis
KGDV

SEQ ID NO: 2147410 - protein, 9 aa, Cryptosporidium hominis
KGDVQGSEN

SEQ ID NO: 2147411 - protein, 8 aa, Cryptosporidium hominis
KGEANDPL

SEQ ID NO: 2147412 - protein, 5 aa, Cryptosporidium hominis
KGEES

SEQ ID NO: 2147413 - protein, 8 aa, Cryptosporidium hominis
KGEESPDV

SEQ ID NO: 2147414 - protein, 22 aa, Cryptosporidium hominis
KGEFEKNEAKKDKTKEKYSPLF

SEQ ID NO: 2147415 - protein, 34 aa, Cryptosporidium hominis
KGEGDKNDEQSNFTSNDLNGNTSIVSKEDGSSGF

SEQ ID NO: 2147416 - protein, 8 aa, Cryptosporidium hominis
KGEGELEN

SEQ ID NO: 2147417 - protein, 7 aa, Cryptosporidium hominis
KGEGGIS

SEQ ID NO: 2147418 - protein, 6 aa, Cryptosporidium hominis
KGEGKI

SEQ ID NO: 2147419 - protein, 6 aa, Cryptosporidium hominis
KGEGKS

SEQ ID NO: 2147420 - protein, 13 aa, Cryptosporidium hominis
KGEGSSSSPPLLS

SEQ ID NO: 2147421 - protein, 14 aa, Cryptosporidium hominis
KGEKIKSSVKLFYE

SEQ ID NO: 2147422 - protein, 5 aa, Cryptosporidium hominis
KGELM

SEQ ID NO: 2147423 - protein, 6 aa, Cryptosporidium hominis
KGELRG

SEQ ID NO: 2147424 - protein, 4 aa, Cryptosporidium hominis
KGEM

SEQ ID NO: 2147425 - protein, 4 aa, Cryptosporidium hominis
KGEN

SEQ ID NO: 2147426 - protein, 29 aa, Cryptosporidium hominis
KGENDPKKKLTLEERNYDYSSAGPEADRG

SEQ ID NO: 2147427 - protein, 8 aa, Cryptosporidium hominis
KGESERRT

SEQ ID NO: 2147428 - protein, 8 aa, Cryptosporidium hominis
KGESSQRD

SEQ ID NO: 2147429 - protein, 8 aa, Cryptosporidium hominis
KGETKKDK

SEQ ID NO: 2147430 - protein, 4 aa, Cryptosporidium hominis
KGEV

SEQ ID NO: 2147431 - protein, 6 aa, Cryptosporidium hominis
KGEVIG

SEQ ID NO: 2147432 - protein, 8 aa, Cryptosporidium hominis
KGEYDEKS

SEQ ID NO: 2147433 - protein, 6 aa, Cryptosporidium hominis
KGEYDN

SEQ ID NO: 2147434 - protein, 8 aa, Cryptosporidium hominis
KGEYNKKI

SEQ ID NO: 2147435 - protein, 6 aa, Cryptosporidium hominis
KGFEEG

SEQ ID NO: 2147436 - protein, 17 aa, Cryptosporidium hominis
KGFSSQNGRGTGETSGG

SEQ ID NO: 2147437 - protein, 5 aa, Cryptosporidium hominis
KGFTD

SEQ ID NO: 2147438 - protein, 7 aa, Cryptosporidium hominis
KGFTDKS

SEQ ID NO: 2147439 - protein, 13 aa, Cryptosporidium hominis
KGFTGDSEENLEN

SEQ ID NO: 2147440 - protein, 5 aa, Cryptosporidium hominis
KGGAR

SEQ ID NO: 2147441 - protein, 8 aa, Cryptosporidium hominis
KGGDYQKI

SEQ ID NO: 2147442 - protein, 6 aa, Cryptosporidium hominis
KGGGNL

SEQ ID NO: 2147443 - protein, 4 aa, Cryptosporidium hominis
KGGI

SEQ ID NO: 2147444 - protein, 7 aa, Cryptosporidium hominis
KGGISSA

SEQ ID NO: 2147445 - protein, 15 aa, Cryptosporidium hominis
KGGKTVDEVEDQCGD

SEQ ID NO: 2147446 - protein, 9 aa, Cryptosporidium hominis
KGGRNSQKC

SEQ ID NO: 2147447 - protein, 25 aa, Cryptosporidium hominis
KGGSRPKGISKEQDLNQARRKGEEI

SEQ ID NO: 2147448 - protein, 21 aa, Cryptosporidium hominis
KGGVDNNGQDSISSSSSIPGF

SEQ ID NO: 2147449 - protein, 20 aa, Cryptosporidium hominis
KGGYDDFDNRRSKNSGKKEI

SEQ ID NO: 2147450 - protein, 4 aa, Cryptosporidium hominis
KGHS

SEQ ID NO: 2147451 - protein, 8 aa, Cryptosporidium hominis
KGIDPKKI

SEQ ID NO: 2147452 - protein, 20 aa, Cryptosporidium hominis
KGIEEDEKIQTNSNTKGGIQ

SEQ ID NO: 2147453 - protein, 32 aa, Cryptosporidium hominis
KGIEYSRSNSISPDRISSNGSRRYPNPNFEKN

SEQ ID NO: 2147454 - protein, 8 aa, Cryptosporidium hominis
KGIGPDSN

SEQ ID NO: 2147455 - protein, 6 aa, Cryptosporidium hominis
KGIGPH

SEQ ID NO: 2147456 - protein, 7 aa, Cryptosporidium hominis
KGINSQS

SEQ ID NO: 2147457 - protein, 25 aa, Cryptosporidium hominis
KGIPKDCKGEDKNDNLDKKNKERNK

SEQ ID NO: 2147458 - protein, 4 aa, Cryptosporidium hominis
KGIT

SEQ ID NO: 2147459 - protein, 17 aa, Cryptosporidium hominis
KGKEGRFRGNLSGKRVD

SEQ ID NO: 2147460 - protein, 6 aa, Cryptosporidium hominis
KGKEKY

SEQ ID NO: 2147461 - protein, 7 aa, Cryptosporidium hominis
KGKGEQR

SEQ ID NO: 2147462 - protein, 5 aa, Cryptosporidium hominis
KGKGY

SEQ ID NO: 2147463 - protein, 7 aa, Cryptosporidium hominis
KGKGYKG

SEQ ID NO: 2147464 - protein, 5 aa, Cryptosporidium hominis
KGKHI

SEQ ID NO: 2147465 - protein, 16 aa, Cryptosporidium hominis
KGKHSNIRKDGQLDNF

SEQ ID NO: 2147466 - protein, 8 aa, Cryptosporidium hominis
KGKIPPRQ

SEQ ID NO: 2147467 - protein, 15 aa, Cryptosporidium hominis
KGKMSGDCSESTNSL

SEQ ID NO: 2147468 - protein, 10 aa, Cryptosporidium hominis
KGKNGDHAAM

SEQ ID NO: 2147469 - protein, 8 aa, Cryptosporidium hominis
KGKNMQED

SEQ ID NO: 2147470 - protein, 11 aa, Cryptosporidium hominis
KGKNNGYNNMN

SEQ ID NO: 2147471 - protein, 10 aa, Cryptosporidium hominis
KGKNRDEPFG

SEQ ID NO: 2147472 - protein, 8 aa, Cryptosporidium hominis
KGKRLPRG

SEQ ID NO: 2147473 - protein, 12 aa, Cryptosporidium hominis
KGKRNSKLEGGH

SEQ ID NO: 2147474 - protein, 20 aa, Cryptosporidium hominis
KGKSDTNNSKIDTDNMDENE

SEQ ID NO: 2147475 - protein, 14 aa, Cryptosporidium hominis
KGKSSYIDKNNNRS

SEQ ID NO: 2147476 - protein, 36 aa, Cryptosporidium hominis
KGKSVDSRKKLSTASNESENTGSAKVTTGSNSMSNK

SEQ ID NO: 2147477 - protein, 7 aa, Cryptosporidium hominis
KGKTGQF

SEQ ID NO: 2147478 - protein, 9 aa, Cryptosporidium hominis
KGKVEKGTI

SEQ ID NO: 2147479 - protein, 11 aa, Cryptosporidium hominis
KGKWTKEEEQE

SEQ ID NO: 2147480 - protein, 7 aa, Cryptosporidium hominis
KGKYGSV

SEQ ID NO: 2147481 - protein, 24 aa, Cryptosporidium hominis
KGLHNKRKKQVNAQKNQEQTSKQF

SEQ ID NO: 2147482 - protein, 6 aa, Cryptosporidium hominis
KGLKSF

SEQ ID NO: 2147483 - protein, 13 aa, Cryptosporidium hominis
KGLPKSRRKETEI

SEQ ID NO: 2147484 - protein, 7 aa, Cryptosporidium hominis
KGLQHDR

SEQ ID NO: 2147485 - protein, 6 aa, Cryptosporidium hominis
KGLRGE

SEQ ID NO: 2147486 - protein, 5 aa, Cryptosporidium hominis
KGLSI

SEQ ID NO: 2147487 - protein, 10 aa, Cryptosporidium hominis
KGLSNSTLRQ

SEQ ID NO: 2147488 - protein, 12 aa, Cryptosporidium hominis
KGLSQSSNHHSL

SEQ ID NO: 2147489 - protein, 4 aa, Cryptosporidium hominis
KGLT

SEQ ID NO: 2147490 - protein, 14 aa, Cryptosporidium hominis
KGLTRKRKKIEGNA

SEQ ID NO: 2147491 - protein, 13 aa, Cryptosporidium hominis
KGMQSKGNQINNG

SEQ ID NO: 2147492 - protein, 9 aa, Cryptosporidium hominis
KGNCPSSKG

SEQ ID NO: 2147493 - protein, 11 aa, Cryptosporidium hominis
KGNDNGDTKEM

SEQ ID NO: 2147494 - protein, 4 aa, Cryptosporidium hominis
KGNG

SEQ ID NO: 2147495 - protein, 12 aa, Cryptosporidium hominis
KGNGENETLGSG

SEQ ID NO: 2147496 - protein, 6 aa, Cryptosporidium hominis
KGNGPC

SEQ ID NO: 2147497 - protein, 31 aa, Cryptosporidium hominis
KGNGRGGGTYRGNRFSRGNKTKSGSIYRDQN

SEQ ID NO: 2147498 - protein, 13 aa, Cryptosporidium hominis
KGNHKTLSEGDQN

SEQ ID NO: 2147499 - protein, 4 aa, Cryptosporidium hominis
KGNI

SEQ ID NO: 2147500 - protein, 8 aa, Cryptosporidium hominis
KGNITRDL

SEQ ID NO: 2147501 - protein, 5 aa, Cryptosporidium hominis
KGNKS

SEQ ID NO: 2147502 - protein, 9 aa, Cryptosporidium hominis
KGNNNNKVL

SEQ ID NO: 2147503 - protein, 8 aa, Cryptosporidium hominis
KGNNSNQM

SEQ ID NO: 2147504 - protein, 8 aa, Cryptosporidium hominis
KGNNVNNS

SEQ ID NO: 2147505 - protein, 5 aa, Cryptosporidium hominis
KGNQQ

SEQ ID NO: 2147506 - protein, 11 aa, Cryptosporidium hominis
KGNSAGAMGQP

SEQ ID NO: 2147507 - protein, 13 aa, Cryptosporidium hominis
KGNSCSSTNKDSW

SEQ ID NO: 2147508 - protein, 7 aa, Cryptosporidium hominis
KGNSRRN

SEQ ID NO: 2147509 - protein, 10 aa, Cryptosporidium hominis
KGNTNSKTSS

SEQ ID NO: 2147510 - protein, 4 aa, Cryptosporidium hominis
KGNV

SEQ ID NO: 2147511 - protein, 4 aa, Cryptosporidium hominis
KGNY

SEQ ID NO: 2147512 - protein, 6 aa, Cryptosporidium hominis
KGNYKK

SEQ ID NO: 2147513 - protein, 11 aa, Cryptosporidium hominis
KGNYKKGKGDI

SEQ ID NO: 2147514 - protein, 6 aa, Cryptosporidium hominis
KGPEEL

SEQ ID NO: 2147515 - protein, 5 aa, Cryptosporidium hominis
KGPGF

SEQ ID NO: 2147516 - protein, 4 aa, Cryptosporidium hominis
KGPM

SEQ ID NO: 2147517 - protein, 6 aa, Cryptosporidium hominis
KGPPIF

SEQ ID NO: 2147518 - protein, 6 aa, Cryptosporidium hominis
KGPVRG

SEQ ID NO: 2147519 - protein, 5 aa, Cryptosporidium hominis
KGQDS

SEQ ID NO: 2147520 - protein, 7 aa, Cryptosporidium hominis
KGQEKEV

SEQ ID NO: 2147521 - protein, 10 aa, Cryptosporidium hominis
KGQESDDECK

SEQ ID NO: 2147522 - protein, 8 aa, Cryptosporidium hominis
KGQESEIN

SEQ ID NO: 2147523 - protein, 22 aa, Cryptosporidium hominis
KGQLSNPISNASSLNNNRTNTI

SEQ ID NO: 2147524 - protein, 5 aa, Cryptosporidium hominis
KGQLT

SEQ ID NO: 2147525 - protein, 7 aa, Cryptosporidium hominis
KGQMNQN

SEQ ID NO: 2147526 - protein, 7 aa, Cryptosporidium hominis
KGQNIES

SEQ ID NO: 2147527 - protein, 13 aa, Cryptosporidium hominis
KGQNNNHVNESEK

SEQ ID NO: 2147528 - protein, 5 aa, Cryptosporidium hominis
KGQPF

SEQ ID NO: 2147529 - protein, 10 aa, Cryptosporidium hominis
KGQVANSDDL

SEQ ID NO: 2147530 - protein, 16 aa, Cryptosporidium hominis
KGRASTGMQQDPAISS

SEQ ID NO: 2147531 - protein, 17 aa, Cryptosporidium hominis
KGRESTTSSKSEDSRNA

SEQ ID NO: 2147532 - protein, 12 aa, Cryptosporidium hominis
KGRETKVNTSTF

SEQ ID NO: 2147533 - protein, 4 aa, Cryptosporidium hominis
KGRG

SEQ ID NO: 2147534 - protein, 6 aa, Cryptosporidium hominis
KGRMSK

SEQ ID NO: 2147535 - protein, 7 aa, Cryptosporidium hominis
KGRSTQV

SEQ ID NO: 2147536 - protein, 5 aa, Cryptosporidium hominis
KGSDG

SEQ ID NO: 2147537 - protein, 13 aa, Cryptosporidium hominis
KGSDTKYKTEESR

SEQ ID NO: 2147538 - protein, 6 aa, Cryptosporidium hominis
KGSEEI

SEQ ID NO: 2147539 - protein, 10 aa, Cryptosporidium hominis
KGSGSGSKKG

SEQ ID NO: 2147540 - protein, 20 aa, Cryptosporidium hominis
KGSKIESDYSRKNENITPEA

SEQ ID NO: 2147541 - protein, 9 aa, Cryptosporidium hominis
KGSKNNNEF

SEQ ID NO: 2147542 - protein, 8 aa, Cryptosporidium hominis
KGSKSQTE

SEQ ID NO: 2147543 - protein, 37 aa, Cryptosporidium hominis
KGSLRPSPNTQVRDRNQSISKEPRSSLQYSASATDLS

SEQ ID NO: 2147544 - protein, 7 aa, Cryptosporidium hominis
KGSNDDL

SEQ ID NO: 2147545 - protein, 8 aa, Cryptosporidium hominis
KGSNKGTK

SEQ ID NO: 2147546 - protein, 7 aa, Cryptosporidium hominis
KGSPHSI

SEQ ID NO: 2147547 - protein, 10 aa, Cryptosporidium hominis
KGSQKPKNLS

SEQ ID NO: 2147548 - protein, 6 aa, Cryptosporidium hominis
KGSRIN

SEQ ID NO: 2147549 - protein, 4 aa, Cryptosporidium hominis
KGSS

SEQ ID NO: 2147550 - protein, 20 aa, Cryptosporidium hominis
KGSSHIKNKQKIDGQENYKM

SEQ ID NO: 2147551 - protein, 27 aa, Cryptosporidium hominis
KGSSRNERRENISDSIKDDNDKGNDKV

SEQ ID NO: 2147552 - protein, 9 aa, Cryptosporidium hominis
KGSTENARK

SEQ ID NO: 2147553 - protein, 17 aa, Cryptosporidium hominis
KGTAQKKKARLSIDEDP

SEQ ID NO: 2147554 - protein, 7 aa, Cryptosporidium hominis
KGTGVSH

SEQ ID NO: 2147555 - protein, 6 aa, Cryptosporidium hominis
KGTGVV

SEQ ID NO: 2147556 - protein, 8 aa, Cryptosporidium hominis
KGTHTGEE

SEQ ID NO: 2147557 - protein, 6 aa, Cryptosporidium hominis
KGTLVD

SEQ ID NO: 2147558 - protein, 8 aa, Cryptosporidium hominis
KGTPKYGE

SEQ ID NO: 2147559 - protein, 6 aa, Cryptosporidium hominis
KGTRAY

SEQ ID NO: 2147560 - protein, 9 aa, Cryptosporidium hominis
KGTSPKLEL

SEQ ID NO: 2147561 - protein, 12 aa, Cryptosporidium hominis
KGTTLSSEDVNG

SEQ ID NO: 2147562 - protein, 7 aa, Cryptosporidium hominis
KGVSNGT

SEQ ID NO: 2147563 - protein, 11 aa, Cryptosporidium hominis
KGVSQRGYNSS

SEQ ID NO: 2147564 - protein, 11 aa, Cryptosporidium hominis
KGYDNTAINNS

SEQ ID NO: 2147565 - protein, 7 aa, Cryptosporidium hominis
KGYGKDA

SEQ ID NO: 2147566 - protein, 7 aa, Cryptosporidium hominis
KGYPDDT

SEQ ID NO: 2147567 - protein, 7 aa, Cryptosporidium hominis
KGYQSEK

SEQ ID NO: 2147568 - protein, 6 aa, Cryptosporidium hominis
KGYRTG

SEQ ID NO: 2147569 - protein, 4 aa, Cryptosporidium hominis
KGYS

SEQ ID NO: 2147570 - protein, 7 aa, Cryptosporidium hominis
KGYSDQS

SEQ ID NO: 2147571 - protein, 10 aa, Cryptosporidium hominis
KGYSGKNETF

SEQ ID NO: 2147572 - protein, 6 aa, Cryptosporidium hominis
KGYTES

SEQ ID NO: 2147573 - protein, 18 aa, Cryptosporidium hominis
KHCQEADESNLDSRNISS

SEQ ID NO: 2147574 - protein, 15 aa, Cryptosporidium hominis
KHDALRKDDLTDEDY

SEQ ID NO: 2147575 - protein, 12 aa, Cryptosporidium hominis
KHDGSDIAGFGA

SEQ ID NO: 2147576 - protein, 8 aa, Cryptosporidium hominis
KHDNAKKL

SEQ ID NO: 2147577 - protein, 6 aa, Cryptosporidium hominis
KHDRSS

SEQ ID NO: 2147578 - protein, 7 aa, Cryptosporidium hominis
KHDSGSL

SEQ ID NO: 2147579 - protein, 5 aa, Cryptosporidium hominis
KHDTG

SEQ ID NO: 2147580 - protein, 10 aa, Cryptosporidium hominis
KHEAKKTVKK

SEQ ID NO: 2147581 - protein, 4 aa, Cryptosporidium hominis
KHED

SEQ ID NO: 2147582 - protein, 20 aa, Cryptosporidium hominis
KHEEVKKTNSEYKRAEKTLT

SEQ ID NO: 2147583 - protein, 5 aa, Cryptosporidium hominis
KHENQ

SEQ ID NO: 2147584 - protein, 30 aa, Cryptosporidium hominis
KHENSNDHDNINSSSFSSSSSSSSSSSAVS

SEQ ID NO: 2147585 - protein, 7 aa, Cryptosporidium hominis
KHGEEID

SEQ ID NO: 2147586 - protein, 14 aa, Cryptosporidium hominis
KHGNDRSGNSPEKF

SEQ ID NO: 2147587 - protein, 8 aa, Cryptosporidium hominis
KHGNPNLR

SEQ ID NO: 2147588 - protein, 4 aa, Cryptosporidium hominis
KHGP

SEQ ID NO: 2147589 - protein, 6 aa, Cryptosporidium hominis
KHGRKG

SEQ ID NO: 2147590 - protein, 5 aa, Cryptosporidium hominis
KHGSA

SEQ ID NO: 2147591 - protein, 6 aa, Cryptosporidium hominis
KHHKNG

SEQ ID NO: 2147592 - protein, 30 aa, Cryptosporidium hominis
KHHSSKGNSGSKKSREYRKTKALIDNIKND

SEQ ID NO: 2147593 - protein, 81 aa, Cryptosporidium hominis
KHKPGNSGQKARLKSSPSSSSSSSPRSSSSSSSSPRSSSSSSSSPRSSSSSSSRSRSRSGSRSGFKSESRTKSRSASEPRI

SEQ ID NO: 2147594 - protein, 7 aa, Cryptosporidium hominis
KHKQGES

SEQ ID NO: 2147595 - protein, 5 aa, Cryptosporidium hominis
KHKQI

SEQ ID NO: 2147596 - protein, 7 aa, Cryptosporidium hominis
KHKQNSL

SEQ ID NO: 2147597 - protein, 31 aa, Cryptosporidium hominis
KHKQSSNANQNESKFSATIPAASTIGENVSS

SEQ ID NO: 2147598 - protein, 9 aa, Cryptosporidium hominis
KHKTGSKNY

SEQ ID NO: 2147599 - protein, 8 aa, Cryptosporidium hominis
KHKTKGEI

SEQ ID NO: 2147600 - protein, 16 aa, Cryptosporidium hominis
KHLERPPSVDDYPDEN

SEQ ID NO: 2147601 - protein, 14 aa, Cryptosporidium hominis
KHLESNPSIEEQTK

SEQ ID NO: 2147602 - protein, 6 aa, Cryptosporidium hominis
KHLNNK

SEQ ID NO: 2147603 - protein, 13 aa, Cryptosporidium hominis
KHLSERLKDSNEQ

SEQ ID NO: 2147604 - protein, 11 aa, Cryptosporidium hominis
KHLSNPNNKQG

SEQ ID NO: 2147605 - protein, 9 aa, Cryptosporidium hominis
KHNDDSQVI

SEQ ID NO: 2147606 - protein, 7 aa, Cryptosporidium hominis
KHNEHPD

SEQ ID NO: 2147607 - protein, 15 aa, Cryptosporidium hominis
KHNENNEGNTSNRRF

SEQ ID NO: 2147608 - protein, 9 aa, Cryptosporidium hominis
KHNENQSNE

SEQ ID NO: 2147609 - protein, 7 aa, Cryptosporidium hominis
KHNGLQG

SEQ ID NO: 2147610 - protein, 8 aa, Cryptosporidium hominis
KHNGPNWN

SEQ ID NO: 2147611 - protein, 5 aa, Cryptosporidium hominis
KHNPQ

SEQ ID NO: 2147612 - protein, 6 aa, Cryptosporidium hominis
KHNQGV

SEQ ID NO: 2147613 - protein, 10 aa, Cryptosporidium hominis
KHNSNEKEVT

SEQ ID NO: 2147614 - protein, 5 aa, Cryptosporidium hominis
KHPDL

SEQ ID NO: 2147615 - protein, 6 aa, Cryptosporidium hominis
KHPDNV

SEQ ID NO: 2147616 - protein, 13 aa, Cryptosporidium hominis
KHPKLEFSQCFPN

SEQ ID NO: 2147617 - protein, 16 aa, Cryptosporidium hominis
KHPPTKSPPGYWDLDE

SEQ ID NO: 2147618 - protein, 5 aa, Cryptosporidium hominis
KHPRG

SEQ ID NO: 2147619 - protein, 6 aa, Cryptosporidium hominis
KHPSST

SEQ ID NO: 2147620 - protein, 8 aa, Cryptosporidium hominis
KHRSSNAN

SEQ ID NO: 2147621 - protein, 4 aa, Cryptosporidium hominis
KHSD

SEQ ID NO: 2147622 - protein, 14 aa, Cryptosporidium hominis
KHSDKKKDNKLSCE

SEQ ID NO: 2147623 - protein, 10 aa, Cryptosporidium hominis
KHSDQGGDFD

SEQ ID NO: 2147624 - protein, 5 aa, Cryptosporidium hominis
KHSEI

SEQ ID NO: 2147625 - protein, 25 aa, Cryptosporidium hominis
KHSENNTPNPSTRYSSSSSSSSDSL

SEQ ID NO: 2147626 - protein, 8 aa, Cryptosporidium hominis
KHSKGKER

SEQ ID NO: 2147627 - protein, 12 aa, Cryptosporidium hominis
KHSKKNKDISET

SEQ ID NO: 2147628 - protein, 16 aa, Cryptosporidium hominis
KHSKRFNSPIRVLKDK

SEQ ID NO: 2147629 - protein, 12 aa, Cryptosporidium hominis
KHSPKESQYEHE

SEQ ID NO: 2147630 - protein, 20 aa, Cryptosporidium hominis
KHSSTTNSTASSSAIPSNNI

SEQ ID NO: 2147631 - protein, 11 aa, Cryptosporidium hominis
KHSTEGSGGHM

SEQ ID NO: 2147632 - protein, 9 aa, Cryptosporidium hominis
KHSTHSHSK

SEQ ID NO: 2147633 - protein, 6 aa, Cryptosporidium hominis
KHSYNL

SEQ ID NO: 2147634 - protein, 8 aa, Cryptosporidium hominis
KHTESIPA

SEQ ID NO: 2147635 - protein, 4 aa, Cryptosporidium hominis
KHTG

SEQ ID NO: 2147636 - protein, 5 aa, Cryptosporidium hominis
KHVGP

SEQ ID NO: 2147637 - protein, 6 aa, Cryptosporidium hominis
KHVSPT

SEQ ID NO: 2147638 - protein, 10 aa, Cryptosporidium hominis
KHYPNNEKAS

SEQ ID NO: 2147639 - protein, 14 aa, Cryptosporidium hominis
KIAENVEEESSESV

SEQ ID NO: 2147640 - protein, 11 aa, Cryptosporidium hominis
KIANDKSDKTV

SEQ ID NO: 2147641 - protein, 20 aa, Cryptosporidium hominis
KIASEKAERLESRRKLLSKN

SEQ ID NO: 2147642 - protein, 5 aa, Cryptosporidium hominis
KIDDS

SEQ ID NO: 2147643 - protein, 19 aa, Cryptosporidium hominis
KIDEELKDTINKKNSKLDE

SEQ ID NO: 2147644 - protein, 6 aa, Cryptosporidium hominis
KIDKQK

SEQ ID NO: 2147645 - protein, 23 aa, Cryptosporidium hominis
KIDNNEDIKGEKDDEYEDGELSE

SEQ ID NO: 2147646 - protein, 20 aa, Cryptosporidium hominis
KIDTKNINTGTDNVKIDSRE

SEQ ID NO: 2147647 - protein, 6 aa, Cryptosporidium hominis
KIEADT

SEQ ID NO: 2147648 - protein, 16 aa, Cryptosporidium hominis
KIEDEGSGNKKLSKGG

SEQ ID NO: 2147649 - protein, 4 aa, Cryptosporidium hominis
KIEG

SEQ ID NO: 2147650 - protein, 8 aa, Cryptosporidium hominis
KIEGKQRR

SEQ ID NO: 2147651 - protein, 11 aa, Cryptosporidium hominis
KIEGYSDSHSL

SEQ ID NO: 2147652 - protein, 6 aa, Cryptosporidium hominis
KIEKQE

SEQ ID NO: 2147653 - protein, 8 aa, Cryptosporidium hominis
KIEKTQDK

SEQ ID NO: 2147654 - protein, 4 aa, Cryptosporidium hominis
KIEN

SEQ ID NO: 2147655 - protein, 26 aa, Cryptosporidium hominis
KIEPKELTNEDSKGNSFNELPSYDED

SEQ ID NO: 2147656 - protein, 4 aa, Cryptosporidium hominis
KIEQ

SEQ ID NO: 2147657 - protein, 5 aa, Cryptosporidium hominis
KIESF

SEQ ID NO: 2147658 - protein, 17 aa, Cryptosporidium hominis
KIESPKEKLGIKSGEYM

SEQ ID NO: 2147659 - protein, 8 aa, Cryptosporidium hominis
KIETEEQM

SEQ ID NO: 2147660 - protein, 11 aa, Cryptosporidium hominis
KIGEDRSAQYH

SEQ ID NO: 2147661 - protein, 10 aa, Cryptosporidium hominis
KIGGNNYNEY

SEQ ID NO: 2147662 - protein, 17 aa, Cryptosporidium hominis
KIGKQKPKSEPKLVGQT

SEQ ID NO: 2147663 - protein, 13 aa, Cryptosporidium hominis
KIGKTGSDSEDDI

SEQ ID NO: 2147664 - protein, 15 aa, Cryptosporidium hominis
KIGNDSQADQSQKQP

SEQ ID NO: 2147665 - protein, 7 aa, Cryptosporidium hominis
KIGRKQQ

SEQ ID NO: 2147666 - protein, 4 aa, Cryptosporidium hominis
KIGT

SEQ ID NO: 2147667 - protein, 5 aa, Cryptosporidium hominis
KIGTG

SEQ ID NO: 2147668 - protein, 10 aa, Cryptosporidium hominis
KIHDNGKNEE

SEQ ID NO: 2147669 - protein, 14 aa, Cryptosporidium hominis
KIHPSDTSKTPENI

SEQ ID NO: 2147670 - protein, 4 aa, Cryptosporidium hominis
KIIG

SEQ ID NO: 2147671 - protein, 6 aa, Cryptosporidium hominis
KIIPDG

SEQ ID NO: 2147672 - protein, 9 aa, Cryptosporidium hominis
KIKDGSRSL

SEQ ID NO: 2147673 - protein, 15 aa, Cryptosporidium hominis
KIKDNSKNSVGKTHS

SEQ ID NO: 2147674 - protein, 8 aa, Cryptosporidium hominis
KIKESGDW

SEQ ID NO: 2147675 - protein, 8 aa, Cryptosporidium hominis
KIKGTKKI

SEQ ID NO: 2147676 - protein, 26 aa, Cryptosporidium hominis
KIKNDSKDKGKKKKKKDGKVSSINEK

SEQ ID NO: 2147677 - protein, 6 aa, Cryptosporidium hominis
KIKQDE

SEQ ID NO: 2147678 - protein, 6 aa, Cryptosporidium hominis
KIKQPI

SEQ ID NO: 2147679 - protein, 12 aa, Cryptosporidium hominis
KIKSDKTRELEN

SEQ ID NO: 2147680 - protein, 8 aa, Cryptosporidium hominis
KIKSECKD

SEQ ID NO: 2147681 - protein, 7 aa, Cryptosporidium hominis
KIKSKRK

SEQ ID NO: 2147682 - protein, 7 aa, Cryptosporidium hominis
KIKSKSQ

SEQ ID NO: 2147683 - protein, 6 aa, Cryptosporidium hominis
KIKSNN

SEQ ID NO: 2147684 - protein, 7 aa, Cryptosporidium hominis
KIKSSEL

SEQ ID NO: 2147685 - protein, 7 aa, Cryptosporidium hominis
KIKTDST

SEQ ID NO: 2147686 - protein, 11 aa, Cryptosporidium hominis
KIKTSETNNMS

SEQ ID NO: 2147687 - protein, 100 aa, Cryptosporidium hominis
KINAERGESGGSSAKVSNSSQYKSQNGSSFKASDKNAATDNNVKSAAASSNPWQKHATSSSSKGGPVGSNNSAKTSEKNKTYSQSNHDANIDKNGYGQEI

SEQ ID NO: 2147688 - protein, 30 aa, Cryptosporidium hominis
KINASSGSIVNSSENTISSNIATSNAETVE

SEQ ID NO: 2147689 - protein, 13 aa, Cryptosporidium hominis
KINDDQPSYQRPT

SEQ ID NO: 2147690 - protein, 20 aa, Cryptosporidium hominis
KINDSTQYGGYSSSNIGNSQ

SEQ ID NO: 2147691 - protein, 18 aa, Cryptosporidium hominis
KINEQEEKLGHSKETELE

SEQ ID NO: 2147692 - protein, 5 aa, Cryptosporidium hominis
KINEY

SEQ ID NO: 2147693 - protein, 14 aa, Cryptosporidium hominis
KINNSRLESPKNTL

SEQ ID NO: 2147694 - protein, 4 aa, Cryptosporidium hominis
KINP

SEQ ID NO: 2147695 - protein, 7 aa, Cryptosporidium hominis
KINPSEP

SEQ ID NO: 2147696 - protein, 7 aa, Cryptosporidium hominis
KINYESA

SEQ ID NO: 2147697 - protein, 6 aa, Cryptosporidium hominis
KIPDSQ

SEQ ID NO: 2147698 - protein, 8 aa, Cryptosporidium hominis
KIPENPTR

SEQ ID NO: 2147699 - protein, 6 aa, Cryptosporidium hominis
KIPENQ

SEQ ID NO: 2147700 - protein, 4 aa, Cryptosporidium hominis
KIPG

SEQ ID NO: 2147701 - protein, 7 aa, Cryptosporidium hominis
KIPGDSA

SEQ ID NO: 2147702 - protein, 10 aa, Cryptosporidium hominis
KIPKDPVKKS

SEQ ID NO: 2147703 - protein, 6 aa, Cryptosporidium hominis
KIPKQF

SEQ ID NO: 2147704 - protein, 7 aa, Cryptosporidium hominis
KIPMQDS

SEQ ID NO: 2147705 - protein, 6 aa, Cryptosporidium hominis
KIPNDE

SEQ ID NO: 2147706 - protein, 7 aa, Cryptosporidium hominis
KIPPKKD

SEQ ID NO: 2147707 - protein, 13 aa, Cryptosporidium hominis
KIPPKKDGLVTSL

SEQ ID NO: 2147708 - protein, 7 aa, Cryptosporidium hominis
KIPQNRI

SEQ ID NO: 2147709 - protein, 11 aa, Cryptosporidium hominis
KIPRGARTGTV

SEQ ID NO: 2147710 - protein, 23 aa, Cryptosporidium hominis
KIPSDGRTLGKAISGNESSRDLN

SEQ ID NO: 2147711 - protein, 6 aa, Cryptosporidium hominis
KIPSDN

SEQ ID NO: 2147712 - protein, 6 aa, Cryptosporidium hominis
KIPSSG

SEQ ID NO: 2147713 - protein, 6 aa, Cryptosporidium hominis
KIPSSP

SEQ ID NO: 2147714 - protein, 6 aa, Cryptosporidium hominis
KIQDES

SEQ ID NO: 2147715 - protein, 7 aa, Cryptosporidium hominis
KIQEPTK

SEQ ID NO: 2147716 - protein, 6 aa, Cryptosporidium hominis
KIQESQ

SEQ ID NO: 2147717 - protein, 7 aa, Cryptosporidium hominis
KIQKDEE

SEQ ID NO: 2147718 - protein, 5 aa, Cryptosporidium hominis
KIQPQ

SEQ ID NO: 2147719 - protein, 4 aa, Cryptosporidium hominis
KIQQ

SEQ ID NO: 2147720 - protein, 7 aa, Cryptosporidium hominis
KIQTPRE

SEQ ID NO: 2147721 - protein, 4 aa, Cryptosporidium hominis
KIRE

SEQ ID NO: 2147722 - protein, 4 aa, Cryptosporidium hominis
KIRK

SEQ ID NO: 2147723 - protein, 9 aa, Cryptosporidium hominis
KIRNPDSGI

SEQ ID NO: 2147724 - protein, 5 aa, Cryptosporidium hominis
KIRRE

SEQ ID NO: 2147725 - protein, 10 aa, Cryptosporidium hominis
KIRRESSKID

SEQ ID NO: 2147726 - protein, 7 aa, Cryptosporidium hominis
KIRYPQT

SEQ ID NO: 2147727 - protein, 17 aa, Cryptosporidium hominis
KISAKSAVKSEKKTKME

SEQ ID NO: 2147728 - protein, 14 aa, Cryptosporidium hominis
KISDQQNLQSCENP

SEQ ID NO: 2147729 - protein, 22 aa, Cryptosporidium hominis
KISEKDIQEYKERYRGSDDEWE

SEQ ID NO: 2147730 - protein, 10 aa, Cryptosporidium hominis
KISEKQKNWT

SEQ ID NO: 2147731 - protein, 8 aa, Cryptosporidium hominis
KISEQHDR

SEQ ID NO: 2147732 - protein, 5 aa, Cryptosporidium hominis
KISET

SEQ ID NO: 2147733 - protein, 7 aa, Cryptosporidium hominis
KISGDGR

SEQ ID NO: 2147734 - protein, 12 aa, Cryptosporidium hominis
KISKDTTNNHDD

SEQ ID NO: 2147735 - protein, 10 aa, Cryptosporidium hominis
KISKNNSSNH

SEQ ID NO: 2147736 - protein, 5 aa, Cryptosporidium hominis
KISKR

SEQ ID NO: 2147737 - protein, 14 aa, Cryptosporidium hominis
KISNNNNNSGGDYN

SEQ ID NO: 2147738 - protein, 6 aa, Cryptosporidium hominis
KISNSN

SEQ ID NO: 2147739 - protein, 7 aa, Cryptosporidium hominis
KISNTKN

SEQ ID NO: 2147740 - protein, 19 aa, Cryptosporidium hominis
KISNYEQGSGYPGDPKTKE

SEQ ID NO: 2147741 - protein, 7 aa, Cryptosporidium hominis
KISPDIN

SEQ ID NO: 2147742 - protein, 17 aa, Cryptosporidium hominis
KISPGGNLNQYAEKQSI

SEQ ID NO: 2147743 - protein, 5 aa, Cryptosporidium hominis
KISPK

SEQ ID NO: 2147744 - protein, 9 aa, Cryptosporidium hominis
KISPSGVNE

SEQ ID NO: 2147745 - protein, 5 aa, Cryptosporidium hominis
KISQI

SEQ ID NO: 2147746 - protein, 5 aa, Cryptosporidium hominis
KISQR

SEQ ID NO: 2147747 - protein, 6 aa, Cryptosporidium hominis
KISSGK

SEQ ID NO: 2147748 - protein, 6 aa, Cryptosporidium hominis
KISSNK

SEQ ID NO: 2147749 - protein, 10 aa, Cryptosporidium hominis
KISSRSEDIQ

SEQ ID NO: 2147750 - protein, 7 aa, Cryptosporidium hominis
KISTEGN

SEQ ID NO: 2147751 - protein, 7 aa, Cryptosporidium hominis
KISTKTY

SEQ ID NO: 2147752 - protein, 18 aa, Cryptosporidium hominis
KISYSGGSGVDENNYSDK

SEQ ID NO: 2147753 - protein, 7 aa, Cryptosporidium hominis
KITEDPN

SEQ ID NO: 2147754 - protein, 5 aa, Cryptosporidium hominis
KITEK

SEQ ID NO: 2147755 - protein, 9 aa, Cryptosporidium hominis
KITEKNGLL

SEQ ID NO: 2147756 - protein, 7 aa, Cryptosporidium hominis
KITPDKD

SEQ ID NO: 2147757 - protein, 9 aa, Cryptosporidium hominis
KITPPRGGT

SEQ ID NO: 2147758 - protein, 17 aa, Cryptosporidium hominis
KITQGRDGIASMYKNEI

SEQ ID NO: 2147759 - protein, 49 aa, Cryptosporidium hominis
KITSEKVVQGNDEKQIASKSKSKKRTQEEHADENNSTNKVSKEAPTLKK

SEQ ID NO: 2147760 - protein, 11 aa, Cryptosporidium hominis
KITTPSPARAK

SEQ ID NO: 2147761 - protein, 19 aa, Cryptosporidium hominis
KIYSPNSSTIEPQETSQEV

SEQ ID NO: 2147762 - protein, 21 aa, Cryptosporidium hominis
KKADSETEKGMQDSAQYYQTK

SEQ ID NO: 2147763 - protein, 6 aa, Cryptosporidium hominis
KKAEKS

SEQ ID NO: 2147764 - protein, 14 aa, Cryptosporidium hominis
KKAERFSEKDKTFT

SEQ ID NO: 2147765 - protein, 7 aa, Cryptosporidium hominis
KKAETEA

SEQ ID NO: 2147766 - protein, 13 aa, Cryptosporidium hominis
KKAGSKKCENEKI

SEQ ID NO: 2147767 - protein, 8 aa, Cryptosporidium hominis
KKAKGTLV

SEQ ID NO: 2147768 - protein, 9 aa, Cryptosporidium hominis
KKALEDRRA

SEQ ID NO: 2147769 - protein, 18 aa, Cryptosporidium hominis
KKALQDKKAKEKPASKSS

SEQ ID NO: 2147770 - protein, 26 aa, Cryptosporidium hominis
KKALSKSDNPQDLDSLSNSDNYTENH

SEQ ID NO: 2147771 - protein, 50 aa, Cryptosporidium hominis
KKANPTQNNNSVSEDPKENTPKKSKTEIVNDDSQISSSSPIKGQNQNETP

SEQ ID NO: 2147772 - protein, 18 aa, Cryptosporidium hominis
KKAPNIKKTPKSKKGKSK

SEQ ID NO: 2147773 - protein, 17 aa, Cryptosporidium hominis
KKAQGIKVKDNKSKLIK

SEQ ID NO: 2147774 - protein, 8 aa, Cryptosporidium hominis
KKARDIKT

SEQ ID NO: 2147775 - protein, 7 aa, Cryptosporidium hominis
KKASNIP

SEQ ID NO: 2147776 - protein, 7 aa, Cryptosporidium hominis
KKATFDD

SEQ ID NO: 2147777 - protein, 34 aa, Cryptosporidium hominis
KKATNGSKNSSDAQTSTTASYSYDDKDSTANTKL

SEQ ID NO: 2147778 - protein, 9 aa, Cryptosporidium hominis
KKAVQNNNL

SEQ ID NO: 2147779 - protein, 6 aa, Cryptosporidium hominis
KKCLES

SEQ ID NO: 2147780 - protein, 8 aa, Cryptosporidium hominis
KKCPELKS

SEQ ID NO: 2147781 - protein, 7 aa, Cryptosporidium hominis
KKCRETN

SEQ ID NO: 2147782 - protein, 12 aa, Cryptosporidium hominis
KKCSGSGSVKER

SEQ ID NO: 2147783 - protein, 17 aa, Cryptosporidium hominis
KKDDISEGEVRSKINKE

SEQ ID NO: 2147784 - protein, 14 aa, Cryptosporidium hominis
KKDEESQESVIDSE

SEQ ID NO: 2147785 - protein, 12 aa, Cryptosporidium hominis
KKDEKKERRKKR

SEQ ID NO: 2147786 - protein, 11 aa, Cryptosporidium hominis
KKDEKRSKKIK

SEQ ID NO: 2147787 - protein, 7 aa, Cryptosporidium hominis
KKDEQIS

SEQ ID NO: 2147788 - protein, 13 aa, Cryptosporidium hominis
KKDETKKFSEEKN

SEQ ID NO: 2147789 - protein, 8 aa, Cryptosporidium hominis
KKDGKMEE

SEQ ID NO: 2147790 - protein, 9 aa, Cryptosporidium hominis
KKDGLSTGD

SEQ ID NO: 2147791 - protein, 8 aa, Cryptosporidium hominis
KKDIKRSQ

SEQ ID NO: 2147792 - protein, 6 aa, Cryptosporidium hominis
KKDIRK

SEQ ID NO: 2147793 - protein, 6 aa, Cryptosporidium hominis
KKDKEE

SEQ ID NO: 2147794 - protein, 8 aa, Cryptosporidium hominis
KKDKIKVD

SEQ ID NO: 2147795 - protein, 19 aa, Cryptosporidium hominis
KKDKQKNKNKGGDENESLK

SEQ ID NO: 2147796 - protein, 7 aa, Cryptosporidium hominis
KKDKRKI

SEQ ID NO: 2147797 - protein, 5 aa, Cryptosporidium hominis
KKDNC

SEQ ID NO: 2147798 - protein, 9 aa, Cryptosporidium hominis
KKDNQNDTE

SEQ ID NO: 2147799 - protein, 4 aa, Cryptosporidium hominis
KKDP

SEQ ID NO: 2147800 - protein, 5 aa, Cryptosporidium hominis
KKDPH

SEQ ID NO: 2147801 - protein, 7 aa, Cryptosporidium hominis
KKDPSTL

SEQ ID NO: 2147802 - protein, 10 aa, Cryptosporidium hominis
KKDQNLQSSF

SEQ ID NO: 2147803 - protein, 13 aa, Cryptosporidium hominis
KKDQQDQETYKKE

SEQ ID NO: 2147804 - protein, 8 aa, Cryptosporidium hominis
KKDSEDLA

SEQ ID NO: 2147805 - protein, 15 aa, Cryptosporidium hominis
KKDSFDKAKYGDAPI

SEQ ID NO: 2147806 - protein, 8 aa, Cryptosporidium hominis
KKDSKLEE

SEQ ID NO: 2147807 - protein, 8 aa, Cryptosporidium hominis
KKDSSMST

SEQ ID NO: 2147808 - protein, 16 aa, Cryptosporidium hominis
KKDTIPSSESCSNQDL

SEQ ID NO: 2147809 - protein, 9 aa, Cryptosporidium hominis
KKDTSDDKE

SEQ ID NO: 2147810 - protein, 9 aa, Cryptosporidium hominis
KKEAHKEKE

SEQ ID NO: 2147811 - protein, 6 aa, Cryptosporidium hominis
KKEDAK

SEQ ID NO: 2147812 - protein, 8 aa, Cryptosporidium hominis
KKEDGSEV

SEQ ID NO: 2147813 - protein, 20 aa, Cryptosporidium hominis
KKEDKSQSSNNIPPPPSPLE

SEQ ID NO: 2147814 - protein, 25 aa, Cryptosporidium hominis
KKEDNEIKSKLSSAKGQVMSKQTLR

SEQ ID NO: 2147815 - protein, 8 aa, Cryptosporidium hominis
KKEEANRP

SEQ ID NO: 2147816 - protein, 20 aa, Cryptosporidium hominis
KKEEGDNNNNNNNNNNNTRR

SEQ ID NO: 2147817 - protein, 12 aa, Cryptosporidium hominis
KKEEHPDQEMDI

SEQ ID NO: 2147818 - protein, 8 aa, Cryptosporidium hominis
KKEEISKS

SEQ ID NO: 2147819 - protein, 7 aa, Cryptosporidium hominis
KKEENEQ

SEQ ID NO: 2147820 - protein, 17 aa, Cryptosporidium hominis
KKEESENNGSDGSRLKS

SEQ ID NO: 2147821 - protein, 8 aa, Cryptosporidium hominis
KKEESERR

SEQ ID NO: 2147822 - protein, 8 aa, Cryptosporidium hominis
KKEESIRM

SEQ ID NO: 2147823 - protein, 7 aa, Cryptosporidium hominis
KKEGHYL

SEQ ID NO: 2147824 - protein, 6 aa, Cryptosporidium hominis
KKEGMS

SEQ ID NO: 2147825 - protein, 7 aa, Cryptosporidium hominis
KKEGTNE

SEQ ID NO: 2147826 - protein, 5 aa, Cryptosporidium hominis
KKEIE

SEQ ID NO: 2147827 - protein, 8 aa, Cryptosporidium hominis
KKEISEEE

SEQ ID NO: 2147828 - protein, 7 aa, Cryptosporidium hominis
KKEITAD

SEQ ID NO: 2147829 - protein, 4 aa, Cryptosporidium hominis
KKEK

SEQ ID NO: 2147830 - protein, 8 aa, Cryptosporidium hominis
KKEKCTED

SEQ ID NO: 2147831 - protein, 23 aa, Cryptosporidium hominis
KKEKEEEEKSKADAAKQGKQMSG

SEQ ID NO: 2147832 - protein, 8 aa, Cryptosporidium hominis
KKELERSI

SEQ ID NO: 2147833 - protein, 9 aa, Cryptosporidium hominis
KKELETKLK

SEQ ID NO: 2147834 - protein, 7 aa, Cryptosporidium hominis
KKELYQD

SEQ ID NO: 2147835 - protein, 17 aa, Cryptosporidium hominis
KKEMERNKYRKSTTKKL

SEQ ID NO: 2147836 - protein, 4 aa, Cryptosporidium hominis
KKEN

SEQ ID NO: 2147837 - protein, 6 aa, Cryptosporidium hominis
KKENFE

SEQ ID NO: 2147838 - protein, 16 aa, Cryptosporidium hominis
KKENSFNKAQLPENEP

SEQ ID NO: 2147839 - protein, 18 aa, Cryptosporidium hominis
KKEQDADSDYDEEDGYEY

SEQ ID NO: 2147840 - protein, 8 aa, Cryptosporidium hominis
KKEREQLK

SEQ ID NO: 2147841 - protein, 7 aa, Cryptosporidium hominis
KKERSDY

SEQ ID NO: 2147842 - protein, 5 aa, Cryptosporidium hominis
KKESI

SEQ ID NO: 2147843 - protein, 17 aa, Cryptosporidium hominis
KKESKEEVNEIESTNKS

SEQ ID NO: 2147844 - protein, 9 aa, Cryptosporidium hominis
KKESNPTIQ

SEQ ID NO: 2147845 - protein, 8 aa, Cryptosporidium hominis
KKESPRSI

SEQ ID NO: 2147846 - protein, 4 aa, Cryptosporidium hominis
KKET

SEQ ID NO: 2147847 - protein, 15 aa, Cryptosporidium hominis
KKETGIDQTTKNNEF

SEQ ID NO: 2147848 - protein, 5 aa, Cryptosporidium hominis
KKETS

SEQ ID NO: 2147849 - protein, 4 aa, Cryptosporidium hominis
KKEW

SEQ ID NO: 2147850 - protein, 4 aa, Cryptosporidium hominis
KKEY

SEQ ID NO: 2147851 - protein, 7 aa, Cryptosporidium hominis
KKEYRGI

SEQ ID NO: 2147852 - protein, 22 aa, Cryptosporidium hominis
KKFKTKEKNSVNRTRGSRTNEL

SEQ ID NO: 2147853 - protein, 5 aa, Cryptosporidium hominis
KKFNE

SEQ ID NO: 2147854 - protein, 13 aa, Cryptosporidium hominis
KKFPSNKGSDTIE

SEQ ID NO: 2147855 - protein, 12 aa, Cryptosporidium hominis
KKFSATAKYMVY

SEQ ID NO: 2147856 - protein, 6 aa, Cryptosporidium hominis
KKFSDK

SEQ ID NO: 2147857 - protein, 8 aa, Cryptosporidium hominis
KKGDKDIE

SEQ ID NO: 2147858 - protein, 4 aa, Cryptosporidium hominis
KKGE

SEQ ID NO: 2147859 - protein, 10 aa, Cryptosporidium hominis
KKGEEPKELK

SEQ ID NO: 2147860 - protein, 8 aa, Cryptosporidium hominis
KKGEFPDF

SEQ ID NO: 2147861 - protein, 8 aa, Cryptosporidium hominis
KKGEHELS

SEQ ID NO: 2147862 - protein, 8 aa, Cryptosporidium hominis
KKGEIENK

SEQ ID NO: 2147863 - protein, 8 aa, Cryptosporidium hominis
KKGEQERE

SEQ ID NO: 2147864 - protein, 10 aa, Cryptosporidium hominis
KKGESQTNVE

SEQ ID NO: 2147865 - protein, 44 aa, Cryptosporidium hominis
KKGGSKADLSSFDSLDEKNSYSKSKSYDDKTKDSEDTNSQTSKF

SEQ ID NO: 2147866 - protein, 11 aa, Cryptosporidium hominis
KKGIEDEYGYG

SEQ ID NO: 2147867 - protein, 7 aa, Cryptosporidium hominis
KKGKDKM

SEQ ID NO: 2147868 - protein, 8 aa, Cryptosporidium hominis
KKGKPELR

SEQ ID NO: 2147869 - protein, 6 aa, Cryptosporidium hominis
KKGLEN

SEQ ID NO: 2147870 - protein, 9 aa, Cryptosporidium hominis
KKGLERPPY

SEQ ID NO: 2147871 - protein, 12 aa, Cryptosporidium hominis
KKGLLMKKLSQL

SEQ ID NO: 2147872 - protein, 5 aa, Cryptosporidium hominis
KKGLP

SEQ ID NO: 2147873 - protein, 4 aa, Cryptosporidium hominis
KKGN

SEQ ID NO: 2147874 - protein, 6 aa, Cryptosporidium hominis
KKGNEF

SEQ ID NO: 2147875 - protein, 14 aa, Cryptosporidium hominis
KKGNPPSARSGSTI

SEQ ID NO: 2147876 - protein, 12 aa, Cryptosporidium hominis
KKGPPPSPFSEE

SEQ ID NO: 2147877 - protein, 21 aa, Cryptosporidium hominis
KKGQKGMSATHEGVSSYLKDS

SEQ ID NO: 2147878 - protein, 19 aa, Cryptosporidium hominis
KKGQKVSSGEQKKSGGMSG

SEQ ID NO: 2147879 - protein, 6 aa, Cryptosporidium hominis
KKGRGF

SEQ ID NO: 2147880 - protein, 6 aa, Cryptosporidium hominis
KKGTEI

SEQ ID NO: 2147881 - protein, 14 aa, Cryptosporidium hominis
KKGTVGSRDFSSKD

SEQ ID NO: 2147882 - protein, 12 aa, Cryptosporidium hominis
KKGVERRNEEIE

SEQ ID NO: 2147883 - protein, 6 aa, Cryptosporidium hominis
KKGVNR

SEQ ID NO: 2147884 - protein, 7 aa, Cryptosporidium hominis
KKGYPET

SEQ ID NO: 2147885 - protein, 23 aa, Cryptosporidium hominis
KKHEKNSKVSFSSVNQNDQDTEP

SEQ ID NO: 2147886 - protein, 7 aa, Cryptosporidium hominis
KKHGEGE

SEQ ID NO: 2147887 - protein, 10 aa, Cryptosporidium hominis
KKHGRGGQSA

SEQ ID NO: 2147888 - protein, 9 aa, Cryptosporidium hominis
KKHGSSNKL

SEQ ID NO: 2147889 - protein, 34 aa, Cryptosporidium hominis
KKHHNKGNKLKRSYSNNKNSLNTSHINKHRLESY

SEQ ID NO: 2147890 - protein, 23 aa, Cryptosporidium hominis
KKHRQNDISEENSDFPTENDDDE

SEQ ID NO: 2147891 - protein, 24 aa, Cryptosporidium hominis
KKHSSESNNALTEDEKQAKIDKSV

SEQ ID NO: 2147892 - protein, 6 aa, Cryptosporidium hominis
KKIAEE

SEQ ID NO: 2147893 - protein, 24 aa, Cryptosporidium hominis
KKIDGESSSDTSDSQSSASSFEEL

SEQ ID NO: 2147894 - protein, 8 aa, Cryptosporidium hominis
KKIEAPNQ

SEQ ID NO: 2147895 - protein, 7 aa, Cryptosporidium hominis
KKIERNR

SEQ ID NO: 2147896 - protein, 6 aa, Cryptosporidium hominis
KKIGGV

SEQ ID NO: 2147897 - protein, 7 aa, Cryptosporidium hominis
KKIGTGD

SEQ ID NO: 2147898 - protein, 9 aa, Cryptosporidium hominis
KKIKPSDIP

SEQ ID NO: 2147899 - protein, 31 aa, Cryptosporidium hominis
KKINKDSKLPTAVGTPLPSNGTCSHYKKSNR

SEQ ID NO: 2147900 - protein, 10 aa, Cryptosporidium hominis
KKINSRIKED

SEQ ID NO: 2147901 - protein, 6 aa, Cryptosporidium hominis
KKIPID

SEQ ID NO: 2147902 - protein, 16 aa, Cryptosporidium hominis
KKIQSNTKCKAKEDIY

SEQ ID NO: 2147903 - protein, 8 aa, Cryptosporidium hominis
KKIRETRK

SEQ ID NO: 2147904 - protein, 13 aa, Cryptosporidium hominis
KKISHSQAKVSIN

SEQ ID NO: 2147905 - protein, 42 aa, Cryptosporidium hominis
KKISPENSDHYRPEDNKAKQFKSDEQSEKATNNEDMENLNNA

SEQ ID NO: 2147906 - protein, 5 aa, Cryptosporidium hominis
KKISS

SEQ ID NO: 2147907 - protein, 7 aa, Cryptosporidium hominis
KKITSKP

SEQ ID NO: 2147908 - protein, 17 aa, Cryptosporidium hominis
KKKAPPKASFSPGSRFP

SEQ ID NO: 2147909 - protein, 9 aa, Cryptosporidium hominis
KKKAPTQSK

SEQ ID NO: 2147910 - protein, 58 aa, Cryptosporidium hominis
KKKAQRPKKTVANTKNTKKASKKPTKKAKSASKPPSKPRKRQSIKSENDSEDDDINKD

SEQ ID NO: 2147911 - protein, 7 aa, Cryptosporidium hominis
KKKASYI

SEQ ID NO: 2147912 - protein, 5 aa, Cryptosporidium hominis
KKKAT

SEQ ID NO: 2147913 - protein, 10 aa, Cryptosporidium hominis
KKKAVEKVPL

SEQ ID NO: 2147914 - protein, 18 aa, Cryptosporidium hominis
KKKDPKADCKDLQDKSVQ

SEQ ID NO: 2147915 - protein, 9 aa, Cryptosporidium hominis
KKKDPSIYD

SEQ ID NO: 2147916 - protein, 25 aa, Cryptosporidium hominis
KKKDSTHESNDPDSADAENSSGIQT

SEQ ID NO: 2147917 - protein, 8 aa, Cryptosporidium hominis
KKKEAAKL

SEQ ID NO: 2147918 - protein, 6 aa, Cryptosporidium hominis
KKKESH

SEQ ID NO: 2147919 - protein, 9 aa, Cryptosporidium hominis
KKKETSPEI

SEQ ID NO: 2147920 - protein, 8 aa, Cryptosporidium hominis
KKKFDEKS

SEQ ID NO: 2147921 - protein, 6 aa, Cryptosporidium hominis
KKKIRN

SEQ ID NO: 2147922 - protein, 8 aa, Cryptosporidium hominis
KKKKERDL

SEQ ID NO: 2147923 - protein, 29 aa, Cryptosporidium hominis
KKKKIESESKPNKKNIRNKSCDKSFKSKN

SEQ ID NO: 2147924 - protein, 9 aa, Cryptosporidium hominis
KKKKKEFQG

SEQ ID NO: 2147925 - protein, 26 aa, Cryptosporidium hominis
KKKKKKKKKKNQWEKSKGDAENNAKA

SEQ ID NO: 2147926 - protein, 21 aa, Cryptosporidium hominis
KKKKKKSNLKKKKFKSKAKRI

SEQ ID NO: 2147927 - protein, 9 aa, Cryptosporidium hominis
KKKKQSAEE

SEQ ID NO: 2147928 - protein, 7 aa, Cryptosporidium hominis
KKKKSIL

SEQ ID NO: 2147929 - protein, 14 aa, Cryptosporidium hominis
KKKLQDNKKVDSNI

SEQ ID NO: 2147930 - protein, 35 aa, Cryptosporidium hominis
KKKLSGTPTRNIKSELDENVHTSNKSRKKNRKLNI

SEQ ID NO: 2147931 - protein, 8 aa, Cryptosporidium hominis
KKKNNGLE

SEQ ID NO: 2147932 - protein, 12 aa, Cryptosporidium hominis
KKKNSEKDDKKK

SEQ ID NO: 2147933 - protein, 19 aa, Cryptosporidium hominis
KKKNSNNSKKNKKKKNKRS

SEQ ID NO: 2147934 - protein, 10 aa, Cryptosporidium hominis
KKKNSSNEFK

SEQ ID NO: 2147935 - protein, 9 aa, Cryptosporidium hominis
KKKNYAAKF

SEQ ID NO: 2147936 - protein, 7 aa, Cryptosporidium hominis
KKKPNIS

SEQ ID NO: 2147937 - protein, 9 aa, Cryptosporidium hominis
KKKPTQHSV

SEQ ID NO: 2147938 - protein, 16 aa, Cryptosporidium hominis
KKKQSSGLSRSLRDSS

SEQ ID NO: 2147939 - protein, 4 aa, Cryptosporidium hominis
KKKR

SEQ ID NO: 2147940 - protein, 10 aa, Cryptosporidium hominis
KKKRKDKSEI

SEQ ID NO: 2147941 - protein, 10 aa, Cryptosporidium hominis
KKKRKVSEGQ

SEQ ID NO: 2147942 - protein, 6 aa, Cryptosporidium hominis
KKKSGF

SEQ ID NO: 2147943 - protein, 16 aa, Cryptosporidium hominis
KKKSKGSKKAKKIKSG

SEQ ID NO: 2147944 - protein, 37 aa, Cryptosporidium hominis
KKKSNNNDEVKDLEKEDDADENNKKNDNKKSNQNGGK

SEQ ID NO: 2147945 - protein, 8 aa, Cryptosporidium hominis
KKKSNSFY

SEQ ID NO: 2147946 - protein, 24 aa, Cryptosporidium hominis
KKKSPNGKANQNSLNNDDNNGKVN

SEQ ID NO: 2147947 - protein, 30 aa, Cryptosporidium hominis
KKKSSGTEDGNGPPKDQAGISQGGHTNIST

SEQ ID NO: 2147948 - protein, 8 aa, Cryptosporidium hominis
KKKTNKKK

SEQ ID NO: 2147949 - protein, 10 aa, Cryptosporidium hominis
KKKTPSVTSL

SEQ ID NO: 2147950 - protein, 8 aa, Cryptosporidium hominis
KKKTQIAE

SEQ ID NO: 2147951 - protein, 9 aa, Cryptosporidium hominis
KKKTSEPIK

SEQ ID NO: 2147952 - protein, 9 aa, Cryptosporidium hominis
KKKVSSGLD

SEQ ID NO: 2147953 - protein, 4 aa, Cryptosporidium hominis
KKKY

SEQ ID NO: 2147954 - protein, 18 aa, Cryptosporidium hominis
KKKYPKTSSKTNNINNKT

SEQ ID NO: 2147955 - protein, 4 aa, Cryptosporidium hominis
KKLA

SEQ ID NO: 2147956 - protein, 8 aa, Cryptosporidium hominis
KKLDQGNL

SEQ ID NO: 2147957 - protein, 63 aa, Cryptosporidium hominis
KKLEGSSSINSFSNNNNNNNNSNNNNNNNNSNNINNSNTNNMPRIGTTGGSFSGSHDKPNQNM

SEQ ID NO: 2147958 - protein, 13 aa, Cryptosporidium hominis
KKLEKSSTEQSKL

SEQ ID NO: 2147959 - protein, 5 aa, Cryptosporidium hominis
KKLGL

SEQ ID NO: 2147960 - protein, 7 aa, Cryptosporidium hominis
KKLKDDI

SEQ ID NO: 2147961 - protein, 15 aa, Cryptosporidium hominis
KKLNRDSNVESNESN

SEQ ID NO: 2147962 - protein, 6 aa, Cryptosporidium hominis
KKLPIS

SEQ ID NO: 2147963 - protein, 25 aa, Cryptosporidium hominis
KKLPSLNSPHSKKGPISSHKNSKRF

SEQ ID NO: 2147964 - protein, 7 aa, Cryptosporidium hominis
KKLRNDL

SEQ ID NO: 2147965 - protein, 6 aa, Cryptosporidium hominis
KKLSDL

SEQ ID NO: 2147966 - protein, 7 aa, Cryptosporidium hominis
KKLSGRS

SEQ ID NO: 2147967 - protein, 12 aa, Cryptosporidium hominis
KKLSKAKATSFN

SEQ ID NO: 2147968 - protein, 8 aa, Cryptosporidium hominis
KKLSKTEK

SEQ ID NO: 2147969 - protein, 9 aa, Cryptosporidium hominis
KKLSSESEN

SEQ ID NO: 2147970 - protein, 7 aa, Cryptosporidium hominis
KKLSSNS

SEQ ID NO: 2147971 - protein, 15 aa, Cryptosporidium hominis
KKLTKEDVLRFKQKY

SEQ ID NO: 2147972 - protein, 7 aa, Cryptosporidium hominis
KKLTPGT

SEQ ID NO: 2147973 - protein, 5 aa, Cryptosporidium hominis
KKLTR

SEQ ID NO: 2147974 - protein, 17 aa, Cryptosporidium hominis
KKLTRKISEVSSTSISS

SEQ ID NO: 2147975 - protein, 23 aa, Cryptosporidium hominis
KKLTSNKKKSTINGEVSNQNIDE

SEQ ID NO: 2147976 - protein, 14 aa, Cryptosporidium hominis
KKMNKQIKQSSNIV

SEQ ID NO: 2147977 - protein, 6 aa, Cryptosporidium hominis
KKMTES

SEQ ID NO: 2147978 - protein, 11 aa, Cryptosporidium hominis
KKNAKNKVNKI

SEQ ID NO: 2147979 - protein, 7 aa, Cryptosporidium hominis
KKNCTNE

SEQ ID NO: 2147980 - protein, 24 aa, Cryptosporidium hominis
KKNDEKSGGTGALTPQLGAPGGTP

SEQ ID NO: 2147981 - protein, 13 aa, Cryptosporidium hominis
KKNDINEKAKENW

SEQ ID NO: 2147982 - protein, 16 aa, Cryptosporidium hominis
KKNDKIDNNNNNNSNT

SEQ ID NO: 2147983 - protein, 7 aa, Cryptosporidium hominis
KKNDRHE

SEQ ID NO: 2147984 - protein, 5 aa, Cryptosporidium hominis
KKNDS

SEQ ID NO: 2147985 - protein, 8 aa, Cryptosporidium hominis
KKNEIKKN

SEQ ID NO: 2147986 - protein, 7 aa, Cryptosporidium hominis
KKNENEL

SEQ ID NO: 2147987 - protein, 4 aa, Cryptosporidium hominis
KKNF

SEQ ID NO: 2147988 - protein, 6 aa, Cryptosporidium hominis
KKNFKN

SEQ ID NO: 2147989 - protein, 11 aa, Cryptosporidium hominis
KKNGEKWGEKK

SEQ ID NO: 2147990 - protein, 8 aa, Cryptosporidium hominis
KKNGQHLN

SEQ ID NO: 2147991 - protein, 8 aa, Cryptosporidium hominis
KKNGVTIS

SEQ ID NO: 2147992 - protein, 6 aa, Cryptosporidium hominis
KKNISN

SEQ ID NO: 2147993 - protein, 10 aa, Cryptosporidium hominis
KKNKNRKNEI

SEQ ID NO: 2147994 - protein, 9 aa, Cryptosporidium hominis
KKNKPNLIE

SEQ ID NO: 2147995 - protein, 19 aa, Cryptosporidium hominis
KKNKQFQRSYDSNSIEARS

SEQ ID NO: 2147996 - protein, 12 aa, Cryptosporidium hominis
KKNKRKMSKRNM

SEQ ID NO: 2147997 - protein, 17 aa, Cryptosporidium hominis
KKNKSDNCNKTQNSIEN

SEQ ID NO: 2147998 - protein, 5 aa, Cryptosporidium hominis
KKNKY

SEQ ID NO: 2147999 - protein, 4 aa, Cryptosporidium hominis
KKNN

SEQ ID NO: 2148000 - protein, 8 aa, Cryptosporidium hominis
KKNNESWD

SEQ ID NO: 2148001 - protein, 7 aa, Cryptosporidium hominis
KKNNLDR

SEQ ID NO: 2148002 - protein, 6 aa, Cryptosporidium hominis
KKNNPD

SEQ ID NO: 2148003 - protein, 4 aa, Cryptosporidium hominis
KKNP

SEQ ID NO: 2148004 - protein, 8 aa, Cryptosporidium hominis
KKNPGNSV

SEQ ID NO: 2148005 - protein, 8 aa, Cryptosporidium hominis
KKNPNGQK

SEQ ID NO: 2148006 - protein, 8 aa, Cryptosporidium hominis
KKNPQSQL

SEQ ID NO: 2148007 - protein, 7 aa, Cryptosporidium hominis
KKNQEEM

SEQ ID NO: 2148008 - protein, 8 aa, Cryptosporidium hominis
KKNQKNDE

SEQ ID NO: 2148009 - protein, 19 aa, Cryptosporidium hominis
KKNRFKNDKTNSKNLTNIE

SEQ ID NO: 2148010 - protein, 8 aa, Cryptosporidium hominis
KKNRPSGL

SEQ ID NO: 2148011 - protein, 7 aa, Cryptosporidium hominis
KKNSDVI

SEQ ID NO: 2148012 - protein, 5 aa, Cryptosporidium hominis
KKNSI

SEQ ID NO: 2148013 - protein, 7 aa, Cryptosporidium hominis
KKNSKNI

SEQ ID NO: 2148014 - protein, 8 aa, Cryptosporidium hominis
KKNSKNVK

SEQ ID NO: 2148015 - protein, 11 aa, Cryptosporidium hominis
KKNSKSLLSPT

SEQ ID NO: 2148016 - protein, 9 aa, Cryptosporidium hominis
KKNSPGFND

SEQ ID NO: 2148017 - protein, 5 aa, Cryptosporidium hominis
KKNTI

SEQ ID NO: 2148018 - protein, 6 aa, Cryptosporidium hominis
KKNTNV

SEQ ID NO: 2148019 - protein, 7 aa, Cryptosporidium hominis
KKNYSKD

SEQ ID NO: 2148020 - protein, 5 aa, Cryptosporidium hominis
KKPAL

SEQ ID NO: 2148021 - protein, 8 aa, Cryptosporidium hominis
KKPANDQI

SEQ ID NO: 2148022 - protein, 6 aa, Cryptosporidium hominis
KKPCPF

SEQ ID NO: 2148023 - protein, 5 aa, Cryptosporidium hominis
KKPEF

SEQ ID NO: 2148024 - protein, 14 aa, Cryptosporidium hominis
KKPESMSHLRNENS

SEQ ID NO: 2148025 - protein, 20 aa, Cryptosporidium hominis
KKPIENTSSAGVIKSEGGSI

SEQ ID NO: 2148026 - protein, 6 aa, Cryptosporidium hominis
KKPIGS

SEQ ID NO: 2148027 - protein, 6 aa, Cryptosporidium hominis
KKPKIP

SEQ ID NO: 2148028 - protein, 20 aa, Cryptosporidium hominis
KKPNEQIESSIQNSSGNENQ

SEQ ID NO: 2148029 - protein, 25 aa, Cryptosporidium hominis
KKPNTNDTQTRENKGAETKGYSNIG

SEQ ID NO: 2148030 - protein, 6 aa, Cryptosporidium hominis
KKPPQI

SEQ ID NO: 2148031 - protein, 6 aa, Cryptosporidium hominis
KKPQKH

SEQ ID NO: 2148032 - protein, 8 aa, Cryptosporidium hominis
KKPQNDLK

SEQ ID NO: 2148033 - protein, 10 aa, Cryptosporidium hominis
KKPQPPPEVV

SEQ ID NO: 2148034 - protein, 13 aa, Cryptosporidium hominis
KKPRKPKNYVSDP

SEQ ID NO: 2148035 - protein, 13 aa, Cryptosporidium hominis
KKPRVMTRKNKNS

SEQ ID NO: 2148036 - protein, 14 aa, Cryptosporidium hominis
KKPSNIQDSSSAEV

SEQ ID NO: 2148037 - protein, 6 aa, Cryptosporidium hominis
KKPTNV

SEQ ID NO: 2148038 - protein, 38 aa, Cryptosporidium hominis
KKPTTSSSQSSANIEGNNYSSGLSSSANNLNSSSLESL

SEQ ID NO: 2148039 - protein, 13 aa, Cryptosporidium hominis
KKPVSEGKKGQEV

SEQ ID NO: 2148040 - protein, 5 aa, Cryptosporidium hominis
KKPYI

SEQ ID NO: 2148041 - protein, 10 aa, Cryptosporidium hominis
KKQDSNLENT

SEQ ID NO: 2148042 - protein, 8 aa, Cryptosporidium hominis
KKQDSVIE

SEQ ID NO: 2148043 - protein, 8 aa, Cryptosporidium hominis
KKQEEESG

SEQ ID NO: 2148044 - protein, 7 aa, Cryptosporidium hominis
KKQEQNA

SEQ ID NO: 2148045 - protein, 8 aa, Cryptosporidium hominis
KKQEYARK

SEQ ID NO: 2148046 - protein, 8 aa, Cryptosporidium hominis
KKQEYSSS

SEQ ID NO: 2148047 - protein, 15 aa, Cryptosporidium hominis
KKQFNLSQNSSDSSS

SEQ ID NO: 2148048 - protein, 8 aa, Cryptosporidium hominis
KKQFSSDI

SEQ ID NO: 2148049 - protein, 7 aa, Cryptosporidium hominis
KKQIEPC

SEQ ID NO: 2148050 - protein, 15 aa, Cryptosporidium hominis
KKQKKKNEKKREKKK

SEQ ID NO: 2148051 - protein, 14 aa, Cryptosporidium hominis
KKQKSINEKNHANN

SEQ ID NO: 2148052 - protein, 21 aa, Cryptosporidium hominis
KKQMKKKNKSIFPPEPTPRKE

SEQ ID NO: 2148053 - protein, 7 aa, Cryptosporidium hominis
KKQPFSE

SEQ ID NO: 2148054 - protein, 31 aa, Cryptosporidium hominis
KKQPSSSETSEGEQDQDQQAKKDRKQQKKGL

SEQ ID NO: 2148055 - protein, 7 aa, Cryptosporidium hominis
KKQYDNE

SEQ ID NO: 2148056 - protein, 7 aa, Cryptosporidium hominis
KKREDQL

SEQ ID NO: 2148057 - protein, 45 aa, Cryptosporidium hominis
KKREIRKRNDKTSNQDSSLNKEKQREERQKDKISEQINSKEDISN

SEQ ID NO: 2148058 - protein, 11 aa, Cryptosporidium hominis
KKRHYSKGDEK

SEQ ID NO: 2148059 - protein, 6 aa, Cryptosporidium hominis
KKRIPE

SEQ ID NO: 2148060 - protein, 7 aa, Cryptosporidium hominis
KKRIQSC

SEQ ID NO: 2148061 - protein, 8 aa, Cryptosporidium hominis
KKRITAEE

SEQ ID NO: 2148062 - protein, 29 aa, Cryptosporidium hominis
KKRKELGSDSKIDAKLSGKIKSKSLNKRG

SEQ ID NO: 2148063 - protein, 18 aa, Cryptosporidium hominis
KKRKGKSKRCKAKNTQSM

SEQ ID NO: 2148064 - protein, 6 aa, Cryptosporidium hominis
KKRKKY

SEQ ID NO: 2148065 - protein, 8 aa, Cryptosporidium hominis
KKRKNRTS

SEQ ID NO: 2148066 - protein, 13 aa, Cryptosporidium hominis
KKRKPKKPCNRVK

SEQ ID NO: 2148067 - protein, 16 aa, Cryptosporidium hominis
KKRKRKKISQDSQANE

SEQ ID NO: 2148068 - protein, 7 aa, Cryptosporidium hominis
KKRKRSR

SEQ ID NO: 2148069 - protein, 13 aa, Cryptosporidium hominis
KKRMEEKGIRKRR

SEQ ID NO: 2148070 - protein, 6 aa, Cryptosporidium hominis
KKRPAV

SEQ ID NO: 2148071 - protein, 16 aa, Cryptosporidium hominis
KKRQQRMNSGKSISLN

SEQ ID NO: 2148072 - protein, 7 aa, Cryptosporidium hominis
KKRQTKL

SEQ ID NO: 2148073 - protein, 5 aa, Cryptosporidium hominis
KKRRD

SEQ ID NO: 2148074 - protein, 14 aa, Cryptosporidium hominis
KKRREEEQREQQKT

SEQ ID NO: 2148075 - protein, 6 aa, Cryptosporidium hominis
KKRSIY

SEQ ID NO: 2148076 - protein, 8 aa, Cryptosporidium hominis
KKRSNHLN

SEQ ID NO: 2148077 - protein, 32 aa, Cryptosporidium hominis
KKRSPLVQKTARSSISTTYLPGSNIPSSRNSL

SEQ ID NO: 2148078 - protein, 9 aa, Cryptosporidium hominis
KKRSSQVPN

SEQ ID NO: 2148079 - protein, 24 aa, Cryptosporidium hominis
KKRTDVENTTQSNGSNNVTNSSNI

SEQ ID NO: 2148080 - protein, 8 aa, Cryptosporidium hominis
KKRTEDRK

SEQ ID NO: 2148081 - protein, 5 aa, Cryptosporidium hominis
KKRTI

SEQ ID NO: 2148082 - protein, 12 aa, Cryptosporidium hominis
KKRTLSSREVQT

SEQ ID NO: 2148083 - protein, 32 aa, Cryptosporidium hominis
KKRTRNDQISENDCKEKDEIDQNKIDKEITKD

SEQ ID NO: 2148084 - protein, 9 aa, Cryptosporidium hominis
KKRYAEKAT

SEQ ID NO: 2148085 - protein, 5 aa, Cryptosporidium hominis
KKRYL

SEQ ID NO: 2148086 - protein, 8 aa, Cryptosporidium hominis
KKSATRAI

SEQ ID NO: 2148087 - protein, 8 aa, Cryptosporidium hominis
KKSDENPI

SEQ ID NO: 2148088 - protein, 8 aa, Cryptosporidium hominis
KKSDNLGL

SEQ ID NO: 2148089 - protein, 17 aa, Cryptosporidium hominis
KKSEDDDDEKKDSSSYE

SEQ ID NO: 2148090 - protein, 8 aa, Cryptosporidium hominis
KKSEEKLE

SEQ ID NO: 2148091 - protein, 23 aa, Cryptosporidium hominis
KKSEKKALEQINSEYKQEERRIE

SEQ ID NO: 2148092 - protein, 10 aa, Cryptosporidium hominis
KKSEKTTPTE

SEQ ID NO: 2148093 - protein, 8 aa, Cryptosporidium hominis
KKSFTSQK

SEQ ID NO: 2148094 - protein, 7 aa, Cryptosporidium hominis
KKSGDDV

SEQ ID NO: 2148095 - protein, 6 aa, Cryptosporidium hominis
KKSGSW

SEQ ID NO: 2148096 - protein, 10 aa, Cryptosporidium hominis
KKSISAPKTD

SEQ ID NO: 2148097 - protein, 27 aa, Cryptosporidium hominis
KKSISAPKTDVKSSTSENTVSKEISAP

SEQ ID NO: 2148098 - protein, 8 aa, Cryptosporidium hominis
KKSISEVT

SEQ ID NO: 2148099 - protein, 18 aa, Cryptosporidium hominis
KKSKENNLKDFPDGIPEC

SEQ ID NO: 2148100 - protein, 10 aa, Cryptosporidium hominis
KKSKNKTSQT

SEQ ID NO: 2148101 - protein, 14 aa, Cryptosporidium hominis
KKSKQANRKLKKQN

SEQ ID NO: 2148102 - protein, 12 aa, Cryptosporidium hominis
KKSKSKQGNSQE

SEQ ID NO: 2148103 - protein, 9 aa, Cryptosporidium hominis
KKSKVPKLD

SEQ ID NO: 2148104 - protein, 7 aa, Cryptosporidium hominis
KKSLEDR

SEQ ID NO: 2148105 - protein, 5 aa, Cryptosporidium hominis
KKSLI

SEQ ID NO: 2148106 - protein, 6 aa, Cryptosporidium hominis
KKSLKE

SEQ ID NO: 2148107 - protein, 21 aa, Cryptosporidium hominis
KKSLNNNGNLPISSNTDNQSD

SEQ ID NO: 2148108 - protein, 18 aa, Cryptosporidium hominis
KKSLTSTKNINSGSIATQ

SEQ ID NO: 2148109 - protein, 24 aa, Cryptosporidium hominis
KKSMDSNPQEGQGAGKQRKPLTKK

SEQ ID NO: 2148110 - protein, 4 aa, Cryptosporidium hominis
KKSN

SEQ ID NO: 2148111 - protein, 6 aa, Cryptosporidium hominis
KKSNDE

SEQ ID NO: 2148112 - protein, 12 aa, Cryptosporidium hominis
KKSNEGSPEKEL

SEQ ID NO: 2148113 - protein, 8 aa, Cryptosporidium hominis
KKSNGKFS

SEQ ID NO: 2148114 - protein, 46 aa, Cryptosporidium hominis
KKSNSGIKGNRNSNKNNNQAEVSGPSSSSAPKKMNSHKKESIPDKD

SEQ ID NO: 2148115 - protein, 5 aa, Cryptosporidium hominis
KKSNT

SEQ ID NO: 2148116 - protein, 5 aa, Cryptosporidium hominis
KKSNV

SEQ ID NO: 2148117 - protein, 5 aa, Cryptosporidium hominis
KKSPE

SEQ ID NO: 2148118 - protein, 18 aa, Cryptosporidium hominis
KKSPRDEQLREKETKQAL

SEQ ID NO: 2148119 - protein, 11 aa, Cryptosporidium hominis
KKSQEKAKEMQ

SEQ ID NO: 2148120 - protein, 5 aa, Cryptosporidium hominis
KKSQK

SEQ ID NO: 2148121 - protein, 6 aa, Cryptosporidium hominis
KKSQLK

SEQ ID NO: 2148122 - protein, 10 aa, Cryptosporidium hominis
KKSRAAKLNE

SEQ ID NO: 2148123 - protein, 8 aa, Cryptosporidium hominis
KKSRANTK

SEQ ID NO: 2148124 - protein, 13 aa, Cryptosporidium hominis
KKSRDLKSAKTVE

SEQ ID NO: 2148125 - protein, 6 aa, Cryptosporidium hominis
KKSSFP

SEQ ID NO: 2148126 - protein, 20 aa, Cryptosporidium hominis
KKSSKEDLASSDQIKGNQDQ

SEQ ID NO: 2148127 - protein, 11 aa, Cryptosporidium hominis
KKSSKFKNSDV

SEQ ID NO: 2148128 - protein, 13 aa, Cryptosporidium hominis
KKSSLSDDSNKEI

SEQ ID NO: 2148129 - protein, 15 aa, Cryptosporidium hominis
KKSSSNHKLKNQCPK

SEQ ID NO: 2148130 - protein, 10 aa, Cryptosporidium hominis
KKSSSNVKIT

SEQ ID NO: 2148131 - protein, 9 aa, Cryptosporidium hominis
KKSTSATPK

SEQ ID NO: 2148132 - protein, 12 aa, Cryptosporidium hominis
KKSVKDRTEKEV

SEQ ID NO: 2148133 - protein, 61 aa, Cryptosporidium hominis
KKSVTRSDTFHSDKYSSKHPLSRKTTAPANMSKKDASSSNESPRSCTEEEFEESNADTEFR

SEQ ID NO: 2148134 - protein, 10 aa, Cryptosporidium hominis
KKTAGNKQNS

SEQ ID NO: 2148135 - protein, 8 aa, Cryptosporidium hominis
KKTAKHRE

SEQ ID NO: 2148136 - protein, 13 aa, Cryptosporidium hominis
KKTAQQQSEAAKD

SEQ ID NO: 2148137 - protein, 8 aa, Cryptosporidium hominis
KKTATPEY

SEQ ID NO: 2148138 - protein, 26 aa, Cryptosporidium hominis
KKTATTGTQKQGENNTVTNTSTVNTE

SEQ ID NO: 2148139 - protein, 5 aa, Cryptosporidium hominis
KKTDA

SEQ ID NO: 2148140 - protein, 9 aa, Cryptosporidium hominis
KKTDLGTEV

SEQ ID NO: 2148141 - protein, 7 aa, Cryptosporidium hominis
KKTDVNN

SEQ ID NO: 2148142 - protein, 5 aa, Cryptosporidium hominis
KKTEL

SEQ ID NO: 2148143 - protein, 8 aa, Cryptosporidium hominis
KKTETNHQ

SEQ ID NO: 2148144 - protein, 10 aa, Cryptosporidium hominis
KKTEWSRAEE

SEQ ID NO: 2148145 - protein, 41 aa, Cryptosporidium hominis
KKTFDDPRRKREEQQAQIRKQQRDEQLSKRRQGNDGENNDI

SEQ ID NO: 2148146 - protein, 7 aa, Cryptosporidium hominis
KKTGEIS

SEQ ID NO: 2148147 - protein, 7 aa, Cryptosporidium hominis
KKTGKRI

SEQ ID NO: 2148148 - protein, 5 aa, Cryptosporidium hominis
KKTGN

SEQ ID NO: 2148149 - protein, 8 aa, Cryptosporidium hominis
KKTIENAK

SEQ ID NO: 2148150 - protein, 14 aa, Cryptosporidium hominis
KKTKPGGLGIVTII

SEQ ID NO: 2148151 - protein, 6 aa, Cryptosporidium hominis
KKTLGT

SEQ ID NO: 2148152 - protein, 5 aa, Cryptosporidium hominis
KKTNN

SEQ ID NO: 2148153 - protein, 7 aa, Cryptosporidium hominis
KKTPLAK

SEQ ID NO: 2148154 - protein, 19 aa, Cryptosporidium hominis
KKTPQGPGAKTEKEEKALS

SEQ ID NO: 2148155 - protein, 13 aa, Cryptosporidium hominis
KKTPSKRAPPHKS

SEQ ID NO: 2148156 - protein, 6 aa, Cryptosporidium hominis
KKTQDI

SEQ ID NO: 2148157 - protein, 5 aa, Cryptosporidium hominis
KKTQE

SEQ ID NO: 2148158 - protein, 8 aa, Cryptosporidium hominis
KKTQKLNE

SEQ ID NO: 2148159 - protein, 8 aa, Cryptosporidium hominis
KKTQLNTR

SEQ ID NO: 2148160 - protein, 5 aa, Cryptosporidium hominis
KKTQR

SEQ ID NO: 2148161 - protein, 13 aa, Cryptosporidium hominis
KKTQSKRTRSTNP

SEQ ID NO: 2148162 - protein, 14 aa, Cryptosporidium hominis
KKTRKAVRPEIGES

SEQ ID NO: 2148163 - protein, 9 aa, Cryptosporidium hominis
KKTRRGKIR

SEQ ID NO: 2148164 - protein, 8 aa, Cryptosporidium hominis
KKTRVNPE

SEQ ID NO: 2148165 - protein, 7 aa, Cryptosporidium hominis
KKTSGDL

SEQ ID NO: 2148166 - protein, 8 aa, Cryptosporidium hominis
KKTSIPPL

SEQ ID NO: 2148167 - protein, 12 aa, Cryptosporidium hominis
KKTSSGGHFGRS

SEQ ID NO: 2148168 - protein, 5 aa, Cryptosporidium hominis
KKTTL

SEQ ID NO: 2148169 - protein, 4 aa, Cryptosporidium hominis
KKTV

SEQ ID NO: 2148170 - protein, 6 aa, Cryptosporidium hominis
KKVASP

SEQ ID NO: 2148171 - protein, 6 aa, Cryptosporidium hominis
KKVEEL

SEQ ID NO: 2148172 - protein, 34 aa, Cryptosporidium hominis
KKVEQDSEEKEVSKKKTESGPSSLGRKERVSSPL

SEQ ID NO: 2148173 - protein, 20 aa, Cryptosporidium hominis
KKVETKSQNVEESIANGSKK

SEQ ID NO: 2148174 - protein, 25 aa, Cryptosporidium hominis
KKVEVQKTKVKNEQEEDSVDDKETF

SEQ ID NO: 2148175 - protein, 10 aa, Cryptosporidium hominis
KKVKKRKNNF

SEQ ID NO: 2148176 - protein, 8 aa, Cryptosporidium hominis
KKVNRDEK

SEQ ID NO: 2148177 - protein, 19 aa, Cryptosporidium hominis
KKVSAEDARKVDPSTIKAE

SEQ ID NO: 2148178 - protein, 15 aa, Cryptosporidium hominis
KKVSNTGTKKDQPTM

SEQ ID NO: 2148179 - protein, 8 aa, Cryptosporidium hominis
KKWSPEGF

SEQ ID NO: 2148180 - protein, 8 aa, Cryptosporidium hominis
KKYAGEKI

SEQ ID NO: 2148181 - protein, 7 aa, Cryptosporidium hominis
KKYEDTV

SEQ ID NO: 2148182 - protein, 6 aa, Cryptosporidium hominis
KKYEGG

SEQ ID NO: 2148183 - protein, 6 aa, Cryptosporidium hominis
KKYFET

SEQ ID NO: 2148184 - protein, 6 aa, Cryptosporidium hominis
KKYGKE

SEQ ID NO: 2148185 - protein, 21 aa, Cryptosporidium hominis
KKYHGTASDVNSFREPVLPPL

SEQ ID NO: 2148186 - protein, 5 aa, Cryptosporidium hominis
KKYNE

SEQ ID NO: 2148187 - protein, 6 aa, Cryptosporidium hominis
KKYNSQ

SEQ ID NO: 2148188 - protein, 6 aa, Cryptosporidium hominis
KKYSTS

SEQ ID NO: 2148189 - protein, 5 aa, Cryptosporidium hominis
KKYYN

SEQ ID NO: 2148190 - protein, 8 aa, Cryptosporidium hominis
KLAEQSTQ

SEQ ID NO: 2148191 - protein, 8 aa, Cryptosporidium hominis
KLAGADSE

SEQ ID NO: 2148192 - protein, 8 aa, Cryptosporidium hominis
KLAKQGEI

SEQ ID NO: 2148193 - protein, 5 aa, Cryptosporidium hominis
KLAKT

SEQ ID NO: 2148194 - protein, 9 aa, Cryptosporidium hominis
KLANTKKQE

SEQ ID NO: 2148195 - protein, 46 aa, Cryptosporidium hominis
KLASQKEPKPNTGINSNNNNNNNNNITQSSSNVFDQQSANLQNKHI

SEQ ID NO: 2148196 - protein, 6 aa, Cryptosporidium hominis
KLDDGG

SEQ ID NO: 2148197 - protein, 5 aa, Cryptosporidium hominis
KLDED

SEQ ID NO: 2148198 - protein, 25 aa, Cryptosporidium hominis
KLDEERRLKQKQENLAKREKSASTV

SEQ ID NO: 2148199 - protein, 7 aa, Cryptosporidium hominis
KLDESEE

SEQ ID NO: 2148200 - protein, 10 aa, Cryptosporidium hominis
KLDGDTNMNQ

SEQ ID NO: 2148201 - protein, 13 aa, Cryptosporidium hominis
KLDGGESVNEQNI

SEQ ID NO: 2148202 - protein, 12 aa, Cryptosporidium hominis
KLDKSKLTSGTR

SEQ ID NO: 2148203 - protein, 11 aa, Cryptosporidium hominis
KLDQKTESIIP

SEQ ID NO: 2148204 - protein, 11 aa, Cryptosporidium hominis
KLDSKSQGILE

SEQ ID NO: 2148205 - protein, 11 aa, Cryptosporidium hominis
KLEDNDEITSI

SEQ ID NO: 2148206 - protein, 7 aa, Cryptosporidium hominis
KLEEAER

SEQ ID NO: 2148207 - protein, 9 aa, Cryptosporidium hominis
KLEEDNKKY

SEQ ID NO: 2148208 - protein, 10 aa, Cryptosporidium hominis
KLEKEENPLK

SEQ ID NO: 2148209 - protein, 10 aa, Cryptosporidium hominis
KLENAKKKNW

SEQ ID NO: 2148210 - protein, 11 aa, Cryptosporidium hominis
KLENDQPSVNN

SEQ ID NO: 2148211 - protein, 22 aa, Cryptosporidium hominis
KLENNSELNSNEEKTTDNCDSL

SEQ ID NO: 2148212 - protein, 6 aa, Cryptosporidium hominis
KLENNT

SEQ ID NO: 2148213 - protein, 5 aa, Cryptosporidium hominis
KLENV

SEQ ID NO: 2148214 - protein, 7 aa, Cryptosporidium hominis
KLEQEEA

SEQ ID NO: 2148215 - protein, 9 aa, Cryptosporidium hominis
KLEQSNKEL

SEQ ID NO: 2148216 - protein, 6 aa, Cryptosporidium hominis
KLESED

SEQ ID NO: 2148217 - protein, 67 aa, Cryptosporidium hominis
KLESETKNYNYKDSHLENSKVKKTSGANSTHSDIQEHTSMSDQEKKFNREVNRSKHNFESSNHLKNN

SEQ ID NO: 2148218 - protein, 21 aa, Cryptosporidium hominis
KLESTRSSLSLKSSDKNSSCP

SEQ ID NO: 2148219 - protein, 9 aa, Cryptosporidium hominis
KLETTSKGL

SEQ ID NO: 2148220 - protein, 4 aa, Cryptosporidium hominis
KLEV

SEQ ID NO: 2148221 - protein, 10 aa, Cryptosporidium hominis
KLGDKKENFT

SEQ ID NO: 2148222 - protein, 7 aa, Cryptosporidium hominis
KLGDKSS

SEQ ID NO: 2148223 - protein, 9 aa, Cryptosporidium hominis
KLGDNRTQF

SEQ ID NO: 2148224 - protein, 14 aa, Cryptosporidium hominis
KLGERNDSNDQKES

SEQ ID NO: 2148225 - protein, 15 aa, Cryptosporidium hominis
KLGGIDSRASGPSYN

SEQ ID NO: 2148226 - protein, 12 aa, Cryptosporidium hominis
KLGKENQQEPDK

SEQ ID NO: 2148227 - protein, 7 aa, Cryptosporidium hominis
KLGNSTP

SEQ ID NO: 2148228 - protein, 6 aa, Cryptosporidium hominis
KLGPNG

SEQ ID NO: 2148229 - protein, 10 aa, Cryptosporidium hominis
KLGRGHESDV

SEQ ID NO: 2148230 - protein, 7 aa, Cryptosporidium hominis
KLGRNDE

SEQ ID NO: 2148231 - protein, 22 aa, Cryptosporidium hominis
KLGSSSRESKAIESPENNSISL

SEQ ID NO: 2148232 - protein, 10 aa, Cryptosporidium hominis
KLIQESATDY

SEQ ID NO: 2148233 - protein, 10 aa, Cryptosporidium hominis
KLKEDLPGHA

SEQ ID NO: 2148234 - protein, 20 aa, Cryptosporidium hominis
KLKEEEEDKIYKKNDSDEEI

SEQ ID NO: 2148235 - protein, 10 aa, Cryptosporidium hominis
KLKEKEKEYD

SEQ ID NO: 2148236 - protein, 17 aa, Cryptosporidium hominis
KLKEKSKSKQKKSYPEV

SEQ ID NO: 2148237 - protein, 11 aa, Cryptosporidium hominis
KLKEPKKIQED

SEQ ID NO: 2148238 - protein, 9 aa, Cryptosporidium hominis
KLKESDSVE

SEQ ID NO: 2148239 - protein, 9 aa, Cryptosporidium hominis
KLKKEENNL

SEQ ID NO: 2148240 - protein, 20 aa, Cryptosporidium hominis
KLKNDDSPGNYGKKALKSPN

SEQ ID NO: 2148241 - protein, 11 aa, Cryptosporidium hominis
KLKNESTTDFT

SEQ ID NO: 2148242 - protein, 10 aa, Cryptosporidium hominis
KLKNSSRETI

SEQ ID NO: 2148243 - protein, 8 aa, Cryptosporidium hominis
KLKPDQKE

SEQ ID NO: 2148244 - protein, 10 aa, Cryptosporidium hominis
KLKSAGMDET

SEQ ID NO: 2148245 - protein, 19 aa, Cryptosporidium hominis
KLKSKSHKIYKNDDRSSFN

SEQ ID NO: 2148246 - protein, 16 aa, Cryptosporidium hominis
KLKSRKKVKYQRKFNI

SEQ ID NO: 2148247 - protein, 5 aa, Cryptosporidium hominis
KLKSS

SEQ ID NO: 2148248 - protein, 10 aa, Cryptosporidium hominis
KLKTGGDREK

SEQ ID NO: 2148249 - protein, 11 aa, Cryptosporidium hominis
KLKTNKNRQVG

SEQ ID NO: 2148250 - protein, 11 aa, Cryptosporidium hominis
KLKTQNEELRD

SEQ ID NO: 2148251 - protein, 6 aa, Cryptosporidium hominis
KLKTRK

SEQ ID NO: 2148252 - protein, 6 aa, Cryptosporidium hominis
KLKTSK

SEQ ID NO: 2148253 - protein, 6 aa, Cryptosporidium hominis
KLNDAN

SEQ ID NO: 2148254 - protein, 5 aa, Cryptosporidium hominis
KLNDN

SEQ ID NO: 2148255 - protein, 8 aa, Cryptosporidium hominis
KLNEQTEQ

SEQ ID NO: 2148256 - protein, 15 aa, Cryptosporidium hominis
KLNESQNDNRVSELE

SEQ ID NO: 2148257 - protein, 7 aa, Cryptosporidium hominis
KLNKEKN

SEQ ID NO: 2148258 - protein, 10 aa, Cryptosporidium hominis
KLNNEDTSDD

SEQ ID NO: 2148259 - protein, 20 aa, Cryptosporidium hominis
KLNPTEPYRDPKKVSGKEQI

SEQ ID NO: 2148260 - protein, 7 aa, Cryptosporidium hominis
KLNPTES

SEQ ID NO: 2148261 - protein, 9 aa, Cryptosporidium hominis
KLNSQKSKH

SEQ ID NO: 2148262 - protein, 6 aa, Cryptosporidium hominis
KLNSTE

SEQ ID NO: 2148263 - protein, 10 aa, Cryptosporidium hominis
KLNSTNSNHS

SEQ ID NO: 2148264 - protein, 20 aa, Cryptosporidium hominis
KLNTKKKDNKNTKGKTKHKK

SEQ ID NO: 2148265 - protein, 4 aa, Cryptosporidium hominis
KLPD

SEQ ID NO: 2148266 - protein, 8 aa, Cryptosporidium hominis
KLPDKSEV

SEQ ID NO: 2148267 - protein, 15 aa, Cryptosporidium hominis
KLPDLSEQDNKSAIT

SEQ ID NO: 2148268 - protein, 7 aa, Cryptosporidium hominis
KLPDSLE

SEQ ID NO: 2148269 - protein, 10 aa, Cryptosporidium hominis
KLPEESKSSK

SEQ ID NO: 2148270 - protein, 6 aa, Cryptosporidium hominis
KLPKQE

SEQ ID NO: 2148271 - protein, 5 aa, Cryptosporidium hominis
KLPNS

SEQ ID NO: 2148272 - protein, 81 aa, Cryptosporidium hominis
KLPNSLENDGNIDSKISDDQITKNSLSNETSTPISIDNNSSPISNQSNFNKNTNHPSSGIRNSNSTSSISSSSSPQVLPQN

SEQ ID NO: 2148273 - protein, 23 aa, Cryptosporidium hominis
KLPNTKKLDSNNMSTENNGKTGG

SEQ ID NO: 2148274 - protein, 13 aa, Cryptosporidium hominis
KLPPEDEFRKTTS

SEQ ID NO: 2148275 - protein, 6 aa, Cryptosporidium hominis
KLPPEH

SEQ ID NO: 2148276 - protein, 16 aa, Cryptosporidium hominis
KLPPKEVTEQIKKILE

SEQ ID NO: 2148277 - protein, 8 aa, Cryptosporidium hominis
KLPRQEYS

SEQ ID NO: 2148278 - protein, 5 aa, Cryptosporidium hominis
KLPSN

SEQ ID NO: 2148279 - protein, 5 aa, Cryptosporidium hominis
KLPSS

SEQ ID NO: 2148280 - protein, 15 aa, Cryptosporidium hominis
KLPSSEQSSTQKNDT

SEQ ID NO: 2148281 - protein, 10 aa, Cryptosporidium hominis
KLPTEQTAGT

SEQ ID NO: 2148282 - protein, 80 aa, Cryptosporidium hominis
KLPTGPLARPDRESVKRDEDNENEDDVDDEDEDLDDEEEKEKSFELSNENNLEEKKIEPTNTENENENEKQSSPNGNEFD

SEQ ID NO: 2148283 - protein, 5 aa, Cryptosporidium hominis
KLPTS

SEQ ID NO: 2148284 - protein, 5 aa, Cryptosporidium hominis
KLPVT

SEQ ID NO: 2148285 - protein, 6 aa, Cryptosporidium hominis
KLQEYE

SEQ ID NO: 2148286 - protein, 7 aa, Cryptosporidium hominis
KLQSQAN

SEQ ID NO: 2148287 - protein, 13 aa, Cryptosporidium hominis
KLQTEKQQEHVSN

SEQ ID NO: 2148288 - protein, 19 aa, Cryptosporidium hominis
KLQTRGKDLGSKLTNNPKS

SEQ ID NO: 2148289 - protein, 90 aa, Cryptosporidium hominis
  misc_feature (23)..(23): Xaa can be any naturally occurring amino acid
  misc_feature (28)..(29): Xaa can be any naturally occurring amino acid
  misc_feature (32)..(32): Xaa can be any naturally occurring amino acid
  misc_feature (34)..(34): Xaa can be any naturally occurring amino acid
  misc_feature (36)..(38): Xaa can be any naturally occurring amino acid
  misc_feature (40)..(40): Xaa can be any naturally occurring amino acid
  misc_feature (44)..(45): Xaa can be any naturally occurring amino acid
  misc_feature (47)..(48): Xaa can be any naturally occurring amino acid
  misc_feature (50)..(50): Xaa can be any naturally occurring amino acid
  misc_feature (52)..(52): Xaa can be any naturally occurring amino acid
  misc_feature (55)..(57): Xaa can be any naturally occurring amino acid
  misc_feature (60)..(61): Xaa can be any naturally occurring amino acid
  misc_feature (63)..(63): Xaa can be any naturally occurring amino acid
  misc_feature (65)..(66): Xaa can be any naturally occurring amino acid
  misc_feature (68)..(68): Xaa can be any naturally occurring amino acid
  misc_feature (74)..(74): Xaa can be any naturally occurring amino acid
  misc_feature (80)..(81): Xaa can be any naturally occurring amino acid
  misc_feature (83)..(83): Xaa can be any naturally occurring amino acid
  misc_feature (88)..(90): Xaa can be any naturally occurring amino acid
KLRCGSQEMSNSELQTFLKENPXAIKKXXRAXPXFXXXVXRLAXXAXXSXWXFAXXXASXXSXSXXPXVPLVLXRPPPRXXSXFCCFXXX

SEQ ID NO: 2148290 - protein, 41 aa, Cryptosporidium hominis
KLRDSNSTKKSTNTKNSCKQPKISQKLPSTINRTNSNASLR

SEQ ID NO: 2148291 - protein, 9 aa, Cryptosporidium hominis
KLREKKQSV

SEQ ID NO: 2148292 - protein, 12 aa, Cryptosporidium hominis
KLRKQETKKNLR

SEQ ID NO: 2148293 - protein, 12 aa, Cryptosporidium hominis
KLRRSTSEDNVQ

SEQ ID NO: 2148294 - protein, 7 aa, Cryptosporidium hominis
KLRSQNE

SEQ ID NO: 2148295 - protein, 7 aa, Cryptosporidium hominis
KLSALSE

SEQ ID NO: 2148296 - protein, 7 aa, Cryptosporidium hominis
KLSDEEV

SEQ ID NO: 2148297 - protein, 8 aa, Cryptosporidium hominis
KLSEEKNR

SEQ ID NO: 2148298 - protein, 14 aa, Cryptosporidium hominis
KLSEGEDPRIGGPS

SEQ ID NO: 2148299 - protein, 10 aa, Cryptosporidium hominis
KLSEKNKSGY

SEQ ID NO: 2148300 - protein, 10 aa, Cryptosporidium hominis
KLSENKNLSG

SEQ ID NO: 2148301 - protein, 24 aa, Cryptosporidium hominis
KLSEPKINYPNNNNKADDYNNNAK

SEQ ID NO: 2148302 - protein, 22 aa, Cryptosporidium hominis
KLSKEDLSRISDELEKKKLETS

SEQ ID NO: 2148303 - protein, 108 aa, Cryptosporidium hominis
KLSKEKKLSDKKEKPIVQEKDPKIDKDKKKHPTNKDDSNKGESSAGAQESTKELPQKSTEDSVPGDEKTSSSTKDKEETSSSTASDSDEGSTSKSSPRVKPPLKPKPK

SEQ ID NO: 2148304 - protein, 7 aa, Cryptosporidium hominis
KLSKEMT

SEQ ID NO: 2148305 - protein, 6 aa, Cryptosporidium hominis
KLSKGL

SEQ ID NO: 2148306 - protein, 14 aa, Cryptosporidium hominis
KLSKNEFKSEENKS

SEQ ID NO: 2148307 - protein, 13 aa, Cryptosporidium hominis
KLSKNQSQGQFES

SEQ ID NO: 2148308 - protein, 14 aa, Cryptosporidium hominis
KLSKPRNSEGTSMV

SEQ ID NO: 2148309 - protein, 7 aa, Cryptosporidium hominis
KLSKSDP

SEQ ID NO: 2148310 - protein, 7 aa, Cryptosporidium hominis
KLSNKNQ

SEQ ID NO: 2148311 - protein, 5 aa, Cryptosporidium hominis
KLSNN

SEQ ID NO: 2148312 - protein, 8 aa, Cryptosporidium hominis
KLSNPDSK

SEQ ID NO: 2148313 - protein, 19 aa, Cryptosporidium hominis
KLSNSNISPFNPSKSTSCL

SEQ ID NO: 2148314 - protein, 14 aa, Cryptosporidium hominis
KLSNSNTKQNPSNL

SEQ ID NO: 2148315 - protein, 9 aa, Cryptosporidium hominis
KLSPEDKKN

SEQ ID NO: 2148316 - protein, 5 aa, Cryptosporidium hominis
KLSPK

SEQ ID NO: 2148317 - protein, 17 aa, Cryptosporidium hominis
KLSPKGHQLNKDELTTK

SEQ ID NO: 2148318 - protein, 12 aa, Cryptosporidium hominis
KLSRSSSNSGTI

SEQ ID NO: 2148319 - protein, 8 aa, Cryptosporidium hominis
KLSSSSDI

SEQ ID NO: 2148320 - protein, 11 aa, Cryptosporidium hominis
KLSTQRNTSVS

SEQ ID NO: 2148321 - protein, 14 aa, Cryptosporidium hominis
KLTENTDLGEPSKR

SEQ ID NO: 2148322 - protein, 25 aa, Cryptosporidium hominis
KLTKENNSVLTPTDDTLQKDSHTST

SEQ ID NO: 2148323 - protein, 8 aa, Cryptosporidium hominis
KLTNRDEV

SEQ ID NO: 2148324 - protein, 5 aa, Cryptosporidium hominis
KLTQA

SEQ ID NO: 2148325 - protein, 6 aa, Cryptosporidium hominis
KLTQEY

SEQ ID NO: 2148326 - protein, 5 aa, Cryptosporidium hominis
KLTSD

SEQ ID NO: 2148327 - protein, 7 aa, Cryptosporidium hominis
KLTSEEF

SEQ ID NO: 2148328 - protein, 9 aa, Cryptosporidium hominis
KLTYSEKST

SEQ ID NO: 2148329 - protein, 4 aa, Cryptosporidium hominis
KLVG

SEQ ID NO: 2148330 - protein, 6 aa, Cryptosporidium hominis
KLYQPN

SEQ ID NO: 2148331 - protein, 8 aa, Cryptosporidium hominis
KLYSSPHN

SEQ ID NO: 2148332 - protein, 10 aa, Cryptosporidium hominis
KMDESGGNLD

SEQ ID NO: 2148333 - protein, 4 aa, Cryptosporidium hominis
KMDG

SEQ ID NO: 2148334 - protein, 8 aa, Cryptosporidium hominis
KMDPETSS

SEQ ID NO: 2148335 - protein, 7 aa, Cryptosporidium hominis
KMDTKDA

SEQ ID NO: 2148336 - protein, 6 aa, Cryptosporidium hominis
KMEGSL

SEQ ID NO: 2148337 - protein, 21 aa, Cryptosporidium hominis
KMESGEDDDIPDLVENFEDVE

SEQ ID NO: 2148338 - protein, 4 aa, Cryptosporidium hominis
KMHG

SEQ ID NO: 2148339 - protein, 18 aa, Cryptosporidium hominis
KMKDNSSNLDMNGKFIKN

SEQ ID NO: 2148340 - protein, 11 aa, Cryptosporidium hominis
KMKNPTNSNQI

SEQ ID NO: 2148341 - protein, 8 aa, Cryptosporidium hominis
KMKPDRPN

SEQ ID NO: 2148342 - protein, 25 aa, Cryptosporidium hominis
KMKSSQSKNKSNSQVSGKEGQNKKH

SEQ ID NO: 2148343 - protein, 29 aa, Cryptosporidium hominis
KMLPNERGSIYPNSDISTYPASCKPNTDE

SEQ ID NO: 2148344 - protein, 12 aa, Cryptosporidium hominis
KMNKESEELKSI

SEQ ID NO: 2148345 - protein, 20 aa, Cryptosporidium hominis
KMNKNNIRNRTKQIDPDQAE

SEQ ID NO: 2148346 - protein, 10 aa, Cryptosporidium hominis
KMNSSTNEKS

SEQ ID NO: 2148347 - protein, 5 aa, Cryptosporidium hominis
KMRPM

SEQ ID NO: 2148348 - protein, 11 aa, Cryptosporidium hominis
KMRQDDENQLK

SEQ ID NO: 2148349 - protein, 9 aa, Cryptosporidium hominis
KMSDDEKRK

SEQ ID NO: 2148350 - protein, 10 aa, Cryptosporidium hominis
KMSSRKNAME

SEQ ID NO: 2148351 - protein, 5 aa, Cryptosporidium hominis
KMTST

SEQ ID NO: 2148352 - protein, 7 aa, Cryptosporidium hominis
KNADSIY

SEQ ID NO: 2148353 - protein, 30 aa, Cryptosporidium hominis
KNAETYRKSNLNQQQNQSSNTTSGKKRRIR

SEQ ID NO: 2148354 - protein, 10 aa, Cryptosporidium hominis
KNAGTQSSQS

SEQ ID NO: 2148355 - protein, 7 aa, Cryptosporidium hominis
KNAISKK

SEQ ID NO: 2148356 - protein, 9 aa, Cryptosporidium hominis
KNANATHSV

SEQ ID NO: 2148357 - protein, 8 aa, Cryptosporidium hominis
KNAPKVNH

SEQ ID NO: 2148358 - protein, 5 aa, Cryptosporidium hominis
KNAPL

SEQ ID NO: 2148359 - protein, 7 aa, Cryptosporidium hominis
KNAQNSA

SEQ ID NO: 2148360 - protein, 11 aa, Cryptosporidium hominis
KNASMEKSEYY

SEQ ID NO: 2148361 - protein, 4 aa, Cryptosporidium hominis
KNAT

SEQ ID NO: 2148362 - protein, 5 aa, Cryptosporidium hominis
KNCKR

SEQ ID NO: 2148363 - protein, 6 aa, Cryptosporidium hominis
KNCNSK

SEQ ID NO: 2148364 - protein, 4 aa, Cryptosporidium hominis
KNCP

SEQ ID NO: 2148365 - protein, 5 aa, Cryptosporidium hominis
KNCPE

SEQ ID NO: 2148366 - protein, 7 aa, Cryptosporidium hominis
KNCSTGI

SEQ ID NO: 2148367 - protein, 5 aa, Cryptosporidium hominis
KNCYE

SEQ ID NO: 2148368 - protein, 9 aa, Cryptosporidium hominis
KNDDADLKG

SEQ ID NO: 2148369 - protein, 10 aa, Cryptosporidium hominis
KNDDELPNTY

SEQ ID NO: 2148370 - protein, 4 aa, Cryptosporidium hominis
KNDE

SEQ ID NO: 2148371 - protein, 9 aa, Cryptosporidium hominis
KNDEIQQED

SEQ ID NO: 2148372 - protein, 20 aa, Cryptosporidium hominis
KNDEITKYKGSLTTKEAEIN

SEQ ID NO: 2148373 - protein, 17 aa, Cryptosporidium hominis
KNDELRREENESLKGES

SEQ ID NO: 2148374 - protein, 17 aa, Cryptosporidium hominis
KNDESEADGDRFPIPPE

SEQ ID NO: 2148375 - protein, 15 aa, Cryptosporidium hominis
KNDGEIVKPRGEKGF

SEQ ID NO: 2148376 - protein, 7 aa, Cryptosporidium hominis
KNDGEKQ

SEQ ID NO: 2148377 - protein, 34 aa, Cryptosporidium hominis
KNDGERRVHASGHDRSMTHSSKKAYGDSTDEIQE

SEQ ID NO: 2148378 - protein, 12 aa, Cryptosporidium hominis
KNDGTASNDGSC

SEQ ID NO: 2148379 - protein, 5 aa, Cryptosporidium hominis
KNDIE

SEQ ID NO: 2148380 - protein, 4 aa, Cryptosporidium hominis
KNDK

SEQ ID NO: 2148381 - protein, 10 aa, Cryptosporidium hominis
KNDKKHGKAI

SEQ ID NO: 2148382 - protein, 8 aa, Cryptosporidium hominis
KNDKPDAL

SEQ ID NO: 2148383 - protein, 7 aa, Cryptosporidium hominis
KNDKTSF

SEQ ID NO: 2148384 - protein, 4 aa, Cryptosporidium hominis
KNDM

SEQ ID NO: 2148385 - protein, 6 aa, Cryptosporidium hominis
KNDMQG

SEQ ID NO: 2148386 - protein, 4 aa, Cryptosporidium hominis
KNDN

SEQ ID NO: 2148387 - protein, 7 aa, Cryptosporidium hominis
KNDNANL

SEQ ID NO: 2148388 - protein, 16 aa, Cryptosporidium hominis
KNDNDNVKANSNEAIT

SEQ ID NO: 2148389 - protein, 5 aa, Cryptosporidium hominis
KNDNE

SEQ ID NO: 2148390 - protein, 6 aa, Cryptosporidium hominis
KNDNGI

SEQ ID NO: 2148391 - protein, 15 aa, Cryptosporidium hominis
KNDNINLDSKTNQSE

SEQ ID NO: 2148392 - protein, 12 aa, Cryptosporidium hominis
KNDNNNGINDEE

SEQ ID NO: 2148393 - protein, 7 aa, Cryptosporidium hominis
KNDPEPL

SEQ ID NO: 2148394 - protein, 8 aa, Cryptosporidium hominis
KNDPKSYN

SEQ ID NO: 2148395 - protein, 8 aa, Cryptosporidium hominis
KNDPPTGE

SEQ ID NO: 2148396 - protein, 9 aa, Cryptosporidium hominis
KNDPTHSNL

SEQ ID NO: 2148397 - protein, 18 aa, Cryptosporidium hominis
KNDPVDKSLEEEDIGNKE

SEQ ID NO: 2148398 - protein, 28 aa, Cryptosporidium hominis
KNDREGEDDDESYSESDSSDEDEDSDAE

SEQ ID NO: 2148399 - protein, 8 aa, Cryptosporidium hominis
KNDSAGTD

SEQ ID NO: 2148400 - protein, 25 aa, Cryptosporidium hominis
KNDSESNMDDDNDFTGDECGENHVE

SEQ ID NO: 2148401 - protein, 12 aa, Cryptosporidium hominis
KNDSKRFSSPSS

SEQ ID NO: 2148402 - protein, 39 aa, Cryptosporidium hominis
KNDSNSGGVTTTSSSTGRSENQASVNSDMSNISNDSSNN

SEQ ID NO: 2148403 - protein, 9 aa, Cryptosporidium hominis
KNDTENDYN

SEQ ID NO: 2148404 - protein, 19 aa, Cryptosporidium hominis
KNEAPDSNGLSKMGPGPSF

SEQ ID NO: 2148405 - protein, 10 aa, Cryptosporidium hominis
KNECKEKDNF

SEQ ID NO: 2148406 - protein, 5 aa, Cryptosporidium hominis
KNEDS

SEQ ID NO: 2148407 - protein, 17 aa, Cryptosporidium hominis
KNEEIDKQIASGSPKEE

SEQ ID NO: 2148408 - protein, 5 aa, Cryptosporidium hominis
KNEEL

SEQ ID NO: 2148409 - protein, 5 aa, Cryptosporidium hominis
KNEET

SEQ ID NO: 2148410 - protein, 11 aa, Cryptosporidium hominis
KNEEVEDLNTN

SEQ ID NO: 2148411 - protein, 6 aa, Cryptosporidium hominis
KNEFST

SEQ ID NO: 2148412 - protein, 4 aa, Cryptosporidium hominis
KNEI

SEQ ID NO: 2148413 - protein, 21 aa, Cryptosporidium hominis
KNEIDNRRKQLAKKNKEFAEK

SEQ ID NO: 2148414 - protein, 5 aa, Cryptosporidium hominis
KNEIE

SEQ ID NO: 2148415 - protein, 5 aa, Cryptosporidium hominis
KNEIN

SEQ ID NO: 2148416 - protein, 6 aa, Cryptosporidium hominis
KNEING

SEQ ID NO: 2148417 - protein, 6 aa, Cryptosporidium hominis
KNEKDF

SEQ ID NO: 2148418 - protein, 8 aa, Cryptosporidium hominis
KNEKGAQF

SEQ ID NO: 2148419 - protein, 7 aa, Cryptosporidium hominis
KNEKKNR

SEQ ID NO: 2148420 - protein, 8 aa, Cryptosporidium hominis
KNEKNKEI

SEQ ID NO: 2148421 - protein, 9 aa, Cryptosporidium hominis
KNEKSDEKK

SEQ ID NO: 2148422 - protein, 17 aa, Cryptosporidium hominis
KNEKTNAESVVGSPQCG

SEQ ID NO: 2148423 - protein, 5 aa, Cryptosporidium hominis
KNELS

SEQ ID NO: 2148424 - protein, 13 aa, Cryptosporidium hominis
KNELSNADRKQPR

SEQ ID NO: 2148425 - protein, 6 aa, Cryptosporidium hominis
KNELYT

SEQ ID NO: 2148426 - protein, 7 aa, Cryptosporidium hominis
KNENCRN

SEQ ID NO: 2148427 - protein, 7 aa, Cryptosporidium hominis
KNENEDF

SEQ ID NO: 2148428 - protein, 17 aa, Cryptosporidium hominis
KNENESEKKNSKSQING

SEQ ID NO: 2148429 - protein, 7 aa, Cryptosporidium hominis
KNENKFK

SEQ ID NO: 2148430 - protein, 7 aa, Cryptosporidium hominis
KNENKIK

SEQ ID NO: 2148431 - protein, 8 aa, Cryptosporidium hominis
KNEQESTK

SEQ ID NO: 2148432 - protein, 7 aa, Cryptosporidium hominis
KNEQIED

SEQ ID NO: 2148433 - protein, 4 aa, Cryptosporidium hominis
KNES

SEQ ID NO: 2148434 - protein, 6 aa, Cryptosporidium hominis
KNESDF

SEQ ID NO: 2148435 - protein, 7 aa, Cryptosporidium hominis
KNESEDL

SEQ ID NO: 2148436 - protein, 6 aa, Cryptosporidium hominis
KNESIQ

SEQ ID NO: 2148437 - protein, 7 aa, Cryptosporidium hominis
KNESNEK

SEQ ID NO: 2148438 - protein, 6 aa, Cryptosporidium hominis
KNESQF

SEQ ID NO: 2148439 - protein, 7 aa, Cryptosporidium hominis
KNESSTI

SEQ ID NO: 2148440 - protein, 22 aa, Cryptosporidium hominis
KNETMNVAESDKNNGKKALSSA

SEQ ID NO: 2148441 - protein, 13 aa, Cryptosporidium hominis
KNETNNENNSEEV

SEQ ID NO: 2148442 - protein, 13 aa, Cryptosporidium hominis
KNEVNSEESTVNN

SEQ ID NO: 2148443 - protein, 6 aa, Cryptosporidium hominis
KNFEER

SEQ ID NO: 2148444 - protein, 6 aa, Cryptosporidium hominis
KNFGDN

SEQ ID NO: 2148445 - protein, 11 aa, Cryptosporidium hominis
KNFKKKNDIDS

SEQ ID NO: 2148446 - protein, 24 aa, Cryptosporidium hominis
KNFNDNEKNLESEYHSKQKYEGEI

SEQ ID NO: 2148447 - protein, 8 aa, Cryptosporidium hominis
KNFPEDDL

SEQ ID NO: 2148448 - protein, 24 aa, Cryptosporidium hominis
KNFPESLGNGENDQFVSKSDSNLY

SEQ ID NO: 2148449 - protein, 13 aa, Cryptosporidium hominis
KNFQTYEKNGEPF

SEQ ID NO: 2148450 - protein, 7 aa, Cryptosporidium hominis
KNFSPDD

SEQ ID NO: 2148451 - protein, 12 aa, Cryptosporidium hominis
KNGDSNNTNEDH

SEQ ID NO: 2148452 - protein, 7 aa, Cryptosporidium hominis
KNGEEFE

SEQ ID NO: 2148453 - protein, 8 aa, Cryptosporidium hominis
KNGENWTE

SEQ ID NO: 2148454 - protein, 6 aa, Cryptosporidium hominis
KNGESL

SEQ ID NO: 2148455 - protein, 20 aa, Cryptosporidium hominis
KNGGPREDSTSIGSAGAVRR

SEQ ID NO: 2148456 - protein, 4 aa, Cryptosporidium hominis
KNGI

SEQ ID NO: 2148457 - protein, 5 aa, Cryptosporidium hominis
KNGIR

SEQ ID NO: 2148458 - protein, 5 aa, Cryptosporidium hominis
KNGIS

SEQ ID NO: 2148459 - protein, 19 aa, Cryptosporidium hominis
KNGISHKKGTKSSEIKDGP

SEQ ID NO: 2148460 - protein, 9 aa, Cryptosporidium hominis
KNGKGRNPD

SEQ ID NO: 2148461 - protein, 8 aa, Cryptosporidium hominis
KNGKLGHG

SEQ ID NO: 2148462 - protein, 10 aa, Cryptosporidium hominis
KNGKRARRDS

SEQ ID NO: 2148463 - protein, 6 aa, Cryptosporidium hominis
KNGNEI

SEQ ID NO: 2148464 - protein, 20 aa, Cryptosporidium hominis
KNGPDEIPQIEQRSESSSFK

SEQ ID NO: 2148465 - protein, 4 aa, Cryptosporidium hominis
KNGR

SEQ ID NO: 2148466 - protein, 18 aa, Cryptosporidium hominis
KNGRNLPSFDNDSDSEEI

SEQ ID NO: 2148467 - protein, 5 aa, Cryptosporidium hominis
KNGRW

SEQ ID NO: 2148468 - protein, 12 aa, Cryptosporidium hominis
KNGSISRKETQI

SEQ ID NO: 2148469 - protein, 9 aa, Cryptosporidium hominis
KNGSKPDFH

SEQ ID NO: 2148470 - protein, 9 aa, Cryptosporidium hominis
KNGSKPKYD

SEQ ID NO: 2148471 - protein, 9 aa, Cryptosporidium hominis
KNGSLRTPA

SEQ ID NO: 2148472 - protein, 5 aa, Cryptosporidium hominis
KNGSM

SEQ ID NO: 2148473 - protein, 8 aa, Cryptosporidium hominis
KNGSNDGA

SEQ ID NO: 2148474 - protein, 7 aa, Cryptosporidium hominis
KNGTKIG

SEQ ID NO: 2148475 - protein, 12 aa, Cryptosporidium hominis
KNGTNNGDKISV

SEQ ID NO: 2148476 - protein, 9 aa, Cryptosporidium hominis
KNGVDKSHS

SEQ ID NO: 2148477 - protein, 7 aa, Cryptosporidium hominis
KNGYDYK

SEQ ID NO: 2148478 - protein, 18 aa, Cryptosporidium hominis
KNHAQIKSSSNYKNSKVK

SEQ ID NO: 2148479 - protein, 10 aa, Cryptosporidium hominis
KNHASGEEWR

SEQ ID NO: 2148480 - protein, 4 aa, Cryptosporidium hominis
KNHD

SEQ ID NO: 2148481 - protein, 12 aa, Cryptosporidium hominis
KNHNESEKHKSR

SEQ ID NO: 2148482 - protein, 5 aa, Cryptosporidium hominis
KNHPP

SEQ ID NO: 2148483 - protein, 12 aa, Cryptosporidium hominis
KNHQSSTSSSLI

SEQ ID NO: 2148484 - protein, 8 aa, Cryptosporidium hominis
KNHSEVQA

SEQ ID NO: 2148485 - protein, 39 aa, Cryptosporidium hominis
KNHSNKTGAINSRGQQQDKQTKGFGSKENVGKSLVDLGI

SEQ ID NO: 2148486 - protein, 6 aa, Cryptosporidium hominis
KNHTGT

SEQ ID NO: 2148487 - protein, 10 aa, Cryptosporidium hominis
KNIDQTNKIN

SEQ ID NO: 2148488 - protein, 58 aa, Cryptosporidium hominis
KNIEEDIKAKNASKNEEMKGQQTSDTSSVNNADSSSAVDERKFKRSRSRESDDNLNGS

SEQ ID NO: 2148489 - protein, 6 aa, Cryptosporidium hominis
KNIENR

SEQ ID NO: 2148490 - protein, 7 aa, Cryptosporidium hominis
KNIESKL

SEQ ID NO: 2148491 - protein, 9 aa, Cryptosporidium hominis
KNIKHSGNL

SEQ ID NO: 2148492 - protein, 4 aa, Cryptosporidium hominis
KNIN

SEQ ID NO: 2148493 - protein, 12 aa, Cryptosporidium hominis
KNINELRNSSNN

SEQ ID NO: 2148494 - protein, 5 aa, Cryptosporidium hominis
KNINI

SEQ ID NO: 2148495 - protein, 4 aa, Cryptosporidium hominis
KNIP

SEQ ID NO: 2148496 - protein, 9 aa, Cryptosporidium hominis
KNIPKAGRG

SEQ ID NO: 2148497 - protein, 14 aa, Cryptosporidium hominis
KNIQNEIEEEYESY

SEQ ID NO: 2148498 - protein, 6 aa, Cryptosporidium hominis
KNISNE

SEQ ID NO: 2148499 - protein, 9 aa, Cryptosporidium hominis
KNITGNSSN

SEQ ID NO: 2148500 - protein, 20 aa, Cryptosporidium hominis
KNKDDHESIKSTINNPPGTL

SEQ ID NO: 2148501 - protein, 5 aa, Cryptosporidium hominis
KNKDE

SEQ ID NO: 2148502 - protein, 9 aa, Cryptosporidium hominis
KNKDGDSKY

SEQ ID NO: 2148503 - protein, 8 aa, Cryptosporidium hominis
KNKDKINF

SEQ ID NO: 2148504 - protein, 8 aa, Cryptosporidium hominis
KNKDLRRS

SEQ ID NO: 2148505 - protein, 9 aa, Cryptosporidium hominis
KNKDTLNSV

SEQ ID NO: 2148506 - protein, 9 aa, Cryptosporidium hominis
KNKDVSGDF

SEQ ID NO: 2148507 - protein, 4 aa, Cryptosporidium hominis
KNKE

SEQ ID NO: 2148508 - protein, 15 aa, Cryptosporidium hominis
KNKEEYRTQEERELK

SEQ ID NO: 2148509 - protein, 19 aa, Cryptosporidium hominis
KNKGEEQESTGESNNNDIK

SEQ ID NO: 2148510 - protein, 7 aa, Cryptosporidium hominis
KNKHNEP

SEQ ID NO: 2148511 - protein, 5 aa, Cryptosporidium hominis
KNKHP

SEQ ID NO: 2148512 - protein, 12 aa, Cryptosporidium hominis
KNKIPSDNKKTI

SEQ ID NO: 2148513 - protein, 10 aa, Cryptosporidium hominis
KNKISSSSGI

SEQ ID NO: 2148514 - protein, 7 aa, Cryptosporidium hominis
KNKKFTD

SEQ ID NO: 2148515 - protein, 12 aa, Cryptosporidium hominis
KNKKKSKKHNIE

SEQ ID NO: 2148516 - protein, 8 aa, Cryptosporidium hominis
KNKKNKAL

SEQ ID NO: 2148517 - protein, 8 aa, Cryptosporidium hominis
KNKKNSFQ

SEQ ID NO: 2148518 - protein, 7 aa, Cryptosporidium hominis
KNKKTGI

SEQ ID NO: 2148519 - protein, 4 aa, Cryptosporidium hominis
KNKN

SEQ ID NO: 2148520 - protein, 10 aa, Cryptosporidium hominis
KNKNEKSTGI

SEQ ID NO: 2148521 - protein, 6 aa, Cryptosporidium hominis
KNKNER

SEQ ID NO: 2148522 - protein, 12 aa, Cryptosporidium hominis
KNKNKKSIAESD

SEQ ID NO: 2148523 - protein, 13 aa, Cryptosporidium hominis
KNKNNSESVTNEQ

SEQ ID NO: 2148524 - protein, 11 aa, Cryptosporidium hominis
KNKNPGQNSID

SEQ ID NO: 2148525 - protein, 6 aa, Cryptosporidium hominis
KNKNQS

SEQ ID NO: 2148526 - protein, 8 aa, Cryptosporidium hominis
KNKQNERI

SEQ ID NO: 2148527 - protein, 8 aa, Cryptosporidium hominis
KNKQTEKI

SEQ ID NO: 2148528 - protein, 12 aa, Cryptosporidium hominis
KNKRKKGKKVDS

SEQ ID NO: 2148529 - protein, 18 aa, Cryptosporidium hominis
KNKRQAYGVSTKAGKFLK

SEQ ID NO: 2148530 - protein, 17 aa, Cryptosporidium hominis
KNKSASSISNNSSNKRI

SEQ ID NO: 2148531 - protein, 13 aa, Cryptosporidium hominis
KNKSDSEDDLETD

SEQ ID NO: 2148532 - protein, 26 aa, Cryptosporidium hominis
KNKSQKGFEQDENELRSNSNSPSMNS

SEQ ID NO: 2148533 - protein, 5 aa, Cryptosporidium hominis
KNKSR

SEQ ID NO: 2148534 - protein, 12 aa, Cryptosporidium hominis
KNKSYTNSTFSS

SEQ ID NO: 2148535 - protein, 4 aa, Cryptosporidium hominis
KNKT

SEQ ID NO: 2148536 - protein, 13 aa, Cryptosporidium hominis
KNKTLQNDQLESS

SEQ ID NO: 2148537 - protein, 10 aa, Cryptosporidium hominis
KNKTTQFDKD

SEQ ID NO: 2148538 - protein, 13 aa, Cryptosporidium hominis
KNKTVDSNNQATT

SEQ ID NO: 2148539 - protein, 10 aa, Cryptosporidium hominis
KNKVNNKSIT

SEQ ID NO: 2148540 - protein, 8 aa, Cryptosporidium hominis
KNKVQKNE

SEQ ID NO: 2148541 - protein, 6 aa, Cryptosporidium hominis
KNKVSS

SEQ ID NO: 2148542 - protein, 6 aa, Cryptosporidium hominis
KNKYGR

SEQ ID NO: 2148543 - protein, 19 aa, Cryptosporidium hominis
KNLDEGSELSDSDNETESN

SEQ ID NO: 2148544 - protein, 5 aa, Cryptosporidium hominis
KNLDG

SEQ ID NO: 2148545 - protein, 6 aa, Cryptosporidium hominis
KNLEPK

SEQ ID NO: 2148546 - protein, 20 aa, Cryptosporidium hominis
KNLGSERSVQKNKTNNDLDT

SEQ ID NO: 2148547 - protein, 10 aa, Cryptosporidium hominis
KNLKESRRKR

SEQ ID NO: 2148548 - protein, 5 aa, Cryptosporidium hominis
KNLKS

SEQ ID NO: 2148549 - protein, 9 aa, Cryptosporidium hominis
KNLKSQIKS

SEQ ID NO: 2148550 - protein, 10 aa, Cryptosporidium hominis
KNLQTEKSTR

SEQ ID NO: 2148551 - protein, 4 aa, Cryptosporidium hominis
KNLR

SEQ ID NO: 2148552 - protein, 20 aa, Cryptosporidium hominis
KNLSSADNVDISSSKKSFFN

SEQ ID NO: 2148553 - protein, 5 aa, Cryptosporidium hominis
KNMET

SEQ ID NO: 2148554 - protein, 13 aa, Cryptosporidium hominis
KNMRDGSGLGVEG

SEQ ID NO: 2148555 - protein, 5 aa, Cryptosporidium hominis
KNNDQ

SEQ ID NO: 2148556 - protein, 7 aa, Cryptosporidium hominis
KNNENRI

SEQ ID NO: 2148557 - protein, 12 aa, Cryptosporidium hominis
KNNENSNTSNFF

SEQ ID NO: 2148558 - protein, 9 aa, Cryptosporidium hominis
KNNERNGKN

SEQ ID NO: 2148559 - protein, 8 aa, Cryptosporidium hominis
KNNETDLE

SEQ ID NO: 2148560 - protein, 14 aa, Cryptosporidium hominis
KNNFDSEDSAEYAS

SEQ ID NO: 2148561 - protein, 11 aa, Cryptosporidium hominis
KNNGDPKEERP

SEQ ID NO: 2148562 - protein, 8 aa, Cryptosporidium hominis
KNNGENCN

SEQ ID NO: 2148563 - protein, 6 aa, Cryptosporidium hominis
KNNGKQ

SEQ ID NO: 2148564 - protein, 7 aa, Cryptosporidium hominis
KNNGKYI

SEQ ID NO: 2148565 - protein, 4 aa, Cryptosporidium hominis
KNNI

SEQ ID NO: 2148566 - protein, 6 aa, Cryptosporidium hominis
KNNIKS

SEQ ID NO: 2148567 - protein, 20 aa, Cryptosporidium hominis
KNNKERKVTESSQKCSERIE

SEQ ID NO: 2148568 - protein, 8 aa, Cryptosporidium hominis
KNNKGKDQ

SEQ ID NO: 2148569 - protein, 12 aa, Cryptosporidium hominis
KNNKKNGHFSTG

SEQ ID NO: 2148570 - protein, 6 aa, Cryptosporidium hominis
KNNKTF

SEQ ID NO: 2148571 - protein, 4 aa, Cryptosporidium hominis
KNNL

SEQ ID NO: 2148572 - protein, 12 aa, Cryptosporidium hominis
KNNLDSSSQDIA

SEQ ID NO: 2148573 - protein, 6 aa, Cryptosporidium hominis
KNNLVP

SEQ ID NO: 2148574 - protein, 22 aa, Cryptosporidium hominis
KNNNGTKNEDYDENDNEDDDED

SEQ ID NO: 2148575 - protein, 30 aa, Cryptosporidium hominis
KNNNLKEEKRSEDKDADDKGLDVNTDSDSE

SEQ ID NO: 2148576 - protein, 5 aa, Cryptosporidium hominis
KNNNN

SEQ ID NO: 2148577 - protein, 10 aa, Cryptosporidium hominis
KNNNNNNNIN

SEQ ID NO: 2148578 - protein, 7 aa, Cryptosporidium hominis
KNNNNRE

SEQ ID NO: 2148579 - protein, 8 aa, Cryptosporidium hominis
KNNNSNLN

SEQ ID NO: 2148580 - protein, 10 aa, Cryptosporidium hominis
KNNPEIQKQP

SEQ ID NO: 2148581 - protein, 8 aa, Cryptosporidium hominis
KNNPKDRR

SEQ ID NO: 2148582 - protein, 9 aa, Cryptosporidium hominis
KNNPNNESQ

SEQ ID NO: 2148583 - protein, 5 aa, Cryptosporidium hominis
KNNPS

SEQ ID NO: 2148584 - protein, 11 aa, Cryptosporidium hominis
KNNQKNIKDYE

SEQ ID NO: 2148585 - protein, 11 aa, Cryptosporidium hominis
KNNQSKKQNVT

SEQ ID NO: 2148586 - protein, 9 aa, Cryptosporidium hominis
KNNQSPDSD

SEQ ID NO: 2148587 - protein, 13 aa, Cryptosporidium hominis
KNNQVSRAHRNIM

SEQ ID NO: 2148588 - protein, 4 aa, Cryptosporidium hominis
KNNR

SEQ ID NO: 2148589 - protein, 42 aa, Cryptosporidium hominis
KNNRDVCSAKSKPRADNTNISKKVKSKVKRVSGNDQEKKSNA

SEQ ID NO: 2148590 - protein, 4 aa, Cryptosporidium hominis
KNNS

SEQ ID NO: 2148591 - protein, 8 aa, Cryptosporidium hominis
KNNSAELN

SEQ ID NO: 2148592 - protein, 8 aa, Cryptosporidium hominis
KNNSDGKT

SEQ ID NO: 2148593 - protein, 14 aa, Cryptosporidium hominis
KNNSIRNNSDLQNQ

SEQ ID NO: 2148594 - protein, 30 aa, Cryptosporidium hominis
KNNSISSTITRKQEDQFTAHSNSPPNPLLT

SEQ ID NO: 2148595 - protein, 17 aa, Cryptosporidium hominis
KNNSNASHSCNSNMTGG

SEQ ID NO: 2148596 - protein, 7 aa, Cryptosporidium hominis
KNNSNLV

SEQ ID NO: 2148597 - protein, 18 aa, Cryptosporidium hominis
KNNSQDESKIGKDSLISE

SEQ ID NO: 2148598 - protein, 8 aa, Cryptosporidium hominis
KNNSQDLK

SEQ ID NO: 2148599 - protein, 6 aa, Cryptosporidium hominis
KNNSQF

SEQ ID NO: 2148600 - protein, 14 aa, Cryptosporidium hominis
KNNSSIERINYYRL

SEQ ID NO: 2148601 - protein, 41 aa, Cryptosporidium hominis
KNNTEDSSQTVKTSPSIKRGYSSFRNDSEHSDSESDLKSSE

SEQ ID NO: 2148602 - protein, 5 aa, Cryptosporidium hominis
KNNTN

SEQ ID NO: 2148603 - protein, 9 aa, Cryptosporidium hominis
KNNTSRIQS

SEQ ID NO: 2148604 - protein, 11 aa, Cryptosporidium hominis
KNNVSERANNI

SEQ ID NO: 2148605 - protein, 14 aa, Cryptosporidium hominis
KNNVSNDDVDLDEE

SEQ ID NO: 2148606 - protein, 8 aa, Cryptosporidium hominis
KNNYSSKT

SEQ ID NO: 2148607 - protein, 6 aa, Cryptosporidium hominis
KNPAEG

SEQ ID NO: 2148608 - protein, 5 aa, Cryptosporidium hominis
KNPDI

SEQ ID NO: 2148609 - protein, 9 aa, Cryptosporidium hominis
KNPDPTKPL

SEQ ID NO: 2148610 - protein, 9 aa, Cryptosporidium hominis
KNPEGINRD

SEQ ID NO: 2148611 - protein, 6 aa, Cryptosporidium hominis
KNPEIS

SEQ ID NO: 2148612 - protein, 6 aa, Cryptosporidium hominis
KNPELN

SEQ ID NO: 2148613 - protein, 6 aa, Cryptosporidium hominis
KNPFND

SEQ ID NO: 2148614 - protein, 6 aa, Cryptosporidium hominis
KNPFSE

SEQ ID NO: 2148615 - protein, 7 aa, Cryptosporidium hominis
KNPGLVE

SEQ ID NO: 2148616 - protein, 10 aa, Cryptosporidium hominis
KNPGSNNTIN

SEQ ID NO: 2148617 - protein, 10 aa, Cryptosporidium hominis
KNPKDSEKNV

SEQ ID NO: 2148618 - protein, 36 aa, Cryptosporidium hominis
KNPKSGDDAESSSGSESDPNYDLESESDVNLDSDKS

SEQ ID NO: 2148619 - protein, 6 aa, Cryptosporidium hominis
KNPNGF

SEQ ID NO: 2148620 - protein, 8 aa, Cryptosporidium hominis
KNPNPGFM

SEQ ID NO: 2148621 - protein, 64 aa, Cryptosporidium hominis
KNPPGGVESTMGSKNKKERRERDKDRSSEGCNNSNGSTAADNEKPSKHKSKKASKKSSKKSPHE

SEQ ID NO: 2148622 - protein, 7 aa, Cryptosporidium hominis
KNPPLTR

SEQ ID NO: 2148623 - protein, 11 aa, Cryptosporidium hominis
KNPPSAENRWD

SEQ ID NO: 2148624 - protein, 25 aa, Cryptosporidium hominis
KNPQWEETIGKNSSISLSNSTSRPL

SEQ ID NO: 2148625 - protein, 7 aa, Cryptosporidium hominis
KNPRERI

SEQ ID NO: 2148626 - protein, 7 aa, Cryptosporidium hominis
KNPSERI

SEQ ID NO: 2148627 - protein, 46 aa, Cryptosporidium hominis
KNPSIISSKSEQKQGSLDSLKSSNFYQSSPIDENHISSNENTETQE

SEQ ID NO: 2148628 - protein, 7 aa, Cryptosporidium hominis
KNPSTLA

SEQ ID NO: 2148629 - protein, 9 aa, Cryptosporidium hominis
KNPTTSGGK

SEQ ID NO: 2148630 - protein, 16 aa, Cryptosporidium hominis
KNPVKSSTGNHTPNIE

SEQ ID NO: 2148631 - protein, 6 aa, Cryptosporidium hominis
KNPVPE

SEQ ID NO: 2148632 - protein, 7 aa, Cryptosporidium hominis
KNQEGDI

SEQ ID NO: 2148633 - protein, 5 aa, Cryptosporidium hominis
KNQEI

SEQ ID NO: 2148634 - protein, 4 aa, Cryptosporidium hominis
KNQF

SEQ ID NO: 2148635 - protein, 5 aa, Cryptosporidium hominis
KNQGG

SEQ ID NO: 2148636 - protein, 17 aa, Cryptosporidium hominis
KNQKDKPSKVDDHDEIN

SEQ ID NO: 2148637 - protein, 5 aa, Cryptosporidium hominis
KNQKE

SEQ ID NO: 2148638 - protein, 10 aa, Cryptosporidium hominis
KNQKKTRSGI

SEQ ID NO: 2148639 - protein, 19 aa, Cryptosporidium hominis
KNQKRSAETSSSRDRQRIS

SEQ ID NO: 2148640 - protein, 20 aa, Cryptosporidium hominis
KNQNEKKNLSTNKSNGQTIR

SEQ ID NO: 2148641 - protein, 14 aa, Cryptosporidium hominis
KNQNNINDSETHQA

SEQ ID NO: 2148642 - protein, 10 aa, Cryptosporidium hominis
KNQNNLDSSI

SEQ ID NO: 2148643 - protein, 12 aa, Cryptosporidium hominis
KNQNSKSNTSND

SEQ ID NO: 2148644 - protein, 33 aa, Cryptosporidium hominis
KNQQEASIPLTPKSALKSKKDNFVDKSQKLDEE

SEQ ID NO: 2148645 - protein, 20 aa, Cryptosporidium hominis
KNQQNTIITGPRKSAMRDGS

SEQ ID NO: 2148646 - protein, 7 aa, Cryptosporidium hominis
KNQRNEE

SEQ ID NO: 2148647 - protein, 26 aa, Cryptosporidium hominis
KNQSGSEIDQEETPDISEFSKNDGRL

SEQ ID NO: 2148648 - protein, 13 aa, Cryptosporidium hominis
KNQSSSFSPPNQQ

SEQ ID NO: 2148649 - protein, 10 aa, Cryptosporidium hominis
KNQTESREFE

SEQ ID NO: 2148650 - protein, 6 aa, Cryptosporidium hominis
KNQTIE

SEQ ID NO: 2148651 - protein, 14 aa, Cryptosporidium hominis
KNRDAQEKQGIDDN

SEQ ID NO: 2148652 - protein, 6 aa, Cryptosporidium hominis
KNRDSA

SEQ ID NO: 2148653 - protein, 8 aa, Cryptosporidium hominis
KNREREKG

SEQ ID NO: 2148654 - protein, 5 aa, Cryptosporidium hominis
KNRGV

SEQ ID NO: 2148655 - protein, 8 aa, Cryptosporidium hominis
KNRKENTL

SEQ ID NO: 2148656 - protein, 10 aa, Cryptosporidium hominis
KNRNEAYYTQ

SEQ ID NO: 2148657 - protein, 7 aa, Cryptosporidium hominis
KNRNNGV

SEQ ID NO: 2148658 - protein, 4 aa, Cryptosporidium hominis
KNRP

SEQ ID NO: 2148659 - protein, 7 aa, Cryptosporidium hominis
KNRPESG

SEQ ID NO: 2148660 - protein, 5 aa, Cryptosporidium hominis
KNRPT

SEQ ID NO: 2148661 - protein, 11 aa, Cryptosporidium hominis
KNRRDNFNPRS

SEQ ID NO: 2148662 - protein, 5 aa, Cryptosporidium hominis
KNRRW

SEQ ID NO: 2148663 - protein, 18 aa, Cryptosporidium hominis
KNRSEASTDCNERSSRSH

SEQ ID NO: 2148664 - protein, 7 aa, Cryptosporidium hominis
KNRTLND

SEQ ID NO: 2148665 - protein, 22 aa, Cryptosporidium hominis
KNSAIAGNNKSNSKELNSSINE

SEQ ID NO: 2148666 - protein, 8 aa, Cryptosporidium hominis
KNSDSECN

SEQ ID NO: 2148667 - protein, 13 aa, Cryptosporidium hominis
KNSEDFNKPQKCN

SEQ ID NO: 2148668 - protein, 5 aa, Cryptosporidium hominis
KNSEM

SEQ ID NO: 2148669 - protein, 5 aa, Cryptosporidium hominis
KNSEN

SEQ ID NO: 2148670 - protein, 41 aa, Cryptosporidium hominis
KNSGGGRGAGSGGGRGGANNRPAKNNSSTAFQGTSTTFDDS

SEQ ID NO: 2148671 - protein, 19 aa, Cryptosporidium hominis
KNSGKKSKSCLKSSNYCKN

SEQ ID NO: 2148672 - protein, 23 aa, Cryptosporidium hominis
KNSGKTKARSNYSNVNGNSSPYQ

SEQ ID NO: 2148673 - protein, 6 aa, Cryptosporidium hominis
KNSGNS

SEQ ID NO: 2148674 - protein, 16 aa, Cryptosporidium hominis
KNSHLSSSSPTSPNAI

SEQ ID NO: 2148675 - protein, 10 aa, Cryptosporidium hominis
KNSHNSMNTQ

SEQ ID NO: 2148676 - protein, 7 aa, Cryptosporidium hominis
KNSIDTL

SEQ ID NO: 2148677 - protein, 14 aa, Cryptosporidium hominis
KNSIEKSPSSSNFT

SEQ ID NO: 2148678 - protein, 12 aa, Cryptosporidium hominis
KNSIESDHSNNS

SEQ ID NO: 2148679 - protein, 8 aa, Cryptosporidium hominis
KNSIPSSN

SEQ ID NO: 2148680 - protein, 8 aa, Cryptosporidium hominis
KNSISESI

SEQ ID NO: 2148681 - protein, 5 aa, Cryptosporidium hominis
KNSKK

SEQ ID NO: 2148682 - protein, 14 aa, Cryptosporidium hominis
KNSKNKEKDPIKDY

SEQ ID NO: 2148683 - protein, 6 aa, Cryptosporidium hominis
KNSLEE

SEQ ID NO: 2148684 - protein, 9 aa, Cryptosporidium hominis
KNSLESEDE

SEQ ID NO: 2148685 - protein, 5 aa, Cryptosporidium hominis
KNSLG

SEQ ID NO: 2148686 - protein, 4 aa, Cryptosporidium hominis
KNSN

SEQ ID NO: 2148687 - protein, 6 aa, Cryptosporidium hominis
KNSNEG

SEQ ID NO: 2148688 - protein, 12 aa, Cryptosporidium hominis
KNSNISTEDHSL

SEQ ID NO: 2148689 - protein, 14 aa, Cryptosporidium hominis
KNSNNQNNSNNQNI

SEQ ID NO: 2148690 - protein, 9 aa, Cryptosporidium hominis
KNSNSARHV

SEQ ID NO: 2148691 - protein, 18 aa, Cryptosporidium hominis
KNSNSGQKKIRKFISRNL

SEQ ID NO: 2148692 - protein, 18 aa, Cryptosporidium hominis
KNSNSKLGIKNNEKNLVQ

SEQ ID NO: 2148693 - protein, 7 aa, Cryptosporidium hominis
KNSNSPV

SEQ ID NO: 2148694 - protein, 7 aa, Cryptosporidium hominis
KNSNYQQ

SEQ ID NO: 2148695 - protein, 17 aa, Cryptosporidium hominis
KNSPSPRQRNSLTTIPG

SEQ ID NO: 2148696 - protein, 9 aa, Cryptosporidium hominis
KNSQKTVKN

SEQ ID NO: 2148697 - protein, 24 aa, Cryptosporidium hominis
KNSQNSKGMDNSSTPQIIRSRYSD

SEQ ID NO: 2148698 - protein, 4 aa, Cryptosporidium hominis
KNSR

SEQ ID NO: 2148699 - protein, 9 aa, Cryptosporidium hominis
KNSSEANRV

SEQ ID NO: 2148700 - protein, 8 aa, Cryptosporidium hominis
KNSSEMNQ

SEQ ID NO: 2148701 - protein, 10 aa, Cryptosporidium hominis
KNSSKKLEIT

SEQ ID NO: 2148702 - protein, 5 aa, Cryptosporidium hominis
KNSSL

SEQ ID NO: 2148703 - protein, 9 aa, Cryptosporidium hominis
KNSSSSMIK

SEQ ID NO: 2148704 - protein, 13 aa, Cryptosporidium hominis
KNSSTGFNSSLSD

SEQ ID NO: 2148705 - protein, 15 aa, Cryptosporidium hominis
KNSSTISHQGLFKLT

SEQ ID NO: 2148706 - protein, 6 aa, Cryptosporidium hominis
KNSTDV

SEQ ID NO: 2148707 - protein, 6 aa, Cryptosporidium hominis
KNSTED

SEQ ID NO: 2148708 - protein, 9 aa, Cryptosporidium hominis
KNSTGTKSS

SEQ ID NO: 2148709 - protein, 7 aa, Cryptosporidium hominis
KNSTIES

SEQ ID NO: 2148710 - protein, 7 aa, Cryptosporidium hominis
KNSTNKV

SEQ ID NO: 2148711 - protein, 16 aa, Cryptosporidium hominis
KNSTSIPHNKKTGECC

SEQ ID NO: 2148712 - protein, 9 aa, Cryptosporidium hominis
KNSTTNKNK

SEQ ID NO: 2148713 - protein, 15 aa, Cryptosporidium hominis
KNSTVNDSDNIEIEE

SEQ ID NO: 2148714 - protein, 15 aa, Cryptosporidium hominis
KNSTYSTKTKTEELP

SEQ ID NO: 2148715 - protein, 6 aa, Cryptosporidium hominis
KNSVPS

SEQ ID NO: 2148716 - protein, 7 aa, Cryptosporidium hominis
KNSVSNL

SEQ ID NO: 2148717 - protein, 8 aa, Cryptosporidium hominis
KNSYKNIE

SEQ ID NO: 2148718 - protein, 14 aa, Cryptosporidium hominis
KNTALETDEEVKME

SEQ ID NO: 2148719 - protein, 29 aa, Cryptosporidium hominis
KNTANKKNASKSSKNAKDKVDKETELANK

SEQ ID NO: 2148720 - protein, 19 aa, Cryptosporidium hominis
KNTEGGSTANCSTAELSPV

SEQ ID NO: 2148721 - protein, 8 aa, Cryptosporidium hominis
KNTENENI

SEQ ID NO: 2148722 - protein, 8 aa, Cryptosporidium hominis
KNTEPPVL

SEQ ID NO: 2148723 - protein, 5 aa, Cryptosporidium hominis
KNTEQ

SEQ ID NO: 2148724 - protein, 7 aa, Cryptosporidium hominis
KNTERTY

SEQ ID NO: 2148725 - protein, 39 aa, Cryptosporidium hominis
KNTEYGNRPSHGYNYDHGNSNYNDYERDSYNHGDRNWNN

SEQ ID NO: 2148726 - protein, 27 aa, Cryptosporidium hominis
KNTGIKQSNNSPNKKSIQSNSNNSYKS

SEQ ID NO: 2148727 - protein, 5 aa, Cryptosporidium hominis
KNTGL

SEQ ID NO: 2148728 - protein, 20 aa, Cryptosporidium hominis
KNTKLSSKIGSQSSLNQTNY

SEQ ID NO: 2148729 - protein, 7 aa, Cryptosporidium hominis
KNTKNVR

SEQ ID NO: 2148730 - protein, 8 aa, Cryptosporidium hominis
KNTKSIEE

SEQ ID NO: 2148731 - protein, 33 aa, Cryptosporidium hominis
KNTNDNNNINCKSTENCSKNASSSSSVLNETTN

SEQ ID NO: 2148732 - protein, 8 aa, Cryptosporidium hominis
KNTPKDYI

SEQ ID NO: 2148733 - protein, 16 aa, Cryptosporidium hominis
KNTPKIPKNQHENNYS

SEQ ID NO: 2148734 - protein, 17 aa, Cryptosporidium hominis
KNTRKKVQELNTTKDKN

SEQ ID NO: 2148735 - protein, 7 aa, Cryptosporidium hominis
KNTRTKP

SEQ ID NO: 2148736 - protein, 12 aa, Cryptosporidium hominis
KNTSDVRETPSG

SEQ ID NO: 2148737 - protein, 6 aa, Cryptosporidium hominis
KNTSQR

SEQ ID NO: 2148738 - protein, 8 aa, Cryptosporidium hominis
KNTSTQKV

SEQ ID NO: 2148739 - protein, 7 aa, Cryptosporidium hominis
KNTSTST

SEQ ID NO: 2148740 - protein, 8 aa, Cryptosporidium hominis
KNTTEVSD

SEQ ID NO: 2148741 - protein, 5 aa, Cryptosporidium hominis
KNTTR

SEQ ID NO: 2148742 - protein, 8 aa, Cryptosporidium hominis
KNTTSKDK

SEQ ID NO: 2148743 - protein, 8 aa, Cryptosporidium hominis
KNTWPDNS

SEQ ID NO: 2148744 - protein, 6 aa, Cryptosporidium hominis
KNVENY

SEQ ID NO: 2148745 - protein, 13 aa, Cryptosporidium hominis
KNVESNMKSSFTG

SEQ ID NO: 2148746 - protein, 4 aa, Cryptosporidium hominis
KNVK

SEQ ID NO: 2148747 - protein, 13 aa, Cryptosporidium hominis
KNVKLDRKGQRRL

SEQ ID NO: 2148748 - protein, 4 aa, Cryptosporidium hominis
KNVP

SEQ ID NO: 2148749 - protein, 9 aa, Cryptosporidium hominis
KNVSDRDSL

SEQ ID NO: 2148750 - protein, 13 aa, Cryptosporidium hominis
KNVSESPKDQQIE

SEQ ID NO: 2148751 - protein, 17 aa, Cryptosporidium hominis
KNVSSRSGGNVSGTVGG

SEQ ID NO: 2148752 - protein, 18 aa, Cryptosporidium hominis
KNVTDKNSTMDKKNIGST

SEQ ID NO: 2148753 - protein, 18 aa, Cryptosporidium hominis
KNVTNHENSEIKREYSTS

SEQ ID NO: 2148754 - protein, 4 aa, Cryptosporidium hominis
KNWE

SEQ ID NO: 2148755 - protein, 7 aa, Cryptosporidium hominis
KNWNKKA

SEQ ID NO: 2148756 - protein, 18 aa, Cryptosporidium hominis
KNYEKKQQEKKISQVNQQ

SEQ ID NO: 2148757 - protein, 15 aa, Cryptosporidium hominis
KNYENIDKGRSPQAP

SEQ ID NO: 2148758 - protein, 5 aa, Cryptosporidium hominis
KNYGE

SEQ ID NO: 2148759 - protein, 6 aa, Cryptosporidium hominis
KNYHEK

SEQ ID NO: 2148760 - protein, 22 aa, Cryptosporidium hominis
KNYNKNMRSQFKSDTSNKPSKI

SEQ ID NO: 2148761 - protein, 24 aa, Cryptosporidium hominis
KNYPAAKKEYDEAIKRNPSDSRLY

SEQ ID NO: 2148762 - protein, 6 aa, Cryptosporidium hominis
KNYSSS

SEQ ID NO: 2148763 - protein, 25 aa, Cryptosporidium hominis
KNYSSSNLTNSQKKISYSANQENSS

SEQ ID NO: 2148764 - protein, 28 aa, Cryptosporidium hominis
KNYTTQSSSFTSNSSTQDNNNNLNSITG

SEQ ID NO: 2148765 - protein, 17 aa, Cryptosporidium hominis
KPAITKEQPTNNAPKAV

SEQ ID NO: 2148766 - protein, 5 aa, Cryptosporidium hominis
KPALP

SEQ ID NO: 2148767 - protein, 8 aa, Cryptosporidium hominis
KPANPSSH

SEQ ID NO: 2148768 - protein, 9 aa, Cryptosporidium hominis
KPAPGHQKS

SEQ ID NO: 2148769 - protein, 17 aa, Cryptosporidium hominis
KPAPIDGDENNTPPNYH

SEQ ID NO: 2148770 - protein, 5 aa, Cryptosporidium hominis
KPASI

SEQ ID NO: 2148771 - protein, 14 aa, Cryptosporidium hominis
KPAYSRVDKQLNNL

SEQ ID NO: 2148772 - protein, 6 aa, Cryptosporidium hominis
KPCGET

SEQ ID NO: 2148773 - protein, 25 aa, Cryptosporidium hominis
KPCNTPKLSNEDLEKLSKKSTRPGN

SEQ ID NO: 2148774 - protein, 9 aa, Cryptosporidium hominis
KPCSISPTT

SEQ ID NO: 2148775 - protein, 4 aa, Cryptosporidium hominis
KPCT

SEQ ID NO: 2148776 - protein, 9 aa, Cryptosporidium hominis
KPDDEDSVS

SEQ ID NO: 2148777 - protein, 6 aa, Cryptosporidium hominis
KPDESP

SEQ ID NO: 2148778 - protein, 6 aa, Cryptosporidium hominis
KPDQPL

SEQ ID NO: 2148779 - protein, 11 aa, Cryptosporidium hominis
KPDSNGDISKQ

SEQ ID NO: 2148780 - protein, 6 aa, Cryptosporidium hominis
KPDSSV

SEQ ID NO: 2148781 - protein, 7 aa, Cryptosporidium hominis
KPDVTYS

SEQ ID NO: 2148782 - protein, 7 aa, Cryptosporidium hominis
KPEIPGE

SEQ ID NO: 2148783 - protein, 4 aa, Cryptosporidium hominis
KPEN

SEQ ID NO: 2148784 - protein, 8 aa, Cryptosporidium hominis
KPENDGYS

SEQ ID NO: 2148785 - protein, 9 aa, Cryptosporidium hominis
KPENSQNTK

SEQ ID NO: 2148786 - protein, 7 aa, Cryptosporidium hominis
KPERATY

SEQ ID NO: 2148787 - protein, 12 aa, Cryptosporidium hominis
KPESKSQPIDTS

SEQ ID NO: 2148788 - protein, 10 aa, Cryptosporidium hominis
KPESSRNSSL

SEQ ID NO: 2148789 - protein, 6 aa, Cryptosporidium hominis
KPFPEN

SEQ ID NO: 2148790 - protein, 5 aa, Cryptosporidium hominis
KPFQS

SEQ ID NO: 2148791 - protein, 8 aa, Cryptosporidium hominis
KPFTEESK

SEQ ID NO: 2148792 - protein, 4 aa, Cryptosporidium hominis
KPGC

SEQ ID NO: 2148793 - protein, 5 aa, Cryptosporidium hominis
KPGCS

SEQ ID NO: 2148794 - protein, 8 aa, Cryptosporidium hominis
KPGGEQSY

SEQ ID NO: 2148795 - protein, 5 aa, Cryptosporidium hominis
KPGKN

SEQ ID NO: 2148796 - protein, 4 aa, Cryptosporidium hominis
KPGN

SEQ ID NO: 2148797 - protein, 7 aa, Cryptosporidium hominis
KPGNTHW

SEQ ID NO: 2148798 - protein, 6 aa, Cryptosporidium hominis
KPGNVN

SEQ ID NO: 2148799 - protein, 9 aa, Cryptosporidium hominis
KPGSFRDDE

SEQ ID NO: 2148800 - protein, 8 aa, Cryptosporidium hominis
KPGSPVQI

SEQ ID NO: 2148801 - protein, 41 aa, Cryptosporidium hominis
KPGSTMGGKGKALESLNSRESSGEPNKITVKGSSDDPNSLN

SEQ ID NO: 2148802 - protein, 7 aa, Cryptosporidium hominis
KPGTGKT

SEQ ID NO: 2148803 - protein, 9 aa, Cryptosporidium hominis
KPHSGSPAN

SEQ ID NO: 2148804 - protein, 13 aa, Cryptosporidium hominis
KPIAESKPNISLS

SEQ ID NO: 2148805 - protein, 11 aa, Cryptosporidium hominis
KPIEGAQKSGF

SEQ ID NO: 2148806 - protein, 5 aa, Cryptosporidium hominis
KPIGE

SEQ ID NO: 2148807 - protein, 8 aa, Cryptosporidium hominis
KPISDSGN

SEQ ID NO: 2148808 - protein, 5 aa, Cryptosporidium hominis
KPIST

SEQ ID NO: 2148809 - protein, 11 aa, Cryptosporidium hominis
KPITRSMTSSV

SEQ ID NO: 2148810 - protein, 6 aa, Cryptosporidium hominis
KPITTY

SEQ ID NO: 2148811 - protein, 33 aa, Cryptosporidium hominis
KPIYSDKSRELQDHEKNDNCSGESCKVNSKQIA

SEQ ID NO: 2148812 - protein, 5 aa, Cryptosporidium hominis
KPKAD

SEQ ID NO: 2148813 - protein, 12 aa, Cryptosporidium hominis
KPKDFVWKNILL

SEQ ID NO: 2148814 - protein, 6 aa, Cryptosporidium hominis
KPKEIN

SEQ ID NO: 2148815 - protein, 5 aa, Cryptosporidium hominis
KPKEL

SEQ ID NO: 2148816 - protein, 7 aa, Cryptosporidium hominis
KPKGEIK

SEQ ID NO: 2148817 - protein, 8 aa, Cryptosporidium hominis
KPKGNQAI

SEQ ID NO: 2148818 - protein, 9 aa, Cryptosporidium hominis
KPKGQIPDY

SEQ ID NO: 2148819 - protein, 6 aa, Cryptosporidium hominis
KPKIKN

SEQ ID NO: 2148820 - protein, 12 aa, Cryptosporidium hominis
KPKIQSSKSSYM

SEQ ID NO: 2148821 - protein, 5 aa, Cryptosporidium hominis
KPKKG

SEQ ID NO: 2148822 - protein, 9 aa, Cryptosporidium hominis
KPKKIKNVT

SEQ ID NO: 2148823 - protein, 8 aa, Cryptosporidium hominis
KPKKRGFS

SEQ ID NO: 2148824 - protein, 6 aa, Cryptosporidium hominis
KPKKRV

SEQ ID NO: 2148825 - protein, 11 aa, Cryptosporidium hominis
KPKSGSYQRYP

SEQ ID NO: 2148826 - protein, 8 aa, Cryptosporidium hominis
KPKSLSGE

SEQ ID NO: 2148827 - protein, 11 aa, Cryptosporidium hominis
KPKSTNANEDG

SEQ ID NO: 2148828 - protein, 7 aa, Cryptosporidium hominis
KPKVSEN

SEQ ID NO: 2148829 - protein, 9 aa, Cryptosporidium hominis
KPLGETEID

SEQ ID NO: 2148830 - protein, 5 aa, Cryptosporidium hominis
KPLGS

SEQ ID NO: 2148831 - protein, 5 aa, Cryptosporidium hominis
KPLKQ

SEQ ID NO: 2148832 - protein, 33 aa, Cryptosporidium hominis
KPLNIGDRSINKEKSLANKKDQKQTETTGSESR

SEQ ID NO: 2148833 - protein, 6 aa, Cryptosporidium hominis
KPLRTG

SEQ ID NO: 2148834 - protein, 8 aa, Cryptosporidium hominis
KPLSRKEL

SEQ ID NO: 2148835 - protein, 5 aa, Cryptosporidium hominis
KPLSY

SEQ ID NO: 2148836 - protein, 6 aa, Cryptosporidium hominis
KPLSYE

SEQ ID NO: 2148837 - protein, 7 aa, Cryptosporidium hominis
KPLTKQK

SEQ ID NO: 2148838 - protein, 6 aa, Cryptosporidium hominis
KPLTTK

SEQ ID NO: 2148839 - protein, 8 aa, Cryptosporidium hominis
KPLYDSTC

SEQ ID NO: 2148840 - protein, 5 aa, Cryptosporidium hominis
KPMDA

SEQ ID NO: 2148841 - protein, 11 aa, Cryptosporidium hominis
KPMNPRPELNK

SEQ ID NO: 2148842 - protein, 9 aa, Cryptosporidium hominis
KPNAHNSEI

SEQ ID NO: 2148843 - protein, 30 aa, Cryptosporidium hominis
KPNAHSSASESKKDTKVKNDTQESSSLKHE

SEQ ID NO: 2148844 - protein, 7 aa, Cryptosporidium hominis
KPNATTQ

SEQ ID NO: 2148845 - protein, 5 aa, Cryptosporidium hominis
KPNEN

SEQ ID NO: 2148846 - protein, 9 aa, Cryptosporidium hominis
KPNENITNL

SEQ ID NO: 2148847 - protein, 6 aa, Cryptosporidium hominis
KPNEPC

SEQ ID NO: 2148848 - protein, 4 aa, Cryptosporidium hominis
KPNL

SEQ ID NO: 2148849 - protein, 4 aa, Cryptosporidium hominis
KPNN

SEQ ID NO: 2148850 - protein, 5 aa, Cryptosporidium hominis
KPNNY

SEQ ID NO: 2148851 - protein, 7 aa, Cryptosporidium hominis
KPNSMST

SEQ ID NO: 2148852 - protein, 29 aa, Cryptosporidium hominis
KPNSNIKSSKQKKKRSKQSESSDIENSQD

SEQ ID NO: 2148853 - protein, 5 aa, Cryptosporidium hominis
KPNSY

SEQ ID NO: 2148854 - protein, 5 aa, Cryptosporidium hominis
KPNTK

SEQ ID NO: 2148855 - protein, 5 aa, Cryptosporidium hominis
KPNYL

SEQ ID NO: 2148856 - protein, 4 aa, Cryptosporidium hominis
KPPH

SEQ ID NO: 2148857 - protein, 28 aa, Cryptosporidium hominis
KPPPGIGTKPLSDEPSNFENSSRRYPKR

SEQ ID NO: 2148858 - protein, 11 aa, Cryptosporidium hominis
KPPPNNIASTP

SEQ ID NO: 2148859 - protein, 7 aa, Cryptosporidium hominis
KPPSTQA

SEQ ID NO: 2148860 - protein, 5 aa, Cryptosporidium hominis
KPPVA

SEQ ID NO: 2148861 - protein, 5 aa, Cryptosporidium hominis
KPPVK

SEQ ID NO: 2148862 - protein, 22 aa, Cryptosporidium hominis
KPQAENTEQAKPRAPRIGQPKY

SEQ ID NO: 2148863 - protein, 10 aa, Cryptosporidium hominis
KPQEPPADWN

SEQ ID NO: 2148864 - protein, 7 aa, Cryptosporidium hominis
KPQGQGY

SEQ ID NO: 2148865 - protein, 15 aa, Cryptosporidium hominis
KPQGQSERVNPPANT

SEQ ID NO: 2148866 - protein, 12 aa, Cryptosporidium hominis
KPQTISPKFEGS

SEQ ID NO: 2148867 - protein, 20 aa, Cryptosporidium hominis
KPQVGGGGGGTQSGVSGATV

SEQ ID NO: 2148868 - protein, 18 aa, Cryptosporidium hominis
KPQYNRPLPSDGRGPPRK

SEQ ID NO: 2148869 - protein, 30 aa, Cryptosporidium hominis
KPRKNRDTNTIRRTTTLTSRKMGKGLSDRS

SEQ ID NO: 2148870 - protein, 11 aa, Cryptosporidium hominis
KPRNIKDQGQF

SEQ ID NO: 2148871 - protein, 5 aa, Cryptosporidium hominis
KPRRR

SEQ ID NO: 2148872 - protein, 14 aa, Cryptosporidium hominis
KPRRRREGKTDYQA

SEQ ID NO: 2148873 - protein, 7 aa, Cryptosporidium hominis
KPRSTRA

SEQ ID NO: 2148874 - protein, 8 aa, Cryptosporidium hominis
KPSAIQQR

SEQ ID NO: 2148875 - protein, 7 aa, Cryptosporidium hominis
KPSAMSQ

SEQ ID NO: 2148876 - protein, 8 aa, Cryptosporidium hominis
KPSDGGVY

SEQ ID NO: 2148877 - protein, 14 aa, Cryptosporidium hominis
KPSEASTRNNSNDE

SEQ ID NO: 2148878 - protein, 5 aa, Cryptosporidium hominis
KPSEL

SEQ ID NO: 2148879 - protein, 12 aa, Cryptosporidium hominis
KPSETASYSSSV

SEQ ID NO: 2148880 - protein, 7 aa, Cryptosporidium hominis
KPSINKG

SEQ ID NO: 2148881 - protein, 10 aa, Cryptosporidium hominis
KPSINNSANP

SEQ ID NO: 2148882 - protein, 13 aa, Cryptosporidium hominis
KPSLGGGTNQGGL

SEQ ID NO: 2148883 - protein, 12 aa, Cryptosporidium hominis
KPSLGGSELYPG

SEQ ID NO: 2148884 - protein, 28 aa, Cryptosporidium hominis
KPSNRAENKMTFGSEKDLATTLQSSNSE

SEQ ID NO: 2148885 - protein, 7 aa, Cryptosporidium hominis
KPSNSNI

SEQ ID NO: 2148886 - protein, 12 aa, Cryptosporidium hominis
KPSNSRPPSTKN

SEQ ID NO: 2148887 - protein, 5 aa, Cryptosporidium hominis
KPSPY

SEQ ID NO: 2148888 - protein, 5 aa, Cryptosporidium hominis
KPSRI

SEQ ID NO: 2148889 - protein, 7 aa, Cryptosporidium hominis
KPSRITD

SEQ ID NO: 2148890 - protein, 6 aa, Cryptosporidium hominis
KPSVRE

SEQ ID NO: 2148891 - protein, 6 aa, Cryptosporidium hominis
KPTESG

SEQ ID NO: 2148892 - protein, 6 aa, Cryptosporidium hominis
KPTGNF

SEQ ID NO: 2148893 - protein, 8 aa, Cryptosporidium hominis
KPTHSQNN

SEQ ID NO: 2148894 - protein, 9 aa, Cryptosporidium hominis
KPTKAGVSS

SEQ ID NO: 2148895 - protein, 5 aa, Cryptosporidium hominis
KPTLQ

SEQ ID NO: 2148896 - protein, 6 aa, Cryptosporidium hominis
KPTPCD

SEQ ID NO: 2148897 - protein, 5 aa, Cryptosporidium hominis
KPTPI

SEQ ID NO: 2148898 - protein, 6 aa, Cryptosporidium hominis
KPTPLL

SEQ ID NO: 2148899 - protein, 4 aa, Cryptosporidium hominis
KPTR

SEQ ID NO: 2148900 - protein, 9 aa, Cryptosporidium hominis
KPTSENNKF

SEQ ID NO: 2148901 - protein, 7 aa, Cryptosporidium hominis
KPTSYGK

SEQ ID NO: 2148902 - protein, 11 aa, Cryptosporidium hominis
KPTVVTENQDK

SEQ ID NO: 2148903 - protein, 18 aa, Cryptosporidium hominis
KPVEETKYCSNNESSVAS

SEQ ID NO: 2148904 - protein, 12 aa, Cryptosporidium hominis
KPVEFGKGDSDE

SEQ ID NO: 2148905 - protein, 4 aa, Cryptosporidium hominis
KPVG

SEQ ID NO: 2148906 - protein, 14 aa, Cryptosporidium hominis
KPVQSRVDPSQIPR

SEQ ID NO: 2148907 - protein, 14 aa, Cryptosporidium hominis
KPVVATTSGGPRDF

SEQ ID NO: 2148908 - protein, 6 aa, Cryptosporidium hominis
KPVVGN

SEQ ID NO: 2148909 - protein, 8 aa, Cryptosporidium hominis
KPYSGMKS

SEQ ID NO: 2148910 - protein, 4 aa, Cryptosporidium hominis
KPYY

SEQ ID NO: 2148911 - protein, 4 aa, Cryptosporidium hominis
KQAA

SEQ ID NO: 2148912 - protein, 7 aa, Cryptosporidium hominis
KQADELR

SEQ ID NO: 2148913 - protein, 7 aa, Cryptosporidium hominis
KQAEKLP

SEQ ID NO: 2148914 - protein, 6 aa, Cryptosporidium hominis
KQAKDL

SEQ ID NO: 2148915 - protein, 9 aa, Cryptosporidium hominis
KQANTSGVA

SEQ ID NO: 2148916 - protein, 4 aa, Cryptosporidium hominis
KQAQ

SEQ ID NO: 2148917 - protein, 13 aa, Cryptosporidium hominis
KQASELQKDSRLI

SEQ ID NO: 2148918 - protein, 6 aa, Cryptosporidium hominis
KQATCT

SEQ ID NO: 2148919 - protein, 5 aa, Cryptosporidium hominis
KQCKS

SEQ ID NO: 2148920 - protein, 6 aa, Cryptosporidium hominis
KQDGKY

SEQ ID NO: 2148921 - protein, 4 aa, Cryptosporidium hominis
KQDL

SEQ ID NO: 2148922 - protein, 10 aa, Cryptosporidium hominis
KQDPNGNKQR

SEQ ID NO: 2148923 - protein, 8 aa, Cryptosporidium hominis
KQDPSFES

SEQ ID NO: 2148924 - protein, 10 aa, Cryptosporidium hominis
KQDQDELNED

SEQ ID NO: 2148925 - protein, 20 aa, Cryptosporidium hominis
KQDSEPREAQNQHADQKPEL

SEQ ID NO: 2148926 - protein, 9 aa, Cryptosporidium hominis
KQDTHQQGY

SEQ ID NO: 2148927 - protein, 5 aa, Cryptosporidium hominis
KQEEI

SEQ ID NO: 2148928 - protein, 9 aa, Cryptosporidium hominis
KQEESNNNS

SEQ ID NO: 2148929 - protein, 8 aa, Cryptosporidium hominis
KQEGFRAR

SEQ ID NO: 2148930 - protein, 7 aa, Cryptosporidium hominis
KQEHSNA

SEQ ID NO: 2148931 - protein, 9 aa, Cryptosporidium hominis
KQEIQEEKI

SEQ ID NO: 2148932 - protein, 9 aa, Cryptosporidium hominis
KQEKNRNGI

SEQ ID NO: 2148933 - protein, 12 aa, Cryptosporidium hominis
KQEPSERATIEE

SEQ ID NO: 2148934 - protein, 18 aa, Cryptosporidium hominis
KQEPVKSTAGNKENPSSL

SEQ ID NO: 2148935 - protein, 9 aa, Cryptosporidium hominis
KQEQKLETK

SEQ ID NO: 2148936 - protein, 6 aa, Cryptosporidium hominis
KQERDS

SEQ ID NO: 2148937 - protein, 31 aa, Cryptosporidium hominis
KQESNHAFNAQSDQISSTPETSPSSNIQPTT

SEQ ID NO: 2148938 - protein, 6 aa, Cryptosporidium hominis
KQETKD

SEQ ID NO: 2148939 - protein, 23 aa, Cryptosporidium hominis
KQETNKPKEKESEKLKEKKPEKD

SEQ ID NO: 2148940 - protein, 6 aa, Cryptosporidium hominis
KQETRN

SEQ ID NO: 2148941 - protein, 6 aa, Cryptosporidium hominis
KQFDKE

SEQ ID NO: 2148942 - protein, 4 aa, Cryptosporidium hominis
KQFG

SEQ ID NO: 2148943 - protein, 4 aa, Cryptosporidium hominis
KQFN

SEQ ID NO: 2148944 - protein, 5 aa, Cryptosporidium hominis
KQFQD

SEQ ID NO: 2148945 - protein, 6 aa, Cryptosporidium hominis
KQFRDG

SEQ ID NO: 2148946 - protein, 7 aa, Cryptosporidium hominis
KQGEQGD

SEQ ID NO: 2148947 - protein, 5 aa, Cryptosporidium hominis
KQGEV

SEQ ID NO: 2148948 - protein, 20 aa, Cryptosporidium hominis
KQGIQTSTNPFNKAGHKNSL

SEQ ID NO: 2148949 - protein, 21 aa, Cryptosporidium hominis
KQGKANSEDDFGSRKFGTSHH

SEQ ID NO: 2148950 - protein, 6 aa, Cryptosporidium hominis
KQGKHD

SEQ ID NO: 2148951 - protein, 4 aa, Cryptosporidium hominis
KQGQ

SEQ ID NO: 2148952 - protein, 6 aa, Cryptosporidium hominis
KQGRAN

SEQ ID NO: 2148953 - protein, 7 aa, Cryptosporidium hominis
KQGRNIN

SEQ ID NO: 2148954 - protein, 6 aa, Cryptosporidium hominis
KQGTAV

SEQ ID NO: 2148955 - protein, 6 aa, Cryptosporidium hominis
KQHDAS

SEQ ID NO: 2148956 - protein, 8 aa, Cryptosporidium hominis
KQHEDLSQ

SEQ ID NO: 2148957 - protein, 8 aa, Cryptosporidium hominis
KQHNDGRD

SEQ ID NO: 2148958 - protein, 7 aa, Cryptosporidium hominis
KQIDSNV

SEQ ID NO: 2148959 - protein, 7 aa, Cryptosporidium hominis
KQIEEQQ

SEQ ID NO: 2148960 - protein, 5 aa, Cryptosporidium hominis
KQIEN

SEQ ID NO: 2148961 - protein, 14 aa, Cryptosporidium hominis
KQIGQELEEEKQRN

SEQ ID NO: 2148962 - protein, 7 aa, Cryptosporidium hominis
KQIKKNN

SEQ ID NO: 2148963 - protein, 14 aa, Cryptosporidium hominis
KQIKNKEKSINTTN

SEQ ID NO: 2148964 - protein, 9 aa, Cryptosporidium hominis
KQISERKKG

SEQ ID NO: 2148965 - protein, 25 aa, Cryptosporidium hominis
KQISSSAGAKGGSGGILSSAETKFK

SEQ ID NO: 2148966 - protein, 22 aa, Cryptosporidium hominis
KQISSTSTTTTPSTSSSNSMST

SEQ ID NO: 2148967 - protein, 6 aa, Cryptosporidium hominis
KQKAKA

SEQ ID NO: 2148968 - protein, 9 aa, Cryptosporidium hominis
KQKAQQAYE

SEQ ID NO: 2148969 - protein, 10 aa, Cryptosporidium hominis
KQKCGNQPQK

SEQ ID NO: 2148970 - protein, 18 aa, Cryptosporidium hominis
KQKEAKYDSQSPNRKSHG

SEQ ID NO: 2148971 - protein, 21 aa, Cryptosporidium hominis
KQKEEIEKTDLEQSAKNNEKK

SEQ ID NO: 2148972 - protein, 19 aa, Cryptosporidium hominis
KQKEENRVSQMGDETPNKN

SEQ ID NO: 2148973 - protein, 17 aa, Cryptosporidium hominis
KQKEHQKKPNNNNQGHY

SEQ ID NO: 2148974 - protein, 21 aa, Cryptosporidium hominis
KQKEKSSKFPVRGSKIKTDQV

SEQ ID NO: 2148975 - protein, 8 aa, Cryptosporidium hominis
KQKFEEGQ

SEQ ID NO: 2148976 - protein, 13 aa, Cryptosporidium hominis
KQKKASNQSLSGK

SEQ ID NO: 2148977 - protein, 17 aa, Cryptosporidium hominis
KQKKHSSSGDDENNYNN

SEQ ID NO: 2148978 - protein, 7 aa, Cryptosporidium hominis
KQKKTQL

SEQ ID NO: 2148979 - protein, 7 aa, Cryptosporidium hominis
KQKLQKQ

SEQ ID NO: 2148980 - protein, 9 aa, Cryptosporidium hominis
KQKNDDNYC

SEQ ID NO: 2148981 - protein, 12 aa, Cryptosporidium hominis
KQKNENEHEEEE

SEQ ID NO: 2148982 - protein, 18 aa, Cryptosporidium hominis
KQKNNIEEGVSSPSNDGV

SEQ ID NO: 2148983 - protein, 10 aa, Cryptosporidium hominis
KQKQVQKERL

SEQ ID NO: 2148984 - protein, 34 aa, Cryptosporidium hominis
KQKRAQNQSNSGAAQKAALSEAKARQQKKKQSNR

SEQ ID NO: 2148985 - protein, 11 aa, Cryptosporidium hominis
KQKSEESPKEW

SEQ ID NO: 2148986 - protein, 18 aa, Cryptosporidium hominis
KQKSKGLGDLSSTKKPII

SEQ ID NO: 2148987 - protein, 9 aa, Cryptosporidium hominis
KQKSMNSSI

SEQ ID NO: 2148988 - protein, 7 aa, Cryptosporidium hominis
KQKTMAS

SEQ ID NO: 2148989 - protein, 7 aa, Cryptosporidium hominis
KQKTTEI

SEQ ID NO: 2148990 - protein, 31 aa, Cryptosporidium hominis
KQLDETNKSEIKGIDPSKTEISISEQNNNLL

SEQ ID NO: 2148991 - protein, 13 aa, Cryptosporidium hominis
KQLEQESRQSDPL

SEQ ID NO: 2148992 - protein, 9 aa, Cryptosporidium hominis
KQLESSKKN

SEQ ID NO: 2148993 - protein, 10 aa, Cryptosporidium hominis
KQLETKTRDL

SEQ ID NO: 2148994 - protein, 11 aa, Cryptosporidium hominis
KQLGNGNLSKK

SEQ ID NO: 2148995 - protein, 13 aa, Cryptosporidium hominis
KQLKDADKTSNSF

SEQ ID NO: 2148996 - protein, 8 aa, Cryptosporidium hominis
KQLNDEKT

SEQ ID NO: 2148997 - protein, 13 aa, Cryptosporidium hominis
KQLNESGNEISCN

SEQ ID NO: 2148998 - protein, 8 aa, Cryptosporidium hominis
KQLNGAER

SEQ ID NO: 2148999 - protein, 5 aa, Cryptosporidium hominis
KQLPA

SEQ ID NO: 2149000 - protein, 26 aa, Cryptosporidium hominis
KQLPTNQPNGNNSNNNHNNNNNINNN

SEQ ID NO: 2149001 - protein, 11 aa, Cryptosporidium hominis
KQLQEDRQRFE

SEQ ID NO: 2149002 - protein, 7 aa, Cryptosporidium hominis
KQLSEEG

SEQ ID NO: 2149003 - protein, 198 aa, Cryptosporidium hominis
KQLSNKPIEEQNDKKLSRTSSNKNINEAESSTKTPSESNKNSKSEPTGKSSDISKSKVVPSAKEEPKSETKLEGKESSPPPPKDPPTSKGPPPPKGPPAPKGPPGPPSESEGSPASKGPPQPKGPPPPKGPPGPPSESEGSPASKGPPPPKGPPPSKGSPSPESKGPPPPKGPPPPSSKGPPTGKGPSLPKKAPPPKK

SEQ ID NO: 2149004 - protein, 6 aa, Cryptosporidium hominis
KQLSST

SEQ ID NO: 2149005 - protein, 8 aa, Cryptosporidium hominis
KQLSSTNT

SEQ ID NO: 2149006 - protein, 6 aa, Cryptosporidium hominis
KQMKET

SEQ ID NO: 2149007 - protein, 9 aa, Cryptosporidium hominis
KQMNKKRSH

SEQ ID NO: 2149008 - protein, 5 aa, Cryptosporidium hominis
KQMNT

SEQ ID NO: 2149009 - protein, 10 aa, Cryptosporidium hominis
KQNAKNGHEI

SEQ ID NO: 2149010 - protein, 12 aa, Cryptosporidium hominis
KQNAQHSNQHSG

SEQ ID NO: 2149011 - protein, 6 aa, Cryptosporidium hominis
KQNDHN

SEQ ID NO: 2149012 - protein, 4 aa, Cryptosporidium hominis
KQNI

SEQ ID NO: 2149013 - protein, 11 aa, Cryptosporidium hominis
KQNIDPKSSEY

SEQ ID NO: 2149014 - protein, 6 aa, Cryptosporidium hominis
KQNISC

SEQ ID NO: 2149015 - protein, 7 aa, Cryptosporidium hominis
KQNLESE

SEQ ID NO: 2149016 - protein, 6 aa, Cryptosporidium hominis
KQNMES

SEQ ID NO: 2149017 - protein, 5 aa, Cryptosporidium hominis
KQNMK

SEQ ID NO: 2149018 - protein, 7 aa, Cryptosporidium hominis
KQNNSNE

SEQ ID NO: 2149019 - protein, 7 aa, Cryptosporidium hominis
KQNPATL

SEQ ID NO: 2149020 - protein, 4 aa, Cryptosporidium hominis
KQNS

SEQ ID NO: 2149021 - protein, 5 aa, Cryptosporidium hominis
KQNSD

SEQ ID NO: 2149022 - protein, 7 aa, Cryptosporidium hominis
KQNSEPD

SEQ ID NO: 2149023 - protein, 13 aa, Cryptosporidium hominis
KQNSIKKFNESGI

SEQ ID NO: 2149024 - protein, 13 aa, Cryptosporidium hominis
KQNSKNEKHGNYA

SEQ ID NO: 2149025 - protein, 5 aa, Cryptosporidium hominis
KQNSR

SEQ ID NO: 2149026 - protein, 26 aa, Cryptosporidium hominis
KQNSREKPGDVSSLSNKSKSPEPEEK

SEQ ID NO: 2149027 - protein, 10 aa, Cryptosporidium hominis
KQNTSNDKKN

SEQ ID NO: 2149028 - protein, 7 aa, Cryptosporidium hominis
KQPATNQ

SEQ ID NO: 2149029 - protein, 7 aa, Cryptosporidium hominis
KQPEYSP

SEQ ID NO: 2149030 - protein, 5 aa, Cryptosporidium hominis
KQPHD

SEQ ID NO: 2149031 - protein, 27 aa, Cryptosporidium hominis
KQPISDGSSPGIRQKSLNTKTDQNSSL

SEQ ID NO: 2149032 - protein, 11 aa, Cryptosporidium hominis
KQPKETAEAID

SEQ ID NO: 2149033 - protein, 20 aa, Cryptosporidium hominis
KQPMQSPNISNPTSIVDNFL

SEQ ID NO: 2149034 - protein, 13 aa, Cryptosporidium hominis
KQPNTSKNNLSSS

SEQ ID NO: 2149035 - protein, 7 aa, Cryptosporidium hominis
KQPPNIS

SEQ ID NO: 2149036 - protein, 5 aa, Cryptosporidium hominis
KQPSI

SEQ ID NO: 2149037 - protein, 6 aa, Cryptosporidium hominis
KQPSSC

SEQ ID NO: 2149038 - protein, 5 aa, Cryptosporidium hominis
KQQDF

SEQ ID NO: 2149039 - protein, 12 aa, Cryptosporidium hominis
KQQDNRCGDGTT

SEQ ID NO: 2149040 - protein, 7 aa, Cryptosporidium hominis
KQQHEKL

SEQ ID NO: 2149041 - protein, 7 aa, Cryptosporidium hominis
KQQKNEI

SEQ ID NO: 2149042 - protein, 5 aa, Cryptosporidium hominis
KQQLN

SEQ ID NO: 2149043 - protein, 38 aa, Cryptosporidium hominis
KQQQQQQQQQQQQQQQQQQQQQQQQQQQQQQTQNPSQL

SEQ ID NO: 2149044 - protein, 10 aa, Cryptosporidium hominis
KQQQRESRDY

SEQ ID NO: 2149045 - protein, 9 aa, Cryptosporidium hominis
KQQSLEREK

SEQ ID NO: 2149046 - protein, 6 aa, Cryptosporidium hominis
KQQSNV

SEQ ID NO: 2149047 - protein, 14 aa, Cryptosporidium hominis
KQQTAISKSIESNS

SEQ ID NO: 2149048 - protein, 10 aa, Cryptosporidium hominis
KQQTSTANDF

SEQ ID NO: 2149049 - protein, 4 aa, Cryptosporidium hominis
KQRE

SEQ ID NO: 2149050 - protein, 11 aa, Cryptosporidium hominis
KQRELDELEEE

SEQ ID NO: 2149051 - protein, 7 aa, Cryptosporidium hominis
KQRGNPN

SEQ ID NO: 2149052 - protein, 4 aa, Cryptosporidium hominis
KQRI

SEQ ID NO: 2149053 - protein, 6 aa, Cryptosporidium hominis
KQRIPP

SEQ ID NO: 2149054 - protein, 9 aa, Cryptosporidium hominis
KQRQEESNL

SEQ ID NO: 2149055 - protein, 7 aa, Cryptosporidium hominis
KQRQNES

SEQ ID NO: 2149056 - protein, 7 aa, Cryptosporidium hominis
KQRQSTI

SEQ ID NO: 2149057 - protein, 6 aa, Cryptosporidium hominis
KQRRHN

SEQ ID NO: 2149058 - protein, 6 aa, Cryptosporidium hominis
KQRRQQ

SEQ ID NO: 2149059 - protein, 6 aa, Cryptosporidium hominis
KQRRTG

SEQ ID NO: 2149060 - protein, 6 aa, Cryptosporidium hominis
KQRYLD

SEQ ID NO: 2149061 - protein, 7 aa, Cryptosporidium hominis
KQSDPNT

SEQ ID NO: 2149062 - protein, 16 aa, Cryptosporidium hominis
KQSDSTNQKKGSLNNP

SEQ ID NO: 2149063 - protein, 4 aa, Cryptosporidium hominis
KQSE

SEQ ID NO: 2149064 - protein, 6 aa, Cryptosporidium hominis
KQSEYK

SEQ ID NO: 2149065 - protein, 5 aa, Cryptosporidium hominis
KQSGE

SEQ ID NO: 2149066 - protein, 8 aa, Cryptosporidium hominis
KQSIKQTN

SEQ ID NO: 2149067 - protein, 6 aa, Cryptosporidium hominis
KQSKSN

SEQ ID NO: 2149068 - protein, 4 aa, Cryptosporidium hominis
KQSL

SEQ ID NO: 2149069 - protein, 7 aa, Cryptosporidium hominis
KQSLENT

SEQ ID NO: 2149070 - protein, 7 aa, Cryptosporidium hominis
KQSLPPF

SEQ ID NO: 2149071 - protein, 11 aa, Cryptosporidium hominis
KQSNESCNGEP

SEQ ID NO: 2149072 - protein, 10 aa, Cryptosporidium hominis
KQSNNRQETI

SEQ ID NO: 2149073 - protein, 18 aa, Cryptosporidium hominis
KQSNNSSNTDKDDSKEAI

SEQ ID NO: 2149074 - protein, 19 aa, Cryptosporidium hominis
KQSNRFSSNDLSGSRHRSS

SEQ ID NO: 2149075 - protein, 6 aa, Cryptosporidium hominis
KQSQNS

SEQ ID NO: 2149076 - protein, 8 aa, Cryptosporidium hominis
KQSRKDRV

SEQ ID NO: 2149077 - protein, 6 aa, Cryptosporidium hominis
KQSRPI

SEQ ID NO: 2149078 - protein, 5 aa, Cryptosporidium hominis
KQSSN

SEQ ID NO: 2149079 - protein, 7 aa, Cryptosporidium hominis
KQSYTQF

SEQ ID NO: 2149080 - protein, 5 aa, Cryptosporidium hominis
KQTEE

SEQ ID NO: 2149081 - protein, 5 aa, Cryptosporidium hominis
KQTGK

SEQ ID NO: 2149082 - protein, 7 aa, Cryptosporidium hominis
KQTGSVK

SEQ ID NO: 2149083 - protein, 5 aa, Cryptosporidium hominis
KQTKF

SEQ ID NO: 2149084 - protein, 7 aa, Cryptosporidium hominis
KQTKNMT

SEQ ID NO: 2149085 - protein, 8 aa, Cryptosporidium hominis
KQTLESQG

SEQ ID NO: 2149086 - protein, 4 aa, Cryptosporidium hominis
KQTN

SEQ ID NO: 2149087 - protein, 26 aa, Cryptosporidium hominis
KQTNEEAENGDNEINSISERNASGKE

SEQ ID NO: 2149088 - protein, 11 aa, Cryptosporidium hominis
KQTSIQDSKRY

SEQ ID NO: 2149089 - protein, 9 aa, Cryptosporidium hominis
KQTSPPTVP

SEQ ID NO: 2149090 - protein, 5 aa, Cryptosporidium hominis
KQTTK

SEQ ID NO: 2149091 - protein, 14 aa, Cryptosporidium hominis
KQTVENKDFKNNTL

SEQ ID NO: 2149092 - protein, 4 aa, Cryptosporidium hominis
KQVD

SEQ ID NO: 2149093 - protein, 5 aa, Cryptosporidium hominis
KQVED

SEQ ID NO: 2149094 - protein, 10 aa, Cryptosporidium hominis
KQVEDEKNLQ

SEQ ID NO: 2149095 - protein, 5 aa, Cryptosporidium hominis
KQVEG

SEQ ID NO: 2149096 - protein, 7 aa, Cryptosporidium hominis
KQVEHSS

SEQ ID NO: 2149097 - protein, 6 aa, Cryptosporidium hominis
KQVEYK

SEQ ID NO: 2149098 - protein, 9 aa, Cryptosporidium hominis
KQVGETPSQ

SEQ ID NO: 2149099 - protein, 17 aa, Cryptosporidium hominis
KQVKKGSKFINQGDPNA

SEQ ID NO: 2149100 - protein, 8 aa, Cryptosporidium hominis
KQVPPSIT

SEQ ID NO: 2149101 - protein, 10 aa, Cryptosporidium hominis
KQVSAKGVEE

SEQ ID NO: 2149102 - protein, 6 aa, Cryptosporidium hominis
KQVTDE

SEQ ID NO: 2149103 - protein, 5 aa, Cryptosporidium hominis
KQYAA

SEQ ID NO: 2149104 - protein, 13 aa, Cryptosporidium hominis
KQYESERFTNNGI

SEQ ID NO: 2149105 - protein, 5 aa, Cryptosporidium hominis
KQYGN

SEQ ID NO: 2149106 - protein, 20 aa, Cryptosporidium hominis
KQYHPDKNPDDADAKDKFQK

SEQ ID NO: 2149107 - protein, 4 aa, Cryptosporidium hominis
KQYL

SEQ ID NO: 2149108 - protein, 27 aa, Cryptosporidium hominis
KQYNGSNFASNEKSDSSNFEVSDDNQI

SEQ ID NO: 2149109 - protein, 6 aa, Cryptosporidium hominis
KQYSTP

SEQ ID NO: 2149110 - protein, 9 aa, Cryptosporidium hominis
KQYVTEQEL

SEQ ID NO: 2149111 - protein, 27 aa, Cryptosporidium hominis
KRAKSTVNLDDKDEKNEKLKEGTDLTK

SEQ ID NO: 2149112 - protein, 6 aa, Cryptosporidium hominis
KRAQEA

SEQ ID NO: 2149113 - protein, 15 aa, Cryptosporidium hominis
KRATNTELNKANRRT

SEQ ID NO: 2149114 - protein, 6 aa, Cryptosporidium hominis
KRCPTP

SEQ ID NO: 2149115 - protein, 7 aa, Cryptosporidium hominis
KRDEYTQ

SEQ ID NO: 2149116 - protein, 5 aa, Cryptosporidium hominis
KRDGL

SEQ ID NO: 2149117 - protein, 8 aa, Cryptosporidium hominis
KRDNIKSS

SEQ ID NO: 2149118 - protein, 10 aa, Cryptosporidium hominis
KRDNPESKEI

SEQ ID NO: 2149119 - protein, 18 aa, Cryptosporidium hominis
KRDSDSFSSNLSEGSDEN

SEQ ID NO: 2149120 - protein, 13 aa, Cryptosporidium hominis
KRDSSIQGAYPTL

SEQ ID NO: 2149121 - protein, 23 aa, Cryptosporidium hominis
KRDTRESSREADRKKNNDENTEE

SEQ ID NO: 2149122 - protein, 15 aa, Cryptosporidium hominis
KREDSQKKGTKQNTL

SEQ ID NO: 2149123 - protein, 8 aa, Cryptosporidium hominis
KREEAQNA

SEQ ID NO: 2149124 - protein, 8 aa, Cryptosporidium hominis
KREENTNK

SEQ ID NO: 2149125 - protein, 20 aa, Cryptosporidium hominis
KREESRNKKKFKAKNTVEDK

SEQ ID NO: 2149126 - protein, 10 aa, Cryptosporidium hominis
KREGTNSNNI

SEQ ID NO: 2149127 - protein, 16 aa, Cryptosporidium hominis
KREKANPIDFDGEREV

SEQ ID NO: 2149128 - protein, 10 aa, Cryptosporidium hominis
KRENEHKTSV

SEQ ID NO: 2149129 - protein, 10 aa, Cryptosporidium hominis
KRENSDENNM

SEQ ID NO: 2149130 - protein, 4 aa, Cryptosporidium hominis
KREP

SEQ ID NO: 2149131 - protein, 5 aa, Cryptosporidium hominis
KRERE

SEQ ID NO: 2149132 - protein, 13 aa, Cryptosporidium hominis
KRERTVARAYGGT

SEQ ID NO: 2149133 - protein, 11 aa, Cryptosporidium hominis
KRESKRNQVPN

SEQ ID NO: 2149134 - protein, 7 aa, Cryptosporidium hominis
KRESNLA

SEQ ID NO: 2149135 - protein, 11 aa, Cryptosporidium hominis
KRESNYDRNSK

SEQ ID NO: 2149136 - protein, 11 aa, Cryptosporidium hominis
KRESSDAKSVE

SEQ ID NO: 2149137 - protein, 12 aa, Cryptosporidium hominis
KRESSDSQLAIK

SEQ ID NO: 2149138 - protein, 8 aa, Cryptosporidium hominis
KRETPELY

SEQ ID NO: 2149139 - protein, 6 aa, Cryptosporidium hominis
KREVPT

SEQ ID NO: 2149140 - protein, 12 aa, Cryptosporidium hominis
KREYKSRKDFQD

SEQ ID NO: 2149141 - protein, 7 aa, Cryptosporidium hominis
KRFDNTK

SEQ ID NO: 2149142 - protein, 6 aa, Cryptosporidium hominis
KRFGRI

SEQ ID NO: 2149143 - protein, 6 aa, Cryptosporidium hominis
KRFTKT

SEQ ID NO: 2149144 - protein, 9 aa, Cryptosporidium hominis
KRGEHKEQI

SEQ ID NO: 2149145 - protein, 9 aa, Cryptosporidium hominis
KRGKANKAA

SEQ ID NO: 2149146 - protein, 8 aa, Cryptosporidium hominis
KRGNEDGI

SEQ ID NO: 2149147 - protein, 28 aa, Cryptosporidium hominis
KRGRKSLSYNGSSINEQNSPSVTSNKRL

SEQ ID NO: 2149148 - protein, 12 aa, Cryptosporidium hominis
KRGYSQDKIKEN

SEQ ID NO: 2149149 - protein, 4 aa, Cryptosporidium hominis
KRIE

SEQ ID NO: 2149150 - protein, 5 aa, Cryptosporidium hominis
KRIEE

SEQ ID NO: 2149151 - protein, 4 aa, Cryptosporidium hominis
KRIN

SEQ ID NO: 2149152 - protein, 8 aa, Cryptosporidium hominis
KRIPRRGE

SEQ ID NO: 2149153 - protein, 16 aa, Cryptosporidium hominis
KRISAKEALEHSFFQL

SEQ ID NO: 2149154 - protein, 7 aa, Cryptosporidium hominis
KRISARD

SEQ ID NO: 2149155 - protein, 26 aa, Cryptosporidium hominis
KRISKRSSKSCANIKNEELDSDFSDN

SEQ ID NO: 2149156 - protein, 7 aa, Cryptosporidium hominis
KRISSSG

SEQ ID NO: 2149157 - protein, 12 aa, Cryptosporidium hominis
KRITEKEQETQQ

SEQ ID NO: 2149158 - protein, 16 aa, Cryptosporidium hominis
KRKCGRTSQIRPKKKL

SEQ ID NO: 2149159 - protein, 7 aa, Cryptosporidium hominis
KRKDHKF

SEQ ID NO: 2149160 - protein, 4 aa, Cryptosporidium hominis
KRKE

SEQ ID NO: 2149161 - protein, 33 aa, Cryptosporidium hominis
KRKEAENKENNSSLKNGNSNISKSHESDSGKNF

SEQ ID NO: 2149162 - protein, 5 aa, Cryptosporidium hominis
KRKES

SEQ ID NO: 2149163 - protein, 6 aa, Cryptosporidium hominis
KRKFPN

SEQ ID NO: 2149164 - protein, 23 aa, Cryptosporidium hominis
KRKKDSNNQANSENTGSEPEGIF

SEQ ID NO: 2149165 - protein, 32 aa, Cryptosporidium hominis
KRKKERRDKSIEKKKLKDRQFRDGVKKDAKDV

SEQ ID NO: 2149166 - protein, 8 aa, Cryptosporidium hominis
KRKKETKV

SEQ ID NO: 2149167 - protein, 6 aa, Cryptosporidium hominis
KRKKSS

SEQ ID NO: 2149168 - protein, 7 aa, Cryptosporidium hominis
KRKNELG

SEQ ID NO: 2149169 - protein, 21 aa, Cryptosporidium hominis
KRKNLDFSSKEGSGSRKYNRI

SEQ ID NO: 2149170 - protein, 10 aa, Cryptosporidium hominis
KRKPEDGDEI

SEQ ID NO: 2149171 - protein, 11 aa, Cryptosporidium hominis
KRKQKGPPQYA

SEQ ID NO: 2149172 - protein, 13 aa, Cryptosporidium hominis
KRKQKRKERKIQL

SEQ ID NO: 2149173 - protein, 8 aa, Cryptosporidium hominis
KRKQLEEE

SEQ ID NO: 2149174 - protein, 7 aa, Cryptosporidium hominis
KRKRDSA

SEQ ID NO: 2149175 - protein, 6 aa, Cryptosporidium hominis
KRKSEI

SEQ ID NO: 2149176 - protein, 7 aa, Cryptosporidium hominis
KRKSHDK

SEQ ID NO: 2149177 - protein, 15 aa, Cryptosporidium hominis
KRKSNNDSENASKIQ

SEQ ID NO: 2149178 - protein, 13 aa, Cryptosporidium hominis
KRKSRSSRPSYSR

SEQ ID NO: 2149179 - protein, 5 aa, Cryptosporidium hominis
KRKYR

SEQ ID NO: 2149180 - protein, 20 aa, Cryptosporidium hominis
KRKYSPPVNTSKEAKSLNNM

SEQ ID NO: 2149181 - protein, 7 aa, Cryptosporidium hominis
KRLDQDD

SEQ ID NO: 2149182 - protein, 5 aa, Cryptosporidium hominis
KRLGG

SEQ ID NO: 2149183 - protein, 14 aa, Cryptosporidium hominis
KRLKESNKQDIDTN

SEQ ID NO: 2149184 - protein, 6 aa, Cryptosporidium hominis
KRLRER

SEQ ID NO: 2149185 - protein, 6 aa, Cryptosporidium hominis
KRLRGG

SEQ ID NO: 2149186 - protein, 11 aa, Cryptosporidium hominis
KRLSSDGSEMP

SEQ ID NO: 2149187 - protein, 9 aa, Cryptosporidium hominis
KRLYGTNKE

SEQ ID NO: 2149188 - protein, 5 aa, Cryptosporidium hominis
KRMTT

SEQ ID NO: 2149189 - protein, 8 aa, Cryptosporidium hominis
KRNDPDLK

SEQ ID NO: 2149190 - protein, 7 aa, Cryptosporidium hominis
KRNDPKV

SEQ ID NO: 2149191 - protein, 6 aa, Cryptosporidium hominis
KRNDTL

SEQ ID NO: 2149192 - protein, 37 aa, Cryptosporidium hominis
KRNEQDAMSSFSSSSSSSSSSSSSSSSSSSSSSDPTF

SEQ ID NO: 2149193 - protein, 8 aa, Cryptosporidium hominis
KRNGNSNL

SEQ ID NO: 2149194 - protein, 20 aa, Cryptosporidium hominis
KRNKPNTRQPINSKIESSDI

SEQ ID NO: 2149195 - protein, 5 aa, Cryptosporidium hominis
KRNLE

SEQ ID NO: 2149196 - protein, 24 aa, Cryptosporidium hominis
KRNNGNDPSISKFNRGGGGSEPNL

SEQ ID NO: 2149197 - protein, 36 aa, Cryptosporidium hominis
KRNNGSAQVSSGRNNASGLYRGTYKKEGKSQSLYTK

SEQ ID NO: 2149198 - protein, 5 aa, Cryptosporidium hominis
KRNNS

SEQ ID NO: 2149199 - protein, 18 aa, Cryptosporidium hominis
KRNNSGENNNYRESKPYL

SEQ ID NO: 2149200 - protein, 6 aa, Cryptosporidium hominis
KRNPGL

SEQ ID NO: 2149201 - protein, 9 aa, Cryptosporidium hominis
KRNPSESWE

SEQ ID NO: 2149202 - protein, 4 aa, Cryptosporidium hominis
KRNS

SEQ ID NO: 2149203 - protein, 9 aa, Cryptosporidium hominis
KRNSERQTE

SEQ ID NO: 2149204 - protein, 9 aa, Cryptosporidium hominis
KRNSKPSNK

SEQ ID NO: 2149205 - protein, 5 aa, Cryptosporidium hominis
KRNTK

SEQ ID NO: 2149206 - protein, 7 aa, Cryptosporidium hominis
KRNVNRN

SEQ ID NO: 2149207 - protein, 15 aa, Cryptosporidium hominis
KRPARAQSDGSLQSN

SEQ ID NO: 2149208 - protein, 8 aa, Cryptosporidium hominis
KRPEGVSK

SEQ ID NO: 2149209 - protein, 16 aa, Cryptosporidium hominis
KRPESPLKKPISRSNI

SEQ ID NO: 2149210 - protein, 6 aa, Cryptosporidium hominis
KRPHLN

SEQ ID NO: 2149211 - protein, 8 aa, Cryptosporidium hominis
KRPIPGSI

SEQ ID NO: 2149212 - protein, 20 aa, Cryptosporidium hominis
KRPISSKYKPKNTSGTNSNP

SEQ ID NO: 2149213 - protein, 14 aa, Cryptosporidium hominis
KRPKDGLPSRAPTK

SEQ ID NO: 2149214 - protein, 5 aa, Cryptosporidium hominis
KRPKK

SEQ ID NO: 2149215 - protein, 7 aa, Cryptosporidium hominis
KRPKSGD

SEQ ID NO: 2149216 - protein, 8 aa, Cryptosporidium hominis
KRPLDSQE

SEQ ID NO: 2149217 - protein, 7 aa, Cryptosporidium hominis
KRPPAYP

SEQ ID NO: 2149218 - protein, 10 aa, Cryptosporidium hominis
KRPPPNRSPA

SEQ ID NO: 2149219 - protein, 11 aa, Cryptosporidium hominis
KRPPPPPPGVS

SEQ ID NO: 2149220 - protein, 9 aa, Cryptosporidium hominis
KRPSKTYSD

SEQ ID NO: 2149221 - protein, 6 aa, Cryptosporidium hominis
KRQDYQ

SEQ ID NO: 2149222 - protein, 7 aa, Cryptosporidium hominis
KRQESPN

SEQ ID NO: 2149223 - protein, 4 aa, Cryptosporidium hominis
KRQG

SEQ ID NO: 2149224 - protein, 5 aa, Cryptosporidium hominis
KRQKE

SEQ ID NO: 2149225 - protein, 12 aa, Cryptosporidium hominis
KRQKKYTESFIN

SEQ ID NO: 2149226 - protein, 6 aa, Cryptosporidium hominis
KRQLTN

SEQ ID NO: 2149227 - protein, 5 aa, Cryptosporidium hominis
KRQNF

SEQ ID NO: 2149228 - protein, 6 aa, Cryptosporidium hominis
KRQNRR

SEQ ID NO: 2149229 - protein, 9 aa, Cryptosporidium hominis
KRQPASNSC

SEQ ID NO: 2149230 - protein, 5 aa, Cryptosporidium hominis
KRQPL

SEQ ID NO: 2149231 - protein, 4 aa, Cryptosporidium hominis
KRQR

SEQ ID NO: 2149232 - protein, 8 aa, Cryptosporidium hominis
KRRDGDNQ

SEQ ID NO: 2149233 - protein, 19 aa, Cryptosporidium hominis
KRREKIKNKDDESSKDDDW

SEQ ID NO: 2149234 - protein, 5 aa, Cryptosporidium hominis
KRREL

SEQ ID NO: 2149235 - protein, 7 aa, Cryptosporidium hominis
KRRESMS

SEQ ID NO: 2149236 - protein, 24 aa, Cryptosporidium hominis
KRRFSGDSSFESADATNQEYNESK

SEQ ID NO: 2149237 - protein, 14 aa, Cryptosporidium hominis
KRRGHAGKEIPIPA

SEQ ID NO: 2149238 - protein, 48 aa, Cryptosporidium hominis
KRRKLAEKNKETAQFSQNNTNSEGSNVDKKSVESNEGIKPKEELQDSE

SEQ ID NO: 2149239 - protein, 4 aa, Cryptosporidium hominis
KRRL

SEQ ID NO: 2149240 - protein, 25 aa, Cryptosporidium hominis
KRRLEEKQRANAKKRLNGEADYSPK

SEQ ID NO: 2149241 - protein, 7 aa, Cryptosporidium hominis
KRRLSQA

SEQ ID NO: 2149242 - protein, 6 aa, Cryptosporidium hominis
KRRNEE

SEQ ID NO: 2149243 - protein, 6 aa, Cryptosporidium hominis
KRRNLN

SEQ ID NO: 2149244 - protein, 7 aa, Cryptosporidium hominis
KRRPSFE

SEQ ID NO: 2149245 - protein, 6 aa, Cryptosporidium hominis
KRRQRS

SEQ ID NO: 2149246 - protein, 6 aa, Cryptosporidium hominis
KRRRNV

SEQ ID NO: 2149247 - protein, 11 aa, Cryptosporidium hominis
KRRRPGTVGND

SEQ ID NO: 2149248 - protein, 18 aa, Cryptosporidium hominis
KRRSGGNNNIGSSSNASG

SEQ ID NO: 2149249 - protein, 13 aa, Cryptosporidium hominis
KRRSKKIVKKVRF

SEQ ID NO: 2149250 - protein, 25 aa, Cryptosporidium hominis
KRRVNNNTLQEDHSSSYNSTNIENE

SEQ ID NO: 2149251 - protein, 13 aa, Cryptosporidium hominis
KRRYRKDKPWDTD

SEQ ID NO: 2149252 - protein, 46 aa, Cryptosporidium hominis
KRSARNLSDSSSVSSSSIESIGKSDFTDLENSSQDDQTLEEKEAKR

SEQ ID NO: 2149253 - protein, 5 aa, Cryptosporidium hominis
KRSDQ

SEQ ID NO: 2149254 - protein, 5 aa, Cryptosporidium hominis
KRSEE

SEQ ID NO: 2149255 - protein, 13 aa, Cryptosporidium hominis
KRSEKNPEVESSR

SEQ ID NO: 2149256 - protein, 7 aa, Cryptosporidium hominis
KRSGLTR

SEQ ID NO: 2149257 - protein, 12 aa, Cryptosporidium hominis
KRSGNSEESQSK

SEQ ID NO: 2149258 - protein, 17 aa, Cryptosporidium hominis
KRSGYKFKTSSNENKVR

SEQ ID NO: 2149259 - protein, 6 aa, Cryptosporidium hominis
KRSKHE

SEQ ID NO: 2149260 - protein, 31 aa, Cryptosporidium hominis
KRSLGNHQERETYSTKGAKDEGQSSGEVNRE

SEQ ID NO: 2149261 - protein, 9 aa, Cryptosporidium hominis
KRSNEQKRE

SEQ ID NO: 2149262 - protein, 8 aa, Cryptosporidium hominis
KRSQGDPM

SEQ ID NO: 2149263 - protein, 6 aa, Cryptosporidium hominis
KRSQNI

SEQ ID NO: 2149264 - protein, 10 aa, Cryptosporidium hominis
KRSRSITGNE

SEQ ID NO: 2149265 - protein, 30 aa, Cryptosporidium hominis
KRSSNSDEEQNDENNTALSTSSPQSRNQTQ

SEQ ID NO: 2149266 - protein, 11 aa, Cryptosporidium hominis
KRSSQGKINSV

SEQ ID NO: 2149267 - protein, 14 aa, Cryptosporidium hominis
KRSSTRDRPRSSGL

SEQ ID NO: 2149268 - protein, 7 aa, Cryptosporidium hominis
KRTDELN

SEQ ID NO: 2149269 - protein, 7 aa, Cryptosporidium hominis
KRTGMPK

SEQ ID NO: 2149270 - protein, 14 aa, Cryptosporidium hominis
KRTIQKNNKSSFVS

SEQ ID NO: 2149271 - protein, 7 aa, Cryptosporidium hominis
KRTNDSL

SEQ ID NO: 2149272 - protein, 6 aa, Cryptosporidium hominis
KRTNEV

SEQ ID NO: 2149273 - protein, 4 aa, Cryptosporidium hominis
KRTP

SEQ ID NO: 2149274 - protein, 11 aa, Cryptosporidium hominis
KRTRKPPPPVY

SEQ ID NO: 2149275 - protein, 12 aa, Cryptosporidium hominis
KRTSKDDDNSIR

SEQ ID NO: 2149276 - protein, 4 aa, Cryptosporidium hominis
KRTT

SEQ ID NO: 2149277 - protein, 13 aa, Cryptosporidium hominis
KRVETTDPETNEK

SEQ ID NO: 2149278 - protein, 4 aa, Cryptosporidium hominis
KRVK

SEQ ID NO: 2149279 - protein, 9 aa, Cryptosporidium hominis
KRVNKRKTI

SEQ ID NO: 2149280 - protein, 9 aa, Cryptosporidium hominis
KRVQKSAED

SEQ ID NO: 2149281 - protein, 6 aa, Cryptosporidium hominis
KRYNDK

SEQ ID NO: 2149282 - protein, 6 aa, Cryptosporidium hominis
KRYPKY

SEQ ID NO: 2149283 - protein, 6 aa, Cryptosporidium hominis
KRYPNN

SEQ ID NO: 2149284 - protein, 4 aa, Cryptosporidium hominis
KRYS

SEQ ID NO: 2149285 - protein, 44 aa, Cryptosporidium hominis
KRYSSQSTAGSISGNFSPSQNATSNQSPNEAWSKGSEGSREAEI

SEQ ID NO: 2149286 - protein, 9 aa, Cryptosporidium hominis
KSAAEEELQ

SEQ ID NO: 2149287 - protein, 4 aa, Cryptosporidium hominis
KSAL

SEQ ID NO: 2149288 - protein, 20 aa, Cryptosporidium hominis
KSALNSNSEQAYSVGIRNQR

SEQ ID NO: 2149289 - protein, 8 aa, Cryptosporidium hominis
KSANNQTL

SEQ ID NO: 2149290 - protein, 25 aa, Cryptosporidium hominis
KSANQSKSKDMNSSCSYNSSRADYN

SEQ ID NO: 2149291 - protein, 94 aa, Cryptosporidium hominis
KSAPSQAKEGAPTEPKAEPAEAKAPPAKGAPPAKGKGPPAKGKGPPGGKGPPGGKGPPGGKGPPTGKGPPKGKAGKFGGKSGGKSTGPESKTKK

SEQ ID NO: 2149292 - protein, 9 aa, Cryptosporidium hominis
KSASNSTLD

SEQ ID NO: 2149293 - protein, 7 aa, Cryptosporidium hominis
KSASQPE

SEQ ID NO: 2149294 - protein, 9 aa, Cryptosporidium hominis
KSASTGNHF

SEQ ID NO: 2149295 - protein, 5 aa, Cryptosporidium hominis
KSATL

SEQ ID NO: 2149296 - protein, 6 aa, Cryptosporidium hominis
KSCEEH

SEQ ID NO: 2149297 - protein, 14 aa, Cryptosporidium hominis
KSCKKNTRSNEKNT

SEQ ID NO: 2149298 - protein, 7 aa, Cryptosporidium hominis
KSCQRNE

SEQ ID NO: 2149299 - protein, 8 aa, Cryptosporidium hominis
KSCRLPPR

SEQ ID NO: 2149300 - protein, 8 aa, Cryptosporidium hominis
KSDATKKM

SEQ ID NO: 2149301 - protein, 4 aa, Cryptosporidium hominis
KSDE

SEQ ID NO: 2149302 - protein, 6 aa, Cryptosporidium hominis
KSDFGY

SEQ ID NO: 2149303 - protein, 11 aa, Cryptosporidium hominis
KSDGLKSDFKE

SEQ ID NO: 2149304 - protein, 18 aa, Cryptosporidium hominis
KSDIAKNSFRGRGKRGKR

SEQ ID NO: 2149305 - protein, 13 aa, Cryptosporidium hominis
KSDKQDDDSFSEI

SEQ ID NO: 2149306 - protein, 8 aa, Cryptosporidium hominis
KSDKSVAN

SEQ ID NO: 2149307 - protein, 8 aa, Cryptosporidium hominis
KSDMKGSN

SEQ ID NO: 2149308 - protein, 6 aa, Cryptosporidium hominis
KSDPFG

SEQ ID NO: 2149309 - protein, 5 aa, Cryptosporidium hominis
KSDPI

SEQ ID NO: 2149310 - protein, 7 aa, Cryptosporidium hominis
KSDPLNS

SEQ ID NO: 2149311 - protein, 8 aa, Cryptosporidium hominis
KSDPRWPG

SEQ ID NO: 2149312 - protein, 8 aa, Cryptosporidium hominis
KSDQETGN

SEQ ID NO: 2149313 - protein, 6 aa, Cryptosporidium hominis
KSDQGN

SEQ ID NO: 2149314 - protein, 6 aa, Cryptosporidium hominis
KSDQNE

SEQ ID NO: 2149315 - protein, 8 aa, Cryptosporidium hominis
KSDQNLSS

SEQ ID NO: 2149316 - protein, 7 aa, Cryptosporidium hominis
KSDQQKC

SEQ ID NO: 2149317 - protein, 7 aa, Cryptosporidium hominis
KSDREYS

SEQ ID NO: 2149318 - protein, 6 aa, Cryptosporidium hominis
KSDRPS

SEQ ID NO: 2149319 - protein, 7 aa, Cryptosporidium hominis
KSDRSVN

SEQ ID NO: 2149320 - protein, 11 aa, Cryptosporidium hominis
KSDSAKKTRKI

SEQ ID NO: 2149321 - protein, 10 aa, Cryptosporidium hominis
KSDSDDVNSW

SEQ ID NO: 2149322 - protein, 9 aa, Cryptosporidium hominis
KSDSTSSDD

SEQ ID NO: 2149323 - protein, 7 aa, Cryptosporidium hominis
KSDTTGI

SEQ ID NO: 2149324 - protein, 5 aa, Cryptosporidium hominis
KSDVR

SEQ ID NO: 2149325 - protein, 8 aa, Cryptosporidium hominis
KSDYTGEQ

SEQ ID NO: 2149326 - protein, 23 aa, Cryptosporidium hominis
KSEANIEEDTNKTLADSKQETNL

SEQ ID NO: 2149327 - protein, 7 aa, Cryptosporidium hominis
KSEDDVL

SEQ ID NO: 2149328 - protein, 6 aa, Cryptosporidium hominis
KSEDGF

SEQ ID NO: 2149329 - protein, 10 aa, Cryptosporidium hominis
KSEDIPASNT

SEQ ID NO: 2149330 - protein, 7 aa, Cryptosporidium hominis
KSEESKK

SEQ ID NO: 2149331 - protein, 15 aa, Cryptosporidium hominis
KSEEVGSCEKGMDKD

SEQ ID NO: 2149332 - protein, 8 aa, Cryptosporidium hominis
KSEFSSEL

SEQ ID NO: 2149333 - protein, 7 aa, Cryptosporidium hominis
KSEGLDK

SEQ ID NO: 2149334 - protein, 7 aa, Cryptosporidium hominis
KSEGTME

SEQ ID NO: 2149335 - protein, 12 aa, Cryptosporidium hominis
KSEIEESQISSS

SEQ ID NO: 2149336 - protein, 7 aa, Cryptosporidium hominis
KSEIKSD

SEQ ID NO: 2149337 - protein, 7 aa, Cryptosporidium hominis
KSEINSR

SEQ ID NO: 2149338 - protein, 12 aa, Cryptosporidium hominis
KSEKSQGKQTEI

SEQ ID NO: 2149339 - protein, 10 aa, Cryptosporidium hominis
KSEKSQRCNA

SEQ ID NO: 2149340 - protein, 17 aa, Cryptosporidium hominis
KSEKSYLNSSKLKKESI

SEQ ID NO: 2149341 - protein, 11 aa, Cryptosporidium hominis
KSELEAREEEI

SEQ ID NO: 2149342 - protein, 8 aa, Cryptosporidium hominis
KSELGNGN

SEQ ID NO: 2149343 - protein, 36 aa, Cryptosporidium hominis
KSELKSSGAGIRGNGNSEVSAQSQISNAIKKGSSRI

SEQ ID NO: 2149344 - protein, 6 aa, Cryptosporidium hominis
KSELSD

SEQ ID NO: 2149345 - protein, 17 aa, Cryptosporidium hominis
KSENNSSFASVSESRLS

SEQ ID NO: 2149346 - protein, 7 aa, Cryptosporidium hominis
KSENPSE

SEQ ID NO: 2149347 - protein, 16 aa, Cryptosporidium hominis
KSENRELMEQLNSSSN

SEQ ID NO: 2149348 - protein, 6 aa, Cryptosporidium hominis
KSEPEA

SEQ ID NO: 2149349 - protein, 29 aa, Cryptosporidium hominis
KSEPYGRSSPNQRTQNSKFQGLPNSRHDC

SEQ ID NO: 2149350 - protein, 7 aa, Cryptosporidium hominis
KSEQKRI

SEQ ID NO: 2149351 - protein, 9 aa, Cryptosporidium hominis
KSEQNSPKL

SEQ ID NO: 2149352 - protein, 13 aa, Cryptosporidium hominis
KSESELHSQEESK

SEQ ID NO: 2149353 - protein, 19 aa, Cryptosporidium hominis
KSESKVNDGFKGSSQIESE

SEQ ID NO: 2149354 - protein, 8 aa, Cryptosporidium hominis
KSESPNMA

SEQ ID NO: 2149355 - protein, 7 aa, Cryptosporidium hominis
KSESQGY

SEQ ID NO: 2149356 - protein, 6 aa, Cryptosporidium hominis
KSETAV

SEQ ID NO: 2149357 - protein, 5 aa, Cryptosporidium hominis
KSETK

SEQ ID NO: 2149358 - protein, 23 aa, Cryptosporidium hominis
KSETKEKDSLETNKRQALEPETQ

SEQ ID NO: 2149359 - protein, 6 aa, Cryptosporidium hominis
KSETVK

SEQ ID NO: 2149360 - protein, 5 aa, Cryptosporidium hominis
KSEYD

SEQ ID NO: 2149361 - protein, 16 aa, Cryptosporidium hominis
KSEYYDEYSTQNIRDD

SEQ ID NO: 2149362 - protein, 7 aa, Cryptosporidium hominis
KSFEDGS

SEQ ID NO: 2149363 - protein, 8 aa, Cryptosporidium hominis
KSFEPAHA

SEQ ID NO: 2149364 - protein, 6 aa, Cryptosporidium hominis
KSFESD

SEQ ID NO: 2149365 - protein, 6 aa, Cryptosporidium hominis
KSFESN

SEQ ID NO: 2149366 - protein, 7 aa, Cryptosporidium hominis
KSFNDNS

SEQ ID NO: 2149367 - protein, 7 aa, Cryptosporidium hominis
KSFTDRD

SEQ ID NO: 2149368 - protein, 34 aa, Cryptosporidium hominis
KSFTQDSKENDDIGEEENKDIEEKENEESERTYE

SEQ ID NO: 2149369 - protein, 16 aa, Cryptosporidium hominis
KSGAFPATSPQSRVYN

SEQ ID NO: 2149370 - protein, 6 aa, Cryptosporidium hominis
KSGDRL

SEQ ID NO: 2149371 - protein, 8 aa, Cryptosporidium hominis
KSGENSLN

SEQ ID NO: 2149372 - protein, 9 aa, Cryptosporidium hominis
KSGESTNAD

SEQ ID NO: 2149373 - protein, 5 aa, Cryptosporidium hominis
KSGFG

SEQ ID NO: 2149374 - protein, 8 aa, Cryptosporidium hominis
KSGGAILG

SEQ ID NO: 2149375 - protein, 24 aa, Cryptosporidium hominis
KSGGKASRNAGNKSKNKSSNPYFK

SEQ ID NO: 2149376 - protein, 16 aa, Cryptosporidium hominis
KSGGKSIKRNNELPQN

SEQ ID NO: 2149377 - protein, 10 aa, Cryptosporidium hominis
KSGGRREKDE

SEQ ID NO: 2149378 - protein, 8 aa, Cryptosporidium hominis
KSGGSEEV

SEQ ID NO: 2149379 - protein, 5 aa, Cryptosporidium hominis
KSGIM

SEQ ID NO: 2149380 - protein, 7 aa, Cryptosporidium hominis
KSGIPAN

SEQ ID NO: 2149381 - protein, 22 aa, Cryptosporidium hominis
KSGKHMASETNREHQGINDNSI

SEQ ID NO: 2149382 - protein, 7 aa, Cryptosporidium hominis
KSGKHSK

SEQ ID NO: 2149383 - protein, 6 aa, Cryptosporidium hominis
KSGKKL

SEQ ID NO: 2149384 - protein, 7 aa, Cryptosporidium hominis
KSGKLPK

SEQ ID NO: 2149385 - protein, 11 aa, Cryptosporidium hominis
KSGKLSTEKNC

SEQ ID NO: 2149386 - protein, 6 aa, Cryptosporidium hominis
KSGKVD

SEQ ID NO: 2149387 - protein, 4 aa, Cryptosporidium hominis
KSGL

SEQ ID NO: 2149388 - protein, 7 aa, Cryptosporidium hominis
KSGLRDA

SEQ ID NO: 2149389 - protein, 6 aa, Cryptosporidium hominis
KSGMGK

SEQ ID NO: 2149390 - protein, 5 aa, Cryptosporidium hominis
KSGMH

SEQ ID NO: 2149391 - protein, 6 aa, Cryptosporidium hominis
KSGNKY

SEQ ID NO: 2149392 - protein, 9 aa, Cryptosporidium hominis
KSGNNKGKR

SEQ ID NO: 2149393 - protein, 6 aa, Cryptosporidium hominis
KSGNNY

SEQ ID NO: 2149394 - protein, 7 aa, Cryptosporidium hominis
KSGQASI

SEQ ID NO: 2149395 - protein, 76 aa, Cryptosporidium hominis
KSGQEKDDSESKITDQSSHKDSSSNSINTENDSKLKQELENPQVKKQPYGRASGGNTGNKTTSTSNGNQSKPSTSV

SEQ ID NO: 2149396 - protein, 7 aa, Cryptosporidium hominis
KSGRAEL

SEQ ID NO: 2149397 - protein, 6 aa, Cryptosporidium hominis
KSGSIA

SEQ ID NO: 2149398 - protein, 13 aa, Cryptosporidium hominis
KSGSNSKGEEKEL

SEQ ID NO: 2149399 - protein, 11 aa, Cryptosporidium hominis
KSGSSESFNET

SEQ ID NO: 2149400 - protein, 14 aa, Cryptosporidium hominis
KSGSSRYDQENETK

SEQ ID NO: 2149401 - protein, 6 aa, Cryptosporidium hominis
KSGTSH

SEQ ID NO: 2149402 - protein, 7 aa, Cryptosporidium hominis
KSGTVPN

SEQ ID NO: 2149403 - protein, 13 aa, Cryptosporidium hominis
KSGTVSVGTPTWK

SEQ ID NO: 2149404 - protein, 6 aa, Cryptosporidium hominis
KSGTWY

SEQ ID NO: 2149405 - protein, 4 aa, Cryptosporidium hominis
KSGV

SEQ ID NO: 2149406 - protein, 12 aa, Cryptosporidium hominis
KSGVQSNSSVYS

SEQ ID NO: 2149407 - protein, 5 aa, Cryptosporidium hominis
KSHAQ

SEQ ID NO: 2149408 - protein, 7 aa, Cryptosporidium hominis
KSHDSNG

SEQ ID NO: 2149409 - protein, 16 aa, Cryptosporidium hominis
KSHESQKISKKSKIKS

SEQ ID NO: 2149410 - protein, 30 aa, Cryptosporidium hominis
KSHNDKANTNTGSTINTCANSDTSNFSNHT

SEQ ID NO: 2149411 - protein, 8 aa, Cryptosporidium hominis
KSHNNETN

SEQ ID NO: 2149412 - protein, 8 aa, Cryptosporidium hominis
KSHSELRK

SEQ ID NO: 2149413 - protein, 10 aa, Cryptosporidium hominis
KSHSESESVS

SEQ ID NO: 2149414 - protein, 6 aa, Cryptosporidium hominis
KSIDNK

SEQ ID NO: 2149415 - protein, 6 aa, Cryptosporidium hominis
KSIEAE

SEQ ID NO: 2149416 - protein, 5 aa, Cryptosporidium hominis
KSIEI

SEQ ID NO: 2149417 - protein, 12 aa, Cryptosporidium hominis
KSIEKAEKLQNS

SEQ ID NO: 2149418 - protein, 6 aa, Cryptosporidium hominis
KSIEKG

SEQ ID NO: 2149419 - protein, 8 aa, Cryptosporidium hominis
KSIEPTSG

SEQ ID NO: 2149420 - protein, 5 aa, Cryptosporidium hominis
KSIES

SEQ ID NO: 2149421 - protein, 12 aa, Cryptosporidium hominis
KSIGDSSIPARN

SEQ ID NO: 2149422 - protein, 7 aa, Cryptosporidium hominis
KSIGNSF

SEQ ID NO: 2149423 - protein, 7 aa, Cryptosporidium hominis
KSIGREK

SEQ ID NO: 2149424 - protein, 5 aa, Cryptosporidium hominis
KSIGV

SEQ ID NO: 2149425 - protein, 9 aa, Cryptosporidium hominis
KSIKEAREI

SEQ ID NO: 2149426 - protein, 8 aa, Cryptosporidium hominis
KSIKSSDC

SEQ ID NO: 2149427 - protein, 11 aa, Cryptosporidium hominis
KSINSSKTSSI

SEQ ID NO: 2149428 - protein, 5 aa, Cryptosporidium hominis
KSIPD

SEQ ID NO: 2149429 - protein, 74 aa, Cryptosporidium hominis
KSIPKNRDFDEESQRIQKNSSERLPKTSEEATSTKNNTNPTNNKQKNSALPRGKKSKLKKVADKYGEQDDEERK

SEQ ID NO: 2149430 - protein, 12 aa, Cryptosporidium hominis
KSIPTGKSVNSL

SEQ ID NO: 2149431 - protein, 29 aa, Cryptosporidium hominis
KSIRRAQSNKMPHQGLGDDNDGQNPKLGA

SEQ ID NO: 2149432 - protein, 7 aa, Cryptosporidium hominis
KSISALD

SEQ ID NO: 2149433 - protein, 5 aa, Cryptosporidium hominis
KSISE

SEQ ID NO: 2149434 - protein, 7 aa, Cryptosporidium hominis
KSISKSS

SEQ ID NO: 2149435 - protein, 11 aa, Cryptosporidium hominis
KSISNKHPSIS

SEQ ID NO: 2149436 - protein, 11 aa, Cryptosporidium hominis
KSISQSESEHE

SEQ ID NO: 2149437 - protein, 18 aa, Cryptosporidium hominis
KSIVTGSPSLRLNKGNDS

SEQ ID NO: 2149438 - protein, 4 aa, Cryptosporidium hominis
KSKA

SEQ ID NO: 2149439 - protein, 10 aa, Cryptosporidium hominis
KSKAECPMGE

SEQ ID NO: 2149440 - protein, 6 aa, Cryptosporidium hominis
KSKAIQ

SEQ ID NO: 2149441 - protein, 16 aa, Cryptosporidium hominis
KSKALGRQTKETKKRN

SEQ ID NO: 2149442 - protein, 7 aa, Cryptosporidium hominis
KSKDSVN

SEQ ID NO: 2149443 - protein, 8 aa, Cryptosporidium hominis
KSKEEDKI

SEQ ID NO: 2149444 - protein, 10 aa, Cryptosporidium hominis
KSKEKGPNSL

SEQ ID NO: 2149445 - protein, 6 aa, Cryptosporidium hominis
KSKENV

SEQ ID NO: 2149446 - protein, 7 aa, Cryptosporidium hominis
KSKEPDI

SEQ ID NO: 2149447 - protein, 14 aa, Cryptosporidium hominis
KSKFEENPSSMQET

SEQ ID NO: 2149448 - protein, 11 aa, Cryptosporidium hominis
KSKFESGHNEM

SEQ ID NO: 2149449 - protein, 20 aa, Cryptosporidium hominis
KSKGEKSPVSPKSTKISPSL

SEQ ID NO: 2149450 - protein, 7 aa, Cryptosporidium hominis
KSKGNKI

SEQ ID NO: 2149451 - protein, 9 aa, Cryptosporidium hominis
KSKGNTPKY

SEQ ID NO: 2149452 - protein, 10 aa, Cryptosporidium hominis
KSKGSEAKAI

SEQ ID NO: 2149453 - protein, 14 aa, Cryptosporidium hominis
KSKIDQPKSDIPLS

SEQ ID NO: 2149454 - protein, 6 aa, Cryptosporidium hominis
KSKIEE

SEQ ID NO: 2149455 - protein, 6 aa, Cryptosporidium hominis
KSKIPE

SEQ ID NO: 2149456 - protein, 5 aa, Cryptosporidium hominis
KSKKA

SEQ ID NO: 2149457 - protein, 14 aa, Cryptosporidium hominis
KSKKARASSLHKKG

SEQ ID NO: 2149458 - protein, 9 aa, Cryptosporidium hominis
KSKKDEDQQ

SEQ ID NO: 2149459 - protein, 16 aa, Cryptosporidium hominis
KSKKEKDLTRESAKKD

SEQ ID NO: 2149460 - protein, 10 aa, Cryptosporidium hominis
KSKKEQGDEV

SEQ ID NO: 2149461 - protein, 12 aa, Cryptosporidium hominis
KSKKKKVSNKLT

SEQ ID NO: 2149462 - protein, 9 aa, Cryptosporidium hominis
KSKKMEEKA

SEQ ID NO: 2149463 - protein, 6 aa, Cryptosporidium hominis
KSKKYT

SEQ ID NO: 2149464 - protein, 44 aa, Cryptosporidium hominis
KSKLDDSDSKYVGNEDEKDIEKEEEGKERNAFSEEKQNTTCEQL

SEQ ID NO: 2149465 - protein, 28 aa, Cryptosporidium hominis
KSKLEEKLNNSEKNNEFEPEKSEIPTSL

SEQ ID NO: 2149466 - protein, 6 aa, Cryptosporidium hominis
KSKLPD

SEQ ID NO: 2149467 - protein, 4 aa, Cryptosporidium hominis
KSKN

SEQ ID NO: 2149468 - protein, 8 aa, Cryptosporidium hominis
KSKNFSSH

SEQ ID NO: 2149469 - protein, 6 aa, Cryptosporidium hominis
KSKNLK

SEQ ID NO: 2149470 - protein, 9 aa, Cryptosporidium hominis
KSKNNNSNQ

SEQ ID NO: 2149471 - protein, 6 aa, Cryptosporidium hominis
KSKNPL

SEQ ID NO: 2149472 - protein, 8 aa, Cryptosporidium hominis
KSKNPRKM

SEQ ID NO: 2149473 - protein, 8 aa, Cryptosporidium hominis
KSKPALGV

SEQ ID NO: 2149474 - protein, 16 aa, Cryptosporidium hominis
KSKPEKCTSSEFQNER

SEQ ID NO: 2149475 - protein, 9 aa, Cryptosporidium hominis
KSKPPVPLY

SEQ ID NO: 2149476 - protein, 13 aa, Cryptosporidium hominis
KSKPTPADKPYRV

SEQ ID NO: 2149477 - protein, 21 aa, Cryptosporidium hominis
KSKQAYSNYDNNELKDNQEKV

SEQ ID NO: 2149478 - protein, 6 aa, Cryptosporidium hominis
KSKQDA

SEQ ID NO: 2149479 - protein, 7 aa, Cryptosporidium hominis
KSKRGVS

SEQ ID NO: 2149480 - protein, 21 aa, Cryptosporidium hominis
KSKRSIRAPEDPNKPKRPHTA

SEQ ID NO: 2149481 - protein, 11 aa, Cryptosporidium hominis
KSKSDKLSSSN

SEQ ID NO: 2149482 - protein, 7 aa, Cryptosporidium hominis
KSKSDSY

SEQ ID NO: 2149483 - protein, 14 aa, Cryptosporidium hominis
KSKSGGSIKSPRDI

SEQ ID NO: 2149484 - protein, 14 aa, Cryptosporidium hominis
KSKSIVPSKGTDIE

SEQ ID NO: 2149485 - protein, 13 aa, Cryptosporidium hominis
KSKSKLNGNKSIE

SEQ ID NO: 2149486 - protein, 7 aa, Cryptosporidium hominis
KSKSNGM

SEQ ID NO: 2149487 - protein, 8 aa, Cryptosporidium hominis
KSKSPSGV

SEQ ID NO: 2149488 - protein, 7 aa, Cryptosporidium hominis
KSKSQVL

SEQ ID NO: 2149489 - protein, 6 aa, Cryptosporidium hominis
KSKSVL

SEQ ID NO: 2149490 - protein, 11 aa, Cryptosporidium hominis
KSKSVSDLNSK

SEQ ID NO: 2149491 - protein, 5 aa, Cryptosporidium hominis
KSKSY

SEQ ID NO: 2149492 - protein, 9 aa, Cryptosporidium hominis
KSKTDKVNT

SEQ ID NO: 2149493 - protein, 12 aa, Cryptosporidium hominis
KSKTGDSSGMNG

SEQ ID NO: 2149494 - protein, 16 aa, Cryptosporidium hominis
KSKTGQYEGKLPNAIQ

SEQ ID NO: 2149495 - protein, 5 aa, Cryptosporidium hominis
KSKTI

SEQ ID NO: 2149496 - protein, 12 aa, Cryptosporidium hominis
KSKTNSRIKGNT

SEQ ID NO: 2149497 - protein, 15 aa, Cryptosporidium hominis
KSKTWRKNRRKQMQI

SEQ ID NO: 2149498 - protein, 8 aa, Cryptosporidium hominis
KSKVGEQE

SEQ ID NO: 2149499 - protein, 16 aa, Cryptosporidium hominis
KSKYDDNDDDNNNNMQ

SEQ ID NO: 2149500 - protein, 7 aa, Cryptosporidium hominis
KSKYTNL

SEQ ID NO: 2149501 - protein, 6 aa, Cryptosporidium hominis
KSLDDM

SEQ ID NO: 2149502 - protein, 6 aa, Cryptosporidium hominis
KSLDEK

SEQ ID NO: 2149503 - protein, 5 aa, Cryptosporidium hominis
KSLEE

SEQ ID NO: 2149504 - protein, 13 aa, Cryptosporidium hominis
KSLEGSRARYEQS

SEQ ID NO: 2149505 - protein, 10 aa, Cryptosporidium hominis
KSLENERKQI

SEQ ID NO: 2149506 - protein, 8 aa, Cryptosporidium hominis
KSLESTNG

SEQ ID NO: 2149507 - protein, 7 aa, Cryptosporidium hominis
KSLESVK

SEQ ID NO: 2149508 - protein, 29 aa, Cryptosporidium hominis
KSLESYNKKKSSSSYDKVPESVKKLNDEK

SEQ ID NO: 2149509 - protein, 5 aa, Cryptosporidium hominis
KSLGD

SEQ ID NO: 2149510 - protein, 6 aa, Cryptosporidium hominis
KSLGSP

SEQ ID NO: 2149511 - protein, 23 aa, Cryptosporidium hominis
KSLIKNNGQRTKISNKTKTIKSE

SEQ ID NO: 2149512 - protein, 4 aa, Cryptosporidium hominis
KSLK

SEQ ID NO: 2149513 - protein, 8 aa, Cryptosporidium hominis
KSLKQTLE

SEQ ID NO: 2149514 - protein, 7 aa, Cryptosporidium hominis
KSLKSGA

SEQ ID NO: 2149515 - protein, 8 aa, Cryptosporidium hominis
KSLNDEEM

SEQ ID NO: 2149516 - protein, 7 aa, Cryptosporidium hominis
KSLNKTL

SEQ ID NO: 2149517 - protein, 14 aa, Cryptosporidium hominis
KSLNNNFEDQNRET

SEQ ID NO: 2149518 - protein, 5 aa, Cryptosporidium hominis
KSLNP

SEQ ID NO: 2149519 - protein, 5 aa, Cryptosporidium hominis
KSLNS

SEQ ID NO: 2149520 - protein, 8 aa, Cryptosporidium hominis
KSLNSNQH

SEQ ID NO: 2149521 - protein, 6 aa, Cryptosporidium hominis
KSLNST

SEQ ID NO: 2149522 - protein, 8 aa, Cryptosporidium hominis
KSLPADIQ

SEQ ID NO: 2149523 - protein, 5 aa, Cryptosporidium hominis
KSLPN

SEQ ID NO: 2149524 - protein, 48 aa, Cryptosporidium hominis
KSLPNLSKSRRGSYSLTDDSDNESEGGKKGKNTIFSGSKDKTKTKKKG

SEQ ID NO: 2149525 - protein, 7 aa, Cryptosporidium hominis
KSLQGIK

SEQ ID NO: 2149526 - protein, 8 aa, Cryptosporidium hominis
KSLREENE

SEQ ID NO: 2149527 - protein, 6 aa, Cryptosporidium hominis
KSLREP

SEQ ID NO: 2149528 - protein, 13 aa, Cryptosporidium hominis
KSLRPENNKNHYE

SEQ ID NO: 2149529 - protein, 5 aa, Cryptosporidium hominis
KSLSG

SEQ ID NO: 2149530 - protein, 10 aa, Cryptosporidium hominis
KSLSHSNNPL

SEQ ID NO: 2149531 - protein, 6 aa, Cryptosporidium hominis
KSLSNN

SEQ ID NO: 2149532 - protein, 10 aa, Cryptosporidium hominis
KSLSNNNEDF

SEQ ID NO: 2149533 - protein, 13 aa, Cryptosporidium hominis
KSLSSSNNWNPQK

SEQ ID NO: 2149534 - protein, 5 aa, Cryptosporidium hominis
KSLTN

SEQ ID NO: 2149535 - protein, 6 aa, Cryptosporidium hominis
KSMGKN

SEQ ID NO: 2149536 - protein, 4 aa, Cryptosporidium hominis
KSNA

SEQ ID NO: 2149537 - protein, 9 aa, Cryptosporidium hominis
KSNAPYNSN

SEQ ID NO: 2149538 - protein, 16 aa, Cryptosporidium hominis
KSNDFTNEVSQISDKN

SEQ ID NO: 2149539 - protein, 10 aa, Cryptosporidium hominis
KSNDKSSQNI

SEQ ID NO: 2149540 - protein, 39 aa, Cryptosporidium hominis
KSNDNNNESNERISGKYEGDNGNYDNSNLTSGDYSNSKV

SEQ ID NO: 2149541 - protein, 6 aa, Cryptosporidium hominis
KSNELG

SEQ ID NO: 2149542 - protein, 6 aa, Cryptosporidium hominis
KSNENY

SEQ ID NO: 2149543 - protein, 23 aa, Cryptosporidium hominis
KSNESENNQNIKGINPNSTSSSN

SEQ ID NO: 2149544 - protein, 17 aa, Cryptosporidium hominis
KSNESNKSQQNSIKPGS

SEQ ID NO: 2149545 - protein, 23 aa, Cryptosporidium hominis
KSNETNRSGRISNSGAGYSSGSK

SEQ ID NO: 2149546 - protein, 20 aa, Cryptosporidium hominis
KSNFGSKNNLRSNDNNEGFI

SEQ ID NO: 2149547 - protein, 6 aa, Cryptosporidium hominis
KSNFSK

SEQ ID NO: 2149548 - protein, 8 aa, Cryptosporidium hominis
KSNGLSST

SEQ ID NO: 2149549 - protein, 8 aa, Cryptosporidium hominis
KSNGSEYN

SEQ ID NO: 2149550 - protein, 6 aa, Cryptosporidium hominis
KSNHKD

SEQ ID NO: 2149551 - protein, 5 aa, Cryptosporidium hominis
KSNIS

SEQ ID NO: 2149552 - protein, 9 aa, Cryptosporidium hominis
KSNKENKDS

SEQ ID NO: 2149553 - protein, 9 aa, Cryptosporidium hominis
KSNKGIKQN

SEQ ID NO: 2149554 - protein, 7 aa, Cryptosporidium hominis
KSNKKTE

SEQ ID NO: 2149555 - protein, 15 aa, Cryptosporidium hominis
KSNLAQQNSDKSITE

SEQ ID NO: 2149556 - protein, 7 aa, Cryptosporidium hominis
KSNLSRI

SEQ ID NO: 2149557 - protein, 19 aa, Cryptosporidium hominis
KSNNRDVSEAAEILLARVA

SEQ ID NO: 2149558 - protein, 6 aa, Cryptosporidium hominis
KSNNSF

SEQ ID NO: 2149559 - protein, 8 aa, Cryptosporidium hominis
KSNNSKSN

SEQ ID NO: 2149560 - protein, 10 aa, Cryptosporidium hominis
KSNNSRSGIP

SEQ ID NO: 2149561 - protein, 18 aa, Cryptosporidium hominis
KSNNTGDYKEMTKNTDVL

SEQ ID NO: 2149562 - protein, 17 aa, Cryptosporidium hominis
KSNNVTSKENYWVLKKK

SEQ ID NO: 2149563 - protein, 14 aa, Cryptosporidium hominis
KSNPCGSNVQNQGQ

SEQ ID NO: 2149564 - protein, 7 aa, Cryptosporidium hominis
KSNPENL

SEQ ID NO: 2149565 - protein, 8 aa, Cryptosporidium hominis
KSNPTKDY

SEQ ID NO: 2149566 - protein, 8 aa, Cryptosporidium hominis
KSNQEKTI

SEQ ID NO: 2149567 - protein, 6 aa, Cryptosporidium hominis
KSNQEM

SEQ ID NO: 2149568 - protein, 7 aa, Cryptosporidium hominis
KSNQERS

SEQ ID NO: 2149569 - protein, 8 aa, Cryptosporidium hominis
KSNQNYTQ

SEQ ID NO: 2149570 - protein, 6 aa, Cryptosporidium hominis
KSNRDL

SEQ ID NO: 2149571 - protein, 8 aa, Cryptosporidium hominis
KSNSFYKN

SEQ ID NO: 2149572 - protein, 5 aa, Cryptosporidium hominis
KSNSI

SEQ ID NO: 2149573 - protein, 8 aa, Cryptosporidium hominis
KSNSKGSV

SEQ ID NO: 2149574 - protein, 13 aa, Cryptosporidium hominis
KSNSKQDSQNVNE

SEQ ID NO: 2149575 - protein, 25 aa, Cryptosporidium hominis
KSNSKSSVNGKNNNSKESSNSEPNL

SEQ ID NO: 2149576 - protein, 10 aa, Cryptosporidium hominis
KSNSKTYNVK

SEQ ID NO: 2149577 - protein, 9 aa, Cryptosporidium hominis
KSNSKYRQE

SEQ ID NO: 2149578 - protein, 10 aa, Cryptosporidium hominis
KSNSSKRRET

SEQ ID NO: 2149579 - protein, 20 aa, Cryptosporidium hominis
KSNSTFKTISDNNSQNASYD

SEQ ID NO: 2149580 - protein, 6 aa, Cryptosporidium hominis
KSNSVK

SEQ ID NO: 2149581 - protein, 9 aa, Cryptosporidium hominis
KSNTNSSLS

SEQ ID NO: 2149582 - protein, 8 aa, Cryptosporidium hominis
KSNTSNSF

SEQ ID NO: 2149583 - protein, 8 aa, Cryptosporidium hominis
KSNVNSPI

SEQ ID NO: 2149584 - protein, 6 aa, Cryptosporidium hominis
KSNYRN

SEQ ID NO: 2149585 - protein, 8 aa, Cryptosporidium hominis
KSPAQGQS

SEQ ID NO: 2149586 - protein, 7 aa, Cryptosporidium hominis
KSPASTI

SEQ ID NO: 2149587 - protein, 9 aa, Cryptosporidium hominis
KSPDEFNDQ

SEQ ID NO: 2149588 - protein, 9 aa, Cryptosporidium hominis
KSPDKKIGK

SEQ ID NO: 2149589 - protein, 7 aa, Cryptosporidium hominis
KSPEANF

SEQ ID NO: 2149590 - protein, 7 aa, Cryptosporidium hominis
KSPEEKH

SEQ ID NO: 2149591 - protein, 13 aa, Cryptosporidium hominis
KSPEEQEENFGRS

SEQ ID NO: 2149592 - protein, 22 aa, Cryptosporidium hominis
KSPEKVDKNTPDFGAAGDGDCD

SEQ ID NO: 2149593 - protein, 26 aa, Cryptosporidium hominis
KSPETWKPQSLAEDQEPKKADQSIEE

SEQ ID NO: 2149594 - protein, 8 aa, Cryptosporidium hominis
KSPETYTS

SEQ ID NO: 2149595 - protein, 6 aa, Cryptosporidium hominis
KSPIDP

SEQ ID NO: 2149596 - protein, 5 aa, Cryptosporidium hominis
KSPIE

SEQ ID NO: 2149597 - protein, 6 aa, Cryptosporidium hominis
KSPIKC

SEQ ID NO: 2149598 - protein, 5 aa, Cryptosporidium hominis
KSPIW

SEQ ID NO: 2149599 - protein, 6 aa, Cryptosporidium hominis
KSPKDK

SEQ ID NO: 2149600 - protein, 7 aa, Cryptosporidium hominis
KSPKGID

SEQ ID NO: 2149601 - protein, 6 aa, Cryptosporidium hominis
KSPKGL

SEQ ID NO: 2149602 - protein, 12 aa, Cryptosporidium hominis
KSPKKGQNTNTV

SEQ ID NO: 2149603 - protein, 6 aa, Cryptosporidium hominis
KSPKNI

SEQ ID NO: 2149604 - protein, 8 aa, Cryptosporidium hominis
KSPKQRIT

SEQ ID NO: 2149605 - protein, 5 aa, Cryptosporidium hominis
KSPKR

SEQ ID NO: 2149606 - protein, 7 aa, Cryptosporidium hominis
KSPNEAL

SEQ ID NO: 2149607 - protein, 8 aa, Cryptosporidium hominis
KSPNGNGG

SEQ ID NO: 2149608 - protein, 6 aa, Cryptosporidium hominis
KSPNIE

SEQ ID NO: 2149609 - protein, 5 aa, Cryptosporidium hominis
KSPNK

SEQ ID NO: 2149610 - protein, 7 aa, Cryptosporidium hominis
KSPQGVG

SEQ ID NO: 2149611 - protein, 6 aa, Cryptosporidium hominis
KSPSDF

SEQ ID NO: 2149612 - protein, 12 aa, Cryptosporidium hominis
KSPSKRISAQES

SEQ ID NO: 2149613 - protein, 9 aa, Cryptosporidium hominis
KSPTSFTNT

SEQ ID NO: 2149614 - protein, 5 aa, Cryptosporidium hominis
KSPYY

SEQ ID NO: 2149615 - protein, 12 aa, Cryptosporidium hominis
KSQDAEIGDGTT

SEQ ID NO: 2149616 - protein, 12 aa, Cryptosporidium hominis
KSQDSMSTQNKN

SEQ ID NO: 2149617 - protein, 22 aa, Cryptosporidium hominis
KSQDSNEILQDNNKKKCQSTQI

SEQ ID NO: 2149618 - protein, 7 aa, Cryptosporidium hominis
KSQENNS

SEQ ID NO: 2149619 - protein, 8 aa, Cryptosporidium hominis
KSQEQKNI

SEQ ID NO: 2149620 - protein, 9 aa, Cryptosporidium hominis
KSQESKRIE

SEQ ID NO: 2149621 - protein, 13 aa, Cryptosporidium hominis
KSQGTEDYSNNGD

SEQ ID NO: 2149622 - protein, 18 aa, Cryptosporidium hominis
KSQIKSNNNESTSKKSSF

SEQ ID NO: 2149623 - protein, 5 aa, Cryptosporidium hominis
KSQLE

SEQ ID NO: 2149624 - protein, 13 aa, Cryptosporidium hominis
KSQLGLGKPGSEL

SEQ ID NO: 2149625 - protein, 5 aa, Cryptosporidium hominis
KSQME

SEQ ID NO: 2149626 - protein, 68 aa, Cryptosporidium hominis
KSQMNSKSYFESSPKSRSHSHSHSCSRSHSNSSPHSYSNSCSYSNSPSGSQSKSNSHSRSRSNSYSEF

SEQ ID NO: 2149627 - protein, 8 aa, Cryptosporidium hominis
KSQNAVKN

SEQ ID NO: 2149628 - protein, 10 aa, Cryptosporidium hominis
KSQNSQDVSF

SEQ ID NO: 2149629 - protein, 9 aa, Cryptosporidium hominis
KSQQSAGKE

SEQ ID NO: 2149630 - protein, 19 aa, Cryptosporidium hominis
KSQRESGRPWKDTPNLKSK

SEQ ID NO: 2149631 - protein, 8 aa, Cryptosporidium hominis
KSQRETVN

SEQ ID NO: 2149632 - protein, 6 aa, Cryptosporidium hominis
KSQSGL

SEQ ID NO: 2149633 - protein, 10 aa, Cryptosporidium hominis
KSQSNEYNLP

SEQ ID NO: 2149634 - protein, 14 aa, Cryptosporidium hominis
KSQSNIENSDHSEP

SEQ ID NO: 2149635 - protein, 7 aa, Cryptosporidium hominis
KSQSRSS

SEQ ID NO: 2149636 - protein, 5 aa, Cryptosporidium hominis
KSQTN

SEQ ID NO: 2149637 - protein, 17 aa, Cryptosporidium hominis
KSQVPNDHKNTSNELDS

SEQ ID NO: 2149638 - protein, 10 aa, Cryptosporidium hominis
KSRASSGISS

SEQ ID NO: 2149639 - protein, 5 aa, Cryptosporidium hominis
KSRCN

SEQ ID NO: 2149640 - protein, 17 aa, Cryptosporidium hominis
KSRDELSVAESQSRRFE

SEQ ID NO: 2149641 - protein, 5 aa, Cryptosporidium hominis
KSREK

SEQ ID NO: 2149642 - protein, 13 aa, Cryptosporidium hominis
KSREKKGFSNIDR

SEQ ID NO: 2149643 - protein, 14 aa, Cryptosporidium hominis
KSRETLSSAEANLR

SEQ ID NO: 2149644 - protein, 6 aa, Cryptosporidium hominis
KSRGDR

SEQ ID NO: 2149645 - protein, 14 aa, Cryptosporidium hominis
KSRGGNPSKMPPEI

SEQ ID NO: 2149646 - protein, 8 aa, Cryptosporidium hominis
KSRGPESP

SEQ ID NO: 2149647 - protein, 6 aa, Cryptosporidium hominis
KSRGSY

SEQ ID NO: 2149648 - protein, 7 aa, Cryptosporidium hominis
KSRHGRK

SEQ ID NO: 2149649 - protein, 5 aa, Cryptosporidium hominis
KSRHP

SEQ ID NO: 2149650 - protein, 11 aa, Cryptosporidium hominis
KSRKKTSNSIF

SEQ ID NO: 2149651 - protein, 12 aa, Cryptosporidium hominis
KSRKSKYNSTNG

SEQ ID NO: 2149652 - protein, 8 aa, Cryptosporidium hominis
KSRKYDKI

SEQ ID NO: 2149653 - protein, 10 aa, Cryptosporidium hominis
KSRNASLSDS

SEQ ID NO: 2149654 - protein, 7 aa, Cryptosporidium hominis
KSRNMDP

SEQ ID NO: 2149655 - protein, 4 aa, Cryptosporidium hominis
KSRP

SEQ ID NO: 2149656 - protein, 9 aa, Cryptosporidium hominis
KSRQDAQYT

SEQ ID NO: 2149657 - protein, 7 aa, Cryptosporidium hominis
KSRQDGQ

SEQ ID NO: 2149658 - protein, 6 aa, Cryptosporidium hominis
KSRQGD

SEQ ID NO: 2149659 - protein, 6 aa, Cryptosporidium hominis
KSRQLR

SEQ ID NO: 2149660 - protein, 15 aa, Cryptosporidium hominis
KSRQNDFDYKGKQTY

SEQ ID NO: 2149661 - protein, 6 aa, Cryptosporidium hominis
KSRREC

SEQ ID NO: 2149662 - protein, 8 aa, Cryptosporidium hominis
KSRREGKE

SEQ ID NO: 2149663 - protein, 17 aa, Cryptosporidium hominis
KSRRVAETTMNERSSRS

SEQ ID NO: 2149664 - protein, 7 aa, Cryptosporidium hominis
KSRSFGN

SEQ ID NO: 2149665 - protein, 10 aa, Cryptosporidium hominis
KSRSGSANTD

SEQ ID NO: 2149666 - protein, 12 aa, Cryptosporidium hominis
KSRSKNNGFSGN

SEQ ID NO: 2149667 - protein, 5 aa, Cryptosporidium hominis
KSRYG

SEQ ID NO: 2149668 - protein, 13 aa, Cryptosporidium hominis
KSSADMKNADPET

SEQ ID NO: 2149669 - protein, 8 aa, Cryptosporidium hominis
KSSAPDVD

SEQ ID NO: 2149670 - protein, 8 aa, Cryptosporidium hominis
KSSASSSS

SEQ ID NO: 2149671 - protein, 14 aa, Cryptosporidium hominis
KSSCPTGSEQQQQI

SEQ ID NO: 2149672 - protein, 7 aa, Cryptosporidium hominis
KSSDDIV

SEQ ID NO: 2149673 - protein, 8 aa, Cryptosporidium hominis
KSSDLSAA

SEQ ID NO: 2149674 - protein, 6 aa, Cryptosporidium hominis
KSSEDS

SEQ ID NO: 2149675 - protein, 19 aa, Cryptosporidium hominis
KSSEDTDESHEKKQDSFQK

SEQ ID NO: 2149676 - protein, 7 aa, Cryptosporidium hominis
KSSEKNI

SEQ ID NO: 2149677 - protein, 9 aa, Cryptosporidium hominis
KSSELKNKK

SEQ ID NO: 2149678 - protein, 15 aa, Cryptosporidium hominis
KSSENPFLIFALLAD

SEQ ID NO: 2149679 - protein, 7 aa, Cryptosporidium hominis
KSSEQLS

SEQ ID NO: 2149680 - protein, 7 aa, Cryptosporidium hominis
KSSEQTI

SEQ ID NO: 2149681 - protein, 6 aa, Cryptosporidium hominis
KSSESI

SEQ ID NO: 2149682 - protein, 8 aa, Cryptosporidium hominis
KSSETTDG

SEQ ID NO: 2149683 - protein, 17 aa, Cryptosporidium hominis
KSSFPHGSFRPSSSNIS

SEQ ID NO: 2149684 - protein, 8 aa, Cryptosporidium hominis
KSSGADVP

SEQ ID NO: 2149685 - protein, 10 aa, Cryptosporidium hominis
KSSGKTNNIQ

SEQ ID NO: 2149686 - protein, 8 aa, Cryptosporidium hominis
KSSGNVNN

SEQ ID NO: 2149687 - protein, 9 aa, Cryptosporidium hominis
KSSGSTSNA

SEQ ID NO: 2149688 - protein, 7 aa, Cryptosporidium hominis
KSSGTHE

SEQ ID NO: 2149689 - protein, 15 aa, Cryptosporidium hominis
KSSIDNLTPSKEINT

SEQ ID NO: 2149690 - protein, 13 aa, Cryptosporidium hominis
KSSIRKKSSQRLR

SEQ ID NO: 2149691 - protein, 7 aa, Cryptosporidium hominis
KSSKDID

SEQ ID NO: 2149692 - protein, 5 aa, Cryptosporidium hominis
KSSKI

SEQ ID NO: 2149693 - protein, 6 aa, Cryptosporidium hominis
KSSKIG

SEQ ID NO: 2149694 - protein, 10 aa, Cryptosporidium hominis
KSSKLSPENR

SEQ ID NO: 2149695 - protein, 6 aa, Cryptosporidium hominis
KSSKPK

SEQ ID NO: 2149696 - protein, 29 aa, Cryptosporidium hominis
KSSKPNIAPLSETEINKKRKQLKAAEMEE

SEQ ID NO: 2149697 - protein, 8 aa, Cryptosporidium hominis
KSSKSKIT

SEQ ID NO: 2149698 - protein, 5 aa, Cryptosporidium hominis
KSSLE

SEQ ID NO: 2149699 - protein, 6 aa, Cryptosporidium hominis
KSSLES

SEQ ID NO: 2149700 - protein, 9 aa, Cryptosporidium hominis
KSSLKSLKT

SEQ ID NO: 2149701 - protein, 19 aa, Cryptosporidium hominis
KSSLPQEDTRINSSIQDER

SEQ ID NO: 2149702 - protein, 9 aa, Cryptosporidium hominis
KSSMDESRG

SEQ ID NO: 2149703 - protein, 32 aa, Cryptosporidium hominis
KSSMNEKPRQGRRKRGSGSGSGPGSGSGSGVT

SEQ ID NO: 2149704 - protein, 4 aa, Cryptosporidium hominis
KSSN

SEQ ID NO: 2149705 - protein, 21 aa, Cryptosporidium hominis
KSSNIGNTYRGDNAIRNSGEV

SEQ ID NO: 2149706 - protein, 26 aa, Cryptosporidium hominis
KSSNKKDLTGNRPKSTSISTSTENTK

SEQ ID NO: 2149707 - protein, 10 aa, Cryptosporidium hominis
KSSNKNIENL

SEQ ID NO: 2149708 - protein, 5 aa, Cryptosporidium hominis
KSSNL

SEQ ID NO: 2149709 - protein, 6 aa, Cryptosporidium hominis
KSSNLL

SEQ ID NO: 2149710 - protein, 15 aa, Cryptosporidium hominis
KSSNNYSGGPKPRCS

SEQ ID NO: 2149711 - protein, 6 aa, Cryptosporidium hominis
KSSNQF

SEQ ID NO: 2149712 - protein, 9 aa, Cryptosporidium hominis
KSSNSNGGF

SEQ ID NO: 2149713 - protein, 14 aa, Cryptosporidium hominis
KSSNTNQGTKVSSG

SEQ ID NO: 2149714 - protein, 8 aa, Cryptosporidium hominis
KSSPDPAP

SEQ ID NO: 2149715 - protein, 18 aa, Cryptosporidium hominis
KSSQKQGKTQANSETFLP

SEQ ID NO: 2149716 - protein, 7 aa, Cryptosporidium hominis
KSSRGDM

SEQ ID NO: 2149717 - protein, 17 aa, Cryptosporidium hominis
KSSRSNLNHDKTIDSLD

SEQ ID NO: 2149718 - protein, 8 aa, Cryptosporidium hominis
KSSSITKQ

SEQ ID NO: 2149719 - protein, 14 aa, Cryptosporidium hominis
KSSSLNNKSFERSK

SEQ ID NO: 2149720 - protein, 13 aa, Cryptosporidium hominis
KSSSNEEGNNGLL

SEQ ID NO: 2149721 - protein, 13 aa, Cryptosporidium hominis
KSSSNSSKHKSMT

SEQ ID NO: 2149722 - protein, 9 aa, Cryptosporidium hominis
KSSSSGMDV

SEQ ID NO: 2149723 - protein, 8 aa, Cryptosporidium hominis
KSSSSPEL

SEQ ID NO: 2149724 - protein, 62 aa, Cryptosporidium hominis
KSSSVKKDDGEKKEEKEEKEEKKDEKEDKKDKKKEEIEEAKEKKEEKKESDEKKDETDNKEV

SEQ ID NO: 2149725 - protein, 6 aa, Cryptosporidium hominis
KSSSYL

SEQ ID NO: 2149726 - protein, 8 aa, Cryptosporidium hominis
KSSTCSDF

SEQ ID NO: 2149727 - protein, 5 aa, Cryptosporidium hominis
KSSTK

SEQ ID NO: 2149728 - protein, 8 aa, Cryptosporidium hominis
KSSTKDNR

SEQ ID NO: 2149729 - protein, 11 aa, Cryptosporidium hominis
KSSTNTSSNQQ

SEQ ID NO: 2149730 - protein, 7 aa, Cryptosporidium hominis
KSSTSLL

SEQ ID NO: 2149731 - protein, 6 aa, Cryptosporidium hominis
KSSTTV

SEQ ID NO: 2149732 - protein, 7 aa, Cryptosporidium hominis
KSSTVDK

SEQ ID NO: 2149733 - protein, 9 aa, Cryptosporidium hominis
KSSVEKYSP

SEQ ID NO: 2149734 - protein, 30 aa, Cryptosporidium hominis
KSSVKAPPVPKSGPGNEKTEEEKLKSSEPI

SEQ ID NO: 2149735 - protein, 8 aa, Cryptosporidium hominis
KSSVQPSI

SEQ ID NO: 2149736 - protein, 14 aa, Cryptosporidium hominis
KSSVSSVKTASRIS

SEQ ID NO: 2149737 - protein, 4 aa, Cryptosporidium hominis
KSSW

SEQ ID NO: 2149738 - protein, 7 aa, Cryptosporidium hominis
KSSWPKK

SEQ ID NO: 2149739 - protein, 9 aa, Cryptosporidium hominis
KSSYGPKNK

SEQ ID NO: 2149740 - protein, 5 aa, Cryptosporidium hominis
KSSYV

SEQ ID NO: 2149741 - protein, 8 aa, Cryptosporidium hominis
KSTDESVI

SEQ ID NO: 2149742 - protein, 6 aa, Cryptosporidium hominis
KSTEKI

SEQ ID NO: 2149743 - protein, 10 aa, Cryptosporidium hominis
KSTENDELTT

SEQ ID NO: 2149744 - protein, 18 aa, Cryptosporidium hominis
KSTENPLKKLVNSKENSE

SEQ ID NO: 2149745 - protein, 35 aa, Cryptosporidium hominis
KSTFKDNSRAQKEKNKLAKRTKKDSVIRDNTNKSL

SEQ ID NO: 2149746 - protein, 11 aa, Cryptosporidium hominis
KSTGADTQKRE

SEQ ID NO: 2149747 - protein, 7 aa, Cryptosporidium hominis
KSTGIHR

SEQ ID NO: 2149748 - protein, 10 aa, Cryptosporidium hominis
KSTGRGSEIS

SEQ ID NO: 2149749 - protein, 8 aa, Cryptosporidium hominis
KSTHSTDN

SEQ ID NO: 2149750 - protein, 5 aa, Cryptosporidium hominis
KSTIE

SEQ ID NO: 2149751 - protein, 5 aa, Cryptosporidium hominis
KSTIT

SEQ ID NO: 2149752 - protein, 15 aa, Cryptosporidium hominis
KSTITSGISNSNNVN

SEQ ID NO: 2149753 - protein, 4 aa, Cryptosporidium hominis
KSTK

SEQ ID NO: 2149754 - protein, 8 aa, Cryptosporidium hominis
KSTKIGNN

SEQ ID NO: 2149755 - protein, 10 aa, Cryptosporidium hominis
KSTKKRMKAE

SEQ ID NO: 2149756 - protein, 5 aa, Cryptosporidium hominis
KSTLN

SEQ ID NO: 2149757 - protein, 8 aa, Cryptosporidium hominis
KSTLVGDE

SEQ ID NO: 2149758 - protein, 7 aa, Cryptosporidium hominis
KSTNAKI

SEQ ID NO: 2149759 - protein, 5 aa, Cryptosporidium hominis
KSTNG

SEQ ID NO: 2149760 - protein, 9 aa, Cryptosporidium hominis
KSTNLNNGT

SEQ ID NO: 2149761 - protein, 7 aa, Cryptosporidium hominis
KSTNNEL

SEQ ID NO: 2149762 - protein, 16 aa, Cryptosporidium hominis
KSTPQDGIDQELDGNG

SEQ ID NO: 2149763 - protein, 26 aa, Cryptosporidium hominis
KSTQSLNNCKRNGSNILSSNTHSGLT

SEQ ID NO: 2149764 - protein, 7 aa, Cryptosporidium hominis
KSTRQVY

SEQ ID NO: 2149765 - protein, 68 aa, Cryptosporidium hominis
KSTRSKRVLSSDSSDGCKSSGDESEESASNFQSQPSNYTTSEDESDNKSSDNESDDESDSSLSTRGRR

SEQ ID NO: 2149766 - protein, 17 aa, Cryptosporidium hominis
KSTSMTNSGNAKPIQRN

SEQ ID NO: 2149767 - protein, 7 aa, Cryptosporidium hominis
KSTSNKF

SEQ ID NO: 2149768 - protein, 7 aa, Cryptosporidium hominis
KSTSNTL

SEQ ID NO: 2149769 - protein, 5 aa, Cryptosporidium hominis
KSTTV

SEQ ID NO: 2149770 - protein, 4 aa, Cryptosporidium hominis
KSTV

SEQ ID NO: 2149771 - protein, 12 aa, Cryptosporidium hominis
KSTVGGGGSNVG

SEQ ID NO: 2149772 - protein, 7 aa, Cryptosporidium hominis
KSTVGKV

SEQ ID NO: 2149773 - protein, 4 aa, Cryptosporidium hominis
KSTY

SEQ ID NO: 2149774 - protein, 5 aa, Cryptosporidium hominis
KSTYN

SEQ ID NO: 2149775 - protein, 20 aa, Cryptosporidium hominis
KSVDSASFRNAAKDKAERVR

SEQ ID NO: 2149776 - protein, 20 aa, Cryptosporidium hominis
KSVEESIKRTPTKSDIYSAP

SEQ ID NO: 2149777 - protein, 27 aa, Cryptosporidium hominis
KSVGENNSKSTLSKRSEKLSKSSSLNN

SEQ ID NO: 2149778 - protein, 12 aa, Cryptosporidium hominis
KSVGYKSEEEIE

SEQ ID NO: 2149779 - protein, 9 aa, Cryptosporidium hominis
KSVNGGRGI

SEQ ID NO: 2149780 - protein, 6 aa, Cryptosporidium hominis
KSVNIS

SEQ ID NO: 2149781 - protein, 20 aa, Cryptosporidium hominis
KSVPKKQASKVQNTHGETHS

SEQ ID NO: 2149782 - protein, 7 aa, Cryptosporidium hominis
KSVQGNY

SEQ ID NO: 2149783 - protein, 13 aa, Cryptosporidium hominis
KSVRQDRNYTTKS

SEQ ID NO: 2149784 - protein, 4 aa, Cryptosporidium hominis
KSVS

SEQ ID NO: 2149785 - protein, 10 aa, Cryptosporidium hominis
KSVSESNQDR

SEQ ID NO: 2149786 - protein, 6 aa, Cryptosporidium hominis
KSVSKD

SEQ ID NO: 2149787 - protein, 7 aa, Cryptosporidium hominis
KSVSSKD

SEQ ID NO: 2149788 - protein, 24 aa, Cryptosporidium hominis
KSVTKPGNTSGFSNPGAKNKKHDF

SEQ ID NO: 2149789 - protein, 9 aa, Cryptosporidium hominis
KSVTSNLQT

SEQ ID NO: 2149790 - protein, 5 aa, Cryptosporidium hominis
KSVTV

SEQ ID NO: 2149791 - protein, 18 aa, Cryptosporidium hominis
KSWNENDNNEYQSAEKEL

SEQ ID NO: 2149792 - protein, 17 aa, Cryptosporidium hominis
KSWSNSTQRSEYNKHSN

SEQ ID NO: 2149793 - protein, 7 aa, Cryptosporidium hominis
KSYAQRR

SEQ ID NO: 2149794 - protein, 6 aa, Cryptosporidium hominis
KSYDEI

SEQ ID NO: 2149795 - protein, 7 aa, Cryptosporidium hominis
KSYGGSK

SEQ ID NO: 2149796 - protein, 6 aa, Cryptosporidium hominis
KSYGKL

SEQ ID NO: 2149797 - protein, 6 aa, Cryptosporidium hominis
KSYNKS

SEQ ID NO: 2149798 - protein, 17 aa, Cryptosporidium hominis
KSYPCKDNADFPHCNSL

SEQ ID NO: 2149799 - protein, 5 aa, Cryptosporidium hominis
KSYPI

SEQ ID NO: 2149800 - protein, 6 aa, Cryptosporidium hominis
KSYSGD

SEQ ID NO: 2149801 - protein, 6 aa, Cryptosporidium hominis
KSYSSA

SEQ ID NO: 2149802 - protein, 7 aa, Cryptosporidium hominis
KSYTNEM

SEQ ID NO: 2149803 - protein, 9 aa, Cryptosporidium hominis
KTAAEERSI

SEQ ID NO: 2149804 - protein, 4 aa, Cryptosporidium hominis
KTAC

SEQ ID NO: 2149805 - protein, 8 aa, Cryptosporidium hominis
KTACNSGG

SEQ ID NO: 2149806 - protein, 5 aa, Cryptosporidium hominis
KTAEE

SEQ ID NO: 2149807 - protein, 7 aa, Cryptosporidium hominis
KTAETGY

SEQ ID NO: 2149808 - protein, 7 aa, Cryptosporidium hominis
KTAKGST

SEQ ID NO: 2149809 - protein, 9 aa, Cryptosporidium hominis
KTASKNPDL

SEQ ID NO: 2149810 - protein, 13 aa, Cryptosporidium hominis
KTASSKELPPQNS

SEQ ID NO: 2149811 - protein, 7 aa, Cryptosporidium hominis
KTCETTE

SEQ ID NO: 2149812 - protein, 4 aa, Cryptosporidium hominis
KTCR

SEQ ID NO: 2149813 - protein, 7 aa, Cryptosporidium hominis
KTDAFSE

SEQ ID NO: 2149814 - protein, 23 aa, Cryptosporidium hominis
KTDEKRLANNISNREEEEEEEEE

SEQ ID NO: 2149815 - protein, 5 aa, Cryptosporidium hominis
KTDGC

SEQ ID NO: 2149816 - protein, 4 aa, Cryptosporidium hominis
KTDK

SEQ ID NO: 2149817 - protein, 5 aa, Cryptosporidium hominis
KTDKL

SEQ ID NO: 2149818 - protein, 9 aa, Cryptosporidium hominis
KTDKQSELG

SEQ ID NO: 2149819 - protein, 13 aa, Cryptosporidium hominis
KTDNNDENQNRSQ

SEQ ID NO: 2149820 - protein, 7 aa, Cryptosporidium hominis
KTDPNEL

SEQ ID NO: 2149821 - protein, 6 aa, Cryptosporidium hominis
KTDQKI

SEQ ID NO: 2149822 - protein, 10 aa, Cryptosporidium hominis
KTDTNDKYGE

SEQ ID NO: 2149823 - protein, 7 aa, Cryptosporidium hominis
KTDYDEI

SEQ ID NO: 2149824 - protein, 5 aa, Cryptosporidium hominis
KTDYQ

SEQ ID NO: 2149825 - protein, 4 aa, Cryptosporidium hominis
KTEA

SEQ ID NO: 2149826 - protein, 22 aa, Cryptosporidium hominis
KTEAGKSEKISLSTDELDTGHK

SEQ ID NO: 2149827 - protein, 6 aa, Cryptosporidium hominis
KTEEYE

SEQ ID NO: 2149828 - protein, 23 aa, Cryptosporidium hominis
KTEFGGYANAKSTVSKPNSSNWK

SEQ ID NO: 2149829 - protein, 9 aa, Cryptosporidium hominis
KTEGFSGRQ

SEQ ID NO: 2149830 - protein, 36 aa, Cryptosporidium hominis
KTEHESDDYSTRKNVKSLKERKKEKTGKKKGKKNLV

SEQ ID NO: 2149831 - protein, 6 aa, Cryptosporidium hominis
KTEIDS

SEQ ID NO: 2149832 - protein, 6 aa, Cryptosporidium hominis
KTEIKS

SEQ ID NO: 2149833 - protein, 8 aa, Cryptosporidium hominis
KTEKYSDL

SEQ ID NO: 2149834 - protein, 9 aa, Cryptosporidium hominis
KTENGSSTL

SEQ ID NO: 2149835 - protein, 9 aa, Cryptosporidium hominis
KTENGTPVI

SEQ ID NO: 2149836 - protein, 9 aa, Cryptosporidium hominis
KTENQLPSN

SEQ ID NO: 2149837 - protein, 30 aa, Cryptosporidium hominis
KTENSNGNIINQGAGSTNVSSSNNSGGFTE

SEQ ID NO: 2149838 - protein, 6 aa, Cryptosporidium hominis
KTEPVS

SEQ ID NO: 2149839 - protein, 8 aa, Cryptosporidium hominis
KTERKGEF

SEQ ID NO: 2149840 - protein, 7 aa, Cryptosporidium hominis
KTERSVK

SEQ ID NO: 2149841 - protein, 9 aa, Cryptosporidium hominis
KTESEKDTC

SEQ ID NO: 2149842 - protein, 8 aa, Cryptosporidium hominis
KTETRRRS

SEQ ID NO: 2149843 - protein, 18 aa, Cryptosporidium hominis
KTEVPQSLSNTQNKKRNR

SEQ ID NO: 2149844 - protein, 4 aa, Cryptosporidium hominis
KTEY

SEQ ID NO: 2149845 - protein, 9 aa, Cryptosporidium hominis
KTFSDSSER

SEQ ID NO: 2149846 - protein, 6 aa, Cryptosporidium hominis
KTGDSL

SEQ ID NO: 2149847 - protein, 11 aa, Cryptosporidium hominis
KTGHSGTLDPK

SEQ ID NO: 2149848 - protein, 24 aa, Cryptosporidium hominis
KTGIESPSYVSDNSQISDKTQKHM

SEQ ID NO: 2149849 - protein, 8 aa, Cryptosporidium hominis
KTGKPATQ

SEQ ID NO: 2149850 - protein, 43 aa, Cryptosporidium hominis
KTGKRIKDLNKSGNNVESKVEGGSRTKSSSSTNSGSISRNSKV

SEQ ID NO: 2149851 - protein, 6 aa, Cryptosporidium hominis
KTGMDS

SEQ ID NO: 2149852 - protein, 4 aa, Cryptosporidium hominis
KTGN

SEQ ID NO: 2149853 - protein, 8 aa, Cryptosporidium hominis
KTGNIEST

SEQ ID NO: 2149854 - protein, 9 aa, Cryptosporidium hominis
KTGNSSEFN

SEQ ID NO: 2149855 - protein, 12 aa, Cryptosporidium hominis
KTGNYHENDRNE

SEQ ID NO: 2149856 - protein, 7 aa, Cryptosporidium hominis
KTGREMK

SEQ ID NO: 2149857 - protein, 6 aa, Cryptosporidium hominis
KTGRGP

SEQ ID NO: 2149858 - protein, 6 aa, Cryptosporidium hominis
KTGSDM

SEQ ID NO: 2149859 - protein, 6 aa, Cryptosporidium hominis
KTGTID

SEQ ID NO: 2149860 - protein, 29 aa, Cryptosporidium hominis
KTGVRGRPPGSGNRGRPPGSTKKAKKDPQ

SEQ ID NO: 2149861 - protein, 12 aa, Cryptosporidium hominis
KTHKENTSGTVS

SEQ ID NO: 2149862 - protein, 6 aa, Cryptosporidium hominis
KTHKKE

SEQ ID NO: 2149863 - protein, 11 aa, Cryptosporidium hominis
KTHPVSDNSMG

SEQ ID NO: 2149864 - protein, 8 aa, Cryptosporidium hominis
KTHTNSNN

SEQ ID NO: 2149865 - protein, 13 aa, Cryptosporidium hominis
KTIDKNSNLDNPE

SEQ ID NO: 2149866 - protein, 5 aa, Cryptosporidium hominis
KTIED

SEQ ID NO: 2149867 - protein, 5 aa, Cryptosporidium hominis
KTIEN

SEQ ID NO: 2149868 - protein, 14 aa, Cryptosporidium hominis
KTIENLKKKSSENR

SEQ ID NO: 2149869 - protein, 16 aa, Cryptosporidium hominis
KTIKDEELGDYDDQEI

SEQ ID NO: 2149870 - protein, 11 aa, Cryptosporidium hominis
KTISDAQSNYL

SEQ ID NO: 2149871 - protein, 6 aa, Cryptosporidium hominis
KTITEK

SEQ ID NO: 2149872 - protein, 15 aa, Cryptosporidium hominis
KTKCSSRKMGMQLGC

SEQ ID NO: 2149873 - protein, 7 aa, Cryptosporidium hominis
KTKEDDL

SEQ ID NO: 2149874 - protein, 15 aa, Cryptosporidium hominis
KTKEDSIDETENQYE

SEQ ID NO: 2149875 - protein, 7 aa, Cryptosporidium hominis
KTKEMSE

SEQ ID NO: 2149876 - protein, 11 aa, Cryptosporidium hominis
KTKENNNPENI

SEQ ID NO: 2149877 - protein, 5 aa, Cryptosporidium hominis
KTKEY

SEQ ID NO: 2149878 - protein, 6 aa, Cryptosporidium hominis
KTKFNQ

SEQ ID NO: 2149879 - protein, 9 aa, Cryptosporidium hominis
KTKGEYSIP

SEQ ID NO: 2149880 - protein, 5 aa, Cryptosporidium hominis
KTKGN

SEQ ID NO: 2149881 - protein, 12 aa, Cryptosporidium hominis
KTKKAKLKDMKI

SEQ ID NO: 2149882 - protein, 6 aa, Cryptosporidium hominis
KTKKAV

SEQ ID NO: 2149883 - protein, 10 aa, Cryptosporidium hominis
KTKKDKREEK

SEQ ID NO: 2149884 - protein, 9 aa, Cryptosporidium hominis
KTKKGQPVL

SEQ ID NO: 2149885 - protein, 13 aa, Cryptosporidium hominis
KTKKRGNKREHRV

SEQ ID NO: 2149886 - protein, 16 aa, Cryptosporidium hominis
KTKNEDLSNSTKNHQK

SEQ ID NO: 2149887 - protein, 10 aa, Cryptosporidium hominis
KTKNKKNSHC

SEQ ID NO: 2149888 - protein, 13 aa, Cryptosporidium hominis
KTKNSLKVSSKID

SEQ ID NO: 2149889 - protein, 9 aa, Cryptosporidium hominis
KTKPLPDTR

SEQ ID NO: 2149890 - protein, 6 aa, Cryptosporidium hominis
KTKQGL

SEQ ID NO: 2149891 - protein, 7 aa, Cryptosporidium hominis
KTKQNGI

SEQ ID NO: 2149892 - protein, 32 aa, Cryptosporidium hominis
KTKRDRDENDNSDSDLSDSDDSDDDNFADEDP

SEQ ID NO: 2149893 - protein, 17 aa, Cryptosporidium hominis
KTKSKHKKRKPRYPKGF

SEQ ID NO: 2149894 - protein, 7 aa, Cryptosporidium hominis
KTKSNVY

SEQ ID NO: 2149895 - protein, 8 aa, Cryptosporidium hominis
KTKSSDTP

SEQ ID NO: 2149896 - protein, 20 aa, Cryptosporidium hominis
KTKSSLDENGEQVQTMSQPN

SEQ ID NO: 2149897 - protein, 6 aa, Cryptosporidium hominis
KTKSST

SEQ ID NO: 2149898 - protein, 8 aa, Cryptosporidium hominis
KTKTYSPI

SEQ ID NO: 2149899 - protein, 7 aa, Cryptosporidium hominis
KTLDPQK

SEQ ID NO: 2149900 - protein, 6 aa, Cryptosporidium hominis
KTLNKT

SEQ ID NO: 2149901 - protein, 23 aa, Cryptosporidium hominis
KTLNPNETFASERSNRNTKFKGP

SEQ ID NO: 2149902 - protein, 6 aa, Cryptosporidium hominis
KTLPQI

SEQ ID NO: 2149903 - protein, 12 aa, Cryptosporidium hominis
KTLSSVGKIGGE

SEQ ID NO: 2149904 - protein, 18 aa, Cryptosporidium hominis
KTLTDESEAKTKENEELR

SEQ ID NO: 2149905 - protein, 8 aa, Cryptosporidium hominis
KTMNSLGT

SEQ ID NO: 2149906 - protein, 49 aa, Cryptosporidium hominis
KTNCETNMTSEQTKKRPSDVAKEEQSKKVCTETSGDVTTTTTTTTTTGI

SEQ ID NO: 2149907 - protein, 8 aa, Cryptosporidium hominis
KTNDSTWK

SEQ ID NO: 2149908 - protein, 5 aa, Cryptosporidium hominis
KTNEF

SEQ ID NO: 2149909 - protein, 5 aa, Cryptosporidium hominis
KTNGE

SEQ ID NO: 2149910 - protein, 15 aa, Cryptosporidium hominis
KTNGLDDATSSQYAQ

SEQ ID NO: 2149911 - protein, 6 aa, Cryptosporidium hominis
KTNIEQ

SEQ ID NO: 2149912 - protein, 6 aa, Cryptosporidium hominis
KTNKAI

SEQ ID NO: 2149913 - protein, 14 aa, Cryptosporidium hominis
KTNKDSKINEMPGT

SEQ ID NO: 2149914 - protein, 7 aa, Cryptosporidium hominis
KTNKLPN

SEQ ID NO: 2149915 - protein, 11 aa, Cryptosporidium hominis
KTNKNKNDHDS

SEQ ID NO: 2149916 - protein, 10 aa, Cryptosporidium hominis
KTNKNTFENS

SEQ ID NO: 2149917 - protein, 7 aa, Cryptosporidium hominis
KTNKTTY

SEQ ID NO: 2149918 - protein, 14 aa, Cryptosporidium hominis
KTNMNSNPPPPSGQ

SEQ ID NO: 2149919 - protein, 9 aa, Cryptosporidium hominis
KTNNNPKWS

SEQ ID NO: 2149920 - protein, 8 aa, Cryptosporidium hominis
KTNNSKYT

SEQ ID NO: 2149921 - protein, 9 aa, Cryptosporidium hominis
KTNNTIEND

SEQ ID NO: 2149922 - protein, 5 aa, Cryptosporidium hominis
KTNPP

SEQ ID NO: 2149923 - protein, 14 aa, Cryptosporidium hominis
KTNQNQVQDENNID

SEQ ID NO: 2149924 - protein, 8 aa, Cryptosporidium hominis
KTNQRGSN

SEQ ID NO: 2149925 - protein, 5 aa, Cryptosporidium hominis
KTNRK

SEQ ID NO: 2149926 - protein, 4 aa, Cryptosporidium hominis
KTNS

SEQ ID NO: 2149927 - protein, 15 aa, Cryptosporidium hominis
KTNSFDMDNRNSQNI

SEQ ID NO: 2149928 - protein, 7 aa, Cryptosporidium hominis
KTNSKDV

SEQ ID NO: 2149929 - protein, 6 aa, Cryptosporidium hominis
KTNSKL

SEQ ID NO: 2149930 - protein, 11 aa, Cryptosporidium hominis
KTNSKNEFQEN

SEQ ID NO: 2149931 - protein, 11 aa, Cryptosporidium hominis
KTNSNFSNPIG

SEQ ID NO: 2149932 - protein, 12 aa, Cryptosporidium hominis
KTNSQDSKHVDT

SEQ ID NO: 2149933 - protein, 21 aa, Cryptosporidium hominis
KTNSSPEIVQNKEDKIPGPTR

SEQ ID NO: 2149934 - protein, 11 aa, Cryptosporidium hominis
KTNVDNTTESG

SEQ ID NO: 2149935 - protein, 15 aa, Cryptosporidium hominis
KTNVQDNEAGGITQQ

SEQ ID NO: 2149936 - protein, 7 aa, Cryptosporidium hominis
KTPDSRK

SEQ ID NO: 2149937 - protein, 8 aa, Cryptosporidium hominis
KTPEDDKM

SEQ ID NO: 2149938 - protein, 7 aa, Cryptosporidium hominis
KTPGGRN

SEQ ID NO: 2149939 - protein, 4 aa, Cryptosporidium hominis
KTPK

SEQ ID NO: 2149940 - protein, 12 aa, Cryptosporidium hominis
KTPKSQKKVQFG

SEQ ID NO: 2149941 - protein, 4 aa, Cryptosporidium hominis
KTPN

SEQ ID NO: 2149942 - protein, 6 aa, Cryptosporidium hominis
KTPNGI

SEQ ID NO: 2149943 - protein, 8 aa, Cryptosporidium hominis
KTPNPGEW

SEQ ID NO: 2149944 - protein, 7 aa, Cryptosporidium hominis
KTPNSKA

SEQ ID NO: 2149945 - protein, 16 aa, Cryptosporidium hominis
KTPPPLKEPNLPEKEQ

SEQ ID NO: 2149946 - protein, 5 aa, Cryptosporidium hominis
KTPQE

SEQ ID NO: 2149947 - protein, 8 aa, Cryptosporidium hominis
KTPQSQIE

SEQ ID NO: 2149948 - protein, 6 aa, Cryptosporidium hominis
KTPRLT

SEQ ID NO: 2149949 - protein, 7 aa, Cryptosporidium hominis
KTPSSKN

SEQ ID NO: 2149950 - protein, 7 aa, Cryptosporidium hominis
KTPTEIQ

SEQ ID NO: 2149951 - protein, 6 aa, Cryptosporidium hominis
KTPTIS

SEQ ID NO: 2149952 - protein, 19 aa, Cryptosporidium hominis
KTPTQTDSVTGKPIDPTTG

SEQ ID NO: 2149953 - protein, 4 aa, Cryptosporidium hominis
KTPV

SEQ ID NO: 2149954 - protein, 11 aa, Cryptosporidium hominis
KTQDSRIPSTY

SEQ ID NO: 2149955 - protein, 4 aa, Cryptosporidium hominis
KTQE

SEQ ID NO: 2149956 - protein, 5 aa, Cryptosporidium hominis
KTQEA

SEQ ID NO: 2149957 - protein, 9 aa, Cryptosporidium hominis
KTQEKGVEN

SEQ ID NO: 2149958 - protein, 18 aa, Cryptosporidium hominis
KTQENKGELNPPENSAYS

SEQ ID NO: 2149959 - protein, 7 aa, Cryptosporidium hominis
KTQGIDL

SEQ ID NO: 2149960 - protein, 22 aa, Cryptosporidium hominis
KTQISGKGTTLGDNNKIHKNSR

SEQ ID NO: 2149961 - protein, 13 aa, Cryptosporidium hominis
KTQKKVGTKNEQV

SEQ ID NO: 2149962 - protein, 10 aa, Cryptosporidium hominis
KTQKNDNTIE

SEQ ID NO: 2149963 - protein, 10 aa, Cryptosporidium hominis
KTQKNNTFSE

SEQ ID NO: 2149964 - protein, 7 aa, Cryptosporidium hominis
KTQLNKD

SEQ ID NO: 2149965 - protein, 6 aa, Cryptosporidium hominis
KTQNGM

SEQ ID NO: 2149966 - protein, 8 aa, Cryptosporidium hominis
KTQQNPEN

SEQ ID NO: 2149967 - protein, 7 aa, Cryptosporidium hominis
KTQRRRN

SEQ ID NO: 2149968 - protein, 5 aa, Cryptosporidium hominis
KTQRS

SEQ ID NO: 2149969 - protein, 16 aa, Cryptosporidium hominis
KTQSYQFPNDDQNNYP

SEQ ID NO: 2149970 - protein, 15 aa, Cryptosporidium hominis
KTQSYSDNRDPAEES

SEQ ID NO: 2149971 - protein, 7 aa, Cryptosporidium hominis
KTQTHPT

SEQ ID NO: 2149972 - protein, 4 aa, Cryptosporidium hominis
KTQV

SEQ ID NO: 2149973 - protein, 28 aa, Cryptosporidium hominis
KTQVTDSSMGLSNGPISTPNSQSFNSSG

SEQ ID NO: 2149974 - protein, 7 aa, Cryptosporidium hominis
KTQYDLT

SEQ ID NO: 2149975 - protein, 11 aa, Cryptosporidium hominis
KTRDEDLSSTL

SEQ ID NO: 2149976 - protein, 6 aa, Cryptosporidium hominis
KTREET

SEQ ID NO: 2149977 - protein, 4 aa, Cryptosporidium hominis
KTRL

SEQ ID NO: 2149978 - protein, 10 aa, Cryptosporidium hominis
KTRNDQTEYE

SEQ ID NO: 2149979 - protein, 8 aa, Cryptosporidium hominis
KTRNSTSI

SEQ ID NO: 2149980 - protein, 5 aa, Cryptosporidium hominis
KTRRE

SEQ ID NO: 2149981 - protein, 16 aa, Cryptosporidium hominis
KTRTEKAGDSNSQGIK

SEQ ID NO: 2149982 - protein, 9 aa, Cryptosporidium hominis
KTSANSVYG

SEQ ID NO: 2149983 - protein, 55 aa, Cryptosporidium hominis
KTSAQKTTKKTGEAAIGKKRGFNSSPGRGGQSRGVRGRGFARGASPRGFRGRGTS

SEQ ID NO: 2149984 - protein, 5 aa, Cryptosporidium hominis
KTSDG

SEQ ID NO: 2149985 - protein, 10 aa, Cryptosporidium hominis
KTSDNNYQSD

SEQ ID NO: 2149986 - protein, 14 aa, Cryptosporidium hominis
KTSEIGVGPSPKVD

SEQ ID NO: 2149987 - protein, 30 aa, Cryptosporidium hominis
KTSENSTAPEEPKPEEKAPPLLSSQSSTFS

SEQ ID NO: 2149988 - protein, 6 aa, Cryptosporidium hominis
KTSEQN

SEQ ID NO: 2149989 - protein, 7 aa, Cryptosporidium hominis
KTSETGY

SEQ ID NO: 2149990 - protein, 5 aa, Cryptosporidium hominis
KTSFS

SEQ ID NO: 2149991 - protein, 6 aa, Cryptosporidium hominis
KTSGNF

SEQ ID NO: 2149992 - protein, 8 aa, Cryptosporidium hominis
KTSGRNKG

SEQ ID NO: 2149993 - protein, 5 aa, Cryptosporidium hominis
KTSHH

SEQ ID NO: 2149994 - protein, 4 aa, Cryptosporidium hominis
KTSI

SEQ ID NO: 2149995 - protein, 6 aa, Cryptosporidium hominis
KTSIGN

SEQ ID NO: 2149996 - protein, 18 aa, Cryptosporidium hominis
KTSKAGKLRESNKNNKSL

SEQ ID NO: 2149997 - protein, 5 aa, Cryptosporidium hominis
KTSKN

SEQ ID NO: 2149998 - protein, 11 aa, Cryptosporidium hominis
KTSKNPNGTVS

SEQ ID NO: 2149999 - protein, 6 aa, Cryptosporidium hominis
KTSNSI

SEQ ID NO: 2150000 - protein, 15 aa, Cryptosporidium hominis
KTSPASGQTPSRRQS

SEQ ID NO: 2150001 - protein, 8 aa, Cryptosporidium hominis
KTSPEFKK

SEQ ID NO: 2150002 - protein, 9 aa, Cryptosporidium hominis
KTSPTPECD

SEQ ID NO: 2150003 - protein, 8 aa, Cryptosporidium hominis
KTSQEGPY

SEQ ID NO: 2150004 - protein, 9 aa, Cryptosporidium hominis
KTSQNMKDD

SEQ ID NO: 2150005 - protein, 32 aa, Cryptosporidium hominis
KTSQSTKDKATLSDESKNLSASAIKGRDKDES

SEQ ID NO: 2150006 - protein, 6 aa, Cryptosporidium hominis
KTSRSG

SEQ ID NO: 2150007 - protein, 7 aa, Cryptosporidium hominis
KTSSEDH

SEQ ID NO: 2150008 - protein, 10 aa, Cryptosporidium hominis
KTSSNQDLNV

SEQ ID NO: 2150009 - protein, 16 aa, Cryptosporidium hominis
KTSSPCSESQNSTPWT

SEQ ID NO: 2150010 - protein, 49 aa, Cryptosporidium hominis
KTSSSNDDSKGKGSDKNKKSQGGKKPTQKKDKKSVSDHSTFPEDTNYSE

SEQ ID NO: 2150011 - protein, 7 aa, Cryptosporidium hominis
KTSTEIR

SEQ ID NO: 2150012 - protein, 7 aa, Cryptosporidium hominis
KTSTEPR

SEQ ID NO: 2150013 - protein, 14 aa, Cryptosporidium hominis
KTTAPNDISETTQK

SEQ ID NO: 2150014 - protein, 23 aa, Cryptosporidium hominis
KTTASSSRSVKSNNSLDPEFNKQ

SEQ ID NO: 2150015 - protein, 7 aa, Cryptosporidium hominis
KTTEEAL

SEQ ID NO: 2150016 - protein, 5 aa, Cryptosporidium hominis
KTTES

SEQ ID NO: 2150017 - protein, 17 aa, Cryptosporidium hominis
KTTFDESNSVDSGNSQA

SEQ ID NO: 2150018 - protein, 16 aa, Cryptosporidium hominis
KTTIEEGHTENGDNIG

SEQ ID NO: 2150019 - protein, 63 aa, Cryptosporidium hominis
KTTIGTTGVTVSSSTSTANANANTNANVTVSANAKTSNTSSAGKTSKMGITSSSETESFTETN

SEQ ID NO: 2150020 - protein, 11 aa, Cryptosporidium hominis
KTTKDLKDTDK

SEQ ID NO: 2150021 - protein, 13 aa, Cryptosporidium hominis
KTTLKSIDPETIS

SEQ ID NO: 2150022 - protein, 13 aa, Cryptosporidium hominis
KTTNLNLDRPDSP

SEQ ID NO: 2150023 - protein, 30 aa, Cryptosporidium hominis
KTTNMKSGNVINDEKDKRKCSKSTENDNFE

SEQ ID NO: 2150024 - protein, 14 aa, Cryptosporidium hominis
KTTNNVSAPMNTGL

SEQ ID NO: 2150025 - protein, 8 aa, Cryptosporidium hominis
KTTPKGNY

SEQ ID NO: 2150026 - protein, 7 aa, Cryptosporidium hominis
KTTPSID

SEQ ID NO: 2150027 - protein, 13 aa, Cryptosporidium hominis
KTTSDEIKNPHLG

SEQ ID NO: 2150028 - protein, 7 aa, Cryptosporidium hominis
KTTSDGK

SEQ ID NO: 2150029 - protein, 23 aa, Cryptosporidium hominis
KTTSECENTAKSSMFSSNKNGEI

SEQ ID NO: 2150030 - protein, 6 aa, Cryptosporidium hominis
KTTSVA

SEQ ID NO: 2150031 - protein, 6 aa, Cryptosporidium hominis
KTVEYA

SEQ ID NO: 2150032 - protein, 9 aa, Cryptosporidium hominis
KTVGKGVAA

SEQ ID NO: 2150033 - protein, 7 aa, Cryptosporidium hominis
KTVKPSY

SEQ ID NO: 2150034 - protein, 6 aa, Cryptosporidium hominis
KTVPTL

SEQ ID NO: 2150035 - protein, 14 aa, Cryptosporidium hominis
KTVQTTNQLKTTEN

SEQ ID NO: 2150036 - protein, 4 aa, Cryptosporidium hominis
KTVS

SEQ ID NO: 2150037 - protein, 6 aa, Cryptosporidium hominis
KTVSEK

SEQ ID NO: 2150038 - protein, 9 aa, Cryptosporidium hominis
KTVSSPEDI

SEQ ID NO: 2150039 - protein, 23 aa, Cryptosporidium hominis
KTVTNTPKHVKKREKLDTNPGAV

SEQ ID NO: 2150040 - protein, 13 aa, Cryptosporidium hominis
KTWSQNTSKKSKI

SEQ ID NO: 2150041 - protein, 12 aa, Cryptosporidium hominis
KTYNTSLSNQNF

SEQ ID NO: 2150042 - protein, 7 aa, Cryptosporidium hominis
KTYPNHS

SEQ ID NO: 2150043 - protein, 4 aa, Cryptosporidium hominis
KTYS

SEQ ID NO: 2150044 - protein, 6 aa, Cryptosporidium hominis
KTYSEQ

SEQ ID NO: 2150045 - protein, 7 aa, Cryptosporidium hominis
KTYTTPR

SEQ ID NO: 2150046 - protein, 7 aa, Cryptosporidium hominis
KVANEKK

SEQ ID NO: 2150047 - protein, 8 aa, Cryptosporidium hominis
KVAPTDIE

SEQ ID NO: 2150048 - protein, 21 aa, Cryptosporidium hominis
KVASTTSSSSGGVPATKQTKI

SEQ ID NO: 2150049 - protein, 28 aa, Cryptosporidium hominis
KVDADELSKRKRQSNSFPGAKKSSSGDL

SEQ ID NO: 2150050 - protein, 4 aa, Cryptosporidium hominis
KVDE

SEQ ID NO: 2150051 - protein, 15 aa, Cryptosporidium hominis
KVDGEKSIDGKECSK

SEQ ID NO: 2150052 - protein, 19 aa, Cryptosporidium hominis
KVDPETFSRKKARTSSTGM

SEQ ID NO: 2150053 - protein, 8 aa, Cryptosporidium hominis
KVDPPNPL

SEQ ID NO: 2150054 - protein, 11 aa, Cryptosporidium hominis
KVDQRSKTRSC

SEQ ID NO: 2150055 - protein, 6 aa, Cryptosporidium hominis
KVDRNA

SEQ ID NO: 2150056 - protein, 13 aa, Cryptosporidium hominis
KVEAGTQSDPPVE

SEQ ID NO: 2150057 - protein, 45 aa, Cryptosporidium hominis
KVEEEKDKKEDEKKEKDEKGKDEKDEKEKEGEKKENKDKQKEKIE

SEQ ID NO: 2150058 - protein, 6 aa, Cryptosporidium hominis
KVEEET

SEQ ID NO: 2150059 - protein, 13 aa, Cryptosporidium hominis
KVEEKKKKGEGRI

SEQ ID NO: 2150060 - protein, 15 aa, Cryptosporidium hominis
KVEESEDTGNNTQVK

SEQ ID NO: 2150061 - protein, 5 aa, Cryptosporidium hominis
KVEGC

SEQ ID NO: 2150062 - protein, 4 aa, Cryptosporidium hominis
KVEK

SEQ ID NO: 2150063 - protein, 8 aa, Cryptosporidium hominis
KVEKSQDN

SEQ ID NO: 2150064 - protein, 7 aa, Cryptosporidium hominis
KVENNGF

SEQ ID NO: 2150065 - protein, 12 aa, Cryptosporidium hominis
KVENSSGSVKND

SEQ ID NO: 2150066 - protein, 8 aa, Cryptosporidium hominis
KVEPENKK

SEQ ID NO: 2150067 - protein, 17 aa, Cryptosporidium hominis
KVEREEIKTNHKEWSER

SEQ ID NO: 2150068 - protein, 7 aa, Cryptosporidium hominis
KVESNEL

SEQ ID NO: 2150069 - protein, 25 aa, Cryptosporidium hominis
KVESNSRDTHKDDKNQTGNNNDQQI

SEQ ID NO: 2150070 - protein, 8 aa, Cryptosporidium hominis
KVESPPMK

SEQ ID NO: 2150071 - protein, 4 aa, Cryptosporidium hominis
KVEY

SEQ ID NO: 2150072 - protein, 5 aa, Cryptosporidium hominis
KVFKD

SEQ ID NO: 2150073 - protein, 8 aa, Cryptosporidium hominis
KVGDIDDP

SEQ ID NO: 2150074 - protein, 6 aa, Cryptosporidium hominis
KVGENN

SEQ ID NO: 2150075 - protein, 9 aa, Cryptosporidium hominis
KVGEQNSWG

SEQ ID NO: 2150076 - protein, 7 aa, Cryptosporidium hominis
KVGKRGI

SEQ ID NO: 2150077 - protein, 4 aa, Cryptosporidium hominis
KVGP

SEQ ID NO: 2150078 - protein, 51 aa, Cryptosporidium hominis
KVGPTEKKQKGKVRSGPTNSSNQRRAGTRFSNNPNLQTQSHVPTQPSPVSG

SEQ ID NO: 2150079 - protein, 13 aa, Cryptosporidium hominis
KVGRGRRQRIKNA

SEQ ID NO: 2150080 - protein, 19 aa, Cryptosporidium hominis
KVHPDKNRGKHEKSAHESF

SEQ ID NO: 2150081 - protein, 7 aa, Cryptosporidium hominis
KVIGTND

SEQ ID NO: 2150082 - protein, 5 aa, Cryptosporidium hominis
KVIKD

SEQ ID NO: 2150083 - protein, 16 aa, Cryptosporidium hominis
KVINKTSDSPNISEQP

SEQ ID NO: 2150084 - protein, 9 aa, Cryptosporidium hominis
KVKDNDSFD

SEQ ID NO: 2150085 - protein, 22 aa, Cryptosporidium hominis
KVKEPTEQKSLEDKPKNTKDIG

SEQ ID NO: 2150086 - protein, 7 aa, Cryptosporidium hominis
KVKGEDY

SEQ ID NO: 2150087 - protein, 6 aa, Cryptosporidium hominis
KVKIEE

SEQ ID NO: 2150088 - protein, 19 aa, Cryptosporidium hominis
KVKKETPNIRKKSENKSNF

SEQ ID NO: 2150089 - protein, 9 aa, Cryptosporidium hominis
KVKLDSTQG

SEQ ID NO: 2150090 - protein, 8 aa, Cryptosporidium hominis
KVKNEENL

SEQ ID NO: 2150091 - protein, 9 aa, Cryptosporidium hominis
KVKRAQYNS

SEQ ID NO: 2150092 - protein, 16 aa, Cryptosporidium hominis
KVKSKKKSQIESSSQT

SEQ ID NO: 2150093 - protein, 16 aa, Cryptosporidium hominis
KVLPRQENQLPVPDYF

SEQ ID NO: 2150094 - protein, 11 aa, Cryptosporidium hominis
KVLQDENAFEN

SEQ ID NO: 2150095 - protein, 11 aa, Cryptosporidium hominis
KVNDEGLRNDL

SEQ ID NO: 2150096 - protein, 6 aa, Cryptosporidium hominis
KVNDES

SEQ ID NO: 2150097 - protein, 6 aa, Cryptosporidium hominis
KVNEDE

SEQ ID NO: 2150098 - protein, 23 aa, Cryptosporidium hominis
KVNEVNKEKTVSTDETKKLNKNA

SEQ ID NO: 2150099 - protein, 7 aa, Cryptosporidium hominis
KVNGNSS

SEQ ID NO: 2150100 - protein, 11 aa, Cryptosporidium hominis
KVNNRSRRSIS

SEQ ID NO: 2150101 - protein, 12 aa, Cryptosporidium hominis
KVNQSLSKNYSE

SEQ ID NO: 2150102 - protein, 7 aa, Cryptosporidium hominis
KVNSDSN

SEQ ID NO: 2150103 - protein, 6 aa, Cryptosporidium hominis
KVPEEQ

SEQ ID NO: 2150104 - protein, 6 aa, Cryptosporidium hominis
KVPEHE

SEQ ID NO: 2150105 - protein, 6 aa, Cryptosporidium hominis
KVPEMN

SEQ ID NO: 2150106 - protein, 5 aa, Cryptosporidium hominis
KVPIT

SEQ ID NO: 2150107 - protein, 6 aa, Cryptosporidium hominis
KVPKGS

SEQ ID NO: 2150108 - protein, 5 aa, Cryptosporidium hominis
KVPPS

SEQ ID NO: 2150109 - protein, 9 aa, Cryptosporidium hominis
KVPSRAAFK

SEQ ID NO: 2150110 - protein, 5 aa, Cryptosporidium hominis
KVPTN

SEQ ID NO: 2150111 - protein, 15 aa, Cryptosporidium hominis
KVPVSSANSDKQKSW

SEQ ID NO: 2150112 - protein, 24 aa, Cryptosporidium hominis
KVQDTSTNKNRSQLSKVDKNSSKI

SEQ ID NO: 2150113 - protein, 14 aa, Cryptosporidium hominis
KVQEEPEKIQHSNT

SEQ ID NO: 2150114 - protein, 14 aa, Cryptosporidium hominis
KVQGKKTIVFLLKS

SEQ ID NO: 2150115 - protein, 7 aa, Cryptosporidium hominis
KVQKQVK

SEQ ID NO: 2150116 - protein, 20 aa, Cryptosporidium hominis
KVQNKSVDNNFSSEATNISK

SEQ ID NO: 2150117 - protein, 6 aa, Cryptosporidium hominis
KVQNNN

SEQ ID NO: 2150118 - protein, 5 aa, Cryptosporidium hominis
KVRAD

SEQ ID NO: 2150119 - protein, 21 aa, Cryptosporidium hominis
KVRQKQRNKKAKQGKIDEQLE

SEQ ID NO: 2150120 - protein, 23 aa, Cryptosporidium hominis
KVRSRSSNPFLSNPKSKKNVKMN

SEQ ID NO: 2150121 - protein, 13 aa, Cryptosporidium hominis
KVSEAYSGRVGTK

SEQ ID NO: 2150122 - protein, 8 aa, Cryptosporidium hominis
KVSERGDL

SEQ ID NO: 2150123 - protein, 5 aa, Cryptosporidium hominis
KVSET

SEQ ID NO: 2150124 - protein, 8 aa, Cryptosporidium hominis
KVSEWENG

SEQ ID NO: 2150125 - protein, 13 aa, Cryptosporidium hominis
KVSGDNFSYAKGS

SEQ ID NO: 2150126 - protein, 9 aa, Cryptosporidium hominis
KVSKKDDKT

SEQ ID NO: 2150127 - protein, 11 aa, Cryptosporidium hominis
KVSKKKKKLNS

SEQ ID NO: 2150128 - protein, 6 aa, Cryptosporidium hominis
KVSLET

SEQ ID NO: 2150129 - protein, 8 aa, Cryptosporidium hominis
KVSQDEYK

SEQ ID NO: 2150130 - protein, 12 aa, Cryptosporidium hominis
KVSSNRKRESEK

SEQ ID NO: 2150131 - protein, 8 aa, Cryptosporidium hominis
KVTDNHSD

SEQ ID NO: 2150132 - protein, 17 aa, Cryptosporidium hominis
KVTDSSSQPSDQSAYSA

SEQ ID NO: 2150133 - protein, 7 aa, Cryptosporidium hominis
KVTEEQF

SEQ ID NO: 2150134 - protein, 6 aa, Cryptosporidium hominis
KVTEEV

SEQ ID NO: 2150135 - protein, 6 aa, Cryptosporidium hominis
KVTEVK

SEQ ID NO: 2150136 - protein, 8 aa, Cryptosporidium hominis
KVTKDNNG

SEQ ID NO: 2150137 - protein, 14 aa, Cryptosporidium hominis
KVTPPKIDSGEKRG

SEQ ID NO: 2150138 - protein, 13 aa, Cryptosporidium hominis
KVTTNTDSNSSLD

SEQ ID NO: 2150139 - protein, 9 aa, Cryptosporidium hominis
KVVPQRPPD

SEQ ID NO: 2150140 - protein, 12 aa, Cryptosporidium hominis
KVYENPNNTKGC

SEQ ID NO: 2150141 - protein, 17 aa, Cryptosporidium hominis
KVYKSNKNIDEKNENDS

SEQ ID NO: 2150142 - protein, 16 aa, Cryptosporidium hominis
KVYTNKSEKKSERLSN

SEQ ID NO: 2150143 - protein, 6 aa, Cryptosporidium hominis
KWDKGP

SEQ ID NO: 2150144 - protein, 11 aa, Cryptosporidium hominis
KWEDKEEKSIV

SEQ ID NO: 2150145 - protein, 6 aa, Cryptosporidium hominis
KWSEEE

SEQ ID NO: 2150146 - protein, 6 aa, Cryptosporidium hominis
KWTDEE

SEQ ID NO: 2150147 - protein, 21 aa, Cryptosporidium hominis
KYAEENNGILNPQNKSGNVVP

SEQ ID NO: 2150148 - protein, 7 aa, Cryptosporidium hominis
KYAGETY

SEQ ID NO: 2150149 - protein, 13 aa, Cryptosporidium hominis
KYATDGSGNEWGN

SEQ ID NO: 2150150 - protein, 7 aa, Cryptosporidium hominis
KYDESLK

SEQ ID NO: 2150151 - protein, 5 aa, Cryptosporidium hominis
KYDGP

SEQ ID NO: 2150152 - protein, 7 aa, Cryptosporidium hominis
KYDGRKN

SEQ ID NO: 2150153 - protein, 6 aa, Cryptosporidium hominis
KYDNQD

SEQ ID NO: 2150154 - protein, 8 aa, Cryptosporidium hominis
KYDSNGQV

SEQ ID NO: 2150155 - protein, 5 aa, Cryptosporidium hominis
KYDTA

SEQ ID NO: 2150156 - protein, 10 aa, Cryptosporidium hominis
KYEEATQSAY

SEQ ID NO: 2150157 - protein, 29 aa, Cryptosporidium hominis
KYEEEERRIKKEKGEEERRRAKKKMGEGV

SEQ ID NO: 2150158 - protein, 8 aa, Cryptosporidium hominis
KYEPEKKG

SEQ ID NO: 2150159 - protein, 19 aa, Cryptosporidium hominis
KYEQEKSNKDFKADNKKEY

SEQ ID NO: 2150160 - protein, 16 aa, Cryptosporidium hominis
KYESTPKESRSSSASY

SEQ ID NO: 2150161 - protein, 5 aa, Cryptosporidium hominis
KYEVQ

SEQ ID NO: 2150162 - protein, 12 aa, Cryptosporidium hominis
KYFEENANTPLR

SEQ ID NO: 2150163 - protein, 7 aa, Cryptosporidium hominis
KYGEDSN

SEQ ID NO: 2150164 - protein, 6 aa, Cryptosporidium hominis
KYGEKK

SEQ ID NO: 2150165 - protein, 11 aa, Cryptosporidium hominis
KYGKRKNGYLT

SEQ ID NO: 2150166 - protein, 10 aa, Cryptosporidium hominis
KYGNNFNKES

SEQ ID NO: 2150167 - protein, 7 aa, Cryptosporidium hominis
KYGPEEE

SEQ ID NO: 2150168 - protein, 16 aa, Cryptosporidium hominis
KYGPYETYSGSPASKG

SEQ ID NO: 2150169 - protein, 8 aa, Cryptosporidium hominis
KYGQAPTN

SEQ ID NO: 2150170 - protein, 16 aa, Cryptosporidium hominis
KYGRKLGESKNQGFDE

SEQ ID NO: 2150171 - protein, 6 aa, Cryptosporidium hominis
KYGSVE

SEQ ID NO: 2150172 - protein, 52 aa, Cryptosporidium hominis
KYHSVQQTSSNSNVSTCASSSSNLNNNNGGNSNGNINSSNSNNNASNIGSRQ

SEQ ID NO: 2150173 - protein, 5 aa, Cryptosporidium hominis
KYIPE

SEQ ID NO: 2150174 - protein, 8 aa, Cryptosporidium hominis
KYIPGSVG

SEQ ID NO: 2150175 - protein, 10 aa, Cryptosporidium hominis
KYKDDARPID

SEQ ID NO: 2150176 - protein, 14 aa, Cryptosporidium hominis
KYKEIGDQKTNSVP

SEQ ID NO: 2150177 - protein, 20 aa, Cryptosporidium hominis
KYKETKKLDLDEKKKENIRQ

SEQ ID NO: 2150178 - protein, 5 aa, Cryptosporidium hominis
KYKGV

SEQ ID NO: 2150179 - protein, 11 aa, Cryptosporidium hominis
KYKNKKCLGTR

SEQ ID NO: 2150180 - protein, 17 aa, Cryptosporidium hominis
KYKSSTESLNKDESGLQ

SEQ ID NO: 2150181 - protein, 29 aa, Cryptosporidium hominis
KYKTRTQELEKENSALRQELSEKNERISQ

SEQ ID NO: 2150182 - protein, 9 aa, Cryptosporidium hominis
KYKTSEESM

SEQ ID NO: 2150183 - protein, 11 aa, Cryptosporidium hominis
KYNGNNKKNSL

SEQ ID NO: 2150184 - protein, 9 aa, Cryptosporidium hominis
KYNGQTNNY

SEQ ID NO: 2150185 - protein, 13 aa, Cryptosporidium hominis
KYNKHKKNEPKRK

SEQ ID NO: 2150186 - protein, 12 aa, Cryptosporidium hominis
KYNKKNSPNSKG

SEQ ID NO: 2150187 - protein, 6 aa, Cryptosporidium hominis
KYNPFG

SEQ ID NO: 2150188 - protein, 29 aa, Cryptosporidium hominis
KYNPSNEPIERSDELQNTSTSVQNTKYIS

SEQ ID NO: 2150189 - protein, 12 aa, Cryptosporidium hominis
KYNQKSSRSSQI

SEQ ID NO: 2150190 - protein, 6 aa, Cryptosporidium hominis
KYNQQS

SEQ ID NO: 2150191 - protein, 14 aa, Cryptosporidium hominis
KYPEKRKISEEIQT

SEQ ID NO: 2150192 - protein, 6 aa, Cryptosporidium hominis
KYPLAK

SEQ ID NO: 2150193 - protein, 4 aa, Cryptosporidium hominis
KYPN

SEQ ID NO: 2150194 - protein, 6 aa, Cryptosporidium hominis
KYPNVD

SEQ ID NO: 2150195 - protein, 12 aa, Cryptosporidium hominis
KYPRDLKQEEAV

SEQ ID NO: 2150196 - protein, 8 aa, Cryptosporidium hominis
KYPSPKDY

SEQ ID NO: 2150197 - protein, 7 aa, Cryptosporidium hominis
KYPSSLE

SEQ ID NO: 2150198 - protein, 7 aa, Cryptosporidium hominis
KYPYNPT

SEQ ID NO: 2150199 - protein, 6 aa, Cryptosporidium hominis
KYQEEA

SEQ ID NO: 2150200 - protein, 5 aa, Cryptosporidium hominis
KYQPR

SEQ ID NO: 2150201 - protein, 10 aa, Cryptosporidium hominis
KYQPSDPDFP

SEQ ID NO: 2150202 - protein, 6 aa, Cryptosporidium hominis
KYQPSS

SEQ ID NO: 2150203 - protein, 6 aa, Cryptosporidium hominis
KYQQAI

SEQ ID NO: 2150204 - protein, 8 aa, Cryptosporidium hominis
KYRDEPES

SEQ ID NO: 2150205 - protein, 14 aa, Cryptosporidium hominis
KYRDPKSQAHIPYR

SEQ ID NO: 2150206 - protein, 13 aa, Cryptosporidium hominis
KYRDSKPLKGARI

SEQ ID NO: 2150207 - protein, 4 aa, Cryptosporidium hominis
KYRN

SEQ ID NO: 2150208 - protein, 10 aa, Cryptosporidium hominis
KYRNGREKDL

SEQ ID NO: 2150209 - protein, 4 aa, Cryptosporidium hominis
KYRT

SEQ ID NO: 2150210 - protein, 8 aa, Cryptosporidium hominis
KYSANNDY

SEQ ID NO: 2150211 - protein, 21 aa, Cryptosporidium hominis
KYSESSSNTKALASLKGSLPE

SEQ ID NO: 2150212 - protein, 5 aa, Cryptosporidium hominis
KYSGF

SEQ ID NO: 2150213 - protein, 16 aa, Cryptosporidium hominis
KYSKGSYQLREYTTLI

SEQ ID NO: 2150214 - protein, 9 aa, Cryptosporidium hominis
KYSKNNNLD

SEQ ID NO: 2150215 - protein, 11 aa, Cryptosporidium hominis
KYSLRENSRSI

SEQ ID NO: 2150216 - protein, 4 aa, Cryptosporidium hominis
KYSN

SEQ ID NO: 2150217 - protein, 11 aa, Cryptosporidium hominis
KYSNKNEDSVF

SEQ ID NO: 2150218 - protein, 6 aa, Cryptosporidium hominis
KYSNNS

SEQ ID NO: 2150219 - protein, 6 aa, Cryptosporidium hominis
KYSPER

SEQ ID NO: 2150220 - protein, 4 aa, Cryptosporidium hominis
KYSS

SEQ ID NO: 2150221 - protein, 9 aa, Cryptosporidium hominis
KYSSAQNLA

SEQ ID NO: 2150222 - protein, 9 aa, Cryptosporidium hominis
KYSSDEEIF

SEQ ID NO: 2150223 - protein, 40 aa, Cryptosporidium hominis
KYSSNSASSTSTNFPNKPISGSISKSRFDNAYKGTNGIGS

SEQ ID NO: 2150224 - protein, 9 aa, Cryptosporidium hominis
KYSSRRKAS

SEQ ID NO: 2150225 - protein, 6 aa, Cryptosporidium hominis
KYSSSL

SEQ ID NO: 2150226 - protein, 7 aa, Cryptosporidium hominis
KYSYSSI

SEQ ID NO: 2150227 - protein, 7 aa, Cryptosporidium hominis
KYTGNPA

SEQ ID NO: 2150228 - protein, 6 aa, Cryptosporidium hominis
KYTGNV

SEQ ID NO: 2150229 - protein, 5 aa, Cryptosporidium hominis
KYTHK

SEQ ID NO: 2150230 - protein, 9 aa, Cryptosporidium hominis
KYTKESPRQ

SEQ ID NO: 2150231 - protein, 25 aa, Cryptosporidium hominis
KYTNENDQTEEIGEKAPKKRKSSAH

SEQ ID NO: 2150232 - protein, 5 aa, Cryptosporidium hominis
KYTNT

SEQ ID NO: 2150233 - protein, 8 aa, Cryptosporidium hominis
KYTRGNQT

SEQ ID NO: 2150234 - protein, 8 aa, Cryptosporidium hominis
KYTSESET

SEQ ID NO: 2150235 - protein, 5 aa, Cryptosporidium hominis
KYTSK

SEQ ID NO: 2150236 - protein, 9 aa, Cryptosporidium hominis
KYVNENSSQ

SEQ ID NO: 2150237 - protein, 9 aa, Cryptosporidium hominis
KYYSSNDDY

SEQ ID NO: 2150238 - protein, 5 aa, Cryptosporidium hominis
LADGQ

SEQ ID NO: 2150239 - protein, 14 aa, Cryptosporidium hominis
LADSSSSSSSSSSD

SEQ ID NO: 2150240 - protein, 6 aa, Cryptosporidium hominis
LAEATN

SEQ ID NO: 2150241 - protein, 5 aa, Cryptosporidium hominis
LAEDK

SEQ ID NO: 2150242 - protein, 12 aa, Cryptosporidium hominis
LAEGAYKYSTET

SEQ ID NO: 2150243 - protein, 9 aa, Cryptosporidium hominis
LAEKPKKTT

SEQ ID NO: 2150244 - protein, 9 aa, Cryptosporidium hominis
LAERSKEIY

SEQ ID NO: 2150245 - protein, 13 aa, Cryptosporidium hominis
LAESKDPSSSLKT

SEQ ID NO: 2150246 - protein, 11 aa, Cryptosporidium hominis
LAESSRYERSS

SEQ ID NO: 2150247 - protein, 15 aa, Cryptosporidium hominis
LAESTNAEDRKIQKK

SEQ ID NO: 2150248 - protein, 7 aa, Cryptosporidium hominis
LAGDNID

SEQ ID NO: 2150249 - protein, 6 aa, Cryptosporidium hominis
LAGNDD

SEQ ID NO: 2150250 - protein, 6 aa, Cryptosporidium hominis
LAGYGS

SEQ ID NO: 2150251 - protein, 12 aa, Cryptosporidium hominis
LAKGTKSGGFQH

SEQ ID NO: 2150252 - protein, 9 aa, Cryptosporidium hominis
LAKGTNRRS

SEQ ID NO: 2150253 - protein, 4 aa, Cryptosporidium hominis
LAKN

SEQ ID NO: 2150254 - protein, 11 aa, Cryptosporidium hominis
LAKNDPKTSIG

SEQ ID NO: 2150255 - protein, 6 aa, Cryptosporidium hominis
LAKNQF

SEQ ID NO: 2150256 - protein, 9 aa, Cryptosporidium hominis
LAKRPKTTQ

SEQ ID NO: 2150257 - protein, 5 aa, Cryptosporidium hominis
LAKSP

SEQ ID NO: 2150258 - protein, 12 aa, Cryptosporidium hominis
LAKTQNENQIQP

SEQ ID NO: 2150259 - protein, 16 aa, Cryptosporidium hominis
LANENKRLNDRLKQDK

SEQ ID NO: 2150260 - protein, 10 aa, Cryptosporidium hominis
LANKTTECSD

SEQ ID NO: 2150261 - protein, 5 aa, Cryptosporidium hominis
LANPG

SEQ ID NO: 2150262 - protein, 7 aa, Cryptosporidium hominis
LANPSSF

SEQ ID NO: 2150263 - protein, 7 aa, Cryptosporidium hominis
LANTSSG

SEQ ID NO: 2150264 - protein, 8 aa, Cryptosporidium hominis
LAPAANAN

SEQ ID NO: 2150265 - protein, 9 aa, Cryptosporidium hominis
LAPAGTNDA

SEQ ID NO: 2150266 - protein, 7 aa, Cryptosporidium hominis
LAPGKVK

SEQ ID NO: 2150267 - protein, 4 aa, Cryptosporidium hominis
LAPL

SEQ ID NO: 2150268 - protein, 11 aa, Cryptosporidium hominis
LAPPKNPKVSH

SEQ ID NO: 2150269 - protein, 12 aa, Cryptosporidium hominis
LAPPSSSVSSSK

SEQ ID NO: 2150270 - protein, 7 aa, Cryptosporidium hominis
LAPSSQC

SEQ ID NO: 2150271 - protein, 14 aa, Cryptosporidium hominis
LAQESLEESSIAPS

SEQ ID NO: 2150272 - protein, 7 aa, Cryptosporidium hominis
LAQNSNS

SEQ ID NO: 2150273 - protein, 22 aa, Cryptosporidium hominis
LAQSKGKVGLRGTKRKPSTNIN

SEQ ID NO: 2150274 - protein, 7 aa, Cryptosporidium hominis
LASGDAD

SEQ ID NO: 2150275 - protein, 8 aa, Cryptosporidium hominis
LASGGQDD

SEQ ID NO: 2150276 - protein, 9 aa, Cryptosporidium hominis
LASGSADET

SEQ ID NO: 2150277 - protein, 5 aa, Cryptosporidium hominis
LASIP

SEQ ID NO: 2150278 - protein, 4 aa, Cryptosporidium hominis
LASP

SEQ ID NO: 2150279 - protein, 7 aa, Cryptosporidium hominis
LASPDLN

SEQ ID NO: 2150280 - protein, 6 aa, Cryptosporidium hominis
LASPSE

SEQ ID NO: 2150281 - protein, 10 aa, Cryptosporidium hominis
LASPVSTKSI

SEQ ID NO: 2150282 - protein, 11 aa, Cryptosporidium hominis
LASQDGSIRKR

SEQ ID NO: 2150283 - protein, 5 aa, Cryptosporidium hominis
LASQN

SEQ ID NO: 2150284 - protein, 9 aa, Cryptosporidium hominis
LASSGKDGA

SEQ ID NO: 2150285 - protein, 37 aa, Cryptosporidium hominis
LASSNSLPKISRNKKRTSLNKQGNANYESKNEDKEKR

SEQ ID NO: 2150286 - protein, 8 aa, Cryptosporidium hominis
LASSNSTI

SEQ ID NO: 2150287 - protein, 8 aa, Cryptosporidium hominis
LASSRDKT

SEQ ID NO: 2150288 - protein, 9 aa, Cryptosporidium hominis
LASSTPNVT

SEQ ID NO: 2150289 - protein, 6 aa, Cryptosporidium hominis
LATGAS

SEQ ID NO: 2150290 - protein, 9 aa, Cryptosporidium hominis
LATGSGDTT

SEQ ID NO: 2150291 - protein, 17 aa, Cryptosporidium hominis
LATNNNNNNNLEGNTGY

SEQ ID NO: 2150292 - protein, 6 aa, Cryptosporidium hominis
LATNYQ

SEQ ID NO: 2150293 - protein, 8 aa, Cryptosporidium hominis
LATTSNGS

SEQ ID NO: 2150294 - protein, 7 aa, Cryptosporidium hominis
LCPSDSS

SEQ ID NO: 2150295 - protein, 16 aa, Cryptosporidium hominis
LDASKKCEDVANDSVP

SEQ ID NO: 2150296 - protein, 7 aa, Cryptosporidium hominis
LDASKQK

SEQ ID NO: 2150297 - protein, 4 aa, Cryptosporidium hominis
LDAT

SEQ ID NO: 2150298 - protein, 8 aa, Cryptosporidium hominis
LDATNTGL

SEQ ID NO: 2150299 - protein, 10 aa, Cryptosporidium hominis
LDDDKNSHLT

SEQ ID NO: 2150300 - protein, 16 aa, Cryptosporidium hominis
LDDEDKINEKVSQSLR

SEQ ID NO: 2150301 - protein, 6 aa, Cryptosporidium hominis
LDDKEK

SEQ ID NO: 2150302 - protein, 10 aa, Cryptosporidium hominis
LDDKGELTKV

SEQ ID NO: 2150303 - protein, 25 aa, Cryptosporidium hominis
LDDNQEKGNSNEKKNIKGLGEGEEL

SEQ ID NO: 2150304 - protein, 10 aa, Cryptosporidium hominis
LDDSNKTPFV

SEQ ID NO: 2150305 - protein, 6 aa, Cryptosporidium hominis
LDDSSK

SEQ ID NO: 2150306 - protein, 7 aa, Cryptosporidium hominis
LDDSTGK

SEQ ID NO: 2150307 - protein, 15 aa, Cryptosporidium hominis
LDDTERFNSRTDPRF

SEQ ID NO: 2150308 - protein, 7 aa, Cryptosporidium hominis
LDDTPRC

SEQ ID NO: 2150309 - protein, 5 aa, Cryptosporidium hominis
LDDYP

SEQ ID NO: 2150310 - protein, 27 aa, Cryptosporidium hominis
LDEEEEDDNDYRGYSGENFKNNTSTND

SEQ ID NO: 2150311 - protein, 5 aa, Cryptosporidium hominis
LDEEK

SEQ ID NO: 2150312 - protein, 8 aa, Cryptosporidium hominis
LDEKKSGF

SEQ ID NO: 2150313 - protein, 4 aa, Cryptosporidium hominis
LDEN

SEQ ID NO: 2150314 - protein, 8 aa, Cryptosporidium hominis
LDENGRQL

SEQ ID NO: 2150315 - protein, 11 aa, Cryptosporidium hominis
LDENKTGLQDS

SEQ ID NO: 2150316 - protein, 5 aa, Cryptosporidium hominis
LDEPQ

SEQ ID NO: 2150317 - protein, 9 aa, Cryptosporidium hominis
LDEQRLQDE

SEQ ID NO: 2150318 - protein, 5 aa, Cryptosporidium hominis
LDERD

SEQ ID NO: 2150319 - protein, 6 aa, Cryptosporidium hominis
LDERTY

SEQ ID NO: 2150320 - protein, 14 aa, Cryptosporidium hominis
LDESKDKKQIQDDE

SEQ ID NO: 2150321 - protein, 7 aa, Cryptosporidium hominis
LDESNAM

SEQ ID NO: 2150322 - protein, 6 aa, Cryptosporidium hominis
LDESRI

SEQ ID NO: 2150323 - protein, 6 aa, Cryptosporidium hominis
LDETHK

SEQ ID NO: 2150324 - protein, 8 aa, Cryptosporidium hominis
LDETNSNE

SEQ ID NO: 2150325 - protein, 28 aa, Cryptosporidium hominis
LDETQQSKMEDDNMESKSQVRPSRNSRK

SEQ ID NO: 2150326 - protein, 12 aa, Cryptosporidium hominis
LDEVKGGRAAKL

SEQ ID NO: 2150327 - protein, 12 aa, Cryptosporidium hominis
LDGDGDNAISPD

SEQ ID NO: 2150328 - protein, 6 aa, Cryptosporidium hominis
LDGETD

SEQ ID NO: 2150329 - protein, 4 aa, Cryptosporidium hominis
LDGI

SEQ ID NO: 2150330 - protein, 11 aa, Cryptosporidium hominis
LDGKDGDDQTI

SEQ ID NO: 2150331 - protein, 7 aa, Cryptosporidium hominis
LDGNTDI

SEQ ID NO: 2150332 - protein, 15 aa, Cryptosporidium hominis
LDGPSSNRRTALGNV

SEQ ID NO: 2150333 - protein, 5 aa, Cryptosporidium hominis
LDGRY

SEQ ID NO: 2150334 - protein, 5 aa, Cryptosporidium hominis
LDGSH

SEQ ID NO: 2150335 - protein, 11 aa, Cryptosporidium hominis
LDGSKNEYGFT

SEQ ID NO: 2150336 - protein, 7 aa, Cryptosporidium hominis
LDGTGAT

SEQ ID NO: 2150337 - protein, 6 aa, Cryptosporidium hominis
LDHNNS

SEQ ID NO: 2150338 - protein, 9 aa, Cryptosporidium hominis
LDHSDQETF

SEQ ID NO: 2150339 - protein, 4 aa, Cryptosporidium hominis
LDIP

SEQ ID NO: 2150340 - protein, 11 aa, Cryptosporidium hominis
LDISDDSKLKS

SEQ ID NO: 2150341 - protein, 23 aa, Cryptosporidium hominis
LDKDETKVKNEQKSQKEDLDPKS

SEQ ID NO: 2150342 - protein, 8 aa, Cryptosporidium hominis
LDKEEEKL

SEQ ID NO: 2150343 - protein, 9 aa, Cryptosporidium hominis
LDKNKTTNN

SEQ ID NO: 2150344 - protein, 10 aa, Cryptosporidium hominis
LDKNTRKNSE

SEQ ID NO: 2150345 - protein, 11 aa, Cryptosporidium hominis
LDKNYDKGVSN

SEQ ID NO: 2150346 - protein, 23 aa, Cryptosporidium hominis
LDKPPEEHETFGESSRSSIGSTA

SEQ ID NO: 2150347 - protein, 13 aa, Cryptosporidium hominis
LDKQNSNSKFGKS

SEQ ID NO: 2150348 - protein, 8 aa, Cryptosporidium hominis
LDKRSGNI

SEQ ID NO: 2150349 - protein, 4 aa, Cryptosporidium hominis
LDLE

SEQ ID NO: 2150350 - protein, 9 aa, Cryptosporidium hominis
LDLPKPQLS

SEQ ID NO: 2150351 - protein, 4 aa, Cryptosporidium hominis
LDND

SEQ ID NO: 2150352 - protein, 5 aa, Cryptosporidium hominis
LDNED

SEQ ID NO: 2150353 - protein, 11 aa, Cryptosporidium hominis
LDNEDNQSMTG

SEQ ID NO: 2150354 - protein, 13 aa, Cryptosporidium hominis
LDNGNISDNEPTI

SEQ ID NO: 2150355 - protein, 9 aa, Cryptosporidium hominis
LDNNENEKY

SEQ ID NO: 2150356 - protein, 4 aa, Cryptosporidium hominis
LDNQ

SEQ ID NO: 2150357 - protein, 6 aa, Cryptosporidium hominis
LDNSDS

SEQ ID NO: 2150358 - protein, 7 aa, Cryptosporidium hominis
LDNSGSI

SEQ ID NO: 2150359 - protein, 7 aa, Cryptosporidium hominis
LDNSGTI

SEQ ID NO: 2150360 - protein, 8 aa, Cryptosporidium hominis
LDNSNENP

SEQ ID NO: 2150361 - protein, 21 aa, Cryptosporidium hominis
LDNSTNSASIGGGIGRVGGGI

SEQ ID NO: 2150362 - protein, 6 aa, Cryptosporidium hominis
LDPASS

SEQ ID NO: 2150363 - protein, 11 aa, Cryptosporidium hominis
LDPDEENNQPD

SEQ ID NO: 2150364 - protein, 11 aa, Cryptosporidium hominis
LDPDSELNKEL

SEQ ID NO: 2150365 - protein, 7 aa, Cryptosporidium hominis
LDPGATN

SEQ ID NO: 2150366 - protein, 6 aa, Cryptosporidium hominis
LDPGKL

SEQ ID NO: 2150367 - protein, 9 aa, Cryptosporidium hominis
LDPKAKTPF

SEQ ID NO: 2150368 - protein, 4 aa, Cryptosporidium hominis
LDPS

SEQ ID NO: 2150369 - protein, 9 aa, Cryptosporidium hominis
LDPSSNKQY

SEQ ID NO: 2150370 - protein, 6 aa, Cryptosporidium hominis
LDPSTE

SEQ ID NO: 2150371 - protein, 43 aa, Cryptosporidium hominis
LDPTSEKKDASGKSGRRTAHSSKKINSNSAKSTQTDSSNIGSS

SEQ ID NO: 2150372 - protein, 16 aa, Cryptosporidium hominis
LDQENARAPSNGTSIE

SEQ ID NO: 2150373 - protein, 12 aa, Cryptosporidium hominis
LDQESNNAITNT

SEQ ID NO: 2150374 - protein, 13 aa, Cryptosporidium hominis
LDQETSNYFNGER

SEQ ID NO: 2150375 - protein, 16 aa, Cryptosporidium hominis
LDQKSRKVSSQKASAW

SEQ ID NO: 2150376 - protein, 10 aa, Cryptosporidium hominis
LDQQKHEESY

SEQ ID NO: 2150377 - protein, 10 aa, Cryptosporidium hominis
LDQSEKEAER

SEQ ID NO: 2150378 - protein, 5 aa, Cryptosporidium hominis
LDRDE

SEQ ID NO: 2150379 - protein, 20 aa, Cryptosporidium hominis
LDREHATNYQENSFKKRSNK

SEQ ID NO: 2150380 - protein, 7 aa, Cryptosporidium hominis
LDRGGKD

SEQ ID NO: 2150381 - protein, 11 aa, Cryptosporidium hominis
LDRREVTTEEG

SEQ ID NO: 2150382 - protein, 8 aa, Cryptosporidium hominis
LDRSSNGD

SEQ ID NO: 2150383 - protein, 10 aa, Cryptosporidium hominis
LDRTQRKCGD

SEQ ID NO: 2150384 - protein, 4 aa, Cryptosporidium hominis
LDSD

SEQ ID NO: 2150385 - protein, 16 aa, Cryptosporidium hominis
LDSEMQSISSESESEI

SEQ ID NO: 2150386 - protein, 6 aa, Cryptosporidium hominis
LDSETI

SEQ ID NO: 2150387 - protein, 9 aa, Cryptosporidium hominis
LDSGESNPN

SEQ ID NO: 2150388 - protein, 9 aa, Cryptosporidium hominis
LDSGFSNDT

SEQ ID NO: 2150389 - protein, 5 aa, Cryptosporidium hominis
LDSGI

SEQ ID NO: 2150390 - protein, 7 aa, Cryptosporidium hominis
LDSKTQD

SEQ ID NO: 2150391 - protein, 7 aa, Cryptosporidium hominis
LDSNGKK

SEQ ID NO: 2150392 - protein, 16 aa, Cryptosporidium hominis
LDSNGSKKVETSSMQT

SEQ ID NO: 2150393 - protein, 5 aa, Cryptosporidium hominis
LDSNI

SEQ ID NO: 2150394 - protein, 10 aa, Cryptosporidium hominis
LDSNKDSISN

SEQ ID NO: 2150395 - protein, 15 aa, Cryptosporidium hominis
LDSQTNNQNSKYQSN

SEQ ID NO: 2150396 - protein, 4 aa, Cryptosporidium hominis
LDSR

SEQ ID NO: 2150397 - protein, 15 aa, Cryptosporidium hominis
LDSSKFGDSKYDDFG

SEQ ID NO: 2150398 - protein, 26 aa, Cryptosporidium hominis
LDSSKKGNQIEKVGHSNNKKDKDDEH

SEQ ID NO: 2150399 - protein, 8 aa, Cryptosporidium hominis
LDSTEKTR

SEQ ID NO: 2150400 - protein, 10 aa, Cryptosporidium hominis
LDSVGNDSSI

SEQ ID NO: 2150401 - protein, 6 aa, Cryptosporidium hominis
LDSVPS

SEQ ID NO: 2150402 - protein, 9 aa, Cryptosporidium hominis
LDTDKNDVS

SEQ ID NO: 2150403 - protein, 7 aa, Cryptosporidium hominis
LDTDNDG

SEQ ID NO: 2150404 - protein, 9 aa, Cryptosporidium hominis
LDTDSDIEP

SEQ ID NO: 2150405 - protein, 6 aa, Cryptosporidium hominis
LDTEAT

SEQ ID NO: 2150406 - protein, 10 aa, Cryptosporidium hominis
LDTESSQNSG

SEQ ID NO: 2150407 - protein, 15 aa, Cryptosporidium hominis
LDTKPNGQTSSPNMH

SEQ ID NO: 2150408 - protein, 4 aa, Cryptosporidium hominis
LDTL

SEQ ID NO: 2150409 - protein, 13 aa, Cryptosporidium hominis
LDTLTPKKVREEL

SEQ ID NO: 2150410 - protein, 45 aa, Cryptosporidium hominis
LDTQNGKSGENHKGEKTKKDDDYDSDEDDFDNDYSGNTIESDDEN

SEQ ID NO: 2150411 - protein, 11 aa, Cryptosporidium hominis
LDTSSKMGQKD

SEQ ID NO: 2150412 - protein, 10 aa, Cryptosporidium hominis
LDTSSRKMGP

SEQ ID NO: 2150413 - protein, 4 aa, Cryptosporidium hominis
LDTY

SEQ ID NO: 2150414 - protein, 34 aa, Cryptosporidium hominis
LDTYTPETSPCSHRSYSSSKSLYSKDSSLISNTP

SEQ ID NO: 2150415 - protein, 6 aa, Cryptosporidium hominis
LDVNSN

SEQ ID NO: 2150416 - protein, 5 aa, Cryptosporidium hominis
LDYGE

SEQ ID NO: 2150417 - protein, 4 aa, Cryptosporidium hominis
LDYS

SEQ ID NO: 2150418 - protein, 11 aa, Cryptosporidium hominis
LDYTSDKRETL

SEQ ID NO: 2150419 - protein, 21 aa, Cryptosporidium hominis
LEAEKENSSSNSYFKGNSNHK

SEQ ID NO: 2150420 - protein, 20 aa, Cryptosporidium hominis
LEAEKKGEENKRNIVHMKNS

SEQ ID NO: 2150421 - protein, 9 aa, Cryptosporidium hominis
LEAGDNSIS

SEQ ID NO: 2150422 - protein, 20 aa, Cryptosporidium hominis
LEAKESEGKNLNSSSKYIQS

SEQ ID NO: 2150423 - protein, 7 aa, Cryptosporidium hominis
LEANTGG

SEQ ID NO: 2150424 - protein, 6 aa, Cryptosporidium hominis
LEAPET

SEQ ID NO: 2150425 - protein, 11 aa, Cryptosporidium hominis
LEASKDDDNEL

SEQ ID NO: 2150426 - protein, 44 aa, Cryptosporidium hominis
LEASNSATLLSSGSKPNPSSKTTSKSNGGAASKLAYEKNGDNSQ

SEQ ID NO: 2150427 - protein, 10 aa, Cryptosporidium hominis
LEDANKRISQ

SEQ ID NO: 2150428 - protein, 8 aa, Cryptosporidium hominis
LEDDGSET

SEQ ID NO: 2150429 - protein, 10 aa, Cryptosporidium hominis
LEDDLTEKQL

SEQ ID NO: 2150430 - protein, 11 aa, Cryptosporidium hominis
LEDDQSENKKS

SEQ ID NO: 2150431 - protein, 23 aa, Cryptosporidium hominis
LEDEVEEEEEEEEEKEADEDESF

SEQ ID NO: 2150432 - protein, 21 aa, Cryptosporidium hominis
LEDRNTASQAAALANATSQLE

SEQ ID NO: 2150433 - protein, 4 aa, Cryptosporidium hominis
LEDS

SEQ ID NO: 2150434 - protein, 8 aa, Cryptosporidium hominis
LEDSGNRL

SEQ ID NO: 2150435 - protein, 6 aa, Cryptosporidium hominis
LEDSRT

SEQ ID NO: 2150436 - protein, 9 aa, Cryptosporidium hominis
LEDSSSGLN

SEQ ID NO: 2150437 - protein, 7 aa, Cryptosporidium hominis
LEEADKG

SEQ ID NO: 2150438 - protein, 7 aa, Cryptosporidium hominis
LEEAEEL

SEQ ID NO: 2150439 - protein, 6 aa, Cryptosporidium hominis
LEEATT

SEQ ID NO: 2150440 - protein, 7 aa, Cryptosporidium hominis
LEEDPTL

SEQ ID NO: 2150441 - protein, 8 aa, Cryptosporidium hominis
LEEDSEMR

SEQ ID NO: 2150442 - protein, 18 aa, Cryptosporidium hominis
LEEELEKNENEKDELNEQ

SEQ ID NO: 2150443 - protein, 7 aa, Cryptosporidium hominis
LEEENRI

SEQ ID NO: 2150444 - protein, 7 aa, Cryptosporidium hominis
LEEERAN

SEQ ID NO: 2150445 - protein, 6 aa, Cryptosporidium hominis
LEEETS

SEQ ID NO: 2150446 - protein, 8 aa, Cryptosporidium hominis
LEEGEDLN

SEQ ID NO: 2150447 - protein, 6 aa, Cryptosporidium hominis
LEEGGQ

SEQ ID NO: 2150448 - protein, 9 aa, Cryptosporidium hominis
LEEGLSREK

SEQ ID NO: 2150449 - protein, 7 aa, Cryptosporidium hominis
LEEGTGN

SEQ ID NO: 2150450 - protein, 4 aa, Cryptosporidium hominis
LEEH

SEQ ID NO: 2150451 - protein, 8 aa, Cryptosporidium hominis
LEEHSDSG

SEQ ID NO: 2150452 - protein, 5 aa, Cryptosporidium hominis
LEEKA

SEQ ID NO: 2150453 - protein, 10 aa, Cryptosporidium hominis
LEEKEKREFS

SEQ ID NO: 2150454 - protein, 11 aa, Cryptosporidium hominis
LEEKNNPPNFL

SEQ ID NO: 2150455 - protein, 20 aa, Cryptosporidium hominis
LEEKRKEEAIEREKLKREKK

SEQ ID NO: 2150456 - protein, 5 aa, Cryptosporidium hominis
LEENE

SEQ ID NO: 2150457 - protein, 11 aa, Cryptosporidium hominis
LEENEVGQSMT

SEQ ID NO: 2150458 - protein, 25 aa, Cryptosporidium hominis
LEENGGGDGGDGGDSEGNKKSSQLL

SEQ ID NO: 2150459 - protein, 7 aa, Cryptosporidium hominis
LEENKTI

SEQ ID NO: 2150460 - protein, 24 aa, Cryptosporidium hominis
LEENTQGENKTKKKKNKKRGRSKI

SEQ ID NO: 2150461 - protein, 18 aa, Cryptosporidium hominis
LEEREEGQERGGGTSIPE

SEQ ID NO: 2150462 - protein, 10 aa, Cryptosporidium hominis
LEEREKSVKD

SEQ ID NO: 2150463 - protein, 9 aa, Cryptosporidium hominis
LEERNGKVE

SEQ ID NO: 2150464 - protein, 4 aa, Cryptosporidium hominis
LEES

SEQ ID NO: 2150465 - protein, 22 aa, Cryptosporidium hominis
LEESEGDKKENLHNHKNTNEAI

SEQ ID NO: 2150466 - protein, 16 aa, Cryptosporidium hominis
LEESGNANNSSSDQEI

SEQ ID NO: 2150467 - protein, 8 aa, Cryptosporidium hominis
LEESGSQN

SEQ ID NO: 2150468 - protein, 10 aa, Cryptosporidium hominis
LEESNPNPKD

SEQ ID NO: 2150469 - protein, 5 aa, Cryptosporidium hominis
LEESS

SEQ ID NO: 2150470 - protein, 11 aa, Cryptosporidium hominis
LEETAEEKEAF

SEQ ID NO: 2150471 - protein, 6 aa, Cryptosporidium hominis
LEETDY

SEQ ID NO: 2150472 - protein, 6 aa, Cryptosporidium hominis
LEETKS

SEQ ID NO: 2150473 - protein, 5 aa, Cryptosporidium hominis
LEGEK

SEQ ID NO: 2150474 - protein, 13 aa, Cryptosporidium hominis
LEGESKEKSRERL

SEQ ID NO: 2150475 - protein, 8 aa, Cryptosporidium hominis
LEGKSQEK

SEQ ID NO: 2150476 - protein, 5 aa, Cryptosporidium hominis
LEGPK

SEQ ID NO: 2150477 - protein, 7 aa, Cryptosporidium hominis
LEGSGSG

SEQ ID NO: 2150478 - protein, 9 aa, Cryptosporidium hominis
LEGSSGAMS

SEQ ID NO: 2150479 - protein, 7 aa, Cryptosporidium hominis
LEGTPID

SEQ ID NO: 2150480 - protein, 5 aa, Cryptosporidium hominis
LEGTS

SEQ ID NO: 2150481 - protein, 17 aa, Cryptosporidium hominis
LEGYERENQRLRESNEE

SEQ ID NO: 2150482 - protein, 7 aa, Cryptosporidium hominis
LEGYNDS

SEQ ID NO: 2150483 - protein, 10 aa, Cryptosporidium hominis
LEIGSGAGKL

SEQ ID NO: 2150484 - protein, 14 aa, Cryptosporidium hominis
LEINKSRKIKEDSG

SEQ ID NO: 2150485 - protein, 8 aa, Cryptosporidium hominis
LEKDASGY

SEQ ID NO: 2150486 - protein, 8 aa, Cryptosporidium hominis
LEKDNTRK

SEQ ID NO: 2150487 - protein, 7 aa, Cryptosporidium hominis
LEKEGVN

SEQ ID NO: 2150488 - protein, 11 aa, Cryptosporidium hominis
LEKELERKECG

SEQ ID NO: 2150489 - protein, 10 aa, Cryptosporidium hominis
LEKENNSIAN

SEQ ID NO: 2150490 - protein, 8 aa, Cryptosporidium hominis
LEKENQNI

SEQ ID NO: 2150491 - protein, 9 aa, Cryptosporidium hominis
LEKESREVE

SEQ ID NO: 2150492 - protein, 4 aa, Cryptosporidium hominis
LEKG

SEQ ID NO: 2150493 - protein, 5 aa, Cryptosporidium hominis
LEKGG

SEQ ID NO: 2150494 - protein, 6 aa, Cryptosporidium hominis
LEKKPL

SEQ ID NO: 2150495 - protein, 11 aa, Cryptosporidium hominis
LEKKRSSKISK

SEQ ID NO: 2150496 - protein, 7 aa, Cryptosporidium hominis
LEKNEDN

SEQ ID NO: 2150497 - protein, 11 aa, Cryptosporidium hominis
LEKNKEKELAS

SEQ ID NO: 2150498 - protein, 14 aa, Cryptosporidium hominis
LEKNKQSKSNQSQN

SEQ ID NO: 2150499 - protein, 7 aa, Cryptosporidium hominis
LEKPTNI

SEQ ID NO: 2150500 - protein, 6 aa, Cryptosporidium hominis
LEKSNQ

SEQ ID NO: 2150501 - protein, 8 aa, Cryptosporidium hominis
LEKSPKGL

SEQ ID NO: 2150502 - protein, 9 aa, Cryptosporidium hominis
LEKTEKSLT

SEQ ID NO: 2150503 - protein, 21 aa, Cryptosporidium hominis
LEKTGLKDHGNALETVSETNN

SEQ ID NO: 2150504 - protein, 9 aa, Cryptosporidium hominis
LEKTSNNLQ

SEQ ID NO: 2150505 - protein, 4 aa, Cryptosporidium hominis
LEKV

SEQ ID NO: 2150506 - protein, 12 aa, Cryptosporidium hominis
LELNTEGLNNDS

SEQ ID NO: 2150507 - protein, 7 aa, Cryptosporidium hominis
LENAKNI

SEQ ID NO: 2150508 - protein, 11 aa, Cryptosporidium hominis
LENEKEDLEKI

SEQ ID NO: 2150509 - protein, 18 aa, Cryptosporidium hominis
LENEKNMNITNSKEFEEK

SEQ ID NO: 2150510 - protein, 8 aa, Cryptosporidium hominis
LENENKKR

SEQ ID NO: 2150511 - protein, 4 aa, Cryptosporidium hominis
LENG

SEQ ID NO: 2150512 - protein, 6 aa, Cryptosporidium hominis
LENGEL

SEQ ID NO: 2150513 - protein, 31 aa, Cryptosporidium hominis
LENGRYKKIGSDLSNGGLTSAEERKLAESQN

SEQ ID NO: 2150514 - protein, 10 aa, Cryptosporidium hominis
LENKKLSEEI

SEQ ID NO: 2150515 - protein, 7 aa, Cryptosporidium hominis
LENKYRS

SEQ ID NO: 2150516 - protein, 6 aa, Cryptosporidium hominis
LENNQN

SEQ ID NO: 2150517 - protein, 5 aa, Cryptosporidium hominis
LENPE

SEQ ID NO: 2150518 - protein, 8 aa, Cryptosporidium hominis
LENPNHSD

SEQ ID NO: 2150519 - protein, 6 aa, Cryptosporidium hominis
LENQDD

SEQ ID NO: 2150520 - protein, 6 aa, Cryptosporidium hominis
LENRTK

SEQ ID NO: 2150521 - protein, 22 aa, Cryptosporidium hominis
LENSGAGAQTCRSKGGHSLRGA

SEQ ID NO: 2150522 - protein, 8 aa, Cryptosporidium hominis
LENSGQTI

SEQ ID NO: 2150523 - protein, 10 aa, Cryptosporidium hominis
LENSKSGGVC

SEQ ID NO: 2150524 - protein, 9 aa, Cryptosporidium hominis
LENSMANEE

SEQ ID NO: 2150525 - protein, 42 aa, Cryptosporidium hominis
LENSNIENKRIGNQSNKDDYSTDKFSDVGSEANNKVNKNTIV

SEQ ID NO: 2150526 - protein, 8 aa, Cryptosporidium hominis
LENSSNKE

SEQ ID NO: 2150527 - protein, 10 aa, Cryptosporidium hominis
LENSSTMKRE

SEQ ID NO: 2150528 - protein, 33 aa, Cryptosporidium hominis
LENTDQSSSNISNGVGNPPLGGTSSTNISNNAN

SEQ ID NO: 2150529 - protein, 8 aa, Cryptosporidium hominis
LEPEPEYN

SEQ ID NO: 2150530 - protein, 4 aa, Cryptosporidium hominis
LEPN

SEQ ID NO: 2150531 - protein, 8 aa, Cryptosporidium hominis
LEPNNNDQ

SEQ ID NO: 2150532 - protein, 10 aa, Cryptosporidium hominis
LEPNNQPCRG

SEQ ID NO: 2150533 - protein, 24 aa, Cryptosporidium hominis
LEPNSGESKNKNSENSVTEEEKSV

SEQ ID NO: 2150534 - protein, 18 aa, Cryptosporidium hominis
LEPTENAYKNLNEQETEH

SEQ ID NO: 2150535 - protein, 5 aa, Cryptosporidium hominis
LEPTH

SEQ ID NO: 2150536 - protein, 12 aa, Cryptosporidium hominis
LEQDESSKKNEI

SEQ ID NO: 2150537 - protein, 9 aa, Cryptosporidium hominis
LEQDSDYKK

SEQ ID NO: 2150538 - protein, 27 aa, Cryptosporidium hominis
LEQEELEEEEKEQQKEQENEVSEGSKN

SEQ ID NO: 2150539 - protein, 21 aa, Cryptosporidium hominis
LEQESRKKHEEQLQKRKKLSS

SEQ ID NO: 2150540 - protein, 4 aa, Cryptosporidium hominis
LEQN

SEQ ID NO: 2150541 - protein, 10 aa, Cryptosporidium hominis
LEQQAAEKER

SEQ ID NO: 2150542 - protein, 11 aa, Cryptosporidium hominis
LEQRRGRNVYD

SEQ ID NO: 2150543 - protein, 5 aa, Cryptosporidium hominis
LEQSL

SEQ ID NO: 2150544 - protein, 10 aa, Cryptosporidium hominis
LEQSNLNSTL

SEQ ID NO: 2150545 - protein, 10 aa, Cryptosporidium hominis
LEQSNSSPNY

SEQ ID NO: 2150546 - protein, 8 aa, Cryptosporidium hominis
LEQTKSQL

SEQ ID NO: 2150547 - protein, 10 aa, Cryptosporidium hominis
LERDSNTETN

SEQ ID NO: 2150548 - protein, 5 aa, Cryptosporidium hominis
LEREK

SEQ ID NO: 2150549 - protein, 7 aa, Cryptosporidium hominis
LERKERE

SEQ ID NO: 2150550 - protein, 25 aa, Cryptosporidium hominis
LERKQSESKTIEDESKNKDNNESEL

SEQ ID NO: 2150551 - protein, 23 aa, Cryptosporidium hominis
LERQEKKKLKQEKSFKNEKSNSL

SEQ ID NO: 2150552 - protein, 14 aa, Cryptosporidium hominis
LERSPWERKAQDVK

SEQ ID NO: 2150553 - protein, 10 aa, Cryptosporidium hominis
LERTSNTRER

SEQ ID NO: 2150554 - protein, 11 aa, Cryptosporidium hominis
LESAEEQQSYG

SEQ ID NO: 2150555 - protein, 7 aa, Cryptosporidium hominis
LESDDQQ

SEQ ID NO: 2150556 - protein, 12 aa, Cryptosporidium hominis
LESDNNSCESED

SEQ ID NO: 2150557 - protein, 7 aa, Cryptosporidium hominis
LESERSK

SEQ ID NO: 2150558 - protein, 96 aa, Cryptosporidium hominis
LESESNSNIESSSSKKRKEKKETNDEESSSSFSSKNKKEKNKRKSTEPLSENGSSSSSSDSSSSNSSSDDEKSKSKGKKSSKDKSKKKKKHSRISE

SEQ ID NO: 2150559 - protein, 25 aa, Cryptosporidium hominis
LESETGRNKSLSDEVESLQNSNGTY

SEQ ID NO: 2150560 - protein, 12 aa, Cryptosporidium hominis
LESGKQIKCINF

SEQ ID NO: 2150561 - protein, 32 aa, Cryptosporidium hominis
LESGNDSKKRESNMNGQNDREFGSIESKEQLS

SEQ ID NO: 2150562 - protein, 7 aa, Cryptosporidium hominis
LESIENK

SEQ ID NO: 2150563 - protein, 45 aa, Cryptosporidium hominis
LESINSDSGTIEDEGRNLTPIQNQNQNLSLPQEESFENSFTGPQP

SEQ ID NO: 2150564 - protein, 11 aa, Cryptosporidium hominis
LESKNERTSNY

SEQ ID NO: 2150565 - protein, 10 aa, Cryptosporidium hominis
LESKRQDDLR

SEQ ID NO: 2150566 - protein, 18 aa, Cryptosporidium hominis
LESKYSSNQGGSGSNSAY

SEQ ID NO: 2150567 - protein, 10 aa, Cryptosporidium hominis
LESNDENDQE

SEQ ID NO: 2150568 - protein, 8 aa, Cryptosporidium hominis
LESNDPDA

SEQ ID NO: 2150569 - protein, 14 aa, Cryptosporidium hominis
LESNKSEESDAEKL

SEQ ID NO: 2150570 - protein, 18 aa, Cryptosporidium hominis
LESNTSNSVRSNASNLNL

SEQ ID NO: 2150571 - protein, 9 aa, Cryptosporidium hominis
LESPKNYTE

SEQ ID NO: 2150572 - protein, 11 aa, Cryptosporidium hominis
LESPKSGVSGF

SEQ ID NO: 2150573 - protein, 18 aa, Cryptosporidium hominis
LESPPTSKNNLKPENIDN

SEQ ID NO: 2150574 - protein, 6 aa, Cryptosporidium hominis
LESPTR

SEQ ID NO: 2150575 - protein, 5 aa, Cryptosporidium hominis
LESQR

SEQ ID NO: 2150576 - protein, 7 aa, Cryptosporidium hominis
LESQRDI

SEQ ID NO: 2150577 - protein, 4 aa, Cryptosporidium hominis
LESS

SEQ ID NO: 2150578 - protein, 13 aa, Cryptosporidium hominis
LESSPKLEILSEI

SEQ ID NO: 2150579 - protein, 8 aa, Cryptosporidium hominis
LESSSSAN

SEQ ID NO: 2150580 - protein, 4 aa, Cryptosporidium hominis
LEST

SEQ ID NO: 2150581 - protein, 28 aa, Cryptosporidium hominis
LESTDSNLDDDDELAASNTLSQGIGHPR

SEQ ID NO: 2150582 - protein, 7 aa, Cryptosporidium hominis
LESTEQY

SEQ ID NO: 2150583 - protein, 11 aa, Cryptosporidium hominis
LESTTGSKVGR

SEQ ID NO: 2150584 - protein, 6 aa, Cryptosporidium hominis
LETANE

SEQ ID NO: 2150585 - protein, 5 aa, Cryptosporidium hominis
LETAQ

SEQ ID NO: 2150586 - protein, 6 aa, Cryptosporidium hominis
LETEEV

SEQ ID NO: 2150587 - protein, 17 aa, Cryptosporidium hominis
LETENKQLKEGNKDETM

SEQ ID NO: 2150588 - protein, 14 aa, Cryptosporidium hominis
LETGSDMSSGEEED

SEQ ID NO: 2150589 - protein, 10 aa, Cryptosporidium hominis
LETKEREAQT

SEQ ID NO: 2150590 - protein, 6 aa, Cryptosporidium hominis
LETPEF

SEQ ID NO: 2150591 - protein, 6 aa, Cryptosporidium hominis
LETPQT

SEQ ID NO: 2150592 - protein, 10 aa, Cryptosporidium hominis
LETSSNNTIS

SEQ ID NO: 2150593 - protein, 10 aa, Cryptosporidium hominis
LETSTSELET

SEQ ID NO: 2150594 - protein, 17 aa, Cryptosporidium hominis
LETTDSIDRQSNDSISS

SEQ ID NO: 2150595 - protein, 4 aa, Cryptosporidium hominis
LFPA

SEQ ID NO: 2150596 - protein, 7 aa, Cryptosporidium hominis
LFPGTSD

SEQ ID NO: 2150597 - protein, 16 aa, Cryptosporidium hominis
LFPTQSTLNSSNNALS

SEQ ID NO: 2150598 - protein, 4 aa, Cryptosporidium hominis
LFST

SEQ ID NO: 2150599 - protein, 7 aa, Cryptosporidium hominis
LGADGST

SEQ ID NO: 2150600 - protein, 11 aa, Cryptosporidium hominis
LGANGDIDGSL

SEQ ID NO: 2150601 - protein, 5 aa, Cryptosporidium hominis
LGDAY

SEQ ID NO: 2150602 - protein, 5 aa, Cryptosporidium hominis
LGDDD

SEQ ID NO: 2150603 - protein, 10 aa, Cryptosporidium hominis
LGDDTPEKEA

SEQ ID NO: 2150604 - protein, 7 aa, Cryptosporidium hominis
LGDEGLE

SEQ ID NO: 2150605 - protein, 32 aa, Cryptosporidium hominis
LGDEYGEISDGDGYSDGEQDDLDMKSGGSDVL

SEQ ID NO: 2150606 - protein, 13 aa, Cryptosporidium hominis
LGDPTSSDSSRKA

SEQ ID NO: 2150607 - protein, 16 aa, Cryptosporidium hominis
LGEAIDTEKSFPNNNI

SEQ ID NO: 2150608 - protein, 11 aa, Cryptosporidium hominis
LGEDSNPKTIK

SEQ ID NO: 2150609 - protein, 12 aa, Cryptosporidium hominis
LGEEDVTSTELG

SEQ ID NO: 2150610 - protein, 9 aa, Cryptosporidium hominis
LGENISDEE

SEQ ID NO: 2150611 - protein, 11 aa, Cryptosporidium hominis
LGENLSQDERK

SEQ ID NO: 2150612 - protein, 11 aa, Cryptosporidium hominis
LGEPPESDNEM

SEQ ID NO: 2150613 - protein, 4 aa, Cryptosporidium hominis
LGEQ

SEQ ID NO: 2150614 - protein, 19 aa, Cryptosporidium hominis
LGESFQNKENEKSNNSNFL

SEQ ID NO: 2150615 - protein, 6 aa, Cryptosporidium hominis
LGEYGR

SEQ ID NO: 2150616 - protein, 4 aa, Cryptosporidium hominis
LGFE

SEQ ID NO: 2150617 - protein, 4 aa, Cryptosporidium hominis
LGGE

SEQ ID NO: 2150618 - protein, 5 aa, Cryptosporidium hominis
LGGEV

SEQ ID NO: 2150619 - protein, 12 aa, Cryptosporidium hominis
LGGGGSGGLEDP

SEQ ID NO: 2150620 - protein, 18 aa, Cryptosporidium hominis
LGGGLGKVRGQEKPESKR

SEQ ID NO: 2150621 - protein, 9 aa, Cryptosporidium hominis
LGGGRTVEG

SEQ ID NO: 2150622 - protein, 9 aa, Cryptosporidium hominis
LGGGTGSGM

SEQ ID NO: 2150623 - protein, 49 aa, Cryptosporidium hominis
LGGKEQDHSRGEAQQSSSGGGSGNNCNTGGSSSSKPLSKAQQERQRRQK

SEQ ID NO: 2150624 - protein, 6 aa, Cryptosporidium hominis
LGGKKQ

SEQ ID NO: 2150625 - protein, 13 aa, Cryptosporidium hominis
LGGKRSGSNAPIP

SEQ ID NO: 2150626 - protein, 7 aa, Cryptosporidium hominis
LGGNKGN

SEQ ID NO: 2150627 - protein, 5 aa, Cryptosporidium hominis
LGGNS

SEQ ID NO: 2150628 - protein, 8 aa, Cryptosporidium hominis
LGGPGNNS

SEQ ID NO: 2150629 - protein, 5 aa, Cryptosporidium hominis
LGGPW

SEQ ID NO: 2150630 - protein, 4 aa, Cryptosporidium hominis
LGGS

SEQ ID NO: 2150631 - protein, 21 aa, Cryptosporidium hominis
LGGSLKQNKDSIFDSNGKEYQ

SEQ ID NO: 2150632 - protein, 6 aa, Cryptosporidium hominis
LGGSPG

SEQ ID NO: 2150633 - protein, 24 aa, Cryptosporidium hominis
LGGSSNIRMGNNSSRLINGSGNGE

SEQ ID NO: 2150634 - protein, 11 aa, Cryptosporidium hominis
LGGVSKSDLKA

SEQ ID NO: 2150635 - protein, 8 aa, Cryptosporidium hominis
LGHGDTQD

SEQ ID NO: 2150636 - protein, 5 aa, Cryptosporidium hominis
LGIPD

SEQ ID NO: 2150637 - protein, 8 aa, Cryptosporidium hominis
LGIPPGPL

SEQ ID NO: 2150638 - protein, 10 aa, Cryptosporidium hominis
LGIQEKNKNF

SEQ ID NO: 2150639 - protein, 11 aa, Cryptosporidium hominis
LGKAKTGTGKT

SEQ ID NO: 2150640 - protein, 7 aa, Cryptosporidium hominis
LGKGQNM

SEQ ID NO: 2150641 - protein, 8 aa, Cryptosporidium hominis
LGKHSKDS

SEQ ID NO: 2150642 - protein, 8 aa, Cryptosporidium hominis
LGKKGGLD

SEQ ID NO: 2150643 - protein, 4 aa, Cryptosporidium hominis
LGKN

SEQ ID NO: 2150644 - protein, 10 aa, Cryptosporidium hominis
LGKSSLKSNV

SEQ ID NO: 2150645 - protein, 4 aa, Cryptosporidium hominis
LGKT

SEQ ID NO: 2150646 - protein, 5 aa, Cryptosporidium hominis
LGKTA

SEQ ID NO: 2150647 - protein, 11 aa, Cryptosporidium hominis
LGLDNSSKHNL

SEQ ID NO: 2150648 - protein, 4 aa, Cryptosporidium hominis
LGMG

SEQ ID NO: 2150649 - protein, 8 aa, Cryptosporidium hominis
LGNDGIET

SEQ ID NO: 2150650 - protein, 4 aa, Cryptosporidium hominis
LGNG

SEQ ID NO: 2150651 - protein, 13 aa, Cryptosporidium hominis
LGNGESKSQFSAS

SEQ ID NO: 2150652 - protein, 16 aa, Cryptosporidium hominis
LGNGGLNDIKTDQSGN

SEQ ID NO: 2150653 - protein, 7 aa, Cryptosporidium hominis
LGNPSKS

SEQ ID NO: 2150654 - protein, 9 aa, Cryptosporidium hominis
LGNSNESIS

SEQ ID NO: 2150655 - protein, 10 aa, Cryptosporidium hominis
LGNSNGCNNL

SEQ ID NO: 2150656 - protein, 9 aa, Cryptosporidium hominis
LGNSNSQCL

SEQ ID NO: 2150657 - protein, 4 aa, Cryptosporidium hominis
LGPA

SEQ ID NO: 2150658 - protein, 8 aa, Cryptosporidium hominis
LGPDAPHE

SEQ ID NO: 2150659 - protein, 7 aa, Cryptosporidium hominis
LGPDGRP

SEQ ID NO: 2150660 - protein, 6 aa, Cryptosporidium hominis
LGPDYD

SEQ ID NO: 2150661 - protein, 47 aa, Cryptosporidium hominis
LGPGPGPGPDHDHDHDPDHGSSFNGTIEEGERRAGVGVGEEEEEEEE

SEQ ID NO: 2150662 - protein, 5 aa, Cryptosporidium hominis
LGPNG

SEQ ID NO: 2150663 - protein, 9 aa, Cryptosporidium hominis
LGPNKTKRE

SEQ ID NO: 2150664 - protein, 20 aa, Cryptosporidium hominis
LGPNSGNRTSPYLSGRKRNI

SEQ ID NO: 2150665 - protein, 6 aa, Cryptosporidium hominis
LGPRGR

SEQ ID NO: 2150666 - protein, 7 aa, Cryptosporidium hominis
LGPRKAK

SEQ ID NO: 2150667 - protein, 6 aa, Cryptosporidium hominis
LGPSQD

SEQ ID NO: 2150668 - protein, 6 aa, Cryptosporidium hominis
LGPSTS

SEQ ID NO: 2150669 - protein, 12 aa, Cryptosporidium hominis
LGPSYQSSSKNT

SEQ ID NO: 2150670 - protein, 4 aa, Cryptosporidium hominis
LGPY

SEQ ID NO: 2150671 - protein, 15 aa, Cryptosporidium hominis
LGQGKESCKSKERAC

SEQ ID NO: 2150672 - protein, 20 aa, Cryptosporidium hominis
LGQKSESSSNYESNKSETKL

SEQ ID NO: 2150673 - protein, 14 aa, Cryptosporidium hominis
LGQKSSSSFSNDSQ

SEQ ID NO: 2150674 - protein, 15 aa, Cryptosporidium hominis
LGQNGGISIQGPHSQ

SEQ ID NO: 2150675 - protein, 4 aa, Cryptosporidium hominis
LGQV

SEQ ID NO: 2150676 - protein, 25 aa, Cryptosporidium hominis
LGREKDKDLLPNSVPNSNQISHNPN

SEQ ID NO: 2150677 - protein, 7 aa, Cryptosporidium hominis
LGRGSYG

SEQ ID NO: 2150678 - protein, 28 aa, Cryptosporidium hominis
  misc_feature (14)..(14): Xaa can be any naturally occurring amino acid
LGRTLPPSLFSASXLGAVPACASRPSFR

SEQ ID NO: 2150679 - protein, 7 aa, Cryptosporidium hominis
LGSDDQF

SEQ ID NO: 2150680 - protein, 4 aa, Cryptosporidium hominis
LGSE

SEQ ID NO: 2150681 - protein, 7 aa, Cryptosporidium hominis
LGSEKYD

SEQ ID NO: 2150682 - protein, 14 aa, Cryptosporidium hominis
LGSGAISNNDYNHA

SEQ ID NO: 2150683 - protein, 5 aa, Cryptosporidium hominis
LGSGK

SEQ ID NO: 2150684 - protein, 7 aa, Cryptosporidium hominis
LGSGKIG

SEQ ID NO: 2150685 - protein, 6 aa, Cryptosporidium hominis
LGSGQF

SEQ ID NO: 2150686 - protein, 11 aa, Cryptosporidium hominis
LGSGSGSDSGL

SEQ ID NO: 2150687 - protein, 9 aa, Cryptosporidium hominis
LGSNSEDLS

SEQ ID NO: 2150688 - protein, 7 aa, Cryptosporidium hominis
LGSNSRN

SEQ ID NO: 2150689 - protein, 9 aa, Cryptosporidium hominis
LGSQHSAAV

SEQ ID NO: 2150690 - protein, 18 aa, Cryptosporidium hominis
LGSSSDEDEFSKEGASLS

SEQ ID NO: 2150691 - protein, 5 aa, Cryptosporidium hominis
LGSTG

SEQ ID NO: 2150692 - protein, 5 aa, Cryptosporidium hominis
LGTDF

SEQ ID NO: 2150693 - protein, 4 aa, Cryptosporidium hominis
LGTE

SEQ ID NO: 2150694 - protein, 13 aa, Cryptosporidium hominis
LGTERRAKKKRDE

SEQ ID NO: 2150695 - protein, 5 aa, Cryptosporidium hominis
LGTGT

SEQ ID NO: 2150696 - protein, 8 aa, Cryptosporidium hominis
LGTPNSKV

SEQ ID NO: 2150697 - protein, 7 aa, Cryptosporidium hominis
LGTPNSR

SEQ ID NO: 2150698 - protein, 16 aa, Cryptosporidium hominis
LGTSDEGMYGETREKG

SEQ ID NO: 2150699 - protein, 6 aa, Cryptosporidium hominis
LGYPSN

SEQ ID NO: 2150700 - protein, 11 aa, Cryptosporidium hominis
LGYSEKSSVRA

SEQ ID NO: 2150701 - protein, 4 aa, Cryptosporidium hominis
LHDR

SEQ ID NO: 2150702 - protein, 10 aa, Cryptosporidium hominis
LHDTDSNAPL

SEQ ID NO: 2150703 - protein, 14 aa, Cryptosporidium hominis
LHKNTDNRRHTEKE

SEQ ID NO: 2150704 - protein, 5 aa, Cryptosporidium hominis
LHKPE

SEQ ID NO: 2150705 - protein, 9 aa, Cryptosporidium hominis
LHKSDQRGH

SEQ ID NO: 2150706 - protein, 12 aa, Cryptosporidium hominis
LHPGDLKKGLSD

SEQ ID NO: 2150707 - protein, 15 aa, Cryptosporidium hominis
LHPSSTGTSDINAAR

SEQ ID NO: 2150708 - protein, 6 aa, Cryptosporidium hominis
LHPVPA

SEQ ID NO: 2150709 - protein, 8 aa, Cryptosporidium hominis
LHSNPNNL

SEQ ID NO: 2150710 - protein, 4 aa, Cryptosporidium hominis
LIGE

SEQ ID NO: 2150711 - protein, 5 aa, Cryptosporidium hominis
LIGQT

SEQ ID NO: 2150712 - protein, 8 aa, Cryptosporidium hominis
LIGSGDIS

SEQ ID NO: 2150713 - protein, 17 aa, Cryptosporidium hominis
LIKSDENSSTIIESTYL

SEQ ID NO: 2150714 - protein, 6 aa, Cryptosporidium hominis
LIKSGD

SEQ ID NO: 2150715 - protein, 18 aa, Cryptosporidium hominis
LINGKDKDEESENFKDKQ

SEQ ID NO: 2150716 - protein, 7 aa, Cryptosporidium hominis
LIPSEPS

SEQ ID NO: 2150717 - protein, 10 aa, Cryptosporidium hominis
LITNSRDLNS

SEQ ID NO: 2150718 - protein, 9 aa, Cryptosporidium hominis
LKAKKSEVA

SEQ ID NO: 2150719 - protein, 11 aa, Cryptosporidium hominis
LKAKNKANEYE

SEQ ID NO: 2150720 - protein, 6 aa, Cryptosporidium hominis
LKATDI

SEQ ID NO: 2150721 - protein, 23 aa, Cryptosporidium hominis
LKDDESQRISTYQPKKDNSNVTF

SEQ ID NO: 2150722 - protein, 7 aa, Cryptosporidium hominis
LKDDSSI

SEQ ID NO: 2150723 - protein, 8 aa, Cryptosporidium hominis
LKDEANKA

SEQ ID NO: 2150724 - protein, 8 aa, Cryptosporidium hominis
LKDEQNKH

SEQ ID NO: 2150725 - protein, 5 aa, Cryptosporidium hominis
LKDET

SEQ ID NO: 2150726 - protein, 17 aa, Cryptosporidium hominis
LKDKDSEAAETKKDEPV

SEQ ID NO: 2150727 - protein, 9 aa, Cryptosporidium hominis
LKDNEQNLT

SEQ ID NO: 2150728 - protein, 6 aa, Cryptosporidium hominis
LKDPSL

SEQ ID NO: 2150729 - protein, 17 aa, Cryptosporidium hominis
LKDREGLIGEEDEEVDN

SEQ ID NO: 2150730 - protein, 7 aa, Cryptosporidium hominis
LKDRTES

SEQ ID NO: 2150731 - protein, 7 aa, Cryptosporidium hominis
LKDSGEL

SEQ ID NO: 2150732 - protein, 7 aa, Cryptosporidium hominis
LKDSGFS

SEQ ID NO: 2150733 - protein, 11 aa, Cryptosporidium hominis
LKEAGDLNNSI

SEQ ID NO: 2150734 - protein, 8 aa, Cryptosporidium hominis
LKEARRTK

SEQ ID NO: 2150735 - protein, 12 aa, Cryptosporidium hominis
LKEDTKEGSKIT

SEQ ID NO: 2150736 - protein, 16 aa, Cryptosporidium hominis
LKEEEINEQSKPESIY

SEQ ID NO: 2150737 - protein, 11 aa, Cryptosporidium hominis
LKEEERKQEEL

SEQ ID NO: 2150738 - protein, 8 aa, Cryptosporidium hominis
LKEGTSTF

SEQ ID NO: 2150739 - protein, 12 aa, Cryptosporidium hominis
LKEKDKANSQKI

SEQ ID NO: 2150740 - protein, 8 aa, Cryptosporidium hominis
LKEKGINE

SEQ ID NO: 2150741 - protein, 6 aa, Cryptosporidium hominis
LKEKIS

SEQ ID NO: 2150742 - protein, 15 aa, Cryptosporidium hominis
LKEKQEEEKRRKEAL

SEQ ID NO: 2150743 - protein, 19 aa, Cryptosporidium hominis
LKEKSSNPPKSEEEKNELE

SEQ ID NO: 2150744 - protein, 8 aa, Cryptosporidium hominis
LKEKTNHP

SEQ ID NO: 2150745 - protein, 6 aa, Cryptosporidium hominis
LKELSP

SEQ ID NO: 2150746 - protein, 7 aa, Cryptosporidium hominis
LKENATN

SEQ ID NO: 2150747 - protein, 7 aa, Cryptosporidium hominis
LKENEED

SEQ ID NO: 2150748 - protein, 16 aa, Cryptosporidium hominis
LKENNETNEKKKVSIK

SEQ ID NO: 2150749 - protein, 15 aa, Cryptosporidium hominis
LKEQKPDQDSTMENQ

SEQ ID NO: 2150750 - protein, 11 aa, Cryptosporidium hominis
LKESNNSTTGV

SEQ ID NO: 2150751 - protein, 17 aa, Cryptosporidium hominis
LKESPTNNDNSSNSNNF

SEQ ID NO: 2150752 - protein, 13 aa, Cryptosporidium hominis
LKETDSKDSLSNC

SEQ ID NO: 2150753 - protein, 13 aa, Cryptosporidium hominis
LKETRKSANGKAK

SEQ ID NO: 2150754 - protein, 7 aa, Cryptosporidium hominis
LKGAQDV

SEQ ID NO: 2150755 - protein, 8 aa, Cryptosporidium hominis
LKGDDKAL

SEQ ID NO: 2150756 - protein, 12 aa, Cryptosporidium hominis
LKGDGLNSSDSD

SEQ ID NO: 2150757 - protein, 7 aa, Cryptosporidium hominis
LKGDPNK

SEQ ID NO: 2150758 - protein, 11 aa, Cryptosporidium hominis
LKGELSSQKFK

SEQ ID NO: 2150759 - protein, 12 aa, Cryptosporidium hominis
LKGEQKKANEHL

SEQ ID NO: 2150760 - protein, 5 aa, Cryptosporidium hominis
LKGGA

SEQ ID NO: 2150761 - protein, 10 aa, Cryptosporidium hominis
LKGGRNPEIG

SEQ ID NO: 2150762 - protein, 8 aa, Cryptosporidium hominis
LKGKDNST

SEQ ID NO: 2150763 - protein, 15 aa, Cryptosporidium hominis
LKGKGSNQDEFDPGR

SEQ ID NO: 2150764 - protein, 7 aa, Cryptosporidium hominis
LKGNEDI

SEQ ID NO: 2150765 - protein, 14 aa, Cryptosporidium hominis
LKGNRASSKRKGNL

SEQ ID NO: 2150766 - protein, 12 aa, Cryptosporidium hominis
LKGQTKCPTPTR

SEQ ID NO: 2150767 - protein, 9 aa, Cryptosporidium hominis
LKGSDQCDN

SEQ ID NO: 2150768 - protein, 12 aa, Cryptosporidium hominis
LKGSSSSRIDAD

SEQ ID NO: 2150769 - protein, 20 aa, Cryptosporidium hominis
LKGSSSSSSSSSSSSSSSSL

SEQ ID NO: 2150770 - protein, 30 aa, Cryptosporidium hominis
LKHKDKSDSGETNIPIKSKTEHYDEPNEDF

SEQ ID NO: 2150771 - protein, 4 aa, Cryptosporidium hominis
LKHS

SEQ ID NO: 2150772 - protein, 24 aa, Cryptosporidium hominis
LKIPPKKDLSTTPIKKEADTSIPI

SEQ ID NO: 2150773 - protein, 25 aa, Cryptosporidium hominis
LKISPKKDLSTPPIKKEADTSIQTK

SEQ ID NO: 2150774 - protein, 11 aa, Cryptosporidium hominis
LKKASGDDSAM

SEQ ID NO: 2150775 - protein, 7 aa, Cryptosporidium hominis
LKKDKRA

SEQ ID NO: 2150776 - protein, 6 aa, Cryptosporidium hominis
LKKEDD

SEQ ID NO: 2150777 - protein, 9 aa, Cryptosporidium hominis
LKKESPPNF

SEQ ID NO: 2150778 - protein, 7 aa, Cryptosporidium hominis
LKKGEEI

SEQ ID NO: 2150779 - protein, 20 aa, Cryptosporidium hominis
LKKNEQLKEENQKKESKGRY

SEQ ID NO: 2150780 - protein, 12 aa, Cryptosporidium hominis
LKKPNVNKENNT

SEQ ID NO: 2150781 - protein, 10 aa, Cryptosporidium hominis
LKKPSTISRE

SEQ ID NO: 2150782 - protein, 4 aa, Cryptosporidium hominis
LKKQ

SEQ ID NO: 2150783 - protein, 19 aa, Cryptosporidium hominis
LKKQNNGELSKSSTYLNPN

SEQ ID NO: 2150784 - protein, 47 aa, Cryptosporidium hominis
LKKRKKRSYNLTDDESDGNMSDTESSDGEDNYKRRKGAKKGSEVELK

SEQ ID NO: 2150785 - protein, 13 aa, Cryptosporidium hominis
LKKRKQDNRYNGN

SEQ ID NO: 2150786 - protein, 15 aa, Cryptosporidium hominis
LKKSKSNSRGGGYRK

SEQ ID NO: 2150787 - protein, 10 aa, Cryptosporidium hominis
LKKSNQEVGF

SEQ ID NO: 2150788 - protein, 9 aa, Cryptosporidium hominis
LKKTSKRSR

SEQ ID NO: 2150789 - protein, 21 aa, Cryptosporidium hominis
LKLDPTKSKAKSKAAQTGPKL

SEQ ID NO: 2150790 - protein, 15 aa, Cryptosporidium hominis
LKLPGTSTSTSASNI

SEQ ID NO: 2150791 - protein, 8 aa, Cryptosporidium hominis
LKLTGEKK

SEQ ID NO: 2150792 - protein, 4 aa, Cryptosporidium hominis
LKMT

SEQ ID NO: 2150793 - protein, 15 aa, Cryptosporidium hominis
LKNASKKRKRETINT

SEQ ID NO: 2150794 - protein, 9 aa, Cryptosporidium hominis
LKNDKTKTA

SEQ ID NO: 2150795 - protein, 11 aa, Cryptosporidium hominis
LKNESENRRKL

SEQ ID NO: 2150796 - protein, 28 aa, Cryptosporidium hominis
LKNGEQANAVSRGRMATNTANINNTNTV

SEQ ID NO: 2150797 - protein, 9 aa, Cryptosporidium hominis
LKNGESVQI

SEQ ID NO: 2150798 - protein, 14 aa, Cryptosporidium hominis
LKNGETSSKPINSQ

SEQ ID NO: 2150799 - protein, 8 aa, Cryptosporidium hominis
LKNGNKVK

SEQ ID NO: 2150800 - protein, 12 aa, Cryptosporidium hominis
LKNKNKSKSVQK

SEQ ID NO: 2150801 - protein, 12 aa, Cryptosporidium hominis
LKNKSSNARERM

SEQ ID NO: 2150802 - protein, 4 aa, Cryptosporidium hominis
LKNN

SEQ ID NO: 2150803 - protein, 10 aa, Cryptosporidium hominis
LKNNNVSDSK

SEQ ID NO: 2150804 - protein, 8 aa, Cryptosporidium hominis
LKNPAKCS

SEQ ID NO: 2150805 - protein, 9 aa, Cryptosporidium hominis
LKNPTDSNS

SEQ ID NO: 2150806 - protein, 4 aa, Cryptosporidium hominis
LKNQ

SEQ ID NO: 2150807 - protein, 7 aa, Cryptosporidium hominis
LKNQKRA

SEQ ID NO: 2150808 - protein, 8 aa, Cryptosporidium hominis
LKNRGAKT

SEQ ID NO: 2150809 - protein, 14 aa, Cryptosporidium hominis
LKNSEEVSYSVPDT

SEQ ID NO: 2150810 - protein, 8 aa, Cryptosporidium hominis
LKNSEGLK

SEQ ID NO: 2150811 - protein, 18 aa, Cryptosporidium hominis
LKNSKKSDKNENTEDDEK

SEQ ID NO: 2150812 - protein, 8 aa, Cryptosporidium hominis
LKNSTGSG

SEQ ID NO: 2150813 - protein, 8 aa, Cryptosporidium hominis
LKPDEELR

SEQ ID NO: 2150814 - protein, 11 aa, Cryptosporidium hominis
LKPEEINNPKI

SEQ ID NO: 2150815 - protein, 9 aa, Cryptosporidium hominis
LKPESPNQD

SEQ ID NO: 2150816 - protein, 4 aa, Cryptosporidium hominis
LKPG

SEQ ID NO: 2150817 - protein, 6 aa, Cryptosporidium hominis
LKPGQR

SEQ ID NO: 2150818 - protein, 5 aa, Cryptosporidium hominis
LKPGS

SEQ ID NO: 2150819 - protein, 9 aa, Cryptosporidium hominis
LKPKKNQIN

SEQ ID NO: 2150820 - protein, 4 aa, Cryptosporidium hominis
LKPP

SEQ ID NO: 2150821 - protein, 7 aa, Cryptosporidium hominis
LKPPEGE

SEQ ID NO: 2150822 - protein, 8 aa, Cryptosporidium hominis
LKPPIENA

SEQ ID NO: 2150823 - protein, 7 aa, Cryptosporidium hominis
LKPPKKV

SEQ ID NO: 2150824 - protein, 5 aa, Cryptosporidium hominis
LKPSL

SEQ ID NO: 2150825 - protein, 13 aa, Cryptosporidium hominis
LKQDSSIDNDSVE

SEQ ID NO: 2150826 - protein, 7 aa, Cryptosporidium hominis
LKQEDQS

SEQ ID NO: 2150827 - protein, 12 aa, Cryptosporidium hominis
LKQLDSSPNAQK

SEQ ID NO: 2150828 - protein, 10 aa, Cryptosporidium hominis
LKQNEENNQS

SEQ ID NO: 2150829 - protein, 14 aa, Cryptosporidium hominis
LKQNQRQRLRSKYG

SEQ ID NO: 2150830 - protein, 21 aa, Cryptosporidium hominis
LKQNSDKSGSQPLQKKPNVKV

SEQ ID NO: 2150831 - protein, 6 aa, Cryptosporidium hominis
LKRDNT

SEQ ID NO: 2150832 - protein, 6 aa, Cryptosporidium hominis
LKRNKT

SEQ ID NO: 2150833 - protein, 11 aa, Cryptosporidium hominis
LKRNSKGVESL

SEQ ID NO: 2150834 - protein, 10 aa, Cryptosporidium hominis
LKRQEKKRKI

SEQ ID NO: 2150835 - protein, 5 aa, Cryptosporidium hominis
LKRQN

SEQ ID NO: 2150836 - protein, 8 aa, Cryptosporidium hominis
LKRSKSQE

SEQ ID NO: 2150837 - protein, 13 aa, Cryptosporidium hominis
LKRSQAEYESRKK

SEQ ID NO: 2150838 - protein, 7 aa, Cryptosporidium hominis
LKRTKTL

SEQ ID NO: 2150839 - protein, 18 aa, Cryptosporidium hominis
LKRTQDQRVQQLKDDREK

SEQ ID NO: 2150840 - protein, 7 aa, Cryptosporidium hominis
LKSAGYS

SEQ ID NO: 2150841 - protein, 24 aa, Cryptosporidium hominis
LKSAQDALKANRTMDSKNLSSNLN

SEQ ID NO: 2150842 - protein, 8 aa, Cryptosporidium hominis
LKSDHDKR

SEQ ID NO: 2150843 - protein, 9 aa, Cryptosporidium hominis
LKSDHSQHK

SEQ ID NO: 2150844 - protein, 19 aa, Cryptosporidium hominis
LKSDRDNSVVESQKSENNC

SEQ ID NO: 2150845 - protein, 32 aa, Cryptosporidium hominis
LKSEQKARQTAEDALKKASAKPKSAIEETEKL

SEQ ID NO: 2150846 - protein, 7 aa, Cryptosporidium hominis
LKSERAK

SEQ ID NO: 2150847 - protein, 18 aa, Cryptosporidium hominis
LKSGKSVTYTNSSHNNAE

SEQ ID NO: 2150848 - protein, 8 aa, Cryptosporidium hominis
LKSGNKQL

SEQ ID NO: 2150849 - protein, 6 aa, Cryptosporidium hominis
LKSGSY

SEQ ID NO: 2150850 - protein, 12 aa, Cryptosporidium hominis
LKSGYANNDQVE

SEQ ID NO: 2150851 - protein, 10 aa, Cryptosporidium hominis
LKSKASQNET

SEQ ID NO: 2150852 - protein, 26 aa, Cryptosporidium hominis
LKSKGKKKKVVTKNGNTEYVWYPKRK

SEQ ID NO: 2150853 - protein, 8 aa, Cryptosporidium hominis
LKSKNYRS

SEQ ID NO: 2150854 - protein, 25 aa, Cryptosporidium hominis
LKSKRGRKKINKQSSEKVKSKNKEA

SEQ ID NO: 2150855 - protein, 15 aa, Cryptosporidium hominis
LKSKSNLTNENNNTL

SEQ ID NO: 2150856 - protein, 8 aa, Cryptosporidium hominis
LKSNGKKE

SEQ ID NO: 2150857 - protein, 7 aa, Cryptosporidium hominis
LKSNNAG

SEQ ID NO: 2150858 - protein, 24 aa, Cryptosporidium hominis
LKSNQPNDAKQSIKTENKECKEKK

SEQ ID NO: 2150859 - protein, 9 aa, Cryptosporidium hominis
LKSPASSIS

SEQ ID NO: 2150860 - protein, 13 aa, Cryptosporidium hominis
LKSPRSPTITSGL

SEQ ID NO: 2150861 - protein, 15 aa, Cryptosporidium hominis
LKSQLDTAKTSNITY

SEQ ID NO: 2150862 - protein, 11 aa, Cryptosporidium hominis
LKSQNSSTISN

SEQ ID NO: 2150863 - protein, 14 aa, Cryptosporidium hominis
LKSRDPGSAPNIGD

SEQ ID NO: 2150864 - protein, 7 aa, Cryptosporidium hominis
LKSRTPL

SEQ ID NO: 2150865 - protein, 5 aa, Cryptosporidium hominis
LKSSL

SEQ ID NO: 2150866 - protein, 9 aa, Cryptosporidium hominis
LKSSLKDDI

SEQ ID NO: 2150867 - protein, 9 aa, Cryptosporidium hominis
LKSSNKKLR

SEQ ID NO: 2150868 - protein, 14 aa, Cryptosporidium hominis
LKSSNRKKTVNREI

SEQ ID NO: 2150869 - protein, 5 aa, Cryptosporidium hominis
LKSSQ

SEQ ID NO: 2150870 - protein, 13 aa, Cryptosporidium hominis
LKSSQNNQQDQNK

SEQ ID NO: 2150871 - protein, 11 aa, Cryptosporidium hominis
LKSSSKNSNFY

SEQ ID NO: 2150872 - protein, 6 aa, Cryptosporidium hominis
LKSSSM

SEQ ID NO: 2150873 - protein, 35 aa, Cryptosporidium hominis
LKSSSSSSKIETLSGSDSKLGSSTSISFTPYQGMI

SEQ ID NO: 2150874 - protein, 11 aa, Cryptosporidium hominis
LKSTNNGSKLL

SEQ ID NO: 2150875 - protein, 8 aa, Cryptosporidium hominis
LKSTQTGF

SEQ ID NO: 2150876 - protein, 8 aa, Cryptosporidium hominis
LKSVGYKG

SEQ ID NO: 2150877 - protein, 4 aa, Cryptosporidium hominis
LKSY

SEQ ID NO: 2150878 - protein, 8 aa, Cryptosporidium hominis
LKTDKERI

SEQ ID NO: 2150879 - protein, 4 aa, Cryptosporidium hominis
LKTE

SEQ ID NO: 2150880 - protein, 15 aa, Cryptosporidium hominis
LKTEKKSEPRDENKV

SEQ ID NO: 2150881 - protein, 10 aa, Cryptosporidium hominis
LKTENNSKGF

SEQ ID NO: 2150882 - protein, 8 aa, Cryptosporidium hominis
LKTEQDSF

SEQ ID NO: 2150883 - protein, 10 aa, Cryptosporidium hominis
LKTESKKKSK

SEQ ID NO: 2150884 - protein, 11 aa, Cryptosporidium hominis
LKTGTNGSDIK

SEQ ID NO: 2150885 - protein, 8 aa, Cryptosporidium hominis
LKTHNSEK

SEQ ID NO: 2150886 - protein, 6 aa, Cryptosporidium hominis
LKTKLS

SEQ ID NO: 2150887 - protein, 12 aa, Cryptosporidium hominis
LKTKTQWDQEQR

SEQ ID NO: 2150888 - protein, 5 aa, Cryptosporidium hominis
LKTQK

SEQ ID NO: 2150889 - protein, 7 aa, Cryptosporidium hominis
LKTQKST

SEQ ID NO: 2150890 - protein, 12 aa, Cryptosporidium hominis
LKTRSKASNHKS

SEQ ID NO: 2150891 - protein, 16 aa, Cryptosporidium hominis
LKTSKKKSNYQNNTKK

SEQ ID NO: 2150892 - protein, 19 aa, Cryptosporidium hominis
LKTSRGMIDSSGGGTIGSR

SEQ ID NO: 2150893 - protein, 6 aa, Cryptosporidium hominis
LKTSSK

SEQ ID NO: 2150894 - protein, 15 aa, Cryptosporidium hominis
LKTTTKKKNKVNGPM

SEQ ID NO: 2150895 - protein, 4 aa, Cryptosporidium hominis
LKTV

SEQ ID NO: 2150896 - protein, 4 aa, Cryptosporidium hominis
LKVA

SEQ ID NO: 2150897 - protein, 6 aa, Cryptosporidium hominis
LKVPNN

SEQ ID NO: 2150898 - protein, 13 aa, Cryptosporidium hominis
LKVSRGEKSEKKG

SEQ ID NO: 2150899 - protein, 15 aa, Cryptosporidium hominis
LKWNGGGTGSNNGGI

SEQ ID NO: 2150900 - protein, 11 aa, Cryptosporidium hominis
LKYESDNDNEF

SEQ ID NO: 2150901 - protein, 4 aa, Cryptosporidium hominis
LKYG

SEQ ID NO: 2150902 - protein, 78 aa, Cryptosporidium hominis
LKYRDDGYTYVGGDNSGSEDGRTGRIGDQGLEADENFGTKGKKQSKKKTKEKSVKKSSGSGSSGKSRASSSSGGSKKM

SEQ ID NO: 2150903 - protein, 13 aa, Cryptosporidium hominis
LLESSNSLQEYNK

SEQ ID NO: 2150904 - protein, 12 aa, Cryptosporidium hominis
LLGEDSKLGRKN

SEQ ID NO: 2150905 - protein, 8 aa, Cryptosporidium hominis
LLPGDDEV

SEQ ID NO: 2150906 - protein, 9 aa, Cryptosporidium hominis
LLPPSGDLN

SEQ ID NO: 2150907 - protein, 19 aa, Cryptosporidium hominis
LLSDKQNDLGRSNPYSERK

SEQ ID NO: 2150908 - protein, 12 aa, Cryptosporidium hominis
LLSDPQKRSEYK

SEQ ID NO: 2150909 - protein, 15 aa, Cryptosporidium hominis
LNAESDKTALTTGNS

SEQ ID NO: 2150910 - protein, 11 aa, Cryptosporidium hominis
LNAKAGGNYYG

SEQ ID NO: 2150911 - protein, 9 aa, Cryptosporidium hominis
LNDAASKKY

SEQ ID NO: 2150912 - protein, 7 aa, Cryptosporidium hominis
LNDAKKN

SEQ ID NO: 2150913 - protein, 16 aa, Cryptosporidium hominis
LNDDENGDIKTDNDVE

SEQ ID NO: 2150914 - protein, 7 aa, Cryptosporidium hominis
LNDENDP

SEQ ID NO: 2150915 - protein, 19 aa, Cryptosporidium hominis
LNDKNSSSSQSLLSDPNDL

SEQ ID NO: 2150916 - protein, 8 aa, Cryptosporidium hominis
LNDPRKDQ

SEQ ID NO: 2150917 - protein, 4 aa, Cryptosporidium hominis
LNDQ

SEQ ID NO: 2150918 - protein, 9 aa, Cryptosporidium hominis
LNDRKSNKT

SEQ ID NO: 2150919 - protein, 4 aa, Cryptosporidium hominis
LNDS

SEQ ID NO: 2150920 - protein, 24 aa, Cryptosporidium hominis
LNDSTSEYQYRKTNKENKEKMPNR

SEQ ID NO: 2150921 - protein, 4 aa, Cryptosporidium hominis
LNDT

SEQ ID NO: 2150922 - protein, 20 aa, Cryptosporidium hominis
LNEDCQRSQENQAQPGPSPA

SEQ ID NO: 2150923 - protein, 5 aa, Cryptosporidium hominis
LNEDE

SEQ ID NO: 2150924 - protein, 14 aa, Cryptosporidium hominis
LNEDQKKVTKEKIK

SEQ ID NO: 2150925 - protein, 11 aa, Cryptosporidium hominis
LNEDSKTKLNE

SEQ ID NO: 2150926 - protein, 4 aa, Cryptosporidium hominis
LNEE

SEQ ID NO: 2150927 - protein, 9 aa, Cryptosporidium hominis
LNEENSKQE

SEQ ID NO: 2150928 - protein, 9 aa, Cryptosporidium hominis
LNEEPNSQL

SEQ ID NO: 2150929 - protein, 5 aa, Cryptosporidium hominis
LNEET

SEQ ID NO: 2150930 - protein, 4 aa, Cryptosporidium hominis
LNEG

SEQ ID NO: 2150931 - protein, 9 aa, Cryptosporidium hominis
LNEGESSCE

SEQ ID NO: 2150932 - protein, 5 aa, Cryptosporidium hominis
LNEGG

SEQ ID NO: 2150933 - protein, 8 aa, Cryptosporidium hominis
LNEGPGLT

SEQ ID NO: 2150934 - protein, 5 aa, Cryptosporidium hominis
LNEHT

SEQ ID NO: 2150935 - protein, 4 aa, Cryptosporidium hominis
LNEI

SEQ ID NO: 2150936 - protein, 10 aa, Cryptosporidium hominis
LNEKNKRRRV

SEQ ID NO: 2150937 - protein, 6 aa, Cryptosporidium hominis
LNENDP

SEQ ID NO: 2150938 - protein, 8 aa, Cryptosporidium hominis
LNENEKEL

SEQ ID NO: 2150939 - protein, 9 aa, Cryptosporidium hominis
LNENNEESI

SEQ ID NO: 2150940 - protein, 18 aa, Cryptosporidium hominis
LNENTGEKPKSGSSSSIL

SEQ ID NO: 2150941 - protein, 7 aa, Cryptosporidium hominis
LNEPNSI

SEQ ID NO: 2150942 - protein, 6 aa, Cryptosporidium hominis
LNEQQE

SEQ ID NO: 2150943 - protein, 5 aa, Cryptosporidium hominis
LNEQR

SEQ ID NO: 2150944 - protein, 7 aa, Cryptosporidium hominis
LNERNEE

SEQ ID NO: 2150945 - protein, 9 aa, Cryptosporidium hominis
LNESDVDDE

SEQ ID NO: 2150946 - protein, 5 aa, Cryptosporidium hominis
LNESG

SEQ ID NO: 2150947 - protein, 27 aa, Cryptosporidium hominis
LNESYSQNNQNTYQGSPPQESVVAQLH

SEQ ID NO: 2150948 - protein, 9 aa, Cryptosporidium hominis
LNETQSGVD

SEQ ID NO: 2150949 - protein, 11 aa, Cryptosporidium hominis
LNGDATSKSAM

SEQ ID NO: 2150950 - protein, 7 aa, Cryptosporidium hominis
LNGDDSR

SEQ ID NO: 2150951 - protein, 10 aa, Cryptosporidium hominis
LNGDGNSKLS

SEQ ID NO: 2150952 - protein, 4 aa, Cryptosporidium hominis
LNGE

SEQ ID NO: 2150953 - protein, 8 aa, Cryptosporidium hominis
LNGEDAER

SEQ ID NO: 2150954 - protein, 12 aa, Cryptosporidium hominis
LNGEQDKDISSV

SEQ ID NO: 2150955 - protein, 6 aa, Cryptosporidium hominis
LNGESK

SEQ ID NO: 2150956 - protein, 10 aa, Cryptosporidium hominis
LNGGPNATQI

SEQ ID NO: 2150957 - protein, 9 aa, Cryptosporidium hominis
LNGGSECNT

SEQ ID NO: 2150958 - protein, 16 aa, Cryptosporidium hominis
LNGIGETNNVKYSSNN

SEQ ID NO: 2150959 - protein, 7 aa, Cryptosporidium hominis
LNGNDET

SEQ ID NO: 2150960 - protein, 23 aa, Cryptosporidium hominis
LNGNEKDIVNSSNTNPNPATNSF

SEQ ID NO: 2150961 - protein, 9 aa, Cryptosporidium hominis
LNGNNVDSA

SEQ ID NO: 2150962 - protein, 8 aa, Cryptosporidium hominis
LNGNPSLS

SEQ ID NO: 2150963 - protein, 10 aa, Cryptosporidium hominis
LNGNQGEIEI

SEQ ID NO: 2150964 - protein, 18 aa, Cryptosporidium hominis
LNGRNNFTGENLTENDSK

SEQ ID NO: 2150965 - protein, 4 aa, Cryptosporidium hominis
LNGS

SEQ ID NO: 2150966 - protein, 7 aa, Cryptosporidium hominis
LNGSAEV

SEQ ID NO: 2150967 - protein, 12 aa, Cryptosporidium hominis
LNGSSNPASTNN

SEQ ID NO: 2150968 - protein, 9 aa, Cryptosporidium hominis
LNGSSSEYI

SEQ ID NO: 2150969 - protein, 7 aa, Cryptosporidium hominis
LNHPEEV

SEQ ID NO: 2150970 - protein, 18 aa, Cryptosporidium hominis
LNHSDHDNFKSGRSLGDC

SEQ ID NO: 2150971 - protein, 23 aa, Cryptosporidium hominis
LNIPPQKKTYNQTPSTAAQTGLL

SEQ ID NO: 2150972 - protein, 8 aa, Cryptosporidium hominis
LNIPTDPI

SEQ ID NO: 2150973 - protein, 10 aa, Cryptosporidium hominis
LNKDRGDDEM

SEQ ID NO: 2150974 - protein, 10 aa, Cryptosporidium hominis
LNKDSQKHRL

SEQ ID NO: 2150975 - protein, 36 aa, Cryptosporidium hominis
LNKDTSAESNKDGSDTDDTGDNTHDNEGNSSSRQDA

SEQ ID NO: 2150976 - protein, 5 aa, Cryptosporidium hominis
LNKEG

SEQ ID NO: 2150977 - protein, 8 aa, Cryptosporidium hominis
LNKEQARE

SEQ ID NO: 2150978 - protein, 10 aa, Cryptosporidium hominis
LNKGRSSNSE

SEQ ID NO: 2150979 - protein, 17 aa, Cryptosporidium hominis
LNKGSNNGNNNNNNNNN

SEQ ID NO: 2150980 - protein, 18 aa, Cryptosporidium hominis
LNKHNDETSSNSTTLEKL

SEQ ID NO: 2150981 - protein, 33 aa, Cryptosporidium hominis
LNKNNNSSSGSNSKNFNKKKRSSLSSNTSEGGA

SEQ ID NO: 2150982 - protein, 15 aa, Cryptosporidium hominis
LNKPLNKKNNNYNSN

SEQ ID NO: 2150983 - protein, 10 aa, Cryptosporidium hominis
LNKPTGPPST

SEQ ID NO: 2150984 - protein, 12 aa, Cryptosporidium hominis
LNKRKESSIDKK

SEQ ID NO: 2150985 - protein, 10 aa, Cryptosporidium hominis
LNKSASSWKK

SEQ ID NO: 2150986 - protein, 12 aa, Cryptosporidium hominis
LNKSDSEDKKDK

SEQ ID NO: 2150987 - protein, 15 aa, Cryptosporidium hominis
LNKSEPTVQSPNFES

SEQ ID NO: 2150988 - protein, 13 aa, Cryptosporidium hominis
LNKSETASKFGED

SEQ ID NO: 2150989 - protein, 8 aa, Cryptosporidium hominis
LNKSGGSL

SEQ ID NO: 2150990 - protein, 6 aa, Cryptosporidium hominis
LNKSGI

SEQ ID NO: 2150991 - protein, 5 aa, Cryptosporidium hominis
LNKSK

SEQ ID NO: 2150992 - protein, 16 aa, Cryptosporidium hominis
LNKSNQDDLVDSDNNE

SEQ ID NO: 2150993 - protein, 10 aa, Cryptosporidium hominis
LNKSNSSSQV

SEQ ID NO: 2150994 - protein, 9 aa, Cryptosporidium hominis
LNNDEDQAF

SEQ ID NO: 2150995 - protein, 8 aa, Cryptosporidium hominis
LNNDGEIK

SEQ ID NO: 2150996 - protein, 4 aa, Cryptosporidium hominis
LNNE

SEQ ID NO: 2150997 - protein, 9 aa, Cryptosporidium hominis
LNNEKQEKK

SEQ ID NO: 2150998 - protein, 6 aa, Cryptosporidium hominis
LNNENE

SEQ ID NO: 2150999 - protein, 6 aa, Cryptosporidium hominis
LNNEQS

SEQ ID NO: 2151000 - protein, 5 aa, Cryptosporidium hominis
LNNES

SEQ ID NO: 2151001 - protein, 9 aa, Cryptosporidium hominis
LNNGKGPEL

SEQ ID NO: 2151002 - protein, 9 aa, Cryptosporidium hominis
LNNGQNSKI

SEQ ID NO: 2151003 - protein, 9 aa, Cryptosporidium hominis
LNNGSAKDY

SEQ ID NO: 2151004 - protein, 5 aa, Cryptosporidium hominis
LNNHE

SEQ ID NO: 2151005 - protein, 10 aa, Cryptosporidium hominis
LNNHKTDTNL

SEQ ID NO: 2151006 - protein, 32 aa, Cryptosporidium hominis
LNNINTNANSNIDANSSTGTSTLNGVDFNKDG

SEQ ID NO: 2151007 - protein, 12 aa, Cryptosporidium hominis
LNNKSKTADRKY

SEQ ID NO: 2151008 - protein, 13 aa, Cryptosporidium hominis
LNNNDNKLTKNNG

SEQ ID NO: 2151009 - protein, 32 aa, Cryptosporidium hominis
LNNNNNKSQLNNVGNDLKNDVNNSIQTDSHCD

SEQ ID NO: 2151010 - protein, 30 aa, Cryptosporidium hominis
LNNNNTSIDTNSSTTDTSTINSNSNGVNIN

SEQ ID NO: 2151011 - protein, 7 aa, Cryptosporidium hominis
LNNNSKQ

SEQ ID NO: 2151012 - protein, 4 aa, Cryptosporidium hominis
LNNP

SEQ ID NO: 2151013 - protein, 40 aa, Cryptosporidium hominis
LNNQDEPNVGLSGSSRANSDVGGGSGNGGSGSGGSLFSGT

SEQ ID NO: 2151014 - protein, 16 aa, Cryptosporidium hominis
LNNQNISKSSKSRNRI

SEQ ID NO: 2151015 - protein, 4 aa, Cryptosporidium hominis
LNNS

SEQ ID NO: 2151016 - protein, 23 aa, Cryptosporidium hominis
LNNSDSIENKGGDNFVGDEEDEF

SEQ ID NO: 2151017 - protein, 10 aa, Cryptosporidium hominis
LNNSSQTNDI

SEQ ID NO: 2151018 - protein, 15 aa, Cryptosporidium hominis
LNNSTQQKKVSINQN

SEQ ID NO: 2151019 - protein, 26 aa, Cryptosporidium hominis
LNNTLSSSKLSSENTKLSENTNSNFN

SEQ ID NO: 2151020 - protein, 10 aa, Cryptosporidium hominis
LNNTNRPSFG

SEQ ID NO: 2151021 - protein, 14 aa, Cryptosporidium hominis
LNNTSEGKAPISTS

SEQ ID NO: 2151022 - protein, 5 aa, Cryptosporidium hominis
LNPCS

SEQ ID NO: 2151023 - protein, 5 aa, Cryptosporidium hominis
LNPDD

SEQ ID NO: 2151024 - protein, 9 aa, Cryptosporidium hominis
LNPDEESKN

SEQ ID NO: 2151025 - protein, 10 aa, Cryptosporidium hominis
LNPGDGAFYG

SEQ ID NO: 2151026 - protein, 8 aa, Cryptosporidium hominis
LNPKPEKY

SEQ ID NO: 2151027 - protein, 11 aa, Cryptosporidium hominis
LNPKSGSHPHT

SEQ ID NO: 2151028 - protein, 20 aa, Cryptosporidium hominis
LNPKSNKFCKTNKDNNNSNS

SEQ ID NO: 2151029 - protein, 4 aa, Cryptosporidium hominis
LNPN

SEQ ID NO: 2151030 - protein, 24 aa, Cryptosporidium hominis
LNPNHPKSKKDQPNDQNHIDPEDS

SEQ ID NO: 2151031 - protein, 14 aa, Cryptosporidium hominis
LNPNMKSKGKLKEI

SEQ ID NO: 2151032 - protein, 6 aa, Cryptosporidium hominis
LNPNQH

SEQ ID NO: 2151033 - protein, 19 aa, Cryptosporidium hominis
LNPPPASSNANNPISDELK

SEQ ID NO: 2151034 - protein, 19 aa, Cryptosporidium hominis
LNPPYSSESASTKSTTLTN

SEQ ID NO: 2151035 - protein, 7 aa, Cryptosporidium hominis
LNPREKY

SEQ ID NO: 2151036 - protein, 9 aa, Cryptosporidium hominis
LNPRKHREK

SEQ ID NO: 2151037 - protein, 6 aa, Cryptosporidium hominis
LNPRSG

SEQ ID NO: 2151038 - protein, 7 aa, Cryptosporidium hominis
LNPRSRN

SEQ ID NO: 2151039 - protein, 12 aa, Cryptosporidium hominis
LNPRTNSNQGNL

SEQ ID NO: 2151040 - protein, 9 aa, Cryptosporidium hominis
LNPSHKDSV

SEQ ID NO: 2151041 - protein, 9 aa, Cryptosporidium hominis
LNPSSGGAG

SEQ ID NO: 2151042 - protein, 7 aa, Cryptosporidium hominis
LNPSSID

SEQ ID NO: 2151043 - protein, 10 aa, Cryptosporidium hominis
LNPSSRSRSL

SEQ ID NO: 2151044 - protein, 12 aa, Cryptosporidium hominis
LNPSSTERITAK

SEQ ID NO: 2151045 - protein, 5 aa, Cryptosporidium hominis
LNPTG

SEQ ID NO: 2151046 - protein, 5 aa, Cryptosporidium hominis
LNPTN

SEQ ID NO: 2151047 - protein, 17 aa, Cryptosporidium hominis
LNPTNSIVSSGDQAQNL

SEQ ID NO: 2151048 - protein, 7 aa, Cryptosporidium hominis
LNPTPFK

SEQ ID NO: 2151049 - protein, 37 aa, Cryptosporidium hominis
LNPVGTSGNDSDALGAATSTNTFTEKQATSTASATIV

SEQ ID NO: 2151050 - protein, 13 aa, Cryptosporidium hominis
LNPWNNDKPYSNK

SEQ ID NO: 2151051 - protein, 10 aa, Cryptosporidium hominis
LNQASKSSNF

SEQ ID NO: 2151052 - protein, 41 aa, Cryptosporidium hominis
LNQDNKNQLKINSTNDCNASQLNTRPSSGFSAGNDDSFSFS

SEQ ID NO: 2151053 - protein, 9 aa, Cryptosporidium hominis
LNQDSRENV

SEQ ID NO: 2151054 - protein, 4 aa, Cryptosporidium hominis
LNQE

SEQ ID NO: 2151055 - protein, 11 aa, Cryptosporidium hominis
LNQEEKERLEK

SEQ ID NO: 2151056 - protein, 7 aa, Cryptosporidium hominis
LNQEKID

SEQ ID NO: 2151057 - protein, 35 aa, Cryptosporidium hominis
LNQEQEQDQEEQDQTKDQYKSETDIETRQKEREID

SEQ ID NO: 2151058 - protein, 19 aa, Cryptosporidium hominis
LNQEQQKQQKQEQEQEQEN

SEQ ID NO: 2151059 - protein, 14 aa, Cryptosporidium hominis
LNQGTSNNNNNNNI

SEQ ID NO: 2151060 - protein, 7 aa, Cryptosporidium hominis
LNQSNKA

SEQ ID NO: 2151061 - protein, 7 aa, Cryptosporidium hominis
LNQSPGD

SEQ ID NO: 2151062 - protein, 30 aa, Cryptosporidium hominis
LNQSQNLDVNQNQNLDVNQNQNLDVNQNQN

SEQ ID NO: 2151063 - protein, 10 aa, Cryptosporidium hominis
LNQSQNQNIK

SEQ ID NO: 2151064 - protein, 5 aa, Cryptosporidium hominis
LNQTS

SEQ ID NO: 2151065 - protein, 14 aa, Cryptosporidium hominis
LNQYNDNLQGQNTY

SEQ ID NO: 2151066 - protein, 8 aa, Cryptosporidium hominis
LNRDGTYG

SEQ ID NO: 2151067 - protein, 5 aa, Cryptosporidium hominis
LNRDR

SEQ ID NO: 2151068 - protein, 6 aa, Cryptosporidium hominis
LNREIT

SEQ ID NO: 2151069 - protein, 6 aa, Cryptosporidium hominis
LNRSQA

SEQ ID NO: 2151070 - protein, 7 aa, Cryptosporidium hominis
LNRSTGL

SEQ ID NO: 2151071 - protein, 4 aa, Cryptosporidium hominis
LNRT

SEQ ID NO: 2151072 - protein, 4 aa, Cryptosporidium hominis
LNSD

SEQ ID NO: 2151073 - protein, 19 aa, Cryptosporidium hominis
LNSDKETNFNNNENETTSE

SEQ ID NO: 2151074 - protein, 9 aa, Cryptosporidium hominis
LNSDSNKWD

SEQ ID NO: 2151075 - protein, 17 aa, Cryptosporidium hominis
LNSDTVEMKNSGNLPPI

SEQ ID NO: 2151076 - protein, 4 aa, Cryptosporidium hominis
LNSE

SEQ ID NO: 2151077 - protein, 11 aa, Cryptosporidium hominis
LNSEEDENPQF

SEQ ID NO: 2151078 - protein, 7 aa, Cryptosporidium hominis
LNSEKNI

SEQ ID NO: 2151079 - protein, 34 aa, Cryptosporidium hominis
LNSELTRNQKNIESTISEPMNDGDPAKNFQNDPC

SEQ ID NO: 2151080 - protein, 8 aa, Cryptosporidium hominis
LNSGGDDL

SEQ ID NO: 2151081 - protein, 15 aa, Cryptosporidium hominis
LNSGIERQSRNSSNW

SEQ ID NO: 2151082 - protein, 16 aa, Cryptosporidium hominis
LNSGSGNDNEQETSEF

SEQ ID NO: 2151083 - protein, 8 aa, Cryptosporidium hominis
LNSKEKKF

SEQ ID NO: 2151084 - protein, 13 aa, Cryptosporidium hominis
LNSKETKKNEYSS

SEQ ID NO: 2151085 - protein, 10 aa, Cryptosporidium hominis
LNSKGSKEDL

SEQ ID NO: 2151086 - protein, 8 aa, Cryptosporidium hominis
LNSKPREI

SEQ ID NO: 2151087 - protein, 10 aa, Cryptosporidium hominis
LNSNGERLES

SEQ ID NO: 2151088 - protein, 5 aa, Cryptosporidium hominis
LNSNN

SEQ ID NO: 2151089 - protein, 8 aa, Cryptosporidium hominis
LNSNQKGE

SEQ ID NO: 2151090 - protein, 10 aa, Cryptosporidium hominis
LNSNQSADEL

SEQ ID NO: 2151091 - protein, 5 aa, Cryptosporidium hominis
LNSNS

SEQ ID NO: 2151092 - protein, 19 aa, Cryptosporidium hominis
LNSNSGEGDDDDIEDDDED

SEQ ID NO: 2151093 - protein, 7 aa, Cryptosporidium hominis
LNSPKAL

SEQ ID NO: 2151094 - protein, 11 aa, Cryptosporidium hominis
LNSPKCNTDFN

SEQ ID NO: 2151095 - protein, 11 aa, Cryptosporidium hominis
LNSPKISHEGS

SEQ ID NO: 2151096 - protein, 4 aa, Cryptosporidium hominis
LNSQ

SEQ ID NO: 2151097 - protein, 22 aa, Cryptosporidium hominis
LNSQDSHNISNNNNNNNNNNFQ

SEQ ID NO: 2151098 - protein, 9 aa, Cryptosporidium hominis
LNSSDMSQE

SEQ ID NO: 2151099 - protein, 15 aa, Cryptosporidium hominis
LNSSDQKGSENNHSI

SEQ ID NO: 2151100 - protein, 13 aa, Cryptosporidium hominis
LNSSINNKKSLND

SEQ ID NO: 2151101 - protein, 7 aa, Cryptosporidium hominis
LNSSPVT

SEQ ID NO: 2151102 - protein, 9 aa, Cryptosporidium hominis
LNSSQESNT

SEQ ID NO: 2151103 - protein, 17 aa, Cryptosporidium hominis
LNSSRISPISKSKALQT

SEQ ID NO: 2151104 - protein, 11 aa, Cryptosporidium hominis
LNSSSPSFYDP

SEQ ID NO: 2151105 - protein, 39 aa, Cryptosporidium hominis
LNSSSSNSQDGSNSNNNGNSTSSGNSSSSLNCKPTAQEI

SEQ ID NO: 2151106 - protein, 32 aa, Cryptosporidium hominis
LNSSTSGGMPGSDSSSSSSSSSSNSPNPPLSS

SEQ ID NO: 2151107 - protein, 17 aa, Cryptosporidium hominis
LNSTKQDHENSTFSSSR

SEQ ID NO: 2151108 - protein, 75 aa, Cryptosporidium hominis
LNSTNPESGGNNLTQNQNTKPHPGVRPYPTEKPSNGEHQESGSEHAPVTSPENESSSNHPSVTIPETGSGSNHAP

SEQ ID NO: 2151109 - protein, 8 aa, Cryptosporidium hominis
LNSTPPTL

SEQ ID NO: 2151110 - protein, 5 aa, Cryptosporidium hominis
LNSTT

SEQ ID NO: 2151111 - protein, 9 aa, Cryptosporidium hominis
LNTANLSQA

SEQ ID NO: 2151112 - protein, 8 aa, Cryptosporidium hominis
LNTARESS

SEQ ID NO: 2151113 - protein, 18 aa, Cryptosporidium hominis
LNTDGNSNNNSNGNSSSS

SEQ ID NO: 2151114 - protein, 25 aa, Cryptosporidium hominis
LNTDNLNSKTLKPSNLAKKSTIKPK

SEQ ID NO: 2151115 - protein, 8 aa, Cryptosporidium hominis
LNTETGEM

SEQ ID NO: 2151116 - protein, 9 aa, Cryptosporidium hominis
LNTETTKVK

SEQ ID NO: 2151117 - protein, 6 aa, Cryptosporidium hominis
LNTGEN

SEQ ID NO: 2151118 - protein, 5 aa, Cryptosporidium hominis
LNTKD

SEQ ID NO: 2151119 - protein, 5 aa, Cryptosporidium hominis
LNTNP

SEQ ID NO: 2151120 - protein, 6 aa, Cryptosporidium hominis
LNTNST

SEQ ID NO: 2151121 - protein, 8 aa, Cryptosporidium hominis
LNTNTYQK

SEQ ID NO: 2151122 - protein, 10 aa, Cryptosporidium hominis
LNTPSYGNNS

SEQ ID NO: 2151123 - protein, 16 aa, Cryptosporidium hominis
LNTQEESNKEDENRYP

SEQ ID NO: 2151124 - protein, 13 aa, Cryptosporidium hominis
LNTSGRDDKHSRD

SEQ ID NO: 2151125 - protein, 41 aa, Cryptosporidium hominis
LNTSPEATKETNKTYDNNSDAKNRINQSKNATDKRSEKQAD

SEQ ID NO: 2151126 - protein, 12 aa, Cryptosporidium hominis
LNTSSTSNDSED

SEQ ID NO: 2151127 - protein, 9 aa, Cryptosporidium hominis
LNTTSPSPQ

SEQ ID NO: 2151128 - protein, 11 aa, Cryptosporidium hominis
LNVTGSNDNIY

SEQ ID NO: 2151129 - protein, 6 aa, Cryptosporidium hominis
LNYQTQ

SEQ ID NO: 2151130 - protein, 5 aa, Cryptosporidium hominis
LNYTG

SEQ ID NO: 2151131 - protein, 8 aa, Cryptosporidium hominis
LPAEERNT

SEQ ID NO: 2151132 - protein, 9 aa, Cryptosporidium hominis
LPAENRESF

SEQ ID NO: 2151133 - protein, 9 aa, Cryptosporidium hominis
LPAKREKTR

SEQ ID NO: 2151134 - protein, 8 aa, Cryptosporidium hominis
LPAPKTIS

SEQ ID NO: 2151135 - protein, 6 aa, Cryptosporidium hominis
LPAWSE

SEQ ID NO: 2151136 - protein, 4 aa, Cryptosporidium hominis
LPDD

SEQ ID NO: 2151137 - protein, 37 aa, Cryptosporidium hominis
LPDDHSNYPSFNRKRDADETDGVGSIRTNTPESKKSH

SEQ ID NO: 2151138 - protein, 4 aa, Cryptosporidium hominis
LPDE

SEQ ID NO: 2151139 - protein, 18 aa, Cryptosporidium hominis
LPDGNSNKKLEKPNYLSP

SEQ ID NO: 2151140 - protein, 6 aa, Cryptosporidium hominis
LPDIED

SEQ ID NO: 2151141 - protein, 7 aa, Cryptosporidium hominis
LPDKADS

SEQ ID NO: 2151142 - protein, 16 aa, Cryptosporidium hominis
LPDLESKKKTKEKNLI

SEQ ID NO: 2151143 - protein, 4 aa, Cryptosporidium hominis
LPDN

SEQ ID NO: 2151144 - protein, 36 aa, Cryptosporidium hominis
LPDNSSENEEATNEGKEQIKKDQKAESVENQNKTNL

SEQ ID NO: 2151145 - protein, 5 aa, Cryptosporidium hominis
LPDNV

SEQ ID NO: 2151146 - protein, 9 aa, Cryptosporidium hominis
LPDPNGQTP

SEQ ID NO: 2151147 - protein, 7 aa, Cryptosporidium hominis
LPDSEGR

SEQ ID NO: 2151148 - protein, 5 aa, Cryptosporidium hominis
LPDSS

SEQ ID NO: 2151149 - protein, 16 aa, Cryptosporidium hominis
LPDTGSIYEENGGGTV

SEQ ID NO: 2151150 - protein, 5 aa, Cryptosporidium hominis
LPDTN

SEQ ID NO: 2151151 - protein, 7 aa, Cryptosporidium hominis
LPEEDEF

SEQ ID NO: 2151152 - protein, 9 aa, Cryptosporidium hominis
LPEEQQKAK

SEQ ID NO: 2151153 - protein, 8 aa, Cryptosporidium hominis
LPEESTSY

SEQ ID NO: 2151154 - protein, 4 aa, Cryptosporidium hominis
LPEG

SEQ ID NO: 2151155 - protein, 8 aa, Cryptosporidium hominis
LPEGDSTS

SEQ ID NO: 2151156 - protein, 6 aa, Cryptosporidium hominis
LPEKSR

SEQ ID NO: 2151157 - protein, 13 aa, Cryptosporidium hominis
LPENEKNYSGRFG

SEQ ID NO: 2151158 - protein, 8 aa, Cryptosporidium hominis
LPENENGI

SEQ ID NO: 2151159 - protein, 11 aa, Cryptosporidium hominis
LPERASRGKRY

SEQ ID NO: 2151160 - protein, 5 aa, Cryptosporidium hominis
LPEYS

SEQ ID NO: 2151161 - protein, 6 aa, Cryptosporidium hominis
LPGAQQ

SEQ ID NO: 2151162 - protein, 10 aa, Cryptosporidium hominis
LPGASESGAT

SEQ ID NO: 2151163 - protein, 5 aa, Cryptosporidium hominis
LPGDN

SEQ ID NO: 2151164 - protein, 5 aa, Cryptosporidium hominis
LPGEL

SEQ ID NO: 2151165 - protein, 8 aa, Cryptosporidium hominis
LPGGGGTE

SEQ ID NO: 2151166 - protein, 16 aa, Cryptosporidium hominis
LPGLPQSRTRSNRPIK

SEQ ID NO: 2151167 - protein, 8 aa, Cryptosporidium hominis
LPGPGTPV

SEQ ID NO: 2151168 - protein, 5 aa, Cryptosporidium hominis
LPGRG

SEQ ID NO: 2151169 - protein, 8 aa, Cryptosporidium hominis
LPGSDSDF

SEQ ID NO: 2151170 - protein, 6 aa, Cryptosporidium hominis
LPGTKE

SEQ ID NO: 2151171 - protein, 12 aa, Cryptosporidium hominis
LPGTTETSGVSN

SEQ ID NO: 2151172 - protein, 6 aa, Cryptosporidium hominis
LPGWGA

SEQ ID NO: 2151173 - protein, 11 aa, Cryptosporidium hominis
LPHKSYSYNGI

SEQ ID NO: 2151174 - protein, 5 aa, Cryptosporidium hominis
LPHND

SEQ ID NO: 2151175 - protein, 10 aa, Cryptosporidium hominis
LPHNSSGTPC

SEQ ID NO: 2151176 - protein, 10 aa, Cryptosporidium hominis
LPHPNEEARS

SEQ ID NO: 2151177 - protein, 5 aa, Cryptosporidium hominis
LPHPS

SEQ ID NO: 2151178 - protein, 23 aa, Cryptosporidium hominis
LPIDPETGLPRDPVSGLPQLPNG

SEQ ID NO: 2151179 - protein, 8 aa, Cryptosporidium hominis
LPIPGSVA

SEQ ID NO: 2151180 - protein, 11 aa, Cryptosporidium hominis
LPIPSSIQGRN

SEQ ID NO: 2151181 - protein, 4 aa, Cryptosporidium hominis
LPIS

SEQ ID NO: 2151182 - protein, 7 aa, Cryptosporidium hominis
LPKENPF

SEQ ID NO: 2151183 - protein, 8 aa, Cryptosporidium hominis
LPKGPELS

SEQ ID NO: 2151184 - protein, 22 aa, Cryptosporidium hominis
LPKHSSTVSYSPSSLSSGKNDK

SEQ ID NO: 2151185 - protein, 4 aa, Cryptosporidium hominis
LPKI

SEQ ID NO: 2151186 - protein, 4 aa, Cryptosporidium hominis
LPKK

SEQ ID NO: 2151187 - protein, 5 aa, Cryptosporidium hominis
LPKND

SEQ ID NO: 2151188 - protein, 8 aa, Cryptosporidium hominis
LPKNQQKN

SEQ ID NO: 2151189 - protein, 7 aa, Cryptosporidium hominis
LPKPTEY

SEQ ID NO: 2151190 - protein, 4 aa, Cryptosporidium hominis
LPKS

SEQ ID NO: 2151191 - protein, 41 aa, Cryptosporidium hominis
LPKSNGVTTPGTGSKHTTSTAATTVTATTTTTTTSSSPSSV

SEQ ID NO: 2151192 - protein, 6 aa, Cryptosporidium hominis
LPKSQV

SEQ ID NO: 2151193 - protein, 6 aa, Cryptosporidium hominis
LPLGTQ

SEQ ID NO: 2151194 - protein, 4 aa, Cryptosporidium hominis
LPNE

SEQ ID NO: 2151195 - protein, 15 aa, Cryptosporidium hominis
LPNEEQFSSEVPKNI

SEQ ID NO: 2151196 - protein, 6 aa, Cryptosporidium hominis
LPNETP

SEQ ID NO: 2151197 - protein, 7 aa, Cryptosporidium hominis
LPNKQNS

SEQ ID NO: 2151198 - protein, 5 aa, Cryptosporidium hominis
LPNKS

SEQ ID NO: 2151199 - protein, 8 aa, Cryptosporidium hominis
LPNNSQAQ

SEQ ID NO: 2151200 - protein, 9 aa, Cryptosporidium hominis
LPNPDCKTK

SEQ ID NO: 2151201 - protein, 9 aa, Cryptosporidium hominis
LPNPQRPSD

SEQ ID NO: 2151202 - protein, 8 aa, Cryptosporidium hominis
LPNPSIEE

SEQ ID NO: 2151203 - protein, 9 aa, Cryptosporidium hominis
LPNQGGSEL

SEQ ID NO: 2151204 - protein, 5 aa, Cryptosporidium hominis
LPNRS

SEQ ID NO: 2151205 - protein, 5 aa, Cryptosporidium hominis
LPNSL

SEQ ID NO: 2151206 - protein, 20 aa, Cryptosporidium hominis
LPNSNQQPCSPSPPNNMNPG

SEQ ID NO: 2151207 - protein, 8 aa, Cryptosporidium hominis
LPNYSPDW

SEQ ID NO: 2151208 - protein, 4 aa, Cryptosporidium hominis
LPPD

SEQ ID NO: 2151209 - protein, 6 aa, Cryptosporidium hominis
LPPDKL

SEQ ID NO: 2151210 - protein, 11 aa, Cryptosporidium hominis
LPPEDSEIGDP

SEQ ID NO: 2151211 - protein, 22 aa, Cryptosporidium hominis
LPPESRNNISNIPASKIEGSQD

SEQ ID NO: 2151212 - protein, 7 aa, Cryptosporidium hominis
LPPESTY

SEQ ID NO: 2151213 - protein, 26 aa, Cryptosporidium hominis
LPPFPKPREGIKSQQHSLEQNKSIPP

SEQ ID NO: 2151214 - protein, 8 aa, Cryptosporidium hominis
LPPHNDLG

SEQ ID NO: 2151215 - protein, 6 aa, Cryptosporidium hominis
LPPHPG

SEQ ID NO: 2151216 - protein, 6 aa, Cryptosporidium hominis
LPPIAD

SEQ ID NO: 2151217 - protein, 5 aa, Cryptosporidium hominis
LPPIS

SEQ ID NO: 2151218 - protein, 4 aa, Cryptosporidium hominis
LPPK

SEQ ID NO: 2151219 - protein, 9 aa, Cryptosporidium hominis
LPPKQRSKI

SEQ ID NO: 2151220 - protein, 8 aa, Cryptosporidium hominis
LPPKSPGL

SEQ ID NO: 2151221 - protein, 23 aa, Cryptosporidium hominis
LPPNNMNPGANTAFNARSKKRPA

SEQ ID NO: 2151222 - protein, 10 aa, Cryptosporidium hominis
LPPNTEPSSN

SEQ ID NO: 2151223 - protein, 20 aa, Cryptosporidium hominis
LPPPADTKPKTSKFAKLFKK

SEQ ID NO: 2151224 - protein, 16 aa, Cryptosporidium hominis
LPPPIDTSDLKPYPTS

SEQ ID NO: 2151225 - protein, 5 aa, Cryptosporidium hominis
LPPPK

SEQ ID NO: 2151226 - protein, 9 aa, Cryptosporidium hominis
LPPPPPITG

SEQ ID NO: 2151227 - protein, 9 aa, Cryptosporidium hominis
LPPPPPTST

SEQ ID NO: 2151228 - protein, 4 aa, Cryptosporidium hominis
LPPR

SEQ ID NO: 2151229 - protein, 9 aa, Cryptosporidium hominis
LPPRATNCR

SEQ ID NO: 2151230 - protein, 5 aa, Cryptosporidium hominis
LPPSD

SEQ ID NO: 2151231 - protein, 7 aa, Cryptosporidium hominis
LPPSGGK

SEQ ID NO: 2151232 - protein, 12 aa, Cryptosporidium hominis
LPPSPDASITSV

SEQ ID NO: 2151233 - protein, 17 aa, Cryptosporidium hominis
LPPTEETFKKLSSSVNI

SEQ ID NO: 2151234 - protein, 5 aa, Cryptosporidium hominis
LPPTG

SEQ ID NO: 2151235 - protein, 7 aa, Cryptosporidium hominis
LPPTGGW

SEQ ID NO: 2151236 - protein, 6 aa, Cryptosporidium hominis
LPPYKQ

SEQ ID NO: 2151237 - protein, 4 aa, Cryptosporidium hominis
LPQD

SEQ ID NO: 2151238 - protein, 4 aa, Cryptosporidium hominis
LPQN

SEQ ID NO: 2151239 - protein, 33 aa, Cryptosporidium hominis
LPQNSRKRTYYESRRTGIKHRKNEINNTYSGNR

SEQ ID NO: 2151240 - protein, 8 aa, Cryptosporidium hominis
LPQSSNSR

SEQ ID NO: 2151241 - protein, 12 aa, Cryptosporidium hominis
LPQSTETTDSKS

SEQ ID NO: 2151242 - protein, 4 aa, Cryptosporidium hominis
LPQT

SEQ ID NO: 2151243 - protein, 11 aa, Cryptosporidium hominis
LPQTAGFSTPS

SEQ ID NO: 2151244 - protein, 4 aa, Cryptosporidium hominis
LPQY

SEQ ID NO: 2151245 - protein, 9 aa, Cryptosporidium hominis
LPRKDGLDL

SEQ ID NO: 2151246 - protein, 9 aa, Cryptosporidium hominis
LPRKTRRGV

SEQ ID NO: 2151247 - protein, 15 aa, Cryptosporidium hominis
LPSAGSSMKSNRSDV

SEQ ID NO: 2151248 - protein, 6 aa, Cryptosporidium hominis
LPSDGA

SEQ ID NO: 2151249 - protein, 7 aa, Cryptosporidium hominis
LPSEQQA

SEQ ID NO: 2151250 - protein, 13 aa, Cryptosporidium hominis
LPSERVGNGSPNW

SEQ ID NO: 2151251 - protein, 15 aa, Cryptosporidium hominis
LPSETPINSEGYKND

SEQ ID NO: 2151252 - protein, 14 aa, Cryptosporidium hominis
LPSGARKTISSQSR

SEQ ID NO: 2151253 - protein, 4 aa, Cryptosporidium hominis
LPSK

SEQ ID NO: 2151254 - protein, 11 aa, Cryptosporidium hominis
LPSKSDKEPLK

SEQ ID NO: 2151255 - protein, 12 aa, Cryptosporidium hominis
LPSKSKRSNSFL

SEQ ID NO: 2151256 - protein, 39 aa, Cryptosporidium hominis
LPSKVNKETSKAENDLENKIEKDDESNKKEIKKEEDSIA

SEQ ID NO: 2151257 - protein, 5 aa, Cryptosporidium hominis
LPSLE

SEQ ID NO: 2151258 - protein, 5 aa, Cryptosporidium hominis
LPSLN

SEQ ID NO: 2151259 - protein, 5 aa, Cryptosporidium hominis
LPSMN

SEQ ID NO: 2151260 - protein, 9 aa, Cryptosporidium hominis
LPSPQYPSD

SEQ ID NO: 2151261 - protein, 17 aa, Cryptosporidium hominis
LPSPSDNSGDLKGNENI

SEQ ID NO: 2151262 - protein, 7 aa, Cryptosporidium hominis
LPSPVTK

SEQ ID NO: 2151263 - protein, 8 aa, Cryptosporidium hominis
LPSQTPLN

SEQ ID NO: 2151264 - protein, 8 aa, Cryptosporidium hominis
LPSSAAGI

SEQ ID NO: 2151265 - protein, 12 aa, Cryptosporidium hominis
LPSSSISKKRRV

SEQ ID NO: 2151266 - protein, 18 aa, Cryptosporidium hominis
LPSSSTKLEKSEENRNEL

SEQ ID NO: 2151267 - protein, 19 aa, Cryptosporidium hominis
LPSSTTESQELDPKSNSTE

SEQ ID NO: 2151268 - protein, 5 aa, Cryptosporidium hominis
LPSTL

SEQ ID NO: 2151269 - protein, 11 aa, Cryptosporidium hominis
LPTAGDKVSGY

SEQ ID NO: 2151270 - protein, 5 aa, Cryptosporidium hominis
LPTGD

SEQ ID NO: 2151271 - protein, 6 aa, Cryptosporidium hominis
LPTGNT

SEQ ID NO: 2151272 - protein, 10 aa, Cryptosporidium hominis
LPTNKDEDSE

SEQ ID NO: 2151273 - protein, 6 aa, Cryptosporidium hominis
LPTPED

SEQ ID NO: 2151274 - protein, 7 aa, Cryptosporidium hominis
LPTPNGT

SEQ ID NO: 2151275 - protein, 20 aa, Cryptosporidium hominis
LPTPSTSTFPLTSSHSSSVF

SEQ ID NO: 2151276 - protein, 9 aa, Cryptosporidium hominis
LPTSNEAKY

SEQ ID NO: 2151277 - protein, 5 aa, Cryptosporidium hominis
LPTSR

SEQ ID NO: 2151278 - protein, 8 aa, Cryptosporidium hominis
LPVSSGTE

SEQ ID NO: 2151279 - protein, 6 aa, Cryptosporidium hominis
LPWDTN

SEQ ID NO: 2151280 - protein, 4 aa, Cryptosporidium hominis
LPYG

SEQ ID NO: 2151281 - protein, 11 aa, Cryptosporidium hominis
LPYGNSPLNRN

SEQ ID NO: 2151282 - protein, 9 aa, Cryptosporidium hominis
LPYNNNKNS

SEQ ID NO: 2151283 - protein, 11 aa, Cryptosporidium hominis
LQASSESQNHS

SEQ ID NO: 2151284 - protein, 6 aa, Cryptosporidium hominis
LQASSV

SEQ ID NO: 2151285 - protein, 10 aa, Cryptosporidium hominis
LQDPNWEKQE

SEQ ID NO: 2151286 - protein, 7 aa, Cryptosporidium hominis
LQDPRSA

SEQ ID NO: 2151287 - protein, 8 aa, Cryptosporidium hominis
LQDQNNHD

SEQ ID NO: 2151288 - protein, 7 aa, Cryptosporidium hominis
LQDQSKA

SEQ ID NO: 2151289 - protein, 9 aa, Cryptosporidium hominis
LQDSSTEYD

SEQ ID NO: 2151290 - protein, 9 aa, Cryptosporidium hominis
LQEAPSKAI

SEQ ID NO: 2151291 - protein, 11 aa, Cryptosporidium hominis
LQEDHDSLSRE

SEQ ID NO: 2151292 - protein, 7 aa, Cryptosporidium hominis
LQEEKER

SEQ ID NO: 2151293 - protein, 4 aa, Cryptosporidium hominis
LQEI

SEQ ID NO: 2151294 - protein, 6 aa, Cryptosporidium hominis
LQEKSL

SEQ ID NO: 2151295 - protein, 8 aa, Cryptosporidium hominis
LQENQISN

SEQ ID NO: 2151296 - protein, 6 aa, Cryptosporidium hominis
LQEPKK

SEQ ID NO: 2151297 - protein, 4 aa, Cryptosporidium hominis
LQES

SEQ ID NO: 2151298 - protein, 8 aa, Cryptosporidium hominis
LQESGIDN

SEQ ID NO: 2151299 - protein, 22 aa, Cryptosporidium hominis
LQESSRRESVENTFRSSRIGSN

SEQ ID NO: 2151300 - protein, 13 aa, Cryptosporidium hominis
LQESTGRDRPTVI

SEQ ID NO: 2151301 - protein, 8 aa, Cryptosporidium hominis
LQETNKNI

SEQ ID NO: 2151302 - protein, 6 aa, Cryptosporidium hominis
LQGDRE

SEQ ID NO: 2151303 - protein, 8 aa, Cryptosporidium hominis
LQGGPHNH

SEQ ID NO: 2151304 - protein, 7 aa, Cryptosporidium hominis
LQGQRPE

SEQ ID NO: 2151305 - protein, 6 aa, Cryptosporidium hominis
LQGQTD

SEQ ID NO: 2151306 - protein, 6 aa, Cryptosporidium hominis
LQGTPI

SEQ ID NO: 2151307 - protein, 12 aa, Cryptosporidium hominis
LQGTSEQENKQV

SEQ ID NO: 2151308 - protein, 6 aa, Cryptosporidium hominis
LQGTTG

SEQ ID NO: 2151309 - protein, 8 aa, Cryptosporidium hominis
LQHKPELG

SEQ ID NO: 2151310 - protein, 4 aa, Cryptosporidium hominis
LQHP

SEQ ID NO: 2151311 - protein, 7 aa, Cryptosporidium hominis
LQIPETS

SEQ ID NO: 2151312 - protein, 7 aa, Cryptosporidium hominis
LQIPPKK

SEQ ID NO: 2151313 - protein, 11 aa, Cryptosporidium hominis
LQKKGTEYQGN

SEQ ID NO: 2151314 - protein, 18 aa, Cryptosporidium hominis
LQKNISDQAQKQHEEKKR

SEQ ID NO: 2151315 - protein, 4 aa, Cryptosporidium hominis
LQKS

SEQ ID NO: 2151316 - protein, 9 aa, Cryptosporidium hominis
LQKSSDKSH

SEQ ID NO: 2151317 - protein, 9 aa, Cryptosporidium hominis
LQNDNKPLC

SEQ ID NO: 2151318 - protein, 17 aa, Cryptosporidium hominis
LQNESTEFSNSYQTPLS

SEQ ID NO: 2151319 - protein, 5 aa, Cryptosporidium hominis
LQNGN

SEQ ID NO: 2151320 - protein, 6 aa, Cryptosporidium hominis
LQNKRK

SEQ ID NO: 2151321 - protein, 6 aa, Cryptosporidium hominis
LQNNNE

SEQ ID NO: 2151322 - protein, 8 aa, Cryptosporidium hominis
LQNNNLAQ

SEQ ID NO: 2151323 - protein, 12 aa, Cryptosporidium hominis
LQNPTGAMSPGP

SEQ ID NO: 2151324 - protein, 9 aa, Cryptosporidium hominis
LQNSKASHD

SEQ ID NO: 2151325 - protein, 13 aa, Cryptosporidium hominis
LQNSQNKNGYSTQ

SEQ ID NO: 2151326 - protein, 8 aa, Cryptosporidium hominis
LQNSSSRI

SEQ ID NO: 2151327 - protein, 18 aa, Cryptosporidium hominis
LQNSTAKKINSSRYPEEG

SEQ ID NO: 2151328 - protein, 19 aa, Cryptosporidium hominis
LQNTNNSYALNSNPPNNAA

SEQ ID NO: 2151329 - protein, 37 aa, Cryptosporidium hominis
LQPNNENIDENDEEDNLDTDGRSKSRKKSRRATRAKE

SEQ ID NO: 2151330 - protein, 12 aa, Cryptosporidium hominis
LQPRRSKDLPLS

SEQ ID NO: 2151331 - protein, 10 aa, Cryptosporidium hominis
LQQDQGYDNL

SEQ ID NO: 2151332 - protein, 22 aa, Cryptosporidium hominis
LQQPESDSQDSPVENTKRRKIS

SEQ ID NO: 2151333 - protein, 5 aa, Cryptosporidium hominis
LQQQE

SEQ ID NO: 2151334 - protein, 17 aa, Cryptosporidium hominis
LQQSQDWESQGNWKLNN

SEQ ID NO: 2151335 - protein, 5 aa, Cryptosporidium hominis
LQRKS

SEQ ID NO: 2151336 - protein, 7 aa, Cryptosporidium hominis
LQRNKTS

SEQ ID NO: 2151337 - protein, 9 aa, Cryptosporidium hominis
LQRSTRPTW

SEQ ID NO: 2151338 - protein, 9 aa, Cryptosporidium hominis
LQSDSKRYI

SEQ ID NO: 2151339 - protein, 10 aa, Cryptosporidium hominis
LQSEESNKLE

SEQ ID NO: 2151340 - protein, 37 aa, Cryptosporidium hominis
LQSEGTSFKAGVSKNIQGGASNSSFSSSSLSGAGEKS

SEQ ID NO: 2151341 - protein, 10 aa, Cryptosporidium hominis
LQSGDFGSKL

SEQ ID NO: 2151342 - protein, 6 aa, Cryptosporidium hominis
LQSGID

SEQ ID NO: 2151343 - protein, 7 aa, Cryptosporidium hominis
LQSNPTI

SEQ ID NO: 2151344 - protein, 8 aa, Cryptosporidium hominis
LQSNQNKS

SEQ ID NO: 2151345 - protein, 6 aa, Cryptosporidium hominis
LQSRED

SEQ ID NO: 2151346 - protein, 9 aa, Cryptosporidium hominis
LQSSAPNRG

SEQ ID NO: 2151347 - protein, 24 aa, Cryptosporidium hominis
LQSSTETTVGPDGLEKSSASADCS

SEQ ID NO: 2151348 - protein, 9 aa, Cryptosporidium hominis
LQSSTREEL

SEQ ID NO: 2151349 - protein, 5 aa, Cryptosporidium hominis
LQTEN

SEQ ID NO: 2151350 - protein, 15 aa, Cryptosporidium hominis
LQTNPNSSSNSNSNN

SEQ ID NO: 2151351 - protein, 7 aa, Cryptosporidium hominis
LQTSGQV

SEQ ID NO: 2151352 - protein, 12 aa, Cryptosporidium hominis
LQTSNKKISELG

SEQ ID NO: 2151353 - protein, 15 aa, Cryptosporidium hominis
LQTTTSISSNSSGSF

SEQ ID NO: 2151354 - protein, 10 aa, Cryptosporidium hominis
LRADGQTVSF

SEQ ID NO: 2151355 - protein, 8 aa, Cryptosporidium hominis
LRARPEGF

SEQ ID NO: 2151356 - protein, 18 aa, Cryptosporidium hominis
LRDEKEKINQYKKHDDDF

SEQ ID NO: 2151357 - protein, 28 aa, Cryptosporidium hominis
LRDNINQSFSKKPLNKNRSLGKGGKKHL

SEQ ID NO: 2151358 - protein, 7 aa, Cryptosporidium hominis
LRDNNSS

SEQ ID NO: 2151359 - protein, 4 aa, Cryptosporidium hominis
LRDQ

SEQ ID NO: 2151360 - protein, 4 aa, Cryptosporidium hominis
LRDS

SEQ ID NO: 2151361 - protein, 8 aa, Cryptosporidium hominis
LRDSEKQS

SEQ ID NO: 2151362 - protein, 6 aa, Cryptosporidium hominis
LRDSNK

SEQ ID NO: 2151363 - protein, 6 aa, Cryptosporidium hominis
LRDSRS

SEQ ID NO: 2151364 - protein, 5 aa, Cryptosporidium hominis
LRDTS

SEQ ID NO: 2151365 - protein, 11 aa, Cryptosporidium hominis
LRDVQKQTNPL

SEQ ID NO: 2151366 - protein, 7 aa, Cryptosporidium hominis
LRDYSNK

SEQ ID NO: 2151367 - protein, 5 aa, Cryptosporidium hominis
LREEE

SEQ ID NO: 2151368 - protein, 6 aa, Cryptosporidium hominis
LREKGS

SEQ ID NO: 2151369 - protein, 10 aa, Cryptosporidium hominis
LRENSSEQSL

SEQ ID NO: 2151370 - protein, 12 aa, Cryptosporidium hominis
LRESNQGSYSDP

SEQ ID NO: 2151371 - protein, 7 aa, Cryptosporidium hominis
LRESQNQ

SEQ ID NO: 2151372 - protein, 6 aa, Cryptosporidium hominis
LRETTS

SEQ ID NO: 2151373 - protein, 19 aa, Cryptosporidium hominis
LRGKGSGYLEGYNKQEADE

SEQ ID NO: 2151374 - protein, 11 aa, Cryptosporidium hominis
LRGSNSNNNEE

SEQ ID NO: 2151375 - protein, 16 aa, Cryptosporidium hominis
LRHRKPKNSDNFSHAD

SEQ ID NO: 2151376 - protein, 10 aa, Cryptosporidium hominis
LRKAQENRKW

SEQ ID NO: 2151377 - protein, 9 aa, Cryptosporidium hominis
LRKEEKACQ

SEQ ID NO: 2151378 - protein, 7 aa, Cryptosporidium hominis
LRKGEQY

SEQ ID NO: 2151379 - protein, 7 aa, Cryptosporidium hominis
LRKGTSR

SEQ ID NO: 2151380 - protein, 10 aa, Cryptosporidium hominis
LRKKANDRKR

SEQ ID NO: 2151381 - protein, 19 aa, Cryptosporidium hominis
LRKNTGTRTTSDKSNIDCN

SEQ ID NO: 2151382 - protein, 4 aa, Cryptosporidium hominis
LRKP

SEQ ID NO: 2151383 - protein, 13 aa, Cryptosporidium hominis
LRKQNKAGNISTV

SEQ ID NO: 2151384 - protein, 11 aa, Cryptosporidium hominis
LRKQNSSHRIS

SEQ ID NO: 2151385 - protein, 7 aa, Cryptosporidium hominis
LRKRGKV

SEQ ID NO: 2151386 - protein, 18 aa, Cryptosporidium hominis
LRKSTLGNESTGGQTISP

SEQ ID NO: 2151387 - protein, 8 aa, Cryptosporidium hominis
LRNEPGQL

SEQ ID NO: 2151388 - protein, 6 aa, Cryptosporidium hominis
LRNNED

SEQ ID NO: 2151389 - protein, 7 aa, Cryptosporidium hominis
LRNNTQV

SEQ ID NO: 2151390 - protein, 4 aa, Cryptosporidium hominis
LRNP

SEQ ID NO: 2151391 - protein, 6 aa, Cryptosporidium hominis
LRNPET

SEQ ID NO: 2151392 - protein, 11 aa, Cryptosporidium hominis
LRNYNSNPGSF

SEQ ID NO: 2151393 - protein, 7 aa, Cryptosporidium hominis
LRPETKR

SEQ ID NO: 2151394 - protein, 4 aa, Cryptosporidium hominis
LRPH

SEQ ID NO: 2151395 - protein, 10 aa, Cryptosporidium hominis
LRPKRRSFES

SEQ ID NO: 2151396 - protein, 9 aa, Cryptosporidium hominis
LRPPPIPIS

SEQ ID NO: 2151397 - protein, 8 aa, Cryptosporidium hominis
LRPTSDQL

SEQ ID NO: 2151398 - protein, 22 aa, Cryptosporidium hominis
LRQSNKKVKDQSKVQSEAEEVI

SEQ ID NO: 2151399 - protein, 9 aa, Cryptosporidium hominis
LRRKYDSSI

SEQ ID NO: 2151400 - protein, 8 aa, Cryptosporidium hominis
LRSEGKAT

SEQ ID NO: 2151401 - protein, 7 aa, Cryptosporidium hominis
LRSRGSS

SEQ ID NO: 2151402 - protein, 13 aa, Cryptosporidium hominis
LRSRNNGSNSNSN

SEQ ID NO: 2151403 - protein, 12 aa, Cryptosporidium hominis
LRSSPNKNSVSG

SEQ ID NO: 2151404 - protein, 9 aa, Cryptosporidium hominis
LRSSTQKYK

SEQ ID NO: 2151405 - protein, 11 aa, Cryptosporidium hominis
LRTAKNDSKVE

SEQ ID NO: 2151406 - protein, 18 aa, Cryptosporidium hominis
LRTNDSSIFSSNDDFESR

SEQ ID NO: 2151407 - protein, 8 aa, Cryptosporidium hominis
LRTNNGNF

SEQ ID NO: 2151408 - protein, 5 aa, Cryptosporidium hominis
LSAEE

SEQ ID NO: 2151409 - protein, 9 aa, Cryptosporidium hominis
LSAKKTKSL

SEQ ID NO: 2151410 - protein, 12 aa, Cryptosporidium hominis
LSALQESGGDIN

SEQ ID NO: 2151411 - protein, 10 aa, Cryptosporidium hominis
LSARNEEYNE

SEQ ID NO: 2151412 - protein, 12 aa, Cryptosporidium hominis
LSATQKKNLKRR

SEQ ID NO: 2151413 - protein, 4 aa, Cryptosporidium hominis
LSDD

SEQ ID NO: 2151414 - protein, 10 aa, Cryptosporidium hominis
LSDDEDDQQI

SEQ ID NO: 2151415 - protein, 7 aa, Cryptosporidium hominis
LSDDQEE

SEQ ID NO: 2151416 - protein, 10 aa, Cryptosporidium hominis
LSDDSARGIE

SEQ ID NO: 2151417 - protein, 17 aa, Cryptosporidium hominis
LSDDSYGKKFSNKTNYR

SEQ ID NO: 2151418 - protein, 5 aa, Cryptosporidium hominis
LSDDV

SEQ ID NO: 2151419 - protein, 5 aa, Cryptosporidium hominis
LSDER

SEQ ID NO: 2151420 - protein, 7 aa, Cryptosporidium hominis
LSDKEES

SEQ ID NO: 2151421 - protein, 5 aa, Cryptosporidium hominis
LSDKK

SEQ ID NO: 2151422 - protein, 13 aa, Cryptosporidium hominis
LSDNSDDDLSSAF

SEQ ID NO: 2151423 - protein, 6 aa, Cryptosporidium hominis
LSDPEL

SEQ ID NO: 2151424 - protein, 7 aa, Cryptosporidium hominis
LSDQGQN

SEQ ID NO: 2151425 - protein, 11 aa, Cryptosporidium hominis
LSDRHKELNSA

SEQ ID NO: 2151426 - protein, 13 aa, Cryptosporidium hominis
LSDRQQHITNNQN

SEQ ID NO: 2151427 - protein, 14 aa, Cryptosporidium hominis
LSDSKSDDELTTDQ

SEQ ID NO: 2151428 - protein, 8 aa, Cryptosporidium hominis
LSDSLKEK

SEQ ID NO: 2151429 - protein, 8 aa, Cryptosporidium hominis
LSDSSIHS

SEQ ID NO: 2151430 - protein, 26 aa, Cryptosporidium hominis
LSDSTAKYNLGSNDYDLQRDTQTCRK

SEQ ID NO: 2151431 - protein, 7 aa, Cryptosporidium hominis
LSEAAAN

SEQ ID NO: 2151432 - protein, 6 aa, Cryptosporidium hominis
LSEANT

SEQ ID NO: 2151433 - protein, 47 aa, Cryptosporidium hominis
LSEDSDTNDYKDIGQEYNSDYEYRRGQNASRNNCERQFSDEYSDLSE

SEQ ID NO: 2151434 - protein, 23 aa, Cryptosporidium hominis
LSEDTASMSPNSDVGCDNEEKIE

SEQ ID NO: 2151435 - protein, 7 aa, Cryptosporidium hominis
LSEDYRS

SEQ ID NO: 2151436 - protein, 18 aa, Cryptosporidium hominis
LSEEEAKSKANSKNSRRR

SEQ ID NO: 2151437 - protein, 8 aa, Cryptosporidium hominis
LSEEEDRE

SEQ ID NO: 2151438 - protein, 6 aa, Cryptosporidium hominis
LSEEQA

SEQ ID NO: 2151439 - protein, 9 aa, Cryptosporidium hominis
LSEEQEKYS

SEQ ID NO: 2151440 - protein, 18 aa, Cryptosporidium hominis
LSEESKAKFKDGEARMST

SEQ ID NO: 2151441 - protein, 4 aa, Cryptosporidium hominis
LSEG

SEQ ID NO: 2151442 - protein, 8 aa, Cryptosporidium hominis
LSEHDSDI

SEQ ID NO: 2151443 - protein, 7 aa, Cryptosporidium hominis
LSEIPGT

SEQ ID NO: 2151444 - protein, 6 aa, Cryptosporidium hominis
LSEKEI

SEQ ID NO: 2151445 - protein, 14 aa, Cryptosporidium hominis
LSELTEEKNNLKTQ

SEQ ID NO: 2151446 - protein, 4 aa, Cryptosporidium hominis
LSEN

SEQ ID NO: 2151447 - protein, 8 aa, Cryptosporidium hominis
LSENTTNN

SEQ ID NO: 2151448 - protein, 9 aa, Cryptosporidium hominis
LSEPKDNGR

SEQ ID NO: 2151449 - protein, 11 aa, Cryptosporidium hominis
LSEQDLNSNKI

SEQ ID NO: 2151450 - protein, 10 aa, Cryptosporidium hominis
LSEQGVSEAI

SEQ ID NO: 2151451 - protein, 5 aa, Cryptosporidium hominis
LSEQR

SEQ ID NO: 2151452 - protein, 12 aa, Cryptosporidium hominis
LSERETGKTNDV

SEQ ID NO: 2151453 - protein, 6 aa, Cryptosporidium hominis
LSERTT

SEQ ID NO: 2151454 - protein, 7 aa, Cryptosporidium hominis
LSESDRN

SEQ ID NO: 2151455 - protein, 8 aa, Cryptosporidium hominis
LSESGKRK

SEQ ID NO: 2151456 - protein, 10 aa, Cryptosporidium hominis
LSESLNNSKT

SEQ ID NO: 2151457 - protein, 7 aa, Cryptosporidium hominis
LSESSRK

SEQ ID NO: 2151458 - protein, 8 aa, Cryptosporidium hominis
LSESSVDK

SEQ ID NO: 2151459 - protein, 9 aa, Cryptosporidium hominis
LSESTGQDG

SEQ ID NO: 2151460 - protein, 12 aa, Cryptosporidium hominis
LSETALESSFSE

SEQ ID NO: 2151461 - protein, 13 aa, Cryptosporidium hominis
LSETDDKYIQESS

SEQ ID NO: 2151462 - protein, 10 aa, Cryptosporidium hominis
LSETSRNCKS

SEQ ID NO: 2151463 - protein, 10 aa, Cryptosporidium hominis
LSGEGASREV

SEQ ID NO: 2151464 - protein, 11 aa, Cryptosporidium hominis
LSGEKKDPMLP

SEQ ID NO: 2151465 - protein, 5 aa, Cryptosporidium hominis
LSGGE

SEQ ID NO: 2151466 - protein, 8 aa, Cryptosporidium hominis
LSGGEKTM

SEQ ID NO: 2151467 - protein, 9 aa, Cryptosporidium hominis
LSGGEQSKY

SEQ ID NO: 2151468 - protein, 14 aa, Cryptosporidium hominis
LSGGGQPGAGNMRQ

SEQ ID NO: 2151469 - protein, 7 aa, Cryptosporidium hominis
LSGGQKT

SEQ ID NO: 2151470 - protein, 7 aa, Cryptosporidium hominis
LSGHTSN

SEQ ID NO: 2151471 - protein, 4 aa, Cryptosporidium hominis
LSGI

SEQ ID NO: 2151472 - protein, 5 aa, Cryptosporidium hominis
LSGKG

SEQ ID NO: 2151473 - protein, 15 aa, Cryptosporidium hominis
LSGKNRENQKNQLRK

SEQ ID NO: 2151474 - protein, 5 aa, Cryptosporidium hominis
LSGLD

SEQ ID NO: 2151475 - protein, 6 aa, Cryptosporidium hominis
LSGLSS

SEQ ID NO: 2151476 - protein, 9 aa, Cryptosporidium hominis
LSGPQGSNY

SEQ ID NO: 2151477 - protein, 9 aa, Cryptosporidium hominis
LSGRRNQSV

SEQ ID NO: 2151478 - protein, 9 aa, Cryptosporidium hominis
LSGSERSNL

SEQ ID NO: 2151479 - protein, 21 aa, Cryptosporidium hominis
LSGSGSKGFSGSKNLTKKPPK

SEQ ID NO: 2151480 - protein, 10 aa, Cryptosporidium hominis
LSGSKKEKDQ

SEQ ID NO: 2151481 - protein, 18 aa, Cryptosporidium hominis
LSGSSPSNINNANNMNTN

SEQ ID NO: 2151482 - protein, 15 aa, Cryptosporidium hominis
LSGSTEPKTVKTGTT

SEQ ID NO: 2151483 - protein, 4 aa, Cryptosporidium hominis
LSHG

SEQ ID NO: 2151484 - protein, 11 aa, Cryptosporidium hominis
LSHRSPSNASL

SEQ ID NO: 2151485 - protein, 9 aa, Cryptosporidium hominis
LSHSNDRNG

SEQ ID NO: 2151486 - protein, 55 aa, Cryptosporidium hominis
LSHSTGNKHYHRETGNYGPNNRRDRFQSHGNTQNSQGSKRVNDNANGGAQNSTLD

SEQ ID NO: 2151487 - protein, 6 aa, Cryptosporidium hominis
LSIETK

SEQ ID NO: 2151488 - protein, 17 aa, Cryptosporidium hominis
LSIPPIKKEADTSIQTK

SEQ ID NO: 2151489 - protein, 23 aa, Cryptosporidium hominis
LSIPPIKKEADTSIQTKNNLKAA

SEQ ID NO: 2151490 - protein, 19 aa, Cryptosporidium hominis
LSIPPIKKEADTSIQTKSN

SEQ ID NO: 2151491 - protein, 10 aa, Cryptosporidium hominis
LSITDDQDQK

SEQ ID NO: 2151492 - protein, 4 aa, Cryptosporidium hominis
LSKD

SEQ ID NO: 2151493 - protein, 8 aa, Cryptosporidium hominis
LSKDKSNM

SEQ ID NO: 2151494 - protein, 7 aa, Cryptosporidium hominis
LSKDTDS

SEQ ID NO: 2151495 - protein, 7 aa, Cryptosporidium hominis
LSKECSD

SEQ ID NO: 2151496 - protein, 13 aa, Cryptosporidium hominis
LSKEKTDNEPSKL

SEQ ID NO: 2151497 - protein, 7 aa, Cryptosporidium hominis
LSKEKTY

SEQ ID NO: 2151498 - protein, 6 aa, Cryptosporidium hominis
LSKGDI

SEQ ID NO: 2151499 - protein, 13 aa, Cryptosporidium hominis
LSKGFSEGVPPFT

SEQ ID NO: 2151500 - protein, 4 aa, Cryptosporidium hominis
LSKK

SEQ ID NO: 2151501 - protein, 9 aa, Cryptosporidium hominis
LSKKDDSYI

SEQ ID NO: 2151502 - protein, 10 aa, Cryptosporidium hominis
LSKKQTRRQD

SEQ ID NO: 2151503 - protein, 4 aa, Cryptosporidium hominis
LSKN

SEQ ID NO: 2151504 - protein, 14 aa, Cryptosporidium hominis
LSKNGKKKSYLELI

SEQ ID NO: 2151505 - protein, 10 aa, Cryptosporidium hominis
LSKNKSTDSF

SEQ ID NO: 2151506 - protein, 19 aa, Cryptosporidium hominis
LSKNYNRDENASKYGNNKN

SEQ ID NO: 2151507 - protein, 4 aa, Cryptosporidium hominis
LSKP

SEQ ID NO: 2151508 - protein, 8 aa, Cryptosporidium hominis
LSKPKDGC

SEQ ID NO: 2151509 - protein, 9 aa, Cryptosporidium hominis
LSKQSTKNS

SEQ ID NO: 2151510 - protein, 8 aa, Cryptosporidium hominis
LSKRDDSW

SEQ ID NO: 2151511 - protein, 22 aa, Cryptosporidium hominis
LSKSAPELGSQDKKNKKSRSNL

SEQ ID NO: 2151512 - protein, 9 aa, Cryptosporidium hominis
LSKSPNKHN

SEQ ID NO: 2151513 - protein, 13 aa, Cryptosporidium hominis
LSKTPLPSSTSKI

SEQ ID NO: 2151514 - protein, 12 aa, Cryptosporidium hominis
LSKTTGGTKTSL

SEQ ID NO: 2151515 - protein, 9 aa, Cryptosporidium hominis
LSLNGTQKS

SEQ ID NO: 2151516 - protein, 9 aa, Cryptosporidium hominis
LSLPPGGPI

SEQ ID NO: 2151517 - protein, 26 aa, Cryptosporidium hominis
LSLPSTTTTTTTTTTTTTTTTTAPPK

SEQ ID NO: 2151518 - protein, 9 aa, Cryptosporidium hominis
LSNAPTATQ

SEQ ID NO: 2151519 - protein, 5 aa, Cryptosporidium hominis
LSNDE

SEQ ID NO: 2151520 - protein, 28 aa, Cryptosporidium hominis
LSNDGFKENEDDNTDDENSGEEGDSKDE

SEQ ID NO: 2151521 - protein, 9 aa, Cryptosporidium hominis
LSNDGPSNW

SEQ ID NO: 2151522 - protein, 6 aa, Cryptosporidium hominis
LSNEND

SEQ ID NO: 2151523 - protein, 7 aa, Cryptosporidium hominis
LSNEQSL

SEQ ID NO: 2151524 - protein, 19 aa, Cryptosporidium hominis
LSNESNKSDENKSLLGTTP

SEQ ID NO: 2151525 - protein, 25 aa, Cryptosporidium hominis
LSNESSNNDAVKSNDLQKNSNSLKV

SEQ ID NO: 2151526 - protein, 6 aa, Cryptosporidium hominis
LSNETK

SEQ ID NO: 2151527 - protein, 11 aa, Cryptosporidium hominis
LSNFSQNKYNN

SEQ ID NO: 2151528 - protein, 5 aa, Cryptosporidium hominis
LSNGE

SEQ ID NO: 2151529 - protein, 14 aa, Cryptosporidium hominis
LSNGNKKEHSDSKN

SEQ ID NO: 2151530 - protein, 17 aa, Cryptosporidium hominis
LSNGNQNNDLQNSNEPL

SEQ ID NO: 2151531 - protein, 4 aa, Cryptosporidium hominis
LSNH

SEQ ID NO: 2151532 - protein, 4 aa, Cryptosporidium hominis
LSNI

SEQ ID NO: 2151533 - protein, 5 aa, Cryptosporidium hominis
LSNIQ

SEQ ID NO: 2151534 - protein, 4 aa, Cryptosporidium hominis
LSNK

SEQ ID NO: 2151535 - protein, 9 aa, Cryptosporidium hominis
LSNKIKKNG

SEQ ID NO: 2151536 - protein, 6 aa, Cryptosporidium hominis
LSNKNF

SEQ ID NO: 2151537 - protein, 5 aa, Cryptosporidium hominis
LSNND

SEQ ID NO: 2151538 - protein, 11 aa, Cryptosporidium hominis
LSNNKSSRYQE

SEQ ID NO: 2151539 - protein, 9 aa, Cryptosporidium hominis
LSNNNISDE

SEQ ID NO: 2151540 - protein, 10 aa, Cryptosporidium hominis
LSNNSRLSKD

SEQ ID NO: 2151541 - protein, 9 aa, Cryptosporidium hominis
LSNPPSEPY

SEQ ID NO: 2151542 - protein, 24 aa, Cryptosporidium hominis
LSNQGYSKKTSEDAYYNKNNRKNA

SEQ ID NO: 2151543 - protein, 8 aa, Cryptosporidium hominis
LSNQQDAF

SEQ ID NO: 2151544 - protein, 9 aa, Cryptosporidium hominis
LSNQSTFNK

SEQ ID NO: 2151545 - protein, 12 aa, Cryptosporidium hominis
LSNRESKNLSAT

SEQ ID NO: 2151546 - protein, 12 aa, Cryptosporidium hominis
LSNRIGEELNDS

SEQ ID NO: 2151547 - protein, 14 aa, Cryptosporidium hominis
LSNRPKRKSPKCIK

SEQ ID NO: 2151548 - protein, 4 aa, Cryptosporidium hominis
LSNS

SEQ ID NO: 2151549 - protein, 13 aa, Cryptosporidium hominis
LSNSDKPKSEIET

SEQ ID NO: 2151550 - protein, 11 aa, Cryptosporidium hominis
LSNSDSSLNTI

SEQ ID NO: 2151551 - protein, 10 aa, Cryptosporidium hominis
LSNSEKTTLG

SEQ ID NO: 2151552 - protein, 8 aa, Cryptosporidium hominis
LSNSHSPW

SEQ ID NO: 2151553 - protein, 11 aa, Cryptosporidium hominis
LSNSKHNEKNK

SEQ ID NO: 2151554 - protein, 5 aa, Cryptosporidium hominis
LSNSR

SEQ ID NO: 2151555 - protein, 5 aa, Cryptosporidium hominis
LSNSS

SEQ ID NO: 2151556 - protein, 13 aa, Cryptosporidium hominis
LSNSSNIDNQNSK

SEQ ID NO: 2151557 - protein, 7 aa, Cryptosporidium hominis
LSNTNQN

SEQ ID NO: 2151558 - protein, 12 aa, Cryptosporidium hominis
LSNTQNGTGQPR

SEQ ID NO: 2151559 - protein, 7 aa, Cryptosporidium hominis
LSPDESE

SEQ ID NO: 2151560 - protein, 12 aa, Cryptosporidium hominis
LSPDNKQQTEDY

SEQ ID NO: 2151561 - protein, 4 aa, Cryptosporidium hominis
LSPE

SEQ ID NO: 2151562 - protein, 8 aa, Cryptosporidium hominis
LSPEANKL

SEQ ID NO: 2151563 - protein, 5 aa, Cryptosporidium hominis
LSPER

SEQ ID NO: 2151564 - protein, 5 aa, Cryptosporidium hominis
LSPEY

SEQ ID NO: 2151565 - protein, 6 aa, Cryptosporidium hominis
LSPGDK

SEQ ID NO: 2151566 - protein, 6 aa, Cryptosporidium hominis
LSPGLE

SEQ ID NO: 2151567 - protein, 4 aa, Cryptosporidium hominis
LSPK

SEQ ID NO: 2151568 - protein, 6 aa, Cryptosporidium hominis
LSPKGL

SEQ ID NO: 2151569 - protein, 9 aa, Cryptosporidium hominis
LSPKQVESD

SEQ ID NO: 2151570 - protein, 6 aa, Cryptosporidium hominis
LSPKRS

SEQ ID NO: 2151571 - protein, 5 aa, Cryptosporidium hominis
LSPKT

SEQ ID NO: 2151572 - protein, 5 aa, Cryptosporidium hominis
LSPLD

SEQ ID NO: 2151573 - protein, 9 aa, Cryptosporidium hominis
LSPMESSKL

SEQ ID NO: 2151574 - protein, 6 aa, Cryptosporidium hominis
LSPNLS

SEQ ID NO: 2151575 - protein, 22 aa, Cryptosporidium hominis
LSPNPTLTRGKSKAKNKDIHEY

SEQ ID NO: 2151576 - protein, 126 aa, Cryptosporidium hominis
LSPPGGKKPPPPAKPLGGKPATKIPPPSKLSSTPSPNPSESPLPKPSSPPPPKPSSLPPPNSASPSPSPPASPPGPKVSKGPPTALKPPSKALIPKKSSEPLNDTPISNGHAPPASVPSKPASAKT

SEQ ID NO: 2151577 - protein, 7 aa, Cryptosporidium hominis
LSPPNIT

SEQ ID NO: 2151578 - protein, 30 aa, Cryptosporidium hominis
LSPPSTTDLAPNSGNFTKVGESKDDDHNSV

SEQ ID NO: 2151579 - protein, 8 aa, Cryptosporidium hominis
LSPQNRNR

SEQ ID NO: 2151580 - protein, 6 aa, Cryptosporidium hominis
LSPRTR

SEQ ID NO: 2151581 - protein, 6 aa, Cryptosporidium hominis
LSPSCE

SEQ ID NO: 2151582 - protein, 6 aa, Cryptosporidium hominis
LSPSET

SEQ ID NO: 2151583 - protein, 8 aa, Cryptosporidium hominis
LSPSKNDN

SEQ ID NO: 2151584 - protein, 16 aa, Cryptosporidium hominis
LSPSNVNAAKQRVSSN

SEQ ID NO: 2151585 - protein, 6 aa, Cryptosporidium hominis
LSPSQG

SEQ ID NO: 2151586 - protein, 7 aa, Cryptosporidium hominis
LSPSRIT

SEQ ID NO: 2151587 - protein, 36 aa, Cryptosporidium hominis
LSPSVRSASPQLPSSPTDSSSSKFPDNSEANKASAR

SEQ ID NO: 2151588 - protein, 6 aa, Cryptosporidium hominis
LSPTTF

SEQ ID NO: 2151589 - protein, 10 aa, Cryptosporidium hominis
LSPVNKSKGL

SEQ ID NO: 2151590 - protein, 7 aa, Cryptosporidium hominis
LSQDERS

SEQ ID NO: 2151591 - protein, 5 aa, Cryptosporidium hominis
LSQDR

SEQ ID NO: 2151592 - protein, 12 aa, Cryptosporidium hominis
LSQGPSTQQSLE

SEQ ID NO: 2151593 - protein, 5 aa, Cryptosporidium hominis
LSQKE

SEQ ID NO: 2151594 - protein, 6 aa, Cryptosporidium hominis
LSQKQR

SEQ ID NO: 2151595 - protein, 9 aa, Cryptosporidium hominis
LSQKTPLNA

SEQ ID NO: 2151596 - protein, 4 aa, Cryptosporidium hominis
LSQN

SEQ ID NO: 2151597 - protein, 13 aa, Cryptosporidium hominis
LSQPGREVSEEVE

SEQ ID NO: 2151598 - protein, 20 aa, Cryptosporidium hominis
LSQQEGGDSFSLSPNSKINK

SEQ ID NO: 2151599 - protein, 6 aa, Cryptosporidium hominis
LSQQRR

SEQ ID NO: 2151600 - protein, 12 aa, Cryptosporidium hominis
LSQRSAASNGVS

SEQ ID NO: 2151601 - protein, 9 aa, Cryptosporidium hominis
LSQSNDKSL

SEQ ID NO: 2151602 - protein, 9 aa, Cryptosporidium hominis
LSQSPVKNE

SEQ ID NO: 2151603 - protein, 5 aa, Cryptosporidium hominis
LSQTH

SEQ ID NO: 2151604 - protein, 7 aa, Cryptosporidium hominis
LSRDKSK

SEQ ID NO: 2151605 - protein, 8 aa, Cryptosporidium hominis
LSRESSEQ

SEQ ID NO: 2151606 - protein, 4 aa, Cryptosporidium hominis
LSRG

SEQ ID NO: 2151607 - protein, 35 aa, Cryptosporidium hominis
LSRNNNHHENNDEEDDLTKNNASPNLSSSFHSPPP

SEQ ID NO: 2151608 - protein, 5 aa, Cryptosporidium hominis
LSRNR

SEQ ID NO: 2151609 - protein, 8 aa, Cryptosporidium hominis
LSRNSSGI

SEQ ID NO: 2151610 - protein, 14 aa, Cryptosporidium hominis
LSRNSSNEAIENNS

SEQ ID NO: 2151611 - protein, 13 aa, Cryptosporidium hominis
LSRNTEKSNALRE

SEQ ID NO: 2151612 - protein, 11 aa, Cryptosporidium hominis
LSRQEPPLNEY

SEQ ID NO: 2151613 - protein, 7 aa, Cryptosporidium hominis
LSRSGQA

SEQ ID NO: 2151614 - protein, 18 aa, Cryptosporidium hominis
LSRSGTNMGASKAPEFAT

SEQ ID NO: 2151615 - protein, 5 aa, Cryptosporidium hominis
LSRSK

SEQ ID NO: 2151616 - protein, 7 aa, Cryptosporidium hominis
LSRSKNY

SEQ ID NO: 2151617 - protein, 11 aa, Cryptosporidium hominis
LSRSTDDFNGA

SEQ ID NO: 2151618 - protein, 8 aa, Cryptosporidium hominis
LSRTGAPI

SEQ ID NO: 2151619 - protein, 9 aa, Cryptosporidium hominis
LSRTPRPFP

SEQ ID NO: 2151620 - protein, 7 aa, Cryptosporidium hominis
LSSANQE

SEQ ID NO: 2151621 - protein, 4 aa, Cryptosporidium hominis
LSSD

SEQ ID NO: 2151622 - protein, 12 aa, Cryptosporidium hominis
LSSDSKSSSELS

SEQ ID NO: 2151623 - protein, 10 aa, Cryptosporidium hominis
LSSESSDDEI

SEQ ID NO: 2151624 - protein, 15 aa, Cryptosporidium hominis
LSSEVSEIEGELNNS

SEQ ID NO: 2151625 - protein, 18 aa, Cryptosporidium hominis
LSSGADLGCGTTKNVNTR

SEQ ID NO: 2151626 - protein, 7 aa, Cryptosporidium hominis
LSSGATF

SEQ ID NO: 2151627 - protein, 7 aa, Cryptosporidium hominis
LSSGSQS

SEQ ID NO: 2151628 - protein, 9 aa, Cryptosporidium hominis
LSSKEIEDA

SEQ ID NO: 2151629 - protein, 12 aa, Cryptosporidium hominis
LSSKKKRREKYS

SEQ ID NO: 2151630 - protein, 15 aa, Cryptosporidium hominis
LSSKNNSNLSTIQIP

SEQ ID NO: 2151631 - protein, 9 aa, Cryptosporidium hominis
LSSKTESKL

SEQ ID NO: 2151632 - protein, 16 aa, Cryptosporidium hominis
LSSMNSNSITSSSKSL

SEQ ID NO: 2151633 - protein, 9 aa, Cryptosporidium hominis
LSSNDRERE

SEQ ID NO: 2151634 - protein, 5 aa, Cryptosporidium hominis
LSSNR

SEQ ID NO: 2151635 - protein, 11 aa, Cryptosporidium hominis
LSSNRSLQSYK

SEQ ID NO: 2151636 - protein, 6 aa, Cryptosporidium hominis
LSSNSS

SEQ ID NO: 2151637 - protein, 8 aa, Cryptosporidium hominis
LSSNTHNN

SEQ ID NO: 2151638 - protein, 8 aa, Cryptosporidium hominis
LSSNTSQP

SEQ ID NO: 2151639 - protein, 18 aa, Cryptosporidium hominis
LSSPTKLNTWKSSETPIR

SEQ ID NO: 2151640 - protein, 6 aa, Cryptosporidium hominis
LSSQGF

SEQ ID NO: 2151641 - protein, 5 aa, Cryptosporidium hominis
LSSSE

SEQ ID NO: 2151642 - protein, 8 aa, Cryptosporidium hominis
LSSSENPW

SEQ ID NO: 2151643 - protein, 7 aa, Cryptosporidium hominis
LSSSNRD

SEQ ID NO: 2151644 - protein, 21 aa, Cryptosporidium hominis
LSSSNSQSSSSSSSNSSPVSM

SEQ ID NO: 2151645 - protein, 7 aa, Cryptosporidium hominis
LSSSNYG

SEQ ID NO: 2151646 - protein, 7 aa, Cryptosporidium hominis
LSSSPRN

SEQ ID NO: 2151647 - protein, 6 aa, Cryptosporidium hominis
LSSSQV

SEQ ID NO: 2151648 - protein, 8 aa, Cryptosporidium hominis
LSSSSHET

SEQ ID NO: 2151649 - protein, 9 aa, Cryptosporidium hominis
LSSSSPTSH

SEQ ID NO: 2151650 - protein, 13 aa, Cryptosporidium hominis
LSSSTASTHNPIP

SEQ ID NO: 2151651 - protein, 11 aa, Cryptosporidium hominis
LSSSTDASRNI

SEQ ID NO: 2151652 - protein, 21 aa, Cryptosporidium hominis
LSSSTSNSIQPIGNTSPHKCE

SEQ ID NO: 2151653 - protein, 5 aa, Cryptosporidium hominis
LSSTE

SEQ ID NO: 2151654 - protein, 24 aa, Cryptosporidium hominis
LSSTNDNTAKTANSSTKNSKYITT

SEQ ID NO: 2151655 - protein, 11 aa, Cryptosporidium hominis
LSSTPTKGNKK

SEQ ID NO: 2151656 - protein, 13 aa, Cryptosporidium hominis
LSSTSDSNSKENV

SEQ ID NO: 2151657 - protein, 7 aa, Cryptosporidium hominis
LSSTTKE

SEQ ID NO: 2151658 - protein, 10 aa, Cryptosporidium hominis
LSSYQKEDTF

SEQ ID NO: 2151659 - protein, 4 aa, Cryptosporidium hominis
LSTD

SEQ ID NO: 2151660 - protein, 9 aa, Cryptosporidium hominis
LSTDGNIKK

SEQ ID NO: 2151661 - protein, 4 aa, Cryptosporidium hominis
LSTE

SEQ ID NO: 2151662 - protein, 14 aa, Cryptosporidium hominis
LSTEEQTILRLAGQ

SEQ ID NO: 2151663 - protein, 12 aa, Cryptosporidium hominis
LSTENSNNQNTD

SEQ ID NO: 2151664 - protein, 14 aa, Cryptosporidium hominis
LSTERSLEELSKQT

SEQ ID NO: 2151665 - protein, 16 aa, Cryptosporidium hominis
LSTESKCQQSNTHDKC

SEQ ID NO: 2151666 - protein, 12 aa, Cryptosporidium hominis
LSTKGKDSKSQS

SEQ ID NO: 2151667 - protein, 12 aa, Cryptosporidium hominis
LSTKKKKNRPAF

SEQ ID NO: 2151668 - protein, 8 aa, Cryptosporidium hominis
LSTLNTPH

SEQ ID NO: 2151669 - protein, 27 aa, Cryptosporidium hominis
LSTNINDSRYEDLNSDDLSTDSEDESQ

SEQ ID NO: 2151670 - protein, 16 aa, Cryptosporidium hominis
LSTNKEFTDEYETTDI

SEQ ID NO: 2151671 - protein, 10 aa, Cryptosporidium hominis
LSTNNKEKCH

SEQ ID NO: 2151672 - protein, 14 aa, Cryptosporidium hominis
LSTRKKKQNSDSGI

SEQ ID NO: 2151673 - protein, 6 aa, Cryptosporidium hominis
LSTSNG

SEQ ID NO: 2151674 - protein, 9 aa, Cryptosporidium hominis
LSTSSPATL

SEQ ID NO: 2151675 - protein, 11 aa, Cryptosporidium hominis
LSTTATANFTR

SEQ ID NO: 2151676 - protein, 21 aa, Cryptosporidium hominis
LSTTTTNTGQMQSNSINNTSV

SEQ ID NO: 2151677 - protein, 7 aa, Cryptosporidium hominis
LSTVSNK

SEQ ID NO: 2151678 - protein, 6 aa, Cryptosporidium hominis
LSTYSN

SEQ ID NO: 2151679 - protein, 10 aa, Cryptosporidium hominis
LSVKSSNNSF

SEQ ID NO: 2151680 - protein, 12 aa, Cryptosporidium hominis
LSVTSNTHIGKD

SEQ ID NO: 2151681 - protein, 6 aa, Cryptosporidium hominis
LSYDSN

SEQ ID NO: 2151682 - protein, 28 aa, Cryptosporidium hominis
LSYSGEESSYSQSRRRTHDYSKTCPSFQ

SEQ ID NO: 2151683 - protein, 10 aa, Cryptosporidium hominis
LSYSNSFDGD

SEQ ID NO: 2151684 - protein, 5 aa, Cryptosporidium hominis
LSYTS

SEQ ID NO: 2151685 - protein, 5 aa, Cryptosporidium hominis
LTAQD

SEQ ID NO: 2151686 - protein, 14 aa, Cryptosporidium hominis
LTDGETSTTGLDGL

SEQ ID NO: 2151687 - protein, 6 aa, Cryptosporidium hominis
LTDGGL

SEQ ID NO: 2151688 - protein, 14 aa, Cryptosporidium hominis
LTDNSQDSDKENDF

SEQ ID NO: 2151689 - protein, 11 aa, Cryptosporidium hominis
LTDPEQLKSNE

SEQ ID NO: 2151690 - protein, 6 aa, Cryptosporidium hominis
LTDQDA

SEQ ID NO: 2151691 - protein, 5 aa, Cryptosporidium hominis
LTDQE

SEQ ID NO: 2151692 - protein, 10 aa, Cryptosporidium hominis
LTDRGRAQAR

SEQ ID NO: 2151693 - protein, 4 aa, Cryptosporidium hominis
LTDS

SEQ ID NO: 2151694 - protein, 13 aa, Cryptosporidium hominis
LTDSPGSMNISDF

SEQ ID NO: 2151695 - protein, 6 aa, Cryptosporidium hominis
LTEAAE

SEQ ID NO: 2151696 - protein, 4 aa, Cryptosporidium hominis
LTED

SEQ ID NO: 2151697 - protein, 17 aa, Cryptosporidium hominis
LTEDEDDDGTSDSEVDM

SEQ ID NO: 2151698 - protein, 9 aa, Cryptosporidium hominis
LTEEEKQYI

SEQ ID NO: 2151699 - protein, 18 aa, Cryptosporidium hominis
LTEGDSISNESLETQKTD

SEQ ID NO: 2151700 - protein, 15 aa, Cryptosporidium hominis
LTEGQKNSSKSLRQI

SEQ ID NO: 2151701 - protein, 21 aa, Cryptosporidium hominis
LTEGSSPDSYSKDENDDEDDE

SEQ ID NO: 2151702 - protein, 27 aa, Cryptosporidium hominis
LTEKVNSDKFKSINKENNMARRRRDDP

SEQ ID NO: 2151703 - protein, 9 aa, Cryptosporidium hominis
LTENNDNLS

SEQ ID NO: 2151704 - protein, 10 aa, Cryptosporidium hominis
LTENPNKNLN

SEQ ID NO: 2151705 - protein, 10 aa, Cryptosporidium hominis
LTEQEKELNR

SEQ ID NO: 2151706 - protein, 13 aa, Cryptosporidium hominis
LTEQGKGSARTSL

SEQ ID NO: 2151707 - protein, 7 aa, Cryptosporidium hominis
LTESREL

SEQ ID NO: 2151708 - protein, 6 aa, Cryptosporidium hominis
LTETHV

SEQ ID NO: 2151709 - protein, 6 aa, Cryptosporidium hominis
LTETQA

SEQ ID NO: 2151710 - protein, 4 aa, Cryptosporidium hominis
LTEY

SEQ ID NO: 2151711 - protein, 12 aa, Cryptosporidium hominis
LTGANDNVEIDN

SEQ ID NO: 2151712 - protein, 4 aa, Cryptosporidium hominis
LTGE

SEQ ID NO: 2151713 - protein, 18 aa, Cryptosporidium hominis
LTGHSGDNKISQGLGNGD

SEQ ID NO: 2151714 - protein, 8 aa, Cryptosporidium hominis
LTGKRASI

SEQ ID NO: 2151715 - protein, 11 aa, Cryptosporidium hominis
LTGKSGNASGR

SEQ ID NO: 2151716 - protein, 13 aa, Cryptosporidium hominis
LTGNPEKNVQNTT

SEQ ID NO: 2151717 - protein, 11 aa, Cryptosporidium hominis
LTGNSSGVNNR

SEQ ID NO: 2151718 - protein, 12 aa, Cryptosporidium hominis
LTGSTLNNSNHL

SEQ ID NO: 2151719 - protein, 8 aa, Cryptosporidium hominis
LTKADQEN

SEQ ID NO: 2151720 - protein, 6 aa, Cryptosporidium hominis
LTKGSP

SEQ ID NO: 2151721 - protein, 9 aa, Cryptosporidium hominis
LTKKDNYAT

SEQ ID NO: 2151722 - protein, 10 aa, Cryptosporidium hominis
LTKNKTGNRE

SEQ ID NO: 2151723 - protein, 8 aa, Cryptosporidium hominis
LTKSGEKT

SEQ ID NO: 2151724 - protein, 7 aa, Cryptosporidium hominis
LTKTSTN

SEQ ID NO: 2151725 - protein, 12 aa, Cryptosporidium hominis
LTNAQRSGLNQI

SEQ ID NO: 2151726 - protein, 9 aa, Cryptosporidium hominis
LTNDDGLTP

SEQ ID NO: 2151727 - protein, 8 aa, Cryptosporidium hominis
LTNNSSLG

SEQ ID NO: 2151728 - protein, 16 aa, Cryptosporidium hominis
LTNQGATSKRRNKKTV

SEQ ID NO: 2151729 - protein, 18 aa, Cryptosporidium hominis
LTNQSKSVLGNNAAITKS

SEQ ID NO: 2151730 - protein, 22 aa, Cryptosporidium hominis
LTNRSNNTKKQEKNKNGTDSSY

SEQ ID NO: 2151731 - protein, 13 aa, Cryptosporidium hominis
LTNSSNNDNNKGL

SEQ ID NO: 2151732 - protein, 7 aa, Cryptosporidium hominis
LTPDAPP

SEQ ID NO: 2151733 - protein, 9 aa, Cryptosporidium hominis
LTPEDNPHG

SEQ ID NO: 2151734 - protein, 13 aa, Cryptosporidium hominis
LTPEQKKLIKEAL

SEQ ID NO: 2151735 - protein, 7 aa, Cryptosporidium hominis
LTPERKR

SEQ ID NO: 2151736 - protein, 5 aa, Cryptosporidium hominis
LTPFG

SEQ ID NO: 2151737 - protein, 5 aa, Cryptosporidium hominis
LTPFS

SEQ ID NO: 2151738 - protein, 4 aa, Cryptosporidium hominis
LTPI

SEQ ID NO: 2151739 - protein, 12 aa, Cryptosporidium hominis
LTPPSAKTAVHD

SEQ ID NO: 2151740 - protein, 94 aa, Cryptosporidium hominis
LTPSEDEEDSEEEEYQSKDSDENDNTDNEDDDGDYYGEYDSRHQKTDKISKSKRKLRHSESDSEEYDDDNNNYERLKSKGQKRSRRSSSNIQKS

SEQ ID NO: 2151741 - protein, 6 aa, Cryptosporidium hominis
LTPSQE

SEQ ID NO: 2151742 - protein, 6 aa, Cryptosporidium hominis
LTPSSE

SEQ ID NO: 2151743 - protein, 4 aa, Cryptosporidium hominis
LTPT

SEQ ID NO: 2151744 - protein, 30 aa, Cryptosporidium hominis
LTPVNNKELSSSGMANNKVSKRKELAKKGL

SEQ ID NO: 2151745 - protein, 11 aa, Cryptosporidium hominis
LTQEEKEKAAK

SEQ ID NO: 2151746 - protein, 7 aa, Cryptosporidium hominis
LTQERDS

SEQ ID NO: 2151747 - protein, 5 aa, Cryptosporidium hominis
LTQPK

SEQ ID NO: 2151748 - protein, 55 aa, Cryptosporidium hominis
LTQPSQLTQPSQITQPSQLTQPSQLAQASQLSQSSQLAQASQSSQQSYLAPSNPL

SEQ ID NO: 2151749 - protein, 31 aa, Cryptosporidium hominis
LTQQPKSNGGYGRRANNSERGRIRPRKSEAV

SEQ ID NO: 2151750 - protein, 6 aa, Cryptosporidium hominis
LTQQSQ

SEQ ID NO: 2151751 - protein, 23 aa, Cryptosporidium hominis
LTQRENAPKKSKREREAEQADAE

SEQ ID NO: 2151752 - protein, 10 aa, Cryptosporidium hominis
LTQSEHDLKE

SEQ ID NO: 2151753 - protein, 20 aa, Cryptosporidium hominis
LTQSSTKYTFEDENRKSSSH

SEQ ID NO: 2151754 - protein, 6 aa, Cryptosporidium hominis
LTQTNK

SEQ ID NO: 2151755 - protein, 6 aa, Cryptosporidium hominis
LTRAKR

SEQ ID NO: 2151756 - protein, 9 aa, Cryptosporidium hominis
LTREGETAL

SEQ ID NO: 2151757 - protein, 10 aa, Cryptosporidium hominis
LTSDKDKKAT

SEQ ID NO: 2151758 - protein, 11 aa, Cryptosporidium hominis
LTSEDDIPEEV

SEQ ID NO: 2151759 - protein, 6 aa, Cryptosporidium hominis
LTSEGS

SEQ ID NO: 2151760 - protein, 7 aa, Cryptosporidium hominis
LTSERDE

SEQ ID NO: 2151761 - protein, 5 aa, Cryptosporidium hominis
LTSET

SEQ ID NO: 2151762 - protein, 9 aa, Cryptosporidium hominis
LTSGGSLEG

SEQ ID NO: 2151763 - protein, 5 aa, Cryptosporidium hominis
LTSKG

SEQ ID NO: 2151764 - protein, 22 aa, Cryptosporidium hominis
LTSKGENNISSLGGKEDGIPKN

SEQ ID NO: 2151765 - protein, 25 aa, Cryptosporidium hominis
LTSKQTTDSSNDSLNTEKRVEASIR

SEQ ID NO: 2151766 - protein, 15 aa, Cryptosporidium hominis
LTSNSSTFSSSDSSF

SEQ ID NO: 2151767 - protein, 17 aa, Cryptosporidium hominis
LTSNTSLPEPLNTKSYN

SEQ ID NO: 2151768 - protein, 5 aa, Cryptosporidium hominis
LTSPD

SEQ ID NO: 2151769 - protein, 10 aa, Cryptosporidium hominis
LTSRGSQQYR

SEQ ID NO: 2151770 - protein, 29 aa, Cryptosporidium hominis
LTSSDSSSSSSSSSSNTSKTNNSASHQDL

SEQ ID NO: 2151771 - protein, 26 aa, Cryptosporidium hominis
LTSSRGSRRGGNGAYSSGNNAGTGGM

SEQ ID NO: 2151772 - protein, 7 aa, Cryptosporidium hominis
LTSSVEE

SEQ ID NO: 2151773 - protein, 13 aa, Cryptosporidium hominis
LTSTPVTSSKREI

SEQ ID NO: 2151774 - protein, 29 aa, Cryptosporidium hominis
LTTASTAPTAPSTPTATPTSNKTHMETTN

SEQ ID NO: 2151775 - protein, 28 aa, Cryptosporidium hominis
LTTGINSENSVNHSKNNITSRNESEEEI

SEQ ID NO: 2151776 - protein, 33 aa, Cryptosporidium hominis
LTTNSQDISSDQEDQTEKDTTSEVNNAENQNIQ

SEQ ID NO: 2151777 - protein, 11 aa, Cryptosporidium hominis
LTTPKQKNSEV

SEQ ID NO: 2151778 - protein, 10 aa, Cryptosporidium hominis
LTTPKSNFEE

SEQ ID NO: 2151779 - protein, 15 aa, Cryptosporidium hominis
LTTQSTTDTSIETPG

SEQ ID NO: 2151780 - protein, 10 aa, Cryptosporidium hominis
LTTSESSHLS

SEQ ID NO: 2151781 - protein, 27 aa, Cryptosporidium hominis
LTTSNNNNNNSKGSYSYTSSYEEETDL

SEQ ID NO: 2151782 - protein, 14 aa, Cryptosporidium hominis
LTTTASSSARTSHG

SEQ ID NO: 2151783 - protein, 7 aa, Cryptosporidium hominis
LTTTTKE

SEQ ID NO: 2151784 - protein, 10 aa, Cryptosporidium hominis
LTYRGKMDEA

SEQ ID NO: 2151785 - protein, 14 aa, Cryptosporidium hominis
LVDPSNKKPIPGSH

SEQ ID NO: 2151786 - protein, 5 aa, Cryptosporidium hominis
LVEKE

SEQ ID NO: 2151787 - protein, 23 aa, Cryptosporidium hominis
LVESNGLTNISGVSNSTIQSNQI

SEQ ID NO: 2151788 - protein, 15 aa, Cryptosporidium hominis
LVGGTSGSVASYNSG

SEQ ID NO: 2151789 - protein, 15 aa, Cryptosporidium hominis
LVGNKSKVISVEYLI

SEQ ID NO: 2151790 - protein, 16 aa, Cryptosporidium hominis
LVNPTNQDKSSNSTSE

SEQ ID NO: 2151791 - protein, 4 aa, Cryptosporidium hominis
LVNS

SEQ ID NO: 2151792 - protein, 5 aa, Cryptosporidium hominis
LYGES

SEQ ID NO: 2151793 - protein, 6 aa, Cryptosporidium hominis
LYGRDS

SEQ ID NO: 2151794 - protein, 14 aa, Cryptosporidium hominis
LYKPNSVPMTGGGS

SEQ ID NO: 2151795 - protein, 4 aa, Cryptosporidium hominis
LYNE

SEQ ID NO: 2151796 - protein, 10 aa, Cryptosporidium hominis
LYNRDKSASL

SEQ ID NO: 2151797 - protein, 7 aa, Cryptosporidium hominis
LYNSSSN

SEQ ID NO: 2151798 - protein, 12 aa, Cryptosporidium hominis
LYPDGPNSNINH

SEQ ID NO: 2151799 - protein, 18 aa, Cryptosporidium hominis
LYPNGKKPGSGGASFSRD

SEQ ID NO: 2151800 - protein, 7 aa, Cryptosporidium hominis
LYPSSST

SEQ ID NO: 2151801 - protein, 5 aa, Cryptosporidium hominis
LYQDK

SEQ ID NO: 2151802 - protein, 5 aa, Cryptosporidium hominis
LYSDT

SEQ ID NO: 2151803 - protein, 10 aa, Cryptosporidium hominis
LYSGNNNNFE

SEQ ID NO: 2151804 - protein, 4 aa, Cryptosporidium hominis
LYSP

SEQ ID NO: 2151805 - protein, 5 aa, Cryptosporidium hominis
LYSPT

SEQ ID NO: 2151806 - protein, 10 aa, Cryptosporidium hominis
MAASASNSVP

SEQ ID NO: 2151807 - protein, 8 aa, Cryptosporidium hominis
MAASSSIS

SEQ ID NO: 2151808 - protein, 8 aa, Cryptosporidium hominis
MAETNSKE

SEQ ID NO: 2151809 - protein, 5 aa, Cryptosporidium hominis
MAGAD

SEQ ID NO: 2151810 - protein, 15 aa, Cryptosporidium hominis
MAGSNSNSEEEYLPT

SEQ ID NO: 2151811 - protein, 6 aa, Cryptosporidium hominis
MAKEET

SEQ ID NO: 2151812 - protein, 8 aa, Cryptosporidium hominis
MAKESDST

SEQ ID NO: 2151813 - protein, 8 aa, Cryptosporidium hominis
MAKGKSNS

SEQ ID NO: 2151814 - protein, 5 aa, Cryptosporidium hominis
MANNP

SEQ ID NO: 2151815 - protein, 9 aa, Cryptosporidium hominis
MANTSTDVP

SEQ ID NO: 2151816 - protein, 7 aa, Cryptosporidium hominis
MAPSKST

SEQ ID NO: 2151817 - protein, 9 aa, Cryptosporidium hominis
MAQSISSSK

SEQ ID NO: 2151818 - protein, 9 aa, Cryptosporidium hominis
MASSGVAGM

SEQ ID NO: 2151819 - protein, 12 aa, Cryptosporidium hominis
MDDPKKRQPDIS

SEQ ID NO: 2151820 - protein, 7 aa, Cryptosporidium hominis
MDDSSRS

SEQ ID NO: 2151821 - protein, 12 aa, Cryptosporidium hominis
MDEDDKKRSLQE

SEQ ID NO: 2151822 - protein, 5 aa, Cryptosporidium hominis
MDEDP

SEQ ID NO: 2151823 - protein, 22 aa, Cryptosporidium hominis
MDEKGKKDVKSSAGGRRDKNKE

SEQ ID NO: 2151824 - protein, 23 aa, Cryptosporidium hominis
MDEKNEEKNEESQELKGIREERK

SEQ ID NO: 2151825 - protein, 8 aa, Cryptosporidium hominis
MDESDRTA

SEQ ID NO: 2151826 - protein, 14 aa, Cryptosporidium hominis
MDESHSDLTIPGTP

SEQ ID NO: 2151827 - protein, 10 aa, Cryptosporidium hominis
MDESKMDGRQ

SEQ ID NO: 2151828 - protein, 7 aa, Cryptosporidium hominis
MDGEINE

SEQ ID NO: 2151829 - protein, 49 aa, Cryptosporidium hominis
MDGNDENYDDEDSEIEAEIDTDNENESIVGTGGKRGGSKHSSSLENDEV

SEQ ID NO: 2151830 - protein, 6 aa, Cryptosporidium hominis
MDGQNN

SEQ ID NO: 2151831 - protein, 5 aa, Cryptosporidium hominis
MDHSD

SEQ ID NO: 2151832 - protein, 6 aa, Cryptosporidium hominis
MDHSSS

SEQ ID NO: 2151833 - protein, 25 aa, Cryptosporidium hominis
MDHTGRLSSGPDELRSEEQARAEVE

SEQ ID NO: 2151834 - protein, 13 aa, Cryptosporidium hominis
MDKRSGKVLEENP

SEQ ID NO: 2151835 - protein, 11 aa, Cryptosporidium hominis
MDNASNNERAS

SEQ ID NO: 2151836 - protein, 6 aa, Cryptosporidium hominis
MDNNAK

SEQ ID NO: 2151837 - protein, 8 aa, Cryptosporidium hominis
MDPSNSLE

SEQ ID NO: 2151838 - protein, 4 aa, Cryptosporidium hominis
MDQP

SEQ ID NO: 2151839 - protein, 21 aa, Cryptosporidium hominis
MDRNDDLADQNFSQKRGVGGK

SEQ ID NO: 2151840 - protein, 9 aa, Cryptosporidium hominis
MDSEEGKNK

SEQ ID NO: 2151841 - protein, 18 aa, Cryptosporidium hominis
MDSSEGNAAGLTSPITSA

SEQ ID NO: 2151842 - protein, 8 aa, Cryptosporidium hominis
MDVPERDD

SEQ ID NO: 2151843 - protein, 22 aa, Cryptosporidium hominis
MEADEEKKNREEGLNSSGSGAY

SEQ ID NO: 2151844 - protein, 30 aa, Cryptosporidium hominis
MEAPIPPKKTTVAPKSTEVEKEEREQSHEK

SEQ ID NO: 2151845 - protein, 20 aa, Cryptosporidium hominis
MEARERNALSEGDTNSSKMT

SEQ ID NO: 2151846 - protein, 8 aa, Cryptosporidium hominis
MEDENNST

SEQ ID NO: 2151847 - protein, 7 aa, Cryptosporidium hominis
MEDSQGN

SEQ ID NO: 2151848 - protein, 9 aa, Cryptosporidium hominis
MEDSSNSLV

SEQ ID NO: 2151849 - protein, 4 aa, Cryptosporidium hominis
MEEE

SEQ ID NO: 2151850 - protein, 5 aa, Cryptosporidium hominis
MEEEG

SEQ ID NO: 2151851 - protein, 12 aa, Cryptosporidium hominis
MEEGEFSEARED

SEQ ID NO: 2151852 - protein, 5 aa, Cryptosporidium hominis
MEENT

SEQ ID NO: 2151853 - protein, 5 aa, Cryptosporidium hominis
MEEPS

SEQ ID NO: 2151854 - protein, 4 aa, Cryptosporidium hominis
MEES

SEQ ID NO: 2151855 - protein, 11 aa, Cryptosporidium hominis
MEGTQNQEEQI

SEQ ID NO: 2151856 - protein, 11 aa, Cryptosporidium hominis
MEGTTKTDKDD

SEQ ID NO: 2151857 - protein, 10 aa, Cryptosporidium hominis
MEKNRSSLGM

SEQ ID NO: 2151858 - protein, 4 aa, Cryptosporidium hominis
MEKY

SEQ ID NO: 2151859 - protein, 10 aa, Cryptosporidium hominis
MELNSTSTQE

SEQ ID NO: 2151860 - protein, 12 aa, Cryptosporidium hominis
MELTGSKTGTVR

SEQ ID NO: 2151861 - protein, 5 aa, Cryptosporidium hominis
MENAR

SEQ ID NO: 2151862 - protein, 4 aa, Cryptosporidium hominis
MENG

SEQ ID NO: 2151863 - protein, 22 aa, Cryptosporidium hominis
MENRDKVKSNHLNEREEEQEKG

SEQ ID NO: 2151864 - protein, 7 aa, Cryptosporidium hominis
MENSKRE

SEQ ID NO: 2151865 - protein, 6 aa, Cryptosporidium hominis
MENSKT

SEQ ID NO: 2151866 - protein, 6 aa, Cryptosporidium hominis
MENTQK

SEQ ID NO: 2151867 - protein, 4 aa, Cryptosporidium hominis
MEPD

SEQ ID NO: 2151868 - protein, 5 aa, Cryptosporidium hominis
MEPEM

SEQ ID NO: 2151869 - protein, 12 aa, Cryptosporidium hominis
MEPGSSGSPMMN

SEQ ID NO: 2151870 - protein, 12 aa, Cryptosporidium hominis
MEPPKRPTDKPL

SEQ ID NO: 2151871 - protein, 13 aa, Cryptosporidium hominis
MEQSTSSSAVEQP

SEQ ID NO: 2151872 - protein, 13 aa, Cryptosporidium hominis
MEREASGAATAGG

SEQ ID NO: 2151873 - protein, 7 aa, Cryptosporidium hominis
MERNYGK

SEQ ID NO: 2151874 - protein, 5 aa, Cryptosporidium hominis
MERSD

SEQ ID NO: 2151875 - protein, 9 aa, Cryptosporidium hominis
MESGGEDEE

SEQ ID NO: 2151876 - protein, 5 aa, Cryptosporidium hominis
MESKE

SEQ ID NO: 2151877 - protein, 20 aa, Cryptosporidium hominis
METETSRISESYESQKSDLN

SEQ ID NO: 2151878 - protein, 16 aa, Cryptosporidium hominis
METNNARTKDRNTHNI

SEQ ID NO: 2151879 - protein, 13 aa, Cryptosporidium hominis
MEYSDSVTGSPND

SEQ ID NO: 2151880 - protein, 22 aa, Cryptosporidium hominis
MGASEGEEGGFTSKTENSSNKG

SEQ ID NO: 2151881 - protein, 10 aa, Cryptosporidium hominis
MGAVSSQELE

SEQ ID NO: 2151882 - protein, 10 aa, Cryptosporidium hominis
MGDDGKSLIN

SEQ ID NO: 2151883 - protein, 15 aa, Cryptosporidium hominis
MGEDSFSDEEYYSGE

SEQ ID NO: 2151884 - protein, 5 aa, Cryptosporidium hominis
MGEKQ

SEQ ID NO: 2151885 - protein, 10 aa, Cryptosporidium hominis
MGESGSNEDD

SEQ ID NO: 2151886 - protein, 4 aa, Cryptosporidium hominis
MGGA

SEQ ID NO: 2151887 - protein, 5 aa, Cryptosporidium hominis
MGGDL

SEQ ID NO: 2151888 - protein, 11 aa, Cryptosporidium hominis
MGGGSNLGGDI

SEQ ID NO: 2151889 - protein, 6 aa, Cryptosporidium hominis
MGGNLE

SEQ ID NO: 2151890 - protein, 7 aa, Cryptosporidium hominis
MGGPAEF

SEQ ID NO: 2151891 - protein, 10 aa, Cryptosporidium hominis
MGKSKEDTSL

SEQ ID NO: 2151892 - protein, 10 aa, Cryptosporidium hominis
MGLPTSDNLK

SEQ ID NO: 2151893 - protein, 15 aa, Cryptosporidium hominis
MGNSASNNNQSNHTD

SEQ ID NO: 2151894 - protein, 12 aa, Cryptosporidium hominis
MGNTTNSNDPHV

SEQ ID NO: 2151895 - protein, 13 aa, Cryptosporidium hominis
MGPGNRRKYYPGE

SEQ ID NO: 2151896 - protein, 35 aa, Cryptosporidium hominis
MGPSSAEDLQQSTSASTTASASTATSSTASPLTSP

SEQ ID NO: 2151897 - protein, 4 aa, Cryptosporidium hominis
MGQE

SEQ ID NO: 2151898 - protein, 4 aa, Cryptosporidium hominis
MGQR

SEQ ID NO: 2151899 - protein, 10 aa, Cryptosporidium hominis
MGRTNYSRGE

SEQ ID NO: 2151900 - protein, 5 aa, Cryptosporidium hominis
MGSDP

SEQ ID NO: 2151901 - protein, 5 aa, Cryptosporidium hominis
MGSGE

SEQ ID NO: 2151902 - protein, 9 aa, Cryptosporidium hominis
MGSNGLAGS

SEQ ID NO: 2151903 - protein, 33 aa, Cryptosporidium hominis
MGSPSDSRHSYSQDKSQEADRTQNPFQSGKNSI

SEQ ID NO: 2151904 - protein, 11 aa, Cryptosporidium hominis
MGSSSTIKQNN

SEQ ID NO: 2151905 - protein, 8 aa, Cryptosporidium hominis
MGTDVKPD

SEQ ID NO: 2151906 - protein, 6 aa, Cryptosporidium hominis
MGTPGV

SEQ ID NO: 2151907 - protein, 6 aa, Cryptosporidium hominis
MGVPGT

SEQ ID NO: 2151908 - protein, 7 aa, Cryptosporidium hominis
MHNSSTN

SEQ ID NO: 2151909 - protein, 4 aa, Cryptosporidium hominis
MKDK

SEQ ID NO: 2151910 - protein, 5 aa, Cryptosporidium hominis
MKDRI

SEQ ID NO: 2151911 - protein, 9 aa, Cryptosporidium hominis
MKEDKRNLA

SEQ ID NO: 2151912 - protein, 27 aa, Cryptosporidium hominis
MKEGSERGSGGGSGAHSKKSSGGSTIL

SEQ ID NO: 2151913 - protein, 8 aa, Cryptosporidium hominis
MKEKRPDI

SEQ ID NO: 2151914 - protein, 4 aa, Cryptosporidium hominis
MKEL

SEQ ID NO: 2151915 - protein, 11 aa, Cryptosporidium hominis
MKENTPNESEI

SEQ ID NO: 2151916 - protein, 14 aa, Cryptosporidium hominis
MKESVGGEKGTKSR

SEQ ID NO: 2151917 - protein, 15 aa, Cryptosporidium hominis
MKKKGKRRKKIKLSR

SEQ ID NO: 2151918 - protein, 10 aa, Cryptosporidium hominis
MKKKNRQSPK

SEQ ID NO: 2151919 - protein, 9 aa, Cryptosporidium hominis
MKNDKKTKL

SEQ ID NO: 2151920 - protein, 11 aa, Cryptosporidium hominis
MKNEPNNKKEL

SEQ ID NO: 2151921 - protein, 11 aa, Cryptosporidium hominis
MKNNTNPEVQQ

SEQ ID NO: 2151922 - protein, 19 aa, Cryptosporidium hominis
MKNYGAPSEMVDGSEANFS

SEQ ID NO: 2151923 - protein, 25 aa, Cryptosporidium hominis
MKPLDNSDNNACAGEGDGISVESGV

SEQ ID NO: 2151924 - protein, 4 aa, Cryptosporidium hominis
MKPP

SEQ ID NO: 2151925 - protein, 21 aa, Cryptosporidium hominis
MKREPEKQDLTSPTPSPMEPA

SEQ ID NO: 2151926 - protein, 12 aa, Cryptosporidium hominis
MKSGKKGSAKYI

SEQ ID NO: 2151927 - protein, 11 aa, Cryptosporidium hominis
MKSPYGPGPLE

SEQ ID NO: 2151928 - protein, 9 aa, Cryptosporidium hominis
MKTKPSNDQ

SEQ ID NO: 2151929 - protein, 36 aa, Cryptosporidium hominis
MKTQDDDASKNNPATSSSKDDAADEEDVDETGVDSA

SEQ ID NO: 2151930 - protein, 6 aa, Cryptosporidium hominis
MKTSTE

SEQ ID NO: 2151931 - protein, 5 aa, Cryptosporidium hominis
MNATG

SEQ ID NO: 2151932 - protein, 8 aa, Cryptosporidium hominis
MNDDKNKE

SEQ ID NO: 2151933 - protein, 12 aa, Cryptosporidium hominis
MNDPDSETALAA

SEQ ID NO: 2151934 - protein, 17 aa, Cryptosporidium hominis
MNDSEINNGTYEYSSAY

SEQ ID NO: 2151935 - protein, 16 aa, Cryptosporidium hominis
MNDSETEKMNQDSDID

SEQ ID NO: 2151936 - protein, 10 aa, Cryptosporidium hominis
MNEASPQLRT

SEQ ID NO: 2151937 - protein, 7 aa, Cryptosporidium hominis
MNETKTK

SEQ ID NO: 2151938 - protein, 6 aa, Cryptosporidium hominis
MNGGGM

SEQ ID NO: 2151939 - protein, 6 aa, Cryptosporidium hominis
MNGGNG

SEQ ID NO: 2151940 - protein, 10 aa, Cryptosporidium hominis
MNGTENDTKL

SEQ ID NO: 2151941 - protein, 13 aa, Cryptosporidium hominis
MNIDNNTNIENEA

SEQ ID NO: 2151942 - protein, 18 aa, Cryptosporidium hominis
MNKENYDSQRQSYSRGMG

SEQ ID NO: 2151943 - protein, 14 aa, Cryptosporidium hominis
MNKNSGKLKSFNDE

SEQ ID NO: 2151944 - protein, 8 aa, Cryptosporidium hominis
MNKNTLEN

SEQ ID NO: 2151945 - protein, 8 aa, Cryptosporidium hominis
MNKSERYK

SEQ ID NO: 2151946 - protein, 8 aa, Cryptosporidium hominis
MNKSKSDC

SEQ ID NO: 2151947 - protein, 9 aa, Cryptosporidium hominis
MNNQNSSSV

SEQ ID NO: 2151948 - protein, 8 aa, Cryptosporidium hominis
MNNSENLT

SEQ ID NO: 2151949 - protein, 11 aa, Cryptosporidium hominis
MNNTKRSESMK

SEQ ID NO: 2151950 - protein, 5 aa, Cryptosporidium hominis
MNRET

SEQ ID NO: 2151951 - protein, 6 aa, Cryptosporidium hominis
MNSNDD

SEQ ID NO: 2151952 - protein, 8 aa, Cryptosporidium hominis
MNSNNDCY

SEQ ID NO: 2151953 - protein, 6 aa, Cryptosporidium hominis
MNSNST

SEQ ID NO: 2151954 - protein, 6 aa, Cryptosporidium hominis
MNSPEH

SEQ ID NO: 2151955 - protein, 10 aa, Cryptosporidium hominis
MNSPPKSDLT

SEQ ID NO: 2151956 - protein, 9 aa, Cryptosporidium hominis
MNSSEEKVT

SEQ ID NO: 2151957 - protein, 15 aa, Cryptosporidium hominis
MNSSSEQLKKKLGST

SEQ ID NO: 2151958 - protein, 10 aa, Cryptosporidium hominis
MNTGNQRNDQ

SEQ ID NO: 2151959 - protein, 5 aa, Cryptosporidium hominis
MNTNS

SEQ ID NO: 2151960 - protein, 11 aa, Cryptosporidium hominis
MNTSGNNNPLY

SEQ ID NO: 2151961 - protein, 8 aa, Cryptosporidium hominis
MNTTQSME

SEQ ID NO: 2151962 - protein, 10 aa, Cryptosporidium hominis
MNTTSNNVGG

SEQ ID NO: 2151963 - protein, 10 aa, Cryptosporidium hominis
MNVGTSPNGR

SEQ ID NO: 2151964 - protein, 10 aa, Cryptosporidium hominis
MPADSGYPAY

SEQ ID NO: 2151965 - protein, 5 aa, Cryptosporidium hominis
MPDDA

SEQ ID NO: 2151966 - protein, 5 aa, Cryptosporidium hominis
MPDKN

SEQ ID NO: 2151967 - protein, 8 aa, Cryptosporidium hominis
MPEDTTFN

SEQ ID NO: 2151968 - protein, 5 aa, Cryptosporidium hominis
MPESK

SEQ ID NO: 2151969 - protein, 5 aa, Cryptosporidium hominis
MPGDN

SEQ ID NO: 2151970 - protein, 7 aa, Cryptosporidium hominis
MPGISEK

SEQ ID NO: 2151971 - protein, 5 aa, Cryptosporidium hominis
MPGNS

SEQ ID NO: 2151972 - protein, 6 aa, Cryptosporidium hominis
MPKPRS

SEQ ID NO: 2151973 - protein, 13 aa, Cryptosporidium hominis
MPKRSNKQLGSSM

SEQ ID NO: 2151974 - protein, 4 aa, Cryptosporidium hominis
MPKV

SEQ ID NO: 2151975 - protein, 5 aa, Cryptosporidium hominis
MPPHP

SEQ ID NO: 2151976 - protein, 8 aa, Cryptosporidium hominis
MPRNSGNC

SEQ ID NO: 2151977 - protein, 9 aa, Cryptosporidium hominis
MPSNQRNLQ

SEQ ID NO: 2151978 - protein, 13 aa, Cryptosporidium hominis
MPSSDSESNFGSK

SEQ ID NO: 2151979 - protein, 7 aa, Cryptosporidium hominis
MPSSNSP

SEQ ID NO: 2151980 - protein, 7 aa, Cryptosporidium hominis
MPSTVGK

SEQ ID NO: 2151981 - protein, 9 aa, Cryptosporidium hominis
MPTAGRVSG

SEQ ID NO: 2151982 - protein, 11 aa, Cryptosporidium hominis
MPTASTSQILG

SEQ ID NO: 2151983 - protein, 4 aa, Cryptosporidium hominis
MPTR

SEQ ID NO: 2151984 - protein, 8 aa, Cryptosporidium hominis
MQCPPGYS

SEQ ID NO: 2151985 - protein, 10 aa, Cryptosporidium hominis
MQDEEARGIQ

SEQ ID NO: 2151986 - protein, 16 aa, Cryptosporidium hominis
MQDQPNQQGQIHPGGN

SEQ ID NO: 2151987 - protein, 7 aa, Cryptosporidium hominis
MQEQTSG

SEQ ID NO: 2151988 - protein, 20 aa, Cryptosporidium hominis
MQHSQSQNNFRNNQQSMPNQ

SEQ ID NO: 2151989 - protein, 10 aa, Cryptosporidium hominis
MQNNNANHDY

SEQ ID NO: 2151990 - protein, 19 aa, Cryptosporidium hominis
MQQQSNSRNKGSEPQINSN

SEQ ID NO: 2151991 - protein, 15 aa, Cryptosporidium hominis
MRAPSTKASKSSNLY

SEQ ID NO: 2151992 - protein, 4 aa, Cryptosporidium hominis
MRDA

SEQ ID NO: 2151993 - protein, 5 aa, Cryptosporidium hominis
MRDDD

SEQ ID NO: 2151994 - protein, 6 aa, Cryptosporidium hominis
MRDSED

SEQ ID NO: 2151995 - protein, 6 aa, Cryptosporidium hominis
MRGRRR

SEQ ID NO: 2151996 - protein, 12 aa, Cryptosporidium hominis
MRNELNNKNNYE

SEQ ID NO: 2151997 - protein, 4 aa, Cryptosporidium hominis
MRPI

SEQ ID NO: 2151998 - protein, 29 aa, Cryptosporidium hominis
MRQPSSNQSVPSSISVENSSIAKGVSQGI

SEQ ID NO: 2151999 - protein, 7 aa, Cryptosporidium hominis
MRRETEK

SEQ ID NO: 2152000 - protein, 15 aa, Cryptosporidium hominis
MRSGNSQNHSSGLNI

SEQ ID NO: 2152001 - protein, 12 aa, Cryptosporidium hominis
MRSSPVSSSRSN

SEQ ID NO: 2152002 - protein, 5 aa, Cryptosporidium hominis
MSARE

SEQ ID NO: 2152003 - protein, 7 aa, Cryptosporidium hominis
MSDEMQQ

SEQ ID NO: 2152004 - protein, 7 aa, Cryptosporidium hominis
MSDENEV

SEQ ID NO: 2152005 - protein, 7 aa, Cryptosporidium hominis
MSDKDRV

SEQ ID NO: 2152006 - protein, 7 aa, Cryptosporidium hominis
MSENQPL

SEQ ID NO: 2152007 - protein, 5 aa, Cryptosporidium hominis
MSESR

SEQ ID NO: 2152008 - protein, 4 aa, Cryptosporidium hominis
MSGL

SEQ ID NO: 2152009 - protein, 7 aa, Cryptosporidium hominis
MSGNTDC

SEQ ID NO: 2152010 - protein, 5 aa, Cryptosporidium hominis
MSGPE

SEQ ID NO: 2152011 - protein, 5 aa, Cryptosporidium hominis
MSGPI

SEQ ID NO: 2152012 - protein, 15 aa, Cryptosporidium hominis
MSGRAGRAGQKGAFG

SEQ ID NO: 2152013 - protein, 9 aa, Cryptosporidium hominis
MSKATETCN

SEQ ID NO: 2152014 - protein, 17 aa, Cryptosporidium hominis
MSKISNKSVKIDPSSLK

SEQ ID NO: 2152015 - protein, 10 aa, Cryptosporidium hominis
MSKQEGNNKI

SEQ ID NO: 2152016 - protein, 4 aa, Cryptosporidium hominis
MSKS

SEQ ID NO: 2152017 - protein, 8 aa, Cryptosporidium hominis
MSKSNNIS

SEQ ID NO: 2152018 - protein, 8 aa, Cryptosporidium hominis
MSKSPKHL

SEQ ID NO: 2152019 - protein, 49 aa, Cryptosporidium hominis
MSKTGGRTGFSNRNKHGNSNSASSNTDVNNNGTNSGSANLTDSKNGANE

SEQ ID NO: 2152020 - protein, 4 aa, Cryptosporidium hominis
MSLN

SEQ ID NO: 2152021 - protein, 47 aa, Cryptosporidium hominis
MSLSNSRSNSRSCPRAGSRQVQRKSIERGRSKERVKRNYESSPEEFN

SEQ ID NO: 2152022 - protein, 7 aa, Cryptosporidium hominis
MSNNNDN

SEQ ID NO: 2152023 - protein, 10 aa, Cryptosporidium hominis
MSNRIDSAPN

SEQ ID NO: 2152024 - protein, 15 aa, Cryptosporidium hominis
MSNSQANINKKENNF

SEQ ID NO: 2152025 - protein, 5 aa, Cryptosporidium hominis
MSPGN

SEQ ID NO: 2152026 - protein, 4 aa, Cryptosporidium hominis
MSPS

SEQ ID NO: 2152027 - protein, 11 aa, Cryptosporidium hominis
MSPSYNPSEVE

SEQ ID NO: 2152028 - protein, 6 aa, Cryptosporidium hominis
MSQSQR

SEQ ID NO: 2152029 - protein, 7 aa, Cryptosporidium hominis
MSREVDN

SEQ ID NO: 2152030 - protein, 9 aa, Cryptosporidium hominis
MSRQQREKQ

SEQ ID NO: 2152031 - protein, 10 aa, Cryptosporidium hominis
MSRSYSKSYQ

SEQ ID NO: 2152032 - protein, 17 aa, Cryptosporidium hominis
MSSGSNNKALGNSIGPS

SEQ ID NO: 2152033 - protein, 28 aa, Cryptosporidium hominis
MSSGSNRTQLSGDPLDGIQGATGSKEIS

SEQ ID NO: 2152034 - protein, 5 aa, Cryptosporidium hominis
MSSPN

SEQ ID NO: 2152035 - protein, 5 aa, Cryptosporidium hominis
MSSRA

SEQ ID NO: 2152036 - protein, 9 aa, Cryptosporidium hominis
MSSRGQQPT

SEQ ID NO: 2152037 - protein, 14 aa, Cryptosporidium hominis
MSSSSDNMSHDSNN

SEQ ID NO: 2152038 - protein, 7 aa, Cryptosporidium hominis
MSTGEVK

SEQ ID NO: 2152039 - protein, 30 aa, Cryptosporidium hominis
MTDCKPGNTGASNSNSSNINNQKMNTGDQN

SEQ ID NO: 2152040 - protein, 26 aa, Cryptosporidium hominis
MTDEQKKKFSEKDDACGDDDEEEEEY

SEQ ID NO: 2152041 - protein, 7 aa, Cryptosporidium hominis
MTEKANS

SEQ ID NO: 2152042 - protein, 5 aa, Cryptosporidium hominis
MTEKE

SEQ ID NO: 2152043 - protein, 8 aa, Cryptosporidium hominis
MTGRKVNK

SEQ ID NO: 2152044 - protein, 13 aa, Cryptosporidium hominis
MTKDSESLTPSSD

SEQ ID NO: 2152045 - protein, 7 aa, Cryptosporidium hominis
MTNGGEI

SEQ ID NO: 2152046 - protein, 23 aa, Cryptosporidium hominis
MTNKADNSRDISLKSQKKALDSD

SEQ ID NO: 2152047 - protein, 6 aa, Cryptosporidium hominis
MTPPGS

SEQ ID NO: 2152048 - protein, 6 aa, Cryptosporidium hominis
MTPSRF

SEQ ID NO: 2152049 - protein, 14 aa, Cryptosporidium hominis
MTPSSEGSSPEDVS

SEQ ID NO: 2152050 - protein, 16 aa, Cryptosporidium hominis
MTPTTSASSSSVSPIS

SEQ ID NO: 2152051 - protein, 4 aa, Cryptosporidium hominis
MTRL

SEQ ID NO: 2152052 - protein, 48 aa, Cryptosporidium hominis
MTTNSTNEGKVQKTQPSKRLVNTEKSSIASKTKTDINSNNAKKTTQIK

SEQ ID NO: 2152053 - protein, 68 aa, Cryptosporidium hominis
MTTTTTVPSTFTTQTTAGQATTSQTTTSQTTASQTTASQSTASQATTFQTTQTTTGQATTGQTTTGQV

SEQ ID NO: 2152054 - protein, 19 aa, Cryptosporidium hominis
MTVPSDDKETKVNTEAEED

SEQ ID NO: 2152055 - protein, 4 aa, Cryptosporidium hominis
MVDE

SEQ ID NO: 2152056 - protein, 8 aa, Cryptosporidium hominis
MVGSESGF

SEQ ID NO: 2152057 - protein, 45 aa, Cryptosporidium hominis
NAAATTTNASVSANSISTAQTAPINSTANIASANTANNTANTPLG

SEQ ID NO: 2152058 - protein, 5 aa, Cryptosporidium hominis
NAAIE

SEQ ID NO: 2152059 - protein, 12 aa, Cryptosporidium hominis
NAANKLKSTTKL

SEQ ID NO: 2152060 - protein, 5 aa, Cryptosporidium hominis
NAAPT

SEQ ID NO: 2152061 - protein, 19 aa, Cryptosporidium hominis
NADDGDEGEIEKRRKRREA

SEQ ID NO: 2152062 - protein, 5 aa, Cryptosporidium hominis
NADEA

SEQ ID NO: 2152063 - protein, 7 aa, Cryptosporidium hominis
NADEELG

SEQ ID NO: 2152064 - protein, 6 aa, Cryptosporidium hominis
NADGNQ

SEQ ID NO: 2152065 - protein, 5 aa, Cryptosporidium hominis
NADIR

SEQ ID NO: 2152066 - protein, 9 aa, Cryptosporidium hominis
NADNETKKQ

SEQ ID NO: 2152067 - protein, 8 aa, Cryptosporidium hominis
NADNGKKI

SEQ ID NO: 2152068 - protein, 44 aa, Cryptosporidium hominis
NADNQSEDLDENREDEDLKEVKSEEVDKEGNDSFEPYKEESELS

SEQ ID NO: 2152069 - protein, 18 aa, Cryptosporidium hominis
NADPISQKKEKRRAGTGV

SEQ ID NO: 2152070 - protein, 9 aa, Cryptosporidium hominis
NADQVKKES

SEQ ID NO: 2152071 - protein, 12 aa, Cryptosporidium hominis
NADSYEDEVDPI

SEQ ID NO: 2152072 - protein, 6 aa, Cryptosporidium hominis
NADTPE

SEQ ID NO: 2152073 - protein, 6 aa, Cryptosporidium hominis
NAEDSD

SEQ ID NO: 2152074 - protein, 9 aa, Cryptosporidium hominis
NAEESPINS

SEQ ID NO: 2152075 - protein, 17 aa, Cryptosporidium hominis
NAEKTRINKEKSQINEL

SEQ ID NO: 2152076 - protein, 4 aa, Cryptosporidium hominis
NAEL

SEQ ID NO: 2152077 - protein, 7 aa, Cryptosporidium hominis
NAEPNTK

SEQ ID NO: 2152078 - protein, 17 aa, Cryptosporidium hominis
NAEQVNQEDNISSPENE

SEQ ID NO: 2152079 - protein, 16 aa, Cryptosporidium hominis
NAESGDSSSASKRCSY

SEQ ID NO: 2152080 - protein, 10 aa, Cryptosporidium hominis
NAESLNDQNL

SEQ ID NO: 2152081 - protein, 9 aa, Cryptosporidium hominis
NAETGSGKT

SEQ ID NO: 2152082 - protein, 13 aa, Cryptosporidium hominis
NAEYNSNNDINKH

SEQ ID NO: 2152083 - protein, 14 aa, Cryptosporidium hominis
NAFESEEDSKKTGD

SEQ ID NO: 2152084 - protein, 4 aa, Cryptosporidium hominis
NAGF

SEQ ID NO: 2152085 - protein, 6 aa, Cryptosporidium hominis
NAGFDG

SEQ ID NO: 2152086 - protein, 5 aa, Cryptosporidium hominis
NAGKS

SEQ ID NO: 2152087 - protein, 5 aa, Cryptosporidium hominis
NAGKT

SEQ ID NO: 2152088 - protein, 6 aa, Cryptosporidium hominis
NAGKTT

SEQ ID NO: 2152089 - protein, 45 aa, Cryptosporidium hominis
NAGPVTNSRGRARKRTSTTPLGGMRGRRDSTDANKRRGGSPGRHH

SEQ ID NO: 2152090 - protein, 4 aa, Cryptosporidium hominis
NAIN

SEQ ID NO: 2152091 - protein, 18 aa, Cryptosporidium hominis
NAINSTSKLRQEADDSIA

SEQ ID NO: 2152092 - protein, 16 aa, Cryptosporidium hominis
NAIQDEDDLGLSSNNY

SEQ ID NO: 2152093 - protein, 10 aa, Cryptosporidium hominis
NAISEKRKEL

SEQ ID NO: 2152094 - protein, 14 aa, Cryptosporidium hominis
NAISSSPSSIITTS

SEQ ID NO: 2152095 - protein, 13 aa, Cryptosporidium hominis
NAKASKPVVFKIP

SEQ ID NO: 2152096 - protein, 16 aa, Cryptosporidium hominis
NAKESKINTRKEEESF

SEQ ID NO: 2152097 - protein, 10 aa, Cryptosporidium hominis
NAKKGNGMNN

SEQ ID NO: 2152098 - protein, 23 aa, Cryptosporidium hominis
NAKKSNVSTYSSIESKQRAGGFT

SEQ ID NO: 2152099 - protein, 8 aa, Cryptosporidium hominis
NAKKSSEC

SEQ ID NO: 2152100 - protein, 10 aa, Cryptosporidium hominis
NAKNNTVIET

SEQ ID NO: 2152101 - protein, 7 aa, Cryptosporidium hominis
NAKNRAS

SEQ ID NO: 2152102 - protein, 7 aa, Cryptosporidium hominis
NAKPCDF

SEQ ID NO: 2152103 - protein, 9 aa, Cryptosporidium hominis
NAKPQGGQD

SEQ ID NO: 2152104 - protein, 14 aa, Cryptosporidium hominis
NAKSKAGNVTSAPT

SEQ ID NO: 2152105 - protein, 5 aa, Cryptosporidium hominis
NAKTI

SEQ ID NO: 2152106 - protein, 13 aa, Cryptosporidium hominis
NAKTTRNNNSSRF

SEQ ID NO: 2152107 - protein, 4 aa, Cryptosporidium hominis
NAKV

SEQ ID NO: 2152108 - protein, 5 aa, Cryptosporidium hominis
NAKYS

SEQ ID NO: 2152109 - protein, 22 aa, Cryptosporidium hominis
NAKYTSSISNTSENGNNQESEH

SEQ ID NO: 2152110 - protein, 5 aa, Cryptosporidium hominis
NALEP

SEQ ID NO: 2152111 - protein, 15 aa, Cryptosporidium hominis
NALETAKKANSPKTW

SEQ ID NO: 2152112 - protein, 6 aa, Cryptosporidium hominis
NALSEK

SEQ ID NO: 2152113 - protein, 37 aa, Cryptosporidium hominis
NALSPDDPIMTDDEEEEEERRGDGRDDELRVEDEGEV

SEQ ID NO: 2152114 - protein, 13 aa, Cryptosporidium hominis
NAMDDTNSGFEED

SEQ ID NO: 2152115 - protein, 8 aa, Cryptosporidium hominis
NAMDSQST

SEQ ID NO: 2152116 - protein, 4 aa, Cryptosporidium hominis
NAMN

SEQ ID NO: 2152117 - protein, 21 aa, Cryptosporidium hominis
NANAVTSNSSSKNVCLNDAGS

SEQ ID NO: 2152118 - protein, 6 aa, Cryptosporidium hominis
NANEGS

SEQ ID NO: 2152119 - protein, 5 aa, Cryptosporidium hominis
NANFE

SEQ ID NO: 2152120 - protein, 13 aa, Cryptosporidium hominis
NANHKFSSSNISE

SEQ ID NO: 2152121 - protein, 9 aa, Cryptosporidium hominis
NANNASPGL

SEQ ID NO: 2152122 - protein, 16 aa, Cryptosporidium hominis
NANNELSCSESDEVNE

SEQ ID NO: 2152123 - protein, 19 aa, Cryptosporidium hominis
NANNNKKPNKRQKTTQISD

SEQ ID NO: 2152124 - protein, 6 aa, Cryptosporidium hominis
NANPVQ

SEQ ID NO: 2152125 - protein, 11 aa, Cryptosporidium hominis
NANQDTGNKYV

SEQ ID NO: 2152126 - protein, 7 aa, Cryptosporidium hominis
NANRNSD

SEQ ID NO: 2152127 - protein, 6 aa, Cryptosporidium hominis
NANSIV

SEQ ID NO: 2152128 - protein, 11 aa, Cryptosporidium hominis
NANSKKKLVEN

SEQ ID NO: 2152129 - protein, 7 aa, Cryptosporidium hominis
NANSTFS

SEQ ID NO: 2152130 - protein, 12 aa, Cryptosporidium hominis
NAPISKLILNAA

SEQ ID NO: 2152131 - protein, 30 aa, Cryptosporidium hominis
NAPKTGSYVNDGVRAKSCTEAIRENANSVG

SEQ ID NO: 2152132 - protein, 4 aa, Cryptosporidium hominis
NAPN

SEQ ID NO: 2152133 - protein, 16 aa, Cryptosporidium hominis
NAPRRETGDLNNLDPS

SEQ ID NO: 2152134 - protein, 36 aa, Cryptosporidium hominis
NAPYTRSNNFNQSGAPYNSSNQAANSSTGPSSTHGK

SEQ ID NO: 2152135 - protein, 5 aa, Cryptosporidium hominis
NAQNE

SEQ ID NO: 2152136 - protein, 7 aa, Cryptosporidium hominis
NAQNTNG

SEQ ID NO: 2152137 - protein, 5 aa, Cryptosporidium hominis
NAQQD

SEQ ID NO: 2152138 - protein, 5 aa, Cryptosporidium hominis
NARST

SEQ ID NO: 2152139 - protein, 5 aa, Cryptosporidium hominis
NASAA

SEQ ID NO: 2152140 - protein, 6 aa, Cryptosporidium hominis
NASDAL

SEQ ID NO: 2152141 - protein, 7 aa, Cryptosporidium hominis
NASDIYQ

SEQ ID NO: 2152142 - protein, 8 aa, Cryptosporidium hominis
NASEEELS

SEQ ID NO: 2152143 - protein, 22 aa, Cryptosporidium hominis
NASEKKNSNTTLKANDNQEFTN

SEQ ID NO: 2152144 - protein, 5 aa, Cryptosporidium hominis
NASER

SEQ ID NO: 2152145 - protein, 9 aa, Cryptosporidium hominis
NASGRRAIG

SEQ ID NO: 2152146 - protein, 11 aa, Cryptosporidium hominis
NASHSAPDNRE

SEQ ID NO: 2152147 - protein, 5 aa, Cryptosporidium hominis
NASKL

SEQ ID NO: 2152148 - protein, 10 aa, Cryptosporidium hominis
NASLKESISQ

SEQ ID NO: 2152149 - protein, 4 aa, Cryptosporidium hominis
NASN

SEQ ID NO: 2152150 - protein, 7 aa, Cryptosporidium hominis
NASNSAS

SEQ ID NO: 2152151 - protein, 8 aa, Cryptosporidium hominis
NASNSGGC

SEQ ID NO: 2152152 - protein, 8 aa, Cryptosporidium hominis
NASPGNRK

SEQ ID NO: 2152153 - protein, 35 aa, Cryptosporidium hominis
NASQRNSGSGVSSGGSGVSGSNVHTSIKSSGIGNG

SEQ ID NO: 2152154 - protein, 13 aa, Cryptosporidium hominis
NASRSLEGNQTSL

SEQ ID NO: 2152155 - protein, 6 aa, Cryptosporidium hominis
NASSDR

SEQ ID NO: 2152156 - protein, 9 aa, Cryptosporidium hominis
NASSGGECS

SEQ ID NO: 2152157 - protein, 5 aa, Cryptosporidium hominis
NASST

SEQ ID NO: 2152158 - protein, 11 aa, Cryptosporidium hominis
NASSTSSSSSL

SEQ ID NO: 2152159 - protein, 10 aa, Cryptosporidium hominis
NASSYNSSDA

SEQ ID NO: 2152160 - protein, 13 aa, Cryptosporidium hominis
NASTDFSKTSNKN

SEQ ID NO: 2152161 - protein, 21 aa, Cryptosporidium hominis
NASTNGSKQNISNSDYTDEEI

SEQ ID NO: 2152162 - protein, 5 aa, Cryptosporidium hominis
NASWR

SEQ ID NO: 2152163 - protein, 9 aa, Cryptosporidium hominis
NATAGSFAE

SEQ ID NO: 2152164 - protein, 5 aa, Cryptosporidium hominis
NATDI

SEQ ID NO: 2152165 - protein, 7 aa, Cryptosporidium hominis
NATGRVE

SEQ ID NO: 2152166 - protein, 7 aa, Cryptosporidium hominis
NATIERN

SEQ ID NO: 2152167 - protein, 8 aa, Cryptosporidium hominis
NATQNEFG

SEQ ID NO: 2152168 - protein, 8 aa, Cryptosporidium hominis
NATTGGTV

SEQ ID NO: 2152169 - protein, 13 aa, Cryptosporidium hominis
NAVDTKDNMSQFS

SEQ ID NO: 2152170 - protein, 4 aa, Cryptosporidium hominis
NAVE

SEQ ID NO: 2152171 - protein, 12 aa, Cryptosporidium hominis
NCASESTFEGER

SEQ ID NO: 2152172 - protein, 4 aa, Cryptosporidium hominis
NCDE

SEQ ID NO: 2152173 - protein, 5 aa, Cryptosporidium hominis
NCDSH

SEQ ID NO: 2152174 - protein, 8 aa, Cryptosporidium hominis
NCDSLGGG

SEQ ID NO: 2152175 - protein, 9 aa, Cryptosporidium hominis
NCEAGSKNH

SEQ ID NO: 2152176 - protein, 9 aa, Cryptosporidium hominis
NCEESLRNG

SEQ ID NO: 2152177 - protein, 4 aa, Cryptosporidium hominis
NCEK

SEQ ID NO: 2152178 - protein, 8 aa, Cryptosporidium hominis
NCESYKNE

SEQ ID NO: 2152179 - protein, 5 aa, Cryptosporidium hominis
NCGDS

SEQ ID NO: 2152180 - protein, 9 aa, Cryptosporidium hominis
NCGNNSDTF

SEQ ID NO: 2152181 - protein, 18 aa, Cryptosporidium hominis
NCHSTSGTGGGKGGGVSE

SEQ ID NO: 2152182 - protein, 12 aa, Cryptosporidium hominis
NCKNQGKYLKGD

SEQ ID NO: 2152183 - protein, 11 aa, Cryptosporidium hominis
NCNETSANRTK

SEQ ID NO: 2152184 - protein, 11 aa, Cryptosporidium hominis
NCPSDKSHKPI

SEQ ID NO: 2152185 - protein, 5 aa, Cryptosporidium hominis
NCPSQ

SEQ ID NO: 2152186 - protein, 4 aa, Cryptosporidium hominis
NCPV

SEQ ID NO: 2152187 - protein, 7 aa, Cryptosporidium hominis
NCQNKNT

SEQ ID NO: 2152188 - protein, 7 aa, Cryptosporidium hominis
NCQNSDE

SEQ ID NO: 2152189 - protein, 6 aa, Cryptosporidium hominis
NCSNGI

SEQ ID NO: 2152190 - protein, 14 aa, Cryptosporidium hominis
NCSSIGKSKPSLSL

SEQ ID NO: 2152191 - protein, 13 aa, Cryptosporidium hominis
NCVEEEEERVDEV

SEQ ID NO: 2152192 - protein, 23 aa, Cryptosporidium hominis
NDAEDDQTPESDTNKDLGTFNSS

SEQ ID NO: 2152193 - protein, 9 aa, Cryptosporidium hominis
NDAEPGPEE

SEQ ID NO: 2152194 - protein, 15 aa, Cryptosporidium hominis
NDAESDHGATNGGAI

SEQ ID NO: 2152195 - protein, 7 aa, Cryptosporidium hominis
NDAGQTW

SEQ ID NO: 2152196 - protein, 10 aa, Cryptosporidium hominis
NDAKKKHDEI

SEQ ID NO: 2152197 - protein, 6 aa, Cryptosporidium hominis
NDANQL

SEQ ID NO: 2152198 - protein, 4 aa, Cryptosporidium hominis
NDAT

SEQ ID NO: 2152199 - protein, 4 aa, Cryptosporidium hominis
NDAY

SEQ ID NO: 2152200 - protein, 7 aa, Cryptosporidium hominis
NDDDGEF

SEQ ID NO: 2152201 - protein, 8 aa, Cryptosporidium hominis
NDDDRDEL

SEQ ID NO: 2152202 - protein, 4 aa, Cryptosporidium hominis
NDDE

SEQ ID NO: 2152203 - protein, 9 aa, Cryptosporidium hominis
NDDFKEELN

SEQ ID NO: 2152204 - protein, 23 aa, Cryptosporidium hominis
NDDGLEDNNNERSGLPASQIDGD

SEQ ID NO: 2152205 - protein, 8 aa, Cryptosporidium hominis
NDDGSIGK

SEQ ID NO: 2152206 - protein, 12 aa, Cryptosporidium hominis
NDDHHNSLAGGT

SEQ ID NO: 2152207 - protein, 6 aa, Cryptosporidium hominis
NDDHKT

SEQ ID NO: 2152208 - protein, 16 aa, Cryptosporidium hominis
NDDNNNQMNSEEFNEK

SEQ ID NO: 2152209 - protein, 10 aa, Cryptosporidium hominis
NDDNNQNDNI

SEQ ID NO: 2152210 - protein, 5 aa, Cryptosporidium hominis
NDDNQ

SEQ ID NO: 2152211 - protein, 11 aa, Cryptosporidium hominis
NDDSDDSDKNL

SEQ ID NO: 2152212 - protein, 15 aa, Cryptosporidium hominis
NDDSGSDAQNSNSNT

SEQ ID NO: 2152213 - protein, 8 aa, Cryptosporidium hominis
NDDSPNKF

SEQ ID NO: 2152214 - protein, 17 aa, Cryptosporidium hominis
NDDSTVRGGNKANINEI

SEQ ID NO: 2152215 - protein, 8 aa, Cryptosporidium hominis
NDDTHNPI

SEQ ID NO: 2152216 - protein, 8 aa, Cryptosporidium hominis
NDDTRMEE

SEQ ID NO: 2152217 - protein, 6 aa, Cryptosporidium hominis
NDDVLE

SEQ ID NO: 2152218 - protein, 5 aa, Cryptosporidium hominis
NDDYI

SEQ ID NO: 2152219 - protein, 16 aa, Cryptosporidium hominis
NDEDISRSNIDTVGGE

SEQ ID NO: 2152220 - protein, 12 aa, Cryptosporidium hominis
NDEDYDQDEELS

SEQ ID NO: 2152221 - protein, 4 aa, Cryptosporidium hominis
NDEE

SEQ ID NO: 2152222 - protein, 5 aa, Cryptosporidium hominis
NDEEL

SEQ ID NO: 2152223 - protein, 8 aa, Cryptosporidium hominis
NDEENKMN

SEQ ID NO: 2152224 - protein, 8 aa, Cryptosporidium hominis
NDEESKNF

SEQ ID NO: 2152225 - protein, 7 aa, Cryptosporidium hominis
NDEGANN

SEQ ID NO: 2152226 - protein, 8 aa, Cryptosporidium hominis
NDEGNKSN

SEQ ID NO: 2152227 - protein, 8 aa, Cryptosporidium hominis
NDEGTVSG

SEQ ID NO: 2152228 - protein, 14 aa, Cryptosporidium hominis
NDEGVTSATGLTIS

SEQ ID NO: 2152229 - protein, 12 aa, Cryptosporidium hominis
NDEHSDEKKQLS

SEQ ID NO: 2152230 - protein, 6 aa, Cryptosporidium hominis
NDEIEK

SEQ ID NO: 2152231 - protein, 9 aa, Cryptosporidium hominis
NDEKEAFPD

SEQ ID NO: 2152232 - protein, 8 aa, Cryptosporidium hominis
NDELANQL

SEQ ID NO: 2152233 - protein, 22 aa, Cryptosporidium hominis
NDELDELEEAKQQLKENSEKIT

SEQ ID NO: 2152234 - protein, 8 aa, Cryptosporidium hominis
NDENEKNS

SEQ ID NO: 2152235 - protein, 11 aa, Cryptosporidium hominis
NDENKKDDEML

SEQ ID NO: 2152236 - protein, 24 aa, Cryptosporidium hominis
NDENQSKNDFNNNNNNHNNDYKSN

SEQ ID NO: 2152237 - protein, 5 aa, Cryptosporidium hominis
NDENS

SEQ ID NO: 2152238 - protein, 9 aa, Cryptosporidium hominis
NDENSKLGN

SEQ ID NO: 2152239 - protein, 12 aa, Cryptosporidium hominis
NDENSSNNESYN

SEQ ID NO: 2152240 - protein, 16 aa, Cryptosporidium hominis
NDEPIPGSQAGQIADT

SEQ ID NO: 2152241 - protein, 5 aa, Cryptosporidium hominis
NDEQR

SEQ ID NO: 2152242 - protein, 19 aa, Cryptosporidium hominis
NDERIRQTPEGNSTSPANL

SEQ ID NO: 2152243 - protein, 5 aa, Cryptosporidium hominis
NDERN

SEQ ID NO: 2152244 - protein, 4 aa, Cryptosporidium hominis
NDES

SEQ ID NO: 2152245 - protein, 8 aa, Cryptosporidium hominis
NDESIEKK

SEQ ID NO: 2152246 - protein, 4 aa, Cryptosporidium hominis
NDET

SEQ ID NO: 2152247 - protein, 5 aa, Cryptosporidium hominis
NDETI

SEQ ID NO: 2152248 - protein, 11 aa, Cryptosporidium hominis
NDFDEQYDSDL

SEQ ID NO: 2152249 - protein, 6 aa, Cryptosporidium hominis
NDFGRN

SEQ ID NO: 2152250 - protein, 20 aa, Cryptosporidium hominis
NDFKQAKKTIKNQISSRPDL

SEQ ID NO: 2152251 - protein, 6 aa, Cryptosporidium hominis
NDFNNT

SEQ ID NO: 2152252 - protein, 4 aa, Cryptosporidium hominis
NDFQ

SEQ ID NO: 2152253 - protein, 6 aa, Cryptosporidium hominis
NDFSNL

SEQ ID NO: 2152254 - protein, 7 aa, Cryptosporidium hominis
NDGENVR

SEQ ID NO: 2152255 - protein, 4 aa, Cryptosporidium hominis
NDGG

SEQ ID NO: 2152256 - protein, 62 aa, Cryptosporidium hominis
NDGGDENREGDRKIDESKSPSRERGVSDDEQRNNEGRNEDNREPVEERDRSRSREKSEVDVS

SEQ ID NO: 2152257 - protein, 9 aa, Cryptosporidium hominis
NDGGGGSAS

SEQ ID NO: 2152258 - protein, 7 aa, Cryptosporidium hominis
NDGIDDD

SEQ ID NO: 2152259 - protein, 23 aa, Cryptosporidium hominis
NDGKVDDYSYRAKPGARYISPEN

SEQ ID NO: 2152260 - protein, 18 aa, Cryptosporidium hominis
NDGLEQHSNEISLLDVLS

SEQ ID NO: 2152261 - protein, 16 aa, Cryptosporidium hominis
NDGNRLPIQGKSKINR

SEQ ID NO: 2152262 - protein, 6 aa, Cryptosporidium hominis
NDGQQH

SEQ ID NO: 2152263 - protein, 7 aa, Cryptosporidium hominis
NDGQRTL

SEQ ID NO: 2152264 - protein, 6 aa, Cryptosporidium hominis
NDGQYP

SEQ ID NO: 2152265 - protein, 22 aa, Cryptosporidium hominis
NDGTGHGGGSSNKKALETIDER

SEQ ID NO: 2152266 - protein, 33 aa, Cryptosporidium hominis
NDHHDKYYGSEEATNATKAINKRRQEQYAKDIQ

SEQ ID NO: 2152267 - protein, 12 aa, Cryptosporidium hominis
NDHKPNSESEKR

SEQ ID NO: 2152268 - protein, 27 aa, Cryptosporidium hominis
NDHNNGNKSVSSNPNVIESDNSRVKSN

SEQ ID NO: 2152269 - protein, 4 aa, Cryptosporidium hominis
NDHR

SEQ ID NO: 2152270 - protein, 19 aa, Cryptosporidium hominis
NDHTNTKGSLKKPNSNEPH

SEQ ID NO: 2152271 - protein, 12 aa, Cryptosporidium hominis
NDIDTRNNEYYE

SEQ ID NO: 2152272 - protein, 5 aa, Cryptosporidium hominis
NDIEN

SEQ ID NO: 2152273 - protein, 60 aa, Cryptosporidium hominis
NDIHNADEKTTDNRNNKKLENTNVKNDEQIPFSDQKKYSKSSPLSKNQCPPKLGKRPPMK

SEQ ID NO: 2152274 - protein, 16 aa, Cryptosporidium hominis
NDIPEGSGKLVSGSSE

SEQ ID NO: 2152275 - protein, 19 aa, Cryptosporidium hominis
NDIPEPGNESSEDDDDDEI

SEQ ID NO: 2152276 - protein, 9 aa, Cryptosporidium hominis
NDISGGANQ

SEQ ID NO: 2152277 - protein, 5 aa, Cryptosporidium hominis
NDISK

SEQ ID NO: 2152278 - protein, 7 aa, Cryptosporidium hominis
NDISSAK

SEQ ID NO: 2152279 - protein, 8 aa, Cryptosporidium hominis
NDKDEEDF

SEQ ID NO: 2152280 - protein, 14 aa, Cryptosporidium hominis
NDKKDGDGKFTWPD

SEQ ID NO: 2152281 - protein, 9 aa, Cryptosporidium hominis
NDKKKQISK

SEQ ID NO: 2152282 - protein, 8 aa, Cryptosporidium hominis
NDKKRKFR

SEQ ID NO: 2152283 - protein, 6 aa, Cryptosporidium hominis
NDKLSK

SEQ ID NO: 2152284 - protein, 18 aa, Cryptosporidium hominis
NDKNKVEYKNKRKAHHSM

SEQ ID NO: 2152285 - protein, 8 aa, Cryptosporidium hominis
NDKNNTVT

SEQ ID NO: 2152286 - protein, 9 aa, Cryptosporidium hominis
NDKNSGYIT

SEQ ID NO: 2152287 - protein, 8 aa, Cryptosporidium hominis
NDKPISRY

SEQ ID NO: 2152288 - protein, 11 aa, Cryptosporidium hominis
NDKPTYSPDGF

SEQ ID NO: 2152289 - protein, 8 aa, Cryptosporidium hominis
NDKQKAVE

SEQ ID NO: 2152290 - protein, 8 aa, Cryptosporidium hominis
NDKRTITI

SEQ ID NO: 2152291 - protein, 20 aa, Cryptosporidium hominis
NDKTLKANMDSNSVSSNSDY

SEQ ID NO: 2152292 - protein, 8 aa, Cryptosporidium hominis
NDKTQDAI

SEQ ID NO: 2152293 - protein, 6 aa, Cryptosporidium hominis
NDKYQL

SEQ ID NO: 2152294 - protein, 11 aa, Cryptosporidium hominis
NDLEDPKKPFS

SEQ ID NO: 2152295 - protein, 6 aa, Cryptosporidium hominis
NDLEEN

SEQ ID NO: 2152296 - protein, 25 aa, Cryptosporidium hominis
NDLEGSSEFYQTNAETNNENSNKVG

SEQ ID NO: 2152297 - protein, 8 aa, Cryptosporidium hominis
NDLGKEQI

SEQ ID NO: 2152298 - protein, 5 aa, Cryptosporidium hominis
NDLNN

SEQ ID NO: 2152299 - protein, 6 aa, Cryptosporidium hominis
NDLPIN

SEQ ID NO: 2152300 - protein, 49 aa, Cryptosporidium hominis
NDNAHYSPDKSSKASIYNPISSSAQNIKSEMNSPSKINNVENEELDNIE

SEQ ID NO: 2152301 - protein, 8 aa, Cryptosporidium hominis
NDNDRPII

SEQ ID NO: 2152302 - protein, 8 aa, Cryptosporidium hominis
NDNEENDL

SEQ ID NO: 2152303 - protein, 12 aa, Cryptosporidium hominis
NDNFDKSTNINN

SEQ ID NO: 2152304 - protein, 7 aa, Cryptosporidium hominis
NDNFGEG

SEQ ID NO: 2152305 - protein, 7 aa, Cryptosporidium hominis
NDNGPQL

SEQ ID NO: 2152306 - protein, 9 aa, Cryptosporidium hominis
NDNKTEEDV

SEQ ID NO: 2152307 - protein, 11 aa, Cryptosporidium hominis
NDNLKNDPASC

SEQ ID NO: 2152308 - protein, 8 aa, Cryptosporidium hominis
NDNMNDSS

SEQ ID NO: 2152309 - protein, 7 aa, Cryptosporidium hominis
NDNNGAL

SEQ ID NO: 2152310 - protein, 12 aa, Cryptosporidium hominis
NDNNGSSTSSRE

SEQ ID NO: 2152311 - protein, 11 aa, Cryptosporidium hominis
NDNNKEKDNSI

SEQ ID NO: 2152312 - protein, 8 aa, Cryptosporidium hominis
NDNNNNAN

SEQ ID NO: 2152313 - protein, 11 aa, Cryptosporidium hominis
NDNNSSNMSIS

SEQ ID NO: 2152314 - protein, 7 aa, Cryptosporidium hominis
NDNPHSY

SEQ ID NO: 2152315 - protein, 13 aa, Cryptosporidium hominis
NDNSHRIPAARGI

SEQ ID NO: 2152316 - protein, 7 aa, Cryptosporidium hominis
NDNSNEL

SEQ ID NO: 2152317 - protein, 20 aa, Cryptosporidium hominis
NDNSNGDNNKGSTKSSKPLV

SEQ ID NO: 2152318 - protein, 8 aa, Cryptosporidium hominis
NDNSPTVR

SEQ ID NO: 2152319 - protein, 7 aa, Cryptosporidium hominis
NDNSQNQ

SEQ ID NO: 2152320 - protein, 19 aa, Cryptosporidium hominis
NDNSTYKENNNLLGNNETT

SEQ ID NO: 2152321 - protein, 6 aa, Cryptosporidium hominis
NDNTGS

SEQ ID NO: 2152322 - protein, 25 aa, Cryptosporidium hominis
NDNTQSSSPSTSNIYSPDSMTGSGI

SEQ ID NO: 2152323 - protein, 12 aa, Cryptosporidium hominis
NDNTSSPIHKSK

SEQ ID NO: 2152324 - protein, 5 aa, Cryptosporidium hominis
NDNTT

SEQ ID NO: 2152325 - protein, 26 aa, Cryptosporidium hominis
NDNVTDSNISNDNNTNSSNNNITENN

SEQ ID NO: 2152326 - protein, 7 aa, Cryptosporidium hominis
NDPDTKD

SEQ ID NO: 2152327 - protein, 6 aa, Cryptosporidium hominis
NDPEKQ

SEQ ID NO: 2152328 - protein, 5 aa, Cryptosporidium hominis
NDPEL

SEQ ID NO: 2152329 - protein, 6 aa, Cryptosporidium hominis
NDPETL

SEQ ID NO: 2152330 - protein, 9 aa, Cryptosporidium hominis
NDPEYKNET

SEQ ID NO: 2152331 - protein, 17 aa, Cryptosporidium hominis
NDPHDVNNNLDNELEAA

SEQ ID NO: 2152332 - protein, 5 aa, Cryptosporidium hominis
NDPKF

SEQ ID NO: 2152333 - protein, 6 aa, Cryptosporidium hominis
NDPKGR

SEQ ID NO: 2152334 - protein, 9 aa, Cryptosporidium hominis
NDPMSKTRS

SEQ ID NO: 2152335 - protein, 9 aa, Cryptosporidium hominis
NDPNENDYH

SEQ ID NO: 2152336 - protein, 14 aa, Cryptosporidium hominis
NDPNENYDERNTES

SEQ ID NO: 2152337 - protein, 6 aa, Cryptosporidium hominis
NDPPNP

SEQ ID NO: 2152338 - protein, 5 aa, Cryptosporidium hominis
NDPRI

SEQ ID NO: 2152339 - protein, 17 aa, Cryptosporidium hominis
NDPSQINDQKPDLEEPE

SEQ ID NO: 2152340 - protein, 12 aa, Cryptosporidium hominis
NDQEKNINGYED

SEQ ID NO: 2152341 - protein, 6 aa, Cryptosporidium hominis
NDQGEL

SEQ ID NO: 2152342 - protein, 36 aa, Cryptosporidium hominis
NDQISQDISEKSVKKVDNGLGSQYETTSLPENEDLE

SEQ ID NO: 2152343 - protein, 7 aa, Cryptosporidium hominis
NDQLRSK

SEQ ID NO: 2152344 - protein, 9 aa, Cryptosporidium hominis
NDQNEPTVA

SEQ ID NO: 2152345 - protein, 5 aa, Cryptosporidium hominis
NDQNK

SEQ ID NO: 2152346 - protein, 10 aa, Cryptosporidium hominis
NDQNKASKVL

SEQ ID NO: 2152347 - protein, 10 aa, Cryptosporidium hominis
NDQQNRDEVS

SEQ ID NO: 2152348 - protein, 5 aa, Cryptosporidium hominis
NDQVS

SEQ ID NO: 2152349 - protein, 21 aa, Cryptosporidium hominis
NDQYGKEKQKEKEEKNEDKNE

SEQ ID NO: 2152350 - protein, 7 aa, Cryptosporidium hominis
NDRDRNF

SEQ ID NO: 2152351 - protein, 15 aa, Cryptosporidium hominis
NDREIDGREILVRID

SEQ ID NO: 2152352 - protein, 6 aa, Cryptosporidium hominis
NDREPE

SEQ ID NO: 2152353 - protein, 12 aa, Cryptosporidium hominis
NDRERINDAKDE

SEQ ID NO: 2152354 - protein, 11 aa, Cryptosporidium hominis
NDRERINDSRD

SEQ ID NO: 2152355 - protein, 14 aa, Cryptosporidium hominis
NDRETSKRQWNKNY

SEQ ID NO: 2152356 - protein, 6 aa, Cryptosporidium hominis
NDRKQI

SEQ ID NO: 2152357 - protein, 10 aa, Cryptosporidium hominis
NDRNTRKNAK

SEQ ID NO: 2152358 - protein, 8 aa, Cryptosporidium hominis
NDRTCEPN

SEQ ID NO: 2152359 - protein, 9 aa, Cryptosporidium hominis
NDSAKYGAK

SEQ ID NO: 2152360 - protein, 5 aa, Cryptosporidium hominis
NDSCD

SEQ ID NO: 2152361 - protein, 11 aa, Cryptosporidium hominis
NDSCYSTQNSQ

SEQ ID NO: 2152362 - protein, 33 aa, Cryptosporidium hominis
NDSDCEEDEKDQQEDDDPSGKRLEESSKKKKYK

SEQ ID NO: 2152363 - protein, 16 aa, Cryptosporidium hominis
NDSDPESSYEKDHSPI

SEQ ID NO: 2152364 - protein, 7 aa, Cryptosporidium hominis
NDSDPIS

SEQ ID NO: 2152365 - protein, 9 aa, Cryptosporidium hominis
NDSENKNGK

SEQ ID NO: 2152366 - protein, 9 aa, Cryptosporidium hominis
NDSEYEEGY

SEQ ID NO: 2152367 - protein, 7 aa, Cryptosporidium hominis
NDSFNNS

SEQ ID NO: 2152368 - protein, 6 aa, Cryptosporidium hominis
NDSFSS

SEQ ID NO: 2152369 - protein, 8 aa, Cryptosporidium hominis
NDSFTSSH

SEQ ID NO: 2152370 - protein, 8 aa, Cryptosporidium hominis
NDSGRHNY

SEQ ID NO: 2152371 - protein, 8 aa, Cryptosporidium hominis
NDSGSSEI

SEQ ID NO: 2152372 - protein, 6 aa, Cryptosporidium hominis
NDSIGR

SEQ ID NO: 2152373 - protein, 12 aa, Cryptosporidium hominis
NDSIGSDSNHSI

SEQ ID NO: 2152374 - protein, 72 aa, Cryptosporidium hominis
NDSKKKKTGNSRKRKNETTKKQESLKVKNPQKSNLKKTSAKPTKKSRIDDSDEEDDYIDGDNYSDEDDYYDD

SEQ ID NO: 2152375 - protein, 6 aa, Cryptosporidium hominis
NDSLTR

SEQ ID NO: 2152376 - protein, 6 aa, Cryptosporidium hominis
NDSNHI

SEQ ID NO: 2152377 - protein, 5 aa, Cryptosporidium hominis
NDSNI

SEQ ID NO: 2152378 - protein, 7 aa, Cryptosporidium hominis
NDSNKED

SEQ ID NO: 2152379 - protein, 12 aa, Cryptosporidium hominis
NDSNNNQLQNDN

SEQ ID NO: 2152380 - protein, 22 aa, Cryptosporidium hominis
NDSNNTTSVSVPSTMNNNQTNS

SEQ ID NO: 2152381 - protein, 35 aa, Cryptosporidium hominis
NDSNQSSSIKENEVSSSETHLNDNQPHDTPTISGV

SEQ ID NO: 2152382 - protein, 9 aa, Cryptosporidium hominis
NDSNTRSST

SEQ ID NO: 2152383 - protein, 7 aa, Cryptosporidium hominis
NDSPDIT

SEQ ID NO: 2152384 - protein, 8 aa, Cryptosporidium hominis
NDSQSSIG

SEQ ID NO: 2152385 - protein, 8 aa, Cryptosporidium hominis
NDSRAQEC

SEQ ID NO: 2152386 - protein, 9 aa, Cryptosporidium hominis
NDSSEDELD

SEQ ID NO: 2152387 - protein, 20 aa, Cryptosporidium hominis
NDSSEEKDVDDSPKDSDFDQ

SEQ ID NO: 2152388 - protein, 8 aa, Cryptosporidium hominis
NDSSLNDE

SEQ ID NO: 2152389 - protein, 21 aa, Cryptosporidium hominis
NDSSMQNGNERKQSVGNEQKL

SEQ ID NO: 2152390 - protein, 6 aa, Cryptosporidium hominis
NDSSNT

SEQ ID NO: 2152391 - protein, 10 aa, Cryptosporidium hominis
NDSSSKGESS

SEQ ID NO: 2152392 - protein, 7 aa, Cryptosporidium hominis
NDSTDRL

SEQ ID NO: 2152393 - protein, 7 aa, Cryptosporidium hominis
NDSTEIS

SEQ ID NO: 2152394 - protein, 8 aa, Cryptosporidium hominis
NDSTNILE

SEQ ID NO: 2152395 - protein, 5 aa, Cryptosporidium hominis
NDSVG

SEQ ID NO: 2152396 - protein, 5 aa, Cryptosporidium hominis
NDSVT

SEQ ID NO: 2152397 - protein, 8 aa, Cryptosporidium hominis
NDTAVQKT

SEQ ID NO: 2152398 - protein, 4 aa, Cryptosporidium hominis
NDTD

SEQ ID NO: 2152399 - protein, 49 aa, Cryptosporidium hominis
NDTEKISTTEKEFTKRKRPYSNNSNNNINVGSNSSNRIGNCTQNSLSGI

SEQ ID NO: 2152400 - protein, 11 aa, Cryptosporidium hominis
NDTEKKSTQDF

SEQ ID NO: 2152401 - protein, 6 aa, Cryptosporidium hominis
NDTELK

SEQ ID NO: 2152402 - protein, 28 aa, Cryptosporidium hominis
NDTIQESYYRNDDNNGMNKNNDEYELND

SEQ ID NO: 2152403 - protein, 16 aa, Cryptosporidium hominis
NDTITSLEQAQKSLLA

SEQ ID NO: 2152404 - protein, 13 aa, Cryptosporidium hominis
NDTLVNPNHSKTL

SEQ ID NO: 2152405 - protein, 4 aa, Cryptosporidium hominis
NDTN

SEQ ID NO: 2152406 - protein, 13 aa, Cryptosporidium hominis
NDTNNANKKSLDP

SEQ ID NO: 2152407 - protein, 17 aa, Cryptosporidium hominis
NDTSKNSNITYSESDLN

SEQ ID NO: 2152408 - protein, 9 aa, Cryptosporidium hominis
NDTTDTYDY

SEQ ID NO: 2152409 - protein, 11 aa, Cryptosporidium hominis
NDVDEDNKTPL

SEQ ID NO: 2152410 - protein, 6 aa, Cryptosporidium hominis
NDVDRK

SEQ ID NO: 2152411 - protein, 21 aa, Cryptosporidium hominis
NDVEDEAEDIGVDNNEGNYNQ

SEQ ID NO: 2152412 - protein, 4 aa, Cryptosporidium hominis
NDVS

SEQ ID NO: 2152413 - protein, 4 aa, Cryptosporidium hominis
NDVT

SEQ ID NO: 2152414 - protein, 5 aa, Cryptosporidium hominis
NDWED

SEQ ID NO: 2152415 - protein, 5 aa, Cryptosporidium hominis
NDYAA

SEQ ID NO: 2152416 - protein, 4 aa, Cryptosporidium hominis
NDYD

SEQ ID NO: 2152417 - protein, 6 aa, Cryptosporidium hominis
NDYNNH

SEQ ID NO: 2152418 - protein, 7 aa, Cryptosporidium hominis
NDYNPSL

SEQ ID NO: 2152419 - protein, 10 aa, Cryptosporidium hominis
NDYQSEGNEE

SEQ ID NO: 2152420 - protein, 8 aa, Cryptosporidium hominis
NDYSGPHY

SEQ ID NO: 2152421 - protein, 8 aa, Cryptosporidium hominis
NDYYSNNN

SEQ ID NO: 2152422 - protein, 8 aa, Cryptosporidium hominis
NEAATFGA

SEQ ID NO: 2152423 - protein, 59 aa, Cryptosporidium hominis
NEADESADSNNQASNNSGNTNANNANISGNSGSNTANSNSNVTGRSHIGGAGGSSGGFS

SEQ ID NO: 2152424 - protein, 4 aa, Cryptosporidium hominis
NEAK

SEQ ID NO: 2152425 - protein, 10 aa, Cryptosporidium hominis
NEAPKTAKLS

SEQ ID NO: 2152426 - protein, 7 aa, Cryptosporidium hominis
NEARDKK

SEQ ID NO: 2152427 - protein, 11 aa, Cryptosporidium hominis
NEASEYQSNSS

SEQ ID NO: 2152428 - protein, 6 aa, Cryptosporidium hominis
NEASKG

SEQ ID NO: 2152429 - protein, 8 aa, Cryptosporidium hominis
NEASNEGQ

SEQ ID NO: 2152430 - protein, 13 aa, Cryptosporidium hominis
NECKKENKDSTID

SEQ ID NO: 2152431 - protein, 4 aa, Cryptosporidium hominis
NECL

SEQ ID NO: 2152432 - protein, 21 aa, Cryptosporidium hominis
NECNSNDNNSMNNDDSNKPPI

SEQ ID NO: 2152433 - protein, 5 aa, Cryptosporidium hominis
NECTS

SEQ ID NO: 2152434 - protein, 5 aa, Cryptosporidium hominis
NEDAA

SEQ ID NO: 2152435 - protein, 7 aa, Cryptosporidium hominis
NEDAEGC

SEQ ID NO: 2152436 - protein, 32 aa, Cryptosporidium hominis
NEDDDYNEDYDDNNNNMNNMNNSNNNNNNNNY

SEQ ID NO: 2152437 - protein, 10 aa, Cryptosporidium hominis
NEDEDLNEKN

SEQ ID NO: 2152438 - protein, 5 aa, Cryptosporidium hominis
NEDGK

SEQ ID NO: 2152439 - protein, 20 aa, Cryptosporidium hominis
NEDIERNSIHSDENQNENIN

SEQ ID NO: 2152440 - protein, 14 aa, Cryptosporidium hominis
NEDKYQTVNSERDE

SEQ ID NO: 2152441 - protein, 17 aa, Cryptosporidium hominis
NEDLSTSAQTVSPQPTL

SEQ ID NO: 2152442 - protein, 9 aa, Cryptosporidium hominis
NEDNDENPY

SEQ ID NO: 2152443 - protein, 11 aa, Cryptosporidium hominis
NEDNEKNDLNP

SEQ ID NO: 2152444 - protein, 8 aa, Cryptosporidium hominis
NEDNNNEL

SEQ ID NO: 2152445 - protein, 11 aa, Cryptosporidium hominis
NEDNSDVQSEI

SEQ ID NO: 2152446 - protein, 16 aa, Cryptosporidium hominis
NEDNTEELRSNQIPPN

SEQ ID NO: 2152447 - protein, 6 aa, Cryptosporidium hominis
NEDQIP

SEQ ID NO: 2152448 - protein, 14 aa, Cryptosporidium hominis
NEDQNYDQSRNNYL

SEQ ID NO: 2152449 - protein, 12 aa, Cryptosporidium hominis
NEDSLKEAYKSF

SEQ ID NO: 2152450 - protein, 7 aa, Cryptosporidium hominis
NEDSSIV

SEQ ID NO: 2152451 - protein, 11 aa, Cryptosporidium hominis
NEDTATEENPC

SEQ ID NO: 2152452 - protein, 18 aa, Cryptosporidium hominis
NEDTKHPIQNKENIKPKI

SEQ ID NO: 2152453 - protein, 8 aa, Cryptosporidium hominis
NEDTNESS

SEQ ID NO: 2152454 - protein, 20 aa, Cryptosporidium hominis
NEDYKRKYDERKRKEALSKA

SEQ ID NO: 2152455 - protein, 5 aa, Cryptosporidium hominis
NEEAV

SEQ ID NO: 2152456 - protein, 7 aa, Cryptosporidium hominis
NEEDLQT

SEQ ID NO: 2152457 - protein, 5 aa, Cryptosporidium hominis
NEEDS

SEQ ID NO: 2152458 - protein, 6 aa, Cryptosporidium hominis
NEEDTP

SEQ ID NO: 2152459 - protein, 21 aa, Cryptosporidium hominis
NEEEAARAKDALDGKEYQDAS

SEQ ID NO: 2152460 - protein, 5 aa, Cryptosporidium hominis
NEEEC

SEQ ID NO: 2152461 - protein, 5 aa, Cryptosporidium hominis
NEEEK

SEQ ID NO: 2152462 - protein, 10 aa, Cryptosporidium hominis
NEEETKAVKC

SEQ ID NO: 2152463 - protein, 12 aa, Cryptosporidium hominis
NEEFSENVTNDN

SEQ ID NO: 2152464 - protein, 4 aa, Cryptosporidium hominis
NEEI

SEQ ID NO: 2152465 - protein, 10 aa, Cryptosporidium hominis
NEEKLQRQIK

SEQ ID NO: 2152466 - protein, 6 aa, Cryptosporidium hominis
NEEKNE

SEQ ID NO: 2152467 - protein, 13 aa, Cryptosporidium hominis
NEEKNNENDSSKL

SEQ ID NO: 2152468 - protein, 6 aa, Cryptosporidium hominis
NEEKSF

SEQ ID NO: 2152469 - protein, 20 aa, Cryptosporidium hominis
NEEKYSPSGGQISVENNNEI

SEQ ID NO: 2152470 - protein, 4 aa, Cryptosporidium hominis
NEEL

SEQ ID NO: 2152471 - protein, 8 aa, Cryptosporidium hominis
NEENEDAD

SEQ ID NO: 2152472 - protein, 8 aa, Cryptosporidium hominis
NEENNEEK

SEQ ID NO: 2152473 - protein, 7 aa, Cryptosporidium hominis
NEENNEI

SEQ ID NO: 2152474 - protein, 7 aa, Cryptosporidium hominis
NEEQEEG

SEQ ID NO: 2152475 - protein, 12 aa, Cryptosporidium hominis
NEESENEELENL

SEQ ID NO: 2152476 - protein, 5 aa, Cryptosporidium hominis
NEESF

SEQ ID NO: 2152477 - protein, 16 aa, Cryptosporidium hominis
NEESKEESKLELSSTS

SEQ ID NO: 2152478 - protein, 8 aa, Cryptosporidium hominis
NEESRKLY

SEQ ID NO: 2152479 - protein, 11 aa, Cryptosporidium hominis
NEETSNSLSTF

SEQ ID NO: 2152480 - protein, 7 aa, Cryptosporidium hominis
NEEVSPE

SEQ ID NO: 2152481 - protein, 6 aa, Cryptosporidium hominis
NEFEGG

SEQ ID NO: 2152482 - protein, 5 aa, Cryptosporidium hominis
NEFEK

SEQ ID NO: 2152483 - protein, 11 aa, Cryptosporidium hominis
NEFKGEESSQK

SEQ ID NO: 2152484 - protein, 7 aa, Cryptosporidium hominis
NEFNSDN

SEQ ID NO: 2152485 - protein, 5 aa, Cryptosporidium hominis
NEFQE

SEQ ID NO: 2152486 - protein, 6 aa, Cryptosporidium hominis
NEFTTN

SEQ ID NO: 2152487 - protein, 7 aa, Cryptosporidium hominis
NEGDEHT

SEQ ID NO: 2152488 - protein, 11 aa, Cryptosporidium hominis
NEGDSNESQLS

SEQ ID NO: 2152489 - protein, 9 aa, Cryptosporidium hominis
NEGESSIPH

SEQ ID NO: 2152490 - protein, 7 aa, Cryptosporidium hominis
NEGHRGI

SEQ ID NO: 2152491 - protein, 4 aa, Cryptosporidium hominis
NEGI

SEQ ID NO: 2152492 - protein, 5 aa, Cryptosporidium hominis
NEGKK

SEQ ID NO: 2152493 - protein, 13 aa, Cryptosporidium hominis
NEGKKQKINETDK

SEQ ID NO: 2152494 - protein, 15 aa, Cryptosporidium hominis
NEGNMNNSNFDGNSS

SEQ ID NO: 2152495 - protein, 5 aa, Cryptosporidium hominis
NEGNY

SEQ ID NO: 2152496 - protein, 6 aa, Cryptosporidium hominis
NEGSIR

SEQ ID NO: 2152497 - protein, 7 aa, Cryptosporidium hominis
NEGSRVK

SEQ ID NO: 2152498 - protein, 5 aa, Cryptosporidium hominis
NEGVE

SEQ ID NO: 2152499 - protein, 16 aa, Cryptosporidium hominis
NEGVSQKKIRPATGIP

SEQ ID NO: 2152500 - protein, 12 aa, Cryptosporidium hominis
NEHDAALGNGGL

SEQ ID NO: 2152501 - protein, 7 aa, Cryptosporidium hominis
NEHKEAN

SEQ ID NO: 2152502 - protein, 4 aa, Cryptosporidium hominis
NEHY

SEQ ID NO: 2152503 - protein, 17 aa, Cryptosporidium hominis
NEIDGGSNLGEEGSKLS

SEQ ID NO: 2152504 - protein, 6 aa, Cryptosporidium hominis
NEIESS

SEQ ID NO: 2152505 - protein, 8 aa, Cryptosporidium hominis
NEIGEEDY

SEQ ID NO: 2152506 - protein, 7 aa, Cryptosporidium hominis
NEIGKDG

SEQ ID NO: 2152507 - protein, 6 aa, Cryptosporidium hominis
NEIKDE

SEQ ID NO: 2152508 - protein, 4 aa, Cryptosporidium hominis
NEIL

SEQ ID NO: 2152509 - protein, 4 aa, Cryptosporidium hominis
NEIN

SEQ ID NO: 2152510 - protein, 14 aa, Cryptosporidium hominis
NEINPDEENNEEYK

SEQ ID NO: 2152511 - protein, 8 aa, Cryptosporidium hominis
NEIPEDAR

SEQ ID NO: 2152512 - protein, 12 aa, Cryptosporidium hominis
NEIQQKNNLNDS

SEQ ID NO: 2152513 - protein, 12 aa, Cryptosporidium hominis
NEIQSGGVLQDK

SEQ ID NO: 2152514 - protein, 8 aa, Cryptosporidium hominis
NEISDQKY

SEQ ID NO: 2152515 - protein, 11 aa, Cryptosporidium hominis
NEISQESKSEW

SEQ ID NO: 2152516 - protein, 6 aa, Cryptosporidium hominis
NEISRN

SEQ ID NO: 2152517 - protein, 6 aa, Cryptosporidium hominis
NEISSP

SEQ ID NO: 2152518 - protein, 18 aa, Cryptosporidium hominis
NEITKTKDQMQNHDSQNE

SEQ ID NO: 2152519 - protein, 8 aa, Cryptosporidium hominis
NEITNNEY

SEQ ID NO: 2152520 - protein, 10 aa, Cryptosporidium hominis
NEITTPNSTL

SEQ ID NO: 2152521 - protein, 9 aa, Cryptosporidium hominis
NEKAPSDDF

SEQ ID NO: 2152522 - protein, 8 aa, Cryptosporidium hominis
NEKDDTQK

SEQ ID NO: 2152523 - protein, 19 aa, Cryptosporidium hominis
NEKDQDNESFPKYNNHKTQ

SEQ ID NO: 2152524 - protein, 13 aa, Cryptosporidium hominis
NEKESFYKKQQEL

SEQ ID NO: 2152525 - protein, 4 aa, Cryptosporidium hominis
NEKH

SEQ ID NO: 2152526 - protein, 14 aa, Cryptosporidium hominis
NEKHYDSKPDSNAF

SEQ ID NO: 2152527 - protein, 8 aa, Cryptosporidium hominis
NEKKNGLK

SEQ ID NO: 2152528 - protein, 7 aa, Cryptosporidium hominis
NEKKVPN

SEQ ID NO: 2152529 - protein, 5 aa, Cryptosporidium hominis
NEKLE

SEQ ID NO: 2152530 - protein, 6 aa, Cryptosporidium hominis
NEKLEE

SEQ ID NO: 2152531 - protein, 14 aa, Cryptosporidium hominis
NEKLRNKKRVREEE

SEQ ID NO: 2152532 - protein, 7 aa, Cryptosporidium hominis
NEKNHNE

SEQ ID NO: 2152533 - protein, 16 aa, Cryptosporidium hominis
NEKNIPSNSKSSISQN

SEQ ID NO: 2152534 - protein, 5 aa, Cryptosporidium hominis
NEKNL

SEQ ID NO: 2152535 - protein, 6 aa, Cryptosporidium hominis
NEKNPG

SEQ ID NO: 2152536 - protein, 10 aa, Cryptosporidium hominis
NEKNQEARER

SEQ ID NO: 2152537 - protein, 7 aa, Cryptosporidium hominis
NEKQYSN

SEQ ID NO: 2152538 - protein, 7 aa, Cryptosporidium hominis
NEKRDTL

SEQ ID NO: 2152539 - protein, 7 aa, Cryptosporidium hominis
NEKRGKR

SEQ ID NO: 2152540 - protein, 9 aa, Cryptosporidium hominis
NEKRKPPSI

SEQ ID NO: 2152541 - protein, 11 aa, Cryptosporidium hominis
NEKSETEKRDE

SEQ ID NO: 2152542 - protein, 11 aa, Cryptosporidium hominis
NEKSKEGREMK

SEQ ID NO: 2152543 - protein, 23 aa, Cryptosporidium hominis
NEKSKKRAKNTKFKGNSKINNED

SEQ ID NO: 2152544 - protein, 10 aa, Cryptosporidium hominis
NEKSKTKIDN

SEQ ID NO: 2152545 - protein, 5 aa, Cryptosporidium hominis
NEKSN

SEQ ID NO: 2152546 - protein, 11 aa, Cryptosporidium hominis
NEKSPKSKSLE

SEQ ID NO: 2152547 - protein, 24 aa, Cryptosporidium hominis
NEKSRQSNDISANGNGNSSSNSMI

SEQ ID NO: 2152548 - protein, 17 aa, Cryptosporidium hominis
NEKTGDSSIAGSPQCGP

SEQ ID NO: 2152549 - protein, 15 aa, Cryptosporidium hominis
NEKTIRKNQRIKQKG

SEQ ID NO: 2152550 - protein, 10 aa, Cryptosporidium hominis
NEKTKTEVES

SEQ ID NO: 2152551 - protein, 6 aa, Cryptosporidium hominis
NEKYEG

SEQ ID NO: 2152552 - protein, 5 aa, Cryptosporidium hominis
NEKYY

SEQ ID NO: 2152553 - protein, 9 aa, Cryptosporidium hominis
NELDEEKDN

SEQ ID NO: 2152554 - protein, 15 aa, Cryptosporidium hominis
NELDGDNTGSKYAGA

SEQ ID NO: 2152555 - protein, 5 aa, Cryptosporidium hominis
NELDL

SEQ ID NO: 2152556 - protein, 8 aa, Cryptosporidium hominis
NELDSRNF

SEQ ID NO: 2152557 - protein, 11 aa, Cryptosporidium hominis
NELESDKEETL

SEQ ID NO: 2152558 - protein, 12 aa, Cryptosporidium hominis
NELESEKVNRNE

SEQ ID NO: 2152559 - protein, 12 aa, Cryptosporidium hominis
NELGEELDDETL

SEQ ID NO: 2152560 - protein, 7 aa, Cryptosporidium hominis
NELGGSN

SEQ ID NO: 2152561 - protein, 6 aa, Cryptosporidium hominis
NELKGL

SEQ ID NO: 2152562 - protein, 8 aa, Cryptosporidium hominis
NELKPGDL

SEQ ID NO: 2152563 - protein, 15 aa, Cryptosporidium hominis
NELKPSGAYGELAKK

SEQ ID NO: 2152564 - protein, 36 aa, Cryptosporidium hominis
NELKRSNESNINRNIQTDEKFTGNISRPGEKSNGVT

SEQ ID NO: 2152565 - protein, 7 aa, Cryptosporidium hominis
NELNDGK

SEQ ID NO: 2152566 - protein, 8 aa, Cryptosporidium hominis
NELNNSEI

SEQ ID NO: 2152567 - protein, 30 aa, Cryptosporidium hominis
NELQQEDNSRNKRREEKKYQRSNHPSKTPE

SEQ ID NO: 2152568 - protein, 4 aa, Cryptosporidium hominis
NELS

SEQ ID NO: 2152569 - protein, 32 aa, Cryptosporidium hominis
NELSDAEYKETQAQQSNTNSLSNYEPDHSETL

SEQ ID NO: 2152570 - protein, 26 aa, Cryptosporidium hominis
NELTEEEVTEAQSNELNQEERESSIE

SEQ ID NO: 2152571 - protein, 7 aa, Cryptosporidium hominis
NEMNASK

SEQ ID NO: 2152572 - protein, 8 aa, Cryptosporidium hominis
NENDRNDL

SEQ ID NO: 2152573 - protein, 4 aa, Cryptosporidium hominis
NENE

SEQ ID NO: 2152574 - protein, 17 aa, Cryptosporidium hominis
NENEGGDDSEGISNSLG

SEQ ID NO: 2152575 - protein, 9 aa, Cryptosporidium hominis
NENEGGESL

SEQ ID NO: 2152576 - protein, 5 aa, Cryptosporidium hominis
NENEI

SEQ ID NO: 2152577 - protein, 6 aa, Cryptosporidium hominis
NENEKY

SEQ ID NO: 2152578 - protein, 17 aa, Cryptosporidium hominis
NENENKYQGNLPPVNET

SEQ ID NO: 2152579 - protein, 6 aa, Cryptosporidium hominis
NENEPF

SEQ ID NO: 2152580 - protein, 5 aa, Cryptosporidium hominis
NENER

SEQ ID NO: 2152581 - protein, 4 aa, Cryptosporidium hominis
NENF

SEQ ID NO: 2152582 - protein, 20 aa, Cryptosporidium hominis
NENINEEYNDELTEEKDQEL

SEQ ID NO: 2152583 - protein, 13 aa, Cryptosporidium hominis
NENIQDDEDQQKV

SEQ ID NO: 2152584 - protein, 12 aa, Cryptosporidium hominis
NENIQESQIQNK

SEQ ID NO: 2152585 - protein, 4 aa, Cryptosporidium hominis
NENK

SEQ ID NO: 2152586 - protein, 8 aa, Cryptosporidium hominis
NENKANMG

SEQ ID NO: 2152587 - protein, 7 aa, Cryptosporidium hominis
NENKKKE

SEQ ID NO: 2152588 - protein, 8 aa, Cryptosporidium hominis
NENKRPLT

SEQ ID NO: 2152589 - protein, 5 aa, Cryptosporidium hominis
NENKT

SEQ ID NO: 2152590 - protein, 7 aa, Cryptosporidium hominis
NENLPNI

SEQ ID NO: 2152591 - protein, 11 aa, Cryptosporidium hominis
NENLQAQEHSK

SEQ ID NO: 2152592 - protein, 11 aa, Cryptosporidium hominis
NENNLEKKTNL

SEQ ID NO: 2152593 - protein, 15 aa, Cryptosporidium hominis
NENNNSSNQKYQSEK

SEQ ID NO: 2152594 - protein, 7 aa, Cryptosporidium hominis
NENNSQY

SEQ ID NO: 2152595 - protein, 11 aa, Cryptosporidium hominis
NENNYNRINNG

SEQ ID NO: 2152596 - protein, 17 aa, Cryptosporidium hominis
NENPEDVNDSNGNLNST

SEQ ID NO: 2152597 - protein, 8 aa, Cryptosporidium hominis
NENPTLKR

SEQ ID NO: 2152598 - protein, 5 aa, Cryptosporidium hominis
NENQN

SEQ ID NO: 2152599 - protein, 9 aa, Cryptosporidium hominis
NENQSQNIK

SEQ ID NO: 2152600 - protein, 7 aa, Cryptosporidium hominis
NENRRIQ

SEQ ID NO: 2152601 - protein, 4 aa, Cryptosporidium hominis
NENS

SEQ ID NO: 2152602 - protein, 8 aa, Cryptosporidium hominis
NENSEKIY

SEQ ID NO: 2152603 - protein, 14 aa, Cryptosporidium hominis
NENSGKDKSITDQD

SEQ ID NO: 2152604 - protein, 8 aa, Cryptosporidium hominis
NENSIGKK

SEQ ID NO: 2152605 - protein, 21 aa, Cryptosporidium hominis
NENSISNSGSGSSSSSNSIPN

SEQ ID NO: 2152606 - protein, 15 aa, Cryptosporidium hominis
NENSKKKQDSNDEKK

SEQ ID NO: 2152607 - protein, 8 aa, Cryptosporidium hominis
NENSKPPI

SEQ ID NO: 2152608 - protein, 6 aa, Cryptosporidium hominis
NENSNI

SEQ ID NO: 2152609 - protein, 13 aa, Cryptosporidium hominis
NENSSCDELIDES

SEQ ID NO: 2152610 - protein, 4 aa, Cryptosporidium hominis
NENT

SEQ ID NO: 2152611 - protein, 21 aa, Cryptosporidium hominis
NENTKDNAMKENDNSTPKNKS

SEQ ID NO: 2152612 - protein, 12 aa, Cryptosporidium hominis
NENTPALKTEDS

SEQ ID NO: 2152613 - protein, 5 aa, Cryptosporidium hominis
NENTS

SEQ ID NO: 2152614 - protein, 4 aa, Cryptosporidium hominis
NENV

SEQ ID NO: 2152615 - protein, 5 aa, Cryptosporidium hominis
NENVQ

SEQ ID NO: 2152616 - protein, 5 aa, Cryptosporidium hominis
NENYK

SEQ ID NO: 2152617 - protein, 5 aa, Cryptosporidium hominis
NENYR

SEQ ID NO: 2152618 - protein, 5 aa, Cryptosporidium hominis
NEPAS

SEQ ID NO: 2152619 - protein, 30 aa, Cryptosporidium hominis
NEPDTPYYYGSSSSSDDEESNTKSKARQKF

SEQ ID NO: 2152620 - protein, 4 aa, Cryptosporidium hominis
NEPI

SEQ ID NO: 2152621 - protein, 14 aa, Cryptosporidium hominis
NEPKAEEDSKEEVK

SEQ ID NO: 2152622 - protein, 13 aa, Cryptosporidium hominis
NEPKDNKDSKGNI

SEQ ID NO: 2152623 - protein, 10 aa, Cryptosporidium hominis
NEPNKTQGHT

SEQ ID NO: 2152624 - protein, 12 aa, Cryptosporidium hominis
NEQDSSVNDQTN

SEQ ID NO: 2152625 - protein, 7 aa, Cryptosporidium hominis
NEQGDLN

SEQ ID NO: 2152626 - protein, 7 aa, Cryptosporidium hominis
NEQIPKK

SEQ ID NO: 2152627 - protein, 10 aa, Cryptosporidium hominis
NEQKRPRSTV

SEQ ID NO: 2152628 - protein, 4 aa, Cryptosporidium hominis
NEQN

SEQ ID NO: 2152629 - protein, 9 aa, Cryptosporidium hominis
NEQNEDLGE

SEQ ID NO: 2152630 - protein, 20 aa, Cryptosporidium hominis
NEQSGEIANRRRDNQEYQEK

SEQ ID NO: 2152631 - protein, 5 aa, Cryptosporidium hominis
NEQTN

SEQ ID NO: 2152632 - protein, 6 aa, Cryptosporidium hominis
NERDLP

SEQ ID NO: 2152633 - protein, 6 aa, Cryptosporidium hominis
NERDSA

SEQ ID NO: 2152634 - protein, 8 aa, Cryptosporidium hominis
NEREATEK

SEQ ID NO: 2152635 - protein, 7 aa, Cryptosporidium hominis
NERKDAI

SEQ ID NO: 2152636 - protein, 12 aa, Cryptosporidium hominis
NERKQDCEHGSD

SEQ ID NO: 2152637 - protein, 9 aa, Cryptosporidium hominis
NERKSNELL

SEQ ID NO: 2152638 - protein, 33 aa, Cryptosporidium hominis
NERKSTRSSMSLRSQERKGRLSTKDEGKADEYA

SEQ ID NO: 2152639 - protein, 7 aa, Cryptosporidium hominis
NERKVNN

SEQ ID NO: 2152640 - protein, 14 aa, Cryptosporidium hominis
NERNNRSNNGGVTL

SEQ ID NO: 2152641 - protein, 9 aa, Cryptosporidium hominis
NERPPSSGI

SEQ ID NO: 2152642 - protein, 9 aa, Cryptosporidium hominis
NERQKRREL

SEQ ID NO: 2152643 - protein, 17 aa, Cryptosporidium hominis
NERQPNPNYWYRKEYEL

SEQ ID NO: 2152644 - protein, 14 aa, Cryptosporidium hominis
NERQSYNKLGNSIE

SEQ ID NO: 2152645 - protein, 8 aa, Cryptosporidium hominis
NERTNKSL

SEQ ID NO: 2152646 - protein, 12 aa, Cryptosporidium hominis
NERTRIEKAGGK

SEQ ID NO: 2152647 - protein, 8 aa, Cryptosporidium hominis
NESAEYGE

SEQ ID NO: 2152648 - protein, 10 aa, Cryptosporidium hominis
NESESTKEPA

SEQ ID NO: 2152649 - protein, 6 aa, Cryptosporidium hominis
NESETI

SEQ ID NO: 2152650 - protein, 9 aa, Cryptosporidium hominis
NESETSVPK

SEQ ID NO: 2152651 - protein, 4 aa, Cryptosporidium hominis
NESG

SEQ ID NO: 2152652 - protein, 7 aa, Cryptosporidium hominis
NESGLKT

SEQ ID NO: 2152653 - protein, 12 aa, Cryptosporidium hominis
NESGTSPNQEDV

SEQ ID NO: 2152654 - protein, 19 aa, Cryptosporidium hominis
NESGVSELKNTENDQNSNR

SEQ ID NO: 2152655 - protein, 7 aa, Cryptosporidium hominis
NESGYSN

SEQ ID NO: 2152656 - protein, 4 aa, Cryptosporidium hominis
NESH

SEQ ID NO: 2152657 - protein, 4 aa, Cryptosporidium hominis
NESI

SEQ ID NO: 2152658 - protein, 6 aa, Cryptosporidium hominis
NESKQQ

SEQ ID NO: 2152659 - protein, 11 aa, Cryptosporidium hominis
NESKSDDKEFF

SEQ ID NO: 2152660 - protein, 4 aa, Cryptosporidium hominis
NESL

SEQ ID NO: 2152661 - protein, 11 aa, Cryptosporidium hominis
NESLGNDIGTQ

SEQ ID NO: 2152662 - protein, 21 aa, Cryptosporidium hominis
NESLNRKHRKGRGGKREEDIK

SEQ ID NO: 2152663 - protein, 8 aa, Cryptosporidium hominis
NESMGDGG

SEQ ID NO: 2152664 - protein, 7 aa, Cryptosporidium hominis
NESNDQL

SEQ ID NO: 2152665 - protein, 5 aa, Cryptosporidium hominis
NESNI

SEQ ID NO: 2152666 - protein, 33 aa, Cryptosporidium hominis
NESNLESSSNCKKNINSSFEKNYEANINKEETK

SEQ ID NO: 2152667 - protein, 7 aa, Cryptosporidium hominis
NESNSWS

SEQ ID NO: 2152668 - protein, 8 aa, Cryptosporidium hominis
NESQEDHH

SEQ ID NO: 2152669 - protein, 17 aa, Cryptosporidium hominis
NESQEDSVNKNKKKLEY

SEQ ID NO: 2152670 - protein, 9 aa, Cryptosporidium hominis
NESQEDYKV

SEQ ID NO: 2152671 - protein, 6 aa, Cryptosporidium hominis
NESRFE

SEQ ID NO: 2152672 - protein, 7 aa, Cryptosporidium hominis
NESRISE

SEQ ID NO: 2152673 - protein, 7 aa, Cryptosporidium hominis
NESSAAD

SEQ ID NO: 2152674 - protein, 7 aa, Cryptosporidium hominis
NESSPDM

SEQ ID NO: 2152675 - protein, 11 aa, Cryptosporidium hominis
NESTSNASLSR

SEQ ID NO: 2152676 - protein, 6 aa, Cryptosporidium hominis
NESWNE

SEQ ID NO: 2152677 - protein, 8 aa, Cryptosporidium hominis
NETDESEL

SEQ ID NO: 2152678 - protein, 6 aa, Cryptosporidium hominis
NETDQV

SEQ ID NO: 2152679 - protein, 12 aa, Cryptosporidium hominis
NETEISKSGANN

SEQ ID NO: 2152680 - protein, 4 aa, Cryptosporidium hominis
NETF

SEQ ID NO: 2152681 - protein, 5 aa, Cryptosporidium hominis
NETGD

SEQ ID NO: 2152682 - protein, 11 aa, Cryptosporidium hominis
NETGGSSTGVR

SEQ ID NO: 2152683 - protein, 5 aa, Cryptosporidium hominis
NETGK

SEQ ID NO: 2152684 - protein, 6 aa, Cryptosporidium hominis
NETGTG

SEQ ID NO: 2152685 - protein, 7 aa, Cryptosporidium hominis
NETHTKE

SEQ ID NO: 2152686 - protein, 5 aa, Cryptosporidium hominis
NETLS

SEQ ID NO: 2152687 - protein, 5 aa, Cryptosporidium hominis
NETNF

SEQ ID NO: 2152688 - protein, 14 aa, Cryptosporidium hominis
NETNKNVSSHSKSA

SEQ ID NO: 2152689 - protein, 23 aa, Cryptosporidium hominis
NETNSKSTNQGKNIGRNNHSKRV

SEQ ID NO: 2152690 - protein, 5 aa, Cryptosporidium hominis
NETSF

SEQ ID NO: 2152691 - protein, 8 aa, Cryptosporidium hominis
NETSGQFK

SEQ ID NO: 2152692 - protein, 6 aa, Cryptosporidium hominis
NETSNK

SEQ ID NO: 2152693 - protein, 6 aa, Cryptosporidium hominis
NEVDSI

SEQ ID NO: 2152694 - protein, 5 aa, Cryptosporidium hominis
NEVEA

SEQ ID NO: 2152695 - protein, 9 aa, Cryptosporidium hominis
NEVERNGDA

SEQ ID NO: 2152696 - protein, 7 aa, Cryptosporidium hominis
NEVGNTH

SEQ ID NO: 2152697 - protein, 4 aa, Cryptosporidium hominis
NEVP

SEQ ID NO: 2152698 - protein, 5 aa, Cryptosporidium hominis
NEVPG

SEQ ID NO: 2152699 - protein, 41 aa, Cryptosporidium hominis
NEVTPNAPASALDTTSKMSRGARKGNTVHRGGRGGYTSSHG

SEQ ID NO: 2152700 - protein, 4 aa, Cryptosporidium hominis
NEWK

SEQ ID NO: 2152701 - protein, 5 aa, Cryptosporidium hominis
NEWNS

SEQ ID NO: 2152702 - protein, 5 aa, Cryptosporidium hominis
NEYEK

SEQ ID NO: 2152703 - protein, 18 aa, Cryptosporidium hominis
NEYKSQTNQINTVRNENN

SEQ ID NO: 2152704 - protein, 5 aa, Cryptosporidium hominis
NEYNN

SEQ ID NO: 2152705 - protein, 10 aa, Cryptosporidium hominis
NEYNNNGEFD

SEQ ID NO: 2152706 - protein, 13 aa, Cryptosporidium hominis
NEYPSSPVTKSSL

SEQ ID NO: 2152707 - protein, 8 aa, Cryptosporidium hominis
NEYSKGNY

SEQ ID NO: 2152708 - protein, 4 aa, Cryptosporidium hominis
NEYY

SEQ ID NO: 2152709 - protein, 6 aa, Cryptosporidium hominis
NFAPQK

SEQ ID NO: 2152710 - protein, 19 aa, Cryptosporidium hominis
  misc_feature (17)..(17): Xaa can be any naturally occurring amino acid
NFDEKNDEISEISECYXDG

SEQ ID NO: 2152711 - protein, 5 aa, Cryptosporidium hominis
NFDEQ

SEQ ID NO: 2152712 - protein, 9 aa, Cryptosporidium hominis
NFDERDKQG

SEQ ID NO: 2152713 - protein, 21 aa, Cryptosporidium hominis
NFDKSNEVEVGNSKISQVQSQ

SEQ ID NO: 2152714 - protein, 5 aa, Cryptosporidium hominis
NFDPE

SEQ ID NO: 2152715 - protein, 12 aa, Cryptosporidium hominis
NFDSKEANNEGD

SEQ ID NO: 2152716 - protein, 6 aa, Cryptosporidium hominis
NFEDRN

SEQ ID NO: 2152717 - protein, 13 aa, Cryptosporidium hominis
NFEEEKYSESSFD

SEQ ID NO: 2152718 - protein, 8 aa, Cryptosporidium hominis
NFEPSSKE

SEQ ID NO: 2152719 - protein, 6 aa, Cryptosporidium hominis
NFEQSP

SEQ ID NO: 2152720 - protein, 8 aa, Cryptosporidium hominis
NFEQTRSE

SEQ ID NO: 2152721 - protein, 4 aa, Cryptosporidium hominis
NFET

SEQ ID NO: 2152722 - protein, 26 aa, Cryptosporidium hominis
NFGDENKSEQNPSLQSKKSRTSTDKF

SEQ ID NO: 2152723 - protein, 31 aa, Cryptosporidium hominis
NFGESSSSESDSDSESDSDSDCNSNCNNKCG

SEQ ID NO: 2152724 - protein, 5 aa, Cryptosporidium hominis
NFGNN

SEQ ID NO: 2152725 - protein, 6 aa, Cryptosporidium hominis
NFGQRS

SEQ ID NO: 2152726 - protein, 5 aa, Cryptosporidium hominis
NFKEN

SEQ ID NO: 2152727 - protein, 22 aa, Cryptosporidium hominis
NFKRREKKSSEICDEKPRKAYN

SEQ ID NO: 2152728 - protein, 10 aa, Cryptosporidium hominis
NFKSSSPITH

SEQ ID NO: 2152729 - protein, 5 aa, Cryptosporidium hominis
NFKTN

SEQ ID NO: 2152730 - protein, 8 aa, Cryptosporidium hominis
NFNNKSTS

SEQ ID NO: 2152731 - protein, 7 aa, Cryptosporidium hominis
NFNPNTE

SEQ ID NO: 2152732 - protein, 20 aa, Cryptosporidium hominis
NFNSEKDTDLDKYTTEETII

SEQ ID NO: 2152733 - protein, 7 aa, Cryptosporidium hominis
NFNSNNT

SEQ ID NO: 2152734 - protein, 8 aa, Cryptosporidium hominis
NFNSPSAE

SEQ ID NO: 2152735 - protein, 5 aa, Cryptosporidium hominis
NFPDE

SEQ ID NO: 2152736 - protein, 14 aa, Cryptosporidium hominis
NFPEEKKPESDEDI

SEQ ID NO: 2152737 - protein, 7 aa, Cryptosporidium hominis
NFPHNNK

SEQ ID NO: 2152738 - protein, 4 aa, Cryptosporidium hominis
NFPN

SEQ ID NO: 2152739 - protein, 72 aa, Cryptosporidium hominis
NFPPLKSKRVKETHITDQEKDTKHNKHLKQKKHGKNAGNLNGNELASPPNKIESGSKGFSFSAQSSNQHNSL

SEQ ID NO: 2152740 - protein, 7 aa, Cryptosporidium hominis
NFQGERE

SEQ ID NO: 2152741 - protein, 18 aa, Cryptosporidium hominis
NFQKTSSNRYSPEESFRS

SEQ ID NO: 2152742 - protein, 6 aa, Cryptosporidium hominis
NFSDNG

SEQ ID NO: 2152743 - protein, 7 aa, Cryptosporidium hominis
NFSDTSS

SEQ ID NO: 2152744 - protein, 6 aa, Cryptosporidium hominis
NFSEKN

SEQ ID NO: 2152745 - protein, 6 aa, Cryptosporidium hominis
NFSENS

SEQ ID NO: 2152746 - protein, 16 aa, Cryptosporidium hominis
NFSNGKPGSGATTTTA

SEQ ID NO: 2152747 - protein, 13 aa, Cryptosporidium hominis
NFSNRNNNNNLPD

SEQ ID NO: 2152748 - protein, 11 aa, Cryptosporidium hominis
NFTPKNNNDSG

SEQ ID NO: 2152749 - protein, 12 aa, Cryptosporidium hominis
NFTSSSSSSSLS

SEQ ID NO: 2152750 - protein, 11 aa, Cryptosporidium hominis
NFYQSDDQEIN

SEQ ID NO: 2152751 - protein, 13 aa, Cryptosporidium hominis
NGAAGNSSSCGRS

SEQ ID NO: 2152752 - protein, 25 aa, Cryptosporidium hominis
NGADPNYKNKQGLTPKDAAESQGHS

SEQ ID NO: 2152753 - protein, 11 aa, Cryptosporidium hominis
NGAEKNDLSQN

SEQ ID NO: 2152754 - protein, 10 aa, Cryptosporidium hominis
NGAERNLSHE

SEQ ID NO: 2152755 - protein, 6 aa, Cryptosporidium hominis
NGAGKT

SEQ ID NO: 2152756 - protein, 5 aa, Cryptosporidium hominis
NGAKS

SEQ ID NO: 2152757 - protein, 12 aa, Cryptosporidium hominis
NGANALHTDKVG

SEQ ID NO: 2152758 - protein, 11 aa, Cryptosporidium hominis
NGANRTSKEQL

SEQ ID NO: 2152759 - protein, 4 aa, Cryptosporidium hominis
NGAP

SEQ ID NO: 2152760 - protein, 10 aa, Cryptosporidium hominis
NGASRSTAYR

SEQ ID NO: 2152761 - protein, 8 aa, Cryptosporidium hominis
NGDDSGKV

SEQ ID NO: 2152762 - protein, 4 aa, Cryptosporidium hominis
NGDE

SEQ ID NO: 2152763 - protein, 63 aa, Cryptosporidium hominis
NGDEESNSSENGNVDGDKAEEVDEIKESSAKNEDSSYGRQPAENIPSTDLDENQNYSDEITPF

SEQ ID NO: 2152764 - protein, 8 aa, Cryptosporidium hominis
NGDERPAQ

SEQ ID NO: 2152765 - protein, 7 aa, Cryptosporidium hominis
NGDKTII

SEQ ID NO: 2152766 - protein, 10 aa, Cryptosporidium hominis
NGDQSVSRPY

SEQ ID NO: 2152767 - protein, 12 aa, Cryptosporidium hominis
NGDSITEGEDSM

SEQ ID NO: 2152768 - protein, 6 aa, Cryptosporidium hominis
NGDSNY

SEQ ID NO: 2152769 - protein, 6 aa, Cryptosporidium hominis
NGDSVS

SEQ ID NO: 2152770 - protein, 4 aa, Cryptosporidium hominis
NGDY

SEQ ID NO: 2152771 - protein, 15 aa, Cryptosporidium hominis
NGDYKDKLSKKSVKL

SEQ ID NO: 2152772 - protein, 7 aa, Cryptosporidium hominis
NGEDSNE

SEQ ID NO: 2152773 - protein, 10 aa, Cryptosporidium hominis
NGEGKTLYSD

SEQ ID NO: 2152774 - protein, 5 aa, Cryptosporidium hominis
NGEGV

SEQ ID NO: 2152775 - protein, 10 aa, Cryptosporidium hominis
NGEITTESEV

SEQ ID NO: 2152776 - protein, 5 aa, Cryptosporidium hominis
NGEKN

SEQ ID NO: 2152777 - protein, 4 aa, Cryptosporidium hominis
NGEL

SEQ ID NO: 2152778 - protein, 7 aa, Cryptosporidium hominis
NGELADT

SEQ ID NO: 2152779 - protein, 30 aa, Cryptosporidium hominis
  misc_feature (14)..(14): Xaa can be any naturally occurring amino acid
NGENDIQDILFESXPNFTNNNNNNNNNTIQ

SEQ ID NO: 2152780 - protein, 20 aa, Cryptosporidium hominis
NGENKHGNEVREKDPNAIRR

SEQ ID NO: 2152781 - protein, 9 aa, Cryptosporidium hominis
NGENNSNNS

SEQ ID NO: 2152782 - protein, 57 aa, Cryptosporidium hominis
NGENTSSKIELQDQQENLVSQQQQEKFEEVQQQQQQQQHQHQHQQQQQQQQQQQQQQ

SEQ ID NO: 2152783 - protein, 8 aa, Cryptosporidium hominis
NGEPPAAA

SEQ ID NO: 2152784 - protein, 8 aa, Cryptosporidium hominis
NGEQSSAV

SEQ ID NO: 2152785 - protein, 10 aa, Cryptosporidium hominis
NGESPTINSP

SEQ ID NO: 2152786 - protein, 4 aa, Cryptosporidium hominis
NGET

SEQ ID NO: 2152787 - protein, 9 aa, Cryptosporidium hominis
NGETEGNHV

SEQ ID NO: 2152788 - protein, 7 aa, Cryptosporidium hominis
NGETVPR

SEQ ID NO: 2152789 - protein, 4 aa, Cryptosporidium hominis
NGFK

SEQ ID NO: 2152790 - protein, 6 aa, Cryptosporidium hominis
NGFPGG

SEQ ID NO: 2152791 - protein, 10 aa, Cryptosporidium hominis
NGFSNQHGTH

SEQ ID NO: 2152792 - protein, 10 aa, Cryptosporidium hominis
NGGANTNIGN

SEQ ID NO: 2152793 - protein, 9 aa, Cryptosporidium hominis
NGGEYSAAS

SEQ ID NO: 2152794 - protein, 5 aa, Cryptosporidium hominis
NGGFP

SEQ ID NO: 2152795 - protein, 29 aa, Cryptosporidium hominis
NGGGICGNNDKGIGGSITTSEINNTLGNS

SEQ ID NO: 2152796 - protein, 7 aa, Cryptosporidium hominis
NGGGSRI

SEQ ID NO: 2152797 - protein, 5 aa, Cryptosporidium hominis
NGGIH

SEQ ID NO: 2152798 - protein, 37 aa, Cryptosporidium hominis
NGGNNGLIGTTGTGALQTGPNGPNGNLQGGNLTGRIQ

SEQ ID NO: 2152799 - protein, 15 aa, Cryptosporidium hominis
NGGNSTASSGYNGNN

SEQ ID NO: 2152800 - protein, 7 aa, Cryptosporidium hominis
NGGRIGN

SEQ ID NO: 2152801 - protein, 5 aa, Cryptosporidium hominis
NGGRT

SEQ ID NO: 2152802 - protein, 4 aa, Cryptosporidium hominis
NGGS

SEQ ID NO: 2152803 - protein, 102 aa, Cryptosporidium hominis
NGGSGTNSAQSQGQSHVADTSSVNQQKPLEASPSNSRRSPKMSYSNAVSGGKPSSTNQGSSSISNGRKDHSRNRQRGGGYSGKSYKGSGGSSHYNNGGGSQR

SEQ ID NO: 2152804 - protein, 8 aa, Cryptosporidium hominis
NGGSQAPN

SEQ ID NO: 2152805 - protein, 9 aa, Cryptosporidium hominis
NGGSRSQIY

SEQ ID NO: 2152806 - protein, 11 aa, Cryptosporidium hominis
NGGSSNAFTDN

SEQ ID NO: 2152807 - protein, 5 aa, Cryptosporidium hominis
NGGSV

SEQ ID NO: 2152808 - protein, 11 aa, Cryptosporidium hominis
NGGVDSKFQTR

SEQ ID NO: 2152809 - protein, 16 aa, Cryptosporidium hominis
NGGVEDPKTSSNTPLN

SEQ ID NO: 2152810 - protein, 9 aa, Cryptosporidium hominis
NGGVGTGGG

SEQ ID NO: 2152811 - protein, 16 aa, Cryptosporidium hominis
NGGYESTSDPTNNNGG

SEQ ID NO: 2152812 - protein, 7 aa, Cryptosporidium hominis
NGHSGQI

SEQ ID NO: 2152813 - protein, 21 aa, Cryptosporidium hominis
NGIESRHSSHPALSNGDIGGP

SEQ ID NO: 2152814 - protein, 4 aa, Cryptosporidium hominis
NGIG

SEQ ID NO: 2152815 - protein, 21 aa, Cryptosporidium hominis
NGIGGGSLDDDCRDGLTSMQS

SEQ ID NO: 2152816 - protein, 6 aa, Cryptosporidium hominis
NGIGKS

SEQ ID NO: 2152817 - protein, 7 aa, Cryptosporidium hominis
NGIGKST

SEQ ID NO: 2152818 - protein, 6 aa, Cryptosporidium hominis
NGIKTD

SEQ ID NO: 2152819 - protein, 4 aa, Cryptosporidium hominis
NGIN

SEQ ID NO: 2152820 - protein, 5 aa, Cryptosporidium hominis
NGINE

SEQ ID NO: 2152821 - protein, 8 aa, Cryptosporidium hominis
NGINPSNV

SEQ ID NO: 2152822 - protein, 10 aa, Cryptosporidium hominis
NGIRKTNGIT

SEQ ID NO: 2152823 - protein, 10 aa, Cryptosporidium hominis
NGKEDAANNF

SEQ ID NO: 2152824 - protein, 7 aa, Cryptosporidium hominis
NGKFSGS

SEQ ID NO: 2152825 - protein, 4 aa, Cryptosporidium hominis
NGKK

SEQ ID NO: 2152826 - protein, 13 aa, Cryptosporidium hominis
NGKLGPDTSINKN

SEQ ID NO: 2152827 - protein, 8 aa, Cryptosporidium hominis
NGKLTKKE

SEQ ID NO: 2152828 - protein, 12 aa, Cryptosporidium hominis
NGKNGGPAQDSV

SEQ ID NO: 2152829 - protein, 5 aa, Cryptosporidium hominis
NGKPI

SEQ ID NO: 2152830 - protein, 5 aa, Cryptosporidium hominis
NGKQG

SEQ ID NO: 2152831 - protein, 5 aa, Cryptosporidium hominis
NGKQH

SEQ ID NO: 2152832 - protein, 8 aa, Cryptosporidium hominis
NGKQKRVK

SEQ ID NO: 2152833 - protein, 9 aa, Cryptosporidium hominis
NGKRSQIER

SEQ ID NO: 2152834 - protein, 9 aa, Cryptosporidium hominis
NGKSIESQI

SEQ ID NO: 2152835 - protein, 9 aa, Cryptosporidium hominis
NGKSKHIEK

SEQ ID NO: 2152836 - protein, 9 aa, Cryptosporidium hominis
NGKVINNSN

SEQ ID NO: 2152837 - protein, 9 aa, Cryptosporidium hominis
NGKYPQEEY

SEQ ID NO: 2152838 - protein, 17 aa, Cryptosporidium hominis
NGLDSSEESIEDNEIGS

SEQ ID NO: 2152839 - protein, 6 aa, Cryptosporidium hominis
NGLHPS

SEQ ID NO: 2152840 - protein, 5 aa, Cryptosporidium hominis
NGLNL

SEQ ID NO: 2152841 - protein, 7 aa, Cryptosporidium hominis
NGLPVPV

SEQ ID NO: 2152842 - protein, 5 aa, Cryptosporidium hominis
NGLQR

SEQ ID NO: 2152843 - protein, 21 aa, Cryptosporidium hominis
NGLSAGAGAGLGGGVGSGTTH

SEQ ID NO: 2152844 - protein, 6 aa, Cryptosporidium hominis
NGLSEK

SEQ ID NO: 2152845 - protein, 11 aa, Cryptosporidium hominis
NGLTDGPGSLT

SEQ ID NO: 2152846 - protein, 11 aa, Cryptosporidium hominis
NGMNSTDIKSQ

SEQ ID NO: 2152847 - protein, 10 aa, Cryptosporidium hominis
NGMTSSNSNF

SEQ ID NO: 2152848 - protein, 4 aa, Cryptosporidium hominis
NGNA

SEQ ID NO: 2152849 - protein, 7 aa, Cryptosporidium hominis
NGNANIS

SEQ ID NO: 2152850 - protein, 7 aa, Cryptosporidium hominis
NGNANKN

SEQ ID NO: 2152851 - protein, 14 aa, Cryptosporidium hominis
NGNANYSEQSKETV

SEQ ID NO: 2152852 - protein, 5 aa, Cryptosporidium hominis
NGNCN

SEQ ID NO: 2152853 - protein, 46 aa, Cryptosporidium hominis
NGNCRGSSSSSSSSSTTTSGGNVNSNNSSNNNNASNSNNNSNNNIN

SEQ ID NO: 2152854 - protein, 10 aa, Cryptosporidium hominis
NGNDELNDSS

SEQ ID NO: 2152855 - protein, 17 aa, Cryptosporidium hominis
NGNDYSNSEDDEGPDGI

SEQ ID NO: 2152856 - protein, 30 aa, Cryptosporidium hominis
NGNFHNNSGQSNNQHGRHHNNHNNQQHNRD

SEQ ID NO: 2152857 - protein, 5 aa, Cryptosporidium hominis
NGNFK

SEQ ID NO: 2152858 - protein, 24 aa, Cryptosporidium hominis
NGNGNNMGLNSSSVNSKGVGNDKI

SEQ ID NO: 2152859 - protein, 4 aa, Cryptosporidium hominis
NGNH

SEQ ID NO: 2152860 - protein, 6 aa, Cryptosporidium hominis
NGNINN

SEQ ID NO: 2152861 - protein, 19 aa, Cryptosporidium hominis
NGNISADSSRNQMNNKGFA

SEQ ID NO: 2152862 - protein, 6 aa, Cryptosporidium hominis
NGNKRL

SEQ ID NO: 2152863 - protein, 6 aa, Cryptosporidium hominis
NGNKSQ

SEQ ID NO: 2152864 - protein, 7 aa, Cryptosporidium hominis
NGNLNSN

SEQ ID NO: 2152865 - protein, 9 aa, Cryptosporidium hominis
NGNMNPKSV

SEQ ID NO: 2152866 - protein, 9 aa, Cryptosporidium hominis
NGNNNITDS

SEQ ID NO: 2152867 - protein, 12 aa, Cryptosporidium hominis
NGNPIETQIRTI

SEQ ID NO: 2152868 - protein, 7 aa, Cryptosporidium hominis
NGNPISE

SEQ ID NO: 2152869 - protein, 5 aa, Cryptosporidium hominis
NGNPT

SEQ ID NO: 2152870 - protein, 7 aa, Cryptosporidium hominis
NGNRYEG

SEQ ID NO: 2152871 - protein, 8 aa, Cryptosporidium hominis
NGNSGTNI

SEQ ID NO: 2152872 - protein, 11 aa, Cryptosporidium hominis
NGNSIGNGNVN

SEQ ID NO: 2152873 - protein, 11 aa, Cryptosporidium hominis
NGNSMSRGRRM

SEQ ID NO: 2152874 - protein, 6 aa, Cryptosporidium hominis
NGNSPL

SEQ ID NO: 2152875 - protein, 5 aa, Cryptosporidium hominis
NGNST

SEQ ID NO: 2152876 - protein, 25 aa, Cryptosporidium hominis
NGNTEEVDKSISNNISDNSTSFPAL

SEQ ID NO: 2152877 - protein, 8 aa, Cryptosporidium hominis
NGNTQPEI

SEQ ID NO: 2152878 - protein, 6 aa, Cryptosporidium hominis
NGNVPE

SEQ ID NO: 2152879 - protein, 7 aa, Cryptosporidium hominis
NGNVSNS

SEQ ID NO: 2152880 - protein, 4 aa, Cryptosporidium hominis
NGNY

SEQ ID NO: 2152881 - protein, 31 aa, Cryptosporidium hominis
NGNYDEEEDEEEDEDEEEEEEEDENDNKNNH

SEQ ID NO: 2152882 - protein, 14 aa, Cryptosporidium hominis
NGNYEDWKIDELIL

SEQ ID NO: 2152883 - protein, 5 aa, Cryptosporidium hominis
NGPDA

SEQ ID NO: 2152884 - protein, 5 aa, Cryptosporidium hominis
NGPDG

SEQ ID NO: 2152885 - protein, 9 aa, Cryptosporidium hominis
NGPDNLSES

SEQ ID NO: 2152886 - protein, 9 aa, Cryptosporidium hominis
NGPISGSDA

SEQ ID NO: 2152887 - protein, 16 aa, Cryptosporidium hominis
NGPNSKVSKAHQGRGG

SEQ ID NO: 2152888 - protein, 6 aa, Cryptosporidium hominis
NGPPHN

SEQ ID NO: 2152889 - protein, 7 aa, Cryptosporidium hominis
NGQEKVE

SEQ ID NO: 2152890 - protein, 6 aa, Cryptosporidium hominis
NGQGNI

SEQ ID NO: 2152891 - protein, 23 aa, Cryptosporidium hominis
NGQPESLDKELDGAELENDENLN

SEQ ID NO: 2152892 - protein, 25 aa, Cryptosporidium hominis
NGQVEPESSPIYRNPNYSKGELSNL

SEQ ID NO: 2152893 - protein, 7 aa, Cryptosporidium hominis
NGQWETK

SEQ ID NO: 2152894 - protein, 8 aa, Cryptosporidium hominis
NGRDSGKY

SEQ ID NO: 2152895 - protein, 9 aa, Cryptosporidium hominis
NGRFSQSGK

SEQ ID NO: 2152896 - protein, 8 aa, Cryptosporidium hominis
NGRIPKPI

SEQ ID NO: 2152897 - protein, 14 aa, Cryptosporidium hominis
NGRMQAAGSGDRTA

SEQ ID NO: 2152898 - protein, 9 aa, Cryptosporidium hominis
NGRPEKAPD

SEQ ID NO: 2152899 - protein, 34 aa, Cryptosporidium hominis
NGRQGGLTSSKSVRFEDSKGISTSSSSLGKNSSL

SEQ ID NO: 2152900 - protein, 6 aa, Cryptosporidium hominis
NGRRKE

SEQ ID NO: 2152901 - protein, 7 aa, Cryptosporidium hominis
NGRTGVR

SEQ ID NO: 2152902 - protein, 5 aa, Cryptosporidium hominis
NGRTN

SEQ ID NO: 2152903 - protein, 8 aa, Cryptosporidium hominis
NGRTQTRN

SEQ ID NO: 2152904 - protein, 14 aa, Cryptosporidium hominis
NGRYKNGMNTYGGY

SEQ ID NO: 2152905 - protein, 23 aa, Cryptosporidium hominis
NGSAPSAALQESSSNNNKKNEIS

SEQ ID NO: 2152906 - protein, 8 aa, Cryptosporidium hominis
NGSDDEDM

SEQ ID NO: 2152907 - protein, 6 aa, Cryptosporidium hominis
NGSDYS

SEQ ID NO: 2152908 - protein, 9 aa, Cryptosporidium hominis
NGSEKRNDY

SEQ ID NO: 2152909 - protein, 4 aa, Cryptosporidium hominis
NGSF

SEQ ID NO: 2152910 - protein, 5 aa, Cryptosporidium hominis
NGSGM

SEQ ID NO: 2152911 - protein, 8 aa, Cryptosporidium hominis
NGSIETST

SEQ ID NO: 2152912 - protein, 15 aa, Cryptosporidium hominis
NGSKDNGIQSSCAQN

SEQ ID NO: 2152913 - protein, 5 aa, Cryptosporidium hominis
NGSKK

SEQ ID NO: 2152914 - protein, 13 aa, Cryptosporidium hominis
NGSLSENGLVSSK

SEQ ID NO: 2152915 - protein, 16 aa, Cryptosporidium hominis
NGSNSYRISSEELKDK

SEQ ID NO: 2152916 - protein, 13 aa, Cryptosporidium hominis
NGSNYSKTQSFNS

SEQ ID NO: 2152917 - protein, 26 aa, Cryptosporidium hominis
NGSQQQENGGASVGNSNHKVLHVPYG

SEQ ID NO: 2152918 - protein, 24 aa, Cryptosporidium hominis
NGSQSGGKGDSDKIINTGSTNTNS

SEQ ID NO: 2152919 - protein, 13 aa, Cryptosporidium hominis
NGSSENESKLDNL

SEQ ID NO: 2152920 - protein, 19 aa, Cryptosporidium hominis
NGSSRTSSSRSISKNNDIE

SEQ ID NO: 2152921 - protein, 21 aa, Cryptosporidium hominis
NGSTCENTVDNKKKRRIDLSK

SEQ ID NO: 2152922 - protein, 4 aa, Cryptosporidium hominis
NGSV

SEQ ID NO: 2152923 - protein, 5 aa, Cryptosporidium hominis
NGSVG

SEQ ID NO: 2152924 - protein, 13 aa, Cryptosporidium hominis
NGSVSQNTKTISL

SEQ ID NO: 2152925 - protein, 5 aa, Cryptosporidium hominis
NGTAS

SEQ ID NO: 2152926 - protein, 7 aa, Cryptosporidium hominis
NGTDYYS

SEQ ID NO: 2152927 - protein, 6 aa, Cryptosporidium hominis
NGTEGF

SEQ ID NO: 2152928 - protein, 28 aa, Cryptosporidium hominis
NGTENDSSDNSNTDDVDSDISQKSEPII

SEQ ID NO: 2152929 - protein, 6 aa, Cryptosporidium hominis
NGTETI

SEQ ID NO: 2152930 - protein, 13 aa, Cryptosporidium hominis
NGTRAQSNSNNRP

SEQ ID NO: 2152931 - protein, 49 aa, Cryptosporidium hominis
NGTSGEQSHEKDPGTGKPLDPNTGLPFDEDSGSLINPETGDKLQGSHSG

SEQ ID NO: 2152932 - protein, 7 aa, Cryptosporidium hominis
NGTSQGK

SEQ ID NO: 2152933 - protein, 9 aa, Cryptosporidium hominis
NGTSRLPEE

SEQ ID NO: 2152934 - protein, 7 aa, Cryptosporidium hominis
NGTVSDI

SEQ ID NO: 2152935 - protein, 5 aa, Cryptosporidium hominis
NGVEN

SEQ ID NO: 2152936 - protein, 7 aa, Cryptosporidium hominis
NGVENCD

SEQ ID NO: 2152937 - protein, 5 aa, Cryptosporidium hominis
NGVEQ

SEQ ID NO: 2152938 - protein, 4 aa, Cryptosporidium hominis
NGVK

SEQ ID NO: 2152939 - protein, 9 aa, Cryptosporidium hominis
NGVNNSHNI

SEQ ID NO: 2152940 - protein, 7 aa, Cryptosporidium hominis
NGVNPIN

SEQ ID NO: 2152941 - protein, 9 aa, Cryptosporidium hominis
NGVSDPRDC

SEQ ID NO: 2152942 - protein, 42 aa, Cryptosporidium hominis
NGVSPNGAANATGSVQNGVTGNAVPGVQGAQNNRTGGNNQRI

SEQ ID NO: 2152943 - protein, 5 aa, Cryptosporidium hominis
NGVSW

SEQ ID NO: 2152944 - protein, 9 aa, Cryptosporidium hominis
NGYEGTGRA

SEQ ID NO: 2152945 - protein, 7 aa, Cryptosporidium hominis
NGYNNKD

SEQ ID NO: 2152946 - protein, 11 aa, Cryptosporidium hominis
NGYRKPHNLAT

SEQ ID NO: 2152947 - protein, 6 aa, Cryptosporidium hominis
NGYSGA

SEQ ID NO: 2152948 - protein, 13 aa, Cryptosporidium hominis
NHANDKYKQPINA

SEQ ID NO: 2152949 - protein, 9 aa, Cryptosporidium hominis
NHCTSQSRN

SEQ ID NO: 2152950 - protein, 10 aa, Cryptosporidium hominis
NHDDPGEEGL

SEQ ID NO: 2152951 - protein, 61 aa, Cryptosporidium hominis
NHDRKEREREREREKECERERERERVRERERERERERERERERERERERERERERERERER

SEQ ID NO: 2152952 - protein, 12 aa, Cryptosporidium hominis
NHDRNDDWKPNE

SEQ ID NO: 2152953 - protein, 10 aa, Cryptosporidium hominis
NHDSDSKGVG

SEQ ID NO: 2152954 - protein, 5 aa, Cryptosporidium hominis
NHDSR

SEQ ID NO: 2152955 - protein, 5 aa, Cryptosporidium hominis
NHDTL

SEQ ID NO: 2152956 - protein, 9 aa, Cryptosporidium hominis
NHEDDSESL

SEQ ID NO: 2152957 - protein, 20 aa, Cryptosporidium hominis
NHESNSKTTNNLDSTGSSTL

SEQ ID NO: 2152958 - protein, 12 aa, Cryptosporidium hominis
NHESYKDDKLQS

SEQ ID NO: 2152959 - protein, 6 aa, Cryptosporidium hominis
NHETGN

SEQ ID NO: 2152960 - protein, 5 aa, Cryptosporidium hominis
NHETP

SEQ ID NO: 2152961 - protein, 4 aa, Cryptosporidium hominis
NHFA

SEQ ID NO: 2152962 - protein, 7 aa, Cryptosporidium hominis
NHFPEEG

SEQ ID NO: 2152963 - protein, 29 aa, Cryptosporidium hominis
NHGGDIPETETASEQGFGGRDDKYGPNNK

SEQ ID NO: 2152964 - protein, 7 aa, Cryptosporidium hominis
NHGKEEM

SEQ ID NO: 2152965 - protein, 9 aa, Cryptosporidium hominis
NHGNAKELD

SEQ ID NO: 2152966 - protein, 10 aa, Cryptosporidium hominis
NHGSSSDENL

SEQ ID NO: 2152967 - protein, 4 aa, Cryptosporidium hominis
NHGT

SEQ ID NO: 2152968 - protein, 7 aa, Cryptosporidium hominis
NHGYSPY

SEQ ID NO: 2152969 - protein, 5 aa, Cryptosporidium hominis
NHHPS

SEQ ID NO: 2152970 - protein, 9 aa, Cryptosporidium hominis
NHHSGSPTH

SEQ ID NO: 2152971 - protein, 11 aa, Cryptosporidium hominis
NHIETSSNNEL

SEQ ID NO: 2152972 - protein, 13 aa, Cryptosporidium hominis
NHISSDNDQISKS

SEQ ID NO: 2152973 - protein, 4 aa, Cryptosporidium hominis
NHKI

SEQ ID NO: 2152974 - protein, 26 aa, Cryptosporidium hominis
NHKPSSENLQDRDKENSVDEKKLDNL

SEQ ID NO: 2152975 - protein, 5 aa, Cryptosporidium hominis
NHLYG

SEQ ID NO: 2152976 - protein, 6 aa, Cryptosporidium hominis
NHNDTS

SEQ ID NO: 2152977 - protein, 12 aa, Cryptosporidium hominis
NHNEDTTPKPVF

SEQ ID NO: 2152978 - protein, 21 aa, Cryptosporidium hominis
NHNGNKEHMSNNESRLNSNKH

SEQ ID NO: 2152979 - protein, 7 aa, Cryptosporidium hominis
NHNPEVN

SEQ ID NO: 2152980 - protein, 10 aa, Cryptosporidium hominis
NHNPSENNAY

SEQ ID NO: 2152981 - protein, 8 aa, Cryptosporidium hominis
NHNSERPK

SEQ ID NO: 2152982 - protein, 16 aa, Cryptosporidium hominis
NHNSNSNFKPNNSLDG

SEQ ID NO: 2152983 - protein, 34 aa, Cryptosporidium hominis
NHNTSKDESSKANKIQRSSKKDKSNSKNSVQNKL

SEQ ID NO: 2152984 - protein, 30 aa, Cryptosporidium hominis
NHPAPVSNIPTTTNSNEESRNRIRNALGDR

SEQ ID NO: 2152985 - protein, 8 aa, Cryptosporidium hominis
NHPDDNID

SEQ ID NO: 2152986 - protein, 19 aa, Cryptosporidium hominis
NHPKSRPELENKKDKKNKY

SEQ ID NO: 2152987 - protein, 12 aa, Cryptosporidium hominis
NHPPKIKNSIQN

SEQ ID NO: 2152988 - protein, 11 aa, Cryptosporidium hominis
NHPQESGAEHA

SEQ ID NO: 2152989 - protein, 5 aa, Cryptosporidium hominis
NHPQQ

SEQ ID NO: 2152990 - protein, 4 aa, Cryptosporidium hominis
NHQD

SEQ ID NO: 2152991 - protein, 8 aa, Cryptosporidium hominis
NHQNTNQV

SEQ ID NO: 2152992 - protein, 7 aa, Cryptosporidium hominis
NHSDTPT

SEQ ID NO: 2152993 - protein, 11 aa, Cryptosporidium hominis
NHSIKEGITEY

SEQ ID NO: 2152994 - protein, 10 aa, Cryptosporidium hominis
NHSNNKSTLN

SEQ ID NO: 2152995 - protein, 33 aa, Cryptosporidium hominis
NHSNNNSSSINNSQSKSSNNNKSSHKTNRSSSI

SEQ ID NO: 2152996 - protein, 5 aa, Cryptosporidium hominis
NHSRG

SEQ ID NO: 2152997 - protein, 16 aa, Cryptosporidium hominis
NHSRITTTHRVGDEDY

SEQ ID NO: 2152998 - protein, 6 aa, Cryptosporidium hominis
NHSRRA

SEQ ID NO: 2152999 - protein, 6 aa, Cryptosporidium hominis
NHSSQE

SEQ ID NO: 2153000 - protein, 4 aa, Cryptosporidium hominis
NHSY

SEQ ID NO: 2153001 - protein, 6 aa, Cryptosporidium hominis
NHTEDE

SEQ ID NO: 2153002 - protein, 9 aa, Cryptosporidium hominis
NHTEENNNT

SEQ ID NO: 2153003 - protein, 19 aa, Cryptosporidium hominis
NHTGNNQIENPNNYDQPQI

SEQ ID NO: 2153004 - protein, 8 aa, Cryptosporidium hominis
NHTKKKPL

SEQ ID NO: 2153005 - protein, 6 aa, Cryptosporidium hominis
NHTNSS

SEQ ID NO: 2153006 - protein, 6 aa, Cryptosporidium hominis
NHTSTF

SEQ ID NO: 2153007 - protein, 10 aa, Cryptosporidium hominis
NHTTGGSNKH

SEQ ID NO: 2153008 - protein, 13 aa, Cryptosporidium hominis
NHYSSNPSTDFEK

SEQ ID NO: 2153009 - protein, 14 aa, Cryptosporidium hominis
NIAKKDAEKASKGL

SEQ ID NO: 2153010 - protein, 10 aa, Cryptosporidium hominis
NIAQKDNKFN

SEQ ID NO: 2153011 - protein, 6 aa, Cryptosporidium hominis
NIDDDQ

SEQ ID NO: 2153012 - protein, 8 aa, Cryptosporidium hominis
NIDEDDPS

SEQ ID NO: 2153013 - protein, 15 aa, Cryptosporidium hominis
NIDGSNNNSSSSSSI

SEQ ID NO: 2153014 - protein, 7 aa, Cryptosporidium hominis
NIDKSDE

SEQ ID NO: 2153015 - protein, 22 aa, Cryptosporidium hominis
NIDLESRDVNTSNISYKPSRSI

SEQ ID NO: 2153016 - protein, 9 aa, Cryptosporidium hominis
NIDNKEDTV

SEQ ID NO: 2153017 - protein, 5 aa, Cryptosporidium hominis
NIDQR

SEQ ID NO: 2153018 - protein, 8 aa, Cryptosporidium hominis
NIDSPLPE

SEQ ID NO: 2153019 - protein, 7 aa, Cryptosporidium hominis
NIDSSNN

SEQ ID NO: 2153020 - protein, 12 aa, Cryptosporidium hominis
NIEAGNKSAPIT

SEQ ID NO: 2153021 - protein, 9 aa, Cryptosporidium hominis
NIEDDKMSR

SEQ ID NO: 2153022 - protein, 5 aa, Cryptosporidium hominis
NIEDS

SEQ ID NO: 2153023 - protein, 7 aa, Cryptosporidium hominis
NIEESCN

SEQ ID NO: 2153024 - protein, 13 aa, Cryptosporidium hominis
NIEFDSKEQINRR

SEQ ID NO: 2153025 - protein, 6 aa, Cryptosporidium hominis
NIEGDG

SEQ ID NO: 2153026 - protein, 11 aa, Cryptosporidium hominis
NIEGGSIGARG

SEQ ID NO: 2153027 - protein, 4 aa, Cryptosporidium hominis
NIEK

SEQ ID NO: 2153028 - protein, 31 aa, Cryptosporidium hominis
NIEKEKNNRRSLSADNIKKDESNQTFTTPLR

SEQ ID NO: 2153029 - protein, 5 aa, Cryptosporidium hominis
NIEKY

SEQ ID NO: 2153030 - protein, 7 aa, Cryptosporidium hominis
NIENTER

SEQ ID NO: 2153031 - protein, 13 aa, Cryptosporidium hominis
NIENTNANDTEDV

SEQ ID NO: 2153032 - protein, 4 aa, Cryptosporidium hominis
NIER

SEQ ID NO: 2153033 - protein, 4 aa, Cryptosporidium hominis
NIES

SEQ ID NO: 2153034 - protein, 6 aa, Cryptosporidium hominis
NIESHS

SEQ ID NO: 2153035 - protein, 9 aa, Cryptosporidium hominis
NIESNPNIT

SEQ ID NO: 2153036 - protein, 7 aa, Cryptosporidium hominis
NIESTDS

SEQ ID NO: 2153037 - protein, 4 aa, Cryptosporidium hominis
NIET

SEQ ID NO: 2153038 - protein, 7 aa, Cryptosporidium hominis
NIETETE

SEQ ID NO: 2153039 - protein, 8 aa, Cryptosporidium hominis
NIGDNTNF

SEQ ID NO: 2153040 - protein, 12 aa, Cryptosporidium hominis
NIGGNKAEYEEV

SEQ ID NO: 2153041 - protein, 6 aa, Cryptosporidium hominis
NIGNQE

SEQ ID NO: 2153042 - protein, 8 aa, Cryptosporidium hominis
NIGQKRNL

SEQ ID NO: 2153043 - protein, 6 aa, Cryptosporidium hominis
NIGQPS

SEQ ID NO: 2153044 - protein, 5 aa, Cryptosporidium hominis
NIGSE

SEQ ID NO: 2153045 - protein, 6 aa, Cryptosporidium hominis
NIGSNE

SEQ ID NO: 2153046 - protein, 15 aa, Cryptosporidium hominis
NIGSNSGSNTTTTVK

SEQ ID NO: 2153047 - protein, 14 aa, Cryptosporidium hominis
NIGTEDNNNRQKQK

SEQ ID NO: 2153048 - protein, 6 aa, Cryptosporidium hominis
NIGTQT

SEQ ID NO: 2153049 - protein, 8 aa, Cryptosporidium hominis
NIKATSDF

SEQ ID NO: 2153050 - protein, 10 aa, Cryptosporidium hominis
NIKDSDIKEI

SEQ ID NO: 2153051 - protein, 7 aa, Cryptosporidium hominis
NIKEKGE

SEQ ID NO: 2153052 - protein, 12 aa, Cryptosporidium hominis
NIKGKGRTSGSI

SEQ ID NO: 2153053 - protein, 4 aa, Cryptosporidium hominis
NIKN

SEQ ID NO: 2153054 - protein, 6 aa, Cryptosporidium hominis
NIKNEE

SEQ ID NO: 2153055 - protein, 24 aa, Cryptosporidium hominis
NIKNEQDKEKRSLISSNKVSKNKD

SEQ ID NO: 2153056 - protein, 21 aa, Cryptosporidium hominis
NIKNNEHNNIQNDNNNNNNNI

SEQ ID NO: 2153057 - protein, 9 aa, Cryptosporidium hominis
NIKNNNKVS

SEQ ID NO: 2153058 - protein, 5 aa, Cryptosporidium hominis
NIKNP

SEQ ID NO: 2153059 - protein, 12 aa, Cryptosporidium hominis
NIKNSASQRYKS

SEQ ID NO: 2153060 - protein, 7 aa, Cryptosporidium hominis
NIKPPSG

SEQ ID NO: 2153061 - protein, 14 aa, Cryptosporidium hominis
NIKSNANKNMQRDS

SEQ ID NO: 2153062 - protein, 5 aa, Cryptosporidium hominis
NIKSS

SEQ ID NO: 2153063 - protein, 15 aa, Cryptosporidium hominis
NILDSSKQHDKKTKF

SEQ ID NO: 2153064 - protein, 28 aa, Cryptosporidium hominis
NILGETSPEISGESKDFMSDNDKLGNSI

SEQ ID NO: 2153065 - protein, 4 aa, Cryptosporidium hominis
NINE

SEQ ID NO: 2153066 - protein, 29 aa, Cryptosporidium hominis
NINENEGSNNKENTRLGENSGLSKDTNRD

SEQ ID NO: 2153067 - protein, 10 aa, Cryptosporidium hominis
NINGNSKNIH

SEQ ID NO: 2153068 - protein, 12 aa, Cryptosporidium hominis
NINGSPYETAYN

SEQ ID NO: 2153069 - protein, 13 aa, Cryptosporidium hominis
NINKSESSQNNNI

SEQ ID NO: 2153070 - protein, 15 aa, Cryptosporidium hominis
NINKTSNDLNQPYSS

SEQ ID NO: 2153071 - protein, 4 aa, Cryptosporidium hominis
NINN

SEQ ID NO: 2153072 - protein, 22 aa, Cryptosporidium hominis
NINNNNNNNNNNNNNNNSGIES

SEQ ID NO: 2153073 - protein, 19 aa, Cryptosporidium hominis
NINNTRTKVNNNSTKIIKK

SEQ ID NO: 2153074 - protein, 13 aa, Cryptosporidium hominis
NINNTSKSSSDNL

SEQ ID NO: 2153075 - protein, 4 aa, Cryptosporidium hominis
NINP

SEQ ID NO: 2153076 - protein, 14 aa, Cryptosporidium hominis
NINQIGSENITGNR

SEQ ID NO: 2153077 - protein, 24 aa, Cryptosporidium hominis
NINQNNQSYEDPNKAHSQEDSLDP

SEQ ID NO: 2153078 - protein, 5 aa, Cryptosporidium hominis
NINRG

SEQ ID NO: 2153079 - protein, 28 aa, Cryptosporidium hominis
NINRLNEEQNDQDIDSIKEDQLNKTAKD

SEQ ID NO: 2153080 - protein, 4 aa, Cryptosporidium hominis
NINS

SEQ ID NO: 2153081 - protein, 36 aa, Cryptosporidium hominis
NINSASGITGIAGATGTGAMATGTTGTGIETGATVG

SEQ ID NO: 2153082 - protein, 9 aa, Cryptosporidium hominis
NINSPGIKG

SEQ ID NO: 2153083 - protein, 12 aa, Cryptosporidium hominis
NINSSNNTGINT

SEQ ID NO: 2153084 - protein, 13 aa, Cryptosporidium hominis
NINSSRHKGFQDN

SEQ ID NO: 2153085 - protein, 12 aa, Cryptosporidium hominis
NINTKASNTTIV

SEQ ID NO: 2153086 - protein, 5 aa, Cryptosporidium hominis
NINTN

SEQ ID NO: 2153087 - protein, 12 aa, Cryptosporidium hominis
NIPDEDDLADPA

SEQ ID NO: 2153088 - protein, 5 aa, Cryptosporidium hominis
NIPEN

SEQ ID NO: 2153089 - protein, 4 aa, Cryptosporidium hominis
NIPK

SEQ ID NO: 2153090 - protein, 22 aa, Cryptosporidium hominis
NIPKDSNISQVPYSEDESPNKV

SEQ ID NO: 2153091 - protein, 7 aa, Cryptosporidium hominis
NIPKGGK

SEQ ID NO: 2153092 - protein, 7 aa, Cryptosporidium hominis
NIPNPID

SEQ ID NO: 2153093 - protein, 7 aa, Cryptosporidium hominis
NIPNSGE

SEQ ID NO: 2153094 - protein, 7 aa, Cryptosporidium hominis
NIPNSLK

SEQ ID NO: 2153095 - protein, 13 aa, Cryptosporidium hominis
NIPNSPQTTYQYQ

SEQ ID NO: 2153096 - protein, 6 aa, Cryptosporidium hominis
NIPPNY

SEQ ID NO: 2153097 - protein, 8 aa, Cryptosporidium hominis
NIPPPPYN

SEQ ID NO: 2153098 - protein, 14 aa, Cryptosporidium hominis
NIPQTVPSPAVSGG

SEQ ID NO: 2153099 - protein, 7 aa, Cryptosporidium hominis
NIPRSSA

SEQ ID NO: 2153100 - protein, 14 aa, Cryptosporidium hominis
NIPSEGRPNFNFSP

SEQ ID NO: 2153101 - protein, 9 aa, Cryptosporidium hominis
NIPSETPQK

SEQ ID NO: 2153102 - protein, 4 aa, Cryptosporidium hominis
NIPT

SEQ ID NO: 2153103 - protein, 6 aa, Cryptosporidium hominis
NIPTQS

SEQ ID NO: 2153104 - protein, 7 aa, Cryptosporidium hominis
NIQDNEL

SEQ ID NO: 2153105 - protein, 5 aa, Cryptosporidium hominis
NIQES

SEQ ID NO: 2153106 - protein, 14 aa, Cryptosporidium hominis
NIQKTQDKSENPNI

SEQ ID NO: 2153107 - protein, 9 aa, Cryptosporidium hominis
NIQNDKKSA

SEQ ID NO: 2153108 - protein, 6 aa, Cryptosporidium hominis
NIQNDS

SEQ ID NO: 2153109 - protein, 16 aa, Cryptosporidium hominis
NIQNEKELNSQTRRDK

SEQ ID NO: 2153110 - protein, 11 aa, Cryptosporidium hominis
NIQSGSSEGDG

SEQ ID NO: 2153111 - protein, 9 aa, Cryptosporidium hominis
NIRKKSSDC

SEQ ID NO: 2153112 - protein, 7 aa, Cryptosporidium hominis
NIRPGNN

SEQ ID NO: 2153113 - protein, 7 aa, Cryptosporidium hominis
NIRSEKG

SEQ ID NO: 2153114 - protein, 6 aa, Cryptosporidium hominis
NISADN

SEQ ID NO: 2153115 - protein, 8 aa, Cryptosporidium hominis
NISENSNT

SEQ ID NO: 2153116 - protein, 5 aa, Cryptosporidium hominis
NISKN

SEQ ID NO: 2153117 - protein, 8 aa, Cryptosporidium hominis
NISKPSDR

SEQ ID NO: 2153118 - protein, 10 aa, Cryptosporidium hominis
NISKSSEAAF

SEQ ID NO: 2153119 - protein, 11 aa, Cryptosporidium hominis
NISLGEGEDDL

SEQ ID NO: 2153120 - protein, 7 aa, Cryptosporidium hominis
NISNANN

SEQ ID NO: 2153121 - protein, 19 aa, Cryptosporidium hominis
NISNHPSTLTSSNNTTINN

SEQ ID NO: 2153122 - protein, 12 aa, Cryptosporidium hominis
NISNRKSSSISE

SEQ ID NO: 2153123 - protein, 25 aa, Cryptosporidium hominis
NISNSIGSSGGGSGNIGITNNNGLT

SEQ ID NO: 2153124 - protein, 5 aa, Cryptosporidium hominis
NISPK

SEQ ID NO: 2153125 - protein, 8 aa, Cryptosporidium hominis
NISPKRSK

SEQ ID NO: 2153126 - protein, 9 aa, Cryptosporidium hominis
NISPPGFAS

SEQ ID NO: 2153127 - protein, 8 aa, Cryptosporidium hominis
NISPSSEI

SEQ ID NO: 2153128 - protein, 4 aa, Cryptosporidium hominis
NISQ

SEQ ID NO: 2153129 - protein, 34 aa, Cryptosporidium hominis
NISQNNSSNSNTSTDNNTTINNNNTNNSQTTPQL

SEQ ID NO: 2153130 - protein, 15 aa, Cryptosporidium hominis
NISRSIKEEDCEENH

SEQ ID NO: 2153131 - protein, 35 aa, Cryptosporidium hominis
NISRSSSASYKSKNEQDSDRSEYEFESDGEDGEEY

SEQ ID NO: 2153132 - protein, 12 aa, Cryptosporidium hominis
NISRTNNTGNYS

SEQ ID NO: 2153133 - protein, 8 aa, Cryptosporidium hominis
NISSDERF

SEQ ID NO: 2153134 - protein, 19 aa, Cryptosporidium hominis
NISSETKQLNNPNDEQSEL

SEQ ID NO: 2153135 - protein, 8 aa, Cryptosporidium hominis
NISSGNNV

SEQ ID NO: 2153136 - protein, 10 aa, Cryptosporidium hominis
NISSKKDFGT

SEQ ID NO: 2153137 - protein, 37 aa, Cryptosporidium hominis
NISSKNMSSTSSSSSYDESHNSVNDQHIEGGDNGNSK

SEQ ID NO: 2153138 - protein, 6 aa, Cryptosporidium hominis
NISSNP

SEQ ID NO: 2153139 - protein, 14 aa, Cryptosporidium hominis
NISSPTDSRESSLS

SEQ ID NO: 2153140 - protein, 42 aa, Cryptosporidium hominis
NISSPTQSLEKSDSLPVSSSDNSRIESSVPTAANSPTSYSSS

SEQ ID NO: 2153141 - protein, 23 aa, Cryptosporidium hominis
NISSSGSSNYGSISSPKAVALPS

SEQ ID NO: 2153142 - protein, 6 aa, Cryptosporidium hominis
NISSSV

SEQ ID NO: 2153143 - protein, 13 aa, Cryptosporidium hominis
NISSVSRSNSSTI

SEQ ID NO: 2153144 - protein, 21 aa, Cryptosporidium hominis
NISTNKDESESNMGRSERKDV

SEQ ID NO: 2153145 - protein, 7 aa, Cryptosporidium hominis
NISTSEL

SEQ ID NO: 2153146 - protein, 9 aa, Cryptosporidium hominis
NISTSSNSF

SEQ ID NO: 2153147 - protein, 17 aa, Cryptosporidium hominis
NISTSSSQTQASSSAAA

SEQ ID NO: 2153148 - protein, 12 aa, Cryptosporidium hominis
NITAQKGEAIDK

SEQ ID NO: 2153149 - protein, 4 aa, Cryptosporidium hominis
NITD

SEQ ID NO: 2153150 - protein, 5 aa, Cryptosporidium hominis
NITEE

SEQ ID NO: 2153151 - protein, 12 aa, Cryptosporidium hominis
NITNNNSTSNVV

SEQ ID NO: 2153152 - protein, 5 aa, Cryptosporidium hominis
NITQE

SEQ ID NO: 2153153 - protein, 17 aa, Cryptosporidium hominis
NITQTGQSITPPAIPGN

SEQ ID NO: 2153154 - protein, 21 aa, Cryptosporidium hominis
NITRCSSNYREENFDRDSGSN

SEQ ID NO: 2153155 - protein, 17 aa, Cryptosporidium hominis
NITSDNNNNENRKTTSI

SEQ ID NO: 2153156 - protein, 5 aa, Cryptosporidium hominis
NITTN

SEQ ID NO: 2153157 - protein, 14 aa, Cryptosporidium hominis
NIVNPKSNRDEKLK

SEQ ID NO: 2153158 - protein, 12 aa, Cryptosporidium hominis
NIYGASEHSTEV

SEQ ID NO: 2153159 - protein, 28 aa, Cryptosporidium hominis
NKAAENKQNLEKQKAANGPVKKQSTSEA

SEQ ID NO: 2153160 - protein, 8 aa, Cryptosporidium hominis
NKADHSKA

SEQ ID NO: 2153161 - protein, 7 aa, Cryptosporidium hominis
NKAEGTC

SEQ ID NO: 2153162 - protein, 7 aa, Cryptosporidium hominis
NKAERRR

SEQ ID NO: 2153163 - protein, 8 aa, Cryptosporidium hominis
NKAESSII

SEQ ID NO: 2153164 - protein, 8 aa, Cryptosporidium hominis
NKAGEATA

SEQ ID NO: 2153165 - protein, 15 aa, Cryptosporidium hominis
NKAHYSSENISIPSD

SEQ ID NO: 2153166 - protein, 10 aa, Cryptosporidium hominis
NKANRDDPGA

SEQ ID NO: 2153167 - protein, 26 aa, Cryptosporidium hominis
NKANSNKKTGIYESNTKSSIEAKSKE

SEQ ID NO: 2153168 - protein, 9 aa, Cryptosporidium hominis
NKAQEELYQ

SEQ ID NO: 2153169 - protein, 8 aa, Cryptosporidium hominis
NKAQNINK

SEQ ID NO: 2153170 - protein, 9 aa, Cryptosporidium hominis
NKASKSKKV

SEQ ID NO: 2153171 - protein, 19 aa, Cryptosporidium hominis
NKASKYPNNKKSESSTDNL

SEQ ID NO: 2153172 - protein, 11 aa, Cryptosporidium hominis
NKASQSHPNQY

SEQ ID NO: 2153173 - protein, 13 aa, Cryptosporidium hominis
NKASTYNLTNSEH

SEQ ID NO: 2153174 - protein, 8 aa, Cryptosporidium hominis
NKATGAGF

SEQ ID NO: 2153175 - protein, 7 aa, Cryptosporidium hominis
NKAVGTM

SEQ ID NO: 2153176 - protein, 27 aa, Cryptosporidium hominis
NKCKSQNQSKSGAQDENIGKYDHTNDY

SEQ ID NO: 2153177 - protein, 8 aa, Cryptosporidium hominis
NKDADGEF

SEQ ID NO: 2153178 - protein, 9 aa, Cryptosporidium hominis
NKDDGTINL

SEQ ID NO: 2153179 - protein, 4 aa, Cryptosporidium hominis
NKDE

SEQ ID NO: 2153180 - protein, 7 aa, Cryptosporidium hominis
NKDEKKV

SEQ ID NO: 2153181 - protein, 5 aa, Cryptosporidium hominis
NKDEL

SEQ ID NO: 2153182 - protein, 10 aa, Cryptosporidium hominis
NKDGSASNFG

SEQ ID NO: 2153183 - protein, 7 aa, Cryptosporidium hominis
NKDKACS

SEQ ID NO: 2153184 - protein, 5 aa, Cryptosporidium hominis
NKDKC

SEQ ID NO: 2153185 - protein, 11 aa, Cryptosporidium hominis
NKDKDPKTKYN

SEQ ID NO: 2153186 - protein, 8 aa, Cryptosporidium hominis
NKDLSEKY

SEQ ID NO: 2153187 - protein, 6 aa, Cryptosporidium hominis
NKDLTD

SEQ ID NO: 2153188 - protein, 8 aa, Cryptosporidium hominis
NKDNDNLK

SEQ ID NO: 2153189 - protein, 13 aa, Cryptosporidium hominis
NKDNSDKKQKKDG

SEQ ID NO: 2153190 - protein, 22 aa, Cryptosporidium hominis
NKDPFSECKKNESKKNKSNYKI

SEQ ID NO: 2153191 - protein, 6 aa, Cryptosporidium hominis
NKDPKH

SEQ ID NO: 2153192 - protein, 8 aa, Cryptosporidium hominis
NKDPNSPE

SEQ ID NO: 2153193 - protein, 6 aa, Cryptosporidium hominis
NKDPSL

SEQ ID NO: 2153194 - protein, 25 aa, Cryptosporidium hominis
NKDPSLIPSEEQDKSFFNSDDSGGR

SEQ ID NO: 2153195 - protein, 7 aa, Cryptosporidium hominis
NKDPTKK

SEQ ID NO: 2153196 - protein, 8 aa, Cryptosporidium hominis
NKDQLSHY

SEQ ID NO: 2153197 - protein, 7 aa, Cryptosporidium hominis
NKDSELN

SEQ ID NO: 2153198 - protein, 7 aa, Cryptosporidium hominis
NKDSGEL

SEQ ID NO: 2153199 - protein, 9 aa, Cryptosporidium hominis
NKDSSSNIY

SEQ ID NO: 2153200 - protein, 38 aa, Cryptosporidium hominis
NKDTQIATGSENGKTVGNIASPATANGSSVINPGQTFD

SEQ ID NO: 2153201 - protein, 6 aa, Cryptosporidium hominis
NKDTSA

SEQ ID NO: 2153202 - protein, 10 aa, Cryptosporidium hominis
NKDTTQDHEE

SEQ ID NO: 2153203 - protein, 6 aa, Cryptosporidium hominis
NKDVDG

SEQ ID NO: 2153204 - protein, 6 aa, Cryptosporidium hominis
NKEADV

SEQ ID NO: 2153205 - protein, 20 aa, Cryptosporidium hominis
NKEDSDTSNSELKKHESTLT

SEQ ID NO: 2153206 - protein, 14 aa, Cryptosporidium hominis
NKEELDKENENKRY

SEQ ID NO: 2153207 - protein, 9 aa, Cryptosporidium hominis
NKEESRYQV

SEQ ID NO: 2153208 - protein, 15 aa, Cryptosporidium hominis
NKEGKEVEDYGYDDE

SEQ ID NO: 2153209 - protein, 12 aa, Cryptosporidium hominis
NKEIQNESKSQI

SEQ ID NO: 2153210 - protein, 9 aa, Cryptosporidium hominis
NKEKEYQEK

SEQ ID NO: 2153211 - protein, 9 aa, Cryptosporidium hominis
NKEKKLDKV

SEQ ID NO: 2153212 - protein, 30 aa, Cryptosporidium hominis
NKEKNEKTDEVEKKDENNLNSKISKEEYEY

SEQ ID NO: 2153213 - protein, 14 aa, Cryptosporidium hominis
NKEKNKQNKRPLSR

SEQ ID NO: 2153214 - protein, 6 aa, Cryptosporidium hominis
NKEKNL

SEQ ID NO: 2153215 - protein, 7 aa, Cryptosporidium hominis
NKELESS

SEQ ID NO: 2153216 - protein, 18 aa, Cryptosporidium hominis
NKELGNACREGAVGAPEL

SEQ ID NO: 2153217 - protein, 7 aa, Cryptosporidium hominis
NKEMASN

SEQ ID NO: 2153218 - protein, 17 aa, Cryptosporidium hominis
NKENDDASTISSSFSNQ

SEQ ID NO: 2153219 - protein, 19 aa, Cryptosporidium hominis
NKENDQRKIETERVKREEE

SEQ ID NO: 2153220 - protein, 7 aa, Cryptosporidium hominis
NKENDSF

SEQ ID NO: 2153221 - protein, 12 aa, Cryptosporidium hominis
NKENEAIKENSK

SEQ ID NO: 2153222 - protein, 6 aa, Cryptosporidium hominis
NKENEL

SEQ ID NO: 2153223 - protein, 9 aa, Cryptosporidium hominis
NKENETNKW

SEQ ID NO: 2153224 - protein, 7 aa, Cryptosporidium hominis
NKENNRC

SEQ ID NO: 2153225 - protein, 15 aa, Cryptosporidium hominis
NKENSIDNINDENNR

SEQ ID NO: 2153226 - protein, 13 aa, Cryptosporidium hominis
NKEPNNSKPHPDV

SEQ ID NO: 2153227 - protein, 6 aa, Cryptosporidium hominis
NKEQEL

SEQ ID NO: 2153228 - protein, 8 aa, Cryptosporidium hominis
NKEQNSYN

SEQ ID NO: 2153229 - protein, 5 aa, Cryptosporidium hominis
NKESL

SEQ ID NO: 2153230 - protein, 9 aa, Cryptosporidium hominis
NKESRWKNK

SEQ ID NO: 2153231 - protein, 8 aa, Cryptosporidium hominis
NKESTYNH

SEQ ID NO: 2153232 - protein, 4 aa, Cryptosporidium hominis
NKET

SEQ ID NO: 2153233 - protein, 5 aa, Cryptosporidium hominis
NKETV

SEQ ID NO: 2153234 - protein, 5 aa, Cryptosporidium hominis
NKEVD

SEQ ID NO: 2153235 - protein, 7 aa, Cryptosporidium hominis
NKEYDTL

SEQ ID NO: 2153236 - protein, 12 aa, Cryptosporidium hominis
NKEYGKDTLSKR

SEQ ID NO: 2153237 - protein, 12 aa, Cryptosporidium hominis
NKEYSENYHEGE

SEQ ID NO: 2153238 - protein, 13 aa, Cryptosporidium hominis
NKFESHNFIYHII

SEQ ID NO: 2153239 - protein, 14 aa, Cryptosporidium hominis
NKFESSQSNLMKNG

SEQ ID NO: 2153240 - protein, 21 aa, Cryptosporidium hominis
NKFTKKEANNTLNTGTQNNSV

SEQ ID NO: 2153241 - protein, 8 aa, Cryptosporidium hominis
NKFTPPEI

SEQ ID NO: 2153242 - protein, 9 aa, Cryptosporidium hominis
NKGCGGMSE

SEQ ID NO: 2153243 - protein, 7 aa, Cryptosporidium hominis
NKGDNFS

SEQ ID NO: 2153244 - protein, 8 aa, Cryptosporidium hominis
NKGDSRDV

SEQ ID NO: 2153245 - protein, 7 aa, Cryptosporidium hominis
NKGDWHK

SEQ ID NO: 2153246 - protein, 10 aa, Cryptosporidium hominis
NKGEEENQES

SEQ ID NO: 2153247 - protein, 59 aa, Cryptosporidium hominis
NKGFEVKSNGTKFERETSERVGTVTQQTNNISDEKNSRSNHRKNKESISDMKGDGDLEG

SEQ ID NO: 2153248 - protein, 43 aa, Cryptosporidium hominis
NKGGAAAVSGPGSASGSYSSTSGGSSNSSSTKDKDSKANKENT

SEQ ID NO: 2153249 - protein, 22 aa, Cryptosporidium hominis
NKGGTTIGNPIQDSTNNNNSLK

SEQ ID NO: 2153250 - protein, 6 aa, Cryptosporidium hominis
NKGINI

SEQ ID NO: 2153251 - protein, 9 aa, Cryptosporidium hominis
NKGKNKAKR

SEQ ID NO: 2153252 - protein, 6 aa, Cryptosporidium hominis
NKGLGL

SEQ ID NO: 2153253 - protein, 9 aa, Cryptosporidium hominis
NKGLNNENN

SEQ ID NO: 2153254 - protein, 71 aa, Cryptosporidium hominis
NKGNAESQGGSEDLAEDRAEDQVEDQSQDRVEDRVEDRVEDRSQDRAEDQSQDRAEDQDHSQSRPQNQPKD

SEQ ID NO: 2153255 - protein, 9 aa, Cryptosporidium hominis
NKGNENVNV

SEQ ID NO: 2153256 - protein, 8 aa, Cryptosporidium hominis
NKGPSRTL

SEQ ID NO: 2153257 - protein, 7 aa, Cryptosporidium hominis
NKGSDEC

SEQ ID NO: 2153258 - protein, 11 aa, Cryptosporidium hominis
NKGSEGTSSFE

SEQ ID NO: 2153259 - protein, 6 aa, Cryptosporidium hominis
NKGSEI

SEQ ID NO: 2153260 - protein, 6 aa, Cryptosporidium hominis
NKGSFN

SEQ ID NO: 2153261 - protein, 14 aa, Cryptosporidium hominis
NKGSKMNGGPSNIP

SEQ ID NO: 2153262 - protein, 11 aa, Cryptosporidium hominis
NKGSTDNSNLG

SEQ ID NO: 2153263 - protein, 5 aa, Cryptosporidium hominis
NKGSY

SEQ ID NO: 2153264 - protein, 9 aa, Cryptosporidium hominis
NKGVPSKAY

SEQ ID NO: 2153265 - protein, 5 aa, Cryptosporidium hominis
NKGYI

SEQ ID NO: 2153266 - protein, 7 aa, Cryptosporidium hominis
NKGYNDS

SEQ ID NO: 2153267 - protein, 16 aa, Cryptosporidium hominis
NKHEGSKKGNDPRFND

SEQ ID NO: 2153268 - protein, 7 aa, Cryptosporidium hominis
NKHGEKD

SEQ ID NO: 2153269 - protein, 6 aa, Cryptosporidium hominis
NKHGYG

SEQ ID NO: 2153270 - protein, 8 aa, Cryptosporidium hominis
NKHIQDSE

SEQ ID NO: 2153271 - protein, 10 aa, Cryptosporidium hominis
NKHQEKLSNN

SEQ ID NO: 2153272 - protein, 13 aa, Cryptosporidium hominis
NKHQSNTPLSHST

SEQ ID NO: 2153273 - protein, 10 aa, Cryptosporidium hominis
NKHTGKSRGY

SEQ ID NO: 2153274 - protein, 5 aa, Cryptosporidium hominis
NKIDQ

SEQ ID NO: 2153275 - protein, 6 aa, Cryptosporidium hominis
NKIQDK

SEQ ID NO: 2153276 - protein, 9 aa, Cryptosporidium hominis
NKISKSEDF

SEQ ID NO: 2153277 - protein, 11 aa, Cryptosporidium hominis
NKISKSQKKVG

SEQ ID NO: 2153278 - protein, 12 aa, Cryptosporidium hominis
NKITNNTGKRMA

SEQ ID NO: 2153279 - protein, 6 aa, Cryptosporidium hominis
NKKCRN

SEQ ID NO: 2153280 - protein, 10 aa, Cryptosporidium hominis
NKKDKREKIP

SEQ ID NO: 2153281 - protein, 7 aa, Cryptosporidium hominis
NKKDVDE

SEQ ID NO: 2153282 - protein, 11 aa, Cryptosporidium hominis
NKKEEDRIKTL

SEQ ID NO: 2153283 - protein, 7 aa, Cryptosporidium hominis
NKKEFGG

SEQ ID NO: 2153284 - protein, 12 aa, Cryptosporidium hominis
NKKEKVKVTEKK

SEQ ID NO: 2153285 - protein, 9 aa, Cryptosporidium hominis
NKKELKNGC

SEQ ID NO: 2153286 - protein, 5 aa, Cryptosporidium hominis
NKKEN

SEQ ID NO: 2153287 - protein, 7 aa, Cryptosporidium hominis
NKKENMS

SEQ ID NO: 2153288 - protein, 10 aa, Cryptosporidium hominis
NKKEQGGLKR

SEQ ID NO: 2153289 - protein, 15 aa, Cryptosporidium hominis
NKKERSDSNDEQCEN

SEQ ID NO: 2153290 - protein, 14 aa, Cryptosporidium hominis
NKKGEQLLASPNEN

SEQ ID NO: 2153291 - protein, 15 aa, Cryptosporidium hominis
NKKGKVKDSKCENKK

SEQ ID NO: 2153292 - protein, 7 aa, Cryptosporidium hominis
NKKHLRN

SEQ ID NO: 2153293 - protein, 8 aa, Cryptosporidium hominis
NKKIEQPE

SEQ ID NO: 2153294 - protein, 8 aa, Cryptosporidium hominis
NKKISTYS

SEQ ID NO: 2153295 - protein, 9 aa, Cryptosporidium hominis
NKKKKETGS

SEQ ID NO: 2153296 - protein, 13 aa, Cryptosporidium hominis
NKKKKYSKYEEEQ

SEQ ID NO: 2153297 - protein, 5 aa, Cryptosporidium hominis
NKKKL

SEQ ID NO: 2153298 - protein, 6 aa, Cryptosporidium hominis
NKKKSK

SEQ ID NO: 2153299 - protein, 9 aa, Cryptosporidium hominis
NKKKSNDFV

SEQ ID NO: 2153300 - protein, 8 aa, Cryptosporidium hominis
NKKKTESL

SEQ ID NO: 2153301 - protein, 10 aa, Cryptosporidium hominis
NKKLEKPKDI

SEQ ID NO: 2153302 - protein, 9 aa, Cryptosporidium hominis
NKKLQQPNI

SEQ ID NO: 2153303 - protein, 6 aa, Cryptosporidium hominis
NKKNEI

SEQ ID NO: 2153304 - protein, 7 aa, Cryptosporidium hominis
NKKNHAV

SEQ ID NO: 2153305 - protein, 10 aa, Cryptosporidium hominis
NKKNSTNNEM

SEQ ID NO: 2153306 - protein, 7 aa, Cryptosporidium hominis
NKKPAEE

SEQ ID NO: 2153307 - protein, 8 aa, Cryptosporidium hominis
NKKPLENE

SEQ ID NO: 2153308 - protein, 14 aa, Cryptosporidium hominis
NKKQDQSKAISQSC

SEQ ID NO: 2153309 - protein, 9 aa, Cryptosporidium hominis
NKKQTSEVI

SEQ ID NO: 2153310 - protein, 5 aa, Cryptosporidium hominis
NKKRI

SEQ ID NO: 2153311 - protein, 6 aa, Cryptosporidium hominis
NKKSID

SEQ ID NO: 2153312 - protein, 11 aa, Cryptosporidium hominis
NKKSMDESENN

SEQ ID NO: 2153313 - protein, 18 aa, Cryptosporidium hominis
NKKSNLSLNQKANLNGNF

SEQ ID NO: 2153314 - protein, 11 aa, Cryptosporidium hominis
NKKSTPTKMPT

SEQ ID NO: 2153315 - protein, 7 aa, Cryptosporidium hominis
NKKTSKN

SEQ ID NO: 2153316 - protein, 10 aa, Cryptosporidium hominis
NKKVEEDKDS

SEQ ID NO: 2153317 - protein, 8 aa, Cryptosporidium hominis
NKKYASVD

SEQ ID NO: 2153318 - protein, 10 aa, Cryptosporidium hominis
NKLDSSNGNA

SEQ ID NO: 2153319 - protein, 18 aa, Cryptosporidium hominis
NKLEQDDSRNRKVNQGEL

SEQ ID NO: 2153320 - protein, 8 aa, Cryptosporidium hominis
NKLGGDEI

SEQ ID NO: 2153321 - protein, 4 aa, Cryptosporidium hominis
NKLI

SEQ ID NO: 2153322 - protein, 10 aa, Cryptosporidium hominis
NKLKKPSARA

SEQ ID NO: 2153323 - protein, 23 aa, Cryptosporidium hominis
NKLKKQRNKENRKKRKSEQVGNQ

SEQ ID NO: 2153324 - protein, 8 aa, Cryptosporidium hominis
NKLSKNNE

SEQ ID NO: 2153325 - protein, 5 aa, Cryptosporidium hominis
NKLSS

SEQ ID NO: 2153326 - protein, 44 aa, Cryptosporidium hominis
NKMDDNKTIHRGNNNISRNGGNHSNNNSSYSSGNSQSNSGQSNF

SEQ ID NO: 2153327 - protein, 22 aa, Cryptosporidium hominis
NKMEQTKMNSNYYKQSKEYSSS

SEQ ID NO: 2153328 - protein, 4 aa, Cryptosporidium hominis
NKMG

SEQ ID NO: 2153329 - protein, 17 aa, Cryptosporidium hominis
NKMNSSKNINNSKSDEF

SEQ ID NO: 2153330 - protein, 11 aa, Cryptosporidium hominis
NKNDDSDDNEQ

SEQ ID NO: 2153331 - protein, 7 aa, Cryptosporidium hominis
NKNDDVS

SEQ ID NO: 2153332 - protein, 23 aa, Cryptosporidium hominis
NKNDNGVYEEEDDEDEDDDNEEQ

SEQ ID NO: 2153333 - protein, 8 aa, Cryptosporidium hominis
NKNDNIPD

SEQ ID NO: 2153334 - protein, 8 aa, Cryptosporidium hominis
NKNEELSN

SEQ ID NO: 2153335 - protein, 7 aa, Cryptosporidium hominis
NKNEVSY

SEQ ID NO: 2153336 - protein, 8 aa, Cryptosporidium hominis
NKNGNEQA

SEQ ID NO: 2153337 - protein, 10 aa, Cryptosporidium hominis
NKNGRKAIYT

SEQ ID NO: 2153338 - protein, 33 aa, Cryptosporidium hominis
NKNGSNKDYQLESNTQKTSSDKSNSKLTRNDLE

SEQ ID NO: 2153339 - protein, 6 aa, Cryptosporidium hominis
NKNGTL

SEQ ID NO: 2153340 - protein, 4 aa, Cryptosporidium hominis
NKNI

SEQ ID NO: 2153341 - protein, 8 aa, Cryptosporidium hominis
NKNIGPEE

SEQ ID NO: 2153342 - protein, 11 aa, Cryptosporidium hominis
NKNKANNSMEN

SEQ ID NO: 2153343 - protein, 7 aa, Cryptosporidium hominis
NKNKEIT

SEQ ID NO: 2153344 - protein, 27 aa, Cryptosporidium hominis
NKNKEQKSPGLINNTKTPGSFDNTTAG

SEQ ID NO: 2153345 - protein, 5 aa, Cryptosporidium hominis
NKNKK

SEQ ID NO: 2153346 - protein, 7 aa, Cryptosporidium hominis
NKNKNEP

SEQ ID NO: 2153347 - protein, 26 aa, Cryptosporidium hominis
NKNKSKGDRNSSKMEFDTDSDDDFDE

SEQ ID NO: 2153348 - protein, 7 aa, Cryptosporidium hominis
NKNKVEQ

SEQ ID NO: 2153349 - protein, 9 aa, Cryptosporidium hominis
NKNLTGTAR

SEQ ID NO: 2153350 - protein, 7 aa, Cryptosporidium hominis
NKNMEAR

SEQ ID NO: 2153351 - protein, 6 aa, Cryptosporidium hominis
NKNNGS

SEQ ID NO: 2153352 - protein, 9 aa, Cryptosporidium hominis
NKNNKNHNF

SEQ ID NO: 2153353 - protein, 6 aa, Cryptosporidium hominis
NKNNQF

SEQ ID NO: 2153354 - protein, 5 aa, Cryptosporidium hominis
NKNNR

SEQ ID NO: 2153355 - protein, 23 aa, Cryptosporidium hominis
NKNNRRSSNQNLTNSSGKFQYNK

SEQ ID NO: 2153356 - protein, 10 aa, Cryptosporidium hominis
NKNNSKNTKG

SEQ ID NO: 2153357 - protein, 27 aa, Cryptosporidium hominis
NKNNSLTQKSPIKQTSSPIKSVSASTI

SEQ ID NO: 2153358 - protein, 9 aa, Cryptosporidium hominis
NKNNVEQKI

SEQ ID NO: 2153359 - protein, 12 aa, Cryptosporidium hominis
NKNPELDKYDPE

SEQ ID NO: 2153360 - protein, 17 aa, Cryptosporidium hominis
NKNQQIKRNDNNHNSDH

SEQ ID NO: 2153361 - protein, 9 aa, Cryptosporidium hominis
NKNQQSPYN

SEQ ID NO: 2153362 - protein, 54 aa, Cryptosporidium hominis
NKNRNSKKGQIGKGGHQGAIPTSNIEAKPAAPSTAKQAALSSSSGIRRSHKKKR

SEQ ID NO: 2153363 - protein, 23 aa, Cryptosporidium hominis
NKNRNTKNSMNKDEQKKKGNGLL

SEQ ID NO: 2153364 - protein, 18 aa, Cryptosporidium hominis
NKNRTASKNKLRSSRSGR

SEQ ID NO: 2153365 - protein, 8 aa, Cryptosporidium hominis
NKNSDLSK

SEQ ID NO: 2153366 - protein, 14 aa, Cryptosporidium hominis
NKNSENYSNNKNGV

SEQ ID NO: 2153367 - protein, 23 aa, Cryptosporidium hominis
NKNSNISNKDNSQVEKNDSETEF

SEQ ID NO: 2153368 - protein, 14 aa, Cryptosporidium hominis
NKNSQDSNSSSHIN

SEQ ID NO: 2153369 - protein, 16 aa, Cryptosporidium hominis
NKNSSINDTRTNKANN

SEQ ID NO: 2153370 - protein, 9 aa, Cryptosporidium hominis
NKNTLSNPF

SEQ ID NO: 2153371 - protein, 23 aa, Cryptosporidium hominis
NKNTSSSTSDQKQDVLSPERASA

SEQ ID NO: 2153372 - protein, 6 aa, Cryptosporidium hominis
NKNVNY

SEQ ID NO: 2153373 - protein, 6 aa, Cryptosporidium hominis
NKNVRN

SEQ ID NO: 2153374 - protein, 8 aa, Cryptosporidium hominis
NKNYDTHL

SEQ ID NO: 2153375 - protein, 10 aa, Cryptosporidium hominis
NKPDNSTIQG

SEQ ID NO: 2153376 - protein, 4 aa, Cryptosporidium hominis
NKPF

SEQ ID NO: 2153377 - protein, 18 aa, Cryptosporidium hominis
NKPGEDAQNMRGGVAGGS

SEQ ID NO: 2153378 - protein, 6 aa, Cryptosporidium hominis
NKPGVI

SEQ ID NO: 2153379 - protein, 29 aa, Cryptosporidium hominis
NKPITDNNVNQESKRGNHTKPSKNTEKVE

SEQ ID NO: 2153380 - protein, 4 aa, Cryptosporidium hominis
NKPL

SEQ ID NO: 2153381 - protein, 7 aa, Cryptosporidium hominis
NKPLGGY

SEQ ID NO: 2153382 - protein, 9 aa, Cryptosporidium hominis
NKPLNDNNT

SEQ ID NO: 2153383 - protein, 7 aa, Cryptosporidium hominis
NKPPESN

SEQ ID NO: 2153384 - protein, 25 aa, Cryptosporidium hominis
NKPQQSNNTQTTSKVEKKPKQVKKI

SEQ ID NO: 2153385 - protein, 8 aa, Cryptosporidium hominis
NKPQSTEL

SEQ ID NO: 2153386 - protein, 21 aa, Cryptosporidium hominis
NKPSKKKKSSSSTLKKLGKIF

SEQ ID NO: 2153387 - protein, 46 aa, Cryptosporidium hominis
NKPSKRRSQTQPRSGTNNEPIRENEADSVSNSELETESDSESETSS

SEQ ID NO: 2153388 - protein, 6 aa, Cryptosporidium hominis
NKPSTW

SEQ ID NO: 2153389 - protein, 7 aa, Cryptosporidium hominis
NKPYTYK

SEQ ID NO: 2153390 - protein, 7 aa, Cryptosporidium hominis
NKQDKVY

SEQ ID NO: 2153391 - protein, 9 aa, Cryptosporidium hominis
NKQDTRNSD

SEQ ID NO: 2153392 - protein, 10 aa, Cryptosporidium hominis
NKQGNSNIQL

SEQ ID NO: 2153393 - protein, 30 aa, Cryptosporidium hominis
NKQKESSKRNAPRIDSNSNSKGETSQNTKQ

SEQ ID NO: 2153394 - protein, 8 aa, Cryptosporidium hominis
NKQNIKEV

SEQ ID NO: 2153395 - protein, 28 aa, Cryptosporidium hominis
NKQNKDFSKNLKDSKALLDEKSKKLEQL

SEQ ID NO: 2153396 - protein, 18 aa, Cryptosporidium hominis
NKQQKLQQQQQQQQQQQQ

SEQ ID NO: 2153397 - protein, 26 aa, Cryptosporidium hominis
NKQSGIQSNTREHNEGGEVRHSHSSG

SEQ ID NO: 2153398 - protein, 26 aa, Cryptosporidium hominis
NKQSQTIGNANSNSAESNNDNATNPI

SEQ ID NO: 2153399 - protein, 8 aa, Cryptosporidium hominis
NKQVNSCS

SEQ ID NO: 2153400 - protein, 7 aa, Cryptosporidium hominis
NKRENEI

SEQ ID NO: 2153401 - protein, 7 aa, Cryptosporidium hominis
NKRERTS

SEQ ID NO: 2153402 - protein, 10 aa, Cryptosporidium hominis
NKRGRKGKNV

SEQ ID NO: 2153403 - protein, 8 aa, Cryptosporidium hominis
NKRISAND

SEQ ID NO: 2153404 - protein, 13 aa, Cryptosporidium hominis
NKRKNSDENPEDV

SEQ ID NO: 2153405 - protein, 7 aa, Cryptosporidium hominis
NKRKNSL

SEQ ID NO: 2153406 - protein, 7 aa, Cryptosporidium hominis
NKRLSST

SEQ ID NO: 2153407 - protein, 7 aa, Cryptosporidium hominis
NKRNSFK

SEQ ID NO: 2153408 - protein, 18 aa, Cryptosporidium hominis
NKRSGFKRSFGGNSQKHS

SEQ ID NO: 2153409 - protein, 15 aa, Cryptosporidium hominis
NKRSIPRGNSITFRK

SEQ ID NO: 2153410 - protein, 12 aa, Cryptosporidium hominis
NKRSPSNKQDSA

SEQ ID NO: 2153411 - protein, 9 aa, Cryptosporidium hominis
NKRVEEAAC

SEQ ID NO: 2153412 - protein, 9 aa, Cryptosporidium hominis
NKRVEKSTA

SEQ ID NO: 2153413 - protein, 45 aa, Cryptosporidium hominis
NKRYSTISNEAYPLKAKSRNNLETSDSGQSSHDSSSSSKSSRGYM

SEQ ID NO: 2153414 - protein, 12 aa, Cryptosporidium hominis
NKSASLNGPLSG

SEQ ID NO: 2153415 - protein, 7 aa, Cryptosporidium hominis
NKSDLIR

SEQ ID NO: 2153416 - protein, 10 aa, Cryptosporidium hominis
NKSDPNSGVE

SEQ ID NO: 2153417 - protein, 10 aa, Cryptosporidium hominis
NKSDSKDMIN

SEQ ID NO: 2153418 - protein, 13 aa, Cryptosporidium hominis
NKSEAAQLNSSHD

SEQ ID NO: 2153419 - protein, 9 aa, Cryptosporidium hominis
NKSESQISD

SEQ ID NO: 2153420 - protein, 5 aa, Cryptosporidium hominis
NKSEV

SEQ ID NO: 2153421 - protein, 8 aa, Cryptosporidium hominis
NKSFGGAR

SEQ ID NO: 2153422 - protein, 6 aa, Cryptosporidium hominis
NKSFNP

SEQ ID NO: 2153423 - protein, 13 aa, Cryptosporidium hominis
NKSGDKNKEFDGV

SEQ ID NO: 2153424 - protein, 5 aa, Cryptosporidium hominis
NKSGK

SEQ ID NO: 2153425 - protein, 7 aa, Cryptosporidium hominis
NKSIYSE

SEQ ID NO: 2153426 - protein, 10 aa, Cryptosporidium hominis
NKSKAKTDSE

SEQ ID NO: 2153427 - protein, 21 aa, Cryptosporidium hominis
NKSKGERDLAQNQDQDQYQDP

SEQ ID NO: 2153428 - protein, 23 aa, Cryptosporidium hominis
NKSKKKSLGNESTSTLNDDIEND

SEQ ID NO: 2153429 - protein, 21 aa, Cryptosporidium hominis
NKSKLNKCQTDQIEAGNRGMG

SEQ ID NO: 2153430 - protein, 14 aa, Cryptosporidium hominis
NKSKSLKDSKNQTK

SEQ ID NO: 2153431 - protein, 20 aa, Cryptosporidium hominis
NKSKTNLVSNKESHKGNEMP

SEQ ID NO: 2153432 - protein, 9 aa, Cryptosporidium hominis
NKSLEEQNT

SEQ ID NO: 2153433 - protein, 15 aa, Cryptosporidium hominis
NKSLKPNNEISSNSK

SEQ ID NO: 2153434 - protein, 7 aa, Cryptosporidium hominis
NKSMRSL

SEQ ID NO: 2153435 - protein, 28 aa, Cryptosporidium hominis
NKSNFKDPKSKNDDENNFSENDPLVPPK

SEQ ID NO: 2153436 - protein, 9 aa, Cryptosporidium hominis
NKSNINNDP

SEQ ID NO: 2153437 - protein, 11 aa, Cryptosporidium hominis
NKSNPNKAPLG

SEQ ID NO: 2153438 - protein, 11 aa, Cryptosporidium hominis
NKSNQNNSISK

SEQ ID NO: 2153439 - protein, 12 aa, Cryptosporidium hominis
NKSNSRSEIKDN

SEQ ID NO: 2153440 - protein, 15 aa, Cryptosporidium hominis
NKSNSRSSTKDKGSL

SEQ ID NO: 2153441 - protein, 10 aa, Cryptosporidium hominis
NKSNYDGQMG

SEQ ID NO: 2153442 - protein, 36 aa, Cryptosporidium hominis
NKSPGLEHTKNKYSEEIGGAYSPFRKRNKNNEKYSL

SEQ ID NO: 2153443 - protein, 8 aa, Cryptosporidium hominis
NKSPSWNS

SEQ ID NO: 2153444 - protein, 9 aa, Cryptosporidium hominis
NKSQEGNQF

SEQ ID NO: 2153445 - protein, 7 aa, Cryptosporidium hominis
NKSQLEQ

SEQ ID NO: 2153446 - protein, 19 aa, Cryptosporidium hominis
NKSRKVNNSSKNGFESTNI

SEQ ID NO: 2153447 - protein, 13 aa, Cryptosporidium hominis
NKSSEMDEDISEK

SEQ ID NO: 2153448 - protein, 9 aa, Cryptosporidium hominis
NKSSGKITK

SEQ ID NO: 2153449 - protein, 14 aa, Cryptosporidium hominis
NKSSKASKNDEDSE

SEQ ID NO: 2153450 - protein, 7 aa, Cryptosporidium hominis
NKSSLND

SEQ ID NO: 2153451 - protein, 8 aa, Cryptosporidium hominis
NKSSSEEV

SEQ ID NO: 2153452 - protein, 7 aa, Cryptosporidium hominis
NKSSSRS

SEQ ID NO: 2153453 - protein, 10 aa, Cryptosporidium hominis
NKSSSYTENS

SEQ ID NO: 2153454 - protein, 8 aa, Cryptosporidium hominis
NKSTLRKK

SEQ ID NO: 2153455 - protein, 18 aa, Cryptosporidium hominis
NKSTSSKKVDKRTKFDQK

SEQ ID NO: 2153456 - protein, 8 aa, Cryptosporidium hominis
NKSVENKN

SEQ ID NO: 2153457 - protein, 10 aa, Cryptosporidium hominis
NKSVPTQITD

SEQ ID NO: 2153458 - protein, 9 aa, Cryptosporidium hominis
NKSYNSNKW

SEQ ID NO: 2153459 - protein, 9 aa, Cryptosporidium hominis
NKSYSNQFK

SEQ ID NO: 2153460 - protein, 13 aa, Cryptosporidium hominis
NKTATDPNTEDDY

SEQ ID NO: 2153461 - protein, 7 aa, Cryptosporidium hominis
NKTDKNN

SEQ ID NO: 2153462 - protein, 6 aa, Cryptosporidium hominis
NKTDKS

SEQ ID NO: 2153463 - protein, 6 aa, Cryptosporidium hominis
NKTEET

SEQ ID NO: 2153464 - protein, 7 aa, Cryptosporidium hominis
NKTERQK

SEQ ID NO: 2153465 - protein, 15 aa, Cryptosporidium hominis
NKTGNDLKEGTIEKV

SEQ ID NO: 2153466 - protein, 27 aa, Cryptosporidium hominis
NKTGNNETISNNSQNNSTNTQSTSSFH

SEQ ID NO: 2153467 - protein, 7 aa, Cryptosporidium hominis
NKTGTKR

SEQ ID NO: 2153468 - protein, 9 aa, Cryptosporidium hominis
NKTGTVPST

SEQ ID NO: 2153469 - protein, 5 aa, Cryptosporidium hominis
NKTHQ

SEQ ID NO: 2153470 - protein, 6 aa, Cryptosporidium hominis
NKTIQN

SEQ ID NO: 2153471 - protein, 38 aa, Cryptosporidium hominis
NKTKENEPYRSTGTRNDSKDGEKSTNSNSNFNTPTKYR

SEQ ID NO: 2153472 - protein, 15 aa, Cryptosporidium hominis
NKTKNANPKSNSLDL

SEQ ID NO: 2153473 - protein, 7 aa, Cryptosporidium hominis
NKTLQNT

SEQ ID NO: 2153474 - protein, 8 aa, Cryptosporidium hominis
NKTNNDIE

SEQ ID NO: 2153475 - protein, 8 aa, Cryptosporidium hominis
NKTNNERN

SEQ ID NO: 2153476 - protein, 5 aa, Cryptosporidium hominis
NKTNS

SEQ ID NO: 2153477 - protein, 7 aa, Cryptosporidium hominis
NKTPKLS

SEQ ID NO: 2153478 - protein, 8 aa, Cryptosporidium hominis
NKTPRAVE

SEQ ID NO: 2153479 - protein, 8 aa, Cryptosporidium hominis
NKTQGEKA

SEQ ID NO: 2153480 - protein, 13 aa, Cryptosporidium hominis
NKTSFSSGSNVRN

SEQ ID NO: 2153481 - protein, 7 aa, Cryptosporidium hominis
NKTSHPM

SEQ ID NO: 2153482 - protein, 7 aa, Cryptosporidium hominis
NKTSNYD

SEQ ID NO: 2153483 - protein, 4 aa, Cryptosporidium hominis
NKTT

SEQ ID NO: 2153484 - protein, 18 aa, Cryptosporidium hominis
NKTTELTTGGTLNSDMNS

SEQ ID NO: 2153485 - protein, 7 aa, Cryptosporidium hominis
NKTTEPV

SEQ ID NO: 2153486 - protein, 8 aa, Cryptosporidium hominis
NKTTKEQA

SEQ ID NO: 2153487 - protein, 29 aa, Cryptosporidium hominis
NKTTSLDDDFASTSTPSDSTNSDPEKTPY

SEQ ID NO: 2153488 - protein, 4 aa, Cryptosporidium hominis
NKTV

SEQ ID NO: 2153489 - protein, 5 aa, Cryptosporidium hominis
NKVDS

SEQ ID NO: 2153490 - protein, 15 aa, Cryptosporidium hominis
NKVKNKPNSVMNSTE

SEQ ID NO: 2153491 - protein, 9 aa, Cryptosporidium hominis
NKVQTPNDS

SEQ ID NO: 2153492 - protein, 26 aa, Cryptosporidium hominis
NKVTDTMKSAQKSNERAGPMGEKDPI

SEQ ID NO: 2153493 - protein, 6 aa, Cryptosporidium hominis
NKVTEY

SEQ ID NO: 2153494 - protein, 14 aa, Cryptosporidium hominis
NKVTNNNNNNNNNN

SEQ ID NO: 2153495 - protein, 7 aa, Cryptosporidium hominis
NKYEELG

SEQ ID NO: 2153496 - protein, 8 aa, Cryptosporidium hominis
NKYGEENA

SEQ ID NO: 2153497 - protein, 22 aa, Cryptosporidium hominis
NKYGKSVHGGNSTYGSTYSPNR

SEQ ID NO: 2153498 - protein, 6 aa, Cryptosporidium hominis
NKYKKI

SEQ ID NO: 2153499 - protein, 18 aa, Cryptosporidium hominis
NKYKNGPRYNLQNSDNDN

SEQ ID NO: 2153500 - protein, 12 aa, Cryptosporidium hominis
NKYKSTNDELNE

SEQ ID NO: 2153501 - protein, 5 aa, Cryptosporidium hominis
NKYLN

SEQ ID NO: 2153502 - protein, 6 aa, Cryptosporidium hominis
NKYNIS

SEQ ID NO: 2153503 - protein, 13 aa, Cryptosporidium hominis
NKYNRTGNNFSSF

SEQ ID NO: 2153504 - protein, 6 aa, Cryptosporidium hominis
NKYSKE

SEQ ID NO: 2153505 - protein, 9 aa, Cryptosporidium hominis
NKYSNLNNE

SEQ ID NO: 2153506 - protein, 16 aa, Cryptosporidium hominis
NLATSKINSNHINEGT

SEQ ID NO: 2153507 - protein, 5 aa, Cryptosporidium hominis
NLDEE

SEQ ID NO: 2153508 - protein, 13 aa, Cryptosporidium hominis
NLDEIEDGTKIQE

SEQ ID NO: 2153509 - protein, 13 aa, Cryptosporidium hominis
NLDEKTSDSALNE

SEQ ID NO: 2153510 - protein, 6 aa, Cryptosporidium hominis
NLDETG

SEQ ID NO: 2153511 - protein, 8 aa, Cryptosporidium hominis
NLDKAAAA

SEQ ID NO: 2153512 - protein, 32 aa, Cryptosporidium hominis
NLDKSKSSFGIRPEDSISKISAKTTNSNTISR

SEQ ID NO: 2153513 - protein, 8 aa, Cryptosporidium hominis
NLDNEGSY

SEQ ID NO: 2153514 - protein, 11 aa, Cryptosporidium hominis
NLDNNNNYTES

SEQ ID NO: 2153515 - protein, 9 aa, Cryptosporidium hominis
NLDNNSNLA

SEQ ID NO: 2153516 - protein, 5 aa, Cryptosporidium hominis
NLDNR

SEQ ID NO: 2153517 - protein, 25 aa, Cryptosporidium hominis
NLDNSSIRKRSFNASENVENTPKKR

SEQ ID NO: 2153518 - protein, 15 aa, Cryptosporidium hominis
NLDSKSKQASWRTSE

SEQ ID NO: 2153519 - protein, 25 aa, Cryptosporidium hominis
NLEEDKKNIEDTDSVHQEDLKQESD

SEQ ID NO: 2153520 - protein, 10 aa, Cryptosporidium hominis
NLEEENDEEF

SEQ ID NO: 2153521 - protein, 35 aa, Cryptosporidium hominis
NLENHDEDENELENNEGQVNNEDYNERDHDEVEDN

SEQ ID NO: 2153522 - protein, 20 aa, Cryptosporidium hominis
NLENIDDNNNNNNSTMSPNY

SEQ ID NO: 2153523 - protein, 12 aa, Cryptosporidium hominis
NLENNKEKLNED

SEQ ID NO: 2153524 - protein, 7 aa, Cryptosporidium hominis
NLENQNK

SEQ ID NO: 2153525 - protein, 8 aa, Cryptosporidium hominis
NLENTDQI

SEQ ID NO: 2153526 - protein, 7 aa, Cryptosporidium hominis
NLENTPQ

SEQ ID NO: 2153527 - protein, 24 aa, Cryptosporidium hominis
NLESASKPSKVKKITKKDAGQSLK

SEQ ID NO: 2153528 - protein, 11 aa, Cryptosporidium hominis
NLESEDESSLD

SEQ ID NO: 2153529 - protein, 10 aa, Cryptosporidium hominis
NLESSSNSNI

SEQ ID NO: 2153530 - protein, 15 aa, Cryptosporidium hominis
NLESTNKSLDNPVDQ

SEQ ID NO: 2153531 - protein, 6 aa, Cryptosporidium hominis
NLETEA

SEQ ID NO: 2153532 - protein, 11 aa, Cryptosporidium hominis
NLETNDEPTKF

SEQ ID NO: 2153533 - protein, 13 aa, Cryptosporidium hominis
NLGFSKEHSRRED

SEQ ID NO: 2153534 - protein, 18 aa, Cryptosporidium hominis
NLGNNIDGRTPQTTKSQV

SEQ ID NO: 2153535 - protein, 7 aa, Cryptosporidium hominis
NLGPKGT

SEQ ID NO: 2153536 - protein, 10 aa, Cryptosporidium hominis
NLGPKNPSEF

SEQ ID NO: 2153537 - protein, 5 aa, Cryptosporidium hominis
NLGQH

SEQ ID NO: 2153538 - protein, 18 aa, Cryptosporidium hominis
NLKKNDKSRSSENNININ

SEQ ID NO: 2153539 - protein, 7 aa, Cryptosporidium hominis
NLKNNQN

SEQ ID NO: 2153540 - protein, 5 aa, Cryptosporidium hominis
NLKNS

SEQ ID NO: 2153541 - protein, 7 aa, Cryptosporidium hominis
NLKQGNI

SEQ ID NO: 2153542 - protein, 5 aa, Cryptosporidium hominis
NLKSQ

SEQ ID NO: 2153543 - protein, 11 aa, Cryptosporidium hominis
NLKSTDNWKNP

SEQ ID NO: 2153544 - protein, 4 aa, Cryptosporidium hominis
NLKT

SEQ ID NO: 2153545 - protein, 5 aa, Cryptosporidium hominis
NLKTD

SEQ ID NO: 2153546 - protein, 9 aa, Cryptosporidium hominis
NLKTQESSE

SEQ ID NO: 2153547 - protein, 18 aa, Cryptosporidium hominis
NLKTTDTNLARSNTTPLL

SEQ ID NO: 2153548 - protein, 7 aa, Cryptosporidium hominis
NLLTPSQ

SEQ ID NO: 2153549 - protein, 4 aa, Cryptosporidium hominis
NLNE

SEQ ID NO: 2153550 - protein, 13 aa, Cryptosporidium hominis
NLNGNNNSNSTIG

SEQ ID NO: 2153551 - protein, 5 aa, Cryptosporidium hominis
NLNKD

SEQ ID NO: 2153552 - protein, 5 aa, Cryptosporidium hominis
NLNKT

SEQ ID NO: 2153553 - protein, 7 aa, Cryptosporidium hominis
NLNPSNE

SEQ ID NO: 2153554 - protein, 20 aa, Cryptosporidium hominis
NLNPTNVNKAGNLNSGKKRI

SEQ ID NO: 2153555 - protein, 14 aa, Cryptosporidium hominis
NLNQDSSSIPVGES

SEQ ID NO: 2153556 - protein, 12 aa, Cryptosporidium hominis
NLNREEKRTTQQ

SEQ ID NO: 2153557 - protein, 11 aa, Cryptosporidium hominis
NLNSESELSPE

SEQ ID NO: 2153558 - protein, 6 aa, Cryptosporidium hominis
NLNSKT

SEQ ID NO: 2153559 - protein, 21 aa, Cryptosporidium hominis
NLNSNKKKKRIPDSENPDEIW

SEQ ID NO: 2153560 - protein, 25 aa, Cryptosporidium hominis
NLNSSSNMSFTGGSTSSQTALQTPG

SEQ ID NO: 2153561 - protein, 6 aa, Cryptosporidium hominis
NLNTSQ

SEQ ID NO: 2153562 - protein, 8 aa, Cryptosporidium hominis
NLNTSTTN

SEQ ID NO: 2153563 - protein, 33 aa, Cryptosporidium hominis
NLPATTEKLKQKPRKSKKAVKIEGNSPAVPPNE

SEQ ID NO: 2153564 - protein, 16 aa, Cryptosporidium hominis
NLPENPVYSSEQGTER

SEQ ID NO: 2153565 - protein, 6 aa, Cryptosporidium hominis
NLPESN

SEQ ID NO: 2153566 - protein, 7 aa, Cryptosporidium hominis
NLPEYSG

SEQ ID NO: 2153567 - protein, 4 aa, Cryptosporidium hominis
NLPI

SEQ ID NO: 2153568 - protein, 14 aa, Cryptosporidium hominis
NLPKENSDDENEDE

SEQ ID NO: 2153569 - protein, 5 aa, Cryptosporidium hominis
NLPND

SEQ ID NO: 2153570 - protein, 11 aa, Cryptosporidium hominis
NLPNKTSVEQQ

SEQ ID NO: 2153571 - protein, 8 aa, Cryptosporidium hominis
NLPPKLKE

SEQ ID NO: 2153572 - protein, 23 aa, Cryptosporidium hominis
NLPQGGCSQTGYMENSQNNIQND

SEQ ID NO: 2153573 - protein, 7 aa, Cryptosporidium hominis
NLPQNPE

SEQ ID NO: 2153574 - protein, 10 aa, Cryptosporidium hominis
NLPSDGNEHS

SEQ ID NO: 2153575 - protein, 21 aa, Cryptosporidium hominis
NLPSLSTSCSPTSVSAVTPTQ

SEQ ID NO: 2153576 - protein, 12 aa, Cryptosporidium hominis
NLPSNDSANPIP

SEQ ID NO: 2153577 - protein, 6 aa, Cryptosporidium hominis
NLPSTD

SEQ ID NO: 2153578 - protein, 7 aa, Cryptosporidium hominis
NLQDGNP

SEQ ID NO: 2153579 - protein, 5 aa, Cryptosporidium hominis
NLQPS

SEQ ID NO: 2153580 - protein, 11 aa, Cryptosporidium hominis
NLQSKSAYNTG

SEQ ID NO: 2153581 - protein, 12 aa, Cryptosporidium hominis
NLQSNETPEGVN

SEQ ID NO: 2153582 - protein, 7 aa, Cryptosporidium hominis
NLQTDQT

SEQ ID NO: 2153583 - protein, 10 aa, Cryptosporidium hominis
NLREISPGNL

SEQ ID NO: 2153584 - protein, 5 aa, Cryptosporidium hominis
NLRKD

SEQ ID NO: 2153585 - protein, 4 aa, Cryptosporidium hominis
NLRV

SEQ ID NO: 2153586 - protein, 7 aa, Cryptosporidium hominis
NLSEEDA

SEQ ID NO: 2153587 - protein, 29 aa, Cryptosporidium hominis
NLSEEELDETLESESEENTENIESENEDD

SEQ ID NO: 2153588 - protein, 6 aa, Cryptosporidium hominis
NLSEGA

SEQ ID NO: 2153589 - protein, 22 aa, Cryptosporidium hominis
NLSENNMNNGITTASKTNKTCN

SEQ ID NO: 2153590 - protein, 7 aa, Cryptosporidium hominis
NLSEQRK

SEQ ID NO: 2153591 - protein, 34 aa, Cryptosporidium hominis
NLSESKDKSTSVRSKNIHKSRKKSRRPASRSRRK

SEQ ID NO: 2153592 - protein, 12 aa, Cryptosporidium hominis
NLSETRNSIIET

SEQ ID NO: 2153593 - protein, 6 aa, Cryptosporidium hominis
NLSGEA

SEQ ID NO: 2153594 - protein, 18 aa, Cryptosporidium hominis
NLSGSGGIAGETSKASKS

SEQ ID NO: 2153595 - protein, 21 aa, Cryptosporidium hominis
NLSGSGGSAQNVTAVGPSVSC

SEQ ID NO: 2153596 - protein, 10 aa, Cryptosporidium hominis
NLSINSNKVN

SEQ ID NO: 2153597 - protein, 16 aa, Cryptosporidium hominis
NLSKDGRYSELNNRST

SEQ ID NO: 2153598 - protein, 5 aa, Cryptosporidium hominis
NLSKE

SEQ ID NO: 2153599 - protein, 15 aa, Cryptosporidium hominis
NLSNDSSLSSSRISS

SEQ ID NO: 2153600 - protein, 49 aa, Cryptosporidium hominis
NLSNSNELNQESKPEVEKEGIDKVEEENSKGVNENHDDDQNSKSASSGL

SEQ ID NO: 2153601 - protein, 6 aa, Cryptosporidium hominis
NLSNTE

SEQ ID NO: 2153602 - protein, 12 aa, Cryptosporidium hominis
NLSNTKQEKESD

SEQ ID NO: 2153603 - protein, 5 aa, Cryptosporidium hominis
NLSPD

SEQ ID NO: 2153604 - protein, 8 aa, Cryptosporidium hominis
NLSQNSNF

SEQ ID NO: 2153605 - protein, 12 aa, Cryptosporidium hominis
NLSRSSPNMPNE

SEQ ID NO: 2153606 - protein, 35 aa, Cryptosporidium hominis
NLSSDTKANSSSGSNRSDRKDQVLDQSEDFQPHNL

SEQ ID NO: 2153607 - protein, 11 aa, Cryptosporidium hominis
NLSSNFGTNYS

SEQ ID NO: 2153608 - protein, 9 aa, Cryptosporidium hominis
NLSSPRALS

SEQ ID NO: 2153609 - protein, 8 aa, Cryptosporidium hominis
NLSSRNRK

SEQ ID NO: 2153610 - protein, 16 aa, Cryptosporidium hominis
NLSSSERTSSSSGNSI

SEQ ID NO: 2153611 - protein, 16 aa, Cryptosporidium hominis
NLSTGRSVNGGQSKRV

SEQ ID NO: 2153612 - protein, 7 aa, Cryptosporidium hominis
NLTDDGK

SEQ ID NO: 2153613 - protein, 6 aa, Cryptosporidium hominis
NLTDEQ

SEQ ID NO: 2153614 - protein, 4 aa, Cryptosporidium hominis
NLTK

SEQ ID NO: 2153615 - protein, 7 aa, Cryptosporidium hominis
NLTNDPN

SEQ ID NO: 2153616 - protein, 21 aa, Cryptosporidium hominis
NLTQQNDNQSVNTNEKTGMRT

SEQ ID NO: 2153617 - protein, 7 aa, Cryptosporidium hominis
NLTRNNK

SEQ ID NO: 2153618 - protein, 6 aa, Cryptosporidium hominis
NLTSPI

SEQ ID NO: 2153619 - protein, 4 aa, Cryptosporidium hominis
NLVG

SEQ ID NO: 2153620 - protein, 7 aa, Cryptosporidium hominis
NLVPGGG

SEQ ID NO: 2153621 - protein, 4 aa, Cryptosporidium hominis
NLVS

SEQ ID NO: 2153622 - protein, 6 aa, Cryptosporidium hominis
NLYSET

SEQ ID NO: 2153623 - protein, 9 aa, Cryptosporidium hominis
NLYSSEGIS

SEQ ID NO: 2153624 - protein, 12 aa, Cryptosporidium hominis
NMDENKDPREAI

SEQ ID NO: 2153625 - protein, 4 aa, Cryptosporidium hominis
NMEE

SEQ ID NO: 2153626 - protein, 5 aa, Cryptosporidium hominis
NMGDF

SEQ ID NO: 2153627 - protein, 5 aa, Cryptosporidium hominis
NMHDS

SEQ ID NO: 2153628 - protein, 16 aa, Cryptosporidium hominis
NMKSQERTPEQERAEK

SEQ ID NO: 2153629 - protein, 4 aa, Cryptosporidium hominis
NMNQ

SEQ ID NO: 2153630 - protein, 10 aa, Cryptosporidium hominis
NMNSDTNEEI

SEQ ID NO: 2153631 - protein, 5 aa, Cryptosporidium hominis
NMQPT

SEQ ID NO: 2153632 - protein, 5 aa, Cryptosporidium hominis
NMSEI

SEQ ID NO: 2153633 - protein, 12 aa, Cryptosporidium hominis
NMSEPIDLFFAI

SEQ ID NO: 2153634 - protein, 12 aa, Cryptosporidium hominis
NMSKDTTHRYGK

SEQ ID NO: 2153635 - protein, 22 aa, Cryptosporidium hominis
NMSRSGSYSATETSELASKYNE

SEQ ID NO: 2153636 - protein, 11 aa, Cryptosporidium hominis
NMSTKGGISEE

SEQ ID NO: 2153637 - protein, 22 aa, Cryptosporidium hominis
NMTESTTYNSELSKQLKENSNF

SEQ ID NO: 2153638 - protein, 17 aa, Cryptosporidium hominis
NMTSGIGSYDHKTRTTR

SEQ ID NO: 2153639 - protein, 13 aa, Cryptosporidium hominis
NMYNTDSNNLNES

SEQ ID NO: 2153640 - protein, 7 aa, Cryptosporidium hominis
NNAEKTL

SEQ ID NO: 2153641 - protein, 12 aa, Cryptosporidium hominis
NNAFKANSRRVN

SEQ ID NO: 2153642 - protein, 9 aa, Cryptosporidium hominis
NNAGDSSYL

SEQ ID NO: 2153643 - protein, 5 aa, Cryptosporidium hominis
NNAHN

SEQ ID NO: 2153644 - protein, 7 aa, Cryptosporidium hominis
NNAKENL

SEQ ID NO: 2153645 - protein, 9 aa, Cryptosporidium hominis
NNALSSSGE

SEQ ID NO: 2153646 - protein, 10 aa, Cryptosporidium hominis
NNANKGPLGS

SEQ ID NO: 2153647 - protein, 9 aa, Cryptosporidium hominis
NNANNRKAF

SEQ ID NO: 2153648 - protein, 5 aa, Cryptosporidium hominis
NNARL

SEQ ID NO: 2153649 - protein, 12 aa, Cryptosporidium hominis
NNASATSGGSKK

SEQ ID NO: 2153650 - protein, 46 aa, Cryptosporidium hominis
NNASSGNNSNCNNGGNNSGNKVGSNVGNNGNGGVSNSISNGNGGSN

SEQ ID NO: 2153651 - protein, 27 aa, Cryptosporidium hominis
NNATNNNDSTDLGEKYNDERVPDPTLT

SEQ ID NO: 2153652 - protein, 15 aa, Cryptosporidium hominis
NNATNTLDNKSENEL

SEQ ID NO: 2153653 - protein, 6 aa, Cryptosporidium hominis
NNCANE

SEQ ID NO: 2153654 - protein, 13 aa, Cryptosporidium hominis
NNCDNNNDNNHDI

SEQ ID NO: 2153655 - protein, 18 aa, Cryptosporidium hominis
NNCHNSSKLNKDVSNYYS

SEQ ID NO: 2153656 - protein, 5 aa, Cryptosporidium hominis
NNCSN

SEQ ID NO: 2153657 - protein, 13 aa, Cryptosporidium hominis
NNDDEITKNSFQK

SEQ ID NO: 2153658 - protein, 24 aa, Cryptosporidium hominis
NNDEGLNELSDGNIKNEKEAKKHK

SEQ ID NO: 2153659 - protein, 14 aa, Cryptosporidium hominis
NNDEPNTRNYNPSS

SEQ ID NO: 2153660 - protein, 17 aa, Cryptosporidium hominis
NNDGENNKEADGTLDSK

SEQ ID NO: 2153661 - protein, 19 aa, Cryptosporidium hominis
NNDIKKSESSNKRLTKSQK

SEQ ID NO: 2153662 - protein, 5 aa, Cryptosporidium hominis
NNDIS

SEQ ID NO: 2153663 - protein, 5 aa, Cryptosporidium hominis
NNDKD

SEQ ID NO: 2153664 - protein, 9 aa, Cryptosporidium hominis
NNDKDEKVE

SEQ ID NO: 2153665 - protein, 4 aa, Cryptosporidium hominis
NNDL

SEQ ID NO: 2153666 - protein, 6 aa, Cryptosporidium hominis
NNDNDI

SEQ ID NO: 2153667 - protein, 19 aa, Cryptosporidium hominis
NNDNESQPPVHPGYTGDNE

SEQ ID NO: 2153668 - protein, 21 aa, Cryptosporidium hominis
NNDNPSSSSSSENHSKFPENA

SEQ ID NO: 2153669 - protein, 7 aa, Cryptosporidium hominis
NNDNVSN

SEQ ID NO: 2153670 - protein, 8 aa, Cryptosporidium hominis
NNDPNLAA

SEQ ID NO: 2153671 - protein, 8 aa, Cryptosporidium hominis
NNDRENAI

SEQ ID NO: 2153672 - protein, 26 aa, Cryptosporidium hominis
NNDSALENKDQEMENADGGNEQLNTD

SEQ ID NO: 2153673 - protein, 8 aa, Cryptosporidium hominis
NNDSDTNN

SEQ ID NO: 2153674 - protein, 18 aa, Cryptosporidium hominis
NNDSGSSNSYSGRTSLQG

SEQ ID NO: 2153675 - protein, 14 aa, Cryptosporidium hominis
NNDSMSNSNNIENL

SEQ ID NO: 2153676 - protein, 7 aa, Cryptosporidium hominis
NNDTDSN

SEQ ID NO: 2153677 - protein, 29 aa, Cryptosporidium hominis
NNDTLTGKSGLNLERNSTVQNDEKNIGSK

SEQ ID NO: 2153678 - protein, 13 aa, Cryptosporidium hominis
NNDTPNSKRASEG

SEQ ID NO: 2153679 - protein, 7 aa, Cryptosporidium hominis
NNDVSNG

SEQ ID NO: 2153680 - protein, 6 aa, Cryptosporidium hominis
NNDYPF

SEQ ID NO: 2153681 - protein, 6 aa, Cryptosporidium hominis
NNEAVR

SEQ ID NO: 2153682 - protein, 6 aa, Cryptosporidium hominis
NNECDG

SEQ ID NO: 2153683 - protein, 8 aa, Cryptosporidium hominis
NNEDESYY

SEQ ID NO: 2153684 - protein, 17 aa, Cryptosporidium hominis
NNEEKMDDSTLENKVGE

SEQ ID NO: 2153685 - protein, 14 aa, Cryptosporidium hominis
NNEENLEKAGISQV

SEQ ID NO: 2153686 - protein, 22 aa, Cryptosporidium hominis
NNEESPKRNSSISKEVNSNIGK

SEQ ID NO: 2153687 - protein, 7 aa, Cryptosporidium hominis
NNEFEQL

SEQ ID NO: 2153688 - protein, 21 aa, Cryptosporidium hominis
NNEFSNSNNESRSSNHEEIES

SEQ ID NO: 2153689 - protein, 6 aa, Cryptosporidium hominis
NNEGSH

SEQ ID NO: 2153690 - protein, 9 aa, Cryptosporidium hominis
NNEINTNIN

SEQ ID NO: 2153691 - protein, 9 aa, Cryptosporidium hominis
NNEKDINNS

SEQ ID NO: 2153692 - protein, 9 aa, Cryptosporidium hominis
NNEKLKNEI

SEQ ID NO: 2153693 - protein, 15 aa, Cryptosporidium hominis
NNEKNKNENKEEYEE

SEQ ID NO: 2153694 - protein, 6 aa, Cryptosporidium hominis
NNELDT

SEQ ID NO: 2153695 - protein, 7 aa, Cryptosporidium hominis
NNELKER

SEQ ID NO: 2153696 - protein, 4 aa, Cryptosporidium hominis
NNEN

SEQ ID NO: 2153697 - protein, 9 aa, Cryptosporidium hominis
NNENEGDDE

SEQ ID NO: 2153698 - protein, 5 aa, Cryptosporidium hominis
NNENI

SEQ ID NO: 2153699 - protein, 28 aa, Cryptosporidium hominis
NNENISQNTVNSVGQEYKRVSNQGVSQK

SEQ ID NO: 2153700 - protein, 20 aa, Cryptosporidium hominis
NNENKLKGKGAVSLDQSAEV

SEQ ID NO: 2153701 - protein, 8 aa, Cryptosporidium hominis
NNENNIHT

SEQ ID NO: 2153702 - protein, 7 aa, Cryptosporidium hominis
NNENNSI

SEQ ID NO: 2153703 - protein, 24 aa, Cryptosporidium hominis
NNEPDKSDDKVSSSISFSSPSNME

SEQ ID NO: 2153704 - protein, 5 aa, Cryptosporidium hominis
NNEQG

SEQ ID NO: 2153705 - protein, 20 aa, Cryptosporidium hominis
NNEQHKSPYTSNQTLKSESN

SEQ ID NO: 2153706 - protein, 18 aa, Cryptosporidium hominis
NNERKDESQINQNIPKNN

SEQ ID NO: 2153707 - protein, 5 aa, Cryptosporidium hominis
NNESE

SEQ ID NO: 2153708 - protein, 9 aa, Cryptosporidium hominis
NNESNKCSQ

SEQ ID NO: 2153709 - protein, 10 aa, Cryptosporidium hominis
NNETAFDNGG

SEQ ID NO: 2153710 - protein, 8 aa, Cryptosporidium hominis
NNETEDLS

SEQ ID NO: 2153711 - protein, 12 aa, Cryptosporidium hominis
NNETGSIYPRGG

SEQ ID NO: 2153712 - protein, 6 aa, Cryptosporidium hominis
NNETRS

SEQ ID NO: 2153713 - protein, 4 aa, Cryptosporidium hominis
NNEY

SEQ ID NO: 2153714 - protein, 7 aa, Cryptosporidium hominis
NNEYRQE

SEQ ID NO: 2153715 - protein, 11 aa, Cryptosporidium hominis
NNFDKNTHSEL

SEQ ID NO: 2153716 - protein, 4 aa, Cryptosporidium hominis
NNFE

SEQ ID NO: 2153717 - protein, 12 aa, Cryptosporidium hominis
NNFNKDEGIKDH

SEQ ID NO: 2153718 - protein, 7 aa, Cryptosporidium hominis
NNFNSEI

SEQ ID NO: 2153719 - protein, 13 aa, Cryptosporidium hominis
NNFNSQNDASDYS

SEQ ID NO: 2153720 - protein, 19 aa, Cryptosporidium hominis
NNFPNSNNRNAYSNNNNIN

SEQ ID NO: 2153721 - protein, 23 aa, Cryptosporidium hominis
NNFQNDSYEQGSHSLPNDICDLG

SEQ ID NO: 2153722 - protein, 10 aa, Cryptosporidium hominis
NNFSESPDND

SEQ ID NO: 2153723 - protein, 5 aa, Cryptosporidium hominis
NNFSQ

SEQ ID NO: 2153724 - protein, 5 aa, Cryptosporidium hominis
NNGEF

SEQ ID NO: 2153725 - protein, 6 aa, Cryptosporidium hominis
NNGEFQ

SEQ ID NO: 2153726 - protein, 18 aa, Cryptosporidium hominis
NNGELNSSSISSEQVDEL

SEQ ID NO: 2153727 - protein, 6 aa, Cryptosporidium hominis
NNGETE

SEQ ID NO: 2153728 - protein, 8 aa, Cryptosporidium hominis
NNGFNDNQ

SEQ ID NO: 2153729 - protein, 5 aa, Cryptosporidium hominis
NNGGP

SEQ ID NO: 2153730 - protein, 8 aa, Cryptosporidium hominis
NNGGSGVN

SEQ ID NO: 2153731 - protein, 15 aa, Cryptosporidium hominis
NNGGSTGNNADAHAL

SEQ ID NO: 2153732 - protein, 17 aa, Cryptosporidium hominis
NNGGTDGMRNESSTPRF

SEQ ID NO: 2153733 - protein, 5 aa, Cryptosporidium hominis
NNGGY

SEQ ID NO: 2153734 - protein, 14 aa, Cryptosporidium hominis
NNGHGGSVTSTLPS

SEQ ID NO: 2153735 - protein, 18 aa, Cryptosporidium hominis
NNGINTGAPGSNNNPIII

SEQ ID NO: 2153736 - protein, 4 aa, Cryptosporidium hominis
NNGL

SEQ ID NO: 2153737 - protein, 6 aa, Cryptosporidium hominis
NNGNEE

SEQ ID NO: 2153738 - protein, 24 aa, Cryptosporidium hominis
NNGNGKEDQTEGVTSGENDENSNK

SEQ ID NO: 2153739 - protein, 12 aa, Cryptosporidium hominis
NNGNNSLSDSKE

SEQ ID NO: 2153740 - protein, 8 aa, Cryptosporidium hominis
NNGNPHDN

SEQ ID NO: 2153741 - protein, 9 aa, Cryptosporidium hominis
NNGNVNTNC

SEQ ID NO: 2153742 - protein, 14 aa, Cryptosporidium hominis
NNGNYFDQENDQIS

SEQ ID NO: 2153743 - protein, 9 aa, Cryptosporidium hominis
NNGSPNTNG

SEQ ID NO: 2153744 - protein, 6 aa, Cryptosporidium hominis
NNGTHN

SEQ ID NO: 2153745 - protein, 6 aa, Cryptosporidium hominis
NNGTWG

SEQ ID NO: 2153746 - protein, 18 aa, Cryptosporidium hominis
NNGVGSNNHYTTNAKNNV

SEQ ID NO: 2153747 - protein, 33 aa, Cryptosporidium hominis
NNGVNNNNGNHSDSTNEDENSSVNGGHSGNGIE

SEQ ID NO: 2153748 - protein, 29 aa, Cryptosporidium hominis
NNGVNTTGSVNNSTSDSTNINSQSNHNQT

SEQ ID NO: 2153749 - protein, 15 aa, Cryptosporidium hominis
NNGVSNSGKSSNNIG

SEQ ID NO: 2153750 - protein, 4 aa, Cryptosporidium hominis
NNGY

SEQ ID NO: 2153751 - protein, 5 aa, Cryptosporidium hominis
NNHDS

SEQ ID NO: 2153752 - protein, 6 aa, Cryptosporidium hominis
NNHKPF

SEQ ID NO: 2153753 - protein, 14 aa, Cryptosporidium hominis
NNHNSNNSTYRDNS

SEQ ID NO: 2153754 - protein, 13 aa, Cryptosporidium hominis
NNHSTSNTNKNMS

SEQ ID NO: 2153755 - protein, 11 aa, Cryptosporidium hominis
NNIDDNDDDDY

SEQ ID NO: 2153756 - protein, 13 aa, Cryptosporidium hominis
NNIDYKDPNISRS

SEQ ID NO: 2153757 - protein, 7 aa, Cryptosporidium hominis
NNIENSS

SEQ ID NO: 2153758 - protein, 5 aa, Cryptosporidium hominis
NNIEP

SEQ ID NO: 2153759 - protein, 17 aa, Cryptosporidium hominis
NNIEVETSESKLSRDSS

SEQ ID NO: 2153760 - protein, 13 aa, Cryptosporidium hominis
NNIGTGSATTSVN

SEQ ID NO: 2153761 - protein, 18 aa, Cryptosporidium hominis
NNIHSSFSNEDANNTSIP

SEQ ID NO: 2153762 - protein, 7 aa, Cryptosporidium hominis
NNIKAQN

SEQ ID NO: 2153763 - protein, 14 aa, Cryptosporidium hominis
NNIKENSNYTKKGN

SEQ ID NO: 2153764 - protein, 8 aa, Cryptosporidium hominis
NNIKNSRS

SEQ ID NO: 2153765 - protein, 5 aa, Cryptosporidium hominis
NNINH

SEQ ID NO: 2153766 - protein, 14 aa, Cryptosporidium hominis
NNINQQVNRQREYG

SEQ ID NO: 2153767 - protein, 16 aa, Cryptosporidium hominis
NNIPNQNLKDGQQIES

SEQ ID NO: 2153768 - protein, 4 aa, Cryptosporidium hominis
NNIQ

SEQ ID NO: 2153769 - protein, 6 aa, Cryptosporidium hominis
NNIQGD

SEQ ID NO: 2153770 - protein, 10 aa, Cryptosporidium hominis
NNIQKQGSLI

SEQ ID NO: 2153771 - protein, 7 aa, Cryptosporidium hominis
NNIQSSN

SEQ ID NO: 2153772 - protein, 6 aa, Cryptosporidium hominis
NNISDE

SEQ ID NO: 2153773 - protein, 8 aa, Cryptosporidium hominis
NNISEHNS

SEQ ID NO: 2153774 - protein, 26 aa, Cryptosporidium hominis
NNISNSTNETLNTVSNTRRKRGTGGI

SEQ ID NO: 2153775 - protein, 8 aa, Cryptosporidium hominis
NNISSEQP

SEQ ID NO: 2153776 - protein, 11 aa, Cryptosporidium hominis
NNITGNCTSMD

SEQ ID NO: 2153777 - protein, 5 aa, Cryptosporidium hominis
NNITN

SEQ ID NO: 2153778 - protein, 10 aa, Cryptosporidium hominis
NNITPPTRQQ

SEQ ID NO: 2153779 - protein, 16 aa, Cryptosporidium hominis
NNKAQNNHDEGSKSQT

SEQ ID NO: 2153780 - protein, 10 aa, Cryptosporidium hominis
NNKCDSNKKN

SEQ ID NO: 2153781 - protein, 10 aa, Cryptosporidium hominis
NNKDGLGQRN

SEQ ID NO: 2153782 - protein, 5 aa, Cryptosporidium hominis
NNKER

SEQ ID NO: 2153783 - protein, 16 aa, Cryptosporidium hominis
NNKESKNSNYKDFKDQ

SEQ ID NO: 2153784 - protein, 22 aa, Cryptosporidium hominis
NNKETSIKTPPPSNFPTNNSNC

SEQ ID NO: 2153785 - protein, 15 aa, Cryptosporidium hominis
NNKGETDTGNIVEGT

SEQ ID NO: 2153786 - protein, 7 aa, Cryptosporidium hominis
NNKGKES

SEQ ID NO: 2153787 - protein, 9 aa, Cryptosporidium hominis
NNKGPISNT

SEQ ID NO: 2153788 - protein, 16 aa, Cryptosporidium hominis
NNKGQKSSISINNPGI

SEQ ID NO: 2153789 - protein, 13 aa, Cryptosporidium hominis
NNKGSSECSNPNF

SEQ ID NO: 2153790 - protein, 8 aa, Cryptosporidium hominis
NNKHQNYN

SEQ ID NO: 2153791 - protein, 7 aa, Cryptosporidium hominis
NNKINSP

SEQ ID NO: 2153792 - protein, 8 aa, Cryptosporidium hominis
NNKNDMAE

SEQ ID NO: 2153793 - protein, 24 aa, Cryptosporidium hominis
NNKNFSKSINSNSDQDKQLETDNN

SEQ ID NO: 2153794 - protein, 20 aa, Cryptosporidium hominis
NNKNIAGTEYNNSVEENSNI

SEQ ID NO: 2153795 - protein, 7 aa, Cryptosporidium hominis
NNKNKIK

SEQ ID NO: 2153796 - protein, 4 aa, Cryptosporidium hominis
NNKP

SEQ ID NO: 2153797 - protein, 8 aa, Cryptosporidium hominis
NNKREEQM

SEQ ID NO: 2153798 - protein, 11 aa, Cryptosporidium hominis
NNKRHHNNEFD

SEQ ID NO: 2153799 - protein, 14 aa, Cryptosporidium hominis
NNKRYSGVATYSSK

SEQ ID NO: 2153800 - protein, 7 aa, Cryptosporidium hominis
NNKSFPN

SEQ ID NO: 2153801 - protein, 6 aa, Cryptosporidium hominis
NNKSTN

SEQ ID NO: 2153802 - protein, 7 aa, Cryptosporidium hominis
NNKSVTM

SEQ ID NO: 2153803 - protein, 9 aa, Cryptosporidium hominis
NNKTEENKK

SEQ ID NO: 2153804 - protein, 6 aa, Cryptosporidium hominis
NNKVGV

SEQ ID NO: 2153805 - protein, 10 aa, Cryptosporidium hominis
NNKVSNSYDT

SEQ ID NO: 2153806 - protein, 37 aa, Cryptosporidium hominis
NNLAQSSQSINTGNPNSHGNINSHSNLQNTSNSTPGY

SEQ ID NO: 2153807 - protein, 8 aa, Cryptosporidium hominis
NNLEEEEL

SEQ ID NO: 2153808 - protein, 33 aa, Cryptosporidium hominis
NNLETSNNNGNNNNNNNNNNNNNNNNNHNDNSC

SEQ ID NO: 2153809 - protein, 11 aa, Cryptosporidium hominis
NNLGNLPNGRE

SEQ ID NO: 2153810 - protein, 5 aa, Cryptosporidium hominis
NNLHG

SEQ ID NO: 2153811 - protein, 57 aa, Cryptosporidium hominis
NNLISSPDFNKSEMEAEKPSKVKKSKKRANKDINKGEVELSDSITKKQKKAKKSLIE

SEQ ID NO: 2153812 - protein, 35 aa, Cryptosporidium hominis
NNLKESSKEKEAESNDTEEVTNSIDTHNGALEGNV

SEQ ID NO: 2153813 - protein, 10 aa, Cryptosporidium hominis
NNLKNSRKQV

SEQ ID NO: 2153814 - protein, 15 aa, Cryptosporidium hominis
NNLNNQLTSNMNDSN

SEQ ID NO: 2153815 - protein, 11 aa, Cryptosporidium hominis
NNLNSSESERH

SEQ ID NO: 2153816 - protein, 33 aa, Cryptosporidium hominis
NNLPISAGGSRRATSPDLLSPTKSTGRGPPPKI

SEQ ID NO: 2153817 - protein, 13 aa, Cryptosporidium hominis
NNLPKTKETPAIN

SEQ ID NO: 2153818 - protein, 5 aa, Cryptosporidium hominis
NNLPP

SEQ ID NO: 2153819 - protein, 4 aa, Cryptosporidium hominis
NNLR

SEQ ID NO: 2153820 - protein, 25 aa, Cryptosporidium hominis
NNLSDSKQKLNPGKSLKNENKENNL

SEQ ID NO: 2153821 - protein, 21 aa, Cryptosporidium hominis
NNLSGSGDNTPVVTSSPETGG

SEQ ID NO: 2153822 - protein, 13 aa, Cryptosporidium hominis
NNLSNNNSSIEDS

SEQ ID NO: 2153823 - protein, 4 aa, Cryptosporidium hominis
NNMK

SEQ ID NO: 2153824 - protein, 19 aa, Cryptosporidium hominis
NNMNKNGQSPKSVKYNSNL

SEQ ID NO: 2153825 - protein, 7 aa, Cryptosporidium hominis
NNNAKSV

SEQ ID NO: 2153826 - protein, 6 aa, Cryptosporidium hominis
NNNAPA

SEQ ID NO: 2153827 - protein, 5 aa, Cryptosporidium hominis
NNNCD

SEQ ID NO: 2153828 - protein, 8 aa, Cryptosporidium hominis
NNNDETSK

SEQ ID NO: 2153829 - protein, 6 aa, Cryptosporidium hominis
NNNDIT

SEQ ID NO: 2153830 - protein, 17 aa, Cryptosporidium hominis
NNNDKSKDNMSSSNPFE

SEQ ID NO: 2153831 - protein, 6 aa, Cryptosporidium hominis
NNNDTC

SEQ ID NO: 2153832 - protein, 12 aa, Cryptosporidium hominis
NNNEGNSITESI

SEQ ID NO: 2153833 - protein, 11 aa, Cryptosporidium hominis
NNNEHTKNDVQ

SEQ ID NO: 2153834 - protein, 6 aa, Cryptosporidium hominis
NNNEKV

SEQ ID NO: 2153835 - protein, 10 aa, Cryptosporidium hominis
NNNELSPDSL

SEQ ID NO: 2153836 - protein, 8 aa, Cryptosporidium hominis
NNNENEEL

SEQ ID NO: 2153837 - protein, 5 aa, Cryptosporidium hominis
NNNEV

SEQ ID NO: 2153838 - protein, 4 aa, Cryptosporidium hominis
NNNG

SEQ ID NO: 2153839 - protein, 8 aa, Cryptosporidium hominis
NNNGEKCN

SEQ ID NO: 2153840 - protein, 10 aa, Cryptosporidium hominis
NNNGGSNEFG

SEQ ID NO: 2153841 - protein, 8 aa, Cryptosporidium hominis
NNNGKETI

SEQ ID NO: 2153842 - protein, 46 aa, Cryptosporidium hominis
NNNGKGSKTISNPNLASTSTSGLSSSSSSENISKSSQNPSNINDPL

SEQ ID NO: 2153843 - protein, 8 aa, Cryptosporidium hominis
NNNGNESI

SEQ ID NO: 2153844 - protein, 8 aa, Cryptosporidium hominis
NNNGNSKV

SEQ ID NO: 2153845 - protein, 7 aa, Cryptosporidium hominis
NNNGSGV

SEQ ID NO: 2153846 - protein, 8 aa, Cryptosporidium hominis
NNNGTDSG

SEQ ID NO: 2153847 - protein, 12 aa, Cryptosporidium hominis
NNNHNDNNDNNT

SEQ ID NO: 2153848 - protein, 5 aa, Cryptosporidium hominis
NNNHV

SEQ ID NO: 2153849 - protein, 5 aa, Cryptosporidium hominis
NNNID

SEQ ID NO: 2153850 - protein, 10 aa, Cryptosporidium hominis
NNNIGEGGGH

SEQ ID NO: 2153851 - protein, 11 aa, Cryptosporidium hominis
NNNIYSGGSSF

SEQ ID NO: 2153852 - protein, 11 aa, Cryptosporidium hominis
NNNKDAPKGWK

SEQ ID NO: 2153853 - protein, 11 aa, Cryptosporidium hominis
NNNKNNDNNVA

SEQ ID NO: 2153854 - protein, 9 aa, Cryptosporidium hominis
NNNKSRRRT

SEQ ID NO: 2153855 - protein, 14 aa, Cryptosporidium hominis
NNNKTGLVSEQTKG

SEQ ID NO: 2153856 - protein, 9 aa, Cryptosporidium hominis
NNNLDNETS

SEQ ID NO: 2153857 - protein, 17 aa, Cryptosporidium hominis
NNNLNDDISAKYSSYSS

SEQ ID NO: 2153858 - protein, 6 aa, Cryptosporidium hominis
NNNLTS

SEQ ID NO: 2153859 - protein, 25 aa, Cryptosporidium hominis
NNNMNNNDNINNGNNGNNSNNNNDL

SEQ ID NO: 2153860 - protein, 14 aa, Cryptosporidium hominis
NNNNHEISSSQNQF

SEQ ID NO: 2153861 - protein, 5 aa, Cryptosporidium hominis
NNNNN

SEQ ID NO: 2153862 - protein, 13 aa, Cryptosporidium hominis
NNNNNDNNNQLDR

SEQ ID NO: 2153863 - protein, 10 aa, Cryptosporidium hominis
NNNNNGANSN

SEQ ID NO: 2153864 - protein, 6 aa, Cryptosporidium hominis
NNNNNI

SEQ ID NO: 2153865 - protein, 14 aa, Cryptosporidium hominis
NNNNNKNNGINQSC

SEQ ID NO: 2153866 - protein, 8 aa, Cryptosporidium hominis
NNNNNKNY

SEQ ID NO: 2153867 - protein, 9 aa, Cryptosporidium hominis
NNNNNKSIN

SEQ ID NO: 2153868 - protein, 7 aa, Cryptosporidium hominis
NNNNNLK

SEQ ID NO: 2153869 - protein, 6 aa, Cryptosporidium hominis
NNNNNN

SEQ ID NO: 2153870 - protein, 9 aa, Cryptosporidium hominis
NNNNNNKRE

SEQ ID NO: 2153871 - protein, 10 aa, Cryptosporidium hominis
NNNNNNKRRI

SEQ ID NO: 2153872 - protein, 7 aa, Cryptosporidium hominis
NNNNNNN

SEQ ID NO: 2153873 - protein, 9 aa, Cryptosporidium hominis
NNNNNNNGC

SEQ ID NO: 2153874 - protein, 12 aa, Cryptosporidium hominis
NNNNNNNIKPQN

SEQ ID NO: 2153875 - protein, 10 aa, Cryptosporidium hominis
NNNNNNNNNG

SEQ ID NO: 2153876 - protein, 14 aa, Cryptosporidium hominis
NNNNNNNNNNDKKK

SEQ ID NO: 2153877 - protein, 22 aa, Cryptosporidium hominis
NNNNNNNNNNNNNNKNNTSNTF

SEQ ID NO: 2153878 - protein, 24 aa, Cryptosporidium hominis
NNNNNNNNNNNNNNNDNDNNNNNI

SEQ ID NO: 2153879 - protein, 58 aa, Cryptosporidium hominis
NNNNNNNNNNNNNNNNINNNNNNNNNNNSNNNNLGSNSTNGSGSSKTNDEQNSTISNQ

SEQ ID NO: 2153880 - protein, 29 aa, Cryptosporidium hominis
NNNNNNNNNNNNNNNNNRLNENKSFKTYA

SEQ ID NO: 2153881 - protein, 22 aa, Cryptosporidium hominis
NNNNNSNNSCNNNNHNFSSGPS

SEQ ID NO: 2153882 - protein, 9 aa, Cryptosporidium hominis
NNNNNTDKF

SEQ ID NO: 2153883 - protein, 10 aa, Cryptosporidium hominis
NNNNQEKDLS

SEQ ID NO: 2153884 - protein, 16 aa, Cryptosporidium hominis
NNNNQQHHEIGFGGCS

SEQ ID NO: 2153885 - protein, 21 aa, Cryptosporidium hominis
NNNNQSRISKKPIQNIRESSP

SEQ ID NO: 2153886 - protein, 9 aa, Cryptosporidium hominis
NNNNSGKID

SEQ ID NO: 2153887 - protein, 19 aa, Cryptosporidium hominis
NNNNSIGIATNSNGANNAV

SEQ ID NO: 2153888 - protein, 34 aa, Cryptosporidium hominis
NNNNSNIISSNNSNSSNSSISSSSSSSSINSNNS

SEQ ID NO: 2153889 - protein, 29 aa, Cryptosporidium hominis
NNNNTANVNNNITTTNTTSSNINNNPGIH

SEQ ID NO: 2153890 - protein, 9 aa, Cryptosporidium hominis
NNNNTNSDE

SEQ ID NO: 2153891 - protein, 5 aa, Cryptosporidium hominis
NNNPA

SEQ ID NO: 2153892 - protein, 7 aa, Cryptosporidium hominis
NNNPELS

SEQ ID NO: 2153893 - protein, 8 aa, Cryptosporidium hominis
NNNPISND

SEQ ID NO: 2153894 - protein, 7 aa, Cryptosporidium hominis
NNNPQES

SEQ ID NO: 2153895 - protein, 16 aa, Cryptosporidium hominis
NNNQCEPNGNLGYGTK

SEQ ID NO: 2153896 - protein, 30 aa, Cryptosporidium hominis
NNNQGQYSTHDPNLPPKMEPHSSNPNNANI

SEQ ID NO: 2153897 - protein, 6 aa, Cryptosporidium hominis
NNNQQK

SEQ ID NO: 2153898 - protein, 6 aa, Cryptosporidium hominis
NNNRGL

SEQ ID NO: 2153899 - protein, 12 aa, Cryptosporidium hominis
NNNRTQENHDNS

SEQ ID NO: 2153900 - protein, 10 aa, Cryptosporidium hominis
NNNRTSNSQS

SEQ ID NO: 2153901 - protein, 10 aa, Cryptosporidium hominis
NNNSGGGIGQ

SEQ ID NO: 2153902 - protein, 8 aa, Cryptosporidium hominis
NNNSNATL

SEQ ID NO: 2153903 - protein, 26 aa, Cryptosporidium hominis
NNNSNKIVTERNESSEINEQEECPQS

SEQ ID NO: 2153904 - protein, 13 aa, Cryptosporidium hominis
NNNSNYDNNNDDL

SEQ ID NO: 2153905 - protein, 29 aa, Cryptosporidium hominis
NNNSQGNPNDPNAAGARAGQMGANGMQDP

SEQ ID NO: 2153906 - protein, 6 aa, Cryptosporidium hominis
NNNSRY

SEQ ID NO: 2153907 - protein, 15 aa, Cryptosporidium hominis
NNNSTTSTTATTTTI

SEQ ID NO: 2153908 - protein, 9 aa, Cryptosporidium hominis
NNNTEKANA

SEQ ID NO: 2153909 - protein, 8 aa, Cryptosporidium hominis
NNNTGNNN

SEQ ID NO: 2153910 - protein, 37 aa, Cryptosporidium hominis
NNNTNNNNNINNNNNNNTSDFGIPRKSSLNSSFSDQM

SEQ ID NO: 2153911 - protein, 6 aa, Cryptosporidium hominis
NNNTQG

SEQ ID NO: 2153912 - protein, 12 aa, Cryptosporidium hominis
NNNTTNSNSNIQ

SEQ ID NO: 2153913 - protein, 5 aa, Cryptosporidium hominis
NNNVD

SEQ ID NO: 2153914 - protein, 53 aa, Cryptosporidium hominis
NNNVDAKRTTDSDDGDEDFYEEPTQKKRGRKPSKTKVSQTSGVKRTVRSSRKA

SEQ ID NO: 2153915 - protein, 7 aa, Cryptosporidium hominis
NNNVGQK

SEQ ID NO: 2153916 - protein, 5 aa, Cryptosporidium hominis
NNNVY

SEQ ID NO: 2153917 - protein, 6 aa, Cryptosporidium hominis
NNNYPF

SEQ ID NO: 2153918 - protein, 5 aa, Cryptosporidium hominis
NNPAS

SEQ ID NO: 2153919 - protein, 5 aa, Cryptosporidium hominis
NNPDR

SEQ ID NO: 2153920 - protein, 6 aa, Cryptosporidium hominis
NNPDRT

SEQ ID NO: 2153921 - protein, 8 aa, Cryptosporidium hominis
NNPEHSES

SEQ ID NO: 2153922 - protein, 12 aa, Cryptosporidium hominis
NNPIKRCGSRTS

SEQ ID NO: 2153923 - protein, 17 aa, Cryptosporidium hominis
NNPINNTNYSCQNQSQN

SEQ ID NO: 2153924 - protein, 7 aa, Cryptosporidium hominis
NNPKLSN

SEQ ID NO: 2153925 - protein, 20 aa, Cryptosporidium hominis
NNPKTSASAETRGERGASAI

SEQ ID NO: 2153926 - protein, 6 aa, Cryptosporidium hominis
NNPKVN

SEQ ID NO: 2153927 - protein, 6 aa, Cryptosporidium hominis
NNPLAY

SEQ ID NO: 2153928 - protein, 4 aa, Cryptosporidium hominis
NNPN

SEQ ID NO: 2153929 - protein, 6 aa, Cryptosporidium hominis
NNPNYE

SEQ ID NO: 2153930 - protein, 4 aa, Cryptosporidium hominis
NNPP

SEQ ID NO: 2153931 - protein, 18 aa, Cryptosporidium hominis
NNPSFNYNNSQKNKQNWR

SEQ ID NO: 2153932 - protein, 7 aa, Cryptosporidium hominis
NNPSNST

SEQ ID NO: 2153933 - protein, 10 aa, Cryptosporidium hominis
NNPTGQGEAI

SEQ ID NO: 2153934 - protein, 12 aa, Cryptosporidium hominis
NNPWNEQHKNGE

SEQ ID NO: 2153935 - protein, 8 aa, Cryptosporidium hominis
NNQATTAP

SEQ ID NO: 2153936 - protein, 8 aa, Cryptosporidium hominis
NNQDEARE

SEQ ID NO: 2153937 - protein, 10 aa, Cryptosporidium hominis
NNQDITQTEG

SEQ ID NO: 2153938 - protein, 5 aa, Cryptosporidium hominis
NNQDK

SEQ ID NO: 2153939 - protein, 8 aa, Cryptosporidium hominis
NNQDNQAL

SEQ ID NO: 2153940 - protein, 8 aa, Cryptosporidium hominis
NNQEEPFS

SEQ ID NO: 2153941 - protein, 12 aa, Cryptosporidium hominis
NNQEHNSKEEKE

SEQ ID NO: 2153942 - protein, 16 aa, Cryptosporidium hominis
NNQERKYKGFKANQSQ

SEQ ID NO: 2153943 - protein, 5 aa, Cryptosporidium hominis
NNQIS

SEQ ID NO: 2153944 - protein, 7 aa, Cryptosporidium hominis
NNQISGQ

SEQ ID NO: 2153945 - protein, 4 aa, Cryptosporidium hominis
NNQK

SEQ ID NO: 2153946 - protein, 16 aa, Cryptosporidium hominis
NNQKESIENKHAEECD

SEQ ID NO: 2153947 - protein, 15 aa, Cryptosporidium hominis
NNQKNDIKALSQLRA

SEQ ID NO: 2153948 - protein, 23 aa, Cryptosporidium hominis
NNQKQQANNTPSNTSNNNEAVSS

SEQ ID NO: 2153949 - protein, 13 aa, Cryptosporidium hominis
NNQKRRNRSFSRE

SEQ ID NO: 2153950 - protein, 8 aa, Cryptosporidium hominis
NNQKSDPN

SEQ ID NO: 2153951 - protein, 7 aa, Cryptosporidium hominis
NNQKSEN

SEQ ID NO: 2153952 - protein, 16 aa, Cryptosporidium hominis
NNQKTDSFELGNSRRR

SEQ ID NO: 2153953 - protein, 7 aa, Cryptosporidium hominis
NNQLGGI

SEQ ID NO: 2153954 - protein, 11 aa, Cryptosporidium hominis
NNQMEDTNEHE

SEQ ID NO: 2153955 - protein, 4 aa, Cryptosporidium hominis
NNQN

SEQ ID NO: 2153956 - protein, 5 aa, Cryptosporidium hominis
NNQQH

SEQ ID NO: 2153957 - protein, 4 aa, Cryptosporidium hominis
NNQS

SEQ ID NO: 2153958 - protein, 14 aa, Cryptosporidium hominis
NNQSDNNIDQIKEE

SEQ ID NO: 2153959 - protein, 5 aa, Cryptosporidium hominis
NNQSL

SEQ ID NO: 2153960 - protein, 9 aa, Cryptosporidium hominis
NNQSLNENE

SEQ ID NO: 2153961 - protein, 11 aa, Cryptosporidium hominis
NNQSNSSSNHN

SEQ ID NO: 2153962 - protein, 24 aa, Cryptosporidium hominis
NNQSSNLNNSDNLVNNNNNSNIDQ

SEQ ID NO: 2153963 - protein, 15 aa, Cryptosporidium hominis
NNQTYFSSNIKPTIW

SEQ ID NO: 2153964 - protein, 6 aa, Cryptosporidium hominis
NNQVSG

SEQ ID NO: 2153965 - protein, 12 aa, Cryptosporidium hominis
NNQYQNSQQQHS

SEQ ID NO: 2153966 - protein, 6 aa, Cryptosporidium hominis
NNRASK

SEQ ID NO: 2153967 - protein, 13 aa, Cryptosporidium hominis
NNRDSSIIGVGGR

SEQ ID NO: 2153968 - protein, 6 aa, Cryptosporidium hominis
NNREDF

SEQ ID NO: 2153969 - protein, 15 aa, Cryptosporidium hominis
NNRESGNSRNTDNNY

SEQ ID NO: 2153970 - protein, 9 aa, Cryptosporidium hominis
NNRGSASLG

SEQ ID NO: 2153971 - protein, 6 aa, Cryptosporidium hominis
NNRGSY

SEQ ID NO: 2153972 - protein, 10 aa, Cryptosporidium hominis
NNRIDDDTPD

SEQ ID NO: 2153973 - protein, 8 aa, Cryptosporidium hominis
NNRIGNDP

SEQ ID NO: 2153974 - protein, 8 aa, Cryptosporidium hominis
NNRKPIPG

SEQ ID NO: 2153975 - protein, 15 aa, Cryptosporidium hominis
NNRKYDNSSLQETFR

SEQ ID NO: 2153976 - protein, 5 aa, Cryptosporidium hominis
NNRLS

SEQ ID NO: 2153977 - protein, 9 aa, Cryptosporidium hominis
NNRNATKSA

SEQ ID NO: 2153978 - protein, 12 aa, Cryptosporidium hominis
NNRQEEDKKKVQ

SEQ ID NO: 2153979 - protein, 16 aa, Cryptosporidium hominis
NNRRKSSISGGRTASA

SEQ ID NO: 2153980 - protein, 18 aa, Cryptosporidium hominis
NNSALTGQGSRPGSGTGI

SEQ ID NO: 2153981 - protein, 7 aa, Cryptosporidium hominis
NNSDIGT

SEQ ID NO: 2153982 - protein, 6 aa, Cryptosporidium hominis
NNSDNK

SEQ ID NO: 2153983 - protein, 11 aa, Cryptosporidium hominis
NNSDNKANKSI

SEQ ID NO: 2153984 - protein, 9 aa, Cryptosporidium hominis
NNSDTESLN

SEQ ID NO: 2153985 - protein, 8 aa, Cryptosporidium hominis
NNSEGNLD

SEQ ID NO: 2153986 - protein, 8 aa, Cryptosporidium hominis
NNSELAAT

SEQ ID NO: 2153987 - protein, 6 aa, Cryptosporidium hominis
NNSENE

SEQ ID NO: 2153988 - protein, 18 aa, Cryptosporidium hominis
NNSESKPEEEDANKSDFN

SEQ ID NO: 2153989 - protein, 8 aa, Cryptosporidium hominis
NNSFNESN

SEQ ID NO: 2153990 - protein, 5 aa, Cryptosporidium hominis
NNSGD

SEQ ID NO: 2153991 - protein, 8 aa, Cryptosporidium hominis
NNSGTSKI

SEQ ID NO: 2153992 - protein, 6 aa, Cryptosporidium hominis
NNSGYI

SEQ ID NO: 2153993 - protein, 30 aa, Cryptosporidium hominis
NNSIHSNSNNNNRDDDHYSSSRAGSNVSDG

SEQ ID NO: 2153994 - protein, 8 aa, Cryptosporidium hominis
NNSINNNN

SEQ ID NO: 2153995 - protein, 9 aa, Cryptosporidium hominis
NNSISNREY

SEQ ID NO: 2153996 - protein, 9 aa, Cryptosporidium hominis
NNSKDGIES

SEQ ID NO: 2153997 - protein, 11 aa, Cryptosporidium hominis
NNSKEDDTSTL

SEQ ID NO: 2153998 - protein, 7 aa, Cryptosporidium hominis
NNSKHDD

SEQ ID NO: 2153999 - protein, 12 aa, Cryptosporidium hominis
NNSKLIEVEKWK

SEQ ID NO: 2154000 - protein, 26 aa, Cryptosporidium hominis
NNSKSGGISNNNNNIRSGEFNTPPRE

SEQ ID NO: 2154001 - protein, 11 aa, Cryptosporidium hominis
NNSKSGGYDSL

SEQ ID NO: 2154002 - protein, 7 aa, Cryptosporidium hominis
NNSLDEQ

SEQ ID NO: 2154003 - protein, 8 aa, Cryptosporidium hominis
NNSLEEHE

SEQ ID NO: 2154004 - protein, 6 aa, Cryptosporidium hominis
NNSLNS

SEQ ID NO: 2154005 - protein, 6 aa, Cryptosporidium hominis
NNSMGG

SEQ ID NO: 2154006 - protein, 8 aa, Cryptosporidium hominis
NNSNAANA

SEQ ID NO: 2154007 - protein, 9 aa, Cryptosporidium hominis
NNSNADPRG

SEQ ID NO: 2154008 - protein, 7 aa, Cryptosporidium hominis
NNSNDAI

SEQ ID NO: 2154009 - protein, 9 aa, Cryptosporidium hominis
NNSNGNSKK

SEQ ID NO: 2154010 - protein, 7 aa, Cryptosporidium hominis
NNSNNNE

SEQ ID NO: 2154011 - protein, 17 aa, Cryptosporidium hominis
NNSNNNNNNNSNISNNI

SEQ ID NO: 2154012 - protein, 5 aa, Cryptosporidium hominis
NNSNS

SEQ ID NO: 2154013 - protein, 8 aa, Cryptosporidium hominis
NNSNSETR

SEQ ID NO: 2154014 - protein, 10 aa, Cryptosporidium hominis
NNSNSGINTS

SEQ ID NO: 2154015 - protein, 8 aa, Cryptosporidium hominis
NNSNTIKG

SEQ ID NO: 2154016 - protein, 7 aa, Cryptosporidium hominis
NNSPMQY

SEQ ID NO: 2154017 - protein, 6 aa, Cryptosporidium hominis
NNSPPI

SEQ ID NO: 2154018 - protein, 10 aa, Cryptosporidium hominis
NNSPTNNQQI

SEQ ID NO: 2154019 - protein, 6 aa, Cryptosporidium hominis
NNSQGI

SEQ ID NO: 2154020 - protein, 10 aa, Cryptosporidium hominis
NNSQKHDIEE

SEQ ID NO: 2154021 - protein, 12 aa, Cryptosporidium hominis
NNSQSNNSNSFN

SEQ ID NO: 2154022 - protein, 23 aa, Cryptosporidium hominis
NNSQSRIHSNSNSSLGAQGDISN

SEQ ID NO: 2154023 - protein, 10 aa, Cryptosporidium hominis
NNSQVSRNDY

SEQ ID NO: 2154024 - protein, 9 aa, Cryptosporidium hominis
NNSQYSGSI

SEQ ID NO: 2154025 - protein, 8 aa, Cryptosporidium hominis
NNSRGLDC

SEQ ID NO: 2154026 - protein, 6 aa, Cryptosporidium hominis
NNSRKK

SEQ ID NO: 2154027 - protein, 8 aa, Cryptosporidium hominis
NNSRPEKF

SEQ ID NO: 2154028 - protein, 7 aa, Cryptosporidium hominis
NNSSAKH

SEQ ID NO: 2154029 - protein, 24 aa, Cryptosporidium hominis
NNSSEIEEKKLDSEINNNEIDTIN

SEQ ID NO: 2154030 - protein, 8 aa, Cryptosporidium hominis
NNSSESSL

SEQ ID NO: 2154031 - protein, 8 aa, Cryptosporidium hominis
NNSSISGG

SEQ ID NO: 2154032 - protein, 9 aa, Cryptosporidium hominis
NNSSKGKEM

SEQ ID NO: 2154033 - protein, 6 aa, Cryptosporidium hominis
NNSSLN

SEQ ID NO: 2154034 - protein, 19 aa, Cryptosporidium hominis
NNSSNEIEDGERTLQTNQA

SEQ ID NO: 2154035 - protein, 8 aa, Cryptosporidium hominis
NNSSNSLT

SEQ ID NO: 2154036 - protein, 13 aa, Cryptosporidium hominis
NNSSPRNQTSSFQ

SEQ ID NO: 2154037 - protein, 22 aa, Cryptosporidium hominis
NNSSTNKKRSKDHTENSEYSEN

SEQ ID NO: 2154038 - protein, 8 aa, Cryptosporidium hominis
NNSSYGGV

SEQ ID NO: 2154039 - protein, 39 aa, Cryptosporidium hominis
NNSTCSTSSSTSVSPVGSASTSCQATNKKQSSSKVMSVN

SEQ ID NO: 2154040 - protein, 16 aa, Cryptosporidium hominis
NNSTIGNENYKGELGN

SEQ ID NO: 2154041 - protein, 8 aa, Cryptosporidium hominis
NNSTQNYS

SEQ ID NO: 2154042 - protein, 7 aa, Cryptosporidium hominis
NNSTSNI

SEQ ID NO: 2154043 - protein, 15 aa, Cryptosporidium hominis
NNSTTQDSFKNNPEI

SEQ ID NO: 2154044 - protein, 18 aa, Cryptosporidium hominis
NNSVENNNTSNNNEITND

SEQ ID NO: 2154045 - protein, 11 aa, Cryptosporidium hominis
NNSVSKSSFGA

SEQ ID NO: 2154046 - protein, 7 aa, Cryptosporidium hominis
NNSYGED

SEQ ID NO: 2154047 - protein, 26 aa, Cryptosporidium hominis
NNSYQDNNVNNAEKLPTRTESNSGAV

SEQ ID NO: 2154048 - protein, 6 aa, Cryptosporidium hominis
NNTAGI

SEQ ID NO: 2154049 - protein, 16 aa, Cryptosporidium hominis
NNTAHPNSNSTSNNTE

SEQ ID NO: 2154050 - protein, 36 aa, Cryptosporidium hominis
NNTAKDNTSAGQPKKRKTEQSEKESSKAQKVQPENA

SEQ ID NO: 2154051 - protein, 8 aa, Cryptosporidium hominis
NNTEDSSK

SEQ ID NO: 2154052 - protein, 16 aa, Cryptosporidium hominis
NNTENEATGESIGNSN

SEQ ID NO: 2154053 - protein, 9 aa, Cryptosporidium hominis
NNTERNMNE

SEQ ID NO: 2154054 - protein, 4 aa, Cryptosporidium hominis
NNTF

SEQ ID NO: 2154055 - protein, 4 aa, Cryptosporidium hominis
NNTG

SEQ ID NO: 2154056 - protein, 8 aa, Cryptosporidium hominis
NNTGNSFG

SEQ ID NO: 2154057 - protein, 4 aa, Cryptosporidium hominis
NNTI

SEQ ID NO: 2154058 - protein, 11 aa, Cryptosporidium hominis
NNTIVSNPESI

SEQ ID NO: 2154059 - protein, 4 aa, Cryptosporidium hominis
NNTK

SEQ ID NO: 2154060 - protein, 6 aa, Cryptosporidium hominis
NNTKEM

SEQ ID NO: 2154061 - protein, 8 aa, Cryptosporidium hominis
NNTKTEID

SEQ ID NO: 2154062 - protein, 4 aa, Cryptosporidium hominis
NNTL

SEQ ID NO: 2154063 - protein, 5 aa, Cryptosporidium hominis
NNTMS

SEQ ID NO: 2154064 - protein, 9 aa, Cryptosporidium hominis
NNTNNESRL

SEQ ID NO: 2154065 - protein, 12 aa, Cryptosporidium hominis
NNTNNGKAPANI

SEQ ID NO: 2154066 - protein, 11 aa, Cryptosporidium hominis
NNTNNIKNDEV

SEQ ID NO: 2154067 - protein, 18 aa, Cryptosporidium hominis
NNTNNNNINHKSNDFGFP

SEQ ID NO: 2154068 - protein, 13 aa, Cryptosporidium hominis
NNTNNNNSSNNNT

SEQ ID NO: 2154069 - protein, 6 aa, Cryptosporidium hominis
NNTNPN

SEQ ID NO: 2154070 - protein, 33 aa, Cryptosporidium hominis
NNTNSAAGFSTGNQNPTNRSIPRNASYLDAEMT

SEQ ID NO: 2154071 - protein, 8 aa, Cryptosporidium hominis
NNTPFDDA

SEQ ID NO: 2154072 - protein, 18 aa, Cryptosporidium hominis
NNTPMTQMTPTSSGNNNF

SEQ ID NO: 2154073 - protein, 12 aa, Cryptosporidium hominis
NNTPSGSRNDKR

SEQ ID NO: 2154074 - protein, 10 aa, Cryptosporidium hominis
NNTPTASNTI

SEQ ID NO: 2154075 - protein, 20 aa, Cryptosporidium hominis
NNTPTSPPTMESPNPSNQRS

SEQ ID NO: 2154076 - protein, 4 aa, Cryptosporidium hominis
NNTQ

SEQ ID NO: 2154077 - protein, 6 aa, Cryptosporidium hominis
NNTQHT

SEQ ID NO: 2154078 - protein, 13 aa, Cryptosporidium hominis
NNTSNNNNKQYYP

SEQ ID NO: 2154079 - protein, 19 aa, Cryptosporidium hominis
NNTTGELSENINQSYGTMD

SEQ ID NO: 2154080 - protein, 8 aa, Cryptosporidium hominis
NNTTNENK

SEQ ID NO: 2154081 - protein, 8 aa, Cryptosporidium hominis
NNTTPDDV

SEQ ID NO: 2154082 - protein, 12 aa, Cryptosporidium hominis
NNTTQYGTNQYD

SEQ ID NO: 2154083 - protein, 8 aa, Cryptosporidium hominis
NNTTTRGT

SEQ ID NO: 2154084 - protein, 8 aa, Cryptosporidium hominis
NNTTYYNK

SEQ ID NO: 2154085 - protein, 7 aa, Cryptosporidium hominis
NNVDTWE

SEQ ID NO: 2154086 - protein, 4 aa, Cryptosporidium hominis
NNVE

SEQ ID NO: 2154087 - protein, 6 aa, Cryptosporidium hominis
NNVEAK

SEQ ID NO: 2154088 - protein, 10 aa, Cryptosporidium hominis
NNVGKGEERV

SEQ ID NO: 2154089 - protein, 14 aa, Cryptosporidium hominis
NNVGSEKEDRYNSE

SEQ ID NO: 2154090 - protein, 5 aa, Cryptosporidium hominis
NNVGT

SEQ ID NO: 2154091 - protein, 20 aa, Cryptosporidium hominis
NNVKDGDHEMEEKRDGSTTI

SEQ ID NO: 2154092 - protein, 5 aa, Cryptosporidium hominis
NNVKS

SEQ ID NO: 2154093 - protein, 6 aa, Cryptosporidium hominis
NNVPDI

SEQ ID NO: 2154094 - protein, 4 aa, Cryptosporidium hominis
NNYD

SEQ ID NO: 2154095 - protein, 14 aa, Cryptosporidium hominis
NNYEGSQRVTPSYY

SEQ ID NO: 2154096 - protein, 12 aa, Cryptosporidium hominis
NNYENGELDGDA

SEQ ID NO: 2154097 - protein, 8 aa, Cryptosporidium hominis
NNYIDSET

SEQ ID NO: 2154098 - protein, 10 aa, Cryptosporidium hominis
NNYKGKSGPL

SEQ ID NO: 2154099 - protein, 23 aa, Cryptosporidium hominis
NNYKTNNAIEPSTCETNQDNEYI

SEQ ID NO: 2154100 - protein, 4 aa, Cryptosporidium hominis
NNYN

SEQ ID NO: 2154101 - protein, 6 aa, Cryptosporidium hominis
NNYNQN

SEQ ID NO: 2154102 - protein, 8 aa, Cryptosporidium hominis
NNYPELNT

SEQ ID NO: 2154103 - protein, 8 aa, Cryptosporidium hominis
NNYQEKGI

SEQ ID NO: 2154104 - protein, 11 aa, Cryptosporidium hominis
NNYQNDPGNLG

SEQ ID NO: 2154105 - protein, 10 aa, Cryptosporidium hominis
NNYSGSSGIT

SEQ ID NO: 2154106 - protein, 4 aa, Cryptosporidium hominis
NNYY

SEQ ID NO: 2154107 - protein, 9 aa, Cryptosporidium hominis
NNYYNENNS

SEQ ID NO: 2154108 - protein, 4 aa, Cryptosporidium hominis
NPCP

SEQ ID NO: 2154109 - protein, 5 aa, Cryptosporidium hominis
NPDAT

SEQ ID NO: 2154110 - protein, 5 aa, Cryptosporidium hominis
NPDEY

SEQ ID NO: 2154111 - protein, 4 aa, Cryptosporidium hominis
NPDG

SEQ ID NO: 2154112 - protein, 9 aa, Cryptosporidium hominis
NPDGTMPMS

SEQ ID NO: 2154113 - protein, 9 aa, Cryptosporidium hominis
NPDKVQKSV

SEQ ID NO: 2154114 - protein, 7 aa, Cryptosporidium hominis
NPDKYDR

SEQ ID NO: 2154115 - protein, 5 aa, Cryptosporidium hominis
NPDLA

SEQ ID NO: 2154116 - protein, 9 aa, Cryptosporidium hominis
NPDLRASSK

SEQ ID NO: 2154117 - protein, 9 aa, Cryptosporidium hominis
NPDPESNGV

SEQ ID NO: 2154118 - protein, 5 aa, Cryptosporidium hominis
NPDPH

SEQ ID NO: 2154119 - protein, 5 aa, Cryptosporidium hominis
NPDQA

SEQ ID NO: 2154120 - protein, 4 aa, Cryptosporidium hominis
NPDV

SEQ ID NO: 2154121 - protein, 8 aa, Cryptosporidium hominis
NPDYKSPT

SEQ ID NO: 2154122 - protein, 6 aa, Cryptosporidium hominis
NPEAND

SEQ ID NO: 2154123 - protein, 8 aa, Cryptosporidium hominis
NPEDMPPL

SEQ ID NO: 2154124 - protein, 4 aa, Cryptosporidium hominis
NPEE

SEQ ID NO: 2154125 - protein, 7 aa, Cryptosporidium hominis
NPEENAL

SEQ ID NO: 2154126 - protein, 5 aa, Cryptosporidium hominis
NPEET

SEQ ID NO: 2154127 - protein, 16 aa, Cryptosporidium hominis
NPEGNHTASGGGRGMG

SEQ ID NO: 2154128 - protein, 12 aa, Cryptosporidium hominis
NPEKLNDGCGAE

SEQ ID NO: 2154129 - protein, 31 aa, Cryptosporidium hominis
NPELDNSNTQKKLQTEENIQDHKQNNNEVPV

SEQ ID NO: 2154130 - protein, 5 aa, Cryptosporidium hominis
NPELS

SEQ ID NO: 2154131 - protein, 9 aa, Cryptosporidium hominis
NPENDETYT

SEQ ID NO: 2154132 - protein, 10 aa, Cryptosporidium hominis
NPENEADNSL

SEQ ID NO: 2154133 - protein, 5 aa, Cryptosporidium hominis
NPENL

SEQ ID NO: 2154134 - protein, 5 aa, Cryptosporidium hominis
NPENS

SEQ ID NO: 2154135 - protein, 7 aa, Cryptosporidium hominis
NPENSPD

SEQ ID NO: 2154136 - protein, 18 aa, Cryptosporidium hominis
NPENSSKESKNDEDSTMT

SEQ ID NO: 2154137 - protein, 6 aa, Cryptosporidium hominis
NPEQES

SEQ ID NO: 2154138 - protein, 9 aa, Cryptosporidium hominis
NPERNYEGT

SEQ ID NO: 2154139 - protein, 14 aa, Cryptosporidium hominis
NPESDIPKRSKTHS

SEQ ID NO: 2154140 - protein, 18 aa, Cryptosporidium hominis
NPESEKKPYLPKDEDDLA

SEQ ID NO: 2154141 - protein, 33 aa, Cryptosporidium hominis
NPESKIDEKDSEKETLNHSKTKEIAKSKAAAQL

SEQ ID NO: 2154142 - protein, 5 aa, Cryptosporidium hominis
NPETG

SEQ ID NO: 2154143 - protein, 5 aa, Cryptosporidium hominis
NPFGD

SEQ ID NO: 2154144 - protein, 5 aa, Cryptosporidium hominis
NPFPP

SEQ ID NO: 2154145 - protein, 6 aa, Cryptosporidium hominis
NPFSES

SEQ ID NO: 2154146 - protein, 9 aa, Cryptosporidium hominis
NPGENENHR

SEQ ID NO: 2154147 - protein, 7 aa, Cryptosporidium hominis
NPGENHG

SEQ ID NO: 2154148 - protein, 8 aa, Cryptosporidium hominis
NPGERELN

SEQ ID NO: 2154149 - protein, 5 aa, Cryptosporidium hominis
NPGIR

SEQ ID NO: 2154150 - protein, 7 aa, Cryptosporidium hominis
NPGLPDY

SEQ ID NO: 2154151 - protein, 24 aa, Cryptosporidium hominis
NPGNLNVNGATNQIQTSSAPMSTP

SEQ ID NO: 2154152 - protein, 6 aa, Cryptosporidium hominis
NPGVEK

SEQ ID NO: 2154153 - protein, 6 aa, Cryptosporidium hominis
NPHFES

SEQ ID NO: 2154154 - protein, 18 aa, Cryptosporidium hominis
NPHPTTTFGTGTNPQSFA

SEQ ID NO: 2154155 - protein, 4 aa, Cryptosporidium hominis
NPHQ

SEQ ID NO: 2154156 - protein, 7 aa, Cryptosporidium hominis
NPHYDAK

SEQ ID NO: 2154157 - protein, 4 aa, Cryptosporidium hominis
NPID

SEQ ID NO: 2154158 - protein, 6 aa, Cryptosporidium hominis
NPIDKD

SEQ ID NO: 2154159 - protein, 5 aa, Cryptosporidium hominis
NPIGE

SEQ ID NO: 2154160 - protein, 13 aa, Cryptosporidium hominis
NPIGQEPDIEDGE

SEQ ID NO: 2154161 - protein, 5 aa, Cryptosporidium hominis
NPIKG

SEQ ID NO: 2154162 - protein, 4 aa, Cryptosporidium hominis
NPIN

SEQ ID NO: 2154163 - protein, 5 aa, Cryptosporidium hominis
NPIPG

SEQ ID NO: 2154164 - protein, 7 aa, Cryptosporidium hominis
NPIPRSD

SEQ ID NO: 2154165 - protein, 6 aa, Cryptosporidium hominis
NPIQNK

SEQ ID NO: 2154166 - protein, 9 aa, Cryptosporidium hominis
NPISEKNES

SEQ ID NO: 2154167 - protein, 4 aa, Cryptosporidium hominis
NPIT

SEQ ID NO: 2154168 - protein, 7 aa, Cryptosporidium hominis
NPITDEQ

SEQ ID NO: 2154169 - protein, 8 aa, Cryptosporidium hominis
NPITGEGG

SEQ ID NO: 2154170 - protein, 16 aa, Cryptosporidium hominis
NPKAPENKRKRPLKPL

SEQ ID NO: 2154171 - protein, 4 aa, Cryptosporidium hominis
NPKD

SEQ ID NO: 2154172 - protein, 4 aa, Cryptosporidium hominis
NPKF

SEQ ID NO: 2154173 - protein, 9 aa, Cryptosporidium hominis
NPKGDFNRA

SEQ ID NO: 2154174 - protein, 7 aa, Cryptosporidium hominis
NPKGDLG

SEQ ID NO: 2154175 - protein, 15 aa, Cryptosporidium hominis
NPKNHDGSQSERQID

SEQ ID NO: 2154176 - protein, 6 aa, Cryptosporidium hominis
NPKNNL

SEQ ID NO: 2154177 - protein, 13 aa, Cryptosporidium hominis
NPKNSGLITQPEN

SEQ ID NO: 2154178 - protein, 31 aa, Cryptosporidium hominis
NPKNTLSPGLTPNKQSNRKNKKRKSSNLSEE

SEQ ID NO: 2154179 - protein, 5 aa, Cryptosporidium hominis
NPKPG

SEQ ID NO: 2154180 - protein, 10 aa, Cryptosporidium hominis
NPKPKKYDTT

SEQ ID NO: 2154181 - protein, 9 aa, Cryptosporidium hominis
NPKTELDAQ

SEQ ID NO: 2154182 - protein, 12 aa, Cryptosporidium hominis
NPKTRKIVPNEG

SEQ ID NO: 2154183 - protein, 5 aa, Cryptosporidium hominis
NPKVD

SEQ ID NO: 2154184 - protein, 4 aa, Cryptosporidium hominis
NPKY

SEQ ID NO: 2154185 - protein, 6 aa, Cryptosporidium hominis
NPLDDL

SEQ ID NO: 2154186 - protein, 4 aa, Cryptosporidium hominis
NPLE

SEQ ID NO: 2154187 - protein, 6 aa, Cryptosporidium hominis
NPLGYP

SEQ ID NO: 2154188 - protein, 15 aa, Cryptosporidium hominis
NPLPESQEDFTEDSD

SEQ ID NO: 2154189 - protein, 23 aa, Cryptosporidium hominis
NPLSAPPSSSISGKVQQRISQGE

SEQ ID NO: 2154190 - protein, 5 aa, Cryptosporidium hominis
NPLSE

SEQ ID NO: 2154191 - protein, 13 aa, Cryptosporidium hominis
NPLSLGNATDESL

SEQ ID NO: 2154192 - protein, 11 aa, Cryptosporidium hominis
NPLSQKKKQMS

SEQ ID NO: 2154193 - protein, 7 aa, Cryptosporidium hominis
NPLSQPP

SEQ ID NO: 2154194 - protein, 6 aa, Cryptosporidium hominis
NPLSRS

SEQ ID NO: 2154195 - protein, 6 aa, Cryptosporidium hominis
NPLSSD

SEQ ID NO: 2154196 - protein, 6 aa, Cryptosporidium hominis
NPMDKN

SEQ ID NO: 2154197 - protein, 5 aa, Cryptosporidium hominis
NPMFS

SEQ ID NO: 2154198 - protein, 8 aa, Cryptosporidium hominis
NPNCPPPQ

SEQ ID NO: 2154199 - protein, 9 aa, Cryptosporidium hominis
NPNDPRHSE

SEQ ID NO: 2154200 - protein, 7 aa, Cryptosporidium hominis
NPNEHGD

SEQ ID NO: 2154201 - protein, 5 aa, Cryptosporidium hominis
NPNEI

SEQ ID NO: 2154202 - protein, 7 aa, Cryptosporidium hominis
NPNFNAP

SEQ ID NO: 2154203 - protein, 7 aa, Cryptosporidium hominis
NPNFPEY

SEQ ID NO: 2154204 - protein, 15 aa, Cryptosporidium hominis
NPNFTDKIEPDNDSM

SEQ ID NO: 2154205 - protein, 12 aa, Cryptosporidium hominis
NPNGPNGQQNGA

SEQ ID NO: 2154206 - protein, 6 aa, Cryptosporidium hominis
NPNGSV

SEQ ID NO: 2154207 - protein, 4 aa, Cryptosporidium hominis
NPNI

SEQ ID NO: 2154208 - protein, 13 aa, Cryptosporidium hominis
NPNIEQNDSKSAI

SEQ ID NO: 2154209 - protein, 13 aa, Cryptosporidium hominis
NPNISGRMGEKQT

SEQ ID NO: 2154210 - protein, 9 aa, Cryptosporidium hominis
NPNKNFGRD

SEQ ID NO: 2154211 - protein, 8 aa, Cryptosporidium hominis
NPNKSPGI

SEQ ID NO: 2154212 - protein, 6 aa, Cryptosporidium hominis
NPNNDI

SEQ ID NO: 2154213 - protein, 5 aa, Cryptosporidium hominis
NPNNV

SEQ ID NO: 2154214 - protein, 7 aa, Cryptosporidium hominis
NPNNVQD

SEQ ID NO: 2154215 - protein, 41 aa, Cryptosporidium hominis
NPNPDSGSGDKDSGGKYTGGNGGGSINGNFDPTALERGAKA

SEQ ID NO: 2154216 - protein, 5 aa, Cryptosporidium hominis
NPNPG

SEQ ID NO: 2154217 - protein, 9 aa, Cryptosporidium hominis
NPNPQERPN

SEQ ID NO: 2154218 - protein, 5 aa, Cryptosporidium hominis
NPNRI

SEQ ID NO: 2154219 - protein, 7 aa, Cryptosporidium hominis
NPNSEEV

SEQ ID NO: 2154220 - protein, 9 aa, Cryptosporidium hominis
NPNSNNDNE

SEQ ID NO: 2154221 - protein, 9 aa, Cryptosporidium hominis
NPNSSESDR

SEQ ID NO: 2154222 - protein, 8 aa, Cryptosporidium hominis
NPNSSFRG

SEQ ID NO: 2154223 - protein, 4 aa, Cryptosporidium hominis
NPNT

SEQ ID NO: 2154224 - protein, 9 aa, Cryptosporidium hominis
NPNTFSRNE

SEQ ID NO: 2154225 - protein, 25 aa, Cryptosporidium hominis
NPNTGTRRLSPQGQRELDSIARQCK

SEQ ID NO: 2154226 - protein, 5 aa, Cryptosporidium hominis
NPNTI

SEQ ID NO: 2154227 - protein, 6 aa, Cryptosporidium hominis
NPNVAA

SEQ ID NO: 2154228 - protein, 15 aa, Cryptosporidium hominis
NPNVIGPDKQRQLED

SEQ ID NO: 2154229 - protein, 4 aa, Cryptosporidium hominis
NPPI

SEQ ID NO: 2154230 - protein, 8 aa, Cryptosporidium hominis
NPPKELGQ

SEQ ID NO: 2154231 - protein, 13 aa, Cryptosporidium hominis
NPPKQPGIDDVTG

SEQ ID NO: 2154232 - protein, 6 aa, Cryptosporidium hominis
NPPPIT

SEQ ID NO: 2154233 - protein, 8 aa, Cryptosporidium hominis
NPPSNDTE

SEQ ID NO: 2154234 - protein, 5 aa, Cryptosporidium hominis
NPPSR

SEQ ID NO: 2154235 - protein, 4 aa, Cryptosporidium hominis
NPPT

SEQ ID NO: 2154236 - protein, 13 aa, Cryptosporidium hominis
NPPTKNIDKPESW

SEQ ID NO: 2154237 - protein, 8 aa, Cryptosporidium hominis
NPQGLEKQ

SEQ ID NO: 2154238 - protein, 4 aa, Cryptosporidium hominis
NPQI

SEQ ID NO: 2154239 - protein, 4 aa, Cryptosporidium hominis
NPQL

SEQ ID NO: 2154240 - protein, 5 aa, Cryptosporidium hominis
NPQQL

SEQ ID NO: 2154241 - protein, 18 aa, Cryptosporidium hominis
NPRHTHYSRKSPKNHLSE

SEQ ID NO: 2154242 - protein, 4 aa, Cryptosporidium hominis
NPRI

SEQ ID NO: 2154243 - protein, 7 aa, Cryptosporidium hominis
NPRLQGS

SEQ ID NO: 2154244 - protein, 18 aa, Cryptosporidium hominis
NPRNVGSLPSDDKNVGTA

SEQ ID NO: 2154245 - protein, 8 aa, Cryptosporidium hominis
NPRPINEN

SEQ ID NO: 2154246 - protein, 12 aa, Cryptosporidium hominis
NPRQKAPNSSLE

SEQ ID NO: 2154247 - protein, 19 aa, Cryptosporidium hominis
NPSATHNTLSGATFDSVSD

SEQ ID NO: 2154248 - protein, 5 aa, Cryptosporidium hominis
NPSDI

SEQ ID NO: 2154249 - protein, 8 aa, Cryptosporidium hominis
NPSDIASK

SEQ ID NO: 2154250 - protein, 15 aa, Cryptosporidium hominis
NPSDKEKKKTKRQIR

SEQ ID NO: 2154251 - protein, 6 aa, Cryptosporidium hominis
NPSDSL

SEQ ID NO: 2154252 - protein, 4 aa, Cryptosporidium hominis
NPSF

SEQ ID NO: 2154253 - protein, 13 aa, Cryptosporidium hominis
NPSGGDKPKDEAE

SEQ ID NO: 2154254 - protein, 23 aa, Cryptosporidium hominis
NPSGLNQTTQAQNPNSNSILNNN

SEQ ID NO: 2154255 - protein, 6 aa, Cryptosporidium hominis
NPSHSS

SEQ ID NO: 2154256 - protein, 10 aa, Cryptosporidium hominis
NPSKNTKPSF

SEQ ID NO: 2154257 - protein, 8 aa, Cryptosporidium hominis
NPSKWGGS

SEQ ID NO: 2154258 - protein, 6 aa, Cryptosporidium hominis
NPSKYK

SEQ ID NO: 2154259 - protein, 5 aa, Cryptosporidium hominis
NPSLY

SEQ ID NO: 2154260 - protein, 4 aa, Cryptosporidium hominis
NPSN

SEQ ID NO: 2154261 - protein, 10 aa, Cryptosporidium hominis
NPSNPEATPP

SEQ ID NO: 2154262 - protein, 8 aa, Cryptosporidium hominis
NPSNPGGI

SEQ ID NO: 2154263 - protein, 11 aa, Cryptosporidium hominis
NPSQDYRSKSL

SEQ ID NO: 2154264 - protein, 16 aa, Cryptosporidium hominis
NPSQGTPPLPKDGLSS

SEQ ID NO: 2154265 - protein, 6 aa, Cryptosporidium hominis
NPSQNK

SEQ ID NO: 2154266 - protein, 6 aa, Cryptosporidium hominis
NPSQTP

SEQ ID NO: 2154267 - protein, 8 aa, Cryptosporidium hominis
NPSSESLK

SEQ ID NO: 2154268 - protein, 6 aa, Cryptosporidium hominis
NPSSKS

SEQ ID NO: 2154269 - protein, 7 aa, Cryptosporidium hominis
NPSTGEE

SEQ ID NO: 2154270 - protein, 11 aa, Cryptosporidium hominis
NPSTGVQTEDS

SEQ ID NO: 2154271 - protein, 5 aa, Cryptosporidium hominis
NPSTI

SEQ ID NO: 2154272 - protein, 6 aa, Cryptosporidium hominis
NPSTNS

SEQ ID NO: 2154273 - protein, 10 aa, Cryptosporidium hominis
NPSTSSSNCQ

SEQ ID NO: 2154274 - protein, 19 aa, Cryptosporidium hominis
NPSVPSLPQNQSNKQQISQ

SEQ ID NO: 2154275 - protein, 5 aa, Cryptosporidium hominis
NPTAN

SEQ ID NO: 2154276 - protein, 6 aa, Cryptosporidium hominis
NPTFAQ

SEQ ID NO: 2154277 - protein, 5 aa, Cryptosporidium hominis
NPTFE

SEQ ID NO: 2154278 - protein, 17 aa, Cryptosporidium hominis
NPTFGSYDDSKDLTQQH

SEQ ID NO: 2154279 - protein, 5 aa, Cryptosporidium hominis
NPTGC

SEQ ID NO: 2154280 - protein, 6 aa, Cryptosporidium hominis
NPTGQA

SEQ ID NO: 2154281 - protein, 6 aa, Cryptosporidium hominis
NPTKGM

SEQ ID NO: 2154282 - protein, 5 aa, Cryptosporidium hominis
NPTKI

SEQ ID NO: 2154283 - protein, 8 aa, Cryptosporidium hominis
NPTKNKFT

SEQ ID NO: 2154284 - protein, 95 aa, Cryptosporidium hominis
NPTKSDESNPKNQSSANSSSSNNTSSSGSKPTSSAQKDYFSDKSKSVSKSRSNNSSDQPHSSSNTHSETSNNSTNKNTVTSYESERGGGAGGNRR

SEQ ID NO: 2154285 - protein, 13 aa, Cryptosporidium hominis
NPTNKAECNASDA

SEQ ID NO: 2154286 - protein, 5 aa, Cryptosporidium hominis
NPTNQ

SEQ ID NO: 2154287 - protein, 6 aa, Cryptosporidium hominis
NPTNTP

SEQ ID NO: 2154288 - protein, 9 aa, Cryptosporidium hominis
NPTPLGHGR

SEQ ID NO: 2154289 - protein, 6 aa, Cryptosporidium hominis
NPTSAE

SEQ ID NO: 2154290 - protein, 8 aa, Cryptosporidium hominis
NPTSKPFG

SEQ ID NO: 2154291 - protein, 6 aa, Cryptosporidium hominis
NPTSTL

SEQ ID NO: 2154292 - protein, 8 aa, Cryptosporidium hominis
NPTTNQVS

SEQ ID NO: 2154293 - protein, 8 aa, Cryptosporidium hominis
NPTTNSYK

SEQ ID NO: 2154294 - protein, 7 aa, Cryptosporidium hominis
NPVESSY

SEQ ID NO: 2154295 - protein, 5 aa, Cryptosporidium hominis
NPVGP

SEQ ID NO: 2154296 - protein, 4 aa, Cryptosporidium hominis
NPVL

SEQ ID NO: 2154297 - protein, 4 aa, Cryptosporidium hominis
NPVN

SEQ ID NO: 2154298 - protein, 13 aa, Cryptosporidium hominis
NPVNKSANPNKMS

SEQ ID NO: 2154299 - protein, 5 aa, Cryptosporidium hominis
NPVNN

SEQ ID NO: 2154300 - protein, 4 aa, Cryptosporidium hominis
NPVR

SEQ ID NO: 2154301 - protein, 11 aa, Cryptosporidium hominis
NPWRPNPTRMP

SEQ ID NO: 2154302 - protein, 4 aa, Cryptosporidium hominis
NPYA

SEQ ID NO: 2154303 - protein, 6 aa, Cryptosporidium hominis
NPYNES

SEQ ID NO: 2154304 - protein, 5 aa, Cryptosporidium hominis
NPYST

SEQ ID NO: 2154305 - protein, 6 aa, Cryptosporidium hominis
NPYTEP

SEQ ID NO: 2154306 - protein, 5 aa, Cryptosporidium hominis
NQAGF

SEQ ID NO: 2154307 - protein, 9 aa, Cryptosporidium hominis
NQAHPSSGY

SEQ ID NO: 2154308 - protein, 24 aa, Cryptosporidium hominis
NQAKASDEKGQKHRSRGLTRDTRA

SEQ ID NO: 2154309 - protein, 24 aa, Cryptosporidium hominis
NQANNELNKKNCNSGTDTDSNTGL

SEQ ID NO: 2154310 - protein, 15 aa, Cryptosporidium hominis
NQANNQNGIIPSTTS

SEQ ID NO: 2154311 - protein, 8 aa, Cryptosporidium hominis
NQAPPSRM

SEQ ID NO: 2154312 - protein, 6 aa, Cryptosporidium hominis
NQASSE

SEQ ID NO: 2154313 - protein, 8 aa, Cryptosporidium hominis
NQAVGETG

SEQ ID NO: 2154314 - protein, 10 aa, Cryptosporidium hominis
NQCDGSKSLE

SEQ ID NO: 2154315 - protein, 12 aa, Cryptosporidium hominis
NQCPAKSQNTGF

SEQ ID NO: 2154316 - protein, 27 aa, Cryptosporidium hominis
NQDDNRFKPLNNNSSKSMGISPSTTTK

SEQ ID NO: 2154317 - protein, 5 aa, Cryptosporidium hominis
NQDDY

SEQ ID NO: 2154318 - protein, 8 aa, Cryptosporidium hominis
NQDGDLGN

SEQ ID NO: 2154319 - protein, 5 aa, Cryptosporidium hominis
NQDGI

SEQ ID NO: 2154320 - protein, 7 aa, Cryptosporidium hominis
NQDGTRI

SEQ ID NO: 2154321 - protein, 4 aa, Cryptosporidium hominis
NQDK

SEQ ID NO: 2154322 - protein, 11 aa, Cryptosporidium hominis
NQDKPRQSDTY

SEQ ID NO: 2154323 - protein, 6 aa, Cryptosporidium hominis
NQDNED

SEQ ID NO: 2154324 - protein, 6 aa, Cryptosporidium hominis
NQDPEA

SEQ ID NO: 2154325 - protein, 6 aa, Cryptosporidium hominis
NQDRPR

SEQ ID NO: 2154326 - protein, 7 aa, Cryptosporidium hominis
NQEDHES

SEQ ID NO: 2154327 - protein, 12 aa, Cryptosporidium hominis
NQEDQKPATAIP

SEQ ID NO: 2154328 - protein, 7 aa, Cryptosporidium hominis
NQEENVT

SEQ ID NO: 2154329 - protein, 5 aa, Cryptosporidium hominis
NQEGP

SEQ ID NO: 2154330 - protein, 20 aa, Cryptosporidium hominis
NQEKNRSENVAKEEKPKEFT

SEQ ID NO: 2154331 - protein, 5 aa, Cryptosporidium hominis
NQELN

SEQ ID NO: 2154332 - protein, 25 aa, Cryptosporidium hominis
NQELNSARELSGTIATENLDSSKNN

SEQ ID NO: 2154333 - protein, 6 aa, Cryptosporidium hominis
NQENID

SEQ ID NO: 2154334 - protein, 6 aa, Cryptosporidium hominis
NQENNL

SEQ ID NO: 2154335 - protein, 5 aa, Cryptosporidium hominis
NQEPA

SEQ ID NO: 2154336 - protein, 5 aa, Cryptosporidium hominis
NQEPT

SEQ ID NO: 2154337 - protein, 4 aa, Cryptosporidium hominis
NQER

SEQ ID NO: 2154338 - protein, 10 aa, Cryptosporidium hominis
NQESSIDTTK

SEQ ID NO: 2154339 - protein, 17 aa, Cryptosporidium hominis
NQEVEEATNARDESRRH

SEQ ID NO: 2154340 - protein, 18 aa, Cryptosporidium hominis
NQEVNEKQDLNVNNDKIS

SEQ ID NO: 2154341 - protein, 4 aa, Cryptosporidium hominis
NQFE

SEQ ID NO: 2154342 - protein, 14 aa, Cryptosporidium hominis
NQFQGTSGLLKFSK

SEQ ID NO: 2154343 - protein, 7 aa, Cryptosporidium hominis
NQFSKQE

SEQ ID NO: 2154344 - protein, 13 aa, Cryptosporidium hominis
NQFTNDSDISGEE

SEQ ID NO: 2154345 - protein, 6 aa, Cryptosporidium hominis
NQGDEN

SEQ ID NO: 2154346 - protein, 6 aa, Cryptosporidium hominis
NQGEEE

SEQ ID NO: 2154347 - protein, 20 aa, Cryptosporidium hominis
NQGIGGIGSGTNHEQLPNTE

SEQ ID NO: 2154348 - protein, 8 aa, Cryptosporidium hominis
NQGNENKF

SEQ ID NO: 2154349 - protein, 6 aa, Cryptosporidium hominis
NQGNNF

SEQ ID NO: 2154350 - protein, 13 aa, Cryptosporidium hominis
NQGNSQQNQIQNQ

SEQ ID NO: 2154351 - protein, 5 aa, Cryptosporidium hominis
NQGQT

SEQ ID NO: 2154352 - protein, 5 aa, Cryptosporidium hominis
NQGRN

SEQ ID NO: 2154353 - protein, 5 aa, Cryptosporidium hominis
NQGSC

SEQ ID NO: 2154354 - protein, 10 aa, Cryptosporidium hominis
NQHGSDAPSH

SEQ ID NO: 2154355 - protein, 6 aa, Cryptosporidium hominis
NQHQHH

SEQ ID NO: 2154356 - protein, 18 aa, Cryptosporidium hominis
NQHSANKSHNSIGNTRET

SEQ ID NO: 2154357 - protein, 11 aa, Cryptosporidium hominis
NQIAGSPSHPN

SEQ ID NO: 2154358 - protein, 32 aa, Cryptosporidium hominis
NQIDPDRQLDGVDTNSHSKSYKFSHGSNSSFQ

SEQ ID NO: 2154359 - protein, 5 aa, Cryptosporidium hominis
NQIEL

SEQ ID NO: 2154360 - protein, 5 aa, Cryptosporidium hominis
NQIKR

SEQ ID NO: 2154361 - protein, 13 aa, Cryptosporidium hominis
NQIKSQNTVQEEI

SEQ ID NO: 2154362 - protein, 9 aa, Cryptosporidium hominis
NQINSSYSS

SEQ ID NO: 2154363 - protein, 10 aa, Cryptosporidium hominis
NQINYSSSGC

SEQ ID NO: 2154364 - protein, 4 aa, Cryptosporidium hominis
NQIP

SEQ ID NO: 2154365 - protein, 8 aa, Cryptosporidium hominis
NQIPPGKQ

SEQ ID NO: 2154366 - protein, 17 aa, Cryptosporidium hominis
NQIRNGQSYKSNSTGQI

SEQ ID NO: 2154367 - protein, 5 aa, Cryptosporidium hominis
NQISH

SEQ ID NO: 2154368 - protein, 16 aa, Cryptosporidium hominis
NQISSSAKYTVTPNPS

SEQ ID NO: 2154369 - protein, 7 aa, Cryptosporidium hominis
NQKENEF

SEQ ID NO: 2154370 - protein, 9 aa, Cryptosporidium hominis
NQKESKISQ

SEQ ID NO: 2154371 - protein, 5 aa, Cryptosporidium hominis
NQKFE

SEQ ID NO: 2154372 - protein, 17 aa, Cryptosporidium hominis
NQKGRRLDENFDFDSLV

SEQ ID NO: 2154373 - protein, 7 aa, Cryptosporidium hominis
NQKIDTF

SEQ ID NO: 2154374 - protein, 15 aa, Cryptosporidium hominis
NQKIQSTNNEDRDLS

SEQ ID NO: 2154375 - protein, 14 aa, Cryptosporidium hominis
NQKKTNIDTNDEIA

SEQ ID NO: 2154376 - protein, 6 aa, Cryptosporidium hominis
NQKPIP

SEQ ID NO: 2154377 - protein, 15 aa, Cryptosporidium hominis
NQKPQCISDNTEANI

SEQ ID NO: 2154378 - protein, 6 aa, Cryptosporidium hominis
NQKRPT

SEQ ID NO: 2154379 - protein, 12 aa, Cryptosporidium hominis
NQKTKSSEIGTT

SEQ ID NO: 2154380 - protein, 7 aa, Cryptosporidium hominis
NQKTPDY

SEQ ID NO: 2154381 - protein, 4 aa, Cryptosporidium hominis
NQKY

SEQ ID NO: 2154382 - protein, 7 aa, Cryptosporidium hominis
NQKYPEY

SEQ ID NO: 2154383 - protein, 4 aa, Cryptosporidium hominis
NQLE

SEQ ID NO: 2154384 - protein, 7 aa, Cryptosporidium hominis
NQLEPGS

SEQ ID NO: 2154385 - protein, 5 aa, Cryptosporidium hominis
NQLGD

SEQ ID NO: 2154386 - protein, 7 aa, Cryptosporidium hominis
NQLNEPH

SEQ ID NO: 2154387 - protein, 19 aa, Cryptosporidium hominis
NQLNSSNNNDDDDDNMDES

SEQ ID NO: 2154388 - protein, 29 aa, Cryptosporidium hominis
NQLSNKNEIQVSSSDISSTISSNHSEKPK

SEQ ID NO: 2154389 - protein, 5 aa, Cryptosporidium hominis
NQLSQ

SEQ ID NO: 2154390 - protein, 23 aa, Cryptosporidium hominis
NQLSSGSTPLNTTKYSKDNLPNI

SEQ ID NO: 2154391 - protein, 7 aa, Cryptosporidium hominis
NQLTPVD

SEQ ID NO: 2154392 - protein, 35 aa, Cryptosporidium hominis
NQLTSGRLSSTGGNKKPSTPSYSPVKSKALGSYDS

SEQ ID NO: 2154393 - protein, 8 aa, Cryptosporidium hominis
NQNDTNNS

SEQ ID NO: 2154394 - protein, 12 aa, Cryptosporidium hominis
NQNGYIKKKSER

SEQ ID NO: 2154395 - protein, 4 aa, Cryptosporidium hominis
NQNI

SEQ ID NO: 2154396 - protein, 8 aa, Cryptosporidium hominis
NQNIEDSS

SEQ ID NO: 2154397 - protein, 9 aa, Cryptosporidium hominis
NQNKTISGK

SEQ ID NO: 2154398 - protein, 4 aa, Cryptosporidium hominis
NQNL

SEQ ID NO: 2154399 - protein, 7 aa, Cryptosporidium hominis
NQNLESN

SEQ ID NO: 2154400 - protein, 7 aa, Cryptosporidium hominis
NQNNDNR

SEQ ID NO: 2154401 - protein, 10 aa, Cryptosporidium hominis
NQNNKYKQTK

SEQ ID NO: 2154402 - protein, 30 aa, Cryptosporidium hominis
NQNNSQTQAKSEPENAQSLSTSPAGCSSSA

SEQ ID NO: 2154403 - protein, 15 aa, Cryptosporidium hominis
NQNQNQNLDVNQNQN

SEQ ID NO: 2154404 - protein, 12 aa, Cryptosporidium hominis
NQNQNQNPSKNR

SEQ ID NO: 2154405 - protein, 11 aa, Cryptosporidium hominis
NQNQNTNIGTS

SEQ ID NO: 2154406 - protein, 8 aa, Cryptosporidium hominis
NQNRTNLN

SEQ ID NO: 2154407 - protein, 4 aa, Cryptosporidium hominis
NQNS

SEQ ID NO: 2154408 - protein, 5 aa, Cryptosporidium hominis
NQNSF

SEQ ID NO: 2154409 - protein, 8 aa, Cryptosporidium hominis
NQNSNKKH

SEQ ID NO: 2154410 - protein, 11 aa, Cryptosporidium hominis
NQNSPSKDQGF

SEQ ID NO: 2154411 - protein, 15 aa, Cryptosporidium hominis
NQNSQEDSSSSGQEY

SEQ ID NO: 2154412 - protein, 7 aa, Cryptosporidium hominis
NQNTIEE

SEQ ID NO: 2154413 - protein, 13 aa, Cryptosporidium hominis
NQPGRKQSRRIAR

SEQ ID NO: 2154414 - protein, 35 aa, Cryptosporidium hominis
NQPKANDEHSEAAEELSNKDSLSKSRKSKFSFNPN

SEQ ID NO: 2154415 - protein, 9 aa, Cryptosporidium hominis
NQPKAPNHL

SEQ ID NO: 2154416 - protein, 5 aa, Cryptosporidium hominis
NQPKE

SEQ ID NO: 2154417 - protein, 4 aa, Cryptosporidium hominis
NQPY

SEQ ID NO: 2154418 - protein, 16 aa, Cryptosporidium hominis
NQPYINSSSNNYSDDK

SEQ ID NO: 2154419 - protein, 8 aa, Cryptosporidium hominis
NQQDKELS

SEQ ID NO: 2154420 - protein, 21 aa, Cryptosporidium hominis
NQQKKEKEHSHSDSNSNSNNQ

SEQ ID NO: 2154421 - protein, 5 aa, Cryptosporidium hominis
NQQNH

SEQ ID NO: 2154422 - protein, 7 aa, Cryptosporidium hominis
NQQNNNN

SEQ ID NO: 2154423 - protein, 12 aa, Cryptosporidium hominis
NQQNSTEAEIGS

SEQ ID NO: 2154424 - protein, 39 aa, Cryptosporidium hominis
NQQPPKEDLKSSVKAPPVPKSGPGNEKTEEEKLKSSEPI

SEQ ID NO: 2154425 - protein, 18 aa, Cryptosporidium hominis
NQQPQNNNTSVDTQNCSS

SEQ ID NO: 2154426 - protein, 11 aa, Cryptosporidium hominis
NQQPSIATNGN

SEQ ID NO: 2154427 - protein, 8 aa, Cryptosporidium hominis
NQQQQQQQ

SEQ ID NO: 2154428 - protein, 14 aa, Cryptosporidium hominis
NQQSSGGLFGTSSS

SEQ ID NO: 2154429 - protein, 8 aa, Cryptosporidium hominis
NQQSVTSK

SEQ ID NO: 2154430 - protein, 8 aa, Cryptosporidium hominis
NQQVENER

SEQ ID NO: 2154431 - protein, 5 aa, Cryptosporidium hominis
NQQVS

SEQ ID NO: 2154432 - protein, 15 aa, Cryptosporidium hominis
NQRENNAYSGTNQEG

SEQ ID NO: 2154433 - protein, 13 aa, Cryptosporidium hominis
NQRHPSPNKLYTG

SEQ ID NO: 2154434 - protein, 6 aa, Cryptosporidium hominis
NQRNAA

SEQ ID NO: 2154435 - protein, 13 aa, Cryptosporidium hominis
NQRNTNQNINQKD

SEQ ID NO: 2154436 - protein, 9 aa, Cryptosporidium hominis
NQRQQSNRV

SEQ ID NO: 2154437 - protein, 8 aa, Cryptosporidium hominis
NQRSDASK

SEQ ID NO: 2154438 - protein, 5 aa, Cryptosporidium hominis
NQRSG

SEQ ID NO: 2154439 - protein, 9 aa, Cryptosporidium hominis
NQSADTDEF

SEQ ID NO: 2154440 - protein, 5 aa, Cryptosporidium hominis
NQSAH

SEQ ID NO: 2154441 - protein, 4 aa, Cryptosporidium hominis
NQSC

SEQ ID NO: 2154442 - protein, 13 aa, Cryptosporidium hominis
NQSDTSEPESLDS

SEQ ID NO: 2154443 - protein, 16 aa, Cryptosporidium hominis
NQSEAEAEQTTSISSQ

SEQ ID NO: 2154444 - protein, 6 aa, Cryptosporidium hominis
NQSEFG

SEQ ID NO: 2154445 - protein, 6 aa, Cryptosporidium hominis
NQSEME

SEQ ID NO: 2154446 - protein, 12 aa, Cryptosporidium hominis
NQSFDSNLDQES

SEQ ID NO: 2154447 - protein, 10 aa, Cryptosporidium hominis
NQSINEAHSE

SEQ ID NO: 2154448 - protein, 6 aa, Cryptosporidium hominis
NQSKDL

SEQ ID NO: 2154449 - protein, 6 aa, Cryptosporidium hominis
NQSKGA

SEQ ID NO: 2154450 - protein, 12 aa, Cryptosporidium hominis
NQSKGGTTCTTR

SEQ ID NO: 2154451 - protein, 17 aa, Cryptosporidium hominis
NQSKHSKISNGKSSSVM

SEQ ID NO: 2154452 - protein, 4 aa, Cryptosporidium hominis
NQSM

SEQ ID NO: 2154453 - protein, 10 aa, Cryptosporidium hominis
NQSNDKISQS

SEQ ID NO: 2154454 - protein, 16 aa, Cryptosporidium hominis
NQSNYNSNWKQTSSGL

SEQ ID NO: 2154455 - protein, 6 aa, Cryptosporidium hominis
NQSPRN

SEQ ID NO: 2154456 - protein, 11 aa, Cryptosporidium hominis
NQSRDSINGNN

SEQ ID NO: 2154457 - protein, 9 aa, Cryptosporidium hominis
NQSSAEFNT

SEQ ID NO: 2154458 - protein, 21 aa, Cryptosporidium hominis
NQSSKEYSSYYTNQTTSFPTK

SEQ ID NO: 2154459 - protein, 16 aa, Cryptosporidium hominis
NQSSNEQNCEAGQGKY

SEQ ID NO: 2154460 - protein, 9 aa, Cryptosporidium hominis
NQSSTDLGD

SEQ ID NO: 2154461 - protein, 8 aa, Cryptosporidium hominis
NQSTIPEN

SEQ ID NO: 2154462 - protein, 5 aa, Cryptosporidium hominis
NQSTT

SEQ ID NO: 2154463 - protein, 7 aa, Cryptosporidium hominis
NQSTTNT

SEQ ID NO: 2154464 - protein, 14 aa, Cryptosporidium hominis
NQTAEKDEFEHQQK

SEQ ID NO: 2154465 - protein, 4 aa, Cryptosporidium hominis
NQTF

SEQ ID NO: 2154466 - protein, 4 aa, Cryptosporidium hominis
NQTI

SEQ ID NO: 2154467 - protein, 15 aa, Cryptosporidium hominis
NQTKPYRHSPGPQTY

SEQ ID NO: 2154468 - protein, 5 aa, Cryptosporidium hominis
NQTLE

SEQ ID NO: 2154469 - protein, 5 aa, Cryptosporidium hominis
NQTNE

SEQ ID NO: 2154470 - protein, 10 aa, Cryptosporidium hominis
NQTPKPPIKR

SEQ ID NO: 2154471 - protein, 7 aa, Cryptosporidium hominis
NQTPSKI

SEQ ID NO: 2154472 - protein, 4 aa, Cryptosporidium hominis
NQTR

SEQ ID NO: 2154473 - protein, 5 aa, Cryptosporidium hominis
NQTRA

SEQ ID NO: 2154474 - protein, 57 aa, Cryptosporidium hominis
NQTRNSSNTKKSSNKINVKKDKDKYKNKSNSNNYPISESETKTKIKPSNSHVIFSDS

SEQ ID NO: 2154475 - protein, 15 aa, Cryptosporidium hominis
NQTSCTRNNEHESKE

SEQ ID NO: 2154476 - protein, 6 aa, Cryptosporidium hominis
NQTSEI

SEQ ID NO: 2154477 - protein, 22 aa, Cryptosporidium hominis
NQVEQDEKNRSSLVNSSGRQYH

SEQ ID NO: 2154478 - protein, 6 aa, Cryptosporidium hominis
NQVNNQ

SEQ ID NO: 2154479 - protein, 9 aa, Cryptosporidium hominis
NQYASSVTS

SEQ ID NO: 2154480 - protein, 7 aa, Cryptosporidium hominis
NQYNSES

SEQ ID NO: 2154481 - protein, 8 aa, Cryptosporidium hominis
NQYPSSTR

SEQ ID NO: 2154482 - protein, 12 aa, Cryptosporidium hominis
NRANNKSNNLEA

SEQ ID NO: 2154483 - protein, 10 aa, Cryptosporidium hominis
NRAREGNYPI

SEQ ID NO: 2154484 - protein, 9 aa, Cryptosporidium hominis
NRDDSKNAE

SEQ ID NO: 2154485 - protein, 4 aa, Cryptosporidium hominis
NRDE

SEQ ID NO: 2154486 - protein, 4 aa, Cryptosporidium hominis
NRDG

SEQ ID NO: 2154487 - protein, 8 aa, Cryptosporidium hominis
NRDGGSGG

SEQ ID NO: 2154488 - protein, 4 aa, Cryptosporidium hominis
NRDK

SEQ ID NO: 2154489 - protein, 4 aa, Cryptosporidium hominis
NRDL

SEQ ID NO: 2154490 - protein, 11 aa, Cryptosporidium hominis
NRDPDKSKHLE

SEQ ID NO: 2154491 - protein, 7 aa, Cryptosporidium hominis
NRDPKSH

SEQ ID NO: 2154492 - protein, 4 aa, Cryptosporidium hominis
NRDR

SEQ ID NO: 2154493 - protein, 6 aa, Cryptosporidium hominis
NRDTSI

SEQ ID NO: 2154494 - protein, 5 aa, Cryptosporidium hominis
NREHQ

SEQ ID NO: 2154495 - protein, 8 aa, Cryptosporidium hominis
NREIPQAP

SEQ ID NO: 2154496 - protein, 10 aa, Cryptosporidium hominis
NREKDKELSE

SEQ ID NO: 2154497 - protein, 4 aa, Cryptosporidium hominis
NREN

SEQ ID NO: 2154498 - protein, 7 aa, Cryptosporidium hominis
NRENSAM

SEQ ID NO: 2154499 - protein, 9 aa, Cryptosporidium hominis
NRENSQDQV

SEQ ID NO: 2154500 - protein, 5 aa, Cryptosporidium hominis
NREQL

SEQ ID NO: 2154501 - protein, 6 aa, Cryptosporidium hominis
NRERAK

SEQ ID NO: 2154502 - protein, 4 aa, Cryptosporidium hominis
NRES

SEQ ID NO: 2154503 - protein, 6 aa, Cryptosporidium hominis
NRESLE

SEQ ID NO: 2154504 - protein, 6 aa, Cryptosporidium hominis
NRESRE

SEQ ID NO: 2154505 - protein, 8 aa, Cryptosporidium hominis
NRETNKNK

SEQ ID NO: 2154506 - protein, 4 aa, Cryptosporidium hominis
NREY

SEQ ID NO: 2154507 - protein, 19 aa, Cryptosporidium hominis
NRFNSNNDHDEFSNYREHT

SEQ ID NO: 2154508 - protein, 18 aa, Cryptosporidium hominis
NRFPGFTKGENGAEDSFD

SEQ ID NO: 2154509 - protein, 6 aa, Cryptosporidium hominis
NRGGGC

SEQ ID NO: 2154510 - protein, 7 aa, Cryptosporidium hominis
NRGGGTM

SEQ ID NO: 2154511 - protein, 6 aa, Cryptosporidium hominis
NRGIYS

SEQ ID NO: 2154512 - protein, 4 aa, Cryptosporidium hominis
NRGN

SEQ ID NO: 2154513 - protein, 5 aa, Cryptosporidium hominis
NRGSR

SEQ ID NO: 2154514 - protein, 14 aa, Cryptosporidium hominis
NRIANTGSSPNISL

SEQ ID NO: 2154515 - protein, 14 aa, Cryptosporidium hominis
NRILPSNDVNSPPS

SEQ ID NO: 2154516 - protein, 42 aa, Cryptosporidium hominis
NRITKSREKVSQESEIPSKRSNKTKKSQTSNINSGISKQQTL

SEQ ID NO: 2154517 - protein, 23 aa, Cryptosporidium hominis
NRITSGSSCSNTPISRETRPELT

SEQ ID NO: 2154518 - protein, 5 aa, Cryptosporidium hominis
NRKFS

SEQ ID NO: 2154519 - protein, 10 aa, Cryptosporidium hominis
NRKISNDSDQ

SEQ ID NO: 2154520 - protein, 9 aa, Cryptosporidium hominis
NRKKKEEID

SEQ ID NO: 2154521 - protein, 4 aa, Cryptosporidium hominis
NRKN

SEQ ID NO: 2154522 - protein, 10 aa, Cryptosporidium hominis
NRKNKEREND

SEQ ID NO: 2154523 - protein, 7 aa, Cryptosporidium hominis
NRKNQTY

SEQ ID NO: 2154524 - protein, 11 aa, Cryptosporidium hominis
NRKNTTGGDIN

SEQ ID NO: 2154525 - protein, 8 aa, Cryptosporidium hominis
NRKPGPAD

SEQ ID NO: 2154526 - protein, 7 aa, Cryptosporidium hominis
NRKPQYS

SEQ ID NO: 2154527 - protein, 4 aa, Cryptosporidium hominis
NRKS

SEQ ID NO: 2154528 - protein, 13 aa, Cryptosporidium hominis
NRKSRPANSSSSI

SEQ ID NO: 2154529 - protein, 6 aa, Cryptosporidium hominis
NRLKER

SEQ ID NO: 2154530 - protein, 4 aa, Cryptosporidium hominis
NRLS

SEQ ID NO: 2154531 - protein, 5 aa, Cryptosporidium hominis
NRLST

SEQ ID NO: 2154532 - protein, 14 aa, Cryptosporidium hominis
NRLTKDRLKGNEEL

SEQ ID NO: 2154533 - protein, 24 aa, Cryptosporidium hominis
NRMSNSQPAQSGTIIPSNEYDVGS

SEQ ID NO: 2154534 - protein, 8 aa, Cryptosporidium hominis
NRNATTAL

SEQ ID NO: 2154535 - protein, 8 aa, Cryptosporidium hominis
NRNDPRIS

SEQ ID NO: 2154536 - protein, 7 aa, Cryptosporidium hominis
NRNEIDK

SEQ ID NO: 2154537 - protein, 7 aa, Cryptosporidium hominis
NRNERRS

SEQ ID NO: 2154538 - protein, 28 aa, Cryptosporidium hominis
NRNHPSEKKINNKQNVNTPNDQNNYNKN

SEQ ID NO: 2154539 - protein, 4 aa, Cryptosporidium hominis
NRNK

SEQ ID NO: 2154540 - protein, 18 aa, Cryptosporidium hominis
NRNKAYSSSKSSSGKPIS

SEQ ID NO: 2154541 - protein, 7 aa, Cryptosporidium hominis
NRNKKEI

SEQ ID NO: 2154542 - protein, 9 aa, Cryptosporidium hominis
NRNNSHDEN

SEQ ID NO: 2154543 - protein, 16 aa, Cryptosporidium hominis
NRNNVNKYNDQEDPIG

SEQ ID NO: 2154544 - protein, 11 aa, Cryptosporidium hominis
NRNPPDPQPSI

SEQ ID NO: 2154545 - protein, 28 aa, Cryptosporidium hominis
NRNQLHPNATATITGGDGRGGNVGITEP

SEQ ID NO: 2154546 - protein, 13 aa, Cryptosporidium hominis
NRNREINDGKSSI

SEQ ID NO: 2154547 - protein, 10 aa, Cryptosporidium hominis
NRNSGTPNNH

SEQ ID NO: 2154548 - protein, 7 aa, Cryptosporidium hominis
NRNSGVN

SEQ ID NO: 2154549 - protein, 12 aa, Cryptosporidium hominis
NRNSLGNEDTEI

SEQ ID NO: 2154550 - protein, 5 aa, Cryptosporidium hominis
NRNSP

SEQ ID NO: 2154551 - protein, 5 aa, Cryptosporidium hominis
NRNSS

SEQ ID NO: 2154552 - protein, 7 aa, Cryptosporidium hominis
NRNVDSK

SEQ ID NO: 2154553 - protein, 7 aa, Cryptosporidium hominis
NRNVKRK

SEQ ID NO: 2154554 - protein, 5 aa, Cryptosporidium hominis
NRPDI

SEQ ID NO: 2154555 - protein, 5 aa, Cryptosporidium hominis
NRPDL

SEQ ID NO: 2154556 - protein, 7 aa, Cryptosporidium hominis
NRPDTLD

SEQ ID NO: 2154557 - protein, 5 aa, Cryptosporidium hominis
NRPEI

SEQ ID NO: 2154558 - protein, 4 aa, Cryptosporidium hominis
NRPF

SEQ ID NO: 2154559 - protein, 4 aa, Cryptosporidium hominis
NRPG

SEQ ID NO: 2154560 - protein, 19 aa, Cryptosporidium hominis
NRPIRKESEALARKKRRYE

SEQ ID NO: 2154561 - protein, 10 aa, Cryptosporidium hominis
NRPNAYGYSR

SEQ ID NO: 2154562 - protein, 8 aa, Cryptosporidium hominis
NRPQQNGK

SEQ ID NO: 2154563 - protein, 7 aa, Cryptosporidium hominis
NRPRLNP

SEQ ID NO: 2154564 - protein, 10 aa, Cryptosporidium hominis
NRPSLDETIS

SEQ ID NO: 2154565 - protein, 7 aa, Cryptosporidium hominis
NRPYPQN

SEQ ID NO: 2154566 - protein, 6 aa, Cryptosporidium hominis
NRQCNS

SEQ ID NO: 2154567 - protein, 7 aa, Cryptosporidium hominis
NRQGVPI

SEQ ID NO: 2154568 - protein, 9 aa, Cryptosporidium hominis
NRQNRPNKG

SEQ ID NO: 2154569 - protein, 10 aa, Cryptosporidium hominis
NRQNTTSSVI

SEQ ID NO: 2154570 - protein, 5 aa, Cryptosporidium hominis
NRQRD

SEQ ID NO: 2154571 - protein, 9 aa, Cryptosporidium hominis
NRQSTTKVS

SEQ ID NO: 2154572 - protein, 5 aa, Cryptosporidium hominis
NRRAA

SEQ ID NO: 2154573 - protein, 10 aa, Cryptosporidium hominis
NRRATAPDNM

SEQ ID NO: 2154574 - protein, 4 aa, Cryptosporidium hominis
NRRD

SEQ ID NO: 2154575 - protein, 15 aa, Cryptosporidium hominis
NRRDSYKSLKSNQTH

SEQ ID NO: 2154576 - protein, 5 aa, Cryptosporidium hominis
NRRGA

SEQ ID NO: 2154577 - protein, 9 aa, Cryptosporidium hominis
NRRGGPDDA

SEQ ID NO: 2154578 - protein, 4 aa, Cryptosporidium hominis
NRRI

SEQ ID NO: 2154579 - protein, 7 aa, Cryptosporidium hominis
NRSAESD

SEQ ID NO: 2154580 - protein, 6 aa, Cryptosporidium hominis
NRSANK

SEQ ID NO: 2154581 - protein, 7 aa, Cryptosporidium hominis
NRSEDEA

SEQ ID NO: 2154582 - protein, 8 aa, Cryptosporidium hominis
NRSEKGGQ

SEQ ID NO: 2154583 - protein, 4 aa, Cryptosporidium hominis
NRSN

SEQ ID NO: 2154584 - protein, 7 aa, Cryptosporidium hominis
NRSQAIN

SEQ ID NO: 2154585 - protein, 4 aa, Cryptosporidium hominis
NRSR

SEQ ID NO: 2154586 - protein, 10 aa, Cryptosporidium hominis
NRSRGRGRFS

SEQ ID NO: 2154587 - protein, 17 aa, Cryptosporidium hominis
NRSRNPKKSISNQSSGI

SEQ ID NO: 2154588 - protein, 10 aa, Cryptosporidium hominis
NRSRVDYGTG

SEQ ID NO: 2154589 - protein, 9 aa, Cryptosporidium hominis
NRSSEVNSM

SEQ ID NO: 2154590 - protein, 18 aa, Cryptosporidium hominis
NRSSNNNDNNNGNQTNGI

SEQ ID NO: 2154591 - protein, 6 aa, Cryptosporidium hominis
NRSSYV

SEQ ID NO: 2154592 - protein, 14 aa, Cryptosporidium hominis
NRSTDNKDEFNSES

SEQ ID NO: 2154593 - protein, 5 aa, Cryptosporidium hominis
NRSTI

SEQ ID NO: 2154594 - protein, 9 aa, Cryptosporidium hominis
NRTDKSELS

SEQ ID NO: 2154595 - protein, 7 aa, Cryptosporidium hominis
NRTKDHA

SEQ ID NO: 2154596 - protein, 23 aa, Cryptosporidium hominis
NRTKNTLSKETKTLEDEDVHDTQ

SEQ ID NO: 2154597 - protein, 6 aa, Cryptosporidium hominis
NRTLGL

SEQ ID NO: 2154598 - protein, 5 aa, Cryptosporidium hominis
NRTMT

SEQ ID NO: 2154599 - protein, 6 aa, Cryptosporidium hominis
NRTPQN

SEQ ID NO: 2154600 - protein, 38 aa, Cryptosporidium hominis
NRTRDEIYESSKRSSCESSSKKKLSKPSRKSISKENAA

SEQ ID NO: 2154601 - protein, 11 aa, Cryptosporidium hominis
NRTRKNQNSLD

SEQ ID NO: 2154602 - protein, 11 aa, Cryptosporidium hominis
NRVETEDEDST

SEQ ID NO: 2154603 - protein, 10 aa, Cryptosporidium hominis
NRVKPPTKLD

SEQ ID NO: 2154604 - protein, 6 aa, Cryptosporidium hominis
NRVSQH

SEQ ID NO: 2154605 - protein, 4 aa, Cryptosporidium hominis
NRYK

SEQ ID NO: 2154606 - protein, 4 aa, Cryptosporidium hominis
NRYP

SEQ ID NO: 2154607 - protein, 14 aa, Cryptosporidium hominis
NRYSTSASSNISSQ

SEQ ID NO: 2154608 - protein, 10 aa, Cryptosporidium hominis
NSAASSTSVV

SEQ ID NO: 2154609 - protein, 7 aa, Cryptosporidium hominis
NSADALE

SEQ ID NO: 2154610 - protein, 9 aa, Cryptosporidium hominis
NSAGEMSEI

SEQ ID NO: 2154611 - protein, 10 aa, Cryptosporidium hominis
NSAGVGLENG

SEQ ID NO: 2154612 - protein, 8 aa, Cryptosporidium hominis
NSAKDATD

SEQ ID NO: 2154613 - protein, 9 aa, Cryptosporidium hominis
NSAKDIKDI

SEQ ID NO: 2154614 - protein, 18 aa, Cryptosporidium hominis
NSAKTNSAEAKKIKNQAS

SEQ ID NO: 2154615 - protein, 10 aa, Cryptosporidium hominis
NSALKTSKST

SEQ ID NO: 2154616 - protein, 26 aa, Cryptosporidium hominis
NSALRSENYGLETPKGLSSKRASINI

SEQ ID NO: 2154617 - protein, 15 aa, Cryptosporidium hominis
NSANKIKNLRNSINE

SEQ ID NO: 2154618 - protein, 7 aa, Cryptosporidium hominis
NSARGLG

SEQ ID NO: 2154619 - protein, 7 aa, Cryptosporidium hominis
NSARNDS

SEQ ID NO: 2154620 - protein, 9 aa, Cryptosporidium hominis
NSASSNKTQ

SEQ ID NO: 2154621 - protein, 21 aa, Cryptosporidium hominis
NSASTNSTSSTNLAENSPNTS

SEQ ID NO: 2154622 - protein, 15 aa, Cryptosporidium hominis
NSASYETHQQATNVH

SEQ ID NO: 2154623 - protein, 7 aa, Cryptosporidium hominis
NSATSLK

SEQ ID NO: 2154624 - protein, 4 aa, Cryptosporidium hominis
NSAY

SEQ ID NO: 2154625 - protein, 15 aa, Cryptosporidium hominis
NSAYQTPSSGNNHQI

SEQ ID NO: 2154626 - protein, 12 aa, Cryptosporidium hominis
NSCKSKDLNKEI

SEQ ID NO: 2154627 - protein, 7 aa, Cryptosporidium hominis
NSCNDTE

SEQ ID NO: 2154628 - protein, 25 aa, Cryptosporidium hominis
NSCQNSQDKYKIKTKTKTTKNYYNN

SEQ ID NO: 2154629 - protein, 4 aa, Cryptosporidium hominis
NSCS

SEQ ID NO: 2154630 - protein, 7 aa, Cryptosporidium hominis
NSDASKV

SEQ ID NO: 2154631 - protein, 14 aa, Cryptosporidium hominis
NSDDEPPRQSNRKE

SEQ ID NO: 2154632 - protein, 10 aa, Cryptosporidium hominis
NSDDKTEISS

SEQ ID NO: 2154633 - protein, 7 aa, Cryptosporidium hominis
NSDEENQ

SEQ ID NO: 2154634 - protein, 6 aa, Cryptosporidium hominis
NSDEIE

SEQ ID NO: 2154635 - protein, 7 aa, Cryptosporidium hominis
NSDESIE

SEQ ID NO: 2154636 - protein, 15 aa, Cryptosporidium hominis
NSDFDNKRKKRTATW

SEQ ID NO: 2154637 - protein, 6 aa, Cryptosporidium hominis
NSDFGD

SEQ ID NO: 2154638 - protein, 6 aa, Cryptosporidium hominis
NSDFGF

SEQ ID NO: 2154639 - protein, 5 aa, Cryptosporidium hominis
NSDGD

SEQ ID NO: 2154640 - protein, 6 aa, Cryptosporidium hominis
NSDGTF

SEQ ID NO: 2154641 - protein, 19 aa, Cryptosporidium hominis
NSDHNNSKSGDDNHPPISE

SEQ ID NO: 2154642 - protein, 22 aa, Cryptosporidium hominis
NSDIRNSKVSGNSNNHISSQSI

SEQ ID NO: 2154643 - protein, 9 aa, Cryptosporidium hominis
NSDISSNTV

SEQ ID NO: 2154644 - protein, 10 aa, Cryptosporidium hominis
NSDKDSKITS

SEQ ID NO: 2154645 - protein, 20 aa, Cryptosporidium hominis
NSDKGPNCNEKDYSKSQDDI

SEQ ID NO: 2154646 - protein, 8 aa, Cryptosporidium hominis
NSDKHKAD

SEQ ID NO: 2154647 - protein, 19 aa, Cryptosporidium hominis
NSDKNSNKQSGSEYNPAAE

SEQ ID NO: 2154648 - protein, 32 aa, Cryptosporidium hominis
NSDLSTTIGSSGLEDRDDISSSDDLSDISDSE

SEQ ID NO: 2154649 - protein, 25 aa, Cryptosporidium hominis
NSDNEDSFNNSEFQTNSNNITSTSI

SEQ ID NO: 2154650 - protein, 7 aa, Cryptosporidium hominis
NSDNHKV

SEQ ID NO: 2154651 - protein, 17 aa, Cryptosporidium hominis
NSDNNYNINDENNNNNY

SEQ ID NO: 2154652 - protein, 9 aa, Cryptosporidium hominis
NSDNTETRR

SEQ ID NO: 2154653 - protein, 12 aa, Cryptosporidium hominis
NSDNTVNTSPQP

SEQ ID NO: 2154654 - protein, 12 aa, Cryptosporidium hominis
NSDQNRNDSNGL

SEQ ID NO: 2154655 - protein, 16 aa, Cryptosporidium hominis
NSDRRTRSKNVNNDLP

SEQ ID NO: 2154656 - protein, 4 aa, Cryptosporidium hominis
NSDS

SEQ ID NO: 2154657 - protein, 10 aa, Cryptosporidium hominis
NSDSDESENG

SEQ ID NO: 2154658 - protein, 13 aa, Cryptosporidium hominis
NSDSQNKNDQTVD

SEQ ID NO: 2154659 - protein, 9 aa, Cryptosporidium hominis
NSDSSIELN

SEQ ID NO: 2154660 - protein, 12 aa, Cryptosporidium hominis
NSDYSSGNDGYG

SEQ ID NO: 2154661 - protein, 6 aa, Cryptosporidium hominis
NSEATK

SEQ ID NO: 2154662 - protein, 12 aa, Cryptosporidium hominis
NSECSEDSEQTA

SEQ ID NO: 2154663 - protein, 5 aa, Cryptosporidium hominis
NSEDE

SEQ ID NO: 2154664 - protein, 5 aa, Cryptosporidium hominis
NSEDI

SEQ ID NO: 2154665 - protein, 7 aa, Cryptosporidium hominis
NSEDTTL

SEQ ID NO: 2154666 - protein, 13 aa, Cryptosporidium hominis
NSEDVPQDLPSHS

SEQ ID NO: 2154667 - protein, 14 aa, Cryptosporidium hominis
NSEEEVSRSTGLQL

SEQ ID NO: 2154668 - protein, 9 aa, Cryptosporidium hominis
NSEEKEGVL

SEQ ID NO: 2154669 - protein, 43 aa, Cryptosporidium hominis
NSEEKGLKGGGAPANQNSKLKLPSQKLDSKLDSSTTEQCNHSK

SEQ ID NO: 2154670 - protein, 6 aa, Cryptosporidium hominis
NSEELK

SEQ ID NO: 2154671 - protein, 13 aa, Cryptosporidium hominis
NSEENSNDTTQNE

SEQ ID NO: 2154672 - protein, 6 aa, Cryptosporidium hominis
NSEEQA

SEQ ID NO: 2154673 - protein, 10 aa, Cryptosporidium hominis
NSEERTRSHS

SEQ ID NO: 2154674 - protein, 8 aa, Cryptosporidium hominis
NSEFDDEE

SEQ ID NO: 2154675 - protein, 15 aa, Cryptosporidium hominis
NSEFSECDETDNTQL

SEQ ID NO: 2154676 - protein, 12 aa, Cryptosporidium hominis
NSEFSNNTNRMD

SEQ ID NO: 2154677 - protein, 25 aa, Cryptosporidium hominis
NSEGFTTKSNNTNNINGNCNNSPSL

SEQ ID NO: 2154678 - protein, 5 aa, Cryptosporidium hominis
NSEGN

SEQ ID NO: 2154679 - protein, 6 aa, Cryptosporidium hominis
NSEHSH

SEQ ID NO: 2154680 - protein, 4 aa, Cryptosporidium hominis
NSEI

SEQ ID NO: 2154681 - protein, 30 aa, Cryptosporidium hominis
NSEICKKNRDKEVGERHESYDQETNNGELS

SEQ ID NO: 2154682 - protein, 15 aa, Cryptosporidium hominis
NSEIDPENSINTSNN

SEQ ID NO: 2154683 - protein, 15 aa, Cryptosporidium hominis
NSEIKKRRGLSSASG

SEQ ID NO: 2154684 - protein, 13 aa, Cryptosporidium hominis
NSEINEESHSRHS

SEQ ID NO: 2154685 - protein, 8 aa, Cryptosporidium hominis
NSEINQPT

SEQ ID NO: 2154686 - protein, 24 aa, Cryptosporidium hominis
NSEISPEELENSEPLTTNSQDNHF

SEQ ID NO: 2154687 - protein, 40 aa, Cryptosporidium hominis
NSEITEHSRLEKGSEYSNNYSSSDNSDSDDDNRDNGKCYS

SEQ ID NO: 2154688 - protein, 13 aa, Cryptosporidium hominis
NSEKDALESAEEM

SEQ ID NO: 2154689 - protein, 7 aa, Cryptosporidium hominis
NSELENN

SEQ ID NO: 2154690 - protein, 8 aa, Cryptosporidium hominis
NSELESNG

SEQ ID NO: 2154691 - protein, 5 aa, Cryptosporidium hominis
NSELS

SEQ ID NO: 2154692 - protein, 26 aa, Cryptosporidium hominis
NSELSNSLSGKNTSNLKYSNNPELSN

SEQ ID NO: 2154693 - protein, 12 aa, Cryptosporidium hominis
NSELSSSEGVKN

SEQ ID NO: 2154694 - protein, 4 aa, Cryptosporidium hominis
NSEN

SEQ ID NO: 2154695 - protein, 16 aa, Cryptosporidium hominis
NSENASQYQTEKINET

SEQ ID NO: 2154696 - protein, 7 aa, Cryptosporidium hominis
NSENIKN

SEQ ID NO: 2154697 - protein, 7 aa, Cryptosporidium hominis
NSENKEY

SEQ ID NO: 2154698 - protein, 9 aa, Cryptosporidium hominis
NSENKSDFE

SEQ ID NO: 2154699 - protein, 10 aa, Cryptosporidium hominis
NSENKSKIEI

SEQ ID NO: 2154700 - protein, 7 aa, Cryptosporidium hominis
NSENLPP

SEQ ID NO: 2154701 - protein, 26 aa, Cryptosporidium hominis
NSENSDTDEVQESDDERFTKPENEED

SEQ ID NO: 2154702 - protein, 9 aa, Cryptosporidium hominis
NSENSKGYF

SEQ ID NO: 2154703 - protein, 14 aa, Cryptosporidium hominis
NSEPELNSNAPKLN

SEQ ID NO: 2154704 - protein, 8 aa, Cryptosporidium hominis
NSEPKKRW

SEQ ID NO: 2154705 - protein, 7 aa, Cryptosporidium hominis
NSEPYHR

SEQ ID NO: 2154706 - protein, 16 aa, Cryptosporidium hominis
NSEQGSAGINDKALSD

SEQ ID NO: 2154707 - protein, 6 aa, Cryptosporidium hominis
NSESEL

SEQ ID NO: 2154708 - protein, 6 aa, Cryptosporidium hominis
NSESMQ

SEQ ID NO: 2154709 - protein, 7 aa, Cryptosporidium hominis
NSESSEF

SEQ ID NO: 2154710 - protein, 19 aa, Cryptosporidium hominis
NSETENASQGPPPPPSSGI

SEQ ID NO: 2154711 - protein, 12 aa, Cryptosporidium hominis
NSETRLKASIYK

SEQ ID NO: 2154712 - protein, 8 aa, Cryptosporidium hominis
NSETVPES

SEQ ID NO: 2154713 - protein, 12 aa, Cryptosporidium hominis
NSEVKERSKPKC

SEQ ID NO: 2154714 - protein, 46 aa, Cryptosporidium hominis
NSEVSTNKEAAEDRDRYDCDSNESIKEEIRDSDARISNSESKPQHT

SEQ ID NO: 2154715 - protein, 14 aa, Cryptosporidium hominis
NSEYEKGKKNLQSR

SEQ ID NO: 2154716 - protein, 22 aa, Cryptosporidium hominis
NSEYNEGQPKETDKIASNNEEA

SEQ ID NO: 2154717 - protein, 9 aa, Cryptosporidium hominis
NSEYQETDE

SEQ ID NO: 2154718 - protein, 7 aa, Cryptosporidium hominis
NSEYRSN

SEQ ID NO: 2154719 - protein, 5 aa, Cryptosporidium hominis
NSEYS

SEQ ID NO: 2154720 - protein, 16 aa, Cryptosporidium hominis
NSEYSSERKTSNGGVA

SEQ ID NO: 2154721 - protein, 18 aa, Cryptosporidium hominis
NSFDISPSSEQNHVESPS

SEQ ID NO: 2154722 - protein, 11 aa, Cryptosporidium hominis
NSFEPRSSEEI

SEQ ID NO: 2154723 - protein, 4 aa, Cryptosporidium hominis
NSFG

SEQ ID NO: 2154724 - protein, 11 aa, Cryptosporidium hominis
NSFGAPGPNNI

SEQ ID NO: 2154725 - protein, 6 aa, Cryptosporidium hominis
NSFGNA

SEQ ID NO: 2154726 - protein, 11 aa, Cryptosporidium hominis
NSFKNDSSVKI

SEQ ID NO: 2154727 - protein, 11 aa, Cryptosporidium hominis
NSFKSGKDMQK

SEQ ID NO: 2154728 - protein, 7 aa, Cryptosporidium hominis
NSFQSNN

SEQ ID NO: 2154729 - protein, 5 aa, Cryptosporidium hominis
NSFRS

SEQ ID NO: 2154730 - protein, 12 aa, Cryptosporidium hominis
NSFSQNQDGKFS

SEQ ID NO: 2154731 - protein, 7 aa, Cryptosporidium hominis
NSFTGGT

SEQ ID NO: 2154732 - protein, 10 aa, Cryptosporidium hominis
NSFTPTNSGS

SEQ ID NO: 2154733 - protein, 21 aa, Cryptosporidium hominis
NSGDSGSGGTSNKRRKRSVSR

SEQ ID NO: 2154734 - protein, 22 aa, Cryptosporidium hominis
NSGGIDELKQSGYSSSNPKLTG

SEQ ID NO: 2154735 - protein, 48 aa, Cryptosporidium hominis
NSGGNYRRKSMNNNNNNNNDSSNNKNNNNSNNSNNNNTNTNDNNDLQK

SEQ ID NO: 2154736 - protein, 4 aa, Cryptosporidium hominis
NSGI

SEQ ID NO: 2154737 - protein, 11 aa, Cryptosporidium hominis
NSGKFQVDPPK

SEQ ID NO: 2154738 - protein, 11 aa, Cryptosporidium hominis
NSGKGVVDTSS

SEQ ID NO: 2154739 - protein, 20 aa, Cryptosporidium hominis
NSGKLRQGGEHLKRPTESEE

SEQ ID NO: 2154740 - protein, 9 aa, Cryptosporidium hominis
NSGKNNQLK

SEQ ID NO: 2154741 - protein, 7 aa, Cryptosporidium hominis
NSGLNST

SEQ ID NO: 2154742 - protein, 8 aa, Cryptosporidium hominis
NSGMNGKE

SEQ ID NO: 2154743 - protein, 7 aa, Cryptosporidium hominis
NSGMSIG

SEQ ID NO: 2154744 - protein, 7 aa, Cryptosporidium hominis
NSGNLNS

SEQ ID NO: 2154745 - protein, 6 aa, Cryptosporidium hominis
NSGNLS

SEQ ID NO: 2154746 - protein, 9 aa, Cryptosporidium hominis
NSGPNTNSS

SEQ ID NO: 2154747 - protein, 7 aa, Cryptosporidium hominis
NSGPQTL

SEQ ID NO: 2154748 - protein, 17 aa, Cryptosporidium hominis
NSGQNTSQAINSSLGQN

SEQ ID NO: 2154749 - protein, 8 aa, Cryptosporidium hominis
NSGQVQDE

SEQ ID NO: 2154750 - protein, 27 aa, Cryptosporidium hominis
NSGSDSILQKPAKRQKIRSKKKNTLAD

SEQ ID NO: 2154751 - protein, 8 aa, Cryptosporidium hominis
NSGSRSNI

SEQ ID NO: 2154752 - protein, 8 aa, Cryptosporidium hominis
NSGTNQVD

SEQ ID NO: 2154753 - protein, 6 aa, Cryptosporidium hominis
NSGVSK

SEQ ID NO: 2154754 - protein, 7 aa, Cryptosporidium hominis
NSGWGGK

SEQ ID NO: 2154755 - protein, 14 aa, Cryptosporidium hominis
NSGYDSPKSSSAHK

SEQ ID NO: 2154756 - protein, 21 aa, Cryptosporidium hominis
NSGYNDEIEEANDDLNNTLSK

SEQ ID NO: 2154757 - protein, 6 aa, Cryptosporidium hominis
NSGYSD

SEQ ID NO: 2154758 - protein, 8 aa, Cryptosporidium hominis
NSHDPIKQ

SEQ ID NO: 2154759 - protein, 7 aa, Cryptosporidium hominis
NSHENNH

SEQ ID NO: 2154760 - protein, 12 aa, Cryptosporidium hominis
NSHHNNGNERSL

SEQ ID NO: 2154761 - protein, 4 aa, Cryptosporidium hominis
NSHI

SEQ ID NO: 2154762 - protein, 21 aa, Cryptosporidium hominis
NSHLEESDNLEGDIKQSQNFR

SEQ ID NO: 2154763 - protein, 7 aa, Cryptosporidium hominis
NSHLGGE

SEQ ID NO: 2154764 - protein, 7 aa, Cryptosporidium hominis
NSHNKYD

SEQ ID NO: 2154765 - protein, 5 aa, Cryptosporidium hominis
NSHPY

SEQ ID NO: 2154766 - protein, 9 aa, Cryptosporidium hominis
NSHREIARS

SEQ ID NO: 2154767 - protein, 7 aa, Cryptosporidium hominis
NSHTKDK

SEQ ID NO: 2154768 - protein, 15 aa, Cryptosporidium hominis
NSIAKSSSNISDEEI

SEQ ID NO: 2154769 - protein, 5 aa, Cryptosporidium hominis
NSIAS

SEQ ID NO: 2154770 - protein, 5 aa, Cryptosporidium hominis
NSIED

SEQ ID NO: 2154771 - protein, 59 aa, Cryptosporidium hominis
NSIEDKEKQTKLDMTTKSSEEEQVDREDQYPASVSSITETQSVHSNSNSCMGAKRLTSS

SEQ ID NO: 2154772 - protein, 15 aa, Cryptosporidium hominis
NSIEEAVKSNSRDAS

SEQ ID NO: 2154773 - protein, 9 aa, Cryptosporidium hominis
NSIENSDNE

SEQ ID NO: 2154774 - protein, 5 aa, Cryptosporidium hominis
NSIET

SEQ ID NO: 2154775 - protein, 6 aa, Cryptosporidium hominis
NSIEYG

SEQ ID NO: 2154776 - protein, 4 aa, Cryptosporidium hominis
NSIG

SEQ ID NO: 2154777 - protein, 8 aa, Cryptosporidium hominis
NSIGCPGN

SEQ ID NO: 2154778 - protein, 7 aa, Cryptosporidium hominis
NSIGRPK

SEQ ID NO: 2154779 - protein, 21 aa, Cryptosporidium hominis
NSIGSSNNSNCSANSHTERNT

SEQ ID NO: 2154780 - protein, 5 aa, Cryptosporidium hominis
NSIHK

SEQ ID NO: 2154781 - protein, 4 aa, Cryptosporidium hominis
NSIK

SEQ ID NO: 2154782 - protein, 7 aa, Cryptosporidium hominis
NSILPST

SEQ ID NO: 2154783 - protein, 8 aa, Cryptosporidium hominis
NSINGSKK

SEQ ID NO: 2154784 - protein, 28 aa, Cryptosporidium hominis
NSINNNNNNNNNNNNINNTTNTSSINGL

SEQ ID NO: 2154785 - protein, 14 aa, Cryptosporidium hominis
NSINRDSSQRLKPG

SEQ ID NO: 2154786 - protein, 11 aa, Cryptosporidium hominis
NSIPNDSSSFS

SEQ ID NO: 2154787 - protein, 21 aa, Cryptosporidium hominis
NSIPPTSNDTNNGTNNNTNDP

SEQ ID NO: 2154788 - protein, 5 aa, Cryptosporidium hominis
NSIPQ

SEQ ID NO: 2154789 - protein, 8 aa, Cryptosporidium hominis
NSIRGQSN

SEQ ID NO: 2154790 - protein, 13 aa, Cryptosporidium hominis
NSIRSDKDNDPNI

SEQ ID NO: 2154791 - protein, 16 aa, Cryptosporidium hominis
NSISSSSSSSSTFTTS

SEQ ID NO: 2154792 - protein, 4 aa, Cryptosporidium hominis
NSIT

SEQ ID NO: 2154793 - protein, 10 aa, Cryptosporidium hominis
NSITNSPTTI

SEQ ID NO: 2154794 - protein, 10 aa, Cryptosporidium hominis
NSITPETSKY

SEQ ID NO: 2154795 - protein, 8 aa, Cryptosporidium hominis
NSITSERI

SEQ ID NO: 2154796 - protein, 10 aa, Cryptosporidium hominis
NSKAKDSKKV

SEQ ID NO: 2154797 - protein, 4 aa, Cryptosporidium hominis
NSKD

SEQ ID NO: 2154798 - protein, 8 aa, Cryptosporidium hominis
NSKDDAQR

SEQ ID NO: 2154799 - protein, 5 aa, Cryptosporidium hominis
NSKDR

SEQ ID NO: 2154800 - protein, 8 aa, Cryptosporidium hominis
NSKDRSDS

SEQ ID NO: 2154801 - protein, 6 aa, Cryptosporidium hominis
NSKDYI

SEQ ID NO: 2154802 - protein, 6 aa, Cryptosporidium hominis
NSKEDR

SEQ ID NO: 2154803 - protein, 5 aa, Cryptosporidium hominis
NSKEF

SEQ ID NO: 2154804 - protein, 7 aa, Cryptosporidium hominis
NSKENSH

SEQ ID NO: 2154805 - protein, 11 aa, Cryptosporidium hominis
NSKEQLDNNED

SEQ ID NO: 2154806 - protein, 8 aa, Cryptosporidium hominis
NSKFESDG

SEQ ID NO: 2154807 - protein, 15 aa, Cryptosporidium hominis
NSKGRGKGAFENKGK

SEQ ID NO: 2154808 - protein, 32 aa, Cryptosporidium hominis
NSKIKNKPSTASQATNSASSGTAPSNTSSMRE

SEQ ID NO: 2154809 - protein, 13 aa, Cryptosporidium hominis
NSKINDSKGKESL

SEQ ID NO: 2154810 - protein, 16 aa, Cryptosporidium hominis
NSKKENSQANVPREDI

SEQ ID NO: 2154811 - protein, 21 aa, Cryptosporidium hominis
NSKKGKQKVNKSVKVAKSIKK

SEQ ID NO: 2154812 - protein, 6 aa, Cryptosporidium hominis
NSKKMN

SEQ ID NO: 2154813 - protein, 10 aa, Cryptosporidium hominis
NSKKSSNLTV

SEQ ID NO: 2154814 - protein, 6 aa, Cryptosporidium hominis
NSKKVE

SEQ ID NO: 2154815 - protein, 9 aa, Cryptosporidium hominis
NSKKVTTEE

SEQ ID NO: 2154816 - protein, 5 aa, Cryptosporidium hominis
NSKLS

SEQ ID NO: 2154817 - protein, 13 aa, Cryptosporidium hominis
NSKLSESSDKFSK

SEQ ID NO: 2154818 - protein, 7 aa, Cryptosporidium hominis
NSKLSRD

SEQ ID NO: 2154819 - protein, 7 aa, Cryptosporidium hominis
NSKLSRE

SEQ ID NO: 2154820 - protein, 15 aa, Cryptosporidium hominis
NSKLTKNPTGSNDEQ

SEQ ID NO: 2154821 - protein, 4 aa, Cryptosporidium hominis
NSKN

SEQ ID NO: 2154822 - protein, 13 aa, Cryptosporidium hominis
NSKNDAGSDKSSV

SEQ ID NO: 2154823 - protein, 12 aa, Cryptosporidium hominis
NSKNETEPKSSI

SEQ ID NO: 2154824 - protein, 9 aa, Cryptosporidium hominis
NSKNGSGLQ

SEQ ID NO: 2154825 - protein, 11 aa, Cryptosporidium hominis
NSKNNKKIGVS

SEQ ID NO: 2154826 - protein, 8 aa, Cryptosporidium hominis
NSKNNTLD

SEQ ID NO: 2154827 - protein, 24 aa, Cryptosporidium hominis
NSKNSKSRPTSAINSSLDSTRGSS

SEQ ID NO: 2154828 - protein, 4 aa, Cryptosporidium hominis
NSKP

SEQ ID NO: 2154829 - protein, 6 aa, Cryptosporidium hominis
NSKPKN

SEQ ID NO: 2154830 - protein, 5 aa, Cryptosporidium hominis
NSKPL

SEQ ID NO: 2154831 - protein, 11 aa, Cryptosporidium hominis
NSKQSGNSDIL

SEQ ID NO: 2154832 - protein, 10 aa, Cryptosporidium hominis
NSKQSSSDIN

SEQ ID NO: 2154833 - protein, 14 aa, Cryptosporidium hominis
NSKQTKLSGNSNTS

SEQ ID NO: 2154834 - protein, 8 aa, Cryptosporidium hominis
NSKRASQV

SEQ ID NO: 2154835 - protein, 13 aa, Cryptosporidium hominis
NSKREKEKREEEK

SEQ ID NO: 2154836 - protein, 9 aa, Cryptosporidium hominis
NSKSDGSAL

SEQ ID NO: 2154837 - protein, 8 aa, Cryptosporidium hominis
NSKSEISL

SEQ ID NO: 2154838 - protein, 9 aa, Cryptosporidium hominis
NSKSKMAGK

SEQ ID NO: 2154839 - protein, 10 aa, Cryptosporidium hominis
NSKSSNKRIK

SEQ ID NO: 2154840 - protein, 9 aa, Cryptosporidium hominis
NSKTRSNLQ

SEQ ID NO: 2154841 - protein, 7 aa, Cryptosporidium hominis
NSKTSQF

SEQ ID NO: 2154842 - protein, 8 aa, Cryptosporidium hominis
NSKTTVSM

SEQ ID NO: 2154843 - protein, 4 aa, Cryptosporidium hominis
NSKV

SEQ ID NO: 2154844 - protein, 7 aa, Cryptosporidium hominis
NSKVKPD

SEQ ID NO: 2154845 - protein, 5 aa, Cryptosporidium hominis
NSKYF

SEQ ID NO: 2154846 - protein, 21 aa, Cryptosporidium hominis
NSLADSSQRNQTNNDTYNEPN

SEQ ID NO: 2154847 - protein, 20 aa, Cryptosporidium hominis
NSLAKGESASSNSEEHSGSI

SEQ ID NO: 2154848 - protein, 6 aa, Cryptosporidium hominis
NSLATG

SEQ ID NO: 2154849 - protein, 4 aa, Cryptosporidium hominis
NSLD

SEQ ID NO: 2154850 - protein, 4 aa, Cryptosporidium hominis
NSLE

SEQ ID NO: 2154851 - protein, 5 aa, Cryptosporidium hominis
NSLEE

SEQ ID NO: 2154852 - protein, 5 aa, Cryptosporidium hominis
NSLET

SEQ ID NO: 2154853 - protein, 13 aa, Cryptosporidium hominis
NSLGKNAETKTCD

SEQ ID NO: 2154854 - protein, 6 aa, Cryptosporidium hominis
NSLISK

SEQ ID NO: 2154855 - protein, 12 aa, Cryptosporidium hominis
NSLITKNSNINE

SEQ ID NO: 2154856 - protein, 8 aa, Cryptosporidium hominis
NSLKNNGH

SEQ ID NO: 2154857 - protein, 39 aa, Cryptosporidium hominis
NSLNERNQSFSPPSTTLTPSSTPSSTPTPSSSSVPTPNI

SEQ ID NO: 2154858 - protein, 8 aa, Cryptosporidium hominis
NSLNNDNI

SEQ ID NO: 2154859 - protein, 7 aa, Cryptosporidium hominis
NSLNNKK

SEQ ID NO: 2154860 - protein, 14 aa, Cryptosporidium hominis
NSLNSTESNPTYIK

SEQ ID NO: 2154861 - protein, 6 aa, Cryptosporidium hominis
NSLQPD

SEQ ID NO: 2154862 - protein, 6 aa, Cryptosporidium hominis
NSLRDG

SEQ ID NO: 2154863 - protein, 40 aa, Cryptosporidium hominis
NSLSNNVSNNTEMTISSKSNNNFNSESPSTKSTMKSEPIN

SEQ ID NO: 2154864 - protein, 7 aa, Cryptosporidium hominis
NSLSNSS

SEQ ID NO: 2154865 - protein, 8 aa, Cryptosporidium hominis
NSLSPKSE

SEQ ID NO: 2154866 - protein, 11 aa, Cryptosporidium hominis
NSLSPNKQKEV

SEQ ID NO: 2154867 - protein, 5 aa, Cryptosporidium hominis
NSLSQ

SEQ ID NO: 2154868 - protein, 6 aa, Cryptosporidium hominis
NSLSSE

SEQ ID NO: 2154869 - protein, 10 aa, Cryptosporidium hominis
NSLSSKNEQE

SEQ ID NO: 2154870 - protein, 26 aa, Cryptosporidium hominis
NSMAASVPSSNSVSSSNSVQSNSLSA

SEQ ID NO: 2154871 - protein, 10 aa, Cryptosporidium hominis
NSMNNAKNEI

SEQ ID NO: 2154872 - protein, 5 aa, Cryptosporidium hominis
NSNAR

SEQ ID NO: 2154873 - protein, 21 aa, Cryptosporidium hominis
NSNATTSSLPSSLSDNNNINN

SEQ ID NO: 2154874 - protein, 33 aa, Cryptosporidium hominis
NSNCSEDESQNFSEGNLTKSSLNTDTELKDGET

SEQ ID NO: 2154875 - protein, 10 aa, Cryptosporidium hominis
NSNDENSNAL

SEQ ID NO: 2154876 - protein, 8 aa, Cryptosporidium hominis
NSNDKNSH

SEQ ID NO: 2154877 - protein, 18 aa, Cryptosporidium hominis
NSNDSSSDEVDKSDGGSL

SEQ ID NO: 2154878 - protein, 17 aa, Cryptosporidium hominis
NSNEASDPDNKSIGKKT

SEQ ID NO: 2154879 - protein, 23 aa, Cryptosporidium hominis
NSNEMKKRSRSRHSVRRRNTREM

SEQ ID NO: 2154880 - protein, 9 aa, Cryptosporidium hominis
NSNENISNN

SEQ ID NO: 2154881 - protein, 9 aa, Cryptosporidium hominis
NSNERASPI

SEQ ID NO: 2154882 - protein, 32 aa, Cryptosporidium hominis
NSNFNGEYNNYSSHQDIPQTPTIGGGRSEHGS

SEQ ID NO: 2154883 - protein, 18 aa, Cryptosporidium hominis
NSNGNGNGNGNGIGNNGY

SEQ ID NO: 2154884 - protein, 12 aa, Cryptosporidium hominis
NSNIPSNIEQKV

SEQ ID NO: 2154885 - protein, 8 aa, Cryptosporidium hominis
NSNISDSN

SEQ ID NO: 2154886 - protein, 6 aa, Cryptosporidium hominis
NSNKEC

SEQ ID NO: 2154887 - protein, 19 aa, Cryptosporidium hominis
NSNKGIQRNGGGVNDNDDE

SEQ ID NO: 2154888 - protein, 14 aa, Cryptosporidium hominis
NSNKQNKRTTQIGQ

SEQ ID NO: 2154889 - protein, 29 aa, Cryptosporidium hominis
NSNKRSQDKSDNVVSGNGNPERENNNRPK

SEQ ID NO: 2154890 - protein, 10 aa, Cryptosporidium hominis
NSNKYRKTEN

SEQ ID NO: 2154891 - protein, 6 aa, Cryptosporidium hominis
NSNLSL

SEQ ID NO: 2154892 - protein, 18 aa, Cryptosporidium hominis
NSNNADESNTRDPEKNDN

SEQ ID NO: 2154893 - protein, 51 aa, Cryptosporidium hominis
NSNNENIQANSTRSSISGDKQELPKKGSETNPSNPEETNHNNSNVSVSRNS

SEQ ID NO: 2154894 - protein, 24 aa, Cryptosporidium hominis
NSNNGENTPSTITSDDAENSPSIL

SEQ ID NO: 2154895 - protein, 6 aa, Cryptosporidium hominis
NSNNIA

SEQ ID NO: 2154896 - protein, 14 aa, Cryptosporidium hominis
NSNNKLAESLSNED

SEQ ID NO: 2154897 - protein, 30 aa, Cryptosporidium hominis
NSNNNNNNNNNNNNNNNNNNNNNNNINNNN

SEQ ID NO: 2154898 - protein, 7 aa, Cryptosporidium hominis
NSNNNNS

SEQ ID NO: 2154899 - protein, 10 aa, Cryptosporidium hominis
NSNNQKAQDL

SEQ ID NO: 2154900 - protein, 11 aa, Cryptosporidium hominis
NSNNSSTEDKE

SEQ ID NO: 2154901 - protein, 11 aa, Cryptosporidium hominis
NSNNTKSSGRL

SEQ ID NO: 2154902 - protein, 10 aa, Cryptosporidium hominis
NSNPDSLTTS

SEQ ID NO: 2154903 - protein, 6 aa, Cryptosporidium hominis
NSNPKI

SEQ ID NO: 2154904 - protein, 6 aa, Cryptosporidium hominis
NSNPQI

SEQ ID NO: 2154905 - protein, 8 aa, Cryptosporidium hominis
NSNRSIDK

SEQ ID NO: 2154906 - protein, 15 aa, Cryptosporidium hominis
NSNRVGNEDQLENSS

SEQ ID NO: 2154907 - protein, 4 aa, Cryptosporidium hominis
NSNS

SEQ ID NO: 2154908 - protein, 9 aa, Cryptosporidium hominis
NSNSEKGYK

SEQ ID NO: 2154909 - protein, 5 aa, Cryptosporidium hominis
NSNSF

SEQ ID NO: 2154910 - protein, 9 aa, Cryptosporidium hominis
NSNSFPDEH

SEQ ID NO: 2154911 - protein, 8 aa, Cryptosporidium hominis
NSNSGNNM

SEQ ID NO: 2154912 - protein, 5 aa, Cryptosporidium hominis
NSNSI

SEQ ID NO: 2154913 - protein, 18 aa, Cryptosporidium hominis
NSNSIESAHSTTSSSRIS

SEQ ID NO: 2154914 - protein, 8 aa, Cryptosporidium hominis
NSNSIPEN

SEQ ID NO: 2154915 - protein, 18 aa, Cryptosporidium hominis
NSNSIRNYKDNHGSFDSR

SEQ ID NO: 2154916 - protein, 12 aa, Cryptosporidium hominis
NSNSNFDNATHI

SEQ ID NO: 2154917 - protein, 25 aa, Cryptosporidium hominis
NSNSNNGSSSTGVTGVSNSSGTAPV

SEQ ID NO: 2154918 - protein, 6 aa, Cryptosporidium hominis
NSNSSE

SEQ ID NO: 2154919 - protein, 8 aa, Cryptosporidium hominis
NSNSSKEI

SEQ ID NO: 2154920 - protein, 9 aa, Cryptosporidium hominis
NSNSSQKFR

SEQ ID NO: 2154921 - protein, 8 aa, Cryptosporidium hominis
NSNSSQKH

SEQ ID NO: 2154922 - protein, 8 aa, Cryptosporidium hominis
NSNSSQSY

SEQ ID NO: 2154923 - protein, 23 aa, Cryptosporidium hominis
NSNSSVTDNNSNDNNNNNNNNIR

SEQ ID NO: 2154924 - protein, 10 aa, Cryptosporidium hominis
NSNSTSTNLF

SEQ ID NO: 2154925 - protein, 9 aa, Cryptosporidium hominis
NSNSWSSSN

SEQ ID NO: 2154926 - protein, 25 aa, Cryptosporidium hominis
NSNTENGMIQGTDPDITGISSVVKE

SEQ ID NO: 2154927 - protein, 7 aa, Cryptosporidium hominis
NSNTSRA

SEQ ID NO: 2154928 - protein, 8 aa, Cryptosporidium hominis
NSNYQNKI

SEQ ID NO: 2154929 - protein, 4 aa, Cryptosporidium hominis
NSPD

SEQ ID NO: 2154930 - protein, 8 aa, Cryptosporidium hominis
NSPDGHSD

SEQ ID NO: 2154931 - protein, 9 aa, Cryptosporidium hominis
NSPDGISKD

SEQ ID NO: 2154932 - protein, 10 aa, Cryptosporidium hominis
NSPDTPLSSN

SEQ ID NO: 2154933 - protein, 11 aa, Cryptosporidium hominis
NSPEDPNENTC

SEQ ID NO: 2154934 - protein, 7 aa, Cryptosporidium hominis
NSPGNVN

SEQ ID NO: 2154935 - protein, 4 aa, Cryptosporidium hominis
NSPI

SEQ ID NO: 2154936 - protein, 7 aa, Cryptosporidium hominis
NSPIQTI

SEQ ID NO: 2154937 - protein, 19 aa, Cryptosporidium hominis
NSPISNTGESNNATTETRN

SEQ ID NO: 2154938 - protein, 10 aa, Cryptosporidium hominis
NSPKEADSNY

SEQ ID NO: 2154939 - protein, 5 aa, Cryptosporidium hominis
NSPLL

SEQ ID NO: 2154940 - protein, 5 aa, Cryptosporidium hominis
NSPLT

SEQ ID NO: 2154941 - protein, 9 aa, Cryptosporidium hominis
NSPNTRGTL

SEQ ID NO: 2154942 - protein, 5 aa, Cryptosporidium hominis
NSPRY

SEQ ID NO: 2154943 - protein, 7 aa, Cryptosporidium hominis
NSPRYYN

SEQ ID NO: 2154944 - protein, 4 aa, Cryptosporidium hominis
NSPS

SEQ ID NO: 2154945 - protein, 38 aa, Cryptosporidium hominis
NSPSLSPQPLPSSLSPPPVTSSSLHPSLSSSPPPISRQ

SEQ ID NO: 2154946 - protein, 7 aa, Cryptosporidium hominis
NSPTVAY

SEQ ID NO: 2154947 - protein, 4 aa, Cryptosporidium hominis
NSPW

SEQ ID NO: 2154948 - protein, 9 aa, Cryptosporidium hominis
NSQAKNESQ

SEQ ID NO: 2154949 - protein, 10 aa, Cryptosporidium hominis
NSQARSTGNL

SEQ ID NO: 2154950 - protein, 8 aa, Cryptosporidium hominis
NSQAVSGV

SEQ ID NO: 2154951 - protein, 4 aa, Cryptosporidium hominis
NSQD

SEQ ID NO: 2154952 - protein, 4 aa, Cryptosporidium hominis
NSQE

SEQ ID NO: 2154953 - protein, 6 aa, Cryptosporidium hominis
NSQENL

SEQ ID NO: 2154954 - protein, 6 aa, Cryptosporidium hominis
NSQENN

SEQ ID NO: 2154955 - protein, 29 aa, Cryptosporidium hominis
NSQGYKPNETFQSTNYSDNTTVSESQLSS

SEQ ID NO: 2154956 - protein, 4 aa, Cryptosporidium hominis
NSQH

SEQ ID NO: 2154957 - protein, 6 aa, Cryptosporidium hominis
NSQIPN

SEQ ID NO: 2154958 - protein, 8 aa, Cryptosporidium hominis
NSQKEESL

SEQ ID NO: 2154959 - protein, 27 aa, Cryptosporidium hominis
NSQKMDSSETLTRPASTSTLKKSDSGC

SEQ ID NO: 2154960 - protein, 4 aa, Cryptosporidium hominis
NSQL

SEQ ID NO: 2154961 - protein, 7 aa, Cryptosporidium hominis
NSQLKTK

SEQ ID NO: 2154962 - protein, 6 aa, Cryptosporidium hominis
NSQMGS

SEQ ID NO: 2154963 - protein, 6 aa, Cryptosporidium hominis
NSQNCK

SEQ ID NO: 2154964 - protein, 13 aa, Cryptosporidium hominis
NSQNNASPHLIFK

SEQ ID NO: 2154965 - protein, 8 aa, Cryptosporidium hominis
NSQNPEHL

SEQ ID NO: 2154966 - protein, 5 aa, Cryptosporidium hominis
NSQNY

SEQ ID NO: 2154967 - protein, 12 aa, Cryptosporidium hominis
NSQSGISNSSNL

SEQ ID NO: 2154968 - protein, 6 aa, Cryptosporidium hominis
NSQSIE

SEQ ID NO: 2154969 - protein, 14 aa, Cryptosporidium hominis
NSQSSEEVAPKSSI

SEQ ID NO: 2154970 - protein, 9 aa, Cryptosporidium hominis
NSQSSQTNI

SEQ ID NO: 2154971 - protein, 11 aa, Cryptosporidium hominis
NSQTDNNDQEK

SEQ ID NO: 2154972 - protein, 13 aa, Cryptosporidium hominis
NSQTLRNNNSSRF

SEQ ID NO: 2154973 - protein, 17 aa, Cryptosporidium hominis
NSQVNQSSSRSRNPKCD

SEQ ID NO: 2154974 - protein, 4 aa, Cryptosporidium hominis
NSRA

SEQ ID NO: 2154975 - protein, 8 aa, Cryptosporidium hominis
NSRDDALQ

SEQ ID NO: 2154976 - protein, 6 aa, Cryptosporidium hominis
NSRDDG

SEQ ID NO: 2154977 - protein, 5 aa, Cryptosporidium hominis
NSRDE

SEQ ID NO: 2154978 - protein, 8 aa, Cryptosporidium hominis
NSRDKKER

SEQ ID NO: 2154979 - protein, 5 aa, Cryptosporidium hominis
NSRDS

SEQ ID NO: 2154980 - protein, 5 aa, Cryptosporidium hominis
NSREI

SEQ ID NO: 2154981 - protein, 11 aa, Cryptosporidium hominis
NSREKKTLEND

SEQ ID NO: 2154982 - protein, 6 aa, Cryptosporidium hominis
NSRENR

SEQ ID NO: 2154983 - protein, 10 aa, Cryptosporidium hominis
NSRGRKRSNE

SEQ ID NO: 2154984 - protein, 8 aa, Cryptosporidium hominis
NSRIESDN

SEQ ID NO: 2154985 - protein, 34 aa, Cryptosporidium hominis
NSRKANGESISRRSSQIRSNPAAKIVPSSAPSRR

SEQ ID NO: 2154986 - protein, 11 aa, Cryptosporidium hominis
NSRKQSETFSN

SEQ ID NO: 2154987 - protein, 6 aa, Cryptosporidium hominis
NSRKYP

SEQ ID NO: 2154988 - protein, 85 aa, Cryptosporidium hominis
NSRLEKKSSSSCSKSKSRSRSRSKSRSRSKPRSKSRSRSKSHSRSRSKSKTRSKSYSSRSSISSPSSSFYSENDSNSDSSSISRT

SEQ ID NO: 2154989 - protein, 4 aa, Cryptosporidium hominis
NSRP

SEQ ID NO: 2154990 - protein, 38 aa, Cryptosporidium hominis
NSRRSFADDDDDDDEDFEDGDLRADGENTDNDDGEELP

SEQ ID NO: 2154991 - protein, 7 aa, Cryptosporidium hominis
NSRSNSS

SEQ ID NO: 2154992 - protein, 5 aa, Cryptosporidium hominis
NSRSS

SEQ ID NO: 2154993 - protein, 9 aa, Cryptosporidium hominis
NSRSSEGSY

SEQ ID NO: 2154994 - protein, 44 aa, Cryptosporidium hominis
NSRTGYYSRSSHRGNSFRHSTRSRYDYPPPSHSRGDQYNRHNDD

SEQ ID NO: 2154995 - protein, 18 aa, Cryptosporidium hominis
NSRTNNDLNSESNISPEE

SEQ ID NO: 2154996 - protein, 4 aa, Cryptosporidium hominis
NSSA

SEQ ID NO: 2154997 - protein, 4 aa, Cryptosporidium hominis
NSSD

SEQ ID NO: 2154998 - protein, 12 aa, Cryptosporidium hominis
NSSDDLENSTGY

SEQ ID NO: 2154999 - protein, 17 aa, Cryptosporidium hominis
NSSDKSSLEAYSSNNSN

SEQ ID NO: 2155000 - protein, 13 aa, Cryptosporidium hominis
NSSDSLKQQRVQD

SEQ ID NO: 2155001 - protein, 5 aa, Cryptosporidium hominis
NSSDV

SEQ ID NO: 2155002 - protein, 6 aa, Cryptosporidium hominis
NSSEIN

SEQ ID NO: 2155003 - protein, 9 aa, Cryptosporidium hominis
NSSELSSNV

SEQ ID NO: 2155004 - protein, 8 aa, Cryptosporidium hominis
NSSENEFD

SEQ ID NO: 2155005 - protein, 7 aa, Cryptosporidium hominis
NSSEQWN

SEQ ID NO: 2155006 - protein, 5 aa, Cryptosporidium hominis
NSSFE

SEQ ID NO: 2155007 - protein, 6 aa, Cryptosporidium hominis
NSSFNS

SEQ ID NO: 2155008 - protein, 8 aa, Cryptosporidium hominis
NSSGAGGL

SEQ ID NO: 2155009 - protein, 6 aa, Cryptosporidium hominis
NSSGQL

SEQ ID NO: 2155010 - protein, 8 aa, Cryptosporidium hominis
NSSGSGLE

SEQ ID NO: 2155011 - protein, 26 aa, Cryptosporidium hominis
NSSGSKDKEEKFDSKVGEPTEGGSTP

SEQ ID NO: 2155012 - protein, 5 aa, Cryptosporidium hominis
NSSGY

SEQ ID NO: 2155013 - protein, 4 aa, Cryptosporidium hominis
NSSI

SEQ ID NO: 2155014 - protein, 24 aa, Cryptosporidium hominis
NSSIEANKTLRDEIDKKKKEISEL

SEQ ID NO: 2155015 - protein, 8 aa, Cryptosporidium hominis
NSSIKSSE

SEQ ID NO: 2155016 - protein, 6 aa, Cryptosporidium hominis
NSSINS

SEQ ID NO: 2155017 - protein, 7 aa, Cryptosporidium hominis
NSSISNI

SEQ ID NO: 2155018 - protein, 4 aa, Cryptosporidium hominis
NSSK

SEQ ID NO: 2155019 - protein, 17 aa, Cryptosporidium hominis
NSSKGKIKANSKRTSSL

SEQ ID NO: 2155020 - protein, 22 aa, Cryptosporidium hominis
NSSKKDESSENQKKISMSSTDI

SEQ ID NO: 2155021 - protein, 23 aa, Cryptosporidium hominis
NSSKKINENNNDQTSCSRSFGGI

SEQ ID NO: 2155022 - protein, 14 aa, Cryptosporidium hominis
NSSKKQVEEKQTLN

SEQ ID NO: 2155023 - protein, 9 aa, Cryptosporidium hominis
NSSKQTYEN

SEQ ID NO: 2155024 - protein, 7 aa, Cryptosporidium hominis
NSSKYSD

SEQ ID NO: 2155025 - protein, 7 aa, Cryptosporidium hominis
NSSLDTV

SEQ ID NO: 2155026 - protein, 13 aa, Cryptosporidium hominis
NSSLESKDEENLE

SEQ ID NO: 2155027 - protein, 8 aa, Cryptosporidium hominis
NSSLGGSM

SEQ ID NO: 2155028 - protein, 12 aa, Cryptosporidium hominis
NSSLNNSTPKGM

SEQ ID NO: 2155029 - protein, 5 aa, Cryptosporidium hominis
NSSLS

SEQ ID NO: 2155030 - protein, 9 aa, Cryptosporidium hominis
NSSLSSDNL

SEQ ID NO: 2155031 - protein, 15 aa, Cryptosporidium hominis
NSSMGTNDKEYFPIE

SEQ ID NO: 2155032 - protein, 8 aa, Cryptosporidium hominis
NSSNANAT

SEQ ID NO: 2155033 - protein, 22 aa, Cryptosporidium hominis
NSSNESDNNLGSLGKAGGGTGI

SEQ ID NO: 2155034 - protein, 13 aa, Cryptosporidium hominis
NSSNIQSDQGYNQ

SEQ ID NO: 2155035 - protein, 6 aa, Cryptosporidium hominis
NSSNKG

SEQ ID NO: 2155036 - protein, 9 aa, Cryptosporidium hominis
NSSNKGTLK

SEQ ID NO: 2155037 - protein, 10 aa, Cryptosporidium hominis
NSSNKTNSDE

SEQ ID NO: 2155038 - protein, 5 aa, Cryptosporidium hominis
NSSNS

SEQ ID NO: 2155039 - protein, 8 aa, Cryptosporidium hominis
NSSNSKEV

SEQ ID NO: 2155040 - protein, 10 aa, Cryptosporidium hominis
NSSNYSYSTK

SEQ ID NO: 2155041 - protein, 4 aa, Cryptosporidium hominis
NSSP

SEQ ID NO: 2155042 - protein, 6 aa, Cryptosporidium hominis
NSSPGC

SEQ ID NO: 2155043 - protein, 7 aa, Cryptosporidium hominis
NSSPHPF

SEQ ID NO: 2155044 - protein, 17 aa, Cryptosporidium hominis
NSSQENLTKPQSIDQNN

SEQ ID NO: 2155045 - protein, 9 aa, Cryptosporidium hominis
NSSQSNSSK

SEQ ID NO: 2155046 - protein, 10 aa, Cryptosporidium hominis
NSSRTEQKLN

SEQ ID NO: 2155047 - protein, 12 aa, Cryptosporidium hominis
NSSSEEKTNQLS

SEQ ID NO: 2155048 - protein, 12 aa, Cryptosporidium hominis
NSSSEPSKISEL

SEQ ID NO: 2155049 - protein, 6 aa, Cryptosporidium hominis
NSSSES

SEQ ID NO: 2155050 - protein, 9 aa, Cryptosporidium hominis
NSSSESKNV

SEQ ID NO: 2155051 - protein, 9 aa, Cryptosporidium hominis
NSSSGNQWN

SEQ ID NO: 2155052 - protein, 10 aa, Cryptosporidium hominis
NSSSIESLAD

SEQ ID NO: 2155053 - protein, 16 aa, Cryptosporidium hominis
NSSSKEDTNFDSSLNN

SEQ ID NO: 2155054 - protein, 8 aa, Cryptosporidium hominis
NSSSKEGL

SEQ ID NO: 2155055 - protein, 11 aa, Cryptosporidium hominis
NSSSKYPKEEY

SEQ ID NO: 2155056 - protein, 5 aa, Cryptosporidium hominis
NSSSN

SEQ ID NO: 2155057 - protein, 22 aa, Cryptosporidium hominis
NSSSNNDNNPPSVSGRGKRSNV

SEQ ID NO: 2155058 - protein, 22 aa, Cryptosporidium hominis
NSSSNQMNQYSSSTSNQQDNYY

SEQ ID NO: 2155059 - protein, 12 aa, Cryptosporidium hominis
NSSSSPNYIQTQ

SEQ ID NO: 2155060 - protein, 9 aa, Cryptosporidium hominis
NSSSSYYGT

SEQ ID NO: 2155061 - protein, 6 aa, Cryptosporidium hominis
NSSSTI

SEQ ID NO: 2155062 - protein, 12 aa, Cryptosporidium hominis
NSSSTSNDNFNT

SEQ ID NO: 2155063 - protein, 16 aa, Cryptosporidium hominis
NSSSWTKNEKSDGPNE

SEQ ID NO: 2155064 - protein, 15 aa, Cryptosporidium hominis
NSSVSGENGRHQKSY

SEQ ID NO: 2155065 - protein, 16 aa, Cryptosporidium hominis
NSSVSSSSTPLSCQSN

SEQ ID NO: 2155066 - protein, 7 aa, Cryptosporidium hominis
NSSYNEL

SEQ ID NO: 2155067 - protein, 6 aa, Cryptosporidium hominis
NSTAIN

SEQ ID NO: 2155068 - protein, 7 aa, Cryptosporidium hominis
NSTCAPI

SEQ ID NO: 2155069 - protein, 10 aa, Cryptosporidium hominis
NSTCGSQQSI

SEQ ID NO: 2155070 - protein, 8 aa, Cryptosporidium hominis
NSTDAQRT

SEQ ID NO: 2155071 - protein, 6 aa, Cryptosporidium hominis
NSTEEY

SEQ ID NO: 2155072 - protein, 7 aa, Cryptosporidium hominis
NSTFTSE

SEQ ID NO: 2155073 - protein, 4 aa, Cryptosporidium hominis
NSTG

SEQ ID NO: 2155074 - protein, 5 aa, Cryptosporidium hominis
NSTGF

SEQ ID NO: 2155075 - protein, 13 aa, Cryptosporidium hominis
NSTIKDSNTGENN

SEQ ID NO: 2155076 - protein, 5 aa, Cryptosporidium hominis
NSTKL

SEQ ID NO: 2155077 - protein, 9 aa, Cryptosporidium hominis
NSTKQNKRK

SEQ ID NO: 2155078 - protein, 12 aa, Cryptosporidium hominis
NSTLAENSNRDK

SEQ ID NO: 2155079 - protein, 14 aa, Cryptosporidium hominis
NSTLKADNKQETKP

SEQ ID NO: 2155080 - protein, 6 aa, Cryptosporidium hominis
NSTLQE

SEQ ID NO: 2155081 - protein, 34 aa, Cryptosporidium hominis
NSTNATTAITTNTTTATTGPNSSTTTASTTTVSS

SEQ ID NO: 2155082 - protein, 17 aa, Cryptosporidium hominis
NSTNPSNNSKNNSSEDA

SEQ ID NO: 2155083 - protein, 7 aa, Cryptosporidium hominis
NSTPDSA

SEQ ID NO: 2155084 - protein, 6 aa, Cryptosporidium hominis
NSTPEE

SEQ ID NO: 2155085 - protein, 12 aa, Cryptosporidium hominis
NSTPHSTSSPAG

SEQ ID NO: 2155086 - protein, 41 aa, Cryptosporidium hominis
NSTPIRNGNLSSKDVNLETPNKSSSRSIGSAGGSSSVRRSS

SEQ ID NO: 2155087 - protein, 22 aa, Cryptosporidium hominis
NSTPKTVRQDISSPKVQNSTTF

SEQ ID NO: 2155088 - protein, 14 aa, Cryptosporidium hominis
NSTQSQVNASNKVT

SEQ ID NO: 2155089 - protein, 6 aa, Cryptosporidium hominis
NSTRLN

SEQ ID NO: 2155090 - protein, 7 aa, Cryptosporidium hominis
NSTSGCE

SEQ ID NO: 2155091 - protein, 9 aa, Cryptosporidium hominis
NSTSNQCSS

SEQ ID NO: 2155092 - protein, 6 aa, Cryptosporidium hominis
NSTSPS

SEQ ID NO: 2155093 - protein, 11 aa, Cryptosporidium hominis
NSTSSPSSSFP

SEQ ID NO: 2155094 - protein, 10 aa, Cryptosporidium hominis
NSTSVKKKSF

SEQ ID NO: 2155095 - protein, 5 aa, Cryptosporidium hominis
NSTSY

SEQ ID NO: 2155096 - protein, 21 aa, Cryptosporidium hominis
NSTTSQFEKNEDHPNPDEINP

SEQ ID NO: 2155097 - protein, 11 aa, Cryptosporidium hominis
NSVAGGNLPPP

SEQ ID NO: 2155098 - protein, 5 aa, Cryptosporidium hominis
NSVAK

SEQ ID NO: 2155099 - protein, 6 aa, Cryptosporidium hominis
NSVEDD

SEQ ID NO: 2155100 - protein, 10 aa, Cryptosporidium hominis
NSVESPPSLN

SEQ ID NO: 2155101 - protein, 10 aa, Cryptosporidium hominis
NSVGNKPNIQ

SEQ ID NO: 2155102 - protein, 15 aa, Cryptosporidium hominis
NSVHSGANGAMRTRG

SEQ ID NO: 2155103 - protein, 9 aa, Cryptosporidium hominis
NSVKCEKES

SEQ ID NO: 2155104 - protein, 10 aa, Cryptosporidium hominis
NSVKEATSSF

SEQ ID NO: 2155105 - protein, 16 aa, Cryptosporidium hominis
NSVKNNIKSKTNTKEI

SEQ ID NO: 2155106 - protein, 6 aa, Cryptosporidium hominis
NSVPNS

SEQ ID NO: 2155107 - protein, 6 aa, Cryptosporidium hominis
NSVSEN

SEQ ID NO: 2155108 - protein, 43 aa, Cryptosporidium hominis
NSVSNKLEKKTTENQGTSSPNQTRCATRNTTSEYPSNVASNGA

SEQ ID NO: 2155109 - protein, 22 aa, Cryptosporidium hominis
NSVSSKLTSPNLNTGSNISPSS

SEQ ID NO: 2155110 - protein, 8 aa, Cryptosporidium hominis
NSVTDDDS

SEQ ID NO: 2155111 - protein, 6 aa, Cryptosporidium hominis
NSWKPI

SEQ ID NO: 2155112 - protein, 9 aa, Cryptosporidium hominis
NSYCSNNRK

SEQ ID NO: 2155113 - protein, 9 aa, Cryptosporidium hominis
NSYESDENI

SEQ ID NO: 2155114 - protein, 6 aa, Cryptosporidium hominis
NSYGTN

SEQ ID NO: 2155115 - protein, 11 aa, Cryptosporidium hominis
NSYKSASDTAI

SEQ ID NO: 2155116 - protein, 10 aa, Cryptosporidium hominis
NSYNNSPQTV

SEQ ID NO: 2155117 - protein, 9 aa, Cryptosporidium hominis
NSYNPKTGL

SEQ ID NO: 2155118 - protein, 7 aa, Cryptosporidium hominis
NSYPSKT

SEQ ID NO: 2155119 - protein, 7 aa, Cryptosporidium hominis
NSYPSPL

SEQ ID NO: 2155120 - protein, 10 aa, Cryptosporidium hominis
NSYSRSLNSN

SEQ ID NO: 2155121 - protein, 14 aa, Cryptosporidium hominis
NTAQNDSKESDQNV

SEQ ID NO: 2155122 - protein, 7 aa, Cryptosporidium hominis
NTASASP

SEQ ID NO: 2155123 - protein, 13 aa, Cryptosporidium hominis
NTASQQTNKSDVK

SEQ ID NO: 2155124 - protein, 10 aa, Cryptosporidium hominis
NTCTKRTKID

SEQ ID NO: 2155125 - protein, 18 aa, Cryptosporidium hominis
NTDEDSSTALGAHGEPYN

SEQ ID NO: 2155126 - protein, 10 aa, Cryptosporidium hominis
NTDESQTENS

SEQ ID NO: 2155127 - protein, 11 aa, Cryptosporidium hominis
NTDHSKNGGNS

SEQ ID NO: 2155128 - protein, 5 aa, Cryptosporidium hominis
NTDIT

SEQ ID NO: 2155129 - protein, 9 aa, Cryptosporidium hominis
NTDNATNTI

SEQ ID NO: 2155130 - protein, 6 aa, Cryptosporidium hominis
NTDNSA

SEQ ID NO: 2155131 - protein, 26 aa, Cryptosporidium hominis
NTDNSTPLDEKGPNTITETNNQPNIE

SEQ ID NO: 2155132 - protein, 7 aa, Cryptosporidium hominis
NTDPRAK

SEQ ID NO: 2155133 - protein, 10 aa, Cryptosporidium hominis
NTDSGSKNLQ

SEQ ID NO: 2155134 - protein, 8 aa, Cryptosporidium hominis
NTDSIEEQ

SEQ ID NO: 2155135 - protein, 41 aa, Cryptosporidium hominis
NTDVSSSSSSNTISNSSMSKFGETNKEEGEKSGSKSQSGSK

SEQ ID NO: 2155136 - protein, 5 aa, Cryptosporidium hominis
NTEAP

SEQ ID NO: 2155137 - protein, 4 aa, Cryptosporidium hominis
NTED

SEQ ID NO: 2155138 - protein, 13 aa, Cryptosporidium hominis
NTEDKLLPSELER

SEQ ID NO: 2155139 - protein, 9 aa, Cryptosporidium hominis
NTEEGEAEV

SEQ ID NO: 2155140 - protein, 5 aa, Cryptosporidium hominis
NTEFS

SEQ ID NO: 2155141 - protein, 10 aa, Cryptosporidium hominis
NTEINEGEPL

SEQ ID NO: 2155142 - protein, 10 aa, Cryptosporidium hominis
NTEKGEAKGF

SEQ ID NO: 2155143 - protein, 5 aa, Cryptosporidium hominis
NTEKS

SEQ ID NO: 2155144 - protein, 5 aa, Cryptosporidium hominis
NTEKW

SEQ ID NO: 2155145 - protein, 7 aa, Cryptosporidium hominis
NTELSSP

SEQ ID NO: 2155146 - protein, 7 aa, Cryptosporidium hominis
NTENDAL

SEQ ID NO: 2155147 - protein, 6 aa, Cryptosporidium hominis
NTENEN

SEQ ID NO: 2155148 - protein, 8 aa, Cryptosporidium hominis
NTENGEPL

SEQ ID NO: 2155149 - protein, 9 aa, Cryptosporidium hominis
NTENTDNLK

SEQ ID NO: 2155150 - protein, 4 aa, Cryptosporidium hominis
NTEP

SEQ ID NO: 2155151 - protein, 6 aa, Cryptosporidium hominis
NTEPYD

SEQ ID NO: 2155152 - protein, 18 aa, Cryptosporidium hominis
NTESEGSNYNISGTPARN

SEQ ID NO: 2155153 - protein, 12 aa, Cryptosporidium hominis
NTESESAPNERF

SEQ ID NO: 2155154 - protein, 7 aa, Cryptosporidium hominis
NTESGLY

SEQ ID NO: 2155155 - protein, 12 aa, Cryptosporidium hominis
NTESSKAGQHLS

SEQ ID NO: 2155156 - protein, 7 aa, Cryptosporidium hominis
NTESTNP

SEQ ID NO: 2155157 - protein, 7 aa, Cryptosporidium hominis
NTETDEF

SEQ ID NO: 2155158 - protein, 6 aa, Cryptosporidium hominis
NTETPD

SEQ ID NO: 2155159 - protein, 25 aa, Cryptosporidium hominis
NTEVNETSKNIQENSQNNSNTNIQI

SEQ ID NO: 2155160 - protein, 15 aa, Cryptosporidium hominis
NTEVSKNKKWKSYGR

SEQ ID NO: 2155161 - protein, 7 aa, Cryptosporidium hominis
NTEYDPS

SEQ ID NO: 2155162 - protein, 6 aa, Cryptosporidium hominis
NTEYKE

SEQ ID NO: 2155163 - protein, 4 aa, Cryptosporidium hominis
NTFD

SEQ ID NO: 2155164 - protein, 9 aa, Cryptosporidium hominis
NTFDKTKND

SEQ ID NO: 2155165 - protein, 7 aa, Cryptosporidium hominis
NTFGDGK

SEQ ID NO: 2155166 - protein, 8 aa, Cryptosporidium hominis
NTFPGSNS

SEQ ID NO: 2155167 - protein, 23 aa, Cryptosporidium hominis
NTGCNSPSLTSSSYSFSSSSAEP

SEQ ID NO: 2155168 - protein, 11 aa, Cryptosporidium hominis
NTGDDNKPRFE

SEQ ID NO: 2155169 - protein, 14 aa, Cryptosporidium hominis
NTGEELKSPSVPRA

SEQ ID NO: 2155170 - protein, 6 aa, Cryptosporidium hominis
NTGENV

SEQ ID NO: 2155171 - protein, 15 aa, Cryptosporidium hominis
NTGGNLENTCKKEAG

SEQ ID NO: 2155172 - protein, 5 aa, Cryptosporidium hominis
NTGHR

SEQ ID NO: 2155173 - protein, 8 aa, Cryptosporidium hominis
NTGINTPN

SEQ ID NO: 2155174 - protein, 5 aa, Cryptosporidium hominis
NTGIY

SEQ ID NO: 2155175 - protein, 4 aa, Cryptosporidium hominis
NTGK

SEQ ID NO: 2155176 - protein, 7 aa, Cryptosporidium hominis
NTGKEYI

SEQ ID NO: 2155177 - protein, 6 aa, Cryptosporidium hominis
NTGKVG

SEQ ID NO: 2155178 - protein, 6 aa, Cryptosporidium hominis
NTGNNT

SEQ ID NO: 2155179 - protein, 5 aa, Cryptosporidium hominis
NTGQY

SEQ ID NO: 2155180 - protein, 8 aa, Cryptosporidium hominis
NTGSELNN

SEQ ID NO: 2155181 - protein, 7 aa, Cryptosporidium hominis
NTGTAIS

SEQ ID NO: 2155182 - protein, 8 aa, Cryptosporidium hominis
NTGTKYKQ

SEQ ID NO: 2155183 - protein, 7 aa, Cryptosporidium hominis
NTHLNQP

SEQ ID NO: 2155184 - protein, 43 aa, Cryptosporidium hominis
NTHSSSSSSNVHSQQYQYSKQQQQHTQYQKHQQHQQQQQQQQQ

SEQ ID NO: 2155185 - protein, 5 aa, Cryptosporidium hominis
NTIDS

SEQ ID NO: 2155186 - protein, 9 aa, Cryptosporidium hominis
NTINPSNNN

SEQ ID NO: 2155187 - protein, 23 aa, Cryptosporidium hominis
NTIQNSSVSRLRNKSNSLEGHGD

SEQ ID NO: 2155188 - protein, 13 aa, Cryptosporidium hominis
NTISPRKSIKEYA

SEQ ID NO: 2155189 - protein, 31 aa, Cryptosporidium hominis
NTITTTTTAVPNANSTSNKDSHIDHTNNSSL

SEQ ID NO: 2155190 - protein, 14 aa, Cryptosporidium hominis
NTKAHNTNTSVTHD

SEQ ID NO: 2155191 - protein, 4 aa, Cryptosporidium hominis
NTKD

SEQ ID NO: 2155192 - protein, 8 aa, Cryptosporidium hominis
NTKDENTY

SEQ ID NO: 2155193 - protein, 7 aa, Cryptosporidium hominis
NTKKAGL

SEQ ID NO: 2155194 - protein, 9 aa, Cryptosporidium hominis
NTKKKPPKY

SEQ ID NO: 2155195 - protein, 8 aa, Cryptosporidium hominis
NTKLNSGY

SEQ ID NO: 2155196 - protein, 5 aa, Cryptosporidium hominis
NTKLS

SEQ ID NO: 2155197 - protein, 10 aa, Cryptosporidium hominis
NTKNKQDEND

SEQ ID NO: 2155198 - protein, 6 aa, Cryptosporidium hominis
NTKNPY

SEQ ID NO: 2155199 - protein, 11 aa, Cryptosporidium hominis
NTKRSISTDQT

SEQ ID NO: 2155200 - protein, 7 aa, Cryptosporidium hominis
NTKSNDF

SEQ ID NO: 2155201 - protein, 9 aa, Cryptosporidium hominis
NTKSYAEST

SEQ ID NO: 2155202 - protein, 8 aa, Cryptosporidium hominis
NTKTPLDI

SEQ ID NO: 2155203 - protein, 7 aa, Cryptosporidium hominis
NTKTRSF

SEQ ID NO: 2155204 - protein, 14 aa, Cryptosporidium hominis
NTLATDSSVPIPAP

SEQ ID NO: 2155205 - protein, 16 aa, Cryptosporidium hominis
NTLDSLGKTKSKRIIT

SEQ ID NO: 2155206 - protein, 6 aa, Cryptosporidium hominis
NTLEKD

SEQ ID NO: 2155207 - protein, 5 aa, Cryptosporidium hominis
NTLEN

SEQ ID NO: 2155208 - protein, 5 aa, Cryptosporidium hominis
NTLGT

SEQ ID NO: 2155209 - protein, 4 aa, Cryptosporidium hominis
NTLN

SEQ ID NO: 2155210 - protein, 5 aa, Cryptosporidium hominis
NTLPP

SEQ ID NO: 2155211 - protein, 12 aa, Cryptosporidium hominis
NTLSTKTESYSL

SEQ ID NO: 2155212 - protein, 4 aa, Cryptosporidium hominis
NTLT

SEQ ID NO: 2155213 - protein, 11 aa, Cryptosporidium hominis
NTLTNEKQQSS

SEQ ID NO: 2155214 - protein, 12 aa, Cryptosporidium hominis
NTNCSKNDSEYN

SEQ ID NO: 2155215 - protein, 7 aa, Cryptosporidium hominis
NTNDNDL

SEQ ID NO: 2155216 - protein, 5 aa, Cryptosporidium hominis
NTNEN

SEQ ID NO: 2155217 - protein, 12 aa, Cryptosporidium hominis
NTNENEKSSGYF

SEQ ID NO: 2155218 - protein, 7 aa, Cryptosporidium hominis
NTNEWGG

SEQ ID NO: 2155219 - protein, 9 aa, Cryptosporidium hominis
NTNGILNSS

SEQ ID NO: 2155220 - protein, 9 aa, Cryptosporidium hominis
NTNHEHPLE

SEQ ID NO: 2155221 - protein, 10 aa, Cryptosporidium hominis
NTNHNQPPLV

SEQ ID NO: 2155222 - protein, 13 aa, Cryptosporidium hominis
NTNINPSTNSNYN

SEQ ID NO: 2155223 - protein, 8 aa, Cryptosporidium hominis
NTNKEHSN

SEQ ID NO: 2155224 - protein, 8 aa, Cryptosporidium hominis
NTNKIQGE

SEQ ID NO: 2155225 - protein, 11 aa, Cryptosporidium hominis
NTNKNNQSYQV

SEQ ID NO: 2155226 - protein, 8 aa, Cryptosporidium hominis
NTNLSQKT

SEQ ID NO: 2155227 - protein, 12 aa, Cryptosporidium hominis
NTNLTSENVRNQ

SEQ ID NO: 2155228 - protein, 4 aa, Cryptosporidium hominis
NTNN

SEQ ID NO: 2155229 - protein, 10 aa, Cryptosporidium hominis
NTNNEDLGTN

SEQ ID NO: 2155230 - protein, 16 aa, Cryptosporidium hominis
NTNNKPNVTSKNPFDL

SEQ ID NO: 2155231 - protein, 5 aa, Cryptosporidium hominis
NTNNM

SEQ ID NO: 2155232 - protein, 9 aa, Cryptosporidium hominis
NTNPKHSPG

SEQ ID NO: 2155233 - protein, 6 aa, Cryptosporidium hominis
NTNPPV

SEQ ID NO: 2155234 - protein, 9 aa, Cryptosporidium hominis
NTNPRKGPF

SEQ ID NO: 2155235 - protein, 5 aa, Cryptosporidium hominis
NTNQR

SEQ ID NO: 2155236 - protein, 10 aa, Cryptosporidium hominis
NTNSIASKEA

SEQ ID NO: 2155237 - protein, 9 aa, Cryptosporidium hominis
NTNSNNPIG

SEQ ID NO: 2155238 - protein, 11 aa, Cryptosporidium hominis
NTNSNNQEEEK

SEQ ID NO: 2155239 - protein, 56 aa, Cryptosporidium hominis
NTNSNQPTKGSSLISDDDDTFGIDNSSSKNGVITNGTSSVALSSHSSTTTTSSGVT

SEQ ID NO: 2155240 - protein, 9 aa, Cryptosporidium hominis
NTNSSEQTR

SEQ ID NO: 2155241 - protein, 8 aa, Cryptosporidium hominis
NTNSSSEK

SEQ ID NO: 2155242 - protein, 7 aa, Cryptosporidium hominis
NTNSSSI

SEQ ID NO: 2155243 - protein, 8 aa, Cryptosporidium hominis
NTNSYSEK

SEQ ID NO: 2155244 - protein, 12 aa, Cryptosporidium hominis
NTNTPDQDSEEF

SEQ ID NO: 2155245 - protein, 8 aa, Cryptosporidium hominis
NTNVQGTS

SEQ ID NO: 2155246 - protein, 5 aa, Cryptosporidium hominis
NTPAN

SEQ ID NO: 2155247 - protein, 5 aa, Cryptosporidium hominis
NTPEF

SEQ ID NO: 2155248 - protein, 7 aa, Cryptosporidium hominis
NTPGGYS

SEQ ID NO: 2155249 - protein, 7 aa, Cryptosporidium hominis
NTPIRKG

SEQ ID NO: 2155250 - protein, 4 aa, Cryptosporidium hominis
NTPK

SEQ ID NO: 2155251 - protein, 18 aa, Cryptosporidium hominis
NTPKIGRESISGGSGNKS

SEQ ID NO: 2155252 - protein, 9 aa, Cryptosporidium hominis
NTPKLTDEA

SEQ ID NO: 2155253 - protein, 16 aa, Cryptosporidium hominis
NTPKSDNTKISKGSRK

SEQ ID NO: 2155254 - protein, 4 aa, Cryptosporidium hominis
NTPL

SEQ ID NO: 2155255 - protein, 9 aa, Cryptosporidium hominis
NTPNHPSGN

SEQ ID NO: 2155256 - protein, 6 aa, Cryptosporidium hominis
NTPNSL

SEQ ID NO: 2155257 - protein, 8 aa, Cryptosporidium hominis
NTPPEPYI

SEQ ID NO: 2155258 - protein, 6 aa, Cryptosporidium hominis
NTPQGL

SEQ ID NO: 2155259 - protein, 12 aa, Cryptosporidium hominis
NTPRAATVKARG

SEQ ID NO: 2155260 - protein, 6 aa, Cryptosporidium hominis
NTPRKA

SEQ ID NO: 2155261 - protein, 20 aa, Cryptosporidium hominis
NTPSEKNSIQGSTKSSYYNP

SEQ ID NO: 2155262 - protein, 8 aa, Cryptosporidium hominis
NTPSSPLQ

SEQ ID NO: 2155263 - protein, 14 aa, Cryptosporidium hominis
NTPTRCRNRRGESL

SEQ ID NO: 2155264 - protein, 8 aa, Cryptosporidium hominis
NTQASSDR

SEQ ID NO: 2155265 - protein, 5 aa, Cryptosporidium hominis
NTQFS

SEQ ID NO: 2155266 - protein, 8 aa, Cryptosporidium hominis
NTQGFSGA

SEQ ID NO: 2155267 - protein, 14 aa, Cryptosporidium hominis
NTQNLKDPSLQSTQ

SEQ ID NO: 2155268 - protein, 6 aa, Cryptosporidium hominis
NTQNLS

SEQ ID NO: 2155269 - protein, 8 aa, Cryptosporidium hominis
NTQSFGSS

SEQ ID NO: 2155270 - protein, 5 aa, Cryptosporidium hominis
NTQSG

SEQ ID NO: 2155271 - protein, 10 aa, Cryptosporidium hominis
NTQYSEESKR

SEQ ID NO: 2155272 - protein, 7 aa, Cryptosporidium hominis
NTRCQSV

SEQ ID NO: 2155273 - protein, 9 aa, Cryptosporidium hominis
NTRDEVSEI

SEQ ID NO: 2155274 - protein, 5 aa, Cryptosporidium hominis
NTRKR

SEQ ID NO: 2155275 - protein, 18 aa, Cryptosporidium hominis
NTRNTGKQSKGKKDIQNN

SEQ ID NO: 2155276 - protein, 12 aa, Cryptosporidium hominis
NTRRNKEKDQVS

SEQ ID NO: 2155277 - protein, 10 aa, Cryptosporidium hominis
NTRTTTTTTI

SEQ ID NO: 2155278 - protein, 7 aa, Cryptosporidium hominis
NTSARKQ

SEQ ID NO: 2155279 - protein, 23 aa, Cryptosporidium hominis
NTSDTGKKPDSSTPNSSNIANPT

SEQ ID NO: 2155280 - protein, 5 aa, Cryptosporidium hominis
NTSEA

SEQ ID NO: 2155281 - protein, 26 aa, Cryptosporidium hominis
NTSGAAPVTATTQGGIGMGQQGTEGL

SEQ ID NO: 2155282 - protein, 15 aa, Cryptosporidium hominis
NTSGSSPSKDGSTSG

SEQ ID NO: 2155283 - protein, 5 aa, Cryptosporidium hominis
NTSIG

SEQ ID NO: 2155284 - protein, 5 aa, Cryptosporidium hominis
NTSIS

SEQ ID NO: 2155285 - protein, 7 aa, Cryptosporidium hominis
NTSKEEI

SEQ ID NO: 2155286 - protein, 15 aa, Cryptosporidium hominis
NTSKNSNLGSSKHKL

SEQ ID NO: 2155287 - protein, 18 aa, Cryptosporidium hominis
NTSKSNGVNQKRKANCEY

SEQ ID NO: 2155288 - protein, 12 aa, Cryptosporidium hominis
NTSKSSNSSNKS

SEQ ID NO: 2155289 - protein, 76 aa, Cryptosporidium hominis
NTSLNSISNPLDDDSLYDSDDDEDYEAEDDDDDDDDDDDDDDDDDDDDDDDDDDNDDDNDDEEEKKEEERDDEELE

SEQ ID NO: 2155290 - protein, 11 aa, Cryptosporidium hominis
NTSNNTLPSSS

SEQ ID NO: 2155291 - protein, 14 aa, Cryptosporidium hominis
NTSNPGNGSKFDSS

SEQ ID NO: 2155292 - protein, 8 aa, Cryptosporidium hominis
NTSNTKFD

SEQ ID NO: 2155293 - protein, 10 aa, Cryptosporidium hominis
NTSQAFRTAR

SEQ ID NO: 2155294 - protein, 9 aa, Cryptosporidium hominis
NTSRNGKKN

SEQ ID NO: 2155295 - protein, 9 aa, Cryptosporidium hominis
NTSRNNPKF

SEQ ID NO: 2155296 - protein, 22 aa, Cryptosporidium hominis
NTSSENNGSNIASGESNSNNHR

SEQ ID NO: 2155297 - protein, 13 aa, Cryptosporidium hominis
NTSSSSDVSHTTH

SEQ ID NO: 2155298 - protein, 9 aa, Cryptosporidium hominis
NTSTNITSK

SEQ ID NO: 2155299 - protein, 14 aa, Cryptosporidium hominis
NTSTPIPKNKSSRL

SEQ ID NO: 2155300 - protein, 6 aa, Cryptosporidium hominis
NTSTRQ

SEQ ID NO: 2155301 - protein, 8 aa, Cryptosporidium hominis
NTSYGGLN

SEQ ID NO: 2155302 - protein, 10 aa, Cryptosporidium hominis
NTTCNKEDSD

SEQ ID NO: 2155303 - protein, 6 aa, Cryptosporidium hominis
NTTDEV

SEQ ID NO: 2155304 - protein, 19 aa, Cryptosporidium hominis
NTTEEAPLVGNGGKSDVAN

SEQ ID NO: 2155305 - protein, 44 aa, Cryptosporidium hominis
NTTEGINDHQSKNSVSQTITTGTGRIPSRGIKRRGSLKSQTDIT

SEQ ID NO: 2155306 - protein, 8 aa, Cryptosporidium hominis
NTTIPAKK

SEQ ID NO: 2155307 - protein, 15 aa, Cryptosporidium hominis
NTTLRNKSDQAISKS

SEQ ID NO: 2155308 - protein, 6 aa, Cryptosporidium hominis
NTTNER

SEQ ID NO: 2155309 - protein, 39 aa, Cryptosporidium hominis
NTTNKKAPVSEKPTQPQIPNKTSDVKKGGTMGGERGSVT

SEQ ID NO: 2155310 - protein, 6 aa, Cryptosporidium hominis
NTTNSK

SEQ ID NO: 2155311 - protein, 18 aa, Cryptosporidium hominis
NTTSEDSSKEYNYNTSNS

SEQ ID NO: 2155312 - protein, 5 aa, Cryptosporidium hominis
NTTSI

SEQ ID NO: 2155313 - protein, 18 aa, Cryptosporidium hominis
NTTSTPRKKLTQTSKSAG

SEQ ID NO: 2155314 - protein, 35 aa, Cryptosporidium hominis
NTTTSASTSCRSNTEISASGASTTTNTSTNSPWNS

SEQ ID NO: 2155315 - protein, 7 aa, Cryptosporidium hominis
NTTTTNN

SEQ ID NO: 2155316 - protein, 11 aa, Cryptosporidium hominis
NTTTVSSEISS

SEQ ID NO: 2155317 - protein, 5 aa, Cryptosporidium hominis
NTTVK

SEQ ID NO: 2155318 - protein, 5 aa, Cryptosporidium hominis
NTTVQ

SEQ ID NO: 2155319 - protein, 26 aa, Cryptosporidium hominis
NTVNDGFEGDSSTSSNGTAEPKPELS

SEQ ID NO: 2155320 - protein, 16 aa, Cryptosporidium hominis
NTVNHNTTGSSTNGSF

SEQ ID NO: 2155321 - protein, 13 aa, Cryptosporidium hominis
NTVQTETSNTYSV

SEQ ID NO: 2155322 - protein, 18 aa, Cryptosporidium hominis
NTVRNGFEESGKSKGISE

SEQ ID NO: 2155323 - protein, 6 aa, Cryptosporidium hominis
NTVSFS

SEQ ID NO: 2155324 - protein, 12 aa, Cryptosporidium hominis
NTYDSGKVQLSD

SEQ ID NO: 2155325 - protein, 7 aa, Cryptosporidium hominis
NTYETAT

SEQ ID NO: 2155326 - protein, 12 aa, Cryptosporidium hominis
NTYGKGNLFYLI

SEQ ID NO: 2155327 - protein, 4 aa, Cryptosporidium hominis
NTYL

SEQ ID NO: 2155328 - protein, 5 aa, Cryptosporidium hominis
NTYNN

SEQ ID NO: 2155329 - protein, 7 aa, Cryptosporidium hominis
NTYNNED

SEQ ID NO: 2155330 - protein, 5 aa, Cryptosporidium hominis
NTYNY

SEQ ID NO: 2155331 - protein, 4 aa, Cryptosporidium hominis
NTYS

SEQ ID NO: 2155332 - protein, 6 aa, Cryptosporidium hominis
NTYSSR

SEQ ID NO: 2155333 - protein, 5 aa, Cryptosporidium hominis
NVAAK

SEQ ID NO: 2155334 - protein, 5 aa, Cryptosporidium hominis
NVAGT

SEQ ID NO: 2155335 - protein, 8 aa, Cryptosporidium hominis
NVASNETD

SEQ ID NO: 2155336 - protein, 24 aa, Cryptosporidium hominis
NVDKQGIEGVNNDQPKKKSERQLK

SEQ ID NO: 2155337 - protein, 15 aa, Cryptosporidium hominis
NVDQSNEMTSEEKEL

SEQ ID NO: 2155338 - protein, 10 aa, Cryptosporidium hominis
NVEDNENNSF

SEQ ID NO: 2155339 - protein, 13 aa, Cryptosporidium hominis
NVEGGSGSNNLNV

SEQ ID NO: 2155340 - protein, 13 aa, Cryptosporidium hominis
NVENSRLEESSDR

SEQ ID NO: 2155341 - protein, 4 aa, Cryptosporidium hominis
NVES

SEQ ID NO: 2155342 - protein, 41 aa, Cryptosporidium hominis
NVESDSSEQEQPTNTNLEKHDKRSKETTSRDSKCKNSNKDI

SEQ ID NO: 2155343 - protein, 12 aa, Cryptosporidium hominis
NVGEPKKSRDIN

SEQ ID NO: 2155344 - protein, 5 aa, Cryptosporidium hominis
NVGGP

SEQ ID NO: 2155345 - protein, 6 aa, Cryptosporidium hominis
NVGKSS

SEQ ID NO: 2155346 - protein, 7 aa, Cryptosporidium hominis
NVGKSTT

SEQ ID NO: 2155347 - protein, 12 aa, Cryptosporidium hominis
NVGRSRTASNKL

SEQ ID NO: 2155348 - protein, 11 aa, Cryptosporidium hominis
NVGSNPISTTN

SEQ ID NO: 2155349 - protein, 7 aa, Cryptosporidium hominis
NVGSNQQ

SEQ ID NO: 2155350 - protein, 8 aa, Cryptosporidium hominis
NVGTQNST

SEQ ID NO: 2155351 - protein, 5 aa, Cryptosporidium hominis
NVIPN

SEQ ID NO: 2155352 - protein, 20 aa, Cryptosporidium hominis
NVIRPKRAAAIKAEESIQKK

SEQ ID NO: 2155353 - protein, 5 aa, Cryptosporidium hominis
NVISP

SEQ ID NO: 2155354 - protein, 16 aa, Cryptosporidium hominis
NVISTNTSQSNESLSI

SEQ ID NO: 2155355 - protein, 25 aa, Cryptosporidium hominis
NVKEGTKIDNSDNNNIEDRDEEVQG

SEQ ID NO: 2155356 - protein, 21 aa, Cryptosporidium hominis
NVKKSKKSSPTVNEGEKTQER

SEQ ID NO: 2155357 - protein, 5 aa, Cryptosporidium hominis
NVKPG

SEQ ID NO: 2155358 - protein, 5 aa, Cryptosporidium hominis
NVKPQ

SEQ ID NO: 2155359 - protein, 6 aa, Cryptosporidium hominis
NVKSDI

SEQ ID NO: 2155360 - protein, 19 aa, Cryptosporidium hominis
NVLSQKSKLSKDSVISSGI

SEQ ID NO: 2155361 - protein, 9 aa, Cryptosporidium hominis
NVNERGRST

SEQ ID NO: 2155362 - protein, 7 aa, Cryptosporidium hominis
NVNKGDP

SEQ ID NO: 2155363 - protein, 8 aa, Cryptosporidium hominis
NVNKGNDP

SEQ ID NO: 2155364 - protein, 12 aa, Cryptosporidium hominis
NVNNTSEGSKLV

SEQ ID NO: 2155365 - protein, 7 aa, Cryptosporidium hominis
NVNQTQK

SEQ ID NO: 2155366 - protein, 62 aa, Cryptosporidium hominis
NVNYEDSKFSPNNEKPSKKTSKSNQVHTQNKDIDTEEENDSSLKTNDESNPNSPSLSKTTND

SEQ ID NO: 2155367 - protein, 19 aa, Cryptosporidium hominis
NVNYKDEETNANNEEEHNG

SEQ ID NO: 2155368 - protein, 15 aa, Cryptosporidium hominis
NVPESISKKQSENLP

SEQ ID NO: 2155369 - protein, 5 aa, Cryptosporidium hominis
NVPGD

SEQ ID NO: 2155370 - protein, 12 aa, Cryptosporidium hominis
NVPGLGKNISTN

SEQ ID NO: 2155371 - protein, 12 aa, Cryptosporidium hominis
NVPKERVERRND

SEQ ID NO: 2155372 - protein, 7 aa, Cryptosporidium hominis
NVPKNSS

SEQ ID NO: 2155373 - protein, 19 aa, Cryptosporidium hominis
NVPLSPSQVGGKRNKETQI

SEQ ID NO: 2155374 - protein, 6 aa, Cryptosporidium hominis
NVPRPN

SEQ ID NO: 2155375 - protein, 13 aa, Cryptosporidium hominis
NVPSTSVDKKGTN

SEQ ID NO: 2155376 - protein, 6 aa, Cryptosporidium hominis
NVQDSS

SEQ ID NO: 2155377 - protein, 8 aa, Cryptosporidium hominis
NVQNKRDA

SEQ ID NO: 2155378 - protein, 11 aa, Cryptosporidium hominis
NVREKGAQEWE

SEQ ID NO: 2155379 - protein, 25 aa, Cryptosporidium hominis
NVRRGNKSAHNLESQNKKEPPRTLG

SEQ ID NO: 2155380 - protein, 25 aa, Cryptosporidium hominis
NVSEDSSNEENIETKKRKSNEENIP

SEQ ID NO: 2155381 - protein, 11 aa, Cryptosporidium hominis
NVSESQRFPSY

SEQ ID NO: 2155382 - protein, 11 aa, Cryptosporidium hominis
NVSGDGNSEGD

SEQ ID NO: 2155383 - protein, 18 aa, Cryptosporidium hominis
NVSGTSGATGNEHGSGSG

SEQ ID NO: 2155384 - protein, 5 aa, Cryptosporidium hominis
NVSNE

SEQ ID NO: 2155385 - protein, 4 aa, Cryptosporidium hominis
NVSQ

SEQ ID NO: 2155386 - protein, 14 aa, Cryptosporidium hominis
NVSRSRKSNAVENS

SEQ ID NO: 2155387 - protein, 5 aa, Cryptosporidium hominis
NVSSA

SEQ ID NO: 2155388 - protein, 6 aa, Cryptosporidium hominis
NVSTPL

SEQ ID NO: 2155389 - protein, 6 aa, Cryptosporidium hominis
NVSTQE

SEQ ID NO: 2155390 - protein, 4 aa, Cryptosporidium hominis
NVTA

SEQ ID NO: 2155391 - protein, 21 aa, Cryptosporidium hominis
NVTENNRIKTNRKRGLISSTD

SEQ ID NO: 2155392 - protein, 33 aa, Cryptosporidium hominis
NVTGNSKSFESKEENKDLSSSISDSEKQNKDVN

SEQ ID NO: 2155393 - protein, 10 aa, Cryptosporidium hominis
NVTPNPGNPL

SEQ ID NO: 2155394 - protein, 11 aa, Cryptosporidium hominis
NVTPSSRREGF

SEQ ID NO: 2155395 - protein, 4 aa, Cryptosporidium hominis
NVTS

SEQ ID NO: 2155396 - protein, 6 aa, Cryptosporidium hominis
NVTSQV

SEQ ID NO: 2155397 - protein, 5 aa, Cryptosporidium hominis
NVTST

SEQ ID NO: 2155398 - protein, 15 aa, Cryptosporidium hominis
NVTTGTKTGETTRTA

SEQ ID NO: 2155399 - protein, 5 aa, Cryptosporidium hominis
NVTTS

SEQ ID NO: 2155400 - protein, 14 aa, Cryptosporidium hominis
NVYDENNDDVAGMS

SEQ ID NO: 2155401 - protein, 11 aa, Cryptosporidium hominis
NVYDSKKGNFK

SEQ ID NO: 2155402 - protein, 5 aa, Cryptosporidium hominis
NVYEG

SEQ ID NO: 2155403 - protein, 9 aa, Cryptosporidium hominis
NVYKPDSVS

SEQ ID NO: 2155404 - protein, 15 aa, Cryptosporidium hominis
NWDSTDDIDDSNTIS

SEQ ID NO: 2155405 - protein, 5 aa, Cryptosporidium hominis
NWEGY

SEQ ID NO: 2155406 - protein, 11 aa, Cryptosporidium hominis
NWKEGNGKYCG

SEQ ID NO: 2155407 - protein, 7 aa, Cryptosporidium hominis
NWPETSN

SEQ ID NO: 2155408 - protein, 7 aa, Cryptosporidium hominis
NWPTLDS

SEQ ID NO: 2155409 - protein, 6 aa, Cryptosporidium hominis
NWSPNA

SEQ ID NO: 2155410 - protein, 8 aa, Cryptosporidium hominis
NYAENQRM

SEQ ID NO: 2155411 - protein, 15 aa, Cryptosporidium hominis
NYDPPGTIEYTDQGE

SEQ ID NO: 2155412 - protein, 9 aa, Cryptosporidium hominis
NYEKENESL

SEQ ID NO: 2155413 - protein, 12 aa, Cryptosporidium hominis
NYENEENEDSSE

SEQ ID NO: 2155414 - protein, 9 aa, Cryptosporidium hominis
NYENGKKDQ

SEQ ID NO: 2155415 - protein, 5 aa, Cryptosporidium hominis
NYENS

SEQ ID NO: 2155416 - protein, 15 aa, Cryptosporidium hominis
NYENTLNKKNRKLTR

SEQ ID NO: 2155417 - protein, 9 aa, Cryptosporidium hominis
NYETSSTDT

SEQ ID NO: 2155418 - protein, 9 aa, Cryptosporidium hominis
NYGNENTRI

SEQ ID NO: 2155419 - protein, 12 aa, Cryptosporidium hominis
NYGSSSESDNYV

SEQ ID NO: 2155420 - protein, 6 aa, Cryptosporidium hominis
NYHPNI

SEQ ID NO: 2155421 - protein, 8 aa, Cryptosporidium hominis
NYKDNANW

SEQ ID NO: 2155422 - protein, 5 aa, Cryptosporidium hominis
NYKDS

SEQ ID NO: 2155423 - protein, 4 aa, Cryptosporidium hominis
NYKG

SEQ ID NO: 2155424 - protein, 10 aa, Cryptosporidium hominis
NYKKSESHYK

SEQ ID NO: 2155425 - protein, 11 aa, Cryptosporidium hominis
NYKNPNNNGTR

SEQ ID NO: 2155426 - protein, 7 aa, Cryptosporidium hominis
NYKQSRE

SEQ ID NO: 2155427 - protein, 10 aa, Cryptosporidium hominis
NYNDSNINNN

SEQ ID NO: 2155428 - protein, 6 aa, Cryptosporidium hominis
NYNETN

SEQ ID NO: 2155429 - protein, 5 aa, Cryptosporidium hominis
NYNFQ

SEQ ID NO: 2155430 - protein, 11 aa, Cryptosporidium hominis
NYNFSNTSDHS

SEQ ID NO: 2155431 - protein, 12 aa, Cryptosporidium hominis
NYNNENDLKKDQ

SEQ ID NO: 2155432 - protein, 13 aa, Cryptosporidium hominis
NYNSPEKDDSDIT

SEQ ID NO: 2155433 - protein, 5 aa, Cryptosporidium hominis
NYNTE

SEQ ID NO: 2155434 - protein, 26 aa, Cryptosporidium hominis
NYNTNDNNSSFDDRSGFDDKDCESQA

SEQ ID NO: 2155435 - protein, 5 aa, Cryptosporidium hominis
NYPDY

SEQ ID NO: 2155436 - protein, 5 aa, Cryptosporidium hominis
NYPEL

SEQ ID NO: 2155437 - protein, 17 aa, Cryptosporidium hominis
NYPERHQSKHKPSPNNG

SEQ ID NO: 2155438 - protein, 4 aa, Cryptosporidium hominis
NYPN

SEQ ID NO: 2155439 - protein, 12 aa, Cryptosporidium hominis
NYPNNKTEYPTV

SEQ ID NO: 2155440 - protein, 49 aa, Cryptosporidium hominis
NYPQRDSARSYSRGRSRSRSGSRGRSRSRSRSRDRIRSRSRSMSEFGSR

SEQ ID NO: 2155441 - protein, 12 aa, Cryptosporidium hominis
NYPQTDSSYENL

SEQ ID NO: 2155442 - protein, 9 aa, Cryptosporidium hominis
NYPSQRQKG

SEQ ID NO: 2155443 - protein, 5 aa, Cryptosporidium hominis
NYPYN

SEQ ID NO: 2155444 - protein, 14 aa, Cryptosporidium hominis
NYQENQTHSTRNEI

SEQ ID NO: 2155445 - protein, 10 aa, Cryptosporidium hominis
NYQSKEPFSS

SEQ ID NO: 2155446 - protein, 14 aa, Cryptosporidium hominis
NYQSSSKKTHQNNN

SEQ ID NO: 2155447 - protein, 4 aa, Cryptosporidium hominis
NYQV

SEQ ID NO: 2155448 - protein, 10 aa, Cryptosporidium hominis
NYRDRRNREH

SEQ ID NO: 2155449 - protein, 10 aa, Cryptosporidium hominis
NYRNDHFPSE

SEQ ID NO: 2155450 - protein, 9 aa, Cryptosporidium hominis
NYSDKQLNR

SEQ ID NO: 2155451 - protein, 21 aa, Cryptosporidium hominis
NYSEITDSNNNNNNNGNNINN

SEQ ID NO: 2155452 - protein, 7 aa, Cryptosporidium hominis
NYSESCK

SEQ ID NO: 2155453 - protein, 26 aa, Cryptosporidium hominis
NYSHSNSKCSFSTNNISEEVNASECN

SEQ ID NO: 2155454 - protein, 7 aa, Cryptosporidium hominis
NYSKDEV

SEQ ID NO: 2155455 - protein, 5 aa, Cryptosporidium hominis
NYSKE

SEQ ID NO: 2155456 - protein, 6 aa, Cryptosporidium hominis
NYSKQR

SEQ ID NO: 2155457 - protein, 13 aa, Cryptosporidium hominis
NYSKVSKPSWDGG

SEQ ID NO: 2155458 - protein, 7 aa, Cryptosporidium hominis
NYSMGGQ

SEQ ID NO: 2155459 - protein, 10 aa, Cryptosporidium hominis
NYSNDGNGYY

SEQ ID NO: 2155460 - protein, 9 aa, Cryptosporidium hominis
NYSNSTTNN

SEQ ID NO: 2155461 - protein, 15 aa, Cryptosporidium hominis
NYSNTSSSTVSRGHT

SEQ ID NO: 2155462 - protein, 9 aa, Cryptosporidium hominis
NYSPETSLQ

SEQ ID NO: 2155463 - protein, 5 aa, Cryptosporidium hominis
NYSQE

SEQ ID NO: 2155464 - protein, 7 aa, Cryptosporidium hominis
NYSQEGL

SEQ ID NO: 2155465 - protein, 26 aa, Cryptosporidium hominis
NYSQSYSQGSSSNLGGLTETDSKAMS

SEQ ID NO: 2155466 - protein, 11 aa, Cryptosporidium hominis
NYSRESSNEYI

SEQ ID NO: 2155467 - protein, 8 aa, Cryptosporidium hominis
NYSSNKGS

SEQ ID NO: 2155468 - protein, 13 aa, Cryptosporidium hominis
NYSSNSRSIEVEA

SEQ ID NO: 2155469 - protein, 13 aa, Cryptosporidium hominis
NYSVNNGKGMTTS

SEQ ID NO: 2155470 - protein, 18 aa, Cryptosporidium hominis
NYTANPEKVDTQSTGNVQ

SEQ ID NO: 2155471 - protein, 4 aa, Cryptosporidium hominis
NYTE

SEQ ID NO: 2155472 - protein, 14 aa, Cryptosporidium hominis
NYTGATSAPESVSI

SEQ ID NO: 2155473 - protein, 5 aa, Cryptosporidium hominis
NYTGS

SEQ ID NO: 2155474 - protein, 21 aa, Cryptosporidium hominis
NYTNEKKSIKLNGANTHDSTC

SEQ ID NO: 2155475 - protein, 9 aa, Cryptosporidium hominis
NYTNNNSGV

SEQ ID NO: 2155476 - protein, 4 aa, Cryptosporidium hominis
NYTT

SEQ ID NO: 2155477 - protein, 6 aa, Cryptosporidium hominis
NYVNPK

SEQ ID NO: 2155478 - protein, 19 aa, Cryptosporidium hominis
NYYGNPNYEYDNNNNNYYN

SEQ ID NO: 2155479 - protein, 15 aa, Cryptosporidium hominis
NYYQESGRAGRDGLE

SEQ ID NO: 2155480 - protein, 11 aa, Cryptosporidium hominis
NYYSNETLPPK

SEQ ID NO: 2155481 - protein, 14 aa, Cryptosporidium hominis
PAAATNNNGLPNDP

SEQ ID NO: 2155482 - protein, 14 aa, Cryptosporidium hominis
PAAGGNSNDKKDVD

SEQ ID NO: 2155483 - protein, 21 aa, Cryptosporidium hominis
PAAPMSTRSTSSIGAESRIST

SEQ ID NO: 2155484 - protein, 26 aa, Cryptosporidium hominis
PAASKSDSEKFKNRSLGNSTISSAVT

SEQ ID NO: 2155485 - protein, 7 aa, Cryptosporidium hominis
PAEDAKS

SEQ ID NO: 2155486 - protein, 13 aa, Cryptosporidium hominis
PAEEFNSNNLSSD

SEQ ID NO: 2155487 - protein, 7 aa, Cryptosporidium hominis
PAERITA

SEQ ID NO: 2155488 - protein, 6 aa, Cryptosporidium hominis
PAERQN

SEQ ID NO: 2155489 - protein, 4 aa, Cryptosporidium hominis
PAET

SEQ ID NO: 2155490 - protein, 10 aa, Cryptosporidium hominis
PAFGTDEDEL

SEQ ID NO: 2155491 - protein, 14 aa, Cryptosporidium hominis
PAGGPKPRSQNDDM

SEQ ID NO: 2155492 - protein, 7 aa, Cryptosporidium hominis
PAGQNSS

SEQ ID NO: 2155493 - protein, 6 aa, Cryptosporidium hominis
PAHSPS

SEQ ID NO: 2155494 - protein, 7 aa, Cryptosporidium hominis
PAHSQDR

SEQ ID NO: 2155495 - protein, 10 aa, Cryptosporidium hominis
PAHSSYKEKS

SEQ ID NO: 2155496 - protein, 10 aa, Cryptosporidium hominis
PAIPQPPIPF

SEQ ID NO: 2155497 - protein, 4 aa, Cryptosporidium hominis
PAIR

SEQ ID NO: 2155498 - protein, 5 aa, Cryptosporidium hominis
PAITK

SEQ ID NO: 2155499 - protein, 6 aa, Cryptosporidium hominis
PAKIGS

SEQ ID NO: 2155500 - protein, 17 aa, Cryptosporidium hominis
PALESANKYSNKNRQNS

SEQ ID NO: 2155501 - protein, 4 aa, Cryptosporidium hominis
PALL

SEQ ID NO: 2155502 - protein, 5 aa, Cryptosporidium hominis
PANCS

SEQ ID NO: 2155503 - protein, 6 aa, Cryptosporidium hominis
PANENV

SEQ ID NO: 2155504 - protein, 4 aa, Cryptosporidium hominis
PANR

SEQ ID NO: 2155505 - protein, 6 aa, Cryptosporidium hominis
PANRPN

SEQ ID NO: 2155506 - protein, 7 aa, Cryptosporidium hominis
PAPARQG

SEQ ID NO: 2155507 - protein, 4 aa, Cryptosporidium hominis
PAPF

SEQ ID NO: 2155508 - protein, 5 aa, Cryptosporidium hominis
PAPKA

SEQ ID NO: 2155509 - protein, 16 aa, Cryptosporidium hominis
PAPKMETLKGGNPIKS

SEQ ID NO: 2155510 - protein, 15 aa, Cryptosporidium hominis
PAPKYHSRSKTQNTS

SEQ ID NO: 2155511 - protein, 16 aa, Cryptosporidium hominis
PAPLGKDGKPRKDFNQ

SEQ ID NO: 2155512 - protein, 11 aa, Cryptosporidium hominis
PAPNADNDNIE

SEQ ID NO: 2155513 - protein, 8 aa, Cryptosporidium hominis
PAPSDPLS

SEQ ID NO: 2155514 - protein, 10 aa, Cryptosporidium hominis
PAPSQEEAVA

SEQ ID NO: 2155515 - protein, 13 aa, Cryptosporidium hominis
PAPWRGSDGEARI

SEQ ID NO: 2155516 - protein, 30 aa, Cryptosporidium hominis
PAQKQQAAKKTAGKSPADGGKRKRRKRTES

SEQ ID NO: 2155517 - protein, 4 aa, Cryptosporidium hominis
PAQR

SEQ ID NO: 2155518 - protein, 57 aa, Cryptosporidium hominis
PAQSPEPNIHPSSEGNTRGRRCTNKDMGGVSNDTNNAETNANGVNYKGEYKSENSSI

SEQ ID NO: 2155519 - protein, 18 aa, Cryptosporidium hominis
PARGPTPGSQPKKTGFYA

SEQ ID NO: 2155520 - protein, 10 aa, Cryptosporidium hominis
PASALPADQD

SEQ ID NO: 2155521 - protein, 11 aa, Cryptosporidium hominis
PASEIKKAKPN

SEQ ID NO: 2155522 - protein, 11 aa, Cryptosporidium hominis
PASGNTYSGQF

SEQ ID NO: 2155523 - protein, 6 aa, Cryptosporidium hominis
PASGYV

SEQ ID NO: 2155524 - protein, 4 aa, Cryptosporidium hominis
PASN

SEQ ID NO: 2155525 - protein, 5 aa, Cryptosporidium hominis
PASNI

SEQ ID NO: 2155526 - protein, 6 aa, Cryptosporidium hominis
PASNKQ

SEQ ID NO: 2155527 - protein, 10 aa, Cryptosporidium hominis
PASRRNNDGN

SEQ ID NO: 2155528 - protein, 4 aa, Cryptosporidium hominis
PASS

SEQ ID NO: 2155529 - protein, 10 aa, Cryptosporidium hominis
PASTGAAKAV

SEQ ID NO: 2155530 - protein, 8 aa, Cryptosporidium hominis
PATAIKAQ

SEQ ID NO: 2155531 - protein, 9 aa, Cryptosporidium hominis
PATAPAGDA

SEQ ID NO: 2155532 - protein, 7 aa, Cryptosporidium hominis
PATEQDI

SEQ ID NO: 2155533 - protein, 5 aa, Cryptosporidium hominis
PATQK

SEQ ID NO: 2155534 - protein, 26 aa, Cryptosporidium hominis
PATSTASTSSAAAPGAHPPRPAIPPP

SEQ ID NO: 2155535 - protein, 8 aa, Cryptosporidium hominis
PATTENTA

SEQ ID NO: 2155536 - protein, 6 aa, Cryptosporidium hominis
PATYTT

SEQ ID NO: 2155537 - protein, 5 aa, Cryptosporidium hominis
PAVDS

SEQ ID NO: 2155538 - protein, 5 aa, Cryptosporidium hominis
PAVTI

SEQ ID NO: 2155539 - protein, 13 aa, Cryptosporidium hominis
PCDPSELPLNYFK

SEQ ID NO: 2155540 - protein, 8 aa, Cryptosporidium hominis
PCEAPDRL

SEQ ID NO: 2155541 - protein, 5 aa, Cryptosporidium hominis
PCNNE

SEQ ID NO: 2155542 - protein, 7 aa, Cryptosporidium hominis
PCRRSKQ

SEQ ID NO: 2155543 - protein, 8 aa, Cryptosporidium hominis
PCSGQDNS

SEQ ID NO: 2155544 - protein, 5 aa, Cryptosporidium hominis
PCSSD

SEQ ID NO: 2155545 - protein, 12 aa, Cryptosporidium hominis
PCSTYDSPTLSS

SEQ ID NO: 2155546 - protein, 14 aa, Cryptosporidium hominis
PCSYRGNYENVDNK

SEQ ID NO: 2155547 - protein, 9 aa, Cryptosporidium hominis
PCTNPTSTT

SEQ ID NO: 2155548 - protein, 8 aa, Cryptosporidium hominis
PDADAERL

SEQ ID NO: 2155549 - protein, 5 aa, Cryptosporidium hominis
PDAPE

SEQ ID NO: 2155550 - protein, 7 aa, Cryptosporidium hominis
PDARRAV

SEQ ID NO: 2155551 - protein, 6 aa, Cryptosporidium hominis
PDASGY

SEQ ID NO: 2155552 - protein, 4 aa, Cryptosporidium hominis
PDCT

SEQ ID NO: 2155553 - protein, 8 aa, Cryptosporidium hominis
PDDDISPE

SEQ ID NO: 2155554 - protein, 7 aa, Cryptosporidium hominis
PDDGSED

SEQ ID NO: 2155555 - protein, 8 aa, Cryptosporidium hominis
PDDHENLT

SEQ ID NO: 2155556 - protein, 4 aa, Cryptosporidium hominis
PDDK

SEQ ID NO: 2155557 - protein, 5 aa, Cryptosporidium hominis
PDDPI

SEQ ID NO: 2155558 - protein, 5 aa, Cryptosporidium hominis
PDDST

SEQ ID NO: 2155559 - protein, 7 aa, Cryptosporidium hominis
PDDTNCH

SEQ ID NO: 2155560 - protein, 8 aa, Cryptosporidium hominis
PDEATKAI

SEQ ID NO: 2155561 - protein, 4 aa, Cryptosporidium hominis
PDED

SEQ ID NO: 2155562 - protein, 5 aa, Cryptosporidium hominis
PDEDP

SEQ ID NO: 2155563 - protein, 5 aa, Cryptosporidium hominis
PDEES

SEQ ID NO: 2155564 - protein, 17 aa, Cryptosporidium hominis
PDEESSELPQDEQNHNK

SEQ ID NO: 2155565 - protein, 9 aa, Cryptosporidium hominis
PDEIDDELK

SEQ ID NO: 2155566 - protein, 21 aa, Cryptosporidium hominis
PDEKTSVSVGENDSELNQMTS

SEQ ID NO: 2155567 - protein, 7 aa, Cryptosporidium hominis
PDENARK

SEQ ID NO: 2155568 - protein, 4 aa, Cryptosporidium hominis
PDEQ

SEQ ID NO: 2155569 - protein, 5 aa, Cryptosporidium hominis
PDERY

SEQ ID NO: 2155570 - protein, 4 aa, Cryptosporidium hominis
PDES

SEQ ID NO: 2155571 - protein, 11 aa, Cryptosporidium hominis
PDESNFQPSNI

SEQ ID NO: 2155572 - protein, 5 aa, Cryptosporidium hominis
PDEVT

SEQ ID NO: 2155573 - protein, 5 aa, Cryptosporidium hominis
PDEYQ

SEQ ID NO: 2155574 - protein, 5 aa, Cryptosporidium hominis
PDFDG

SEQ ID NO: 2155575 - protein, 6 aa, Cryptosporidium hominis
PDFPED

SEQ ID NO: 2155576 - protein, 7 aa, Cryptosporidium hominis
PDGAQTT

SEQ ID NO: 2155577 - protein, 4 aa, Cryptosporidium hominis
PDGE

SEQ ID NO: 2155578 - protein, 28 aa, Cryptosporidium hominis
PDGGFKPTSTEPDSLYNPPFDKTTGTYH

SEQ ID NO: 2155579 - protein, 9 aa, Cryptosporidium hominis
PDGGKYTGE

SEQ ID NO: 2155580 - protein, 5 aa, Cryptosporidium hominis
PDGGS

SEQ ID NO: 2155581 - protein, 7 aa, Cryptosporidium hominis
PDGKAQV

SEQ ID NO: 2155582 - protein, 9 aa, Cryptosporidium hominis
PDGNKVGDE

SEQ ID NO: 2155583 - protein, 11 aa, Cryptosporidium hominis
PDGNRSDTELK

SEQ ID NO: 2155584 - protein, 4 aa, Cryptosporidium hominis
PDGR

SEQ ID NO: 2155585 - protein, 4 aa, Cryptosporidium hominis
PDGS

SEQ ID NO: 2155586 - protein, 6 aa, Cryptosporidium hominis
PDGTPS

SEQ ID NO: 2155587 - protein, 21 aa, Cryptosporidium hominis
PDGYDEDDDEDDGQEESGDDI

SEQ ID NO: 2155588 - protein, 14 aa, Cryptosporidium hominis
PDHEKSKSEAIESQ

SEQ ID NO: 2155589 - protein, 5 aa, Cryptosporidium hominis
PDHIN

SEQ ID NO: 2155590 - protein, 6 aa, Cryptosporidium hominis
PDHIPN

SEQ ID NO: 2155591 - protein, 8 aa, Cryptosporidium hominis
PDHKNKGS

SEQ ID NO: 2155592 - protein, 8 aa, Cryptosporidium hominis
PDIAENEK

SEQ ID NO: 2155593 - protein, 4 aa, Cryptosporidium hominis
PDIP

SEQ ID NO: 2155594 - protein, 4 aa, Cryptosporidium hominis
PDIQ

SEQ ID NO: 2155595 - protein, 8 aa, Cryptosporidium hominis
PDISSSST

SEQ ID NO: 2155596 - protein, 9 aa, Cryptosporidium hominis
PDISTHSEA

SEQ ID NO: 2155597 - protein, 10 aa, Cryptosporidium hominis
PDKDELHPGT

SEQ ID NO: 2155598 - protein, 19 aa, Cryptosporidium hominis
PDKDENTGEIKPEDKYGES

SEQ ID NO: 2155599 - protein, 4 aa, Cryptosporidium hominis
PDKG

SEQ ID NO: 2155600 - protein, 6 aa, Cryptosporidium hominis
PDKGGK

SEQ ID NO: 2155601 - protein, 5 aa, Cryptosporidium hominis
PDKKR

SEQ ID NO: 2155602 - protein, 28 aa, Cryptosporidium hominis
PDKNISELNQEKETQIANNGEQGDHNSR

SEQ ID NO: 2155603 - protein, 13 aa, Cryptosporidium hominis
PDKNPDNREEAEE

SEQ ID NO: 2155604 - protein, 15 aa, Cryptosporidium hominis
PDKNQNDEKSKERFQ

SEQ ID NO: 2155605 - protein, 7 aa, Cryptosporidium hominis
PDKNRNH

SEQ ID NO: 2155606 - protein, 10 aa, Cryptosporidium hominis
PDKSDHPRSA

SEQ ID NO: 2155607 - protein, 4 aa, Cryptosporidium hominis
PDLA

SEQ ID NO: 2155608 - protein, 10 aa, Cryptosporidium hominis
PDLARKSENP

SEQ ID NO: 2155609 - protein, 16 aa, Cryptosporidium hominis
PDLDGNPFKRNDTAVS

SEQ ID NO: 2155610 - protein, 8 aa, Cryptosporidium hominis
PDLGTKDG

SEQ ID NO: 2155611 - protein, 5 aa, Cryptosporidium hominis
PDMNT

SEQ ID NO: 2155612 - protein, 12 aa, Cryptosporidium hominis
PDNKTNKNFTDK

SEQ ID NO: 2155613 - protein, 5 aa, Cryptosporidium hominis
PDNMV

SEQ ID NO: 2155614 - protein, 8 aa, Cryptosporidium hominis
PDNNIPKE

SEQ ID NO: 2155615 - protein, 5 aa, Cryptosporidium hominis
PDNQA

SEQ ID NO: 2155616 - protein, 10 aa, Cryptosporidium hominis
PDNSDSDSNS

SEQ ID NO: 2155617 - protein, 8 aa, Cryptosporidium hominis
PDNSEVSE

SEQ ID NO: 2155618 - protein, 7 aa, Cryptosporidium hominis
PDNSPTK

SEQ ID NO: 2155619 - protein, 4 aa, Cryptosporidium hominis
PDNT

SEQ ID NO: 2155620 - protein, 7 aa, Cryptosporidium hominis
PDNYGNQ

SEQ ID NO: 2155621 - protein, 4 aa, Cryptosporidium hominis
PDPL

SEQ ID NO: 2155622 - protein, 21 aa, Cryptosporidium hominis
PDPLEGPNCDGNTCYKPNPAT

SEQ ID NO: 2155623 - protein, 18 aa, Cryptosporidium hominis
PDPLSNYRSTYETSSPYY

SEQ ID NO: 2155624 - protein, 9 aa, Cryptosporidium hominis
PDPNKSNKL

SEQ ID NO: 2155625 - protein, 6 aa, Cryptosporidium hominis
PDPNLT

SEQ ID NO: 2155626 - protein, 8 aa, Cryptosporidium hominis
PDPPRFPT

SEQ ID NO: 2155627 - protein, 4 aa, Cryptosporidium hominis
PDPS

SEQ ID NO: 2155628 - protein, 10 aa, Cryptosporidium hominis
PDPSAEPSYD

SEQ ID NO: 2155629 - protein, 5 aa, Cryptosporidium hominis
PDRHD

SEQ ID NO: 2155630 - protein, 6 aa, Cryptosporidium hominis
PDRKMR

SEQ ID NO: 2155631 - protein, 12 aa, Cryptosporidium hominis
PDRNITSISTTN

SEQ ID NO: 2155632 - protein, 9 aa, Cryptosporidium hominis
PDRNQAKDS

SEQ ID NO: 2155633 - protein, 4 aa, Cryptosporidium hominis
PDRP

SEQ ID NO: 2155634 - protein, 4 aa, Cryptosporidium hominis
PDRR

SEQ ID NO: 2155635 - protein, 4 aa, Cryptosporidium hominis
PDRV

SEQ ID NO: 2155636 - protein, 4 aa, Cryptosporidium hominis
PDSH

SEQ ID NO: 2155637 - protein, 77 aa, Cryptosporidium hominis
PDSHYRRSNNRKRTLESLDEEPELPIGSNSDNKNVNGSNKDETQRSENDKAEKSTSKRKTSVELPRKNIKSSSSRRD

SEQ ID NO: 2155638 - protein, 4 aa, Cryptosporidium hominis
PDSK

SEQ ID NO: 2155639 - protein, 9 aa, Cryptosporidium hominis
PDSKSPLPH

SEQ ID NO: 2155640 - protein, 4 aa, Cryptosporidium hominis
PDSN

SEQ ID NO: 2155641 - protein, 7 aa, Cryptosporidium hominis
PDSNKIT

SEQ ID NO: 2155642 - protein, 5 aa, Cryptosporidium hominis
PDSNN

SEQ ID NO: 2155643 - protein, 12 aa, Cryptosporidium hominis
PDSNNNNADFTR

SEQ ID NO: 2155644 - protein, 7 aa, Cryptosporidium hominis
PDSPSQV

SEQ ID NO: 2155645 - protein, 11 aa, Cryptosporidium hominis
PDSSEELEEFE

SEQ ID NO: 2155646 - protein, 6 aa, Cryptosporidium hominis
PDSSSF

SEQ ID NO: 2155647 - protein, 4 aa, Cryptosporidium hominis
PDST

SEQ ID NO: 2155648 - protein, 15 aa, Cryptosporidium hominis
PDSWPIPADTRPQRC

SEQ ID NO: 2155649 - protein, 4 aa, Cryptosporidium hominis
PDSY

SEQ ID NO: 2155650 - protein, 6 aa, Cryptosporidium hominis
PDTEKL

SEQ ID NO: 2155651 - protein, 11 aa, Cryptosporidium hominis
PDTIPPGETPH

SEQ ID NO: 2155652 - protein, 4 aa, Cryptosporidium hominis
PDTK

SEQ ID NO: 2155653 - protein, 8 aa, Cryptosporidium hominis
PDTNFRTP

SEQ ID NO: 2155654 - protein, 18 aa, Cryptosporidium hominis
PDTPSTQAPPVLSSNSVG

SEQ ID NO: 2155655 - protein, 4 aa, Cryptosporidium hominis
PDTQ

SEQ ID NO: 2155656 - protein, 8 aa, Cryptosporidium hominis
PDTSKKVQ

SEQ ID NO: 2155657 - protein, 14 aa, Cryptosporidium hominis
PDVRGNGQSLAGDR

SEQ ID NO: 2155658 - protein, 6 aa, Cryptosporidium hominis
PDWTED

SEQ ID NO: 2155659 - protein, 4 aa, Cryptosporidium hominis
PDYD

SEQ ID NO: 2155660 - protein, 4 aa, Cryptosporidium hominis
PDYI

SEQ ID NO: 2155661 - protein, 4 aa, Cryptosporidium hominis
PDYK

SEQ ID NO: 2155662 - protein, 5 aa, Cryptosporidium hominis
PDYKK

SEQ ID NO: 2155663 - protein, 7 aa, Cryptosporidium hominis
PDYRTPN

SEQ ID NO: 2155664 - protein, 10 aa, Cryptosporidium hominis
PDYSSKEQLK

SEQ ID NO: 2155665 - protein, 4 aa, Cryptosporidium hominis
PEAL

SEQ ID NO: 2155666 - protein, 7 aa, Cryptosporidium hominis
PECDSKK

SEQ ID NO: 2155667 - protein, 10 aa, Cryptosporidium hominis
PEDDDNYQDR

SEQ ID NO: 2155668 - protein, 15 aa, Cryptosporidium hominis
PEDDTNNEAFNSKAE

SEQ ID NO: 2155669 - protein, 9 aa, Cryptosporidium hominis
PEDGPKYQE

SEQ ID NO: 2155670 - protein, 14 aa, Cryptosporidium hominis
PEDIQSNSESVSEA

SEQ ID NO: 2155671 - protein, 6 aa, Cryptosporidium hominis
PEDKGY

SEQ ID NO: 2155672 - protein, 12 aa, Cryptosporidium hominis
PEDLDKELDLIW

SEQ ID NO: 2155673 - protein, 11 aa, Cryptosporidium hominis
PEDPSSSIQMT

SEQ ID NO: 2155674 - protein, 6 aa, Cryptosporidium hominis
PEDPVI

SEQ ID NO: 2155675 - protein, 41 aa, Cryptosporidium hominis
PEDRGNCASSEVSFEGKTTRQNSGNRATISHDPSSKDYAGV

SEQ ID NO: 2155676 - protein, 4 aa, Cryptosporidium hominis
PEDT

SEQ ID NO: 2155677 - protein, 7 aa, Cryptosporidium hominis
PEDTTES

SEQ ID NO: 2155678 - protein, 4 aa, Cryptosporidium hominis
PEDY

SEQ ID NO: 2155679 - protein, 6 aa, Cryptosporidium hominis
PEEAQR

SEQ ID NO: 2155680 - protein, 10 aa, Cryptosporidium hominis
PEEASSNKCK

SEQ ID NO: 2155681 - protein, 5 aa, Cryptosporidium hominis
PEEDN

SEQ ID NO: 2155682 - protein, 10 aa, Cryptosporidium hominis
PEEGGGATSF

SEQ ID NO: 2155683 - protein, 4 aa, Cryptosporidium hominis
PEEI

SEQ ID NO: 2155684 - protein, 9 aa, Cryptosporidium hominis
PEEIGKASS

SEQ ID NO: 2155685 - protein, 11 aa, Cryptosporidium hominis
PEEKESKTNRE

SEQ ID NO: 2155686 - protein, 11 aa, Cryptosporidium hominis
PEEKKTWSNNE

SEQ ID NO: 2155687 - protein, 29 aa, Cryptosporidium hominis
PEELNNAESINNTNPTPITTQQEAPQPNI

SEQ ID NO: 2155688 - protein, 9 aa, Cryptosporidium hominis
PEELSNAPF

SEQ ID NO: 2155689 - protein, 19 aa, Cryptosporidium hominis
PEESALDESIDSSASTGIA

SEQ ID NO: 2155690 - protein, 10 aa, Cryptosporidium hominis
PEESVLEKKE

SEQ ID NO: 2155691 - protein, 6 aa, Cryptosporidium hominis
PEESYV

SEQ ID NO: 2155692 - protein, 10 aa, Cryptosporidium hominis
PEETNNDDYD

SEQ ID NO: 2155693 - protein, 8 aa, Cryptosporidium hominis
PEETNTSR

SEQ ID NO: 2155694 - protein, 32 aa, Cryptosporidium hominis
PEEVSTDEGVEDSDQEKGFDDEEDEKNEKRDE

SEQ ID NO: 2155695 - protein, 4 aa, Cryptosporidium hominis
PEFN

SEQ ID NO: 2155696 - protein, 17 aa, Cryptosporidium hominis
PEFNEDSDEDLESSNRF

SEQ ID NO: 2155697 - protein, 11 aa, Cryptosporidium hominis
PEGEENPREKK

SEQ ID NO: 2155698 - protein, 11 aa, Cryptosporidium hominis
PEGSSSNTSIK

SEQ ID NO: 2155699 - protein, 6 aa, Cryptosporidium hominis
PEGTSI

SEQ ID NO: 2155700 - protein, 6 aa, Cryptosporidium hominis
PEGVYS

SEQ ID NO: 2155701 - protein, 14 aa, Cryptosporidium hominis
PEIESKNEQNDDKN

SEQ ID NO: 2155702 - protein, 5 aa, Cryptosporidium hominis
PEIGE

SEQ ID NO: 2155703 - protein, 5 aa, Cryptosporidium hominis
PEIKN

SEQ ID NO: 2155704 - protein, 4 aa, Cryptosporidium hominis
PEIN

SEQ ID NO: 2155705 - protein, 4 aa, Cryptosporidium hominis
PEIT

SEQ ID NO: 2155706 - protein, 5 aa, Cryptosporidium hominis
PEITE

SEQ ID NO: 2155707 - protein, 13 aa, Cryptosporidium hominis
PEKDRRRTGNSVG

SEQ ID NO: 2155708 - protein, 5 aa, Cryptosporidium hominis
PEKDY

SEQ ID NO: 2155709 - protein, 8 aa, Cryptosporidium hominis
PEKENSSI

SEQ ID NO: 2155710 - protein, 20 aa, Cryptosporidium hominis
PEKEQETKNLNEVKRKKRKI

SEQ ID NO: 2155711 - protein, 8 aa, Cryptosporidium hominis
PEKETDEI

SEQ ID NO: 2155712 - protein, 8 aa, Cryptosporidium hominis
PEKKCDEK

SEQ ID NO: 2155713 - protein, 9 aa, Cryptosporidium hominis
PEKKYGEME

SEQ ID NO: 2155714 - protein, 4 aa, Cryptosporidium hominis
PEKL

SEQ ID NO: 2155715 - protein, 8 aa, Cryptosporidium hominis
PEKNENFR

SEQ ID NO: 2155716 - protein, 7 aa, Cryptosporidium hominis
PEKNGNY

SEQ ID NO: 2155717 - protein, 15 aa, Cryptosporidium hominis
PEKNTPSIEHNSDKG

SEQ ID NO: 2155718 - protein, 8 aa, Cryptosporidium hominis
PEKSLQDE

SEQ ID NO: 2155719 - protein, 5 aa, Cryptosporidium hominis
PELDG

SEQ ID NO: 2155720 - protein, 4 aa, Cryptosporidium hominis
PELE

SEQ ID NO: 2155721 - protein, 8 aa, Cryptosporidium hominis
PELEPEPE

SEQ ID NO: 2155722 - protein, 4 aa, Cryptosporidium hominis
PELP

SEQ ID NO: 2155723 - protein, 8 aa, Cryptosporidium hominis
PELPEEGV

SEQ ID NO: 2155724 - protein, 4 aa, Cryptosporidium hominis
PELR

SEQ ID NO: 2155725 - protein, 5 aa, Cryptosporidium hominis
PEMQS

SEQ ID NO: 2155726 - protein, 5 aa, Cryptosporidium hominis
PENLK

SEQ ID NO: 2155727 - protein, 4 aa, Cryptosporidium hominis
PENN

SEQ ID NO: 2155728 - protein, 4 aa, Cryptosporidium hominis
PENP

SEQ ID NO: 2155729 - protein, 5 aa, Cryptosporidium hominis
PENRL

SEQ ID NO: 2155730 - protein, 7 aa, Cryptosporidium hominis
PENSERE

SEQ ID NO: 2155731 - protein, 6 aa, Cryptosporidium hominis
PENSKT

SEQ ID NO: 2155732 - protein, 5 aa, Cryptosporidium hominis
PENTD

SEQ ID NO: 2155733 - protein, 11 aa, Cryptosporidium hominis
PENVESPATSV

SEQ ID NO: 2155734 - protein, 4 aa, Cryptosporidium hominis
PEPD

SEQ ID NO: 2155735 - protein, 9 aa, Cryptosporidium hominis
PEPENQGKD

SEQ ID NO: 2155736 - protein, 16 aa, Cryptosporidium hominis
PEPGKRVTKSFNPRHY

SEQ ID NO: 2155737 - protein, 7 aa, Cryptosporidium hominis
PEPKYDQ

SEQ ID NO: 2155738 - protein, 7 aa, Cryptosporidium hominis
PEPNSRW

SEQ ID NO: 2155739 - protein, 4 aa, Cryptosporidium hominis
PEPR

SEQ ID NO: 2155740 - protein, 9 aa, Cryptosporidium hominis
PEPSSISSI

SEQ ID NO: 2155741 - protein, 26 aa, Cryptosporidium hominis
PEPVVDSSKKNSKKKSISGGAKVNPS

SEQ ID NO: 2155742 - protein, 8 aa, Cryptosporidium hominis
PEQDKTIV

SEQ ID NO: 2155743 - protein, 32 aa, Cryptosporidium hominis
PEQEGGPVDISQSNNTVGLSQKGSQSNLSNNA

SEQ ID NO: 2155744 - protein, 10 aa, Cryptosporidium hominis
PEQEGTKEPS

SEQ ID NO: 2155745 - protein, 16 aa, Cryptosporidium hominis
PEQEKGPWERKAQEFK

SEQ ID NO: 2155746 - protein, 6 aa, Cryptosporidium hominis
PEQKGV

SEQ ID NO: 2155747 - protein, 14 aa, Cryptosporidium hominis
PEQQTQQIAGAQAQ

SEQ ID NO: 2155748 - protein, 12 aa, Cryptosporidium hominis
PESDESVYGDSE

SEQ ID NO: 2155749 - protein, 10 aa, Cryptosporidium hominis
PESDGSESFN

SEQ ID NO: 2155750 - protein, 5 aa, Cryptosporidium hominis
PESDS

SEQ ID NO: 2155751 - protein, 9 aa, Cryptosporidium hominis
PESDSYKIN

SEQ ID NO: 2155752 - protein, 5 aa, Cryptosporidium hominis
PESEI

SEQ ID NO: 2155753 - protein, 4 aa, Cryptosporidium hominis
PESF

SEQ ID NO: 2155754 - protein, 9 aa, Cryptosporidium hominis
PESGSNFNS

SEQ ID NO: 2155755 - protein, 7 aa, Cryptosporidium hominis
PESHPSY

SEQ ID NO: 2155756 - protein, 6 aa, Cryptosporidium hominis
PESIPN

SEQ ID NO: 2155757 - protein, 12 aa, Cryptosporidium hominis
PESKDEKHKEAY

SEQ ID NO: 2155758 - protein, 40 aa, Cryptosporidium hominis
PESNNKNNNVSSNNGFSPMRTGTSFSSSNSFGNNPSDDKY

SEQ ID NO: 2155759 - protein, 4 aa, Cryptosporidium hominis
PETG

SEQ ID NO: 2155760 - protein, 12 aa, Cryptosporidium hominis
PETGIPKLFTKV

SEQ ID NO: 2155761 - protein, 5 aa, Cryptosporidium hominis
PETGQ

SEQ ID NO: 2155762 - protein, 9 aa, Cryptosporidium hominis
PETKDLDHD

SEQ ID NO: 2155763 - protein, 16 aa, Cryptosporidium hominis
PETKKFTKTQEPGSKR

SEQ ID NO: 2155764 - protein, 4 aa, Cryptosporidium hominis
PETL

SEQ ID NO: 2155765 - protein, 17 aa, Cryptosporidium hominis
PETPYSAAPGSSREGIT

SEQ ID NO: 2155766 - protein, 7 aa, Cryptosporidium hominis
PETRRKY

SEQ ID NO: 2155767 - protein, 7 aa, Cryptosporidium hominis
PETTGPN

SEQ ID NO: 2155768 - protein, 4 aa, Cryptosporidium hominis
PEVE

SEQ ID NO: 2155769 - protein, 12 aa, Cryptosporidium hominis
PEVNSKPREFSS

SEQ ID NO: 2155770 - protein, 9 aa, Cryptosporidium hominis
PEVQSKITS

SEQ ID NO: 2155771 - protein, 10 aa, Cryptosporidium hominis
PEVRSPMDSL

SEQ ID NO: 2155772 - protein, 7 aa, Cryptosporidium hominis
PEYEQSK

SEQ ID NO: 2155773 - protein, 6 aa, Cryptosporidium hominis
PEYPKG

SEQ ID NO: 2155774 - protein, 7 aa, Cryptosporidium hominis
PEYSTLS

SEQ ID NO: 2155775 - protein, 4 aa, Cryptosporidium hominis
PFAQ

SEQ ID NO: 2155776 - protein, 7 aa, Cryptosporidium hominis
PFDPKEK

SEQ ID NO: 2155777 - protein, 8 aa, Cryptosporidium hominis
PFDPNTYP

SEQ ID NO: 2155778 - protein, 6 aa, Cryptosporidium hominis
PFESDD

SEQ ID NO: 2155779 - protein, 6 aa, Cryptosporidium hominis
PFETPY

SEQ ID NO: 2155780 - protein, 12 aa, Cryptosporidium hominis
PFGSNKSDNLCA

SEQ ID NO: 2155781 - protein, 6 aa, Cryptosporidium hominis
PFHGSN

SEQ ID NO: 2155782 - protein, 5 aa, Cryptosporidium hominis
PFHKT

SEQ ID NO: 2155783 - protein, 5 aa, Cryptosporidium hominis
PFKNS

SEQ ID NO: 2155784 - protein, 7 aa, Cryptosporidium hominis
PFKPPKV

SEQ ID NO: 2155785 - protein, 7 aa, Cryptosporidium hominis
PFKRPSS

SEQ ID NO: 2155786 - protein, 4 aa, Cryptosporidium hominis
PFNA

SEQ ID NO: 2155787 - protein, 7 aa, Cryptosporidium hominis
PFNPPTG

SEQ ID NO: 2155788 - protein, 5 aa, Cryptosporidium hominis
PFPFE

SEQ ID NO: 2155789 - protein, 7 aa, Cryptosporidium hominis
PFPGPPA

SEQ ID NO: 2155790 - protein, 5 aa, Cryptosporidium hominis
PFPSE

SEQ ID NO: 2155791 - protein, 4 aa, Cryptosporidium hominis
PFQT

SEQ ID NO: 2155792 - protein, 11 aa, Cryptosporidium hominis
PFQTDSQPHFE

SEQ ID NO: 2155793 - protein, 4 aa, Cryptosporidium hominis
PFRS

SEQ ID NO: 2155794 - protein, 8 aa, Cryptosporidium hominis
PFSAPTDS

SEQ ID NO: 2155795 - protein, 12 aa, Cryptosporidium hominis
PFSGKDTTGYIQ

SEQ ID NO: 2155796 - protein, 9 aa, Cryptosporidium hominis
PFSKTERKK

SEQ ID NO: 2155797 - protein, 6 aa, Cryptosporidium hominis
PFSNGS

SEQ ID NO: 2155798 - protein, 19 aa, Cryptosporidium hominis
PFSPSSNSIPQSQSQFPQI

SEQ ID NO: 2155799 - protein, 4 aa, Cryptosporidium hominis
PFTN

SEQ ID NO: 2155800 - protein, 5 aa, Cryptosporidium hominis
PFYTP

SEQ ID NO: 2155801 - protein, 14 aa, Cryptosporidium hominis
PGAGKNELIKPNGR

SEQ ID NO: 2155802 - protein, 9 aa, Cryptosporidium hominis
PGAGYANFD

SEQ ID NO: 2155803 - protein, 10 aa, Cryptosporidium hominis
PGAHKGEGLG

SEQ ID NO: 2155804 - protein, 12 aa, Cryptosporidium hominis
PGASHKLGNSQS

SEQ ID NO: 2155805 - protein, 5 aa, Cryptosporidium hominis
PGDAF

SEQ ID NO: 2155806 - protein, 5 aa, Cryptosporidium hominis
PGDEH

SEQ ID NO: 2155807 - protein, 4 aa, Cryptosporidium hominis
PGDG

SEQ ID NO: 2155808 - protein, 12 aa, Cryptosporidium hominis
PGDKIQTEPNYI

SEQ ID NO: 2155809 - protein, 4 aa, Cryptosporidium hominis
PGDL

SEQ ID NO: 2155810 - protein, 11 aa, Cryptosporidium hominis
PGDLPSDSSPQ

SEQ ID NO: 2155811 - protein, 13 aa, Cryptosporidium hominis
PGDPGPPGGDCSG

SEQ ID NO: 2155812 - protein, 7 aa, Cryptosporidium hominis
PGDPKRR

SEQ ID NO: 2155813 - protein, 8 aa, Cryptosporidium hominis
PGDSCPPA

SEQ ID NO: 2155814 - protein, 5 aa, Cryptosporidium hominis
PGEDV

SEQ ID NO: 2155815 - protein, 8 aa, Cryptosporidium hominis
PGEIPSSV

SEQ ID NO: 2155816 - protein, 4 aa, Cryptosporidium hominis
PGEL

SEQ ID NO: 2155817 - protein, 5 aa, Cryptosporidium hominis
PGEQK

SEQ ID NO: 2155818 - protein, 8 aa, Cryptosporidium hominis
PGETDECQ

SEQ ID NO: 2155819 - protein, 6 aa, Cryptosporidium hominis
PGFGDH

SEQ ID NO: 2155820 - protein, 5 aa, Cryptosporidium hominis
PGFRD

SEQ ID NO: 2155821 - protein, 4 aa, Cryptosporidium hominis
PGFS

SEQ ID NO: 2155822 - protein, 4 aa, Cryptosporidium hominis
PGGE

SEQ ID NO: 2155823 - protein, 6 aa, Cryptosporidium hominis
PGGEIE

SEQ ID NO: 2155824 - protein, 4 aa, Cryptosporidium hominis
PGGG

SEQ ID NO: 2155825 - protein, 9 aa, Cryptosporidium hominis
PGGNDGPSG

SEQ ID NO: 2155826 - protein, 20 aa, Cryptosporidium hominis
PGGPKFEPLNSTSFDEDEDW

SEQ ID NO: 2155827 - protein, 6 aa, Cryptosporidium hominis
PGGRPS

SEQ ID NO: 2155828 - protein, 13 aa, Cryptosporidium hominis
PGGSTSSRAAATA

SEQ ID NO: 2155829 - protein, 8 aa, Cryptosporidium hominis
PGGVGSPG

SEQ ID NO: 2155830 - protein, 15 aa, Cryptosporidium hominis
PGHDRYNEQESPDER

SEQ ID NO: 2155831 - protein, 5 aa, Cryptosporidium hominis
PGHES

SEQ ID NO: 2155832 - protein, 7 aa, Cryptosporidium hominis
PGHPMKP

SEQ ID NO: 2155833 - protein, 12 aa, Cryptosporidium hominis
PGHSSKKSYRNV

SEQ ID NO: 2155834 - protein, 64 aa, Cryptosporidium hominis
PGIGAGSAGLGGRTYKSDPYSNNMGGIGSAGGASMGGNSTIGTRGRRGYGSGSTTTTTTTRSGR

SEQ ID NO: 2155835 - protein, 18 aa, Cryptosporidium hominis
PGIPGPSGVQAPNVPNPL

SEQ ID NO: 2155836 - protein, 4 aa, Cryptosporidium hominis
PGIS

SEQ ID NO: 2155837 - protein, 13 aa, Cryptosporidium hominis
PGKAQFNETYEPS

SEQ ID NO: 2155838 - protein, 9 aa, Cryptosporidium hominis
PGKNEDKRS

SEQ ID NO: 2155839 - protein, 11 aa, Cryptosporidium hominis
PGKPQGENGGI

SEQ ID NO: 2155840 - protein, 10 aa, Cryptosporidium hominis
PGKQEVPHNP

SEQ ID NO: 2155841 - protein, 9 aa, Cryptosporidium hominis
PGKRPFGST

SEQ ID NO: 2155842 - protein, 40 aa, Cryptosporidium hominis
PGKVSGTAMNSATSVSTSSSNQVQSTPNLRQTGNTSMGTI

SEQ ID NO: 2155843 - protein, 5 aa, Cryptosporidium hominis
PGLAK

SEQ ID NO: 2155844 - protein, 9 aa, Cryptosporidium hominis
PGLNKAGKF

SEQ ID NO: 2155845 - protein, 15 aa, Cryptosporidium hominis
PGLSKDTSEILNSID

SEQ ID NO: 2155846 - protein, 4 aa, Cryptosporidium hominis
PGNE

SEQ ID NO: 2155847 - protein, 5 aa, Cryptosporidium hominis
PGNKD

SEQ ID NO: 2155848 - protein, 11 aa, Cryptosporidium hominis
PGNLENPGNIS

SEQ ID NO: 2155849 - protein, 7 aa, Cryptosporidium hominis
PGNNTDY

SEQ ID NO: 2155850 - protein, 10 aa, Cryptosporidium hominis
PGNNYNRSNY

SEQ ID NO: 2155851 - protein, 4 aa, Cryptosporidium hominis
PGNP

SEQ ID NO: 2155852 - protein, 18 aa, Cryptosporidium hominis
PGNPVSAAAAAAAAAASA

SEQ ID NO: 2155853 - protein, 7 aa, Cryptosporidium hominis
PGNSESE

SEQ ID NO: 2155854 - protein, 4 aa, Cryptosporidium hominis
PGNT

SEQ ID NO: 2155855 - protein, 5 aa, Cryptosporidium hominis
PGNTA

SEQ ID NO: 2155856 - protein, 33 aa, Cryptosporidium hominis
PGNYSSDVKSKTSVYRDREKAEEGAGDENILEN

SEQ ID NO: 2155857 - protein, 4 aa, Cryptosporidium hominis
PGPG

SEQ ID NO: 2155858 - protein, 6 aa, Cryptosporidium hominis
PGPPHH

SEQ ID NO: 2155859 - protein, 12 aa, Cryptosporidium hominis
PGQETKAMPSSS

SEQ ID NO: 2155860 - protein, 6 aa, Cryptosporidium hominis
PGQKYA

SEQ ID NO: 2155861 - protein, 16 aa, Cryptosporidium hominis
PGQPVQPTWEPEENLN

SEQ ID NO: 2155862 - protein, 16 aa, Cryptosporidium hominis
PGQSGDLETKHNIENG

SEQ ID NO: 2155863 - protein, 7 aa, Cryptosporidium hominis
PGRDQEE

SEQ ID NO: 2155864 - protein, 11 aa, Cryptosporidium hominis
PGRDSISKNVN

SEQ ID NO: 2155865 - protein, 8 aa, Cryptosporidium hominis
PGRGDTRH

SEQ ID NO: 2155866 - protein, 6 aa, Cryptosporidium hominis
PGRGSS

SEQ ID NO: 2155867 - protein, 4 aa, Cryptosporidium hominis
PGRL

SEQ ID NO: 2155868 - protein, 15 aa, Cryptosporidium hominis
PGRTRNGNSYFFHRV

SEQ ID NO: 2155869 - protein, 7 aa, Cryptosporidium hominis
PGRTTHA

SEQ ID NO: 2155870 - protein, 28 aa, Cryptosporidium hominis
PGSAARKPVRSSKGQKTEVSSSIKPQNR

SEQ ID NO: 2155871 - protein, 10 aa, Cryptosporidium hominis
PGSAKISRES

SEQ ID NO: 2155872 - protein, 20 aa, Cryptosporidium hominis
PGSANLPVGTASAAQSQLTP

SEQ ID NO: 2155873 - protein, 7 aa, Cryptosporidium hominis
PGSGKTT

SEQ ID NO: 2155874 - protein, 7 aa, Cryptosporidium hominis
PGSHNSK

SEQ ID NO: 2155875 - protein, 5 aa, Cryptosporidium hominis
PGSIK

SEQ ID NO: 2155876 - protein, 16 aa, Cryptosporidium hominis
PGSIPGSPNFPCYGNK

SEQ ID NO: 2155877 - protein, 5 aa, Cryptosporidium hominis
PGSNT

SEQ ID NO: 2155878 - protein, 8 aa, Cryptosporidium hominis
PGSSNSGL

SEQ ID NO: 2155879 - protein, 8 aa, Cryptosporidium hominis
PGTATGAF

SEQ ID NO: 2155880 - protein, 5 aa, Cryptosporidium hominis
PGTCQ

SEQ ID NO: 2155881 - protein, 6 aa, Cryptosporidium hominis
PGTGKY

SEQ ID NO: 2155882 - protein, 7 aa, Cryptosporidium hominis
PGTLTNQ

SEQ ID NO: 2155883 - protein, 5 aa, Cryptosporidium hominis
PGTMD

SEQ ID NO: 2155884 - protein, 8 aa, Cryptosporidium hominis
PGTPSSRE

SEQ ID NO: 2155885 - protein, 28 aa, Cryptosporidium hominis
PGTSRTRNFRSNHRNDISRSCNNYSSAD

SEQ ID NO: 2155886 - protein, 5 aa, Cryptosporidium hominis
PGVAK

SEQ ID NO: 2155887 - protein, 7 aa, Cryptosporidium hominis
PGVHPTT

SEQ ID NO: 2155888 - protein, 29 aa, Cryptosporidium hominis
PGVPQASHNGGTSVNGGDLQQANNTRSNN

SEQ ID NO: 2155889 - protein, 9 aa, Cryptosporidium hominis
PGVTDDDQL

SEQ ID NO: 2155890 - protein, 8 aa, Cryptosporidium hominis
PGVTTDAI

SEQ ID NO: 2155891 - protein, 25 aa, Cryptosporidium hominis
PGWKDGTKLTYSGEGDQESPGTSPG

SEQ ID NO: 2155892 - protein, 10 aa, Cryptosporidium hominis
PGYDSNSPNL

SEQ ID NO: 2155893 - protein, 4 aa, Cryptosporidium hominis
PGYS

SEQ ID NO: 2155894 - protein, 5 aa, Cryptosporidium hominis
PHAGP

SEQ ID NO: 2155895 - protein, 6 aa, Cryptosporidium hominis
PHEENE

SEQ ID NO: 2155896 - protein, 5 aa, Cryptosporidium hominis
PHGHG

SEQ ID NO: 2155897 - protein, 6 aa, Cryptosporidium hominis
PHHEDS

SEQ ID NO: 2155898 - protein, 31 aa, Cryptosporidium hominis
PHHTTSGAGINPTTTDPNTGIRDPFLPQTFK

SEQ ID NO: 2155899 - protein, 8 aa, Cryptosporidium hominis
PHKRPSAE

SEQ ID NO: 2155900 - protein, 7 aa, Cryptosporidium hominis
PHKSPQS

SEQ ID NO: 2155901 - protein, 4 aa, Cryptosporidium hominis
PHLN

SEQ ID NO: 2155902 - protein, 8 aa, Cryptosporidium hominis
PHLPPPPN

SEQ ID NO: 2155903 - protein, 4 aa, Cryptosporidium hominis
PHNA

SEQ ID NO: 2155904 - protein, 9 aa, Cryptosporidium hominis
PHPKRGITS

SEQ ID NO: 2155905 - protein, 12 aa, Cryptosporidium hominis
PHPNPSPPKGKW

SEQ ID NO: 2155906 - protein, 5 aa, Cryptosporidium hominis
PHPRP

SEQ ID NO: 2155907 - protein, 6 aa, Cryptosporidium hominis
PHPRTA

SEQ ID NO: 2155908 - protein, 37 aa, Cryptosporidium hominis
PHPRTGLPKSPKIKTRTLSNTKKAMDSAKEQKKTPIR

SEQ ID NO: 2155909 - protein, 9 aa, Cryptosporidium hominis
PHPTTPTPD

SEQ ID NO: 2155910 - protein, 15 aa, Cryptosporidium hominis
PHPVGEESSDDFGTK

SEQ ID NO: 2155911 - protein, 7 aa, Cryptosporidium hominis
PHQENTG

SEQ ID NO: 2155912 - protein, 11 aa, Cryptosporidium hominis
PHSNSPTHHGH

SEQ ID NO: 2155913 - protein, 7 aa, Cryptosporidium hominis
PHSPPND

SEQ ID NO: 2155914 - protein, 5 aa, Cryptosporidium hominis
PHSPS

SEQ ID NO: 2155915 - protein, 7 aa, Cryptosporidium hominis
PHSTPHN

SEQ ID NO: 2155916 - protein, 7 aa, Cryptosporidium hominis
PHSVTTT

SEQ ID NO: 2155917 - protein, 4 aa, Cryptosporidium hominis
PHYE

SEQ ID NO: 2155918 - protein, 5 aa, Cryptosporidium hominis
PIADD

SEQ ID NO: 2155919 - protein, 11 aa, Cryptosporidium hominis
PIARDSGNKGK

SEQ ID NO: 2155920 - protein, 4 aa, Cryptosporidium hominis
PIDD

SEQ ID NO: 2155921 - protein, 18 aa, Cryptosporidium hominis
PIDDNSRKVLGPSKNKFT

SEQ ID NO: 2155922 - protein, 4 aa, Cryptosporidium hominis
PIDP

SEQ ID NO: 2155923 - protein, 4 aa, Cryptosporidium hominis
PIDS

SEQ ID NO: 2155924 - protein, 8 aa, Cryptosporidium hominis
PIDSNYQG

SEQ ID NO: 2155925 - protein, 13 aa, Cryptosporidium hominis
PIDSSERSSIKEK

SEQ ID NO: 2155926 - protein, 10 aa, Cryptosporidium hominis
PIEDNDESLS

SEQ ID NO: 2155927 - protein, 13 aa, Cryptosporidium hominis
PIEEEDFDNEKKH

SEQ ID NO: 2155928 - protein, 16 aa, Cryptosporidium hominis
PIEESEEALSETCSED

SEQ ID NO: 2155929 - protein, 4 aa, Cryptosporidium hominis
PIEK

SEQ ID NO: 2155930 - protein, 7 aa, Cryptosporidium hominis
PIESTKN

SEQ ID NO: 2155931 - protein, 6 aa, Cryptosporidium hominis
PIETTT

SEQ ID NO: 2155932 - protein, 7 aa, Cryptosporidium hominis
PIFPGDS

SEQ ID NO: 2155933 - protein, 16 aa, Cryptosporidium hominis
PIGKKESSSESVEKKR

SEQ ID NO: 2155934 - protein, 5 aa, Cryptosporidium hominis
PIGTP

SEQ ID NO: 2155935 - protein, 14 aa, Cryptosporidium hominis
PIHSPESTSGPKKD

SEQ ID NO: 2155936 - protein, 12 aa, Cryptosporidium hominis
PIKDEQENSEFS

SEQ ID NO: 2155937 - protein, 14 aa, Cryptosporidium hominis
PIKKSKNKPGKRDR

SEQ ID NO: 2155938 - protein, 4 aa, Cryptosporidium hominis
PIKP

SEQ ID NO: 2155939 - protein, 12 aa, Cryptosporidium hominis
PIKRGKDSLSSI

SEQ ID NO: 2155940 - protein, 18 aa, Cryptosporidium hominis
PIKSKSKEHIELSEEDKN

SEQ ID NO: 2155941 - protein, 7 aa, Cryptosporidium hominis
PIKTPEG

SEQ ID NO: 2155942 - protein, 4 aa, Cryptosporidium hominis
PIKY

SEQ ID NO: 2155943 - protein, 14 aa, Cryptosporidium hominis
PILSDESDEYSETC

SEQ ID NO: 2155944 - protein, 10 aa, Cryptosporidium hominis
PINKTSPSHL

SEQ ID NO: 2155945 - protein, 15 aa, Cryptosporidium hominis
PINQPSQGQTVSYRN

SEQ ID NO: 2155946 - protein, 4 aa, Cryptosporidium hominis
PINS

SEQ ID NO: 2155947 - protein, 44 aa, Cryptosporidium hominis
PINSSENQVSQRDSPPTFRENNDQEGENKKDESNQLEDRKTVDT

SEQ ID NO: 2155948 - protein, 10 aa, Cryptosporidium hominis
PINSSKDCPN

SEQ ID NO: 2155949 - protein, 11 aa, Cryptosporidium hominis
PINSSSTSINK

SEQ ID NO: 2155950 - protein, 4 aa, Cryptosporidium hominis
PINT

SEQ ID NO: 2155951 - protein, 8 aa, Cryptosporidium hominis
PINTGYDK

SEQ ID NO: 2155952 - protein, 5 aa, Cryptosporidium hominis
PIPEM

SEQ ID NO: 2155953 - protein, 42 aa, Cryptosporidium hominis
PIPENPVAPNPTNITPVNSNASLNAGLTPSEELSSEQLPGNL

SEQ ID NO: 2155954 - protein, 9 aa, Cryptosporidium hominis
PIPGAPNGG

SEQ ID NO: 2155955 - protein, 4 aa, Cryptosporidium hominis
PIPI

SEQ ID NO: 2155956 - protein, 5 aa, Cryptosporidium hominis
PIPNC

SEQ ID NO: 2155957 - protein, 7 aa, Cryptosporidium hominis
PIPNQSS

SEQ ID NO: 2155958 - protein, 8 aa, Cryptosporidium hominis
PIPNSEPF

SEQ ID NO: 2155959 - protein, 12 aa, Cryptosporidium hominis
PIPNSSEISNRD

SEQ ID NO: 2155960 - protein, 5 aa, Cryptosporidium hominis
PIPNY

SEQ ID NO: 2155961 - protein, 17 aa, Cryptosporidium hominis
PIPPPGVPPLPPNIHGN

SEQ ID NO: 2155962 - protein, 7 aa, Cryptosporidium hominis
PIPQEVN

SEQ ID NO: 2155963 - protein, 10 aa, Cryptosporidium hominis
PIPSHQDKEC

SEQ ID NO: 2155964 - protein, 5 aa, Cryptosporidium hominis
PIPTK

SEQ ID NO: 2155965 - protein, 16 aa, Cryptosporidium hominis
PIQETSPIQETPPINE

SEQ ID NO: 2155966 - protein, 7 aa, Cryptosporidium hominis
PIQRESS

SEQ ID NO: 2155967 - protein, 6 aa, Cryptosporidium hominis
PIQTRT

SEQ ID NO: 2155968 - protein, 4 aa, Cryptosporidium hominis
PIRN

SEQ ID NO: 2155969 - protein, 5 aa, Cryptosporidium hominis
PISEE

SEQ ID NO: 2155970 - protein, 5 aa, Cryptosporidium hominis
PISGE

SEQ ID NO: 2155971 - protein, 4 aa, Cryptosporidium hominis
PISL

SEQ ID NO: 2155972 - protein, 10 aa, Cryptosporidium hominis
PISPHPNSHT

SEQ ID NO: 2155973 - protein, 6 aa, Cryptosporidium hominis
PISPNT

SEQ ID NO: 2155974 - protein, 12 aa, Cryptosporidium hominis
PISPQKNTADCK

SEQ ID NO: 2155975 - protein, 6 aa, Cryptosporidium hominis
PISPSN

SEQ ID NO: 2155976 - protein, 8 aa, Cryptosporidium hominis
PISQANPV

SEQ ID NO: 2155977 - protein, 21 aa, Cryptosporidium hominis
PISQASAKQRSGRAGRTGPGK

SEQ ID NO: 2155978 - protein, 12 aa, Cryptosporidium hominis
PISQEGKNPSSL

SEQ ID NO: 2155979 - protein, 17 aa, Cryptosporidium hominis
PISSHNSNESSKPETFR

SEQ ID NO: 2155980 - protein, 13 aa, Cryptosporidium hominis
PISSRENVGKESF

SEQ ID NO: 2155981 - protein, 22 aa, Cryptosporidium hominis
PISTNSGDQNINSDQNGSNNAK

SEQ ID NO: 2155982 - protein, 7 aa, Cryptosporidium hominis
PITPESL

SEQ ID NO: 2155983 - protein, 36 aa, Cryptosporidium hominis
PITSSSSSSSSSSSSSSSSSSSSSSSSSSSSSSVHN

SEQ ID NO: 2155984 - protein, 5 aa, Cryptosporidium hominis
PIYDE

SEQ ID NO: 2155985 - protein, 10 aa, Cryptosporidium hominis
PIYNEEDNQF

SEQ ID NO: 2155986 - protein, 4 aa, Cryptosporidium hominis
PIYR

SEQ ID NO: 2155987 - protein, 8 aa, Cryptosporidium hominis
PKADCNEE

SEQ ID NO: 2155988 - protein, 7 aa, Cryptosporidium hominis
PKAINSE

SEQ ID NO: 2155989 - protein, 12 aa, Cryptosporidium hominis
PKANAVKTSKLD

SEQ ID NO: 2155990 - protein, 9 aa, Cryptosporidium hominis
PKAVTTKSD

SEQ ID NO: 2155991 - protein, 13 aa, Cryptosporidium hominis
PKCKRRHEPKARH

SEQ ID NO: 2155992 - protein, 7 aa, Cryptosporidium hominis
PKCTTKE

SEQ ID NO: 2155993 - protein, 10 aa, Cryptosporidium hominis
PKDIDHDQKV

SEQ ID NO: 2155994 - protein, 10 aa, Cryptosporidium hominis
PKDKDKDIAD

SEQ ID NO: 2155995 - protein, 18 aa, Cryptosporidium hominis
PKDKQAQADKKKSKFYHP

SEQ ID NO: 2155996 - protein, 4 aa, Cryptosporidium hominis
PKDN

SEQ ID NO: 2155997 - protein, 7 aa, Cryptosporidium hominis
PKDSTEL

SEQ ID NO: 2155998 - protein, 6 aa, Cryptosporidium hominis
PKDTVS

SEQ ID NO: 2155999 - protein, 5 aa, Cryptosporidium hominis
PKEAG

SEQ ID NO: 2156000 - protein, 6 aa, Cryptosporidium hominis
PKEAWK

SEQ ID NO: 2156001 - protein, 9 aa, Cryptosporidium hominis
PKEERTKLS

SEQ ID NO: 2156002 - protein, 9 aa, Cryptosporidium hominis
PKEGADSEA

SEQ ID NO: 2156003 - protein, 10 aa, Cryptosporidium hominis
PKERNSDIKN

SEQ ID NO: 2156004 - protein, 8 aa, Cryptosporidium hominis
PKERSIKG

SEQ ID NO: 2156005 - protein, 10 aa, Cryptosporidium hominis
PKESTPECED

SEQ ID NO: 2156006 - protein, 10 aa, Cryptosporidium hominis
PKEVLGKNGL

SEQ ID NO: 2156007 - protein, 7 aa, Cryptosporidium hominis
PKEVPPS

SEQ ID NO: 2156008 - protein, 9 aa, Cryptosporidium hominis
PKFASTVGS

SEQ ID NO: 2156009 - protein, 4 aa, Cryptosporidium hominis
PKFT

SEQ ID NO: 2156010 - protein, 5 aa, Cryptosporidium hominis
PKGDT

SEQ ID NO: 2156011 - protein, 4 aa, Cryptosporidium hominis
PKGE

SEQ ID NO: 2156012 - protein, 15 aa, Cryptosporidium hominis
PKGEMKGSAITGPVG

SEQ ID NO: 2156013 - protein, 14 aa, Cryptosporidium hominis
PKGGFEPTSNNSKL

SEQ ID NO: 2156014 - protein, 7 aa, Cryptosporidium hominis
PKGIELG

SEQ ID NO: 2156015 - protein, 9 aa, Cryptosporidium hominis
PKGLNASSE

SEQ ID NO: 2156016 - protein, 5 aa, Cryptosporidium hominis
PKGLP

SEQ ID NO: 2156017 - protein, 7 aa, Cryptosporidium hominis
PKGNDQK

SEQ ID NO: 2156018 - protein, 9 aa, Cryptosporidium hominis
PKGYDGRVS

SEQ ID NO: 2156019 - protein, 10 aa, Cryptosporidium hominis
PKHPGKDETM

SEQ ID NO: 2156020 - protein, 4 aa, Cryptosporidium hominis
PKHS

SEQ ID NO: 2156021 - protein, 12 aa, Cryptosporidium hominis
PKHYNNRNEDDF

SEQ ID NO: 2156022 - protein, 10 aa, Cryptosporidium hominis
PKIDDNKTDF

SEQ ID NO: 2156023 - protein, 4 aa, Cryptosporidium hominis
PKIF

SEQ ID NO: 2156024 - protein, 9 aa, Cryptosporidium hominis
PKIGHTNNP

SEQ ID NO: 2156025 - protein, 4 aa, Cryptosporidium hominis
PKIN

SEQ ID NO: 2156026 - protein, 7 aa, Cryptosporidium hominis
PKIPPEQ

SEQ ID NO: 2156027 - protein, 12 aa, Cryptosporidium hominis
PKKDSLQNDEEI

SEQ ID NO: 2156028 - protein, 10 aa, Cryptosporidium hominis
PKKENNTLES

SEQ ID NO: 2156029 - protein, 34 aa, Cryptosporidium hominis
PKKKKTKKDFEEESNELGNKLDKGQRTSRKRGNK

SEQ ID NO: 2156030 - protein, 9 aa, Cryptosporidium hominis
PKKLEESKK

SEQ ID NO: 2156031 - protein, 9 aa, Cryptosporidium hominis
PKKLENNKN

SEQ ID NO: 2156032 - protein, 10 aa, Cryptosporidium hominis
PKKSDGTNKG

SEQ ID NO: 2156033 - protein, 7 aa, Cryptosporidium hominis
PKKSLGN

SEQ ID NO: 2156034 - protein, 40 aa, Cryptosporidium hominis
PKKSSEMIPKSNSSDISDYSPTKSTGGAHSQSGTGRTGSN

SEQ ID NO: 2156035 - protein, 7 aa, Cryptosporidium hominis
PKKTEIT

SEQ ID NO: 2156036 - protein, 4 aa, Cryptosporidium hominis
PKKV

SEQ ID NO: 2156037 - protein, 17 aa, Cryptosporidium hominis
PKLAETDDDKEQETSQV

SEQ ID NO: 2156038 - protein, 10 aa, Cryptosporidium hominis
PKLGTDSEQD

SEQ ID NO: 2156039 - protein, 8 aa, Cryptosporidium hominis
PKLSPSTT

SEQ ID NO: 2156040 - protein, 15 aa, Cryptosporidium hominis
PKLSSSSKDKIRKEV

SEQ ID NO: 2156041 - protein, 4 aa, Cryptosporidium hominis
PKLT

SEQ ID NO: 2156042 - protein, 15 aa, Cryptosporidium hominis
PKLTPSSSKRRFSPQ

SEQ ID NO: 2156043 - protein, 28 aa, Cryptosporidium hominis
PKNAQQNKEQNIEQNSQGSLNAQTSSTP

SEQ ID NO: 2156044 - protein, 5 aa, Cryptosporidium hominis
PKNEQ

SEQ ID NO: 2156045 - protein, 7 aa, Cryptosporidium hominis
PKNERKL

SEQ ID NO: 2156046 - protein, 8 aa, Cryptosporidium hominis
PKNIKEGS

SEQ ID NO: 2156047 - protein, 4 aa, Cryptosporidium hominis
PKNL

SEQ ID NO: 2156048 - protein, 20 aa, Cryptosporidium hominis
PKNNSSIYNTPINASTEQFP

SEQ ID NO: 2156049 - protein, 6 aa, Cryptosporidium hominis
PKNQDF

SEQ ID NO: 2156050 - protein, 8 aa, Cryptosporidium hominis
PKNSGKTT

SEQ ID NO: 2156051 - protein, 23 aa, Cryptosporidium hominis
PKNSKVVSNYNSDINSYSRPSSL

SEQ ID NO: 2156052 - protein, 6 aa, Cryptosporidium hominis
PKNSLN

SEQ ID NO: 2156053 - protein, 20 aa, Cryptosporidium hominis
PKNSNFHSRGVKKNKQNYEH

SEQ ID NO: 2156054 - protein, 18 aa, Cryptosporidium hominis
PKNSSRRSSVDEGPPPLG

SEQ ID NO: 2156055 - protein, 8 aa, Cryptosporidium hominis
PKNTDSMN

SEQ ID NO: 2156056 - protein, 5 aa, Cryptosporidium hominis
PKNVE

SEQ ID NO: 2156057 - protein, 13 aa, Cryptosporidium hominis
PKPAPKKKPDNNN

SEQ ID NO: 2156058 - protein, 8 aa, Cryptosporidium hominis
PKPDFGGL

SEQ ID NO: 2156059 - protein, 34 aa, Cryptosporidium hominis
PKPDNKDENIDGKPQKISTLPASKALNAEAPKQF

SEQ ID NO: 2156060 - protein, 5 aa, Cryptosporidium hominis
PKPDS

SEQ ID NO: 2156061 - protein, 7 aa, Cryptosporidium hominis
PKPERGI

SEQ ID NO: 2156062 - protein, 7 aa, Cryptosporidium hominis
PKPGNSM

SEQ ID NO: 2156063 - protein, 12 aa, Cryptosporidium hominis
PKPGVKKEASNF

SEQ ID NO: 2156064 - protein, 9 aa, Cryptosporidium hominis
PKPKRGVRN

SEQ ID NO: 2156065 - protein, 5 aa, Cryptosporidium hominis
PKPLH

SEQ ID NO: 2156066 - protein, 6 aa, Cryptosporidium hominis
PKPPLS

SEQ ID NO: 2156067 - protein, 6 aa, Cryptosporidium hominis
PKPSDY

SEQ ID NO: 2156068 - protein, 14 aa, Cryptosporidium hominis
PKPTPGVKASPHTT

SEQ ID NO: 2156069 - protein, 7 aa, Cryptosporidium hominis
PKPYLKR

SEQ ID NO: 2156070 - protein, 10 aa, Cryptosporidium hominis
PKQISNQSTN

SEQ ID NO: 2156071 - protein, 7 aa, Cryptosporidium hominis
PKQLGNA

SEQ ID NO: 2156072 - protein, 6 aa, Cryptosporidium hominis
PKQLPA

SEQ ID NO: 2156073 - protein, 7 aa, Cryptosporidium hominis
PKQQEEI

SEQ ID NO: 2156074 - protein, 12 aa, Cryptosporidium hominis
PKQSYADAKSGN

SEQ ID NO: 2156075 - protein, 11 aa, Cryptosporidium hominis
PKRCSKGKEIS

SEQ ID NO: 2156076 - protein, 10 aa, Cryptosporidium hominis
PKREKKTKGI

SEQ ID NO: 2156077 - protein, 7 aa, Cryptosporidium hominis
PKRGIGD

SEQ ID NO: 2156078 - protein, 7 aa, Cryptosporidium hominis
PKRGLNR

SEQ ID NO: 2156079 - protein, 8 aa, Cryptosporidium hominis
PKRISGKE

SEQ ID NO: 2156080 - protein, 7 aa, Cryptosporidium hominis
PKRKSRF

SEQ ID NO: 2156081 - protein, 7 aa, Cryptosporidium hominis
PKRSNLS

SEQ ID NO: 2156082 - protein, 20 aa, Cryptosporidium hominis
PKRSSIGDFDNDNDDLDSDL

SEQ ID NO: 2156083 - protein, 7 aa, Cryptosporidium hominis
PKSEFQC

SEQ ID NO: 2156084 - protein, 8 aa, Cryptosporidium hominis
PKSGCKGV

SEQ ID NO: 2156085 - protein, 16 aa, Cryptosporidium hominis
PKSKAALTAARTNANS

SEQ ID NO: 2156086 - protein, 16 aa, Cryptosporidium hominis
PKSKEEYDSEKAESFK

SEQ ID NO: 2156087 - protein, 8 aa, Cryptosporidium hominis
PKSKKAEI

SEQ ID NO: 2156088 - protein, 13 aa, Cryptosporidium hominis
PKSLNDNSSTENQ

SEQ ID NO: 2156089 - protein, 6 aa, Cryptosporidium hominis
PKSPLE

SEQ ID NO: 2156090 - protein, 7 aa, Cryptosporidium hominis
PKSPNST

SEQ ID NO: 2156091 - protein, 4 aa, Cryptosporidium hominis
PKSR

SEQ ID NO: 2156092 - protein, 12 aa, Cryptosporidium hominis
PKSSKGYYYDSP

SEQ ID NO: 2156093 - protein, 7 aa, Cryptosporidium hominis
PKSSPGI

SEQ ID NO: 2156094 - protein, 11 aa, Cryptosporidium hominis
PKSSSTNNTET

SEQ ID NO: 2156095 - protein, 7 aa, Cryptosporidium hominis
PKSSTVE

SEQ ID NO: 2156096 - protein, 9 aa, Cryptosporidium hominis
PKSTARSNL

SEQ ID NO: 2156097 - protein, 6 aa, Cryptosporidium hominis
PKSTLG

SEQ ID NO: 2156098 - protein, 4 aa, Cryptosporidium hominis
PKSV

SEQ ID NO: 2156099 - protein, 30 aa, Cryptosporidium hominis
PKSVSKTTNLEKKSLNSPSNSSSPKSLKNK

SEQ ID NO: 2156100 - protein, 6 aa, Cryptosporidium hominis
PKTDIE

SEQ ID NO: 2156101 - protein, 10 aa, Cryptosporidium hominis
PKTDTNSNGI

SEQ ID NO: 2156102 - protein, 7 aa, Cryptosporidium hominis
PKTEREK

SEQ ID NO: 2156103 - protein, 4 aa, Cryptosporidium hominis
PKTG

SEQ ID NO: 2156104 - protein, 4 aa, Cryptosporidium hominis
PKTH

SEQ ID NO: 2156105 - protein, 12 aa, Cryptosporidium hominis
PKTIASKISSEL

SEQ ID NO: 2156106 - protein, 4 aa, Cryptosporidium hominis
PKTL

SEQ ID NO: 2156107 - protein, 5 aa, Cryptosporidium hominis
PKTNK

SEQ ID NO: 2156108 - protein, 9 aa, Cryptosporidium hominis
PKTPPASPV

SEQ ID NO: 2156109 - protein, 4 aa, Cryptosporidium hominis
PKTQ

SEQ ID NO: 2156110 - protein, 7 aa, Cryptosporidium hominis
PKTRSGK

SEQ ID NO: 2156111 - protein, 6 aa, Cryptosporidium hominis
PKTSEN

SEQ ID NO: 2156112 - protein, 15 aa, Cryptosporidium hominis
PKTSGGYGKGFEGSE

SEQ ID NO: 2156113 - protein, 4 aa, Cryptosporidium hominis
PKTV

SEQ ID NO: 2156114 - protein, 16 aa, Cryptosporidium hominis
PKTYKKENSGDNGEHL

SEQ ID NO: 2156115 - protein, 10 aa, Cryptosporidium hominis
PKVPGISSNN

SEQ ID NO: 2156116 - protein, 16 aa, Cryptosporidium hominis
PKVSEELDSEKTIVGG

SEQ ID NO: 2156117 - protein, 10 aa, Cryptosporidium hominis
PKVSITNSGG

SEQ ID NO: 2156118 - protein, 6 aa, Cryptosporidium hominis
PKVTSS

SEQ ID NO: 2156119 - protein, 5 aa, Cryptosporidium hominis
PKYGS

SEQ ID NO: 2156120 - protein, 11 aa, Cryptosporidium hominis
PKYSNDKDPKI

SEQ ID NO: 2156121 - protein, 4 aa, Cryptosporidium hominis
PLAA

SEQ ID NO: 2156122 - protein, 10 aa, Cryptosporidium hominis
PLAKSGETVI

SEQ ID NO: 2156123 - protein, 5 aa, Cryptosporidium hominis
PLANK

SEQ ID NO: 2156124 - protein, 4 aa, Cryptosporidium hominis
PLAQ

SEQ ID NO: 2156125 - protein, 4 aa, Cryptosporidium hominis
PLDE

SEQ ID NO: 2156126 - protein, 7 aa, Cryptosporidium hominis
PLDNSEQ

SEQ ID NO: 2156127 - protein, 5 aa, Cryptosporidium hominis
PLDPN

SEQ ID NO: 2156128 - protein, 9 aa, Cryptosporidium hominis
PLDSSHRQN

SEQ ID NO: 2156129 - protein, 8 aa, Cryptosporidium hominis
PLEDSTPS

SEQ ID NO: 2156130 - protein, 5 aa, Cryptosporidium hominis
PLEEP

SEQ ID NO: 2156131 - protein, 8 aa, Cryptosporidium hominis
PLEKKNSW

SEQ ID NO: 2156132 - protein, 6 aa, Cryptosporidium hominis
PLEKNP

SEQ ID NO: 2156133 - protein, 19 aa, Cryptosporidium hominis
PLEPEEKVEPEAAPNKPLK

SEQ ID NO: 2156134 - protein, 7 aa, Cryptosporidium hominis
PLESRSK

SEQ ID NO: 2156135 - protein, 7 aa, Cryptosporidium hominis
PLGGGEF

SEQ ID NO: 2156136 - protein, 6 aa, Cryptosporidium hominis
PLGGPR

SEQ ID NO: 2156137 - protein, 10 aa, Cryptosporidium hominis
PLGNDNGSGM

SEQ ID NO: 2156138 - protein, 5 aa, Cryptosporidium hominis
PLGTS

SEQ ID NO: 2156139 - protein, 7 aa, Cryptosporidium hominis
PLHENQR

SEQ ID NO: 2156140 - protein, 22 aa, Cryptosporidium hominis
PLIPSSSSSPSPSPSPLPSQKN

SEQ ID NO: 2156141 - protein, 14 aa, Cryptosporidium hominis
PLKEEIKEGREKKG

SEQ ID NO: 2156142 - protein, 7 aa, Cryptosporidium hominis
PLKEEQN

SEQ ID NO: 2156143 - protein, 5 aa, Cryptosporidium hominis
PLKGG

SEQ ID NO: 2156144 - protein, 9 aa, Cryptosporidium hominis
PLKNKSEKF

SEQ ID NO: 2156145 - protein, 9 aa, Cryptosporidium hominis
PLKRGSPKI

SEQ ID NO: 2156146 - protein, 10 aa, Cryptosporidium hominis
PLKSTKSNIS

SEQ ID NO: 2156147 - protein, 7 aa, Cryptosporidium hominis
PLNGTEV

SEQ ID NO: 2156148 - protein, 4 aa, Cryptosporidium hominis
PLNK

SEQ ID NO: 2156149 - protein, 5 aa, Cryptosporidium hominis
PLNKS

SEQ ID NO: 2156150 - protein, 4 aa, Cryptosporidium hominis
PLNP

SEQ ID NO: 2156151 - protein, 7 aa, Cryptosporidium hominis
PLNPEIS

SEQ ID NO: 2156152 - protein, 6 aa, Cryptosporidium hominis
PLNPGE

SEQ ID NO: 2156153 - protein, 5 aa, Cryptosporidium hominis
PLPAE

SEQ ID NO: 2156154 - protein, 10 aa, Cryptosporidium hominis
PLPDEPPADH

SEQ ID NO: 2156155 - protein, 26 aa, Cryptosporidium hominis
PLPDGLTDDIEEGKVSPRDDPKERSN

SEQ ID NO: 2156156 - protein, 12 aa, Cryptosporidium hominis
PLPFNDNSETEV

SEQ ID NO: 2156157 - protein, 17 aa, Cryptosporidium hominis
PLPKSSSSKGRNQYKED

SEQ ID NO: 2156158 - protein, 8 aa, Cryptosporidium hominis
PLPNETSR

SEQ ID NO: 2156159 - protein, 25 aa, Cryptosporidium hominis
PLPPKRNGPGWNSHSTGNKLEDSNN

SEQ ID NO: 2156160 - protein, 6 aa, Cryptosporidium hominis
PLPPTK

SEQ ID NO: 2156161 - protein, 5 aa, Cryptosporidium hominis
PLPRG

SEQ ID NO: 2156162 - protein, 11 aa, Cryptosporidium hominis
PLPSPPPLSPP

SEQ ID NO: 2156163 - protein, 30 aa, Cryptosporidium hominis
PLPSSARPNTSSMEDKKKTIPPDVDPKEPF

SEQ ID NO: 2156164 - protein, 5 aa, Cryptosporidium hominis
PLPSY

SEQ ID NO: 2156165 - protein, 10 aa, Cryptosporidium hominis
PLPTTKNGQS

SEQ ID NO: 2156166 - protein, 5 aa, Cryptosporidium hominis
PLPVG

SEQ ID NO: 2156167 - protein, 4 aa, Cryptosporidium hominis
PLQN

SEQ ID NO: 2156168 - protein, 13 aa, Cryptosporidium hominis
PLRPSQTPQTEYE

SEQ ID NO: 2156169 - protein, 4 aa, Cryptosporidium hominis
PLRS

SEQ ID NO: 2156170 - protein, 5 aa, Cryptosporidium hominis
PLSAS

SEQ ID NO: 2156171 - protein, 6 aa, Cryptosporidium hominis
PLSGES

SEQ ID NO: 2156172 - protein, 7 aa, Cryptosporidium hominis
PLSGGSF

SEQ ID NO: 2156173 - protein, 12 aa, Cryptosporidium hominis
PLSNLPPNVSSS

SEQ ID NO: 2156174 - protein, 5 aa, Cryptosporidium hominis
PLSNP

SEQ ID NO: 2156175 - protein, 12 aa, Cryptosporidium hominis
PLSNPSTASSWK

SEQ ID NO: 2156176 - protein, 6 aa, Cryptosporidium hominis
PLSNSQ

SEQ ID NO: 2156177 - protein, 5 aa, Cryptosporidium hominis
PLSPS

SEQ ID NO: 2156178 - protein, 4 aa, Cryptosporidium hominis
PLSQ

SEQ ID NO: 2156179 - protein, 4 aa, Cryptosporidium hominis
PLSR

SEQ ID NO: 2156180 - protein, 11 aa, Cryptosporidium hominis
PLSREEREQLE

SEQ ID NO: 2156181 - protein, 7 aa, Cryptosporidium hominis
PLSSKSH

SEQ ID NO: 2156182 - protein, 6 aa, Cryptosporidium hominis
PLSSNN

SEQ ID NO: 2156183 - protein, 57 aa, Cryptosporidium hominis
PLSSSSSSSSSSSSSSSSSSSSSSSSSSSSSSSSSSSSSSSSSSSSSSSSSSPKNAI

SEQ ID NO: 2156184 - protein, 10 aa, Cryptosporidium hominis
PLSSSTNSSQ

SEQ ID NO: 2156185 - protein, 11 aa, Cryptosporidium hominis
PLSTLRTKKNE

SEQ ID NO: 2156186 - protein, 11 aa, Cryptosporidium hominis
PLSTPDGKKTK

SEQ ID NO: 2156187 - protein, 17 aa, Cryptosporidium hominis
PLTAPKISNSKKSGEII

SEQ ID NO: 2156188 - protein, 10 aa, Cryptosporidium hominis
PLTDNEISRN

SEQ ID NO: 2156189 - protein, 4 aa, Cryptosporidium hominis
PLTE

SEQ ID NO: 2156190 - protein, 5 aa, Cryptosporidium hominis
PLTEK

SEQ ID NO: 2156191 - protein, 7 aa, Cryptosporidium hominis
PLTESES

SEQ ID NO: 2156192 - protein, 9 aa, Cryptosporidium hominis
PLTKPTDFP

SEQ ID NO: 2156193 - protein, 14 aa, Cryptosporidium hominis
PLTPQNTIPENQTS

SEQ ID NO: 2156194 - protein, 13 aa, Cryptosporidium hominis
PLTPTSDPSDPKL

SEQ ID NO: 2156195 - protein, 5 aa, Cryptosporidium hominis
PLTQL

SEQ ID NO: 2156196 - protein, 4 aa, Cryptosporidium hominis
PLTS

SEQ ID NO: 2156197 - protein, 11 aa, Cryptosporidium hominis
PLTSNAAKCPT

SEQ ID NO: 2156198 - protein, 4 aa, Cryptosporidium hominis
PLTT

SEQ ID NO: 2156199 - protein, 11 aa, Cryptosporidium hominis
PLYSESPKKIN

SEQ ID NO: 2156200 - protein, 4 aa, Cryptosporidium hominis
PMED

SEQ ID NO: 2156201 - protein, 10 aa, Cryptosporidium hominis
PMNPKVNRER

SEQ ID NO: 2156202 - protein, 5 aa, Cryptosporidium hominis
PMPDV

SEQ ID NO: 2156203 - protein, 10 aa, Cryptosporidium hominis
PMPSDPTHSS

SEQ ID NO: 2156204 - protein, 8 aa, Cryptosporidium hominis
PMRQGNTK

SEQ ID NO: 2156205 - protein, 5 aa, Cryptosporidium hominis
PMSAA

SEQ ID NO: 2156206 - protein, 7 aa, Cryptosporidium hominis
PMSPDSS

SEQ ID NO: 2156207 - protein, 5 aa, Cryptosporidium hominis
PMTSP

SEQ ID NO: 2156208 - protein, 22 aa, Cryptosporidium hominis
PMYGTNDPEDVASDGLPSHPAI

SEQ ID NO: 2156209 - protein, 10 aa, Cryptosporidium hominis
PNADGSDDED

SEQ ID NO: 2156210 - protein, 8 aa, Cryptosporidium hominis
PNADQETV

SEQ ID NO: 2156211 - protein, 9 aa, Cryptosporidium hominis
PNAGNTTES

SEQ ID NO: 2156212 - protein, 15 aa, Cryptosporidium hominis
PNAIPPNSNPTSLNK

SEQ ID NO: 2156213 - protein, 13 aa, Cryptosporidium hominis
PNAPQNPPYNSRA

SEQ ID NO: 2156214 - protein, 5 aa, Cryptosporidium hominis
PNASA

SEQ ID NO: 2156215 - protein, 4 aa, Cryptosporidium hominis
PNCD

SEQ ID NO: 2156216 - protein, 8 aa, Cryptosporidium hominis
PNCDYSSS

SEQ ID NO: 2156217 - protein, 9 aa, Cryptosporidium hominis
PNDDNSQEN

SEQ ID NO: 2156218 - protein, 7 aa, Cryptosporidium hominis
PNDDSNC

SEQ ID NO: 2156219 - protein, 9 aa, Cryptosporidium hominis
PNDDSNKGI

SEQ ID NO: 2156220 - protein, 4 aa, Cryptosporidium hominis
PNDG

SEQ ID NO: 2156221 - protein, 6 aa, Cryptosporidium hominis
PNDGPD

SEQ ID NO: 2156222 - protein, 7 aa, Cryptosporidium hominis
PNDIGPD

SEQ ID NO: 2156223 - protein, 4 aa, Cryptosporidium hominis
PNDL

SEQ ID NO: 2156224 - protein, 11 aa, Cryptosporidium hominis
PNDNTEQGKEL

SEQ ID NO: 2156225 - protein, 4 aa, Cryptosporidium hominis
PNDQ

SEQ ID NO: 2156226 - protein, 11 aa, Cryptosporidium hominis
PNDQGNRTTPS

SEQ ID NO: 2156227 - protein, 10 aa, Cryptosporidium hominis
PNDTRDPDGC

SEQ ID NO: 2156228 - protein, 10 aa, Cryptosporidium hominis
PNEDTSDSVK

SEQ ID NO: 2156229 - protein, 8 aa, Cryptosporidium hominis
PNEEDGSC

SEQ ID NO: 2156230 - protein, 6 aa, Cryptosporidium hominis
PNEENV

SEQ ID NO: 2156231 - protein, 6 aa, Cryptosporidium hominis
PNEEPN

SEQ ID NO: 2156232 - protein, 4 aa, Cryptosporidium hominis
PNEN

SEQ ID NO: 2156233 - protein, 5 aa, Cryptosporidium hominis
PNEQI

SEQ ID NO: 2156234 - protein, 10 aa, Cryptosporidium hominis
PNEQLTPSSF

SEQ ID NO: 2156235 - protein, 10 aa, Cryptosporidium hominis
PNESGSNIEP

SEQ ID NO: 2156236 - protein, 8 aa, Cryptosporidium hominis
PNESKKPL

SEQ ID NO: 2156237 - protein, 6 aa, Cryptosporidium hominis
PNESND

SEQ ID NO: 2156238 - protein, 12 aa, Cryptosporidium hominis
PNETKERLPNEQ

SEQ ID NO: 2156239 - protein, 4 aa, Cryptosporidium hominis
PNEV

SEQ ID NO: 2156240 - protein, 13 aa, Cryptosporidium hominis
PNFEGNNNNLDSS

SEQ ID NO: 2156241 - protein, 8 aa, Cryptosporidium hominis
PNFKKPKF

SEQ ID NO: 2156242 - protein, 14 aa, Cryptosporidium hominis
PNFQNKRKEYGLNN

SEQ ID NO: 2156243 - protein, 34 aa, Cryptosporidium hominis
PNFQSNNNHHHSTIPSNSSNSNSGNGNWSPTTLG

SEQ ID NO: 2156244 - protein, 12 aa, Cryptosporidium hominis
PNFRKKSNALNN

SEQ ID NO: 2156245 - protein, 10 aa, Cryptosporidium hominis
PNGAGPTQES

SEQ ID NO: 2156246 - protein, 7 aa, Cryptosporidium hominis
PNGDRVS

SEQ ID NO: 2156247 - protein, 4 aa, Cryptosporidium hominis
PNGK

SEQ ID NO: 2156248 - protein, 11 aa, Cryptosporidium hominis
PNGKNQTVDSD

SEQ ID NO: 2156249 - protein, 5 aa, Cryptosporidium hominis
PNGLS

SEQ ID NO: 2156250 - protein, 4 aa, Cryptosporidium hominis
PNGP

SEQ ID NO: 2156251 - protein, 5 aa, Cryptosporidium hominis
PNGPS

SEQ ID NO: 2156252 - protein, 7 aa, Cryptosporidium hominis
PNGSDEK

SEQ ID NO: 2156253 - protein, 20 aa, Cryptosporidium hominis
PNHEGNNSSVKKNTTETNEE

SEQ ID NO: 2156254 - protein, 4 aa, Cryptosporidium hominis
PNHH

SEQ ID NO: 2156255 - protein, 10 aa, Cryptosporidium hominis
PNHMNPTQNT

SEQ ID NO: 2156256 - protein, 6 aa, Cryptosporidium hominis
PNHTTP

SEQ ID NO: 2156257 - protein, 7 aa, Cryptosporidium hominis
PNIDDET

SEQ ID NO: 2156258 - protein, 13 aa, Cryptosporidium hominis
PNIELDNSKEGKN

SEQ ID NO: 2156259 - protein, 5 aa, Cryptosporidium hominis
PNIEP

SEQ ID NO: 2156260 - protein, 8 aa, Cryptosporidium hominis
PNIEPNSK

SEQ ID NO: 2156261 - protein, 16 aa, Cryptosporidium hominis
PNIESKKNTSKSNSGY

SEQ ID NO: 2156262 - protein, 6 aa, Cryptosporidium hominis
PNIGDQ

SEQ ID NO: 2156263 - protein, 11 aa, Cryptosporidium hominis
PNIGGANGGMN

SEQ ID NO: 2156264 - protein, 12 aa, Cryptosporidium hominis
PNINQEKEEKPM

SEQ ID NO: 2156265 - protein, 6 aa, Cryptosporidium hominis
PNINRD

SEQ ID NO: 2156266 - protein, 11 aa, Cryptosporidium hominis
PNIPEASSSLS

SEQ ID NO: 2156267 - protein, 6 aa, Cryptosporidium hominis
PNIPEY

SEQ ID NO: 2156268 - protein, 10 aa, Cryptosporidium hominis
PNISSNYDEY

SEQ ID NO: 2156269 - protein, 11 aa, Cryptosporidium hominis
PNITEKNGNKA

SEQ ID NO: 2156270 - protein, 19 aa, Cryptosporidium hominis
PNITNNSSSISNSSPNSFR

SEQ ID NO: 2156271 - protein, 23 aa, Cryptosporidium hominis
PNITSSTDFNNESENGINNNSRL

SEQ ID NO: 2156272 - protein, 4 aa, Cryptosporidium hominis
PNKD

SEQ ID NO: 2156273 - protein, 6 aa, Cryptosporidium hominis
PNKDQQ

SEQ ID NO: 2156274 - protein, 13 aa, Cryptosporidium hominis
PNKGMEFLLLQLN

SEQ ID NO: 2156275 - protein, 5 aa, Cryptosporidium hominis
PNKIE

SEQ ID NO: 2156276 - protein, 5 aa, Cryptosporidium hominis
PNKKS

SEQ ID NO: 2156277 - protein, 14 aa, Cryptosporidium hominis
PNKKTVSNGQDAGD

SEQ ID NO: 2156278 - protein, 8 aa, Cryptosporidium hominis
PNKQNEHE

SEQ ID NO: 2156279 - protein, 9 aa, Cryptosporidium hominis
PNKRISAQD

SEQ ID NO: 2156280 - protein, 6 aa, Cryptosporidium hominis
PNKRLD

SEQ ID NO: 2156281 - protein, 7 aa, Cryptosporidium hominis
PNKSEFP

SEQ ID NO: 2156282 - protein, 10 aa, Cryptosporidium hominis
PNKSETEDKS

SEQ ID NO: 2156283 - protein, 25 aa, Cryptosporidium hominis
PNKSIENRYNQKDRNSNYGKCENNS

SEQ ID NO: 2156284 - protein, 14 aa, Cryptosporidium hominis
PNKTKNSETISSNQ

SEQ ID NO: 2156285 - protein, 23 aa, Cryptosporidium hominis
PNKTPDDYKDGNNIKHEQHQDFD

SEQ ID NO: 2156286 - protein, 16 aa, Cryptosporidium hominis
PNKTSSIKKKQAEPIE

SEQ ID NO: 2156287 - protein, 4 aa, Cryptosporidium hominis
PNLA

SEQ ID NO: 2156288 - protein, 9 aa, Cryptosporidium hominis
PNLASRRPL

SEQ ID NO: 2156289 - protein, 11 aa, Cryptosporidium hominis
PNLGNSQQTSL

SEQ ID NO: 2156290 - protein, 7 aa, Cryptosporidium hominis
PNLNKEK

SEQ ID NO: 2156291 - protein, 9 aa, Cryptosporidium hominis
PNLSESTNI

SEQ ID NO: 2156292 - protein, 4 aa, Cryptosporidium hominis
PNLV

SEQ ID NO: 2156293 - protein, 5 aa, Cryptosporidium hominis
PNMAA

SEQ ID NO: 2156294 - protein, 8 aa, Cryptosporidium hominis
PNMDGASD

SEQ ID NO: 2156295 - protein, 4 aa, Cryptosporidium hominis
PNMP

SEQ ID NO: 2156296 - protein, 10 aa, Cryptosporidium hominis
PNNCSQRRPF

SEQ ID NO: 2156297 - protein, 10 aa, Cryptosporidium hominis
PNNDDHSEKN

SEQ ID NO: 2156298 - protein, 26 aa, Cryptosporidium hominis
PNNEIEQSNIENQISRRSSQRVSFGA

SEQ ID NO: 2156299 - protein, 4 aa, Cryptosporidium hominis
PNNG

SEQ ID NO: 2156300 - protein, 5 aa, Cryptosporidium hominis
PNNGL

SEQ ID NO: 2156301 - protein, 28 aa, Cryptosporidium hominis
PNNGSQQGQKIELGEEDGTKPSNSLKAA

SEQ ID NO: 2156302 - protein, 14 aa, Cryptosporidium hominis
PNNIRSHQEGGRHN

SEQ ID NO: 2156303 - protein, 8 aa, Cryptosporidium hominis
PNNITNNT

SEQ ID NO: 2156304 - protein, 8 aa, Cryptosporidium hominis
PNNKDGGD

SEQ ID NO: 2156305 - protein, 5 aa, Cryptosporidium hominis
PNNKG

SEQ ID NO: 2156306 - protein, 5 aa, Cryptosporidium hominis
PNNKT

SEQ ID NO: 2156307 - protein, 4 aa, Cryptosporidium hominis
PNNQ

SEQ ID NO: 2156308 - protein, 9 aa, Cryptosporidium hominis
PNNQTQRGG

SEQ ID NO: 2156309 - protein, 9 aa, Cryptosporidium hominis
PNNSAFPSG

SEQ ID NO: 2156310 - protein, 5 aa, Cryptosporidium hominis
PNNSR

SEQ ID NO: 2156311 - protein, 23 aa, Cryptosporidium hominis
PNNSSGGGRGGREGECDGNTNSQ

SEQ ID NO: 2156312 - protein, 19 aa, Cryptosporidium hominis
PNNSTNKESKGEVRGNGES

SEQ ID NO: 2156313 - protein, 8 aa, Cryptosporidium hominis
PNNTSYYK

SEQ ID NO: 2156314 - protein, 20 aa, Cryptosporidium hominis
PNPNRFSNKPKNSNSKVQIQ

SEQ ID NO: 2156315 - protein, 6 aa, Cryptosporidium hominis
PNPQEW

SEQ ID NO: 2156316 - protein, 53 aa, Cryptosporidium hominis
PNPQFYSEKKNKTKSNKEELGTRKKTKSRIKKLTSDNDLDSNSDIDSENSDNI

SEQ ID NO: 2156317 - protein, 5 aa, Cryptosporidium hominis
PNPSP

SEQ ID NO: 2156318 - protein, 9 aa, Cryptosporidium hominis
PNPVESEGI

SEQ ID NO: 2156319 - protein, 11 aa, Cryptosporidium hominis
PNPVNRPNTDD

SEQ ID NO: 2156320 - protein, 13 aa, Cryptosporidium hominis
PNPVSTQNEAIGG

SEQ ID NO: 2156321 - protein, 7 aa, Cryptosporidium hominis
PNQDEAT

SEQ ID NO: 2156322 - protein, 22 aa, Cryptosporidium hominis
PNQGEASGQHIDSGNYNTESNI

SEQ ID NO: 2156323 - protein, 5 aa, Cryptosporidium hominis
PNQGQ

SEQ ID NO: 2156324 - protein, 13 aa, Cryptosporidium hominis
PNQNGSPTDDRTI

SEQ ID NO: 2156325 - protein, 6 aa, Cryptosporidium hominis
PNQNVD

SEQ ID NO: 2156326 - protein, 31 aa, Cryptosporidium hominis
PNQPNLSSKPADVESYGEKDKMVDGEQAISK

SEQ ID NO: 2156327 - protein, 8 aa, Cryptosporidium hominis
PNQQNPNY

SEQ ID NO: 2156328 - protein, 7 aa, Cryptosporidium hominis
PNQYGER

SEQ ID NO: 2156329 - protein, 6 aa, Cryptosporidium hominis
PNRASY

SEQ ID NO: 2156330 - protein, 6 aa, Cryptosporidium hominis
PNREIS

SEQ ID NO: 2156331 - protein, 10 aa, Cryptosporidium hominis
PNRRPHKPYQ

SEQ ID NO: 2156332 - protein, 6 aa, Cryptosporidium hominis
PNRSNL

SEQ ID NO: 2156333 - protein, 9 aa, Cryptosporidium hominis
PNSDEESIS

SEQ ID NO: 2156334 - protein, 26 aa, Cryptosporidium hominis
PNSDFSTVKTKSRKNTTKKSSSNEKK

SEQ ID NO: 2156335 - protein, 8 aa, Cryptosporidium hominis
PNSDSNKD

SEQ ID NO: 2156336 - protein, 9 aa, Cryptosporidium hominis
PNSEPSNIN

SEQ ID NO: 2156337 - protein, 9 aa, Cryptosporidium hominis
PNSGGDVNC

SEQ ID NO: 2156338 - protein, 6 aa, Cryptosporidium hominis
PNSHHN

SEQ ID NO: 2156339 - protein, 4 aa, Cryptosporidium hominis
PNSI

SEQ ID NO: 2156340 - protein, 9 aa, Cryptosporidium hominis
PNSIQSGPK

SEQ ID NO: 2156341 - protein, 12 aa, Cryptosporidium hominis
PNSISGRSNESH

SEQ ID NO: 2156342 - protein, 8 aa, Cryptosporidium hominis
PNSKRARP

SEQ ID NO: 2156343 - protein, 6 aa, Cryptosporidium hominis
PNSKSD

SEQ ID NO: 2156344 - protein, 10 aa, Cryptosporidium hominis
PNSLSQEDEN

SEQ ID NO: 2156345 - protein, 4 aa, Cryptosporidium hominis
PNSN

SEQ ID NO: 2156346 - protein, 14 aa, Cryptosporidium hominis
PNSNDIPKKISSSN

SEQ ID NO: 2156347 - protein, 9 aa, Cryptosporidium hominis
PNSNENERI

SEQ ID NO: 2156348 - protein, 7 aa, Cryptosporidium hominis
PNSNGKL

SEQ ID NO: 2156349 - protein, 9 aa, Cryptosporidium hominis
PNSNGNLED

SEQ ID NO: 2156350 - protein, 10 aa, Cryptosporidium hominis
PNSNNSPDEF

SEQ ID NO: 2156351 - protein, 15 aa, Cryptosporidium hominis
PNSNTNLEENELSDK

SEQ ID NO: 2156352 - protein, 7 aa, Cryptosporidium hominis
PNSPKNI

SEQ ID NO: 2156353 - protein, 20 aa, Cryptosporidium hominis
PNSPPEETDPLAQTYDQDEV

SEQ ID NO: 2156354 - protein, 7 aa, Cryptosporidium hominis
PNSQDRK

SEQ ID NO: 2156355 - protein, 8 aa, Cryptosporidium hominis
PNSQERNL

SEQ ID NO: 2156356 - protein, 6 aa, Cryptosporidium hominis
PNSRKA

SEQ ID NO: 2156357 - protein, 25 aa, Cryptosporidium hominis
PNSRRNHQNTKNCNSSSSSSNTNNH

SEQ ID NO: 2156358 - protein, 9 aa, Cryptosporidium hominis
PNSRSQNPS

SEQ ID NO: 2156359 - protein, 8 aa, Cryptosporidium hominis
PNSSDKNG

SEQ ID NO: 2156360 - protein, 7 aa, Cryptosporidium hominis
PNSSKAK

SEQ ID NO: 2156361 - protein, 9 aa, Cryptosporidium hominis
PNSSPTNIS

SEQ ID NO: 2156362 - protein, 22 aa, Cryptosporidium hominis
PNSSSNTNHTVSTNNSTNNSYI

SEQ ID NO: 2156363 - protein, 11 aa, Cryptosporidium hominis
PNSTESKYSVS

SEQ ID NO: 2156364 - protein, 5 aa, Cryptosporidium hominis
PNSTS

SEQ ID NO: 2156365 - protein, 4 aa, Cryptosporidium hominis
PNTE

SEQ ID NO: 2156366 - protein, 7 aa, Cryptosporidium hominis
PNTITNP

SEQ ID NO: 2156367 - protein, 6 aa, Cryptosporidium hominis
PNTKNS

SEQ ID NO: 2156368 - protein, 6 aa, Cryptosporidium hominis
PNTKRL

SEQ ID NO: 2156369 - protein, 8 aa, Cryptosporidium hominis
PNTLNGKK

SEQ ID NO: 2156370 - protein, 5 aa, Cryptosporidium hominis
PNTLP

SEQ ID NO: 2156371 - protein, 12 aa, Cryptosporidium hominis
PNTLREGGSNPN

SEQ ID NO: 2156372 - protein, 7 aa, Cryptosporidium hominis
PNTNTIS

SEQ ID NO: 2156373 - protein, 14 aa, Cryptosporidium hominis
PNTPIDDEASRRSN

SEQ ID NO: 2156374 - protein, 8 aa, Cryptosporidium hominis
PNTRPFSN

SEQ ID NO: 2156375 - protein, 7 aa, Cryptosporidium hominis
PNTSNES

SEQ ID NO: 2156376 - protein, 10 aa, Cryptosporidium hominis
PNTYYDDEEK

SEQ ID NO: 2156377 - protein, 4 aa, Cryptosporidium hominis
PNVP

SEQ ID NO: 2156378 - protein, 5 aa, Cryptosporidium hominis
PNVTS

SEQ ID NO: 2156379 - protein, 6 aa, Cryptosporidium hominis
PNYEEN

SEQ ID NO: 2156380 - protein, 7 aa, Cryptosporidium hominis
PNYKDRR

SEQ ID NO: 2156381 - protein, 8 aa, Cryptosporidium hominis
PNYNGDDD

SEQ ID NO: 2156382 - protein, 5 aa, Cryptosporidium hominis
PNYPD

SEQ ID NO: 2156383 - protein, 11 aa, Cryptosporidium hominis
PNYPGGRYPPY

SEQ ID NO: 2156384 - protein, 8 aa, Cryptosporidium hominis
PNYPIERS

SEQ ID NO: 2156385 - protein, 8 aa, Cryptosporidium hominis
PNYQESNQ

SEQ ID NO: 2156386 - protein, 15 aa, Cryptosporidium hominis
PNYTTNSKNTNVRSA

SEQ ID NO: 2156387 - protein, 4 aa, Cryptosporidium hominis
PPAF

SEQ ID NO: 2156388 - protein, 7 aa, Cryptosporidium hominis
PPAKNKV

SEQ ID NO: 2156389 - protein, 9 aa, Cryptosporidium hominis
PPANDAYYG

SEQ ID NO: 2156390 - protein, 6 aa, Cryptosporidium hominis
PPAPET

SEQ ID NO: 2156391 - protein, 8 aa, Cryptosporidium hominis
PPAPRGVP

SEQ ID NO: 2156392 - protein, 17 aa, Cryptosporidium hominis
PPAPSSQSDLANSISAE

SEQ ID NO: 2156393 - protein, 23 aa, Cryptosporidium hominis
PPDSASLSSPTPASTLHAKTNGG

SEQ ID NO: 2156394 - protein, 5 aa, Cryptosporidium hominis
PPDSG

SEQ ID NO: 2156395 - protein, 7 aa, Cryptosporidium hominis
PPDSPNF

SEQ ID NO: 2156396 - protein, 7 aa, Cryptosporidium hominis
PPEADSS

SEQ ID NO: 2156397 - protein, 4 aa, Cryptosporidium hominis
PPED

SEQ ID NO: 2156398 - protein, 10 aa, Cryptosporidium hominis
PPEDPKIKES

SEQ ID NO: 2156399 - protein, 4 aa, Cryptosporidium hominis
PPEE

SEQ ID NO: 2156400 - protein, 7 aa, Cryptosporidium hominis
PPEEGPV

SEQ ID NO: 2156401 - protein, 5 aa, Cryptosporidium hominis
PPEIQ

SEQ ID NO: 2156402 - protein, 5 aa, Cryptosporidium hominis
PPEKA

SEQ ID NO: 2156403 - protein, 11 aa, Cryptosporidium hominis
PPEKSKLPEYL

SEQ ID NO: 2156404 - protein, 18 aa, Cryptosporidium hominis
PPELPERVNPDPGTGGAM

SEQ ID NO: 2156405 - protein, 10 aa, Cryptosporidium hominis
PPESKFTKPT

SEQ ID NO: 2156406 - protein, 6 aa, Cryptosporidium hominis
PPEYDN

SEQ ID NO: 2156407 - protein, 6 aa, Cryptosporidium hominis
PPEYDS

SEQ ID NO: 2156408 - protein, 14 aa, Cryptosporidium hominis
PPFKSHNDPSVSQD

SEQ ID NO: 2156409 - protein, 6 aa, Cryptosporidium hominis
PPFSGD

SEQ ID NO: 2156410 - protein, 11 aa, Cryptosporidium hominis
PPGGPVLENSK

SEQ ID NO: 2156411 - protein, 5 aa, Cryptosporidium hominis
PPGNN

SEQ ID NO: 2156412 - protein, 14 aa, Cryptosporidium hominis
PPGNNNSNYMFNFR

SEQ ID NO: 2156413 - protein, 4 aa, Cryptosporidium hominis
PPGT

SEQ ID NO: 2156414 - protein, 6 aa, Cryptosporidium hominis
PPGTGD

SEQ ID NO: 2156415 - protein, 7 aa, Cryptosporidium hominis
PPGTGKT

SEQ ID NO: 2156416 - protein, 7 aa, Cryptosporidium hominis
PPGTTDV

SEQ ID NO: 2156417 - protein, 12 aa, Cryptosporidium hominis
PPHLNDKEEDQD

SEQ ID NO: 2156418 - protein, 10 aa, Cryptosporidium hominis
PPHSTRPKET

SEQ ID NO: 2156419 - protein, 4 aa, Cryptosporidium hominis
PPIL

SEQ ID NO: 2156420 - protein, 28 aa, Cryptosporidium hominis
PPIQSGPARASRNSSNIRRSSTSPPPHI

SEQ ID NO: 2156421 - protein, 8 aa, Cryptosporidium hominis
PPISANDD

SEQ ID NO: 2156422 - protein, 4 aa, Cryptosporidium hominis
PPIV

SEQ ID NO: 2156423 - protein, 5 aa, Cryptosporidium hominis
PPKER

SEQ ID NO: 2156424 - protein, 23 aa, Cryptosporidium hominis
PPKGKKNKRRQNSSSNNSSSTHK

SEQ ID NO: 2156425 - protein, 5 aa, Cryptosporidium hominis
PPKID

SEQ ID NO: 2156426 - protein, 8 aa, Cryptosporidium hominis
PPKIEGTS

SEQ ID NO: 2156427 - protein, 6 aa, Cryptosporidium hominis
PPKKSW

SEQ ID NO: 2156428 - protein, 11 aa, Cryptosporidium hominis
PPKKVDSIADT

SEQ ID NO: 2156429 - protein, 5 aa, Cryptosporidium hominis
PPKLS

SEQ ID NO: 2156430 - protein, 5 aa, Cryptosporidium hominis
PPKLT

SEQ ID NO: 2156431 - protein, 7 aa, Cryptosporidium hominis
PPKRGSQ

SEQ ID NO: 2156432 - protein, 17 aa, Cryptosporidium hominis
PPKRYSNSDHPWNIELL

SEQ ID NO: 2156433 - protein, 6 aa, Cryptosporidium hominis
PPKSGK

SEQ ID NO: 2156434 - protein, 11 aa, Cryptosporidium hominis
PPKTSSSSHDQ

SEQ ID NO: 2156435 - protein, 4 aa, Cryptosporidium hominis
PPKY

SEQ ID NO: 2156436 - protein, 5 aa, Cryptosporidium hominis
PPLEP

SEQ ID NO: 2156437 - protein, 10 aa, Cryptosporidium hominis
PPLNSNPKIA

SEQ ID NO: 2156438 - protein, 11 aa, Cryptosporidium hominis
PPLSDPGQNSL

SEQ ID NO: 2156439 - protein, 10 aa, Cryptosporidium hominis
PPLSNKQKYE

SEQ ID NO: 2156440 - protein, 13 aa, Cryptosporidium hominis
PPNASLPNQAGPS

SEQ ID NO: 2156441 - protein, 4 aa, Cryptosporidium hominis
PPND

SEQ ID NO: 2156442 - protein, 13 aa, Cryptosporidium hominis
PPNDGSINSPYNG

SEQ ID NO: 2156443 - protein, 4 aa, Cryptosporidium hominis
PPNF

SEQ ID NO: 2156444 - protein, 11 aa, Cryptosporidium hominis
PPNGSAPMSMG

SEQ ID NO: 2156445 - protein, 5 aa, Cryptosporidium hominis
PPNHT

SEQ ID NO: 2156446 - protein, 5 aa, Cryptosporidium hominis
PPNIH

SEQ ID NO: 2156447 - protein, 5 aa, Cryptosporidium hominis
PPNIS

SEQ ID NO: 2156448 - protein, 6 aa, Cryptosporidium hominis
PPNLNK

SEQ ID NO: 2156449 - protein, 12 aa, Cryptosporidium hominis
PPNLSNQASNRT

SEQ ID NO: 2156450 - protein, 5 aa, Cryptosporidium hominis
PPNPV

SEQ ID NO: 2156451 - protein, 15 aa, Cryptosporidium hominis
PPNQRQQFPYQFPPQ

SEQ ID NO: 2156452 - protein, 7 aa, Cryptosporidium hominis
PPNSLAE

SEQ ID NO: 2156453 - protein, 12 aa, Cryptosporidium hominis
PPNSNISNNSQN

SEQ ID NO: 2156454 - protein, 11 aa, Cryptosporidium hominis
PPNSRVGSSGA

SEQ ID NO: 2156455 - protein, 5 aa, Cryptosporidium hominis
PPNVT

SEQ ID NO: 2156456 - protein, 4 aa, Cryptosporidium hominis
PPPE

SEQ ID NO: 2156457 - protein, 5 aa, Cryptosporidium hominis
PPPEY

SEQ ID NO: 2156458 - protein, 11 aa, Cryptosporidium hominis
PPPIQPPEKIP

SEQ ID NO: 2156459 - protein, 8 aa, Cryptosporidium hominis
PPPPDYFP

SEQ ID NO: 2156460 - protein, 6 aa, Cryptosporidium hominis
PPPPET

SEQ ID NO: 2156461 - protein, 8 aa, Cryptosporidium hominis
PPPPKNIN

SEQ ID NO: 2156462 - protein, 5 aa, Cryptosporidium hominis
PPPPL

SEQ ID NO: 2156463 - protein, 14 aa, Cryptosporidium hominis
PPPPPHLNPPIPGH

SEQ ID NO: 2156464 - protein, 22 aa, Cryptosporidium hominis
PPPPPNHRAGSNRLYGASKAKN

SEQ ID NO: 2156465 - protein, 14 aa, Cryptosporidium hominis
PPPPPPPSKTSGPL

SEQ ID NO: 2156466 - protein, 7 aa, Cryptosporidium hominis
PPPQSRN

SEQ ID NO: 2156467 - protein, 8 aa, Cryptosporidium hominis
PPPQSSSE

SEQ ID NO: 2156468 - protein, 5 aa, Cryptosporidium hominis
PPPSK

SEQ ID NO: 2156469 - protein, 4 aa, Cryptosporidium hominis
PPPV

SEQ ID NO: 2156470 - protein, 5 aa, Cryptosporidium hominis
PPPVL

SEQ ID NO: 2156471 - protein, 14 aa, Cryptosporidium hominis
PPQDNSHQNQLEKE

SEQ ID NO: 2156472 - protein, 7 aa, Cryptosporidium hominis
PPQMNGD

SEQ ID NO: 2156473 - protein, 15 aa, Cryptosporidium hominis
PPQPPVSHPEDNSQI

SEQ ID NO: 2156474 - protein, 7 aa, Cryptosporidium hominis
PPQQDSK

SEQ ID NO: 2156475 - protein, 10 aa, Cryptosporidium hominis
PPQQSVEHSN

SEQ ID NO: 2156476 - protein, 14 aa, Cryptosporidium hominis
PPQTQSQSIRPPPV

SEQ ID NO: 2156477 - protein, 11 aa, Cryptosporidium hominis
PPQTSRPDSTH

SEQ ID NO: 2156478 - protein, 15 aa, Cryptosporidium hominis
PPRAGASSSENAQKT

SEQ ID NO: 2156479 - protein, 5 aa, Cryptosporidium hominis
PPRDI

SEQ ID NO: 2156480 - protein, 11 aa, Cryptosporidium hominis
PPRKDRKNSYK

SEQ ID NO: 2156481 - protein, 14 aa, Cryptosporidium hominis
PPRLDSSSGQGSVA

SEQ ID NO: 2156482 - protein, 5 aa, Cryptosporidium hominis
PPRSR

SEQ ID NO: 2156483 - protein, 8 aa, Cryptosporidium hominis
PPSEASMT

SEQ ID NO: 2156484 - protein, 6 aa, Cryptosporidium hominis
PPSGAI

SEQ ID NO: 2156485 - protein, 10 aa, Cryptosporidium hominis
PPSHNGEEYY

SEQ ID NO: 2156486 - protein, 5 aa, Cryptosporidium hominis
PPSIQ

SEQ ID NO: 2156487 - protein, 8 aa, Cryptosporidium hominis
PPSKKLTQ

SEQ ID NO: 2156488 - protein, 4 aa, Cryptosporidium hominis
PPSN

SEQ ID NO: 2156489 - protein, 5 aa, Cryptosporidium hominis
PPSNE

SEQ ID NO: 2156490 - protein, 4 aa, Cryptosporidium hominis
PPSP

SEQ ID NO: 2156491 - protein, 29 aa, Cryptosporidium hominis
PPSRLQNRPAATASSTKHPSSKARSNFNN

SEQ ID NO: 2156492 - protein, 9 aa, Cryptosporidium hominis
PPSSSSIST

SEQ ID NO: 2156493 - protein, 15 aa, Cryptosporidium hominis
PPSTPSSGSRSTSAS

SEQ ID NO: 2156494 - protein, 11 aa, Cryptosporidium hominis
PPSTSVSPSNY

SEQ ID NO: 2156495 - protein, 18 aa, Cryptosporidium hominis
PPTAPESQNNSPTRENDN

SEQ ID NO: 2156496 - protein, 8 aa, Cryptosporidium hominis
PPTDDSNV

SEQ ID NO: 2156497 - protein, 4 aa, Cryptosporidium hominis
PPTF

SEQ ID NO: 2156498 - protein, 4 aa, Cryptosporidium hominis
PPTI

SEQ ID NO: 2156499 - protein, 9 aa, Cryptosporidium hominis
PPTIEEDEE

SEQ ID NO: 2156500 - protein, 6 aa, Cryptosporidium hominis
PPTISE

SEQ ID NO: 2156501 - protein, 4 aa, Cryptosporidium hominis
PPTL

SEQ ID NO: 2156502 - protein, 40 aa, Cryptosporidium hominis
PPTNSINKDPVTNAQYSNSTGNIINPETGKVIPGSLPGSL

SEQ ID NO: 2156503 - protein, 8 aa, Cryptosporidium hominis
PPTPQGVA

SEQ ID NO: 2156504 - protein, 7 aa, Cryptosporidium hominis
PPTREFS

SEQ ID NO: 2156505 - protein, 8 aa, Cryptosporidium hominis
PPTRQGYP

SEQ ID NO: 2156506 - protein, 39 aa, Cryptosporidium hominis
PPTSPPPPIPPASPQRTPPASLPPIPPSSSRTRSASPIP

SEQ ID NO: 2156507 - protein, 4 aa, Cryptosporidium hominis
PPVP

SEQ ID NO: 2156508 - protein, 7 aa, Cryptosporidium hominis
PPVPPQN

SEQ ID NO: 2156509 - protein, 5 aa, Cryptosporidium hominis
PPVPS

SEQ ID NO: 2156510 - protein, 4 aa, Cryptosporidium hominis
PPVT

SEQ ID NO: 2156511 - protein, 13 aa, Cryptosporidium hominis
PPVTNKAEKGEVI

SEQ ID NO: 2156512 - protein, 4 aa, Cryptosporidium hominis
PPWG

SEQ ID NO: 2156513 - protein, 7 aa, Cryptosporidium hominis
PPWGGYS

SEQ ID NO: 2156514 - protein, 5 aa, Cryptosporidium hominis
PPYGT

SEQ ID NO: 2156515 - protein, 8 aa, Cryptosporidium hominis
PPYNDDGM

SEQ ID NO: 2156516 - protein, 5 aa, Cryptosporidium hominis
PQAPP

SEQ ID NO: 2156517 - protein, 16 aa, Cryptosporidium hominis
PQASNVDSTYRNEGNV

SEQ ID NO: 2156518 - protein, 7 aa, Cryptosporidium hominis
PQDDRED

SEQ ID NO: 2156519 - protein, 4 aa, Cryptosporidium hominis
PQDE

SEQ ID NO: 2156520 - protein, 4 aa, Cryptosporidium hominis
PQEN

SEQ ID NO: 2156521 - protein, 4 aa, Cryptosporidium hominis
PQEP

SEQ ID NO: 2156522 - protein, 11 aa, Cryptosporidium hominis
PQESVDERNEI

SEQ ID NO: 2156523 - protein, 5 aa, Cryptosporidium hominis
PQETW

SEQ ID NO: 2156524 - protein, 4 aa, Cryptosporidium hominis
PQEV

SEQ ID NO: 2156525 - protein, 4 aa, Cryptosporidium hominis
PQFN

SEQ ID NO: 2156526 - protein, 9 aa, Cryptosporidium hominis
PQGDKERIS

SEQ ID NO: 2156527 - protein, 6 aa, Cryptosporidium hominis
PQGFTS

SEQ ID NO: 2156528 - protein, 15 aa, Cryptosporidium hominis
PQGQTNHSPSSISYR

SEQ ID NO: 2156529 - protein, 8 aa, Cryptosporidium hominis
PQGSDSSF

SEQ ID NO: 2156530 - protein, 6 aa, Cryptosporidium hominis
PQIAPG

SEQ ID NO: 2156531 - protein, 7 aa, Cryptosporidium hominis
PQIAPGV

SEQ ID NO: 2156532 - protein, 10 aa, Cryptosporidium hominis
PQIEKQAEDR

SEQ ID NO: 2156533 - protein, 13 aa, Cryptosporidium hominis
PQILDESNKDEIE

SEQ ID NO: 2156534 - protein, 4 aa, Cryptosporidium hominis
PQIP

SEQ ID NO: 2156535 - protein, 10 aa, Cryptosporidium hominis
PQKDQPQEKS

SEQ ID NO: 2156536 - protein, 10 aa, Cryptosporidium hominis
PQKHPARDSH

SEQ ID NO: 2156537 - protein, 7 aa, Cryptosporidium hominis
PQKKSPL

SEQ ID NO: 2156538 - protein, 4 aa, Cryptosporidium hominis
PQKL

SEQ ID NO: 2156539 - protein, 8 aa, Cryptosporidium hominis
PQKPSDVS

SEQ ID NO: 2156540 - protein, 10 aa, Cryptosporidium hominis
PQLETNSSQA

SEQ ID NO: 2156541 - protein, 4 aa, Cryptosporidium hominis
PQLI

SEQ ID NO: 2156542 - protein, 4 aa, Cryptosporidium hominis
PQLN

SEQ ID NO: 2156543 - protein, 7 aa, Cryptosporidium hominis
PQLPREG

SEQ ID NO: 2156544 - protein, 4 aa, Cryptosporidium hominis
PQND

SEQ ID NO: 2156545 - protein, 4 aa, Cryptosporidium hominis
PQNE

SEQ ID NO: 2156546 - protein, 8 aa, Cryptosporidium hominis
PQNESYYG

SEQ ID NO: 2156547 - protein, 4 aa, Cryptosporidium hominis
PQNF

SEQ ID NO: 2156548 - protein, 4 aa, Cryptosporidium hominis
PQNI

SEQ ID NO: 2156549 - protein, 34 aa, Cryptosporidium hominis
PQNKRMHPRNTGFRRNNPNSLPLGGSNRAYRDLQ

SEQ ID NO: 2156550 - protein, 7 aa, Cryptosporidium hominis
PQNPKEK

SEQ ID NO: 2156551 - protein, 7 aa, Cryptosporidium hominis
PQNSSRV

SEQ ID NO: 2156552 - protein, 9 aa, Cryptosporidium hominis
PQNYPKKEV

SEQ ID NO: 2156553 - protein, 5 aa, Cryptosporidium hominis
PQPDV

SEQ ID NO: 2156554 - protein, 6 aa, Cryptosporidium hominis
PQPGEK

SEQ ID NO: 2156555 - protein, 9 aa, Cryptosporidium hominis
PQPKEKPIT

SEQ ID NO: 2156556 - protein, 5 aa, Cryptosporidium hominis
PQPPF

SEQ ID NO: 2156557 - protein, 32 aa, Cryptosporidium hominis
PQPPNKSSDLDFEDNDQDTVNDFKNSTASSRS

SEQ ID NO: 2156558 - protein, 6 aa, Cryptosporidium hominis
PQPPRI

SEQ ID NO: 2156559 - protein, 7 aa, Cryptosporidium hominis
PQPSKRG

SEQ ID NO: 2156560 - protein, 13 aa, Cryptosporidium hominis
PQPSSGDASSERA

SEQ ID NO: 2156561 - protein, 15 aa, Cryptosporidium hominis
PQPTQLNTGAAGYGY

SEQ ID NO: 2156562 - protein, 7 aa, Cryptosporidium hominis
PQRDKFG

SEQ ID NO: 2156563 - protein, 4 aa, Cryptosporidium hominis
PQRK

SEQ ID NO: 2156564 - protein, 8 aa, Cryptosporidium hominis
PQRKYTTL

SEQ ID NO: 2156565 - protein, 4 aa, Cryptosporidium hominis
PQRS

SEQ ID NO: 2156566 - protein, 4 aa, Cryptosporidium hominis
PQRT

SEQ ID NO: 2156567 - protein, 6 aa, Cryptosporidium hominis
PQSAQN

SEQ ID NO: 2156568 - protein, 9 aa, Cryptosporidium hominis
PQSGNSVSV

SEQ ID NO: 2156569 - protein, 10 aa, Cryptosporidium hominis
PQSITNSSIG

SEQ ID NO: 2156570 - protein, 10 aa, Cryptosporidium hominis
PQSKKFKSSN

SEQ ID NO: 2156571 - protein, 17 aa, Cryptosporidium hominis
PQSTSSLRGPQDTPQGN

SEQ ID NO: 2156572 - protein, 7 aa, Cryptosporidium hominis
PQTNQVR

SEQ ID NO: 2156573 - protein, 4 aa, Cryptosporidium hominis
PQVT

SEQ ID NO: 2156574 - protein, 8 aa, Cryptosporidium hominis
PQYTTTAR

SEQ ID NO: 2156575 - protein, 16 aa, Cryptosporidium hominis
PRAGQKGYGQRTETNK

SEQ ID NO: 2156576 - protein, 7 aa, Cryptosporidium hominis
PRAISPS

SEQ ID NO: 2156577 - protein, 8 aa, Cryptosporidium hominis
PRAKKKVS

SEQ ID NO: 2156578 - protein, 10 aa, Cryptosporidium hominis
PRARSSNPQR

SEQ ID NO: 2156579 - protein, 10 aa, Cryptosporidium hominis
PRDAQDAVNR

SEQ ID NO: 2156580 - protein, 7 aa, Cryptosporidium hominis
PRDLSPN

SEQ ID NO: 2156581 - protein, 6 aa, Cryptosporidium hominis
PRDSTY

SEQ ID NO: 2156582 - protein, 8 aa, Cryptosporidium hominis
PREGNRSK

SEQ ID NO: 2156583 - protein, 4 aa, Cryptosporidium hominis
PREI

SEQ ID NO: 2156584 - protein, 9 aa, Cryptosporidium hominis
PRENCNNSS

SEQ ID NO: 2156585 - protein, 6 aa, Cryptosporidium hominis
PREQTT

SEQ ID NO: 2156586 - protein, 7 aa, Cryptosporidium hominis
PRETVTK

SEQ ID NO: 2156587 - protein, 17 aa, Cryptosporidium hominis
PRGGYKSSSSSNSNPNL

SEQ ID NO: 2156588 - protein, 4 aa, Cryptosporidium hominis
PRGN

SEQ ID NO: 2156589 - protein, 6 aa, Cryptosporidium hominis
PRGNAS

SEQ ID NO: 2156590 - protein, 5 aa, Cryptosporidium hominis
PRGRR

SEQ ID NO: 2156591 - protein, 11 aa, Cryptosporidium hominis
PRGSTDKENMQ

SEQ ID NO: 2156592 - protein, 6 aa, Cryptosporidium hominis
PRHQSA

SEQ ID NO: 2156593 - protein, 21 aa, Cryptosporidium hominis
PRHRDSSKSVQLSSVNSNSNM

SEQ ID NO: 2156594 - protein, 4 aa, Cryptosporidium hominis
PRIA

SEQ ID NO: 2156595 - protein, 4 aa, Cryptosporidium hominis
PRIE

SEQ ID NO: 2156596 - protein, 7 aa, Cryptosporidium hominis
PRIGSPV

SEQ ID NO: 2156597 - protein, 4 aa, Cryptosporidium hominis
PRIN

SEQ ID NO: 2156598 - protein, 17 aa, Cryptosporidium hominis
PRINEPSLKYSKNQEIP

SEQ ID NO: 2156599 - protein, 10 aa, Cryptosporidium hominis
PRINKTDSEN

SEQ ID NO: 2156600 - protein, 5 aa, Cryptosporidium hominis
PRISQ

SEQ ID NO: 2156601 - protein, 16 aa, Cryptosporidium hominis
PRITPNFGDENDNLLP

SEQ ID NO: 2156602 - protein, 27 aa, Cryptosporidium hominis
PRKCSRSNSNSQTPANERESSSIRRSN

SEQ ID NO: 2156603 - protein, 21 aa, Cryptosporidium hominis
PRKEDREPNDPQTPNAHTRCP

SEQ ID NO: 2156604 - protein, 14 aa, Cryptosporidium hominis
PRKGCKDDGSHPPI

SEQ ID NO: 2156605 - protein, 23 aa, Cryptosporidium hominis
PRKGKKTKKGFAGIPNDSAREEF

SEQ ID NO: 2156606 - protein, 21 aa, Cryptosporidium hominis
PRKKTQRSHSQKLKQDKKQTS

SEQ ID NO: 2156607 - protein, 8 aa, Cryptosporidium hominis
PRKPNMTR

SEQ ID NO: 2156608 - protein, 13 aa, Cryptosporidium hominis
PRKPNNQYFHEGG

SEQ ID NO: 2156609 - protein, 6 aa, Cryptosporidium hominis
PRKTQN

SEQ ID NO: 2156610 - protein, 7 aa, Cryptosporidium hominis
PRLENQN

SEQ ID NO: 2156611 - protein, 4 aa, Cryptosporidium hominis
PRLH

SEQ ID NO: 2156612 - protein, 6 aa, Cryptosporidium hominis
PRNDIP

SEQ ID NO: 2156613 - protein, 4 aa, Cryptosporidium hominis
PRNH

SEQ ID NO: 2156614 - protein, 7 aa, Cryptosporidium hominis
PRNKTSL

SEQ ID NO: 2156615 - protein, 9 aa, Cryptosporidium hominis
PRNRGEGSI

SEQ ID NO: 2156616 - protein, 9 aa, Cryptosporidium hominis
PRNSPDVTT

SEQ ID NO: 2156617 - protein, 4 aa, Cryptosporidium hominis
PRNT

SEQ ID NO: 2156618 - protein, 4 aa, Cryptosporidium hominis
PRNY

SEQ ID NO: 2156619 - protein, 4 aa, Cryptosporidium hominis
PRPI

SEQ ID NO: 2156620 - protein, 10 aa, Cryptosporidium hominis
PRPPKPLPPQ

SEQ ID NO: 2156621 - protein, 5 aa, Cryptosporidium hominis
PRPYC

SEQ ID NO: 2156622 - protein, 7 aa, Cryptosporidium hominis
PRQFSTG

SEQ ID NO: 2156623 - protein, 4 aa, Cryptosporidium hominis
PRQI

SEQ ID NO: 2156624 - protein, 21 aa, Cryptosporidium hominis
PRQKNITNIQDSNVKPPPSDI

SEQ ID NO: 2156625 - protein, 7 aa, Cryptosporidium hominis
PRQPTLS

SEQ ID NO: 2156626 - protein, 22 aa, Cryptosporidium hominis
PRRCEPKKFGGPGARARIQKSY

SEQ ID NO: 2156627 - protein, 8 aa, Cryptosporidium hominis
PRRRGVKE

SEQ ID NO: 2156628 - protein, 18 aa, Cryptosporidium hominis
PRRRSRSPSLEEGQSVEE

SEQ ID NO: 2156629 - protein, 4 aa, Cryptosporidium hominis
PRSA

SEQ ID NO: 2156630 - protein, 5 aa, Cryptosporidium hominis
PRSER

SEQ ID NO: 2156631 - protein, 13 aa, Cryptosporidium hominis
PRSNPNMLQRYPG

SEQ ID NO: 2156632 - protein, 5 aa, Cryptosporidium hominis
PRSPL

SEQ ID NO: 2156633 - protein, 7 aa, Cryptosporidium hominis
PRSQSAD

SEQ ID NO: 2156634 - protein, 9 aa, Cryptosporidium hominis
PRSRSGKKI

SEQ ID NO: 2156635 - protein, 4 aa, Cryptosporidium hominis
PRSV

SEQ ID NO: 2156636 - protein, 4 aa, Cryptosporidium hominis
PRTI

SEQ ID NO: 2156637 - protein, 14 aa, Cryptosporidium hominis
PRTKSKQKLPPGRI

SEQ ID NO: 2156638 - protein, 7 aa, Cryptosporidium hominis
PRTNTDF

SEQ ID NO: 2156639 - protein, 4 aa, Cryptosporidium hominis
PRTP

SEQ ID NO: 2156640 - protein, 6 aa, Cryptosporidium hominis
PRTPEC

SEQ ID NO: 2156641 - protein, 5 aa, Cryptosporidium hominis
PRTRD

SEQ ID NO: 2156642 - protein, 5 aa, Cryptosporidium hominis
PRVDS

SEQ ID NO: 2156643 - protein, 6 aa, Cryptosporidium hominis
PRVSTT

SEQ ID NO: 2156644 - protein, 16 aa, Cryptosporidium hominis
PRWTSSEVNNDGFGGG

SEQ ID NO: 2156645 - protein, 4 aa, Cryptosporidium hominis
PRYG

SEQ ID NO: 2156646 - protein, 10 aa, Cryptosporidium hominis
PRYHPKSKPF

SEQ ID NO: 2156647 - protein, 4 aa, Cryptosporidium hominis
PRYK

SEQ ID NO: 2156648 - protein, 4 aa, Cryptosporidium hominis
PRYS

SEQ ID NO: 2156649 - protein, 9 aa, Cryptosporidium hominis
PRYSDTGKM

SEQ ID NO: 2156650 - protein, 11 aa, Cryptosporidium hominis
PRYVPGGKEDL

SEQ ID NO: 2156651 - protein, 5 aa, Cryptosporidium hominis
PSAEN

SEQ ID NO: 2156652 - protein, 16 aa, Cryptosporidium hominis
PSAGQDSVLRMVKSQN

SEQ ID NO: 2156653 - protein, 4 aa, Cryptosporidium hominis
PSAK

SEQ ID NO: 2156654 - protein, 6 aa, Cryptosporidium hominis
PSAKNS

SEQ ID NO: 2156655 - protein, 9 aa, Cryptosporidium hominis
PSAPPTAPV

SEQ ID NO: 2156656 - protein, 9 aa, Cryptosporidium hominis
PSATESTSM

SEQ ID NO: 2156657 - protein, 4 aa, Cryptosporidium hominis
PSAV

SEQ ID NO: 2156658 - protein, 6 aa, Cryptosporidium hominis
PSCGKS

SEQ ID NO: 2156659 - protein, 8 aa, Cryptosporidium hominis
PSDEVRNT

SEQ ID NO: 2156660 - protein, 7 aa, Cryptosporidium hominis
PSDKECR

SEQ ID NO: 2156661 - protein, 13 aa, Cryptosporidium hominis
PSDKIDEKANELK

SEQ ID NO: 2156662 - protein, 7 aa, Cryptosporidium hominis
PSDLEEE

SEQ ID NO: 2156663 - protein, 7 aa, Cryptosporidium hominis
PSDLTNN

SEQ ID NO: 2156664 - protein, 8 aa, Cryptosporidium hominis
PSDNEPPP

SEQ ID NO: 2156665 - protein, 11 aa, Cryptosporidium hominis
PSDNSKGEVDS

SEQ ID NO: 2156666 - protein, 12 aa, Cryptosporidium hominis
PSDSESGNDANL

SEQ ID NO: 2156667 - protein, 7 aa, Cryptosporidium hominis
PSDTEHS

SEQ ID NO: 2156668 - protein, 6 aa, Cryptosporidium hominis
PSEAED

SEQ ID NO: 2156669 - protein, 12 aa, Cryptosporidium hominis
PSEDLSTQTTYE

SEQ ID NO: 2156670 - protein, 8 aa, Cryptosporidium hominis
PSEEEDLS

SEQ ID NO: 2156671 - protein, 10 aa, Cryptosporidium hominis
PSEEKDRESC

SEQ ID NO: 2156672 - protein, 20 aa, Cryptosporidium hominis
PSEGESNQKISDSKNTIETG

SEQ ID NO: 2156673 - protein, 16 aa, Cryptosporidium hominis
PSEKRPKNRNNHASAV

SEQ ID NO: 2156674 - protein, 9 aa, Cryptosporidium hominis
PSENSKDLT

SEQ ID NO: 2156675 - protein, 7 aa, Cryptosporidium hominis
PSEPIGS

SEQ ID NO: 2156676 - protein, 10 aa, Cryptosporidium hominis
PSESAASSNV

SEQ ID NO: 2156677 - protein, 8 aa, Cryptosporidium hominis
PSESSTPV

SEQ ID NO: 2156678 - protein, 14 aa, Cryptosporidium hominis
PSETAGRYVTYRLV

SEQ ID NO: 2156679 - protein, 11 aa, Cryptosporidium hominis
PSETIDPNIHP

SEQ ID NO: 2156680 - protein, 4 aa, Cryptosporidium hominis
PSEV

SEQ ID NO: 2156681 - protein, 5 aa, Cryptosporidium hominis
PSEVN

SEQ ID NO: 2156682 - protein, 6 aa, Cryptosporidium hominis
PSEYSG

SEQ ID NO: 2156683 - protein, 13 aa, Cryptosporidium hominis
PSFENDSLESENN

SEQ ID NO: 2156684 - protein, 12 aa, Cryptosporidium hominis
PSFRDEQPRGSI

SEQ ID NO: 2156685 - protein, 15 aa, Cryptosporidium hominis
PSFTTGKYTLSNLIK

SEQ ID NO: 2156686 - protein, 7 aa, Cryptosporidium hominis
PSGGESL

SEQ ID NO: 2156687 - protein, 8 aa, Cryptosporidium hominis
PSGGGKKV

SEQ ID NO: 2156688 - protein, 16 aa, Cryptosporidium hominis
PSGNDQGESVLKDSSE

SEQ ID NO: 2156689 - protein, 7 aa, Cryptosporidium hominis
PSGPSFS

SEQ ID NO: 2156690 - protein, 33 aa, Cryptosporidium hominis
PSGRFSNSNRSNGLKTLGNSNQVYKQDNIRSQK

SEQ ID NO: 2156691 - protein, 10 aa, Cryptosporidium hominis
PSGRQTPEPG

SEQ ID NO: 2156692 - protein, 14 aa, Cryptosporidium hominis
PSGSYSTIKDSESS

SEQ ID NO: 2156693 - protein, 7 aa, Cryptosporidium hominis
PSGTEEV

SEQ ID NO: 2156694 - protein, 5 aa, Cryptosporidium hominis
PSGTM

SEQ ID NO: 2156695 - protein, 4 aa, Cryptosporidium hominis
PSHY

SEQ ID NO: 2156696 - protein, 7 aa, Cryptosporidium hominis
PSHYQGE

SEQ ID NO: 2156697 - protein, 5 aa, Cryptosporidium hominis
PSINN

SEQ ID NO: 2156698 - protein, 11 aa, Cryptosporidium hominis
PSIPNKEPERA

SEQ ID NO: 2156699 - protein, 16 aa, Cryptosporidium hominis
PSIQAPEGGENLNESY

SEQ ID NO: 2156700 - protein, 5 aa, Cryptosporidium hominis
PSISE

SEQ ID NO: 2156701 - protein, 6 aa, Cryptosporidium hominis
PSISEG

SEQ ID NO: 2156702 - protein, 11 aa, Cryptosporidium hominis
PSISEKTLNSA

SEQ ID NO: 2156703 - protein, 14 aa, Cryptosporidium hominis
PSKDKPYDAAKDSV

SEQ ID NO: 2156704 - protein, 17 aa, Cryptosporidium hominis
PSKELNGATVQDSPTYQ

SEQ ID NO: 2156705 - protein, 7 aa, Cryptosporidium hominis
PSKFGKG

SEQ ID NO: 2156706 - protein, 7 aa, Cryptosporidium hominis
PSKGDKV

SEQ ID NO: 2156707 - protein, 12 aa, Cryptosporidium hominis
PSKGESSKASTN

SEQ ID NO: 2156708 - protein, 10 aa, Cryptosporidium hominis
PSKHNRQIRE

SEQ ID NO: 2156709 - protein, 9 aa, Cryptosporidium hominis
PSKINPSMA

SEQ ID NO: 2156710 - protein, 11 aa, Cryptosporidium hominis
PSKKNNLETDI

SEQ ID NO: 2156711 - protein, 10 aa, Cryptosporidium hominis
PSKNEPKNLP

SEQ ID NO: 2156712 - protein, 20 aa, Cryptosporidium hominis
PSKNKDGKDSNTKNQKADFP

SEQ ID NO: 2156713 - protein, 6 aa, Cryptosporidium hominis
PSKQNG

SEQ ID NO: 2156714 - protein, 4 aa, Cryptosporidium hominis
PSKR

SEQ ID NO: 2156715 - protein, 17 aa, Cryptosporidium hominis
PSKSAHYSSESSSNEKS

SEQ ID NO: 2156716 - protein, 9 aa, Cryptosporidium hominis
PSKSNCDLR

SEQ ID NO: 2156717 - protein, 7 aa, Cryptosporidium hominis
PSKSYAL

SEQ ID NO: 2156718 - protein, 6 aa, Cryptosporidium hominis
PSKTTI

SEQ ID NO: 2156719 - protein, 5 aa, Cryptosporidium hominis
PSLDS

SEQ ID NO: 2156720 - protein, 4 aa, Cryptosporidium hominis
PSLG

SEQ ID NO: 2156721 - protein, 8 aa, Cryptosporidium hominis
PSLGPSNN

SEQ ID NO: 2156722 - protein, 5 aa, Cryptosporidium hominis
PSLPG

SEQ ID NO: 2156723 - protein, 8 aa, Cryptosporidium hominis
PSLPNYTQ

SEQ ID NO: 2156724 - protein, 7 aa, Cryptosporidium hominis
PSLPPNE

SEQ ID NO: 2156725 - protein, 5 aa, Cryptosporidium hominis
PSLPS

SEQ ID NO: 2156726 - protein, 7 aa, Cryptosporidium hominis
PSLQDKI

SEQ ID NO: 2156727 - protein, 5 aa, Cryptosporidium hominis
PSLRS

SEQ ID NO: 2156728 - protein, 8 aa, Cryptosporidium hominis
PSLSPTEY

SEQ ID NO: 2156729 - protein, 64 aa, Cryptosporidium hominis
  misc_feature (13)..(49): Xaa can be any naturally occurring amino acid
PSMGGEGGIMVDXXXXXXXXXXXXXXXXXXXXXXXXXXXXXXXXXXXXXVIMQINLKKIQIGLY

SEQ ID NO: 2156730 - protein, 11 aa, Cryptosporidium hominis
PSMSGGRSSVG

SEQ ID NO: 2156731 - protein, 48 aa, Cryptosporidium hominis
PSNDNTQTVTTNEVSTNDQNQVPNKRRGSSSNRNSSSRKSSSSSKAIA

SEQ ID NO: 2156732 - protein, 13 aa, Cryptosporidium hominis
PSNDSTKATSSIP

SEQ ID NO: 2156733 - protein, 10 aa, Cryptosporidium hominis
PSNEEIERQK

SEQ ID NO: 2156734 - protein, 9 aa, Cryptosporidium hominis
PSNEGSSID

SEQ ID NO: 2156735 - protein, 6 aa, Cryptosporidium hominis
PSNEKA

SEQ ID NO: 2156736 - protein, 8 aa, Cryptosporidium hominis
PSNEKRSF

SEQ ID NO: 2156737 - protein, 15 aa, Cryptosporidium hominis
PSNEPSKSNLTGYAG

SEQ ID NO: 2156738 - protein, 10 aa, Cryptosporidium hominis
PSNESSTPIS

SEQ ID NO: 2156739 - protein, 6 aa, Cryptosporidium hominis
PSNETN

SEQ ID NO: 2156740 - protein, 7 aa, Cryptosporidium hominis
PSNGGYN

SEQ ID NO: 2156741 - protein, 8 aa, Cryptosporidium hominis
PSNGKDAK

SEQ ID NO: 2156742 - protein, 24 aa, Cryptosporidium hominis
PSNHYSSSSLDYNQRHSENKSICD

SEQ ID NO: 2156743 - protein, 4 aa, Cryptosporidium hominis
PSNL

SEQ ID NO: 2156744 - protein, 25 aa, Cryptosporidium hominis
PSNLSTKKSRAKRKVADAIKRVEIT

SEQ ID NO: 2156745 - protein, 6 aa, Cryptosporidium hominis
PSNNSE

SEQ ID NO: 2156746 - protein, 9 aa, Cryptosporidium hominis
PSNNSGKRN

SEQ ID NO: 2156747 - protein, 10 aa, Cryptosporidium hominis
PSNPSIPPPI

SEQ ID NO: 2156748 - protein, 7 aa, Cryptosporidium hominis
PSNPVQR

SEQ ID NO: 2156749 - protein, 4 aa, Cryptosporidium hominis
PSNQ

SEQ ID NO: 2156750 - protein, 7 aa, Cryptosporidium hominis
PSNRPNV

SEQ ID NO: 2156751 - protein, 4 aa, Cryptosporidium hominis
PSNS

SEQ ID NO: 2156752 - protein, 8 aa, Cryptosporidium hominis
PSNSDPFN

SEQ ID NO: 2156753 - protein, 13 aa, Cryptosporidium hominis
PSNSDQSRKSWTT

SEQ ID NO: 2156754 - protein, 49 aa, Cryptosporidium hominis
PSNSGDSSPISKTEDESNVKRRKSFSRSPSVSSIEGNNTQNLGKEKARK

SEQ ID NO: 2156755 - protein, 7 aa, Cryptosporidium hominis
PSNSKLD

SEQ ID NO: 2156756 - protein, 6 aa, Cryptosporidium hominis
PSNSMN

SEQ ID NO: 2156757 - protein, 76 aa, Cryptosporidium hominis
PSNSTGNQKFKANGRKNNNSSGNRTGNKSGHSPSNPKKNNNQKSSFVNGTNPEGTYSEPKVGSKIASISKSPVNDA

SEQ ID NO: 2156758 - protein, 18 aa, Cryptosporidium hominis
PSNTENDSQENGMGNNEL

SEQ ID NO: 2156759 - protein, 5 aa, Cryptosporidium hominis
PSNVS

SEQ ID NO: 2156760 - protein, 15 aa, Cryptosporidium hominis
PSNWGDSQADAESAA

SEQ ID NO: 2156761 - protein, 23 aa, Cryptosporidium hominis
PSNYSSSLQSDHPTSTDPNQTYV

SEQ ID NO: 2156762 - protein, 9 aa, Cryptosporidium hominis
PSPAAAQKY

SEQ ID NO: 2156763 - protein, 12 aa, Cryptosporidium hominis
PSPDFTKIPPED

SEQ ID NO: 2156764 - protein, 5 aa, Cryptosporidium hominis
PSPEE

SEQ ID NO: 2156765 - protein, 4 aa, Cryptosporidium hominis
PSPF

SEQ ID NO: 2156766 - protein, 17 aa, Cryptosporidium hominis
PSPPPPPFSPSSSPLPS

SEQ ID NO: 2156767 - protein, 5 aa, Cryptosporidium hominis
PSPRN

SEQ ID NO: 2156768 - protein, 8 aa, Cryptosporidium hominis
PSPSPLPF

SEQ ID NO: 2156769 - protein, 4 aa, Cryptosporidium hominis
PSQA

SEQ ID NO: 2156770 - protein, 8 aa, Cryptosporidium hominis
PSQDETGK

SEQ ID NO: 2156771 - protein, 5 aa, Cryptosporidium hominis
PSQNW

SEQ ID NO: 2156772 - protein, 4 aa, Cryptosporidium hominis
PSQR

SEQ ID NO: 2156773 - protein, 11 aa, Cryptosporidium hominis
PSQRDQGRKAQ

SEQ ID NO: 2156774 - protein, 10 aa, Cryptosporidium hominis
PSQSGLSSQF

SEQ ID NO: 2156775 - protein, 7 aa, Cryptosporidium hominis
PSQTTFP

SEQ ID NO: 2156776 - protein, 6 aa, Cryptosporidium hominis
PSRELD

SEQ ID NO: 2156777 - protein, 19 aa, Cryptosporidium hominis
PSRGYTESLQQNKSDNKTT

SEQ ID NO: 2156778 - protein, 4 aa, Cryptosporidium hominis
PSRI

SEQ ID NO: 2156779 - protein, 8 aa, Cryptosporidium hominis
PSRRSTER

SEQ ID NO: 2156780 - protein, 6 aa, Cryptosporidium hominis
PSRSSI

SEQ ID NO: 2156781 - protein, 7 aa, Cryptosporidium hominis
PSRSSTR

SEQ ID NO: 2156782 - protein, 6 aa, Cryptosporidium hominis
PSRVGG

SEQ ID NO: 2156783 - protein, 12 aa, Cryptosporidium hominis
PSSASVSSNIDS

SEQ ID NO: 2156784 - protein, 11 aa, Cryptosporidium hominis
PSSATRGQKPV

SEQ ID NO: 2156785 - protein, 4 aa, Cryptosporidium hominis
PSSF

SEQ ID NO: 2156786 - protein, 12 aa, Cryptosporidium hominis
PSSFEGYSGEIS

SEQ ID NO: 2156787 - protein, 10 aa, Cryptosporidium hominis
PSSGAGNGNF

SEQ ID NO: 2156788 - protein, 5 aa, Cryptosporidium hominis
PSSGT

SEQ ID NO: 2156789 - protein, 12 aa, Cryptosporidium hominis
PSSHNASTSQAA

SEQ ID NO: 2156790 - protein, 9 aa, Cryptosporidium hominis
PSSIENTST

SEQ ID NO: 2156791 - protein, 8 aa, Cryptosporidium hominis
PSSKSPIT

SEQ ID NO: 2156792 - protein, 4 aa, Cryptosporidium hominis
PSSL

SEQ ID NO: 2156793 - protein, 5 aa, Cryptosporidium hominis
PSSLN

SEQ ID NO: 2156794 - protein, 7 aa, Cryptosporidium hominis
PSSMNNQ

SEQ ID NO: 2156795 - protein, 6 aa, Cryptosporidium hominis
PSSNEL

SEQ ID NO: 2156796 - protein, 7 aa, Cryptosporidium hominis
PSSNGRF

SEQ ID NO: 2156797 - protein, 8 aa, Cryptosporidium hominis
PSSNQGVY

SEQ ID NO: 2156798 - protein, 9 aa, Cryptosporidium hominis
PSSNSEITK

SEQ ID NO: 2156799 - protein, 5 aa, Cryptosporidium hominis
PSSNT

SEQ ID NO: 2156800 - protein, 8 aa, Cryptosporidium hominis
PSSPQASV

SEQ ID NO: 2156801 - protein, 19 aa, Cryptosporidium hominis
PSSSDTTNADESNMTEKQR

SEQ ID NO: 2156802 - protein, 8 aa, Cryptosporidium hominis
PSSSKEGI

SEQ ID NO: 2156803 - protein, 13 aa, Cryptosporidium hominis
PSSSSSRKPRKSL

SEQ ID NO: 2156804 - protein, 15 aa, Cryptosporidium hominis
PSSSTPIRKSRSIRS

SEQ ID NO: 2156805 - protein, 10 aa, Cryptosporidium hominis
PSSTTTSYNI

SEQ ID NO: 2156806 - protein, 5 aa, Cryptosporidium hominis
PSSWP

SEQ ID NO: 2156807 - protein, 4 aa, Cryptosporidium hominis
PSSY

SEQ ID NO: 2156808 - protein, 5 aa, Cryptosporidium hominis
PSSYT

SEQ ID NO: 2156809 - protein, 4 aa, Cryptosporidium hominis
PSTA

SEQ ID NO: 2156810 - protein, 12 aa, Cryptosporidium hominis
PSTEGSSDKNIA

SEQ ID NO: 2156811 - protein, 10 aa, Cryptosporidium hominis
PSTFNSPSQY

SEQ ID NO: 2156812 - protein, 6 aa, Cryptosporidium hominis
PSTFRN

SEQ ID NO: 2156813 - protein, 5 aa, Cryptosporidium hominis
PSTGQ

SEQ ID NO: 2156814 - protein, 17 aa, Cryptosporidium hominis
PSTNNQEEVKDGQTSGS

SEQ ID NO: 2156815 - protein, 8 aa, Cryptosporidium hominis
PSVLNDPD

SEQ ID NO: 2156816 - protein, 4 aa, Cryptosporidium hominis
PSVN

SEQ ID NO: 2156817 - protein, 8 aa, Cryptosporidium hominis
PSVNNRQE

SEQ ID NO: 2156818 - protein, 4 aa, Cryptosporidium hominis
PSVP

SEQ ID NO: 2156819 - protein, 23 aa, Cryptosporidium hominis
PSVSPKSWKGTPVTNEKKKSLSS

SEQ ID NO: 2156820 - protein, 14 aa, Cryptosporidium hominis
PSVTSIDNTSSNID

SEQ ID NO: 2156821 - protein, 7 aa, Cryptosporidium hominis
PSYDSDI

SEQ ID NO: 2156822 - protein, 4 aa, Cryptosporidium hominis
PSYK

SEQ ID NO: 2156823 - protein, 5 aa, Cryptosporidium hominis
PSYKG

SEQ ID NO: 2156824 - protein, 4 aa, Cryptosporidium hominis
PSYP

SEQ ID NO: 2156825 - protein, 4 aa, Cryptosporidium hominis
PSYR

SEQ ID NO: 2156826 - protein, 22 aa, Cryptosporidium hominis
PSYSSENDQNNDLIKWSNLFGV

SEQ ID NO: 2156827 - protein, 5 aa, Cryptosporidium hominis
PTAAS

SEQ ID NO: 2156828 - protein, 9 aa, Cryptosporidium hominis
PTANNNGKL

SEQ ID NO: 2156829 - protein, 50 aa, Cryptosporidium hominis
PTAPKTQKQKKSKTKLENDNEDKGVNKSALSTSNKRQKTGSLSGKGTSGS

SEQ ID NO: 2156830 - protein, 6 aa, Cryptosporidium hominis
PTARTP

SEQ ID NO: 2156831 - protein, 6 aa, Cryptosporidium hominis
PTASGK

SEQ ID NO: 2156832 - protein, 8 aa, Cryptosporidium hominis
PTATSPDS

SEQ ID NO: 2156833 - protein, 6 aa, Cryptosporidium hominis
PTCESD

SEQ ID NO: 2156834 - protein, 5 aa, Cryptosporidium hominis
PTDIQ

SEQ ID NO: 2156835 - protein, 7 aa, Cryptosporidium hominis
PTDPESP

SEQ ID NO: 2156836 - protein, 12 aa, Cryptosporidium hominis
PTEASLTTTQCS

SEQ ID NO: 2156837 - protein, 34 aa, Cryptosporidium hominis
PTEDKNKTASQNGSTKKTSTQKDPKSLKEAKNKR

SEQ ID NO: 2156838 - protein, 6 aa, Cryptosporidium hominis
PTEDTI

SEQ ID NO: 2156839 - protein, 18 aa, Cryptosporidium hominis
PTELEKEKNLGTPPSEEY

SEQ ID NO: 2156840 - protein, 13 aa, Cryptosporidium hominis
PTENDINIRIIGT

SEQ ID NO: 2156841 - protein, 9 aa, Cryptosporidium hominis
PTENKTHNK

SEQ ID NO: 2156842 - protein, 4 aa, Cryptosporidium hominis
PTEP

SEQ ID NO: 2156843 - protein, 6 aa, Cryptosporidium hominis
PTEPVS

SEQ ID NO: 2156844 - protein, 5 aa, Cryptosporidium hominis
PTERE

SEQ ID NO: 2156845 - protein, 8 aa, Cryptosporidium hominis
PTESAANA

SEQ ID NO: 2156846 - protein, 7 aa, Cryptosporidium hominis
PTESEIT

SEQ ID NO: 2156847 - protein, 16 aa, Cryptosporidium hominis
PTESSINKLSSTELEN

SEQ ID NO: 2156848 - protein, 11 aa, Cryptosporidium hominis
PTFPDQQPSGC

SEQ ID NO: 2156849 - protein, 7 aa, Cryptosporidium hominis
PTGEETF

SEQ ID NO: 2156850 - protein, 49 aa, Cryptosporidium hominis
PTGETSKTEPSNSSKYLPKEDDDLSEEETKEDSEEGDTRVSDKEKPIKK

SEQ ID NO: 2156851 - protein, 4 aa, Cryptosporidium hominis
PTGI

SEQ ID NO: 2156852 - protein, 8 aa, Cryptosporidium hominis
PTGNKPFS

SEQ ID NO: 2156853 - protein, 7 aa, Cryptosporidium hominis
PTGTGKT

SEQ ID NO: 2156854 - protein, 9 aa, Cryptosporidium hominis
PTGTQPGMS

SEQ ID NO: 2156855 - protein, 8 aa, Cryptosporidium hominis
PTGTSVEE

SEQ ID NO: 2156856 - protein, 11 aa, Cryptosporidium hominis
PTGVSKTSSID

SEQ ID NO: 2156857 - protein, 7 aa, Cryptosporidium hominis
PTHTQVR

SEQ ID NO: 2156858 - protein, 5 aa, Cryptosporidium hominis
PTIAN

SEQ ID NO: 2156859 - protein, 4 aa, Cryptosporidium hominis
PTIY

SEQ ID NO: 2156860 - protein, 9 aa, Cryptosporidium hominis
PTKDRRADI

SEQ ID NO: 2156861 - protein, 5 aa, Cryptosporidium hominis
PTKEG

SEQ ID NO: 2156862 - protein, 9 aa, Cryptosporidium hominis
PTKGCGNRT

SEQ ID NO: 2156863 - protein, 15 aa, Cryptosporidium hominis
PTKGLKESEKENQSK

SEQ ID NO: 2156864 - protein, 6 aa, Cryptosporidium hominis
PTKNQA

SEQ ID NO: 2156865 - protein, 5 aa, Cryptosporidium hominis
PTKNS

SEQ ID NO: 2156866 - protein, 5 aa, Cryptosporidium hominis
PTKQQ

SEQ ID NO: 2156867 - protein, 4 aa, Cryptosporidium hominis
PTKS

SEQ ID NO: 2156868 - protein, 13 aa, Cryptosporidium hominis
PTKTETTTTMTET

SEQ ID NO: 2156869 - protein, 10 aa, Cryptosporidium hominis
PTLGASPTSC

SEQ ID NO: 2156870 - protein, 7 aa, Cryptosporidium hominis
PTLPSIT

SEQ ID NO: 2156871 - protein, 15 aa, Cryptosporidium hominis
PTLSMESSENSQDSE

SEQ ID NO: 2156872 - protein, 4 aa, Cryptosporidium hominis
PTNE

SEQ ID NO: 2156873 - protein, 13 aa, Cryptosporidium hominis
PTNHESSESRSTF

SEQ ID NO: 2156874 - protein, 14 aa, Cryptosporidium hominis
PTNMKDDEECMMCS

SEQ ID NO: 2156875 - protein, 11 aa, Cryptosporidium hominis
PTNNEHSNSIN

SEQ ID NO: 2156876 - protein, 10 aa, Cryptosporidium hominis
PTNNNTMDSS

SEQ ID NO: 2156877 - protein, 5 aa, Cryptosporidium hominis
PTNNR

SEQ ID NO: 2156878 - protein, 10 aa, Cryptosporidium hominis
PTNSGQNETL

SEQ ID NO: 2156879 - protein, 35 aa, Cryptosporidium hominis
PTNSNINSEGISNLGEGLDTSNTGESLNKKPRIDD

SEQ ID NO: 2156880 - protein, 17 aa, Cryptosporidium hominis
PTNSPYTPIPQAPRPLP

SEQ ID NO: 2156881 - protein, 17 aa, Cryptosporidium hominis
PTNSSEFGKAPDTTGGA

SEQ ID NO: 2156882 - protein, 11 aa, Cryptosporidium hominis
PTNSSSTSTSR

SEQ ID NO: 2156883 - protein, 4 aa, Cryptosporidium hominis
PTPD

SEQ ID NO: 2156884 - protein, 5 aa, Cryptosporidium hominis
PTPDE

SEQ ID NO: 2156885 - protein, 7 aa, Cryptosporidium hominis
PTPGTVE

SEQ ID NO: 2156886 - protein, 12 aa, Cryptosporidium hominis
PTPNNRADSPRI

SEQ ID NO: 2156887 - protein, 17 aa, Cryptosporidium hominis
PTPRKASEKEKLRPETQ

SEQ ID NO: 2156888 - protein, 9 aa, Cryptosporidium hominis
PTPSQRISS

SEQ ID NO: 2156889 - protein, 15 aa, Cryptosporidium hominis
PTQDNNTGRKLSPAE

SEQ ID NO: 2156890 - protein, 9 aa, Cryptosporidium hominis
PTQNSQQIN

SEQ ID NO: 2156891 - protein, 18 aa, Cryptosporidium hominis
PTQQGNVNPNKSKTYEKP

SEQ ID NO: 2156892 - protein, 4 aa, Cryptosporidium hominis
PTQR

SEQ ID NO: 2156893 - protein, 17 aa, Cryptosporidium hominis
PTRARGERVYKPGGKKE

SEQ ID NO: 2156894 - protein, 17 aa, Cryptosporidium hominis
PTRDEKEEGGGEKAELP

SEQ ID NO: 2156895 - protein, 18 aa, Cryptosporidium hominis
PTRDLEKGDWNNDAVNSS

SEQ ID NO: 2156896 - protein, 4 aa, Cryptosporidium hominis
PTRR

SEQ ID NO: 2156897 - protein, 6 aa, Cryptosporidium hominis
PTSDKG

SEQ ID NO: 2156898 - protein, 4 aa, Cryptosporidium hominis
PTSI

SEQ ID NO: 2156899 - protein, 10 aa, Cryptosporidium hominis
PTSIENQKKM

SEQ ID NO: 2156900 - protein, 12 aa, Cryptosporidium hominis
PTSKRNHKAWMI

SEQ ID NO: 2156901 - protein, 7 aa, Cryptosporidium hominis
PTSPRNY

SEQ ID NO: 2156902 - protein, 6 aa, Cryptosporidium hominis
PTSRDP

SEQ ID NO: 2156903 - protein, 7 aa, Cryptosporidium hominis
PTSREEI

SEQ ID NO: 2156904 - protein, 12 aa, Cryptosporidium hominis
PTSRISSSCFPS

SEQ ID NO: 2156905 - protein, 17 aa, Cryptosporidium hominis
PTSSDQSKVNIKDESQI

SEQ ID NO: 2156906 - protein, 6 aa, Cryptosporidium hominis
PTSSKD

SEQ ID NO: 2156907 - protein, 15 aa, Cryptosporidium hominis
PTSSLLPETSEATNP

SEQ ID NO: 2156908 - protein, 5 aa, Cryptosporidium hominis
PTSSV

SEQ ID NO: 2156909 - protein, 12 aa, Cryptosporidium hominis
PTSTNDQNSKGN

SEQ ID NO: 2156910 - protein, 12 aa, Cryptosporidium hominis
PTSVEQNSKYCS

SEQ ID NO: 2156911 - protein, 5 aa, Cryptosporidium hominis
PTTDM

SEQ ID NO: 2156912 - protein, 7 aa, Cryptosporidium hominis
PTTESDF

SEQ ID NO: 2156913 - protein, 6 aa, Cryptosporidium hominis
PTTLSP

SEQ ID NO: 2156914 - protein, 7 aa, Cryptosporidium hominis
PTTNPIR

SEQ ID NO: 2156915 - protein, 8 aa, Cryptosporidium hominis
PTTSDDEI

SEQ ID NO: 2156916 - protein, 11 aa, Cryptosporidium hominis
PTTTSASISAH

SEQ ID NO: 2156917 - protein, 5 aa, Cryptosporidium hominis
PTVEE

SEQ ID NO: 2156918 - protein, 4 aa, Cryptosporidium hominis
PTYK

SEQ ID NO: 2156919 - protein, 7 aa, Cryptosporidium hominis
PTYPDAG

SEQ ID NO: 2156920 - protein, 14 aa, Cryptosporidium hominis
PTYQDSKKTTKIKP

SEQ ID NO: 2156921 - protein, 5 aa, Cryptosporidium hominis
PTYSK

SEQ ID NO: 2156922 - protein, 9 aa, Cryptosporidium hominis
PVAERDREK

SEQ ID NO: 2156923 - protein, 18 aa, Cryptosporidium hominis
PVDSPSTCGEESITPSKE

SEQ ID NO: 2156924 - protein, 4 aa, Cryptosporidium hominis
PVGE

SEQ ID NO: 2156925 - protein, 14 aa, Cryptosporidium hominis
PVGEQTHGQMIYTK

SEQ ID NO: 2156926 - protein, 7 aa, Cryptosporidium hominis
PVGQKDS

SEQ ID NO: 2156927 - protein, 6 aa, Cryptosporidium hominis
PVGRNS

SEQ ID NO: 2156928 - protein, 12 aa, Cryptosporidium hominis
PVKDGNSGPKWP

SEQ ID NO: 2156929 - protein, 8 aa, Cryptosporidium hominis
PVKDNDKE

SEQ ID NO: 2156930 - protein, 9 aa, Cryptosporidium hominis
PVKEPNIEN

SEQ ID NO: 2156931 - protein, 5 aa, Cryptosporidium hominis
PVKKG

SEQ ID NO: 2156932 - protein, 40 aa, Cryptosporidium hominis
PVKPFNDEQSNESKNISKSTRIKQQNEDQSEKKVDLSPKN

SEQ ID NO: 2156933 - protein, 10 aa, Cryptosporidium hominis
PVNGEDLPEN

SEQ ID NO: 2156934 - protein, 4 aa, Cryptosporidium hominis
PVNP

SEQ ID NO: 2156935 - protein, 13 aa, Cryptosporidium hominis
PVNTGDSLSANNV

SEQ ID NO: 2156936 - protein, 13 aa, Cryptosporidium hominis
PVPGNESNREVQD

SEQ ID NO: 2156937 - protein, 4 aa, Cryptosporidium hominis
PVPL

SEQ ID NO: 2156938 - protein, 19 aa, Cryptosporidium hominis
PVPPSYKGVGTRKNPIGGV

SEQ ID NO: 2156939 - protein, 11 aa, Cryptosporidium hominis
PVPQQNNGSDC

SEQ ID NO: 2156940 - protein, 12 aa, Cryptosporidium hominis
PVPSHSNINSSV

SEQ ID NO: 2156941 - protein, 21 aa, Cryptosporidium hominis
PVSDSDYSKQEQIKNTSGDSK

SEQ ID NO: 2156942 - protein, 4 aa, Cryptosporidium hominis
PVSG

SEQ ID NO: 2156943 - protein, 22 aa, Cryptosporidium hominis
PVSGETSNSNTELKKQNSDFKS

SEQ ID NO: 2156944 - protein, 17 aa, Cryptosporidium hominis
PVSGSGGSTISSSSTNN

SEQ ID NO: 2156945 - protein, 7 aa, Cryptosporidium hominis
PVSGSSM

SEQ ID NO: 2156946 - protein, 7 aa, Cryptosporidium hominis
PVSKIPS

SEQ ID NO: 2156947 - protein, 9 aa, Cryptosporidium hominis
PVSKKTTVS

SEQ ID NO: 2156948 - protein, 9 aa, Cryptosporidium hominis
PVSKRQKQE

SEQ ID NO: 2156949 - protein, 4 aa, Cryptosporidium hominis
PVSN

SEQ ID NO: 2156950 - protein, 12 aa, Cryptosporidium hominis
PVSRRKLDRSSL

SEQ ID NO: 2156951 - protein, 16 aa, Cryptosporidium hominis
PVSSEAQRALKDKNVS

SEQ ID NO: 2156952 - protein, 5 aa, Cryptosporidium hominis
PVSTN

SEQ ID NO: 2156953 - protein, 11 aa, Cryptosporidium hominis
PVTAPTRLNGH

SEQ ID NO: 2156954 - protein, 4 aa, Cryptosporidium hominis
PVTP

SEQ ID NO: 2156955 - protein, 6 aa, Cryptosporidium hominis
PVTQDD

SEQ ID NO: 2156956 - protein, 8 aa, Cryptosporidium hominis
PWGKGRPG

SEQ ID NO: 2156957 - protein, 19 aa, Cryptosporidium hominis
PWKGGNQSSSRLKDSTGDD

SEQ ID NO: 2156958 - protein, 13 aa, Cryptosporidium hominis
PWNKDNGKSDEER

SEQ ID NO: 2156959 - protein, 16 aa, Cryptosporidium hominis
PWSSSKPAQPESETNE

SEQ ID NO: 2156960 - protein, 10 aa, Cryptosporidium hominis
PYDPSTGEII

SEQ ID NO: 2156961 - protein, 88 aa, Cryptosporidium hominis
PYEANKETYETEVRDQSSSLTGGGSSSINLDRNKEGLYDSRARSDFDSSSMDISSNGFNTNESVGFSRSGSNFMSNSNGIGNGIKSEF

SEQ ID NO: 2156962 - protein, 7 aa, Cryptosporidium hominis
PYHQPGQ

SEQ ID NO: 2156963 - protein, 9 aa, Cryptosporidium hominis
PYKFSSSQG

SEQ ID NO: 2156964 - protein, 4 aa, Cryptosporidium hominis
PYKG

SEQ ID NO: 2156965 - protein, 4 aa, Cryptosporidium hominis
PYKK

SEQ ID NO: 2156966 - protein, 7 aa, Cryptosporidium hominis
PYKNGED

SEQ ID NO: 2156967 - protein, 7 aa, Cryptosporidium hominis
PYKPEDL

SEQ ID NO: 2156968 - protein, 10 aa, Cryptosporidium hominis
PYKVQKDDDL

SEQ ID NO: 2156969 - protein, 6 aa, Cryptosporidium hominis
PYNQKS

SEQ ID NO: 2156970 - protein, 5 aa, Cryptosporidium hominis
PYNRP

SEQ ID NO: 2156971 - protein, 4 aa, Cryptosporidium hominis
PYPG

SEQ ID NO: 2156972 - protein, 31 aa, Cryptosporidium hominis
PYPPKAPLSDCNNSESESSFSKKMQDNKERL

SEQ ID NO: 2156973 - protein, 4 aa, Cryptosporidium hominis
PYPT

SEQ ID NO: 2156974 - protein, 11 aa, Cryptosporidium hominis
PYQNGNPNQMT

SEQ ID NO: 2156975 - protein, 74 aa, Cryptosporidium hominis
PYQQGGSGFPPPPPLPPTPPSLPLSQTPSNDDFPPPPPPPPPPPPPSPPPQSPPPQSPPSLPPYPVSGSQGSMP

SEQ ID NO: 2156976 - protein, 15 aa, Cryptosporidium hominis
PYQTTPEVQTNNPNL

SEQ ID NO: 2156977 - protein, 12 aa, Cryptosporidium hominis
PYSDQNKPESLS

SEQ ID NO: 2156978 - protein, 10 aa, Cryptosporidium hominis
PYSEATSQAI

SEQ ID NO: 2156979 - protein, 12 aa, Cryptosporidium hominis
PYSENNNNNSLN

SEQ ID NO: 2156980 - protein, 13 aa, Cryptosporidium hominis
PYSGENDESTTEI

SEQ ID NO: 2156981 - protein, 5 aa, Cryptosporidium hominis
PYSPE

SEQ ID NO: 2156982 - protein, 8 aa, Cryptosporidium hominis
PYSPTDSR

SEQ ID NO: 2156983 - protein, 15 aa, Cryptosporidium hominis
PYSQSKISSRSTGID

SEQ ID NO: 2156984 - protein, 52 aa, Cryptosporidium hominis
PYSSSISTITSSNQSLDDGLSSSGGNLSASTSNSNMNSNPSFSSFSASNNSV

SEQ ID NO: 2156985 - protein, 4 aa, Cryptosporidium hominis
PYTA

SEQ ID NO: 2156986 - protein, 4 aa, Cryptosporidium hominis
PYTE

SEQ ID NO: 2156987 - protein, 6 aa, Cryptosporidium hominis
PYVGDD

SEQ ID NO: 2156988 - protein, 18 aa, Cryptosporidium hominis
QAAENSRSDSEQFSENTE

SEQ ID NO: 2156989 - protein, 8 aa, Cryptosporidium hominis
QAAKTDSK

SEQ ID NO: 2156990 - protein, 9 aa, Cryptosporidium hominis
QADKTLSSC

SEQ ID NO: 2156991 - protein, 11 aa, Cryptosporidium hominis
QADPAPANDPL

SEQ ID NO: 2156992 - protein, 9 aa, Cryptosporidium hominis
QAEEEQINS

SEQ ID NO: 2156993 - protein, 5 aa, Cryptosporidium hominis
QAEEL

SEQ ID NO: 2156994 - protein, 9 aa, Cryptosporidium hominis
QAEEYGDAS

SEQ ID NO: 2156995 - protein, 8 aa, Cryptosporidium hominis
QAEFDTDQ

SEQ ID NO: 2156996 - protein, 7 aa, Cryptosporidium hominis
QAEGQTS

SEQ ID NO: 2156997 - protein, 15 aa, Cryptosporidium hominis
QAEIDPKKNPEKAAA

SEQ ID NO: 2156998 - protein, 5 aa, Cryptosporidium hominis
QAEKL

SEQ ID NO: 2156999 - protein, 9 aa, Cryptosporidium hominis
QAEKSGERI

SEQ ID NO: 2157000 - protein, 18 aa, Cryptosporidium hominis
QAEKSNSRTFKGDDSGLS

SEQ ID NO: 2157001 - protein, 5 aa, Cryptosporidium hominis
QAEKT

SEQ ID NO: 2157002 - protein, 4 aa, Cryptosporidium hominis
QAEM

SEQ ID NO: 2157003 - protein, 15 aa, Cryptosporidium hominis
QAENYAASNASPNKY

SEQ ID NO: 2157004 - protein, 31 aa, Cryptosporidium hominis
QAEPIQEATNAESDEKNQVAPQIERSNDPSC

SEQ ID NO: 2157005 - protein, 13 aa, Cryptosporidium hominis
QAGIENTEANRAA

SEQ ID NO: 2157006 - protein, 5 aa, Cryptosporidium hominis
QAGKK

SEQ ID NO: 2157007 - protein, 6 aa, Cryptosporidium hominis
QAGKTV

SEQ ID NO: 2157008 - protein, 5 aa, Cryptosporidium hominis
QAGLR

SEQ ID NO: 2157009 - protein, 7 aa, Cryptosporidium hominis
QAGRGGR

SEQ ID NO: 2157010 - protein, 5 aa, Cryptosporidium hominis
QAGSD

SEQ ID NO: 2157011 - protein, 8 aa, Cryptosporidium hominis
QAGSPKIE

SEQ ID NO: 2157012 - protein, 7 aa, Cryptosporidium hominis
QAGTPEV

SEQ ID NO: 2157013 - protein, 9 aa, Cryptosporidium hominis
QAHPHSQND

SEQ ID NO: 2157014 - protein, 27 aa, Cryptosporidium hominis
QAIKEDRKRGREQDEDRRVDSGYSRKR

SEQ ID NO: 2157015 - protein, 37 aa, Cryptosporidium hominis
QAIKGTQNSNLNSISSKGGGQDSTGVNTKSEQGEISI

SEQ ID NO: 2157016 - protein, 8 aa, Cryptosporidium hominis
QAISYNRT

SEQ ID NO: 2157017 - protein, 13 aa, Cryptosporidium hominis
QAITDSKEKIQNS

SEQ ID NO: 2157018 - protein, 10 aa, Cryptosporidium hominis
QAITNPENTV

SEQ ID NO: 2157019 - protein, 8 aa, Cryptosporidium hominis
QAKGKPSC

SEQ ID NO: 2157020 - protein, 8 aa, Cryptosporidium hominis
QAKNNPNV

SEQ ID NO: 2157021 - protein, 8 aa, Cryptosporidium hominis
QAKNTDSS

SEQ ID NO: 2157022 - protein, 5 aa, Cryptosporidium hominis
QAKPP

SEQ ID NO: 2157023 - protein, 15 aa, Cryptosporidium hominis
QAKSNIRVTPADDRN

SEQ ID NO: 2157024 - protein, 4 aa, Cryptosporidium hominis
QALG

SEQ ID NO: 2157025 - protein, 8 aa, Cryptosporidium hominis
QALNSPAI

SEQ ID NO: 2157026 - protein, 5 aa, Cryptosporidium hominis
QALQQ

SEQ ID NO: 2157027 - protein, 7 aa, Cryptosporidium hominis
QALTTRS

SEQ ID NO: 2157028 - protein, 6 aa, Cryptosporidium hominis
QANMED

SEQ ID NO: 2157029 - protein, 4 aa, Cryptosporidium hominis
QANQ

SEQ ID NO: 2157030 - protein, 18 aa, Cryptosporidium hominis
QANTTGMNYKNSSSKSSL

SEQ ID NO: 2157031 - protein, 40 aa, Cryptosporidium hominis
QAPAYITPNSGGGNNQDSDDSDDDNHVPYATKKKSKNRYS

SEQ ID NO: 2157032 - protein, 11 aa, Cryptosporidium hominis
QAPGDIAEEYD

SEQ ID NO: 2157033 - protein, 5 aa, Cryptosporidium hominis
QAPGI

SEQ ID NO: 2157034 - protein, 22 aa, Cryptosporidium hominis
QAPNQNIYSNTNQTSLNADDTF

SEQ ID NO: 2157035 - protein, 7 aa, Cryptosporidium hominis
QAPSFPD

SEQ ID NO: 2157036 - protein, 8 aa, Cryptosporidium hominis
QAPSLNPK

SEQ ID NO: 2157037 - protein, 4 aa, Cryptosporidium hominis
QAQA

SEQ ID NO: 2157038 - protein, 10 aa, Cryptosporidium hominis
QAQRGANQAF

SEQ ID NO: 2157039 - protein, 31 aa, Cryptosporidium hominis
QAQSEMGQQPTSNPREFREQKQRHQRNSVHA

SEQ ID NO: 2157040 - protein, 11 aa, Cryptosporidium hominis
QAQTEEPEQSC

SEQ ID NO: 2157041 - protein, 19 aa, Cryptosporidium hominis
QAQTQSQAQVQSSQALPEL

SEQ ID NO: 2157042 - protein, 9 aa, Cryptosporidium hominis
QARNNRGTR

SEQ ID NO: 2157043 - protein, 18 aa, Cryptosporidium hominis
QASGANGTINNTFSSGNN

SEQ ID NO: 2157044 - protein, 8 aa, Cryptosporidium hominis
QASKDHQS

SEQ ID NO: 2157045 - protein, 7 aa, Cryptosporidium hominis
QASKIQN

SEQ ID NO: 2157046 - protein, 13 aa, Cryptosporidium hominis
QASKKSESSIADP

SEQ ID NO: 2157047 - protein, 6 aa, Cryptosporidium hominis
QASKSH

SEQ ID NO: 2157048 - protein, 7 aa, Cryptosporidium hominis
QASLAEK

SEQ ID NO: 2157049 - protein, 10 aa, Cryptosporidium hominis
QASNEGNPEM

SEQ ID NO: 2157050 - protein, 9 aa, Cryptosporidium hominis
QASNTRNSY

SEQ ID NO: 2157051 - protein, 12 aa, Cryptosporidium hominis
QASQAEKNRAAK

SEQ ID NO: 2157052 - protein, 5 aa, Cryptosporidium hominis
QASQT

SEQ ID NO: 2157053 - protein, 21 aa, Cryptosporidium hominis
  misc_feature (14)..(14): Xaa can be any naturally occurring amino acid
QASSPSVEIQQRAXRIYTNFE

SEQ ID NO: 2157054 - protein, 9 aa, Cryptosporidium hominis
QASSQGYSS

SEQ ID NO: 2157055 - protein, 8 aa, Cryptosporidium hominis
QASTATSR

SEQ ID NO: 2157056 - protein, 6 aa, Cryptosporidium hominis
QASYQT

SEQ ID NO: 2157057 - protein, 26 aa, Cryptosporidium hominis
QATAGQATTTQTNKTTTTDSSTNDNV

SEQ ID NO: 2157058 - protein, 9 aa, Cryptosporidium hominis
QATESREKN

SEQ ID NO: 2157059 - protein, 4 aa, Cryptosporidium hominis
QATK

SEQ ID NO: 2157060 - protein, 25 aa, Cryptosporidium hominis
QAVENKVKTDTNTETDSSSSSSKTQ

SEQ ID NO: 2157061 - protein, 4 aa, Cryptosporidium hominis
QAVG

SEQ ID NO: 2157062 - protein, 8 aa, Cryptosporidium hominis
QAVTGEYP

SEQ ID NO: 2157063 - protein, 5 aa, Cryptosporidium hominis
QCDSQ

SEQ ID NO: 2157064 - protein, 31 aa, Cryptosporidium hominis
QCESSNDEIDHTQTLNSTKYEQNNISESQKN

SEQ ID NO: 2157065 - protein, 24 aa, Cryptosporidium hominis
QCESSSFGLSSDKIKKKQKEEEYG

SEQ ID NO: 2157066 - protein, 10 aa, Cryptosporidium hominis
QCESTESNIE

SEQ ID NO: 2157067 - protein, 7 aa, Cryptosporidium hominis
QCNREKN

SEQ ID NO: 2157068 - protein, 7 aa, Cryptosporidium hominis
QCQGPEG

SEQ ID NO: 2157069 - protein, 19 aa, Cryptosporidium hominis
QCRERKVANGAKESKSQLK

SEQ ID NO: 2157070 - protein, 5 aa, Cryptosporidium hominis
QCSQT

SEQ ID NO: 2157071 - protein, 6 aa, Cryptosporidium hominis
QDAEEV

SEQ ID NO: 2157072 - protein, 6 aa, Cryptosporidium hominis
QDAHSL

SEQ ID NO: 2157073 - protein, 6 aa, Cryptosporidium hominis
QDALGG

SEQ ID NO: 2157074 - protein, 9 aa, Cryptosporidium hominis
QDAPRTPQF

SEQ ID NO: 2157075 - protein, 19 aa, Cryptosporidium hominis
QDCSSSSIFEDQSKETINE

SEQ ID NO: 2157076 - protein, 5 aa, Cryptosporidium hominis
QDDEA

SEQ ID NO: 2157077 - protein, 4 aa, Cryptosporidium hominis
QDDI

SEQ ID NO: 2157078 - protein, 8 aa, Cryptosporidium hominis
QDDNLAPN

SEQ ID NO: 2157079 - protein, 9 aa, Cryptosporidium hominis
QDDRKSSIQ

SEQ ID NO: 2157080 - protein, 9 aa, Cryptosporidium hominis
QDDSLSNRI

SEQ ID NO: 2157081 - protein, 12 aa, Cryptosporidium hominis
QDEAQDSEKTKI

SEQ ID NO: 2157082 - protein, 4 aa, Cryptosporidium hominis
QDEC

SEQ ID NO: 2157083 - protein, 9 aa, Cryptosporidium hominis
QDEDGGTKG

SEQ ID NO: 2157084 - protein, 9 aa, Cryptosporidium hominis
QDEDGLIST

SEQ ID NO: 2157085 - protein, 5 aa, Cryptosporidium hominis
QDEEN

SEQ ID NO: 2157086 - protein, 7 aa, Cryptosporidium hominis
QDEENDE

SEQ ID NO: 2157087 - protein, 13 aa, Cryptosporidium hominis
QDEFSSNEASNNE

SEQ ID NO: 2157088 - protein, 12 aa, Cryptosporidium hominis
QDEGKSEEENLS

SEQ ID NO: 2157089 - protein, 11 aa, Cryptosporidium hominis
QDEGQEERRNQ

SEQ ID NO: 2157090 - protein, 5 aa, Cryptosporidium hominis
QDENN

SEQ ID NO: 2157091 - protein, 6 aa, Cryptosporidium hominis
QDENRE

SEQ ID NO: 2157092 - protein, 4 aa, Cryptosporidium hominis
QDER

SEQ ID NO: 2157093 - protein, 13 aa, Cryptosporidium hominis
QDERFGGDKRYNI

SEQ ID NO: 2157094 - protein, 5 aa, Cryptosporidium hominis
QDETD

SEQ ID NO: 2157095 - protein, 7 aa, Cryptosporidium hominis
QDETGFN

SEQ ID NO: 2157096 - protein, 4 aa, Cryptosporidium hominis
QDEV

SEQ ID NO: 2157097 - protein, 5 aa, Cryptosporidium hominis
QDFED

SEQ ID NO: 2157098 - protein, 17 aa, Cryptosporidium hominis
QDFENDQQVYKRQKISD

SEQ ID NO: 2157099 - protein, 4 aa, Cryptosporidium hominis
QDFQ

SEQ ID NO: 2157100 - protein, 16 aa, Cryptosporidium hominis
QDFSSPKLSPEPKNRL

SEQ ID NO: 2157101 - protein, 5 aa, Cryptosporidium hominis
QDFTE

SEQ ID NO: 2157102 - protein, 11 aa, Cryptosporidium hominis
QDFTKNKELNE

SEQ ID NO: 2157103 - protein, 13 aa, Cryptosporidium hominis
QDFTLNDDQDLDD

SEQ ID NO: 2157104 - protein, 6 aa, Cryptosporidium hominis
QDGFNT

SEQ ID NO: 2157105 - protein, 5 aa, Cryptosporidium hominis
QDGHP

SEQ ID NO: 2157106 - protein, 5 aa, Cryptosporidium hominis
QDGKI

SEQ ID NO: 2157107 - protein, 9 aa, Cryptosporidium hominis
QDGNGKITA

SEQ ID NO: 2157108 - protein, 7 aa, Cryptosporidium hominis
QDGRKLT

SEQ ID NO: 2157109 - protein, 5 aa, Cryptosporidium hominis
QDGSI

SEQ ID NO: 2157110 - protein, 9 aa, Cryptosporidium hominis
QDHNTNDQA

SEQ ID NO: 2157111 - protein, 10 aa, Cryptosporidium hominis
QDIANSPELE

SEQ ID NO: 2157112 - protein, 22 aa, Cryptosporidium hominis
QDIDDDDDDDDDDDDDEDLDCN

SEQ ID NO: 2157113 - protein, 6 aa, Cryptosporidium hominis
QDINNV

SEQ ID NO: 2157114 - protein, 5 aa, Cryptosporidium hominis
QDIQI

SEQ ID NO: 2157115 - protein, 7 aa, Cryptosporidium hominis
QDIQPGE

SEQ ID NO: 2157116 - protein, 7 aa, Cryptosporidium hominis
QDISTKP

SEQ ID NO: 2157117 - protein, 9 aa, Cryptosporidium hominis
QDKATISKK

SEQ ID NO: 2157118 - protein, 15 aa, Cryptosporidium hominis
QDKETTDTNTSSEES

SEQ ID NO: 2157119 - protein, 10 aa, Cryptosporidium hominis
QDKEVGDGTT

SEQ ID NO: 2157120 - protein, 8 aa, Cryptosporidium hominis
QDLESSKW

SEQ ID NO: 2157121 - protein, 7 aa, Cryptosporidium hominis
QDLKEKT

SEQ ID NO: 2157122 - protein, 6 aa, Cryptosporidium hominis
QDLPNA

SEQ ID NO: 2157123 - protein, 7 aa, Cryptosporidium hominis
QDLPNAM

SEQ ID NO: 2157124 - protein, 11 aa, Cryptosporidium hominis
QDLSNALKPEE

SEQ ID NO: 2157125 - protein, 7 aa, Cryptosporidium hominis
QDMEADE

SEQ ID NO: 2157126 - protein, 5 aa, Cryptosporidium hominis
QDMKN

SEQ ID NO: 2157127 - protein, 5 aa, Cryptosporidium hominis
QDMRS

SEQ ID NO: 2157128 - protein, 90 aa, Cryptosporidium hominis
QDNDEDDDEDGDEDSDEDDEDDEDDEDDLDDLDDDEEEEEEEEEPVKAPSTKNKNKQSSTSQKTKSSDSQPPSKKSRLESKSQSKPDQLY

SEQ ID NO: 2157129 - protein, 7 aa, Cryptosporidium hominis
QDNEEDS

SEQ ID NO: 2157130 - protein, 7 aa, Cryptosporidium hominis
QDNESAK

SEQ ID NO: 2157131 - protein, 9 aa, Cryptosporidium hominis
QDNKENNGG

SEQ ID NO: 2157132 - protein, 10 aa, Cryptosporidium hominis
QDNNINSDSQ

SEQ ID NO: 2157133 - protein, 11 aa, Cryptosporidium hominis
QDNNISNSGLR

SEQ ID NO: 2157134 - protein, 14 aa, Cryptosporidium hominis
QDNNNLDNNGSQES

SEQ ID NO: 2157135 - protein, 6 aa, Cryptosporidium hominis
QDNNTN

SEQ ID NO: 2157136 - protein, 12 aa, Cryptosporidium hominis
QDPDAPIPDTSE

SEQ ID NO: 2157137 - protein, 18 aa, Cryptosporidium hominis
QDPDPDCNQSNKVGSSGF

SEQ ID NO: 2157138 - protein, 4 aa, Cryptosporidium hominis
QDPE

SEQ ID NO: 2157139 - protein, 6 aa, Cryptosporidium hominis
QDPEEL

SEQ ID NO: 2157140 - protein, 5 aa, Cryptosporidium hominis
QDPIK

SEQ ID NO: 2157141 - protein, 6 aa, Cryptosporidium hominis
QDPLNN

SEQ ID NO: 2157142 - protein, 9 aa, Cryptosporidium hominis
QDPQESREI

SEQ ID NO: 2157143 - protein, 11 aa, Cryptosporidium hominis
QDPQNNNHGYK

SEQ ID NO: 2157144 - protein, 11 aa, Cryptosporidium hominis
QDPQTKELSEM

SEQ ID NO: 2157145 - protein, 8 aa, Cryptosporidium hominis
QDPRYKNR

SEQ ID NO: 2157146 - protein, 12 aa, Cryptosporidium hominis
QDPSDYSEAEEV

SEQ ID NO: 2157147 - protein, 5 aa, Cryptosporidium hominis
QDPTL

SEQ ID NO: 2157148 - protein, 6 aa, Cryptosporidium hominis
QDPTLG

SEQ ID NO: 2157149 - protein, 8 aa, Cryptosporidium hominis
QDQDESNS

SEQ ID NO: 2157150 - protein, 5 aa, Cryptosporidium hominis
QDQDH

SEQ ID NO: 2157151 - protein, 41 aa, Cryptosporidium hominis
QDQEDEQSKESNGEKPMEVDKENYNKDNTTCNMDDTRTDNS

SEQ ID NO: 2157152 - protein, 34 aa, Cryptosporidium hominis
QDQGRTKSKSGQATPTGNLDQTPLNKNRKESDVM

SEQ ID NO: 2157153 - protein, 6 aa, Cryptosporidium hominis
QDQNQA

SEQ ID NO: 2157154 - protein, 8 aa, Cryptosporidium hominis
QDQNTLKS

SEQ ID NO: 2157155 - protein, 4 aa, Cryptosporidium hominis
QDQS

SEQ ID NO: 2157156 - protein, 8 aa, Cryptosporidium hominis
QDQSGSWE

SEQ ID NO: 2157157 - protein, 25 aa, Cryptosporidium hominis
QDQTGLENLDSSSEISDDSSYEIES

SEQ ID NO: 2157158 - protein, 12 aa, Cryptosporidium hominis
QDQTNNSNVNNK

SEQ ID NO: 2157159 - protein, 6 aa, Cryptosporidium hominis
QDQTSY

SEQ ID NO: 2157160 - protein, 14 aa, Cryptosporidium hominis
QDRLDKRRKFNRSD

SEQ ID NO: 2157161 - protein, 6 aa, Cryptosporidium hominis
QDRPSF

SEQ ID NO: 2157162 - protein, 7 aa, Cryptosporidium hominis
QDSAENN

SEQ ID NO: 2157163 - protein, 14 aa, Cryptosporidium hominis
QDSDSVPMTPSGKS

SEQ ID NO: 2157164 - protein, 4 aa, Cryptosporidium hominis
QDSE

SEQ ID NO: 2157165 - protein, 7 aa, Cryptosporidium hominis
QDSEKIE

SEQ ID NO: 2157166 - protein, 8 aa, Cryptosporidium hominis
QDSGLKEY

SEQ ID NO: 2157167 - protein, 5 aa, Cryptosporidium hominis
QDSKV

SEQ ID NO: 2157168 - protein, 8 aa, Cryptosporidium hominis
QDSQSEDL

SEQ ID NO: 2157169 - protein, 5 aa, Cryptosporidium hominis
QDSRL

SEQ ID NO: 2157170 - protein, 8 aa, Cryptosporidium hominis
QDSSNVNG

SEQ ID NO: 2157171 - protein, 4 aa, Cryptosporidium hominis
QDST

SEQ ID NO: 2157172 - protein, 8 aa, Cryptosporidium hominis
QDTATSKL

SEQ ID NO: 2157173 - protein, 6 aa, Cryptosporidium hominis
QDTDEK

SEQ ID NO: 2157174 - protein, 9 aa, Cryptosporidium hominis
QDTKEEQKE

SEQ ID NO: 2157175 - protein, 10 aa, Cryptosporidium hominis
QDTSISGEAL

SEQ ID NO: 2157176 - protein, 19 aa, Cryptosporidium hominis
QDTSLTANNNTDIGNSSQR

SEQ ID NO: 2157177 - protein, 4 aa, Cryptosporidium hominis
QDVG

SEQ ID NO: 2157178 - protein, 18 aa, Cryptosporidium hominis
QDVGEKKLKPSPKKSKYN

SEQ ID NO: 2157179 - protein, 10 aa, Cryptosporidium hominis
QDVSGQRQSP

SEQ ID NO: 2157180 - protein, 9 aa, Cryptosporidium hominis
QDYEDAYPE

SEQ ID NO: 2157181 - protein, 6 aa, Cryptosporidium hominis
QDYEKE

SEQ ID NO: 2157182 - protein, 12 aa, Cryptosporidium hominis
QDYKGYSKDLPA

SEQ ID NO: 2157183 - protein, 27 aa, Cryptosporidium hominis
QDYNQNTDYNCSDTSRKENISQGQGIP

SEQ ID NO: 2157184 - protein, 6 aa, Cryptosporidium hominis
QDYRNE

SEQ ID NO: 2157185 - protein, 24 aa, Cryptosporidium hominis
QEAAKEGDQISPKSVENTPRENSK

SEQ ID NO: 2157186 - protein, 10 aa, Cryptosporidium hominis
QEADGKKQAL

SEQ ID NO: 2157187 - protein, 11 aa, Cryptosporidium hominis
QEAETTKDAVS

SEQ ID NO: 2157188 - protein, 10 aa, Cryptosporidium hominis
QEAPTTWNSH

SEQ ID NO: 2157189 - protein, 9 aa, Cryptosporidium hominis
QEAQQTGGI

SEQ ID NO: 2157190 - protein, 6 aa, Cryptosporidium hominis
QEARDI

SEQ ID NO: 2157191 - protein, 7 aa, Cryptosporidium hominis
QEASESN

SEQ ID NO: 2157192 - protein, 9 aa, Cryptosporidium hominis
QEASKHEKA

SEQ ID NO: 2157193 - protein, 8 aa, Cryptosporidium hominis
QEDAEKKF

SEQ ID NO: 2157194 - protein, 44 aa, Cryptosporidium hominis
QEDDAASDLNSDSEADYSESNRLDSSSETENPAHSHHANDGADF

SEQ ID NO: 2157195 - protein, 13 aa, Cryptosporidium hominis
QEDDDKSRDKADQ

SEQ ID NO: 2157196 - protein, 9 aa, Cryptosporidium hominis
QEDDPEKYK

SEQ ID NO: 2157197 - protein, 9 aa, Cryptosporidium hominis
QEDDPPIST

SEQ ID NO: 2157198 - protein, 6 aa, Cryptosporidium hominis
QEDGTK

SEQ ID NO: 2157199 - protein, 18 aa, Cryptosporidium hominis
QEDGTSMPSIPNNNANFD

SEQ ID NO: 2157200 - protein, 7 aa, Cryptosporidium hominis
QEDLQNK

SEQ ID NO: 2157201 - protein, 8 aa, Cryptosporidium hominis
QEDPESKG

SEQ ID NO: 2157202 - protein, 10 aa, Cryptosporidium hominis
QEDRLEQNEQ

SEQ ID NO: 2157203 - protein, 10 aa, Cryptosporidium hominis
QEDSGPLAHP

SEQ ID NO: 2157204 - protein, 5 aa, Cryptosporidium hominis
QEDSR

SEQ ID NO: 2157205 - protein, 6 aa, Cryptosporidium hominis
QEDSSK

SEQ ID NO: 2157206 - protein, 10 aa, Cryptosporidium hominis
QEDSVCPKNT

SEQ ID NO: 2157207 - protein, 18 aa, Cryptosporidium hominis
QEDTKTGGSSTSSQSGTF

SEQ ID NO: 2157208 - protein, 18 aa, Cryptosporidium hominis
QEEAKRLSDKLGDKKLSE

SEQ ID NO: 2157209 - protein, 17 aa, Cryptosporidium hominis
QEEARRKHTGGKILGFF

SEQ ID NO: 2157210 - protein, 67 aa, Cryptosporidium hominis
QEEASEKKSAISETIKEQKMDNQKKSKRDKIRNRAEKWQRKREKEEDERRKEREEEARKKKEKEEKV

SEQ ID NO: 2157211 - protein, 7 aa, Cryptosporidium hominis
QEEDESV

SEQ ID NO: 2157212 - protein, 6 aa, Cryptosporidium hominis
QEEEEV

SEQ ID NO: 2157213 - protein, 6 aa, Cryptosporidium hominis
QEEELS

SEQ ID NO: 2157214 - protein, 13 aa, Cryptosporidium hominis
QEEENENNENYSE

SEQ ID NO: 2157215 - protein, 8 aa, Cryptosporidium hominis
QEEERERR

SEQ ID NO: 2157216 - protein, 6 aa, Cryptosporidium hominis
QEEERK

SEQ ID NO: 2157217 - protein, 8 aa, Cryptosporidium hominis
QEEGAKSA

SEQ ID NO: 2157218 - protein, 5 aa, Cryptosporidium hominis
QEEGM

SEQ ID NO: 2157219 - protein, 8 aa, Cryptosporidium hominis
QEEIEQGR

SEQ ID NO: 2157220 - protein, 10 aa, Cryptosporidium hominis
QEEKRKQIES

SEQ ID NO: 2157221 - protein, 6 aa, Cryptosporidium hominis
QEELTR

SEQ ID NO: 2157222 - protein, 7 aa, Cryptosporidium hominis
QEENKRR

SEQ ID NO: 2157223 - protein, 4 aa, Cryptosporidium hominis
QEEP

SEQ ID NO: 2157224 - protein, 5 aa, Cryptosporidium hominis
QEEPF

SEQ ID NO: 2157225 - protein, 12 aa, Cryptosporidium hominis
QEERRRKEEEFK

SEQ ID NO: 2157226 - protein, 19 aa, Cryptosporidium hominis
QEESENDSEYNAYPSGLFI

SEQ ID NO: 2157227 - protein, 9 aa, Cryptosporidium hominis
QEESHNPTI

SEQ ID NO: 2157228 - protein, 7 aa, Cryptosporidium hominis
QEETEIP

SEQ ID NO: 2157229 - protein, 8 aa, Cryptosporidium hominis
QEGEGDHR

SEQ ID NO: 2157230 - protein, 12 aa, Cryptosporidium hominis
QEGEVSQDKDTL

SEQ ID NO: 2157231 - protein, 8 aa, Cryptosporidium hominis
QEGFAPKQ

SEQ ID NO: 2157232 - protein, 6 aa, Cryptosporidium hominis
QEGHSR

SEQ ID NO: 2157233 - protein, 9 aa, Cryptosporidium hominis
QEGKRQGSL

SEQ ID NO: 2157234 - protein, 10 aa, Cryptosporidium hominis
QEGKTSQNCL

SEQ ID NO: 2157235 - protein, 9 aa, Cryptosporidium hominis
QEGNTIPID

SEQ ID NO: 2157236 - protein, 11 aa, Cryptosporidium hominis
QEGRKSPESMR

SEQ ID NO: 2157237 - protein, 7 aa, Cryptosporidium hominis
QEGTTEH

SEQ ID NO: 2157238 - protein, 7 aa, Cryptosporidium hominis
QEGYQDP

SEQ ID NO: 2157239 - protein, 13 aa, Cryptosporidium hominis
QEHDPSRGDIIFD

SEQ ID NO: 2157240 - protein, 4 aa, Cryptosporidium hominis
QEHS

SEQ ID NO: 2157241 - protein, 13 aa, Cryptosporidium hominis
QEHYKKDKKLNTT

SEQ ID NO: 2157242 - protein, 6 aa, Cryptosporidium hominis
QEIEET

SEQ ID NO: 2157243 - protein, 6 aa, Cryptosporidium hominis
QEIKDN

SEQ ID NO: 2157244 - protein, 4 aa, Cryptosporidium hominis
QEIN

SEQ ID NO: 2157245 - protein, 9 aa, Cryptosporidium hominis
QEISEKENN

SEQ ID NO: 2157246 - protein, 15 aa, Cryptosporidium hominis
QEKANTNPSETSSNC

SEQ ID NO: 2157247 - protein, 9 aa, Cryptosporidium hominis
QEKDKQEKY

SEQ ID NO: 2157248 - protein, 15 aa, Cryptosporidium hominis
QEKDNEKEKEENQDH

SEQ ID NO: 2157249 - protein, 14 aa, Cryptosporidium hominis
QEKDSNQECQKTQV

SEQ ID NO: 2157250 - protein, 23 aa, Cryptosporidium hominis
QEKDTIKSSSLSSPSPSPLPLSP

SEQ ID NO: 2157251 - protein, 8 aa, Cryptosporidium hominis
QEKEQSNF

SEQ ID NO: 2157252 - protein, 10 aa, Cryptosporidium hominis
QEKESQFESE

SEQ ID NO: 2157253 - protein, 10 aa, Cryptosporidium hominis
QEKKKEWAEA

SEQ ID NO: 2157254 - protein, 8 aa, Cryptosporidium hominis
QEKKNNEY

SEQ ID NO: 2157255 - protein, 9 aa, Cryptosporidium hominis
QEKKVQQQK

SEQ ID NO: 2157256 - protein, 12 aa, Cryptosporidium hominis
QEKMSKSDTSSA

SEQ ID NO: 2157257 - protein, 4 aa, Cryptosporidium hominis
QEKP

SEQ ID NO: 2157258 - protein, 10 aa, Cryptosporidium hominis
QEKQSKKSTK

SEQ ID NO: 2157259 - protein, 4 aa, Cryptosporidium hominis
QEKS

SEQ ID NO: 2157260 - protein, 9 aa, Cryptosporidium hominis
QEKSAITKN

SEQ ID NO: 2157261 - protein, 11 aa, Cryptosporidium hominis
QEKSDNSNRIS

SEQ ID NO: 2157262 - protein, 5 aa, Cryptosporidium hominis
QEKSV

SEQ ID NO: 2157263 - protein, 6 aa, Cryptosporidium hominis
QEKTEK

SEQ ID NO: 2157264 - protein, 30 aa, Cryptosporidium hominis
QEKTQYQSQEQSQNQDLYQEQSQYQNQLGN

SEQ ID NO: 2157265 - protein, 16 aa, Cryptosporidium hominis
QEKVEEKIASQGNPED

SEQ ID NO: 2157266 - protein, 5 aa, Cryptosporidium hominis
QELGS

SEQ ID NO: 2157267 - protein, 9 aa, Cryptosporidium hominis
QELGTKEPI

SEQ ID NO: 2157268 - protein, 16 aa, Cryptosporidium hominis
QELKEKKQSENSNSIE

SEQ ID NO: 2157269 - protein, 11 aa, Cryptosporidium hominis
QELRSKASGNI

SEQ ID NO: 2157270 - protein, 30 aa, Cryptosporidium hominis
QEMYGSSGLDQDDQEKKFSSGLSDTSQNCD

SEQ ID NO: 2157271 - protein, 8 aa, Cryptosporidium hominis
QENDEQPC

SEQ ID NO: 2157272 - protein, 9 aa, Cryptosporidium hominis
QENEASENY

SEQ ID NO: 2157273 - protein, 5 aa, Cryptosporidium hominis
QENFK

SEQ ID NO: 2157274 - protein, 9 aa, Cryptosporidium hominis
QENGDTLQT

SEQ ID NO: 2157275 - protein, 9 aa, Cryptosporidium hominis
QENKKEGIY

SEQ ID NO: 2157276 - protein, 9 aa, Cryptosporidium hominis
QENMDKDQN

SEQ ID NO: 2157277 - protein, 37 aa, Cryptosporidium hominis
QENNHSESDQNSRRSCKEKKMSNRKKRKLKQLEEKKR

SEQ ID NO: 2157278 - protein, 7 aa, Cryptosporidium hominis
QENNKEK

SEQ ID NO: 2157279 - protein, 11 aa, Cryptosporidium hominis
QENNKNSLSEE

SEQ ID NO: 2157280 - protein, 5 aa, Cryptosporidium hominis
QENNL

SEQ ID NO: 2157281 - protein, 8 aa, Cryptosporidium hominis
QENPQDTF

SEQ ID NO: 2157282 - protein, 12 aa, Cryptosporidium hominis
QENQKTIKFEDC

SEQ ID NO: 2157283 - protein, 8 aa, Cryptosporidium hominis
QENRERRL

SEQ ID NO: 2157284 - protein, 4 aa, Cryptosporidium hominis
QENS

SEQ ID NO: 2157285 - protein, 5 aa, Cryptosporidium hominis
QENSA

SEQ ID NO: 2157286 - protein, 16 aa, Cryptosporidium hominis
QENSKAPLPNNSPVEE

SEQ ID NO: 2157287 - protein, 17 aa, Cryptosporidium hominis
QENSLDGNSLSSAEKLR

SEQ ID NO: 2157288 - protein, 18 aa, Cryptosporidium hominis
QENTDMPSYDSNCNGKTG

SEQ ID NO: 2157289 - protein, 11 aa, Cryptosporidium hominis
QENYDSNQEKK

SEQ ID NO: 2157290 - protein, 4 aa, Cryptosporidium hominis
QEPI

SEQ ID NO: 2157291 - protein, 24 aa, Cryptosporidium hominis
QEPMPDPSISKISQAPHSLPKPQT

SEQ ID NO: 2157292 - protein, 14 aa, Cryptosporidium hominis
QEPNSNKNTSRSNL

SEQ ID NO: 2157293 - protein, 7 aa, Cryptosporidium hominis
QEPPKNT

SEQ ID NO: 2157294 - protein, 7 aa, Cryptosporidium hominis
QEPPRSG

SEQ ID NO: 2157295 - protein, 6 aa, Cryptosporidium hominis
QEPQGR

SEQ ID NO: 2157296 - protein, 7 aa, Cryptosporidium hominis
QEPRGSV

SEQ ID NO: 2157297 - protein, 5 aa, Cryptosporidium hominis
QEQDL

SEQ ID NO: 2157298 - protein, 5 aa, Cryptosporidium hominis
QEQDR

SEQ ID NO: 2157299 - protein, 8 aa, Cryptosporidium hominis
QEQKQRLK

SEQ ID NO: 2157300 - protein, 15 aa, Cryptosporidium hominis
QEQNLNDKAKELEQR

SEQ ID NO: 2157301 - protein, 16 aa, Cryptosporidium hominis
QEQNQYQNTYSNTSHS

SEQ ID NO: 2157302 - protein, 8 aa, Cryptosporidium hominis
QEQPPTIE

SEQ ID NO: 2157303 - protein, 30 aa, Cryptosporidium hominis
QEQQNQQLNTNRGNITEYSSSSSSSNIPEN

SEQ ID NO: 2157304 - protein, 5 aa, Cryptosporidium hominis
QEQRN

SEQ ID NO: 2157305 - protein, 11 aa, Cryptosporidium hominis
QEQSGMTETEL

SEQ ID NO: 2157306 - protein, 6 aa, Cryptosporidium hominis
QEQYNQ

SEQ ID NO: 2157307 - protein, 15 aa, Cryptosporidium hominis
QEQYQQKKSHELISD

SEQ ID NO: 2157308 - protein, 19 aa, Cryptosporidium hominis
QERAGKKSKTLRDSDRDIS

SEQ ID NO: 2157309 - protein, 9 aa, Cryptosporidium hominis
QEREDQKSM

SEQ ID NO: 2157310 - protein, 12 aa, Cryptosporidium hominis
QEREEEPAQEYE

SEQ ID NO: 2157311 - protein, 19 aa, Cryptosporidium hominis
QEREEEPAQEYNKEPVQEH

SEQ ID NO: 2157312 - protein, 19 aa, Cryptosporidium hominis
QEREEKLTQEQKKELTQEY

SEQ ID NO: 2157313 - protein, 7 aa, Cryptosporidium hominis
QERKEYS

SEQ ID NO: 2157314 - protein, 24 aa, Cryptosporidium hominis
QERNHEKTEDKAEYSYNDEGNSYI

SEQ ID NO: 2157315 - protein, 5 aa, Cryptosporidium hominis
QERRN

SEQ ID NO: 2157316 - protein, 8 aa, Cryptosporidium hominis
QERTNEMN

SEQ ID NO: 2157317 - protein, 14 aa, Cryptosporidium hominis
QESDEYDSEEIDNE

SEQ ID NO: 2157318 - protein, 8 aa, Cryptosporidium hominis
QESDSAIQ

SEQ ID NO: 2157319 - protein, 7 aa, Cryptosporidium hominis
QESEKIP

SEQ ID NO: 2157320 - protein, 4 aa, Cryptosporidium hominis
QESF

SEQ ID NO: 2157321 - protein, 4 aa, Cryptosporidium hominis
QESG

SEQ ID NO: 2157322 - protein, 6 aa, Cryptosporidium hominis
QESNAE

SEQ ID NO: 2157323 - protein, 9 aa, Cryptosporidium hominis
QESNEDDEF

SEQ ID NO: 2157324 - protein, 7 aa, Cryptosporidium hominis
QESNLNK

SEQ ID NO: 2157325 - protein, 5 aa, Cryptosporidium hominis
QESRQ

SEQ ID NO: 2157326 - protein, 9 aa, Cryptosporidium hominis
QESSNTTKQ

SEQ ID NO: 2157327 - protein, 12 aa, Cryptosporidium hominis
QESSQSSDYESA

SEQ ID NO: 2157328 - protein, 7 aa, Cryptosporidium hominis
QESSRDI

SEQ ID NO: 2157329 - protein, 13 aa, Cryptosporidium hominis
QETDSDNGDNKNN

SEQ ID NO: 2157330 - protein, 5 aa, Cryptosporidium hominis
QETEN

SEQ ID NO: 2157331 - protein, 7 aa, Cryptosporidium hominis
QETGKIP

SEQ ID NO: 2157332 - protein, 11 aa, Cryptosporidium hominis
QETHSEPPAKR

SEQ ID NO: 2157333 - protein, 4 aa, Cryptosporidium hominis
QETL

SEQ ID NO: 2157334 - protein, 7 aa, Cryptosporidium hominis
QETNRNI

SEQ ID NO: 2157335 - protein, 4 aa, Cryptosporidium hominis
QETR

SEQ ID NO: 2157336 - protein, 33 aa, Cryptosporidium hominis
QETRLQSSNEAAASSVSHPRNGTVGSVGSAGSV

SEQ ID NO: 2157337 - protein, 6 aa, Cryptosporidium hominis
QETSEF

SEQ ID NO: 2157338 - protein, 6 aa, Cryptosporidium hominis
QETSRK

SEQ ID NO: 2157339 - protein, 6 aa, Cryptosporidium hominis
QETTNI

SEQ ID NO: 2157340 - protein, 8 aa, Cryptosporidium hominis
QETVTKDD

SEQ ID NO: 2157341 - protein, 4 aa, Cryptosporidium hominis
QEVR

SEQ ID NO: 2157342 - protein, 16 aa, Cryptosporidium hominis
QEYEKEERKEKGSKKV

SEQ ID NO: 2157343 - protein, 6 aa, Cryptosporidium hominis
QEYGPE

SEQ ID NO: 2157344 - protein, 6 aa, Cryptosporidium hominis
QEYPKG

SEQ ID NO: 2157345 - protein, 6 aa, Cryptosporidium hominis
QEYQES

SEQ ID NO: 2157346 - protein, 34 aa, Cryptosporidium hominis
QFASPGSLSSVDNSSHISSINNKEDFNNSPMKET

SEQ ID NO: 2157347 - protein, 10 aa, Cryptosporidium hominis
QFEDSSSSYA

SEQ ID NO: 2157348 - protein, 12 aa, Cryptosporidium hominis
QFEKSNPEAPTV

SEQ ID NO: 2157349 - protein, 12 aa, Cryptosporidium hominis
QFEQKEKKNSLY

SEQ ID NO: 2157350 - protein, 7 aa, Cryptosporidium hominis
QFESDSE

SEQ ID NO: 2157351 - protein, 13 aa, Cryptosporidium hominis
QFGQFNGEQQQAP

SEQ ID NO: 2157352 - protein, 32 aa, Cryptosporidium hominis
QFGSNSNNNTNNKNEGNFNNYGSNNNFGNEQN

SEQ ID NO: 2157353 - protein, 7 aa, Cryptosporidium hominis
QFNPKEH

SEQ ID NO: 2157354 - protein, 10 aa, Cryptosporidium hominis
QFPDDEDIST

SEQ ID NO: 2157355 - protein, 11 aa, Cryptosporidium hominis
QFPMSSSKNYG

SEQ ID NO: 2157356 - protein, 11 aa, Cryptosporidium hominis
QFPQYQQPNYQ

SEQ ID NO: 2157357 - protein, 5 aa, Cryptosporidium hominis
QFPRE

SEQ ID NO: 2157358 - protein, 17 aa, Cryptosporidium hominis
QFPSQNLGNSSSSSNMA

SEQ ID NO: 2157359 - protein, 7 aa, Cryptosporidium hominis
QFQDQSG

SEQ ID NO: 2157360 - protein, 5 aa, Cryptosporidium hominis
QFQGQ

SEQ ID NO: 2157361 - protein, 5 aa, Cryptosporidium hominis
QFQPQ

SEQ ID NO: 2157362 - protein, 11 aa, Cryptosporidium hominis
QFQQDSSSLNK

SEQ ID NO: 2157363 - protein, 10 aa, Cryptosporidium hominis
QFQSGPMDNI

SEQ ID NO: 2157364 - protein, 15 aa, Cryptosporidium hominis
QFSKDYDKIDQTIKT

SEQ ID NO: 2157365 - protein, 12 aa, Cryptosporidium hominis
QFSSNSYNSSPI

SEQ ID NO: 2157366 - protein, 10 aa, Cryptosporidium hominis
QFSSQTQSAT

SEQ ID NO: 2157367 - protein, 6 aa, Cryptosporidium hominis
QFSSSN

SEQ ID NO: 2157368 - protein, 5 aa, Cryptosporidium hominis
QFTGE

SEQ ID NO: 2157369 - protein, 9 aa, Cryptosporidium hominis
QGAKSSDPN

SEQ ID NO: 2157370 - protein, 8 aa, Cryptosporidium hominis
QGASKNPC

SEQ ID NO: 2157371 - protein, 6 aa, Cryptosporidium hominis
QGASRD

SEQ ID NO: 2157372 - protein, 20 aa, Cryptosporidium hominis
QGDDVPDQIPDKEDQSETIS

SEQ ID NO: 2157373 - protein, 5 aa, Cryptosporidium hominis
QGDKG

SEQ ID NO: 2157374 - protein, 5 aa, Cryptosporidium hominis
QGDLR

SEQ ID NO: 2157375 - protein, 5 aa, Cryptosporidium hominis
QGDNI

SEQ ID NO: 2157376 - protein, 6 aa, Cryptosporidium hominis
QGDPLE

SEQ ID NO: 2157377 - protein, 8 aa, Cryptosporidium hominis
QGDQGNSD

SEQ ID NO: 2157378 - protein, 15 aa, Cryptosporidium hominis
QGDVSSVENEDFQDQ

SEQ ID NO: 2157379 - protein, 14 aa, Cryptosporidium hominis
QGEDGKKFKTRSGD

SEQ ID NO: 2157380 - protein, 5 aa, Cryptosporidium hominis
QGEEL

SEQ ID NO: 2157381 - protein, 11 aa, Cryptosporidium hominis
QGEGIENNNIK

SEQ ID NO: 2157382 - protein, 12 aa, Cryptosporidium hominis
QGEGLGKNNQGI

SEQ ID NO: 2157383 - protein, 6 aa, Cryptosporidium hominis
QGEGRT

SEQ ID NO: 2157384 - protein, 4 aa, Cryptosporidium hominis
QGEI

SEQ ID NO: 2157385 - protein, 10 aa, Cryptosporidium hominis
QGEKNIDDNY

SEQ ID NO: 2157386 - protein, 11 aa, Cryptosporidium hominis
QGEKNVSISEP

SEQ ID NO: 2157387 - protein, 8 aa, Cryptosporidium hominis
QGEKQMED

SEQ ID NO: 2157388 - protein, 15 aa, Cryptosporidium hominis
QGEKSQTNSETKLTN

SEQ ID NO: 2157389 - protein, 9 aa, Cryptosporidium hominis
QGEQHQDGC

SEQ ID NO: 2157390 - protein, 6 aa, Cryptosporidium hominis
QGESRG

SEQ ID NO: 2157391 - protein, 14 aa, Cryptosporidium hominis
QGEYYDSNNQYYEE

SEQ ID NO: 2157392 - protein, 7 aa, Cryptosporidium hominis
QGFSTPN

SEQ ID NO: 2157393 - protein, 6 aa, Cryptosporidium hominis
QGGDQD

SEQ ID NO: 2157394 - protein, 4 aa, Cryptosporidium hominis
QGGE

SEQ ID NO: 2157395 - protein, 5 aa, Cryptosporidium hominis
QGGGA

SEQ ID NO: 2157396 - protein, 28 aa, Cryptosporidium hominis
QGGGGFGSLEGSEDGKRYNTGGWDEESI

SEQ ID NO: 2157397 - protein, 7 aa, Cryptosporidium hominis
QGGGSNL

SEQ ID NO: 2157398 - protein, 13 aa, Cryptosporidium hominis
QGGIASTTREERP

SEQ ID NO: 2157399 - protein, 9 aa, Cryptosporidium hominis
QGGSSEESI

SEQ ID NO: 2157400 - protein, 14 aa, Cryptosporidium hominis
QGGVSKSVSTSTSV

SEQ ID NO: 2157401 - protein, 9 aa, Cryptosporidium hominis
QGHEDQSDG

SEQ ID NO: 2157402 - protein, 6 aa, Cryptosporidium hominis
QGHNPA

SEQ ID NO: 2157403 - protein, 4 aa, Cryptosporidium hominis
QGIG

SEQ ID NO: 2157404 - protein, 13 aa, Cryptosporidium hominis
QGIKEEKRNSNDY

SEQ ID NO: 2157405 - protein, 4 aa, Cryptosporidium hominis
QGIQ

SEQ ID NO: 2157406 - protein, 8 aa, Cryptosporidium hominis
QGISENET

SEQ ID NO: 2157407 - protein, 9 aa, Cryptosporidium hominis
QGISSTTGV

SEQ ID NO: 2157408 - protein, 8 aa, Cryptosporidium hominis
QGKDPTQE

SEQ ID NO: 2157409 - protein, 8 aa, Cryptosporidium hominis
QGKDSSLK

SEQ ID NO: 2157410 - protein, 8 aa, Cryptosporidium hominis
QGKKENLS

SEQ ID NO: 2157411 - protein, 8 aa, Cryptosporidium hominis
QGKNAENL

SEQ ID NO: 2157412 - protein, 8 aa, Cryptosporidium hominis
QGKNENNL

SEQ ID NO: 2157413 - protein, 9 aa, Cryptosporidium hominis
QGKPGGRLE

SEQ ID NO: 2157414 - protein, 4 aa, Cryptosporidium hominis
QGKS

SEQ ID NO: 2157415 - protein, 8 aa, Cryptosporidium hominis
QGKSNKSQ

SEQ ID NO: 2157416 - protein, 8 aa, Cryptosporidium hominis
QGKTDRTL

SEQ ID NO: 2157417 - protein, 6 aa, Cryptosporidium hominis
QGKTKL

SEQ ID NO: 2157418 - protein, 15 aa, Cryptosporidium hominis
QGKVSGVVTSQGKAE

SEQ ID NO: 2157419 - protein, 13 aa, Cryptosporidium hominis
QGKWNGKASHDDY

SEQ ID NO: 2157420 - protein, 12 aa, Cryptosporidium hominis
QGLENSDDYTSK

SEQ ID NO: 2157421 - protein, 6 aa, Cryptosporidium hominis
QGMPTS

SEQ ID NO: 2157422 - protein, 5 aa, Cryptosporidium hominis
QGNAG

SEQ ID NO: 2157423 - protein, 10 aa, Cryptosporidium hominis
QGNDEYSSKI

SEQ ID NO: 2157424 - protein, 5 aa, Cryptosporidium hominis
QGNDR

SEQ ID NO: 2157425 - protein, 10 aa, Cryptosporidium hominis
QGNDSHNHAD

SEQ ID NO: 2157426 - protein, 4 aa, Cryptosporidium hominis
QGNE

SEQ ID NO: 2157427 - protein, 9 aa, Cryptosporidium hominis
QGNEKDSFF

SEQ ID NO: 2157428 - protein, 12 aa, Cryptosporidium hominis
QGNIPAGQSTNV

SEQ ID NO: 2157429 - protein, 4 aa, Cryptosporidium hominis
QGNK

SEQ ID NO: 2157430 - protein, 8 aa, Cryptosporidium hominis
QGNKQSQI

SEQ ID NO: 2157431 - protein, 7 aa, Cryptosporidium hominis
QGNPNKA

SEQ ID NO: 2157432 - protein, 13 aa, Cryptosporidium hominis
QGNPSNNENENTL

SEQ ID NO: 2157433 - protein, 15 aa, Cryptosporidium hominis
QGNQSNHNNNNNNKR

SEQ ID NO: 2157434 - protein, 4 aa, Cryptosporidium hominis
QGPE

SEQ ID NO: 2157435 - protein, 10 aa, Cryptosporidium hominis
QGPPGTGKTT

SEQ ID NO: 2157436 - protein, 15 aa, Cryptosporidium hominis
QGQGVGGNSSSGNSS

SEQ ID NO: 2157437 - protein, 41 aa, Cryptosporidium hominis
QGQIQDQGQIQDQGQIQDHGQIQDQNQTQDHGQTQDHGQTQ

SEQ ID NO: 2157438 - protein, 27 aa, Cryptosporidium hominis
QGQKGGIMNSGYNGEVSNGVGNQYYGG

SEQ ID NO: 2157439 - protein, 24 aa, Cryptosporidium hominis
QGQTSGTGITADNAQVGKPGSGVT

SEQ ID NO: 2157440 - protein, 6 aa, Cryptosporidium hominis
QGQYIP

SEQ ID NO: 2157441 - protein, 8 aa, Cryptosporidium hominis
QGRESLPP

SEQ ID NO: 2157442 - protein, 6 aa, Cryptosporidium hominis
QGRNLE

SEQ ID NO: 2157443 - protein, 8 aa, Cryptosporidium hominis
QGRPRNEL

SEQ ID NO: 2157444 - protein, 9 aa, Cryptosporidium hominis
QGRTADSGH

SEQ ID NO: 2157445 - protein, 15 aa, Cryptosporidium hominis
QGRTDNSESNDDEVE

SEQ ID NO: 2157446 - protein, 7 aa, Cryptosporidium hominis
QGSDNNM

SEQ ID NO: 2157447 - protein, 8 aa, Cryptosporidium hominis
QGSKSPAQ

SEQ ID NO: 2157448 - protein, 5 aa, Cryptosporidium hominis
QGSNH

SEQ ID NO: 2157449 - protein, 9 aa, Cryptosporidium hominis
QGSNSNGRV

SEQ ID NO: 2157450 - protein, 4 aa, Cryptosporidium hominis
QGSQ

SEQ ID NO: 2157451 - protein, 9 aa, Cryptosporidium hominis
QGSQSSPYN

SEQ ID NO: 2157452 - protein, 9 aa, Cryptosporidium hominis
QGSRYSEAC

SEQ ID NO: 2157453 - protein, 9 aa, Cryptosporidium hominis
QGSSETYLE

SEQ ID NO: 2157454 - protein, 5 aa, Cryptosporidium hominis
QGSSI

SEQ ID NO: 2157455 - protein, 9 aa, Cryptosporidium hominis
QGSSQEFND

SEQ ID NO: 2157456 - protein, 14 aa, Cryptosporidium hominis
QGTITPDQFGGTSE

SEQ ID NO: 2157457 - protein, 5 aa, Cryptosporidium hominis
QGTTC

SEQ ID NO: 2157458 - protein, 5 aa, Cryptosporidium hominis
QGVGN

SEQ ID NO: 2157459 - protein, 7 aa, Cryptosporidium hominis
QGVGTSK

SEQ ID NO: 2157460 - protein, 19 aa, Cryptosporidium hominis
QGVSEYSQSGNEEHTSKSS

SEQ ID NO: 2157461 - protein, 7 aa, Cryptosporidium hominis
QGYHPAP

SEQ ID NO: 2157462 - protein, 13 aa, Cryptosporidium hominis
QHEIEEQSNQDQM

SEQ ID NO: 2157463 - protein, 9 aa, Cryptosporidium hominis
QHERGLQEN

SEQ ID NO: 2157464 - protein, 10 aa, Cryptosporidium hominis
QHESEEANTY

SEQ ID NO: 2157465 - protein, 23 aa, Cryptosporidium hominis
QHESRKSQYISTEYNETENISTY

SEQ ID NO: 2157466 - protein, 11 aa, Cryptosporidium hominis
QHGAREHSNYH

SEQ ID NO: 2157467 - protein, 8 aa, Cryptosporidium hominis
QHGNQNSI

SEQ ID NO: 2157468 - protein, 4 aa, Cryptosporidium hominis
QHGQ

SEQ ID NO: 2157469 - protein, 24 aa, Cryptosporidium hominis
QHGSHRHGNQSKVTSNGTSNTNTA

SEQ ID NO: 2157470 - protein, 9 aa, Cryptosporidium hominis
QHKASKARN

SEQ ID NO: 2157471 - protein, 4 aa, Cryptosporidium hominis
QHKN

SEQ ID NO: 2157472 - protein, 10 aa, Cryptosporidium hominis
QHNKEEDLNH

SEQ ID NO: 2157473 - protein, 9 aa, Cryptosporidium hominis
QHNQGAQGI

SEQ ID NO: 2157474 - protein, 28 aa, Cryptosporidium hominis
QHPLSTQSNGASANIAQGSFPNSSGVSV

SEQ ID NO: 2157475 - protein, 5 aa, Cryptosporidium hominis
QHQKA

SEQ ID NO: 2157476 - protein, 8 aa, Cryptosporidium hominis
QHSAHPAT

SEQ ID NO: 2157477 - protein, 10 aa, Cryptosporidium hominis
QHSNENTAYQ

SEQ ID NO: 2157478 - protein, 11 aa, Cryptosporidium hominis
QHSNPVTPQQA

SEQ ID NO: 2157479 - protein, 6 aa, Cryptosporidium hominis
QHSYSE

SEQ ID NO: 2157480 - protein, 10 aa, Cryptosporidium hominis
QHTDYPPKYY

SEQ ID NO: 2157481 - protein, 6 aa, Cryptosporidium hominis
QHVPGS

SEQ ID NO: 2157482 - protein, 22 aa, Cryptosporidium hominis
QIDDTKNSGMGSEYKDPSIPEG

SEQ ID NO: 2157483 - protein, 10 aa, Cryptosporidium hominis
QIDITNSQSS

SEQ ID NO: 2157484 - protein, 13 aa, Cryptosporidium hominis
QIEDNENEDDCES

SEQ ID NO: 2157485 - protein, 4 aa, Cryptosporidium hominis
QIEE

SEQ ID NO: 2157486 - protein, 6 aa, Cryptosporidium hominis
QIEEER

SEQ ID NO: 2157487 - protein, 17 aa, Cryptosporidium hominis
QIEENQKLTDYDKEKLR

SEQ ID NO: 2157488 - protein, 6 aa, Cryptosporidium hominis
QIEPGK

SEQ ID NO: 2157489 - protein, 15 aa, Cryptosporidium hominis
QIESSKKNKCLEENV

SEQ ID NO: 2157490 - protein, 7 aa, Cryptosporidium hominis
QIESSND

SEQ ID NO: 2157491 - protein, 8 aa, Cryptosporidium hominis
QIGGTGRR

SEQ ID NO: 2157492 - protein, 5 aa, Cryptosporidium hominis
QIGND

SEQ ID NO: 2157493 - protein, 8 aa, Cryptosporidium hominis
QIGNSGNN

SEQ ID NO: 2157494 - protein, 6 aa, Cryptosporidium hominis
QIGPTA

SEQ ID NO: 2157495 - protein, 11 aa, Cryptosporidium hominis
QIKAPKKISKN

SEQ ID NO: 2157496 - protein, 5 aa, Cryptosporidium hominis
QIKEG

SEQ ID NO: 2157497 - protein, 25 aa, Cryptosporidium hominis
QIKHNSADSAKPKMESSSPPQNVTK

SEQ ID NO: 2157498 - protein, 4 aa, Cryptosporidium hominis
QIND

SEQ ID NO: 2157499 - protein, 10 aa, Cryptosporidium hominis
QINDSDTRTI

SEQ ID NO: 2157500 - protein, 4 aa, Cryptosporidium hominis
QINE

SEQ ID NO: 2157501 - protein, 21 aa, Cryptosporidium hominis
QINEKVSDELNNTNNDDAFEE

SEQ ID NO: 2157502 - protein, 18 aa, Cryptosporidium hominis
QINEQKKKMAKSLETERD

SEQ ID NO: 2157503 - protein, 9 aa, Cryptosporidium hominis
QINQEREQK

SEQ ID NO: 2157504 - protein, 23 aa, Cryptosporidium hominis
QINRPNQENDQSTKDTGNEPQIG

SEQ ID NO: 2157505 - protein, 7 aa, Cryptosporidium hominis
QINSKNK

SEQ ID NO: 2157506 - protein, 7 aa, Cryptosporidium hominis
QIPEPGD

SEQ ID NO: 2157507 - protein, 8 aa, Cryptosporidium hominis
QIPGDQSS

SEQ ID NO: 2157508 - protein, 10 aa, Cryptosporidium hominis
QIPNAESENS

SEQ ID NO: 2157509 - protein, 10 aa, Cryptosporidium hominis
QIPNESPNSY

SEQ ID NO: 2157510 - protein, 13 aa, Cryptosporidium hominis
QIPNSKKRCTENY

SEQ ID NO: 2157511 - protein, 9 aa, Cryptosporidium hominis
QIPTENSKQ

SEQ ID NO: 2157512 - protein, 6 aa, Cryptosporidium hominis
QIPTGN

SEQ ID NO: 2157513 - protein, 26 aa, Cryptosporidium hominis
QIQAKTNDQIPKKNVSENSNLNDSEL

SEQ ID NO: 2157514 - protein, 7 aa, Cryptosporidium hominis
QIQKDGS

SEQ ID NO: 2157515 - protein, 20 aa, Cryptosporidium hominis
QIQKQENEENSKREKENTVK

SEQ ID NO: 2157516 - protein, 49 aa, Cryptosporidium hominis
QIQTDEQSPKNTNRRSSELSIESSSPEAQKGGGHKKYQQNQHHNQNQSY

SEQ ID NO: 2157517 - protein, 11 aa, Cryptosporidium hominis
QIQTGNQAKPI

SEQ ID NO: 2157518 - protein, 19 aa, Cryptosporidium hominis
QIQTRNNNMNIDGDKENNP

SEQ ID NO: 2157519 - protein, 6 aa, Cryptosporidium hominis
QISAEE

SEQ ID NO: 2157520 - protein, 11 aa, Cryptosporidium hominis
QISEARKATME

SEQ ID NO: 2157521 - protein, 5 aa, Cryptosporidium hominis
QISKS

SEQ ID NO: 2157522 - protein, 5 aa, Cryptosporidium hominis
QISND

SEQ ID NO: 2157523 - protein, 12 aa, Cryptosporidium hominis
QISNKQEDQQNN

SEQ ID NO: 2157524 - protein, 8 aa, Cryptosporidium hominis
QISNRGRN

SEQ ID NO: 2157525 - protein, 5 aa, Cryptosporidium hominis
QISNT

SEQ ID NO: 2157526 - protein, 35 aa, Cryptosporidium hominis
QISSGESSEDEDLNSGKTEGVRPRHNKGEKKNRKL

SEQ ID NO: 2157527 - protein, 9 aa, Cryptosporidium hominis
QISSNGNSI

SEQ ID NO: 2157528 - protein, 12 aa, Cryptosporidium hominis
QISTTSKDNSNF

SEQ ID NO: 2157529 - protein, 15 aa, Cryptosporidium hominis
QITGGSSFKDKNRKI

SEQ ID NO: 2157530 - protein, 15 aa, Cryptosporidium hominis
QITGNATVNSNTNLP

SEQ ID NO: 2157531 - protein, 17 aa, Cryptosporidium hominis
QITNGNNGKLDKNAKNE

SEQ ID NO: 2157532 - protein, 7 aa, Cryptosporidium hominis
QITPPHN

SEQ ID NO: 2157533 - protein, 6 aa, Cryptosporidium hominis
QITPPT

SEQ ID NO: 2157534 - protein, 5 aa, Cryptosporidium hominis
QITSS

SEQ ID NO: 2157535 - protein, 23 aa, Cryptosporidium hominis
QKAELKSELNRNKIKSTDYPSKL

SEQ ID NO: 2157536 - protein, 13 aa, Cryptosporidium hominis
QKAKRRRTTGTGR

SEQ ID NO: 2157537 - protein, 8 aa, Cryptosporidium hominis
QKATDEHN

SEQ ID NO: 2157538 - protein, 5 aa, Cryptosporidium hominis
QKAVE

SEQ ID NO: 2157539 - protein, 12 aa, Cryptosporidium hominis
QKAYQAVKQKHQ

SEQ ID NO: 2157540 - protein, 5 aa, Cryptosporidium hominis
QKCPR

SEQ ID NO: 2157541 - protein, 15 aa, Cryptosporidium hominis
QKDDNGKIMENNEDI

SEQ ID NO: 2157542 - protein, 10 aa, Cryptosporidium hominis
QKDDNRSQYN

SEQ ID NO: 2157543 - protein, 6 aa, Cryptosporidium hominis
QKDEEW

SEQ ID NO: 2157544 - protein, 8 aa, Cryptosporidium hominis
QKDESEPI

SEQ ID NO: 2157545 - protein, 4 aa, Cryptosporidium hominis
QKDF

SEQ ID NO: 2157546 - protein, 7 aa, Cryptosporidium hominis
QKDGTVQ

SEQ ID NO: 2157547 - protein, 6 aa, Cryptosporidium hominis
QKDKNR

SEQ ID NO: 2157548 - protein, 8 aa, Cryptosporidium hominis
QKDPTESS

SEQ ID NO: 2157549 - protein, 7 aa, Cryptosporidium hominis
QKDPTTC

SEQ ID NO: 2157550 - protein, 8 aa, Cryptosporidium hominis
QKDRELSE

SEQ ID NO: 2157551 - protein, 21 aa, Cryptosporidium hominis
QKDTSNANKKSDTPATELQGS

SEQ ID NO: 2157552 - protein, 17 aa, Cryptosporidium hominis
QKDYSNNNNSNGNGNVN

SEQ ID NO: 2157553 - protein, 24 aa, Cryptosporidium hominis
QKEAYQEDDEDGHHGGAERVSCRQ

SEQ ID NO: 2157554 - protein, 4 aa, Cryptosporidium hominis
QKEE

SEQ ID NO: 2157555 - protein, 7 aa, Cryptosporidium hominis
QKEEESK

SEQ ID NO: 2157556 - protein, 7 aa, Cryptosporidium hominis
QKEESFT

SEQ ID NO: 2157557 - protein, 13 aa, Cryptosporidium hominis
QKEHEEDLARDAA

SEQ ID NO: 2157558 - protein, 16 aa, Cryptosporidium hominis
QKEHQDHELRQNDEVY

SEQ ID NO: 2157559 - protein, 8 aa, Cryptosporidium hominis
QKEKAQDE

SEQ ID NO: 2157560 - protein, 128 aa, Cryptosporidium hominis
QKEKDQDNNPDDDDDDNEREREREREREREREREREREREREEREREREREREKEREREREREEREREREREKEREREREREKEREREREREKDREREREREREREMDGKKHGLPRKTGEGSSSSATL

SEQ ID NO: 2157561 - protein, 9 aa, Cryptosporidium hominis
QKEKDSEAE

SEQ ID NO: 2157562 - protein, 29 aa, Cryptosporidium hominis
QKEKNPSQNSSNSKNKLKTKNQTNLNEST

SEQ ID NO: 2157563 - protein, 8 aa, Cryptosporidium hominis
QKEKSNSP

SEQ ID NO: 2157564 - protein, 7 aa, Cryptosporidium hominis
QKELEAK

SEQ ID NO: 2157565 - protein, 4 aa, Cryptosporidium hominis
QKEM

SEQ ID NO: 2157566 - protein, 5 aa, Cryptosporidium hominis
QKESI

SEQ ID NO: 2157567 - protein, 18 aa, Cryptosporidium hominis
QKETAQAYHQKQQQQEKA

SEQ ID NO: 2157568 - protein, 10 aa, Cryptosporidium hominis
QKEWKESNDF

SEQ ID NO: 2157569 - protein, 14 aa, Cryptosporidium hominis
QKEYKKRKYSDKFQ

SEQ ID NO: 2157570 - protein, 77 aa, Cryptosporidium hominis
QKEYNSEETNETTISSIQNDDTENGQNSNSSDEELDSGKKDDDDDEEEEDDFEDEESDENEEFKEDEDFEENENIPN

SEQ ID NO: 2157571 - protein, 6 aa, Cryptosporidium hominis
QKGATF

SEQ ID NO: 2157572 - protein, 8 aa, Cryptosporidium hominis
QKGGSSQV

SEQ ID NO: 2157573 - protein, 8 aa, Cryptosporidium hominis
QKGRPNRS

SEQ ID NO: 2157574 - protein, 5 aa, Cryptosporidium hominis
QKGSS

SEQ ID NO: 2157575 - protein, 9 aa, Cryptosporidium hominis
QKGTGIRRA

SEQ ID NO: 2157576 - protein, 9 aa, Cryptosporidium hominis
QKGTLEEEM

SEQ ID NO: 2157577 - protein, 5 aa, Cryptosporidium hominis
QKGTN

SEQ ID NO: 2157578 - protein, 11 aa, Cryptosporidium hominis
QKHENGEDNTV

SEQ ID NO: 2157579 - protein, 11 aa, Cryptosporidium hominis
QKHKDSGELNG

SEQ ID NO: 2157580 - protein, 48 aa, Cryptosporidium hominis
QKHQTYSSSSHNSHHEGRYNQDRRGRGYGYSGNRQHNHGGSSGGGYDL

SEQ ID NO: 2157581 - protein, 12 aa, Cryptosporidium hominis
QKHSQNTEDCSN

SEQ ID NO: 2157582 - protein, 4 aa, Cryptosporidium hominis
QKHY

SEQ ID NO: 2157583 - protein, 12 aa, Cryptosporidium hominis
QKIESSLTSRGY

SEQ ID NO: 2157584 - protein, 4 aa, Cryptosporidium hominis
QKII

SEQ ID NO: 2157585 - protein, 8 aa, Cryptosporidium hominis
QKIPTEKS

SEQ ID NO: 2157586 - protein, 9 aa, Cryptosporidium hominis
QKISDPESE

SEQ ID NO: 2157587 - protein, 28 aa, Cryptosporidium hominis
QKISFNASKNHSVSTRGNKMDEYDWDVE

SEQ ID NO: 2157588 - protein, 7 aa, Cryptosporidium hominis
QKKDSIS

SEQ ID NO: 2157589 - protein, 23 aa, Cryptosporidium hominis
QKKDTHKQKKNLSKTKNEMGCML

SEQ ID NO: 2157590 - protein, 9 aa, Cryptosporidium hominis
QKKESKMKK

SEQ ID NO: 2157591 - protein, 4 aa, Cryptosporidium hominis
QKKG

SEQ ID NO: 2157592 - protein, 16 aa, Cryptosporidium hominis
QKKKPPISLRSGFNFN

SEQ ID NO: 2157593 - protein, 8 aa, Cryptosporidium hominis
QKKNKNIQ

SEQ ID NO: 2157594 - protein, 10 aa, Cryptosporidium hominis
QKKNQRNKKL

SEQ ID NO: 2157595 - protein, 23 aa, Cryptosporidium hominis
QKKRDEEDSSNTDCNSSEEKPVI

SEQ ID NO: 2157596 - protein, 17 aa, Cryptosporidium hominis
QKKSEDLIQDFEKLSIN

SEQ ID NO: 2157597 - protein, 10 aa, Cryptosporidium hominis
QKKSNEIDSK

SEQ ID NO: 2157598 - protein, 5 aa, Cryptosporidium hominis
QKKSQ

SEQ ID NO: 2157599 - protein, 8 aa, Cryptosporidium hominis
QKKSQKMP

SEQ ID NO: 2157600 - protein, 51 aa, Cryptosporidium hominis
QKKTTNQLSTPRRISNSTSKSPKGGTPKTPQISSSGRNNDLSIDGTASSNI

SEQ ID NO: 2157601 - protein, 8 aa, Cryptosporidium hominis
QKKYESSI

SEQ ID NO: 2157602 - protein, 16 aa, Cryptosporidium hominis
QKLDQSSSFQSGSEVM

SEQ ID NO: 2157603 - protein, 23 aa, Cryptosporidium hominis
QKLDTSEMEEINPGRRNQENHSS

SEQ ID NO: 2157604 - protein, 9 aa, Cryptosporidium hominis
QKLENSKEY

SEQ ID NO: 2157605 - protein, 13 aa, Cryptosporidium hominis
QKLKEERNKCTRL

SEQ ID NO: 2157606 - protein, 5 aa, Cryptosporidium hominis
QKLPT

SEQ ID NO: 2157607 - protein, 12 aa, Cryptosporidium hominis
QKLSQESKGITK

SEQ ID NO: 2157608 - protein, 4 aa, Cryptosporidium hominis
QKLV

SEQ ID NO: 2157609 - protein, 4 aa, Cryptosporidium hominis
QKME

SEQ ID NO: 2157610 - protein, 4 aa, Cryptosporidium hominis
QKNA

SEQ ID NO: 2157611 - protein, 11 aa, Cryptosporidium hominis
QKNASQHTQYK

SEQ ID NO: 2157612 - protein, 4 aa, Cryptosporidium hominis
QKNE

SEQ ID NO: 2157613 - protein, 4 aa, Cryptosporidium hominis
QKNI

SEQ ID NO: 2157614 - protein, 13 aa, Cryptosporidium hominis
QKNIGSAANRIDP

SEQ ID NO: 2157615 - protein, 14 aa, Cryptosporidium hominis
QKNISTREKELDGR

SEQ ID NO: 2157616 - protein, 5 aa, Cryptosporidium hominis
QKNKK

SEQ ID NO: 2157617 - protein, 6 aa, Cryptosporidium hominis
QKNKKL

SEQ ID NO: 2157618 - protein, 16 aa, Cryptosporidium hominis
QKNKMNSNISLSSSNN

SEQ ID NO: 2157619 - protein, 9 aa, Cryptosporidium hominis
QKNNKDQSI

SEQ ID NO: 2157620 - protein, 8 aa, Cryptosporidium hominis
QKNNVKNN

SEQ ID NO: 2157621 - protein, 27 aa, Cryptosporidium hominis
QKNQKDDENLDSNLNSNTLSSSDSSSC

SEQ ID NO: 2157622 - protein, 10 aa, Cryptosporidium hominis
QKNSNQINDF

SEQ ID NO: 2157623 - protein, 7 aa, Cryptosporidium hominis
QKNSPFP

SEQ ID NO: 2157624 - protein, 10 aa, Cryptosporidium hominis
QKPGTSGLRK

SEQ ID NO: 2157625 - protein, 5 aa, Cryptosporidium hominis
QKPLT

SEQ ID NO: 2157626 - protein, 8 aa, Cryptosporidium hominis
QKPNHSVK

SEQ ID NO: 2157627 - protein, 18 aa, Cryptosporidium hominis
QKPNNPPVESDFDHGSQT

SEQ ID NO: 2157628 - protein, 7 aa, Cryptosporidium hominis
QKPTPIQ

SEQ ID NO: 2157629 - protein, 4 aa, Cryptosporidium hominis
QKPV

SEQ ID NO: 2157630 - protein, 4 aa, Cryptosporidium hominis
QKPY

SEQ ID NO: 2157631 - protein, 10 aa, Cryptosporidium hominis
QKQEKGQRTN

SEQ ID NO: 2157632 - protein, 30 aa, Cryptosporidium hominis
QKQEQAQEQEKRIEANPSSKMISSKDKDIE

SEQ ID NO: 2157633 - protein, 4 aa, Cryptosporidium hominis
QKQF

SEQ ID NO: 2157634 - protein, 16 aa, Cryptosporidium hominis
QKQHDENKDKFTRNGS

SEQ ID NO: 2157635 - protein, 8 aa, Cryptosporidium hominis
QKQISRDF

SEQ ID NO: 2157636 - protein, 8 aa, Cryptosporidium hominis
QKQPSKLV

SEQ ID NO: 2157637 - protein, 14 aa, Cryptosporidium hominis
QKQSSVSTDSTGEQ

SEQ ID NO: 2157638 - protein, 4 aa, Cryptosporidium hominis
QKRA

SEQ ID NO: 2157639 - protein, 6 aa, Cryptosporidium hominis
QKRDDL

SEQ ID NO: 2157640 - protein, 6 aa, Cryptosporidium hominis
QKRHPI

SEQ ID NO: 2157641 - protein, 9 aa, Cryptosporidium hominis
QKRKEKSAK

SEQ ID NO: 2157642 - protein, 13 aa, Cryptosporidium hominis
QKRKLANKDPVSE

SEQ ID NO: 2157643 - protein, 11 aa, Cryptosporidium hominis
QKRMNQRESTA

SEQ ID NO: 2157644 - protein, 6 aa, Cryptosporidium hominis
QKRNRL

SEQ ID NO: 2157645 - protein, 14 aa, Cryptosporidium hominis
QKRQQVSNSNQTQI

SEQ ID NO: 2157646 - protein, 4 aa, Cryptosporidium hominis
QKRR

SEQ ID NO: 2157647 - protein, 6 aa, Cryptosporidium hominis
QKRSGF

SEQ ID NO: 2157648 - protein, 6 aa, Cryptosporidium hominis
QKRSSV

SEQ ID NO: 2157649 - protein, 15 aa, Cryptosporidium hominis
QKRVTGKKKTYEERI

SEQ ID NO: 2157650 - protein, 7 aa, Cryptosporidium hominis
QKRYQAA

SEQ ID NO: 2157651 - protein, 4 aa, Cryptosporidium hominis
QKSD

SEQ ID NO: 2157652 - protein, 17 aa, Cryptosporidium hominis
QKSDKEGPQNTQNLPEP

SEQ ID NO: 2157653 - protein, 10 aa, Cryptosporidium hominis
QKSDPSQSIN

SEQ ID NO: 2157654 - protein, 10 aa, Cryptosporidium hominis
QKSDSSSGEK

SEQ ID NO: 2157655 - protein, 6 aa, Cryptosporidium hominis
QKSEIE

SEQ ID NO: 2157656 - protein, 7 aa, Cryptosporidium hominis
QKSEIGE

SEQ ID NO: 2157657 - protein, 8 aa, Cryptosporidium hominis
QKSGKKSV

SEQ ID NO: 2157658 - protein, 7 aa, Cryptosporidium hominis
QKSHSDW

SEQ ID NO: 2157659 - protein, 27 aa, Cryptosporidium hominis
QKSHVNHNADNYEVKGETNASKNNSKI

SEQ ID NO: 2157660 - protein, 12 aa, Cryptosporidium hominis
QKSKADKSDGLS

SEQ ID NO: 2157661 - protein, 8 aa, Cryptosporidium hominis
QKSKDNSI

SEQ ID NO: 2157662 - protein, 7 aa, Cryptosporidium hominis
QKSKESN

SEQ ID NO: 2157663 - protein, 32 aa, Cryptosporidium hominis
QKSKKNSTNNGGGNNNRKKTAINSFNNGSNSS

SEQ ID NO: 2157664 - protein, 5 aa, Cryptosporidium hominis
QKSKL

SEQ ID NO: 2157665 - protein, 15 aa, Cryptosporidium hominis
QKSKLSKISQNDQDS

SEQ ID NO: 2157666 - protein, 7 aa, Cryptosporidium hominis
QKSKNQI

SEQ ID NO: 2157667 - protein, 6 aa, Cryptosporidium hominis
QKSKVN

SEQ ID NO: 2157668 - protein, 9 aa, Cryptosporidium hominis
QKSLENSMS

SEQ ID NO: 2157669 - protein, 9 aa, Cryptosporidium hominis
QKSLQNTNS

SEQ ID NO: 2157670 - protein, 7 aa, Cryptosporidium hominis
QKSNNFK

SEQ ID NO: 2157671 - protein, 7 aa, Cryptosporidium hominis
QKSNSRI

SEQ ID NO: 2157672 - protein, 8 aa, Cryptosporidium hominis
QKSREKSY

SEQ ID NO: 2157673 - protein, 11 aa, Cryptosporidium hominis
QKSSTSNKKLN

SEQ ID NO: 2157674 - protein, 7 aa, Cryptosporidium hominis
QKSTAIY

SEQ ID NO: 2157675 - protein, 8 aa, Cryptosporidium hominis
QKSTQVDA

SEQ ID NO: 2157676 - protein, 4 aa, Cryptosporidium hominis
QKSY

SEQ ID NO: 2157677 - protein, 79 aa, Cryptosporidium hominis
QKTCENEQFDQKNENILGKEEEKGEREERKRRREERKRRREEEKGEEDEGEGEGEGEGEEEEEEEEEEEEEEEEEEEAS

SEQ ID NO: 2157678 - protein, 9 aa, Cryptosporidium hominis
QKTIETDVE

SEQ ID NO: 2157679 - protein, 6 aa, Cryptosporidium hominis
QKTLDN

SEQ ID NO: 2157680 - protein, 6 aa, Cryptosporidium hominis
QKTNSR

SEQ ID NO: 2157681 - protein, 8 aa, Cryptosporidium hominis
QKTPGLYP

SEQ ID NO: 2157682 - protein, 9 aa, Cryptosporidium hominis
QKTQKTKTW

SEQ ID NO: 2157683 - protein, 9 aa, Cryptosporidium hominis
QKTSEIDSL

SEQ ID NO: 2157684 - protein, 5 aa, Cryptosporidium hominis
QKTTK

SEQ ID NO: 2157685 - protein, 9 aa, Cryptosporidium hominis
QKTTKTESS

SEQ ID NO: 2157686 - protein, 7 aa, Cryptosporidium hominis
QKTTPSL

SEQ ID NO: 2157687 - protein, 9 aa, Cryptosporidium hominis
QKVDDQKRI

SEQ ID NO: 2157688 - protein, 9 aa, Cryptosporidium hominis
QKVSQYTKV

SEQ ID NO: 2157689 - protein, 8 aa, Cryptosporidium hominis
QKYRNKSK

SEQ ID NO: 2157690 - protein, 13 aa, Cryptosporidium hominis
QLCGTGKKDETEL

SEQ ID NO: 2157691 - protein, 9 aa, Cryptosporidium hominis
QLCPSSSSS

SEQ ID NO: 2157692 - protein, 16 aa, Cryptosporidium hominis
QLDNNNNNNNNNNNNK

SEQ ID NO: 2157693 - protein, 15 aa, Cryptosporidium hominis
QLDNSNDKSEKNVDS

SEQ ID NO: 2157694 - protein, 6 aa, Cryptosporidium hominis
QLDSNS

SEQ ID NO: 2157695 - protein, 25 aa, Cryptosporidium hominis
QLDTSPAKLDESVENEHFESQDPLP

SEQ ID NO: 2157696 - protein, 11 aa, Cryptosporidium hominis
QLEDQASKSMP

SEQ ID NO: 2157697 - protein, 5 aa, Cryptosporidium hominis
QLEER

SEQ ID NO: 2157698 - protein, 10 aa, Cryptosporidium hominis
QLEESKNEHL

SEQ ID NO: 2157699 - protein, 22 aa, Cryptosporidium hominis
QLEESQSDKNIDPFEDQADLNK

SEQ ID NO: 2157700 - protein, 9 aa, Cryptosporidium hominis
QLEKNEASE

SEQ ID NO: 2157701 - protein, 5 aa, Cryptosporidium hominis
QLERT

SEQ ID NO: 2157702 - protein, 9 aa, Cryptosporidium hominis
QLETNDSNS

SEQ ID NO: 2157703 - protein, 5 aa, Cryptosporidium hominis
QLGDD

SEQ ID NO: 2157704 - protein, 10 aa, Cryptosporidium hominis
QLGEEGRKID

SEQ ID NO: 2157705 - protein, 10 aa, Cryptosporidium hominis
QLGGSNKEVA

SEQ ID NO: 2157706 - protein, 10 aa, Cryptosporidium hominis
QLGKAGKSNF

SEQ ID NO: 2157707 - protein, 5 aa, Cryptosporidium hominis
QLGKS

SEQ ID NO: 2157708 - protein, 11 aa, Cryptosporidium hominis
QLGSNEDSINK

SEQ ID NO: 2157709 - protein, 10 aa, Cryptosporidium hominis
QLGSSNERND

SEQ ID NO: 2157710 - protein, 10 aa, Cryptosporidium hominis
QLKDENKELR

SEQ ID NO: 2157711 - protein, 11 aa, Cryptosporidium hominis
QLKGKSKSELE

SEQ ID NO: 2157712 - protein, 9 aa, Cryptosporidium hominis
QLKKGGKMT

SEQ ID NO: 2157713 - protein, 16 aa, Cryptosporidium hominis
QLKKNKNKKNKCEETN

SEQ ID NO: 2157714 - protein, 10 aa, Cryptosporidium hominis
QLKNRDSKRF

SEQ ID NO: 2157715 - protein, 7 aa, Cryptosporidium hominis
QLKPHPD

SEQ ID NO: 2157716 - protein, 27 aa, Cryptosporidium hominis
QLKREKKLEKSKRRRENREREKRGEEV

SEQ ID NO: 2157717 - protein, 17 aa, Cryptosporidium hominis
QLNDESEIKPPSTYEDD

SEQ ID NO: 2157718 - protein, 12 aa, Cryptosporidium hominis
QLNDNDSKNCND

SEQ ID NO: 2157719 - protein, 6 aa, Cryptosporidium hominis
QLNDSE

SEQ ID NO: 2157720 - protein, 11 aa, Cryptosporidium hominis
QLNDSGSNKRV

SEQ ID NO: 2157721 - protein, 25 aa, Cryptosporidium hominis
QLNEESGVTGAEKSFNDNNSPQDSH

SEQ ID NO: 2157722 - protein, 9 aa, Cryptosporidium hominis
QLNKANEIR

SEQ ID NO: 2157723 - protein, 6 aa, Cryptosporidium hominis
QLNKDN

SEQ ID NO: 2157724 - protein, 8 aa, Cryptosporidium hominis
QLNPPNHS

SEQ ID NO: 2157725 - protein, 12 aa, Cryptosporidium hominis
QLNSKKKASEWR

SEQ ID NO: 2157726 - protein, 8 aa, Cryptosporidium hominis
QLPKGDYD

SEQ ID NO: 2157727 - protein, 7 aa, Cryptosporidium hominis
QLPNSSN

SEQ ID NO: 2157728 - protein, 5 aa, Cryptosporidium hominis
QLPPD

SEQ ID NO: 2157729 - protein, 8 aa, Cryptosporidium hominis
QLPPEAEE

SEQ ID NO: 2157730 - protein, 6 aa, Cryptosporidium hominis
QLPPGI

SEQ ID NO: 2157731 - protein, 7 aa, Cryptosporidium hominis
QLPSQDQ

SEQ ID NO: 2157732 - protein, 5 aa, Cryptosporidium hominis
QLPTT

SEQ ID NO: 2157733 - protein, 5 aa, Cryptosporidium hominis
QLQPN

SEQ ID NO: 2157734 - protein, 4 aa, Cryptosporidium hominis
QLRD

SEQ ID NO: 2157735 - protein, 6 aa, Cryptosporidium hominis
QLRGND

SEQ ID NO: 2157736 - protein, 16 aa, Cryptosporidium hominis
QLRKTNQAVIADKIQR

SEQ ID NO: 2157737 - protein, 19 aa, Cryptosporidium hominis
QLSDENSKLNASYKENKTC

SEQ ID NO: 2157738 - protein, 7 aa, Cryptosporidium hominis
QLSEKER

SEQ ID NO: 2157739 - protein, 5 aa, Cryptosporidium hominis
QLSKE

SEQ ID NO: 2157740 - protein, 9 aa, Cryptosporidium hominis
QLSKGPPQI

SEQ ID NO: 2157741 - protein, 38 aa, Cryptosporidium hominis
QLSKKQRTKSQSSTHSSITSTSTSTSTPRSRPTRPKSY

SEQ ID NO: 2157742 - protein, 12 aa, Cryptosporidium hominis
QLSSNSGSFTNG

SEQ ID NO: 2157743 - protein, 11 aa, Cryptosporidium hominis
QLSSSGQIEGA

SEQ ID NO: 2157744 - protein, 7 aa, Cryptosporidium hominis
QLTPTSA

SEQ ID NO: 2157745 - protein, 4 aa, Cryptosporidium hominis
QLTS

SEQ ID NO: 2157746 - protein, 14 aa, Cryptosporidium hominis
QMASPTSRPEQRAI

SEQ ID NO: 2157747 - protein, 5 aa, Cryptosporidium hominis
QMDEN

SEQ ID NO: 2157748 - protein, 8 aa, Cryptosporidium hominis
QMDPSNGA

SEQ ID NO: 2157749 - protein, 23 aa, Cryptosporidium hominis
QMDSNSVKTSPSLVPNSGGNQLA

SEQ ID NO: 2157750 - protein, 7 aa, Cryptosporidium hominis
QMEESRT

SEQ ID NO: 2157751 - protein, 20 aa, Cryptosporidium hominis
QMESNSNKSEFDLNSSSQRF

SEQ ID NO: 2157752 - protein, 9 aa, Cryptosporidium hominis
QMRESSRLA

SEQ ID NO: 2157753 - protein, 5 aa, Cryptosporidium hominis
QMRNS

SEQ ID NO: 2157754 - protein, 12 aa, Cryptosporidium hominis
QMRSESKKAQLR

SEQ ID NO: 2157755 - protein, 6 aa, Cryptosporidium hominis
QMSASS

SEQ ID NO: 2157756 - protein, 8 aa, Cryptosporidium hominis
QMSSNSCS

SEQ ID NO: 2157757 - protein, 5 aa, Cryptosporidium hominis
QMTEG

SEQ ID NO: 2157758 - protein, 36 aa, Cryptosporidium hominis
QMTPSHGCTSKTLGENSAVDGSTKSHSPSSKESNSL

SEQ ID NO: 2157759 - protein, 4 aa, Cryptosporidium hominis
QMTR

SEQ ID NO: 2157760 - protein, 13 aa, Cryptosporidium hominis
QNAFEASKSELEE

SEQ ID NO: 2157761 - protein, 11 aa, Cryptosporidium hominis
QNANNQQLNNN

SEQ ID NO: 2157762 - protein, 6 aa, Cryptosporidium hominis
QNATLR

SEQ ID NO: 2157763 - protein, 21 aa, Cryptosporidium hominis
QNAYSSGLDSFDDDDDQDNES

SEQ ID NO: 2157764 - protein, 13 aa, Cryptosporidium hominis
QNCASNNRKTFSD

SEQ ID NO: 2157765 - protein, 4 aa, Cryptosporidium hominis
QNCS

SEQ ID NO: 2157766 - protein, 6 aa, Cryptosporidium hominis
QNCSSN

SEQ ID NO: 2157767 - protein, 9 aa, Cryptosporidium hominis
QNDDDDLES

SEQ ID NO: 2157768 - protein, 8 aa, Cryptosporidium hominis
QNDEEIKE

SEQ ID NO: 2157769 - protein, 8 aa, Cryptosporidium hominis
QNDENELN

SEQ ID NO: 2157770 - protein, 7 aa, Cryptosporidium hominis
QNDEQGY

SEQ ID NO: 2157771 - protein, 5 aa, Cryptosporidium hominis
QNDER

SEQ ID NO: 2157772 - protein, 7 aa, Cryptosporidium hominis
QNDGTRK

SEQ ID NO: 2157773 - protein, 22 aa, Cryptosporidium hominis
QNDLEKRDKELKAQKEQNKQLK

SEQ ID NO: 2157774 - protein, 6 aa, Cryptosporidium hominis
QNDPIE

SEQ ID NO: 2157775 - protein, 6 aa, Cryptosporidium hominis
QNDPNI

SEQ ID NO: 2157776 - protein, 9 aa, Cryptosporidium hominis
QNDRDAQSK

SEQ ID NO: 2157777 - protein, 9 aa, Cryptosporidium hominis
QNDSAINNS

SEQ ID NO: 2157778 - protein, 10 aa, Cryptosporidium hominis
QNDSPGPNNR

SEQ ID NO: 2157779 - protein, 18 aa, Cryptosporidium hominis
QNDSSSIEHNASTFTDKS

SEQ ID NO: 2157780 - protein, 19 aa, Cryptosporidium hominis
QNDTKKDISDNSNINGNEE

SEQ ID NO: 2157781 - protein, 10 aa, Cryptosporidium hominis
QNDTNSNTPF

SEQ ID NO: 2157782 - protein, 10 aa, Cryptosporidium hominis
QNDVEDIQSS

SEQ ID NO: 2157783 - protein, 9 aa, Cryptosporidium hominis
QNDVSGATQ

SEQ ID NO: 2157784 - protein, 5 aa, Cryptosporidium hominis
QNEDE

SEQ ID NO: 2157785 - protein, 11 aa, Cryptosporidium hominis
QNEDINTRLNE

SEQ ID NO: 2157786 - protein, 6 aa, Cryptosporidium hominis
QNEDMP

SEQ ID NO: 2157787 - protein, 9 aa, Cryptosporidium hominis
QNEDSSHGE

SEQ ID NO: 2157788 - protein, 9 aa, Cryptosporidium hominis
QNEEKQTTE

SEQ ID NO: 2157789 - protein, 5 aa, Cryptosporidium hominis
QNEEN

SEQ ID NO: 2157790 - protein, 15 aa, Cryptosporidium hominis
QNEEQNDKDKAFKNE

SEQ ID NO: 2157791 - protein, 18 aa, Cryptosporidium hominis
QNEGEDNSKSFYSSEEEI

SEQ ID NO: 2157792 - protein, 6 aa, Cryptosporidium hominis
QNEIKG

SEQ ID NO: 2157793 - protein, 19 aa, Cryptosporidium hominis
QNEKDILSKSEKTITPVTN

SEQ ID NO: 2157794 - protein, 10 aa, Cryptosporidium hominis
QNEKTSESKL

SEQ ID NO: 2157795 - protein, 6 aa, Cryptosporidium hominis
QNELGE

SEQ ID NO: 2157796 - protein, 7 aa, Cryptosporidium hominis
QNELKTI

SEQ ID NO: 2157797 - protein, 6 aa, Cryptosporidium hominis
QNELNS

SEQ ID NO: 2157798 - protein, 31 aa, Cryptosporidium hominis
QNENQSKRPIDSKKEKNESGYSSTKINPQQC

SEQ ID NO: 2157799 - protein, 9 aa, Cryptosporidium hominis
QNENSKIGR

SEQ ID NO: 2157800 - protein, 7 aa, Cryptosporidium hominis
QNEPTHI

SEQ ID NO: 2157801 - protein, 11 aa, Cryptosporidium hominis
QNESETDQTHN

SEQ ID NO: 2157802 - protein, 5 aa, Cryptosporidium hominis
QNESF

SEQ ID NO: 2157803 - protein, 9 aa, Cryptosporidium hominis
QNESNRNKE

SEQ ID NO: 2157804 - protein, 16 aa, Cryptosporidium hominis
QNETDSHSIPLPDPDP

SEQ ID NO: 2157805 - protein, 4 aa, Cryptosporidium hominis
QNEV

SEQ ID NO: 2157806 - protein, 16 aa, Cryptosporidium hominis
QNEYGSDEYNTENQGV

SEQ ID NO: 2157807 - protein, 7 aa, Cryptosporidium hominis
QNEYSQI

SEQ ID NO: 2157808 - protein, 22 aa, Cryptosporidium hominis
QNFNGNENNNNGEFEDDEFGDA

SEQ ID NO: 2157809 - protein, 7 aa, Cryptosporidium hominis
QNFNQVD

SEQ ID NO: 2157810 - protein, 11 aa, Cryptosporidium hominis
QNFSNGSELKD

SEQ ID NO: 2157811 - protein, 6 aa, Cryptosporidium hominis
QNFSRR

SEQ ID NO: 2157812 - protein, 7 aa, Cryptosporidium hominis
QNGDLNN

SEQ ID NO: 2157813 - protein, 5 aa, Cryptosporidium hominis
QNGEK

SEQ ID NO: 2157814 - protein, 9 aa, Cryptosporidium hominis
QNGEKYEGY

SEQ ID NO: 2157815 - protein, 10 aa, Cryptosporidium hominis
QNGGAESNEE

SEQ ID NO: 2157816 - protein, 9 aa, Cryptosporidium hominis
QNGGQRDGV

SEQ ID NO: 2157817 - protein, 6 aa, Cryptosporidium hominis
QNGNDD

SEQ ID NO: 2157818 - protein, 8 aa, Cryptosporidium hominis
QNGPNNPL

SEQ ID NO: 2157819 - protein, 21 aa, Cryptosporidium hominis
QNGPSIADSEVTSSKMENRRQ

SEQ ID NO: 2157820 - protein, 4 aa, Cryptosporidium hominis
QNGS

SEQ ID NO: 2157821 - protein, 8 aa, Cryptosporidium hominis
QNGSGKTT

SEQ ID NO: 2157822 - protein, 4 aa, Cryptosporidium hominis
QNGT

SEQ ID NO: 2157823 - protein, 6 aa, Cryptosporidium hominis
QNGTSR

SEQ ID NO: 2157824 - protein, 88 aa, Cryptosporidium hominis
QNHKDGNHHHNNEVEGENTQRRDRKESRSPSPKQSGRGGGGGGGGGRRRTGKKGQEAGANAAEHSSTGSPKPPSKHKKNNGKKQPKPK

SEQ ID NO: 2157825 - protein, 9 aa, Cryptosporidium hominis
QNHLPEKSA

SEQ ID NO: 2157826 - protein, 13 aa, Cryptosporidium hominis
QNHSESINRNSHD

SEQ ID NO: 2157827 - protein, 7 aa, Cryptosporidium hominis
QNHSQYP

SEQ ID NO: 2157828 - protein, 19 aa, Cryptosporidium hominis
QNHSYPRTQVDEESQNEDF

SEQ ID NO: 2157829 - protein, 19 aa, Cryptosporidium hominis
QNIEKDQKSGSSDNTGDNC

SEQ ID NO: 2157830 - protein, 8 aa, Cryptosporidium hominis
QNIETSDD

SEQ ID NO: 2157831 - protein, 4 aa, Cryptosporidium hominis
QNIG

SEQ ID NO: 2157832 - protein, 4 aa, Cryptosporidium hominis
QNIK

SEQ ID NO: 2157833 - protein, 19 aa, Cryptosporidium hominis
QNINSNDQDLKTQSSPPKH

SEQ ID NO: 2157834 - protein, 6 aa, Cryptosporidium hominis
QNIQGK

SEQ ID NO: 2157835 - protein, 19 aa, Cryptosporidium hominis
QNISNTNEYPPLSSASNMV

SEQ ID NO: 2157836 - protein, 9 aa, Cryptosporidium hominis
QNISSGNTL

SEQ ID NO: 2157837 - protein, 5 aa, Cryptosporidium hominis
QNITK

SEQ ID NO: 2157838 - protein, 14 aa, Cryptosporidium hominis
QNITKSRQNERPSI

SEQ ID NO: 2157839 - protein, 5 aa, Cryptosporidium hominis
QNITN

SEQ ID NO: 2157840 - protein, 6 aa, Cryptosporidium hominis
QNKARE

SEQ ID NO: 2157841 - protein, 7 aa, Cryptosporidium hominis
QNKDGSF

SEQ ID NO: 2157842 - protein, 5 aa, Cryptosporidium hominis
QNKEK

SEQ ID NO: 2157843 - protein, 12 aa, Cryptosporidium hominis
QNKENEEKERRR

SEQ ID NO: 2157844 - protein, 8 aa, Cryptosporidium hominis
QNKEQQYR

SEQ ID NO: 2157845 - protein, 12 aa, Cryptosporidium hominis
QNKGENKINSGE

SEQ ID NO: 2157846 - protein, 6 aa, Cryptosporidium hominis
QNKGLN

SEQ ID NO: 2157847 - protein, 9 aa, Cryptosporidium hominis
QNKGRSIGQ

SEQ ID NO: 2157848 - protein, 10 aa, Cryptosporidium hominis
QNKKKNPERV

SEQ ID NO: 2157849 - protein, 12 aa, Cryptosporidium hominis
QNKLDSASEASL

SEQ ID NO: 2157850 - protein, 9 aa, Cryptosporidium hominis
QNKNGEIDS

SEQ ID NO: 2157851 - protein, 7 aa, Cryptosporidium hominis
QNKNGGF

SEQ ID NO: 2157852 - protein, 7 aa, Cryptosporidium hominis
QNKNNIE

SEQ ID NO: 2157853 - protein, 4 aa, Cryptosporidium hominis
QNKR

SEQ ID NO: 2157854 - protein, 17 aa, Cryptosporidium hominis
QNKSESPPAENKISVEK

SEQ ID NO: 2157855 - protein, 9 aa, Cryptosporidium hominis
QNKSPFQHD

SEQ ID NO: 2157856 - protein, 10 aa, Cryptosporidium hominis
QNKSRDKTEV

SEQ ID NO: 2157857 - protein, 4 aa, Cryptosporidium hominis
QNLG

SEQ ID NO: 2157858 - protein, 13 aa, Cryptosporidium hominis
QNLHSSERKGASI

SEQ ID NO: 2157859 - protein, 23 aa, Cryptosporidium hominis
QNLPPPPPKRPTTTDSGTRTESM

SEQ ID NO: 2157860 - protein, 11 aa, Cryptosporidium hominis
QNLSETPRLGN

SEQ ID NO: 2157861 - protein, 9 aa, Cryptosporidium hominis
QNMDKKELS

SEQ ID NO: 2157862 - protein, 6 aa, Cryptosporidium hominis
QNMGSG

SEQ ID NO: 2157863 - protein, 17 aa, Cryptosporidium hominis
QNMSSSQANGISSVGNR

SEQ ID NO: 2157864 - protein, 11 aa, Cryptosporidium hominis
QNNAISEGQQY

SEQ ID NO: 2157865 - protein, 5 aa, Cryptosporidium hominis
QNNEN

SEQ ID NO: 2157866 - protein, 7 aa, Cryptosporidium hominis
QNNENVE

SEQ ID NO: 2157867 - protein, 13 aa, Cryptosporidium hominis
QNNEQNTNYRNNA

SEQ ID NO: 2157868 - protein, 15 aa, Cryptosporidium hominis
QNNGKELGTKTEQKT

SEQ ID NO: 2157869 - protein, 83 aa, Cryptosporidium hominis
  misc_feature (19)..(19): Xaa can be any naturally occurring amino acid
QNNGKNNSDGSESHDNSEXSHEEDDSTQEDEVDYDSEEEEEEEEEEEDDDEYNGRNQDQDNSDNEHREEEEYDETIDKQEYDE

SEQ ID NO: 2157870 - protein, 16 aa, Cryptosporidium hominis
QNNGNVGGTGTGTNNG

SEQ ID NO: 2157871 - protein, 7 aa, Cryptosporidium hominis
QNNHNSA

SEQ ID NO: 2157872 - protein, 43 aa, Cryptosporidium hominis
QNNINSRRNKQDSKKSTTKTAQKAIDKKNVKPESDEIQQSESS

SEQ ID NO: 2157873 - protein, 37 aa, Cryptosporidium hominis
QNNKKQNSIENTKSDSNDINNNHSNHIQDDNSESNRI

SEQ ID NO: 2157874 - protein, 11 aa, Cryptosporidium hominis
QNNKTKKSVEL

SEQ ID NO: 2157875 - protein, 8 aa, Cryptosporidium hominis
QNNNGDDF

SEQ ID NO: 2157876 - protein, 8 aa, Cryptosporidium hominis
QNNNQEYQ

SEQ ID NO: 2157877 - protein, 4 aa, Cryptosporidium hominis
QNNP

SEQ ID NO: 2157878 - protein, 5 aa, Cryptosporidium hominis
QNNPA

SEQ ID NO: 2157879 - protein, 8 aa, Cryptosporidium hominis
QNNPYQSK

SEQ ID NO: 2157880 - protein, 4 aa, Cryptosporidium hominis
QNNQ

SEQ ID NO: 2157881 - protein, 11 aa, Cryptosporidium hominis
QNNSLNKQKQN

SEQ ID NO: 2157882 - protein, 8 aa, Cryptosporidium hominis
QNNSRSKL

SEQ ID NO: 2157883 - protein, 9 aa, Cryptosporidium hominis
QNNSSDPIE

SEQ ID NO: 2157884 - protein, 8 aa, Cryptosporidium hominis
QNNSSISV

SEQ ID NO: 2157885 - protein, 18 aa, Cryptosporidium hominis
QNNSVGYSGRRSNGARGY

SEQ ID NO: 2157886 - protein, 47 aa, Cryptosporidium hominis
QNNTQTASNTNSAESKQSPSSASASNSVSVAPQNLGQATNAGNSLGS

SEQ ID NO: 2157887 - protein, 18 aa, Cryptosporidium hominis
QNNYEKKNKMRSSSTSLP

SEQ ID NO: 2157888 - protein, 8 aa, Cryptosporidium hominis
QNNYSTPI

SEQ ID NO: 2157889 - protein, 8 aa, Cryptosporidium hominis
QNPEADNS

SEQ ID NO: 2157890 - protein, 7 aa, Cryptosporidium hominis
QNPETAR

SEQ ID NO: 2157891 - protein, 6 aa, Cryptosporidium hominis
QNPNYG

SEQ ID NO: 2157892 - protein, 32 aa, Cryptosporidium hominis
QNPPLSDSSNMSKSGTMDKEKSEKSSAEIKKE

SEQ ID NO: 2157893 - protein, 7 aa, Cryptosporidium hominis
QNPPYTS

SEQ ID NO: 2157894 - protein, 6 aa, Cryptosporidium hominis
QNPRNW

SEQ ID NO: 2157895 - protein, 13 aa, Cryptosporidium hominis
QNQDATEKSLNNE

SEQ ID NO: 2157896 - protein, 8 aa, Cryptosporidium hominis
QNQDENRI

SEQ ID NO: 2157897 - protein, 7 aa, Cryptosporidium hominis
QNQEGSF

SEQ ID NO: 2157898 - protein, 15 aa, Cryptosporidium hominis
QNQFKTENQYVESSQ

SEQ ID NO: 2157899 - protein, 8 aa, Cryptosporidium hominis
QNQGKEVR

SEQ ID NO: 2157900 - protein, 6 aa, Cryptosporidium hominis
QNQGNN

SEQ ID NO: 2157901 - protein, 19 aa, Cryptosporidium hominis
QNQHNQNQYQHQQQRYSQN

SEQ ID NO: 2157902 - protein, 4 aa, Cryptosporidium hominis
QNQN

SEQ ID NO: 2157903 - protein, 8 aa, Cryptosporidium hominis
QNQNETQI

SEQ ID NO: 2157904 - protein, 9 aa, Cryptosporidium hominis
QNQNHPQQQ

SEQ ID NO: 2157905 - protein, 6 aa, Cryptosporidium hominis
QNQNKN

SEQ ID NO: 2157906 - protein, 23 aa, Cryptosporidium hominis
QNQNQSQPQSQQQPVSTQSQPVA

SEQ ID NO: 2157907 - protein, 4 aa, Cryptosporidium hominis
QNQQ

SEQ ID NO: 2157908 - protein, 6 aa, Cryptosporidium hominis
QNQQSL

SEQ ID NO: 2157909 - protein, 17 aa, Cryptosporidium hominis
QNQQTSSNPINPLKSSN

SEQ ID NO: 2157910 - protein, 10 aa, Cryptosporidium hominis
QNQSANGNAE

SEQ ID NO: 2157911 - protein, 24 aa, Cryptosporidium hominis
QNQSKSTNLNQSWSSTASSSSPTL

SEQ ID NO: 2157912 - protein, 6 aa, Cryptosporidium hominis
QNRPYS

SEQ ID NO: 2157913 - protein, 4 aa, Cryptosporidium hominis
QNRQ

SEQ ID NO: 2157914 - protein, 7 aa, Cryptosporidium hominis
QNRSFKD

SEQ ID NO: 2157915 - protein, 9 aa, Cryptosporidium hominis
QNRSNTSKI

SEQ ID NO: 2157916 - protein, 11 aa, Cryptosporidium hominis
QNSEEKPETYK

SEQ ID NO: 2157917 - protein, 17 aa, Cryptosporidium hominis
QNSENNSKSYKKSGNTL

SEQ ID NO: 2157918 - protein, 15 aa, Cryptosporidium hominis
QNSGKRISSSSLTPN

SEQ ID NO: 2157919 - protein, 32 aa, Cryptosporidium hominis
QNSGKTVTANENINRENALNGTRRGDKSENLT

SEQ ID NO: 2157920 - protein, 14 aa, Cryptosporidium hominis
QNSGNSYNQNEGVL

SEQ ID NO: 2157921 - protein, 26 aa, Cryptosporidium hominis
QNSISEHNRQSTGHYQNSVENPSPTL

SEQ ID NO: 2157922 - protein, 7 aa, Cryptosporidium hominis
QNSKGEN

SEQ ID NO: 2157923 - protein, 15 aa, Cryptosporidium hominis
QNSKNENSIVQNETD

SEQ ID NO: 2157924 - protein, 15 aa, Cryptosporidium hominis
QNSKRSINMTKSKKK

SEQ ID NO: 2157925 - protein, 7 aa, Cryptosporidium hominis
QNSKVSH

SEQ ID NO: 2157926 - protein, 5 aa, Cryptosporidium hominis
QNSLP

SEQ ID NO: 2157927 - protein, 8 aa, Cryptosporidium hominis
QNSLTPNY

SEQ ID NO: 2157928 - protein, 8 aa, Cryptosporidium hominis
QNSMNNMN

SEQ ID NO: 2157929 - protein, 13 aa, Cryptosporidium hominis
QNSNLKSQSQLNE

SEQ ID NO: 2157930 - protein, 6 aa, Cryptosporidium hominis
QNSNNL

SEQ ID NO: 2157931 - protein, 22 aa, Cryptosporidium hominis
QNSNNVNGNNESNTDDNSNNDV

SEQ ID NO: 2157932 - protein, 4 aa, Cryptosporidium hominis
QNSP

SEQ ID NO: 2157933 - protein, 13 aa, Cryptosporidium hominis
QNSPPRELRSRRG

SEQ ID NO: 2157934 - protein, 9 aa, Cryptosporidium hominis
QNSQDSHGI

SEQ ID NO: 2157935 - protein, 9 aa, Cryptosporidium hominis
QNSQYSTEI

SEQ ID NO: 2157936 - protein, 7 aa, Cryptosporidium hominis
QNSRANY

SEQ ID NO: 2157937 - protein, 22 aa, Cryptosporidium hominis
QNSRLTGNNTSENSSLNVSSTD

SEQ ID NO: 2157938 - protein, 6 aa, Cryptosporidium hominis
QNSRPE

SEQ ID NO: 2157939 - protein, 6 aa, Cryptosporidium hominis
QNSRSN

SEQ ID NO: 2157940 - protein, 8 aa, Cryptosporidium hominis
QNSRYNSL

SEQ ID NO: 2157941 - protein, 9 aa, Cryptosporidium hominis
QNSSDRNVS

SEQ ID NO: 2157942 - protein, 8 aa, Cryptosporidium hominis
QNSSESCG

SEQ ID NO: 2157943 - protein, 13 aa, Cryptosporidium hominis
QNSSNINEQKESL

SEQ ID NO: 2157944 - protein, 8 aa, Cryptosporidium hominis
QNSSNNNP

SEQ ID NO: 2157945 - protein, 5 aa, Cryptosporidium hominis
QNSSS

SEQ ID NO: 2157946 - protein, 11 aa, Cryptosporidium hominis
QNSTETNGELA

SEQ ID NO: 2157947 - protein, 5 aa, Cryptosporidium hominis
QNSTQ

SEQ ID NO: 2157948 - protein, 6 aa, Cryptosporidium hominis
QNSTQF

SEQ ID NO: 2157949 - protein, 4 aa, Cryptosporidium hominis
QNSV

SEQ ID NO: 2157950 - protein, 13 aa, Cryptosporidium hominis
QNSVGEENDDLNK

SEQ ID NO: 2157951 - protein, 10 aa, Cryptosporidium hominis
QNTDKIDSLS

SEQ ID NO: 2157952 - protein, 9 aa, Cryptosporidium hominis
QNTDRANGS

SEQ ID NO: 2157953 - protein, 13 aa, Cryptosporidium hominis
QNTELKASEEPLT

SEQ ID NO: 2157954 - protein, 15 aa, Cryptosporidium hominis
QNTISNIPDPNFSSS

SEQ ID NO: 2157955 - protein, 8 aa, Cryptosporidium hominis
QNTMEESL

SEQ ID NO: 2157956 - protein, 9 aa, Cryptosporidium hominis
QNTNTNSNF

SEQ ID NO: 2157957 - protein, 9 aa, Cryptosporidium hominis
QNTPPNRYV

SEQ ID NO: 2157958 - protein, 8 aa, Cryptosporidium hominis
QNVAGQRI

SEQ ID NO: 2157959 - protein, 4 aa, Cryptosporidium hominis
QNVE

SEQ ID NO: 2157960 - protein, 6 aa, Cryptosporidium hominis
QNVEGK

SEQ ID NO: 2157961 - protein, 4 aa, Cryptosporidium hominis
QNVG

SEQ ID NO: 2157962 - protein, 9 aa, Cryptosporidium hominis
QNVKGSEMQ

SEQ ID NO: 2157963 - protein, 4 aa, Cryptosporidium hominis
QNYE

SEQ ID NO: 2157964 - protein, 12 aa, Cryptosporidium hominis
QNYENSASGIRN

SEQ ID NO: 2157965 - protein, 12 aa, Cryptosporidium hominis
QPALDSKSSFSE

SEQ ID NO: 2157966 - protein, 5 aa, Cryptosporidium hominis
QPANK

SEQ ID NO: 2157967 - protein, 17 aa, Cryptosporidium hominis
QPAPIDGDENNTPPGYH

SEQ ID NO: 2157968 - protein, 10 aa, Cryptosporidium hominis
QPASSHKNNH

SEQ ID NO: 2157969 - protein, 4 aa, Cryptosporidium hominis
QPAY

SEQ ID NO: 2157970 - protein, 8 aa, Cryptosporidium hominis
QPDFTSPG

SEQ ID NO: 2157971 - protein, 8 aa, Cryptosporidium hominis
QPDGPDGK

SEQ ID NO: 2157972 - protein, 6 aa, Cryptosporidium hominis
QPDHHE

SEQ ID NO: 2157973 - protein, 19 aa, Cryptosporidium hominis
QPEDEGYEEAKLKGETHRG

SEQ ID NO: 2157974 - protein, 7 aa, Cryptosporidium hominis
QPENEDI

SEQ ID NO: 2157975 - protein, 8 aa, Cryptosporidium hominis
QPESSRES

SEQ ID NO: 2157976 - protein, 4 aa, Cryptosporidium hominis
QPET

SEQ ID NO: 2157977 - protein, 4 aa, Cryptosporidium hominis
QPFK

SEQ ID NO: 2157978 - protein, 4 aa, Cryptosporidium hominis
QPGA

SEQ ID NO: 2157979 - protein, 23 aa, Cryptosporidium hominis
QPGFKLPPKADDGSPKGEPEPQV

SEQ ID NO: 2157980 - protein, 13 aa, Cryptosporidium hominis
QPGGSTSSRAAAT

SEQ ID NO: 2157981 - protein, 13 aa, Cryptosporidium hominis
QPGISGLGAPNMG

SEQ ID NO: 2157982 - protein, 12 aa, Cryptosporidium hominis
QPGTSRLATAGA

SEQ ID NO: 2157983 - protein, 17 aa, Cryptosporidium hominis
QPGTTNNNKLDNIGAHP

SEQ ID NO: 2157984 - protein, 29 aa, Cryptosporidium hominis
QPGVPGVPGVPGIPGVPGVPGVPGSQGGL

SEQ ID NO: 2157985 - protein, 4 aa, Cryptosporidium hominis
QPID

SEQ ID NO: 2157986 - protein, 31 aa, Cryptosporidium hominis
QPIDQRSINAGTSETLVSKDTTKQSSGSNIR

SEQ ID NO: 2157987 - protein, 7 aa, Cryptosporidium hominis
QPIEAPP

SEQ ID NO: 2157988 - protein, 6 aa, Cryptosporidium hominis
QPIETA

SEQ ID NO: 2157989 - protein, 28 aa, Cryptosporidium hominis
QPIKYSNNQYTNNPISLSNTQKSQGTIS

SEQ ID NO: 2157990 - protein, 6 aa, Cryptosporidium hominis
QPIPDF

SEQ ID NO: 2157991 - protein, 14 aa, Cryptosporidium hominis
QPITPSDAESIDPE

SEQ ID NO: 2157992 - protein, 6 aa, Cryptosporidium hominis
QPKERR

SEQ ID NO: 2157993 - protein, 4 aa, Cryptosporidium hominis
QPKY

SEQ ID NO: 2157994 - protein, 5 aa, Cryptosporidium hominis
QPLKN

SEQ ID NO: 2157995 - protein, 17 aa, Cryptosporidium hominis
QPMDGVTEDSKADEASL

SEQ ID NO: 2157996 - protein, 4 aa, Cryptosporidium hominis
QPMN

SEQ ID NO: 2157997 - protein, 8 aa, Cryptosporidium hominis
QPNDQQDL

SEQ ID NO: 2157998 - protein, 4 aa, Cryptosporidium hominis
QPNE

SEQ ID NO: 2157999 - protein, 5 aa, Cryptosporidium hominis
QPNMA

SEQ ID NO: 2158000 - protein, 6 aa, Cryptosporidium hominis
QPNSGT

SEQ ID NO: 2158001 - protein, 10 aa, Cryptosporidium hominis
QPNSPGNYNQ

SEQ ID NO: 2158002 - protein, 4 aa, Cryptosporidium hominis
QPNY

SEQ ID NO: 2158003 - protein, 6 aa, Cryptosporidium hominis
QPPFGG

SEQ ID NO: 2158004 - protein, 16 aa, Cryptosporidium hominis
QPPGYPLSNGPAPYQI

SEQ ID NO: 2158005 - protein, 15 aa, Cryptosporidium hominis
QPPLDGSSSTGDYSE

SEQ ID NO: 2158006 - protein, 6 aa, Cryptosporidium hominis
QPPNTI

SEQ ID NO: 2158007 - protein, 19 aa, Cryptosporidium hominis
QPPPPQKVDQKDSDNSRLQ

SEQ ID NO: 2158008 - protein, 8 aa, Cryptosporidium hominis
QPPPQLAN

SEQ ID NO: 2158009 - protein, 24 aa, Cryptosporidium hominis
QPPSNKIADKRSQNNSKGSSGDKV

SEQ ID NO: 2158010 - protein, 9 aa, Cryptosporidium hominis
QPPTVVPGG

SEQ ID NO: 2158011 - protein, 12 aa, Cryptosporidium hominis
QPQERLPERQPN

SEQ ID NO: 2158012 - protein, 5 aa, Cryptosporidium hominis
QPQIT

SEQ ID NO: 2158013 - protein, 5 aa, Cryptosporidium hominis
QPQNY

SEQ ID NO: 2158014 - protein, 6 aa, Cryptosporidium hominis
QPQPGV

SEQ ID NO: 2158015 - protein, 25 aa, Cryptosporidium hominis
QPQPPHSPPKSTKPPIPPKPTFPYN

SEQ ID NO: 2158016 - protein, 4 aa, Cryptosporidium hominis
QPRA

SEQ ID NO: 2158017 - protein, 4 aa, Cryptosporidium hominis
QPRR

SEQ ID NO: 2158018 - protein, 17 aa, Cryptosporidium hominis
QPRVANTKRVDEPQRRD

SEQ ID NO: 2158019 - protein, 5 aa, Cryptosporidium hominis
QPSEL

SEQ ID NO: 2158020 - protein, 5 aa, Cryptosporidium hominis
QPSGT

SEQ ID NO: 2158021 - protein, 7 aa, Cryptosporidium hominis
QPSINND

SEQ ID NO: 2158022 - protein, 10 aa, Cryptosporidium hominis
QPSKESEKWN

SEQ ID NO: 2158023 - protein, 7 aa, Cryptosporidium hominis
QPSNQYH

SEQ ID NO: 2158024 - protein, 7 aa, Cryptosporidium hominis
QPSPFNP

SEQ ID NO: 2158025 - protein, 26 aa, Cryptosporidium hominis
QPSQPSQQSQPSQPSQPSQLTQPSQL

SEQ ID NO: 2158026 - protein, 10 aa, Cryptosporidium hominis
QPSSAKVPWG

SEQ ID NO: 2158027 - protein, 5 aa, Cryptosporidium hominis
QPSSF

SEQ ID NO: 2158028 - protein, 8 aa, Cryptosporidium hominis
QPSTASYN

SEQ ID NO: 2158029 - protein, 5 aa, Cryptosporidium hominis
QPTDK

SEQ ID NO: 2158030 - protein, 4 aa, Cryptosporidium hominis
QPTI

SEQ ID NO: 2158031 - protein, 8 aa, Cryptosporidium hominis
QPTRHNTN

SEQ ID NO: 2158032 - protein, 5 aa, Cryptosporidium hominis
QPTYE

SEQ ID NO: 2158033 - protein, 4 aa, Cryptosporidium hominis
QPVD

SEQ ID NO: 2158034 - protein, 14 aa, Cryptosporidium hominis
QPVKETKKIDDSET

SEQ ID NO: 2158035 - protein, 6 aa, Cryptosporidium hominis
QPVKSH

SEQ ID NO: 2158036 - protein, 4 aa, Cryptosporidium hominis
QPVP

SEQ ID NO: 2158037 - protein, 5 aa, Cryptosporidium hominis
QPYPN

SEQ ID NO: 2158038 - protein, 13 aa, Cryptosporidium hominis
QQADAKASGDVEA

SEQ ID NO: 2158039 - protein, 6 aa, Cryptosporidium hominis
QQDSER

SEQ ID NO: 2158040 - protein, 10 aa, Cryptosporidium hominis
QQEETEVKDL

SEQ ID NO: 2158041 - protein, 13 aa, Cryptosporidium hominis
QQEKRRKEQEKME

SEQ ID NO: 2158042 - protein, 6 aa, Cryptosporidium hominis
QQELEE

SEQ ID NO: 2158043 - protein, 29 aa, Cryptosporidium hominis
QQELQKEQLEQQQQLQSQQQQQQQKLQKQ

SEQ ID NO: 2158044 - protein, 5 aa, Cryptosporidium hominis
QQERI

SEQ ID NO: 2158045 - protein, 7 aa, Cryptosporidium hominis
QQESSDH

SEQ ID NO: 2158046 - protein, 4 aa, Cryptosporidium hominis
QQGI

SEQ ID NO: 2158047 - protein, 5 aa, Cryptosporidium hominis
QQGNR

SEQ ID NO: 2158048 - protein, 9 aa, Cryptosporidium hominis
QQGNSLSKV

SEQ ID NO: 2158049 - protein, 12 aa, Cryptosporidium hominis
QQGSNPMSHYYY

SEQ ID NO: 2158050 - protein, 9 aa, Cryptosporidium hominis
QQGSQPHKG

SEQ ID NO: 2158051 - protein, 19 aa, Cryptosporidium hominis
QQGVSQSINTVQPASTGLF

SEQ ID NO: 2158052 - protein, 5 aa, Cryptosporidium hominis
QQGYL

SEQ ID NO: 2158053 - protein, 11 aa, Cryptosporidium hominis
QQHQHSTHQQN

SEQ ID NO: 2158054 - protein, 12 aa, Cryptosporidium hominis
QQIESKNRNFEE

SEQ ID NO: 2158055 - protein, 30 aa, Cryptosporidium hominis
QQIKTSGMTTASTSTTYSSTDTFDSENNHI

SEQ ID NO: 2158056 - protein, 22 aa, Cryptosporidium hominis
QQISKTNKNKKSIGGKNKEKMN

SEQ ID NO: 2158057 - protein, 13 aa, Cryptosporidium hominis
QQKEKKRTKDERD

SEQ ID NO: 2158058 - protein, 6 aa, Cryptosporidium hominis
QQKGER

SEQ ID NO: 2158059 - protein, 8 aa, Cryptosporidium hominis
QQKHGKRE

SEQ ID NO: 2158060 - protein, 30 aa, Cryptosporidium hominis
QQKKGNKKNKKNNISGNDNKISDSNIGADS

SEQ ID NO: 2158061 - protein, 8 aa, Cryptosporidium hominis
QQKNLREK

SEQ ID NO: 2158062 - protein, 9 aa, Cryptosporidium hominis
QQKNSFKQK

SEQ ID NO: 2158063 - protein, 8 aa, Cryptosporidium hominis
QQKPKNEY

SEQ ID NO: 2158064 - protein, 37 aa, Cryptosporidium hominis
QQKREGKQIKSRFGEKPPDFDESARKGSSSSASGGFT

SEQ ID NO: 2158065 - protein, 9 aa, Cryptosporidium hominis
QQKSASERW

SEQ ID NO: 2158066 - protein, 12 aa, Cryptosporidium hominis
QQKVSPSNFFLL

SEQ ID NO: 2158067 - protein, 17 aa, Cryptosporidium hominis
QQLEETKKALEVSQNKY

SEQ ID NO: 2158068 - protein, 5 aa, Cryptosporidium hominis
QQLEQ

SEQ ID NO: 2158069 - protein, 10 aa, Cryptosporidium hominis
QQLNRNPIGG

SEQ ID NO: 2158070 - protein, 11 aa, Cryptosporidium hominis
QQLRNANNNVQ

SEQ ID NO: 2158071 - protein, 5 aa, Cryptosporidium hominis
QQNEA

SEQ ID NO: 2158072 - protein, 19 aa, Cryptosporidium hominis
QQNGSFTNDNEQLTEDKKI

SEQ ID NO: 2158073 - protein, 14 aa, Cryptosporidium hominis
QQNGTDSHSNQRGY

SEQ ID NO: 2158074 - protein, 9 aa, Cryptosporidium hominis
QQNGTGKNI

SEQ ID NO: 2158075 - protein, 12 aa, Cryptosporidium hominis
QQNNNITNYPPP

SEQ ID NO: 2158076 - protein, 6 aa, Cryptosporidium hominis
QQNPIS

SEQ ID NO: 2158077 - protein, 8 aa, Cryptosporidium hominis
QQNPRLND

SEQ ID NO: 2158078 - protein, 12 aa, Cryptosporidium hominis
QQNQQLSSTNGI

SEQ ID NO: 2158079 - protein, 5 aa, Cryptosporidium hominis
QQNQR

SEQ ID NO: 2158080 - protein, 36 aa, Cryptosporidium hominis
QQNQSGGGNGDGSSIINSNSNNSGNNNNSSSLPIKT

SEQ ID NO: 2158081 - protein, 7 aa, Cryptosporidium hominis
QQNRPYT

SEQ ID NO: 2158082 - protein, 22 aa, Cryptosporidium hominis
QQNSFGGSTTGTGGKRKRDSFE

SEQ ID NO: 2158083 - protein, 64 aa, Cryptosporidium hominis
QQNVERRKDGAYIPPHRRQQGLREDPNSNLASFSGNQANSYNSQRNNSSRNNIDGKRNDQTSNL

SEQ ID NO: 2158084 - protein, 9 aa, Cryptosporidium hominis
QQNVRKTTT

SEQ ID NO: 2158085 - protein, 5 aa, Cryptosporidium hominis
QQNYS

SEQ ID NO: 2158086 - protein, 18 aa, Cryptosporidium hominis
QQPNGIDRSEKRKERENI

SEQ ID NO: 2158087 - protein, 8 aa, Cryptosporidium hominis
QQPNSQYR

SEQ ID NO: 2158088 - protein, 4 aa, Cryptosporidium hominis
QQPS

SEQ ID NO: 2158089 - protein, 16 aa, Cryptosporidium hominis
QQPSQVRRNHYLSQNH

SEQ ID NO: 2158090 - protein, 10 aa, Cryptosporidium hominis
QQQENRELER

SEQ ID NO: 2158091 - protein, 7 aa, Cryptosporidium hominis
QQQETDQ

SEQ ID NO: 2158092 - protein, 98 aa, Cryptosporidium hominis
QQQHHQQQNHQQQNHQQQNHQQQNHQQQNHQQQNHQQQNHQQQHHQQQHHQQQHHQQQQHQQQHQQQHHQQQHHQQQHQGQNTTQHPKQVSQRQIPSN

SEQ ID NO: 2158093 - protein, 9 aa, Cryptosporidium hominis
QQQHQQQQQ

SEQ ID NO: 2158094 - protein, 10 aa, Cryptosporidium hominis
QQQKKNNHPL

SEQ ID NO: 2158095 - protein, 9 aa, Cryptosporidium hominis
QQQLQQQQH

SEQ ID NO: 2158096 - protein, 6 aa, Cryptosporidium hominis
QQQQQQ

SEQ ID NO: 2158097 - protein, 27 aa, Cryptosporidium hominis
QQQQQQQQQHQQLQQQQQQQQQQQQQQ

SEQ ID NO: 2158098 - protein, 19 aa, Cryptosporidium hominis
QQQQQQQQQQQQQQQQQQL

SEQ ID NO: 2158099 - protein, 53 aa, Cryptosporidium hominis
QQQQQQQQQQQQQQQQQQQQQQQQQQQQQQQQQQQQQQQQQQQQQQQQQQQQQ

SEQ ID NO: 2158100 - protein, 15 aa, Cryptosporidium hominis
QQQQQSSGAKQGWNT

SEQ ID NO: 2158101 - protein, 15 aa, Cryptosporidium hominis
QQQSQHSRNARSDSL

SEQ ID NO: 2158102 - protein, 9 aa, Cryptosporidium hominis
QQQSSTEKQ

SEQ ID NO: 2158103 - protein, 8 aa, Cryptosporidium hominis
QQQTQKTL

SEQ ID NO: 2158104 - protein, 4 aa, Cryptosporidium hominis
QQQY

SEQ ID NO: 2158105 - protein, 17 aa, Cryptosporidium hominis
QQRKMESGRDNNYSPGL

SEQ ID NO: 2158106 - protein, 4 aa, Cryptosporidium hominis
QQRN

SEQ ID NO: 2158107 - protein, 9 aa, Cryptosporidium hominis
QQRNEIQSN

SEQ ID NO: 2158108 - protein, 13 aa, Cryptosporidium hominis
QQRNGKKSLTTVQ

SEQ ID NO: 2158109 - protein, 4 aa, Cryptosporidium hominis
QQSE

SEQ ID NO: 2158110 - protein, 6 aa, Cryptosporidium hominis
QQSFTT

SEQ ID NO: 2158111 - protein, 9 aa, Cryptosporidium hominis
QQSKKFNTF

SEQ ID NO: 2158112 - protein, 5 aa, Cryptosporidium hominis
QQSNQ

SEQ ID NO: 2158113 - protein, 9 aa, Cryptosporidium hominis
QQSQFGAAN

SEQ ID NO: 2158114 - protein, 10 aa, Cryptosporidium hominis
QQSQQSNSFA

SEQ ID NO: 2158115 - protein, 6 aa, Cryptosporidium hominis
QQSSSI

SEQ ID NO: 2158116 - protein, 6 aa, Cryptosporidium hominis
QQTAGR

SEQ ID NO: 2158117 - protein, 8 aa, Cryptosporidium hominis
QQTEGIPF

SEQ ID NO: 2158118 - protein, 4 aa, Cryptosporidium hominis
QQTQ

SEQ ID NO: 2158119 - protein, 50 aa, Cryptosporidium hominis
QQTQSSSSSTTTTIATSSSSSPSSSSSSSSSSSSSSSSSSSSSATTSDHD

SEQ ID NO: 2158120 - protein, 10 aa, Cryptosporidium hominis
QQTRITKSEI

SEQ ID NO: 2158121 - protein, 7 aa, Cryptosporidium hominis
QQTSTTR

SEQ ID NO: 2158122 - protein, 4 aa, Cryptosporidium hominis
QQVE

SEQ ID NO: 2158123 - protein, 12 aa, Cryptosporidium hominis
QQVSGDKGGSLT

SEQ ID NO: 2158124 - protein, 4 aa, Cryptosporidium hominis
QQVT

SEQ ID NO: 2158125 - protein, 8 aa, Cryptosporidium hominis
QQYEQNER

SEQ ID NO: 2158126 - protein, 8 aa, Cryptosporidium hominis
QQYGASDQ

SEQ ID NO: 2158127 - protein, 15 aa, Cryptosporidium hominis
QQYPIDQNPRSNYNE

SEQ ID NO: 2158128 - protein, 9 aa, Cryptosporidium hominis
QQYRNSGVA

SEQ ID NO: 2158129 - protein, 5 aa, Cryptosporidium hominis
QRAAQ

SEQ ID NO: 2158130 - protein, 4 aa, Cryptosporidium hominis
QRAG

SEQ ID NO: 2158131 - protein, 6 aa, Cryptosporidium hominis
QRAKEE

SEQ ID NO: 2158132 - protein, 21 aa, Cryptosporidium hominis
QRAQKRQDRTAPKTGKSIIEQ

SEQ ID NO: 2158133 - protein, 8 aa, Cryptosporidium hominis
QRAQQESV

SEQ ID NO: 2158134 - protein, 4 aa, Cryptosporidium hominis
QRAR

SEQ ID NO: 2158135 - protein, 4 aa, Cryptosporidium hominis
QRAS

SEQ ID NO: 2158136 - protein, 9 aa, Cryptosporidium hominis
QRCNAGNEH

SEQ ID NO: 2158137 - protein, 7 aa, Cryptosporidium hominis
QRDIRKK

SEQ ID NO: 2158138 - protein, 4 aa, Cryptosporidium hominis
QRDK

SEQ ID NO: 2158139 - protein, 7 aa, Cryptosporidium hominis
QRDPKEE

SEQ ID NO: 2158140 - protein, 4 aa, Cryptosporidium hominis
QRDY

SEQ ID NO: 2158141 - protein, 7 aa, Cryptosporidium hominis
QREATQN

SEQ ID NO: 2158142 - protein, 11 aa, Cryptosporidium hominis
QRELSNTEDQI

SEQ ID NO: 2158143 - protein, 6 aa, Cryptosporidium hominis
QRENNR

SEQ ID NO: 2158144 - protein, 14 aa, Cryptosporidium hominis
QREPSTRRKGAGLG

SEQ ID NO: 2158145 - protein, 21 aa, Cryptosporidium hominis
QRESEASTKTIDPHPEAQGSV

SEQ ID NO: 2158146 - protein, 10 aa, Cryptosporidium hominis
QRFRNSSNIS

SEQ ID NO: 2158147 - protein, 7 aa, Cryptosporidium hominis
QRGDRQS

SEQ ID NO: 2158148 - protein, 35 aa, Cryptosporidium hominis
QRGPDGKRITNETPKVDGSSLLTSGGEGNGGLQAS

SEQ ID NO: 2158149 - protein, 36 aa, Cryptosporidium hominis
QRGYPKSVTSTGSRYGAGNTTGTNFSASSQFRSEPY

SEQ ID NO: 2158150 - protein, 8 aa, Cryptosporidium hominis
QRHKQSKE

SEQ ID NO: 2158151 - protein, 4 aa, Cryptosporidium hominis
QRIE

SEQ ID NO: 2158152 - protein, 7 aa, Cryptosporidium hominis
QRIQQSS

SEQ ID NO: 2158153 - protein, 5 aa, Cryptosporidium hominis
QRKGY

SEQ ID NO: 2158154 - protein, 4 aa, Cryptosporidium hominis
QRKI

SEQ ID NO: 2158155 - protein, 8 aa, Cryptosporidium hominis
QRKLAERN

SEQ ID NO: 2158156 - protein, 15 aa, Cryptosporidium hominis
QRKLPKGGIGNFEDS

SEQ ID NO: 2158157 - protein, 5 aa, Cryptosporidium hominis
QRKNF

SEQ ID NO: 2158158 - protein, 16 aa, Cryptosporidium hominis
QRKSTSKLPGNNSTHA

SEQ ID NO: 2158159 - protein, 24 aa, Cryptosporidium hominis
QRKTDKQEIKKTKRVRDKKKNQIK

SEQ ID NO: 2158160 - protein, 11 aa, Cryptosporidium hominis
QRLTEQKRNIE

SEQ ID NO: 2158161 - protein, 6 aa, Cryptosporidium hominis
QRNCSE

SEQ ID NO: 2158162 - protein, 17 aa, Cryptosporidium hominis
QRNGFDAKNCKQEIRQQ

SEQ ID NO: 2158163 - protein, 7 aa, Cryptosporidium hominis
QRNGTIG

SEQ ID NO: 2158164 - protein, 4 aa, Cryptosporidium hominis
QRPE

SEQ ID NO: 2158165 - protein, 5 aa, Cryptosporidium hominis
QRPFV

SEQ ID NO: 2158166 - protein, 14 aa, Cryptosporidium hominis
QRPSDDSTRTGNIA

SEQ ID NO: 2158167 - protein, 37 aa, Cryptosporidium hominis
QRQDERGFSHSRRSQKLRSVSSSGDRIENRGRAHERS

SEQ ID NO: 2158168 - protein, 6 aa, Cryptosporidium hominis
QRQKAE

SEQ ID NO: 2158169 - protein, 80 aa, Cryptosporidium hominis
QRQNGNSIPNRRSLGSVSSTAGNNPANSRSKKSINEMNASNSGIPRRSSSVTTAQRNNQSNSDVERHKVPEDYASRPSFT

SEQ ID NO: 2158170 - protein, 10 aa, Cryptosporidium hominis
QRRASVQDSP

SEQ ID NO: 2158171 - protein, 10 aa, Cryptosporidium hominis
QRREQSSKDY

SEQ ID NO: 2158172 - protein, 8 aa, Cryptosporidium hominis
QRRKHRTV

SEQ ID NO: 2158173 - protein, 6 aa, Cryptosporidium hominis
QRSDAS

SEQ ID NO: 2158174 - protein, 10 aa, Cryptosporidium hominis
QRSESGSSIN

SEQ ID NO: 2158175 - protein, 8 aa, Cryptosporidium hominis
QRSKKNWK

SEQ ID NO: 2158176 - protein, 5 aa, Cryptosporidium hominis
QRSLG

SEQ ID NO: 2158177 - protein, 21 aa, Cryptosporidium hominis
QRSPTNGAQKSSIGKEKDKIH

SEQ ID NO: 2158178 - protein, 9 aa, Cryptosporidium hominis
QRSRTIRTE

SEQ ID NO: 2158179 - protein, 8 aa, Cryptosporidium hominis
QRSSSEGY

SEQ ID NO: 2158180 - protein, 9 aa, Cryptosporidium hominis
QRSTLGRSA

SEQ ID NO: 2158181 - protein, 12 aa, Cryptosporidium hominis
QRSTSTSITRNN

SEQ ID NO: 2158182 - protein, 4 aa, Cryptosporidium hominis
QRTA

SEQ ID NO: 2158183 - protein, 7 aa, Cryptosporidium hominis
QRTGTQW

SEQ ID NO: 2158184 - protein, 7 aa, Cryptosporidium hominis
QRTNNMG

SEQ ID NO: 2158185 - protein, 7 aa, Cryptosporidium hominis
QRTRCSE

SEQ ID NO: 2158186 - protein, 4 aa, Cryptosporidium hominis
QRVS

SEQ ID NO: 2158187 - protein, 6 aa, Cryptosporidium hominis
QRWSRR

SEQ ID NO: 2158188 - protein, 4 aa, Cryptosporidium hominis
QRYS

SEQ ID NO: 2158189 - protein, 7 aa, Cryptosporidium hominis
QSAETAS

SEQ ID NO: 2158190 - protein, 14 aa, Cryptosporidium hominis
QSAQLDEKKTASDI

SEQ ID NO: 2158191 - protein, 7 aa, Cryptosporidium hominis
QSATRPI

SEQ ID NO: 2158192 - protein, 5 aa, Cryptosporidium hominis
QSAYR

SEQ ID NO: 2158193 - protein, 4 aa, Cryptosporidium hominis
QSCN

SEQ ID NO: 2158194 - protein, 7 aa, Cryptosporidium hominis
QSCQNKK

SEQ ID NO: 2158195 - protein, 26 aa, Cryptosporidium hominis
QSCSSSSSSSSSSQSLSSSFHPTSSS

SEQ ID NO: 2158196 - protein, 6 aa, Cryptosporidium hominis
QSCTDE

SEQ ID NO: 2158197 - protein, 10 aa, Cryptosporidium hominis
QSDAAAPSTS

SEQ ID NO: 2158198 - protein, 5 aa, Cryptosporidium hominis
QSDEN

SEQ ID NO: 2158199 - protein, 28 aa, Cryptosporidium hominis
QSDKDDDEDRANEDRKNMNSKEIGEQSQ

SEQ ID NO: 2158200 - protein, 8 aa, Cryptosporidium hominis
QSDKDLSA

SEQ ID NO: 2158201 - protein, 7 aa, Cryptosporidium hominis
QSDPEKG

SEQ ID NO: 2158202 - protein, 10 aa, Cryptosporidium hominis
QSDPSGNFSG

SEQ ID NO: 2158203 - protein, 12 aa, Cryptosporidium hominis
QSDRKRSLYDST

SEQ ID NO: 2158204 - protein, 9 aa, Cryptosporidium hominis
QSDSEERKM

SEQ ID NO: 2158205 - protein, 33 aa, Cryptosporidium hominis
QSDTGSPSLKSQIQNSGNCPNSNGKGKQPESCQ

SEQ ID NO: 2158206 - protein, 12 aa, Cryptosporidium hominis
QSDTKNESKSIG

SEQ ID NO: 2158207 - protein, 17 aa, Cryptosporidium hominis
QSDYSENDDYKNNDELT

SEQ ID NO: 2158208 - protein, 31 aa, Cryptosporidium hominis
QSEDGKCKPTKRRKTSKSKISNDNNDNENKI

SEQ ID NO: 2158209 - protein, 9 aa, Cryptosporidium hominis
QSEDGTKTR

SEQ ID NO: 2158210 - protein, 8 aa, Cryptosporidium hominis
QSEDRNQI

SEQ ID NO: 2158211 - protein, 9 aa, Cryptosporidium hominis
QSEESDKRL

SEQ ID NO: 2158212 - protein, 12 aa, Cryptosporidium hominis
QSEESSFDEKQG

SEQ ID NO: 2158213 - protein, 4 aa, Cryptosporidium hominis
QSEI

SEQ ID NO: 2158214 - protein, 19 aa, Cryptosporidium hominis
QSEKGKAPKDLIFLRKPLR

SEQ ID NO: 2158215 - protein, 10 aa, Cryptosporidium hominis
QSEKPEKGSA

SEQ ID NO: 2158216 - protein, 5 aa, Cryptosporidium hominis
QSELD

SEQ ID NO: 2158217 - protein, 6 aa, Cryptosporidium hominis
QSELQS

SEQ ID NO: 2158218 - protein, 8 aa, Cryptosporidium hominis
QSENSKGL

SEQ ID NO: 2158219 - protein, 15 aa, Cryptosporidium hominis
QSENTNYMTNTSSGM

SEQ ID NO: 2158220 - protein, 23 aa, Cryptosporidium hominis
QSEPTGVTNLPSYSASNDRKKEI

SEQ ID NO: 2158221 - protein, 5 aa, Cryptosporidium hominis
QSEQL

SEQ ID NO: 2158222 - protein, 7 aa, Cryptosporidium hominis
QSERSQL

SEQ ID NO: 2158223 - protein, 8 aa, Cryptosporidium hominis
QSESSGRV

SEQ ID NO: 2158224 - protein, 4 aa, Cryptosporidium hominis
QSFP

SEQ ID NO: 2158225 - protein, 7 aa, Cryptosporidium hominis
QSFQEDQ

SEQ ID NO: 2158226 - protein, 11 aa, Cryptosporidium hominis
QSFSGGKEDDI

SEQ ID NO: 2158227 - protein, 15 aa, Cryptosporidium hominis
QSGEENGRFNYKKCS

SEQ ID NO: 2158228 - protein, 7 aa, Cryptosporidium hominis
QSGETIS

SEQ ID NO: 2158229 - protein, 11 aa, Cryptosporidium hominis
QSGGTNPMSVP

SEQ ID NO: 2158230 - protein, 6 aa, Cryptosporidium hominis
QSGHPG

SEQ ID NO: 2158231 - protein, 7 aa, Cryptosporidium hominis
QSGISGV

SEQ ID NO: 2158232 - protein, 6 aa, Cryptosporidium hominis
QSGKGR

SEQ ID NO: 2158233 - protein, 10 aa, Cryptosporidium hominis
QSGVRGGAEQ

SEQ ID NO: 2158234 - protein, 8 aa, Cryptosporidium hominis
QSHDSSVS

SEQ ID NO: 2158235 - protein, 9 aa, Cryptosporidium hominis
QSHESTASN

SEQ ID NO: 2158236 - protein, 24 aa, Cryptosporidium hominis
QSHNPELEANTDQQSQISPPSSPT

SEQ ID NO: 2158237 - protein, 8 aa, Cryptosporidium hominis
QSHSNISS

SEQ ID NO: 2158238 - protein, 13 aa, Cryptosporidium hominis
QSHSNNTNFPPNL

SEQ ID NO: 2158239 - protein, 9 aa, Cryptosporidium hominis
QSHTCSNEN

SEQ ID NO: 2158240 - protein, 16 aa, Cryptosporidium hominis
QSHYPTHSGASHAFPS

SEQ ID NO: 2158241 - protein, 13 aa, Cryptosporidium hominis
QSIDGQNVNSVEK

SEQ ID NO: 2158242 - protein, 19 aa, Cryptosporidium hominis
QSIEDDNCSESSIISFLSE

SEQ ID NO: 2158243 - protein, 9 aa, Cryptosporidium hominis
QSIGEPATQ

SEQ ID NO: 2158244 - protein, 9 aa, Cryptosporidium hominis
QSIGEPGTQ

SEQ ID NO: 2158245 - protein, 8 aa, Cryptosporidium hominis
QSIGMGKS

SEQ ID NO: 2158246 - protein, 5 aa, Cryptosporidium hominis
QSIPK

SEQ ID NO: 2158247 - protein, 20 aa, Cryptosporidium hominis
QSIPTESKITDEKLQKTSSY

SEQ ID NO: 2158248 - protein, 8 aa, Cryptosporidium hominis
QSIQAKTL

SEQ ID NO: 2158249 - protein, 19 aa, Cryptosporidium hominis
QSIQNKVKSENIHRSSSEV

SEQ ID NO: 2158250 - protein, 5 aa, Cryptosporidium hominis
QSISG

SEQ ID NO: 2158251 - protein, 22 aa, Cryptosporidium hominis
QSITPNKPVPGENSISVSPQTG

SEQ ID NO: 2158252 - protein, 8 aa, Cryptosporidium hominis
QSITPTGR

SEQ ID NO: 2158253 - protein, 13 aa, Cryptosporidium hominis
QSKGINRKPMKAE

SEQ ID NO: 2158254 - protein, 34 aa, Cryptosporidium hominis
QSKGTQESLSNSNTNISNQNRVNNSTNSQNLNNG

SEQ ID NO: 2158255 - protein, 8 aa, Cryptosporidium hominis
QSKIPTNY

SEQ ID NO: 2158256 - protein, 6 aa, Cryptosporidium hominis
QSKISF

SEQ ID NO: 2158257 - protein, 9 aa, Cryptosporidium hominis
QSKKELNSI

SEQ ID NO: 2158258 - protein, 58 aa, Cryptosporidium hominis
QSKKNNKSEDFDELSRKGGEDRDDGGEDEFDENDDDNDQDEDSSKSSKSKSKASNDLG

SEQ ID NO: 2158259 - protein, 7 aa, Cryptosporidium hominis
QSKLPAT

SEQ ID NO: 2158260 - protein, 20 aa, Cryptosporidium hominis
QSKRTSGKNSPRASSGYGNK

SEQ ID NO: 2158261 - protein, 24 aa, Cryptosporidium hominis
QSKSGNGSSKKNKNLVQVISSKDN

SEQ ID NO: 2158262 - protein, 10 aa, Cryptosporidium hominis
QSKSIEYNDA

SEQ ID NO: 2158263 - protein, 5 aa, Cryptosporidium hominis
QSKTY

SEQ ID NO: 2158264 - protein, 6 aa, Cryptosporidium hominis
QSLDNI

SEQ ID NO: 2158265 - protein, 7 aa, Cryptosporidium hominis
QSLKNPE

SEQ ID NO: 2158266 - protein, 10 aa, Cryptosporidium hominis
QSLKSPNIQG

SEQ ID NO: 2158267 - protein, 4 aa, Cryptosporidium hominis
QSLS

SEQ ID NO: 2158268 - protein, 75 aa, Cryptosporidium hominis
QSLSQQSLSITTNTNTTSTGVSGGSNSSIIGSTNNNYPNQPTITTAATTATATTAVTTTTTTTTSSSSSSSNMKR

SEQ ID NO: 2158269 - protein, 8 aa, Cryptosporidium hominis
QSLSSTEE

SEQ ID NO: 2158270 - protein, 8 aa, Cryptosporidium hominis
QSMSPNVD

SEQ ID NO: 2158271 - protein, 8 aa, Cryptosporidium hominis
QSNDNFNA

SEQ ID NO: 2158272 - protein, 6 aa, Cryptosporidium hominis
QSNEEV

SEQ ID NO: 2158273 - protein, 9 aa, Cryptosporidium hominis
QSNERGEIS

SEQ ID NO: 2158274 - protein, 5 aa, Cryptosporidium hominis
QSNFS

SEQ ID NO: 2158275 - protein, 4 aa, Cryptosporidium hominis
QSNH

SEQ ID NO: 2158276 - protein, 8 aa, Cryptosporidium hominis
QSNHSSNA

SEQ ID NO: 2158277 - protein, 9 aa, Cryptosporidium hominis
QSNIQSNGT

SEQ ID NO: 2158278 - protein, 14 aa, Cryptosporidium hominis
QSNKQSNRSEKKEQ

SEQ ID NO: 2158279 - protein, 12 aa, Cryptosporidium hominis
QSNKYGDDGYCS

SEQ ID NO: 2158280 - protein, 14 aa, Cryptosporidium hominis
QSNLNNSSNDFNSK

SEQ ID NO: 2158281 - protein, 11 aa, Cryptosporidium hominis
QSNLQESHSRN

SEQ ID NO: 2158282 - protein, 6 aa, Cryptosporidium hominis
QSNNDY

SEQ ID NO: 2158283 - protein, 5 aa, Cryptosporidium hominis
QSNPE

SEQ ID NO: 2158284 - protein, 7 aa, Cryptosporidium hominis
QSNRGNS

SEQ ID NO: 2158285 - protein, 7 aa, Cryptosporidium hominis
QSNSFQD

SEQ ID NO: 2158286 - protein, 10 aa, Cryptosporidium hominis
QSNSPQSEAV

SEQ ID NO: 2158287 - protein, 5 aa, Cryptosporidium hominis
QSNSV

SEQ ID NO: 2158288 - protein, 4 aa, Cryptosporidium hominis
QSNT

SEQ ID NO: 2158289 - protein, 7 aa, Cryptosporidium hominis
QSNVSND

SEQ ID NO: 2158290 - protein, 6 aa, Cryptosporidium hominis
QSPKEN

SEQ ID NO: 2158291 - protein, 6 aa, Cryptosporidium hominis
QSPPGV

SEQ ID NO: 2158292 - protein, 5 aa, Cryptosporidium hominis
QSPQL

SEQ ID NO: 2158293 - protein, 7 aa, Cryptosporidium hominis
QSPSISA

SEQ ID NO: 2158294 - protein, 6 aa, Cryptosporidium hominis
QSPSTV

SEQ ID NO: 2158295 - protein, 7 aa, Cryptosporidium hominis
QSPTGIG

SEQ ID NO: 2158296 - protein, 9 aa, Cryptosporidium hominis
QSPTGNEST

SEQ ID NO: 2158297 - protein, 8 aa, Cryptosporidium hominis
QSPTGSGK

SEQ ID NO: 2158298 - protein, 17 aa, Cryptosporidium hominis
QSPVDEEKKQAENSEKK

SEQ ID NO: 2158299 - protein, 19 aa, Cryptosporidium hominis
QSQDQYKRKINSPIKNIHK

SEQ ID NO: 2158300 - protein, 10 aa, Cryptosporidium hominis
QSQDSSNSQV

SEQ ID NO: 2158301 - protein, 4 aa, Cryptosporidium hominis
QSQE

SEQ ID NO: 2158302 - protein, 7 aa, Cryptosporidium hominis
QSQEPHT

SEQ ID NO: 2158303 - protein, 7 aa, Cryptosporidium hominis
QSQHDNL

SEQ ID NO: 2158304 - protein, 25 aa, Cryptosporidium hominis
QSQIQSQQQQQQQTSPFSGGNIQTN

SEQ ID NO: 2158305 - protein, 5 aa, Cryptosporidium hominis
QSQLN

SEQ ID NO: 2158306 - protein, 16 aa, Cryptosporidium hominis
QSQNDSAKLKQAKEEV

SEQ ID NO: 2158307 - protein, 6 aa, Cryptosporidium hominis
QSQNEL

SEQ ID NO: 2158308 - protein, 6 aa, Cryptosporidium hominis
QSQNPI

SEQ ID NO: 2158309 - protein, 19 aa, Cryptosporidium hominis
QSQNQGFNKNDFTQPKLSG

SEQ ID NO: 2158310 - protein, 11 aa, Cryptosporidium hominis
QSQNSEKQQAI

SEQ ID NO: 2158311 - protein, 33 aa, Cryptosporidium hominis
QSQPPSQASQPHHPSSPPPPPPPPPPPPPPPPV

SEQ ID NO: 2158312 - protein, 8 aa, Cryptosporidium hominis
QSQQQAQH

SEQ ID NO: 2158313 - protein, 5 aa, Cryptosporidium hominis
QSQRN

SEQ ID NO: 2158314 - protein, 9 aa, Cryptosporidium hominis
QSQSGTGKT

SEQ ID NO: 2158315 - protein, 22 aa, Cryptosporidium hominis
QSQSKRRKRERERQTKSESINT

SEQ ID NO: 2158316 - protein, 30 aa, Cryptosporidium hominis
QSQSQFQSQSQFQSQSQSQIYNQSQTNMSD

SEQ ID NO: 2158317 - protein, 5 aa, Cryptosporidium hominis
QSQTE

SEQ ID NO: 2158318 - protein, 11 aa, Cryptosporidium hominis
QSQVSTEQNSE

SEQ ID NO: 2158319 - protein, 6 aa, Cryptosporidium hominis
QSQYPI

SEQ ID NO: 2158320 - protein, 11 aa, Cryptosporidium hominis
QSQYRPDEQID

SEQ ID NO: 2158321 - protein, 15 aa, Cryptosporidium hominis
QSQYTSGIGSNSQIY

SEQ ID NO: 2158322 - protein, 11 aa, Cryptosporidium hominis
QSRCKSSENNL

SEQ ID NO: 2158323 - protein, 10 aa, Cryptosporidium hominis
QSRDISSRPK

SEQ ID NO: 2158324 - protein, 26 aa, Cryptosporidium hominis
QSRNGKNMSVQNNRQEKSKSLSQKKN

SEQ ID NO: 2158325 - protein, 6 aa, Cryptosporidium hominis
QSRNIK

SEQ ID NO: 2158326 - protein, 12 aa, Cryptosporidium hominis
QSRNKPDTSKMV

SEQ ID NO: 2158327 - protein, 7 aa, Cryptosporidium hominis
QSRSKPK

SEQ ID NO: 2158328 - protein, 14 aa, Cryptosporidium hominis
QSSDLTQRRIEGSE

SEQ ID NO: 2158329 - protein, 30 aa, Cryptosporidium hominis
QSSDNHTSQDSNQCDLNPESSSKNNEGQAV

SEQ ID NO: 2158330 - protein, 6 aa, Cryptosporidium hominis
QSSEPY

SEQ ID NO: 2158331 - protein, 8 aa, Cryptosporidium hominis
QSSFPPHY

SEQ ID NO: 2158332 - protein, 10 aa, Cryptosporidium hominis
QSSGGLSGAE

SEQ ID NO: 2158333 - protein, 10 aa, Cryptosporidium hominis
QSSGKCENTK

SEQ ID NO: 2158334 - protein, 6 aa, Cryptosporidium hominis
QSSIEG

SEQ ID NO: 2158335 - protein, 4 aa, Cryptosporidium hominis
QSSK

SEQ ID NO: 2158336 - protein, 13 aa, Cryptosporidium hominis
QSSKDDQKKRDEL

SEQ ID NO: 2158337 - protein, 27 aa, Cryptosporidium hominis
QSSKSSESSFSRHSNSTIVSNSPSLYD

SEQ ID NO: 2158338 - protein, 6 aa, Cryptosporidium hominis
QSSMGG

SEQ ID NO: 2158339 - protein, 7 aa, Cryptosporidium hominis
QSSNKQE

SEQ ID NO: 2158340 - protein, 8 aa, Cryptosporidium hominis
QSSNSEEI

SEQ ID NO: 2158341 - protein, 7 aa, Cryptosporidium hominis
QSSPESN

SEQ ID NO: 2158342 - protein, 7 aa, Cryptosporidium hominis
QSSPQAY

SEQ ID NO: 2158343 - protein, 8 aa, Cryptosporidium hominis
QSSQDGSL

SEQ ID NO: 2158344 - protein, 6 aa, Cryptosporidium hominis
QSSQNT

SEQ ID NO: 2158345 - protein, 9 aa, Cryptosporidium hominis
QSSSAFTRE

SEQ ID NO: 2158346 - protein, 5 aa, Cryptosporidium hominis
QSSSC

SEQ ID NO: 2158347 - protein, 9 aa, Cryptosporidium hominis
QSSSEEEIL

SEQ ID NO: 2158348 - protein, 6 aa, Cryptosporidium hominis
QSSSGM

SEQ ID NO: 2158349 - protein, 9 aa, Cryptosporidium hominis
QSSSSGRKE

SEQ ID NO: 2158350 - protein, 30 aa, Cryptosporidium hominis
QSSSYRDSKDGKNNKKNSKINSSGLTNEDL

SEQ ID NO: 2158351 - protein, 6 aa, Cryptosporidium hominis
QSSTLE

SEQ ID NO: 2158352 - protein, 5 aa, Cryptosporidium hominis
QSSTT

SEQ ID NO: 2158353 - protein, 4 aa, Cryptosporidium hominis
QSSV

SEQ ID NO: 2158354 - protein, 10 aa, Cryptosporidium hominis
QSTHNPASCA

SEQ ID NO: 2158355 - protein, 4 aa, Cryptosporidium hominis
QSTK

SEQ ID NO: 2158356 - protein, 7 aa, Cryptosporidium hominis
QSTLKSQ

SEQ ID NO: 2158357 - protein, 4 aa, Cryptosporidium hominis
QSTQ

SEQ ID NO: 2158358 - protein, 5 aa, Cryptosporidium hominis
QSTRD

SEQ ID NO: 2158359 - protein, 6 aa, Cryptosporidium hominis
QSTSDN

SEQ ID NO: 2158360 - protein, 8 aa, Cryptosporidium hominis
QSTVERPN

SEQ ID NO: 2158361 - protein, 6 aa, Cryptosporidium hominis
QSTYGN

SEQ ID NO: 2158362 - protein, 4 aa, Cryptosporidium hominis
QSVF

SEQ ID NO: 2158363 - protein, 72 aa, Cryptosporidium hominis
QSVQNTAKIANNDSGVAKNSGKKSHDSGFETNKSQKEQNHSSKVQCNDEHNKEVNKHATGPKEDDDNKNQSV

SEQ ID NO: 2158364 - protein, 7 aa, Cryptosporidium hominis
QSWDQPN

SEQ ID NO: 2158365 - protein, 16 aa, Cryptosporidium hominis
QSWNNTESNIRDTNSI

SEQ ID NO: 2158366 - protein, 6 aa, Cryptosporidium hominis
QSYEPE

SEQ ID NO: 2158367 - protein, 7 aa, Cryptosporidium hominis
QSYNATN

SEQ ID NO: 2158368 - protein, 8 aa, Cryptosporidium hominis
QSYPQPHQ

SEQ ID NO: 2158369 - protein, 18 aa, Cryptosporidium hominis
QSYRANKQNMKKNQYMVG

SEQ ID NO: 2158370 - protein, 13 aa, Cryptosporidium hominis
QSYSTENEELQQT

SEQ ID NO: 2158371 - protein, 8 aa, Cryptosporidium hominis
QTAEETIK

SEQ ID NO: 2158372 - protein, 6 aa, Cryptosporidium hominis
QTASGA

SEQ ID NO: 2158373 - protein, 7 aa, Cryptosporidium hominis
QTCEEDD

SEQ ID NO: 2158374 - protein, 11 aa, Cryptosporidium hominis
QTCPSNSDATG

SEQ ID NO: 2158375 - protein, 14 aa, Cryptosporidium hominis
QTCSSSLPKSLNSP

SEQ ID NO: 2158376 - protein, 8 aa, Cryptosporidium hominis
QTDEDESF

SEQ ID NO: 2158377 - protein, 6 aa, Cryptosporidium hominis
QTDEQS

SEQ ID NO: 2158378 - protein, 10 aa, Cryptosporidium hominis
QTDGGHQSDL

SEQ ID NO: 2158379 - protein, 4 aa, Cryptosporidium hominis
QTDI

SEQ ID NO: 2158380 - protein, 5 aa, Cryptosporidium hominis
QTDKA

SEQ ID NO: 2158381 - protein, 5 aa, Cryptosporidium hominis
QTDPI

SEQ ID NO: 2158382 - protein, 4 aa, Cryptosporidium hominis
QTDS

SEQ ID NO: 2158383 - protein, 6 aa, Cryptosporidium hominis
QTDSGQ

SEQ ID NO: 2158384 - protein, 15 aa, Cryptosporidium hominis
QTDSSGEISNTKEYD

SEQ ID NO: 2158385 - protein, 9 aa, Cryptosporidium hominis
QTEASNDKF

SEQ ID NO: 2158386 - protein, 7 aa, Cryptosporidium hominis
QTEEEQE

SEQ ID NO: 2158387 - protein, 5 aa, Cryptosporidium hominis
QTEGL

SEQ ID NO: 2158388 - protein, 7 aa, Cryptosporidium hominis
QTEIQSK

SEQ ID NO: 2158389 - protein, 5 aa, Cryptosporidium hominis
QTENL

SEQ ID NO: 2158390 - protein, 6 aa, Cryptosporidium hominis
QTENNK

SEQ ID NO: 2158391 - protein, 5 aa, Cryptosporidium hominis
QTEYK

SEQ ID NO: 2158392 - protein, 8 aa, Cryptosporidium hominis
QTGEEEQS

SEQ ID NO: 2158393 - protein, 21 aa, Cryptosporidium hominis
QTGEKNDDKEEKTSENETIKE

SEQ ID NO: 2158394 - protein, 5 aa, Cryptosporidium hominis
QTGKD

SEQ ID NO: 2158395 - protein, 7 aa, Cryptosporidium hominis
QTGNEAK

SEQ ID NO: 2158396 - protein, 7 aa, Cryptosporidium hominis
QTGPNNL

SEQ ID NO: 2158397 - protein, 6 aa, Cryptosporidium hominis
QTGQPL

SEQ ID NO: 2158398 - protein, 8 aa, Cryptosporidium hominis
QTGRAASL

SEQ ID NO: 2158399 - protein, 8 aa, Cryptosporidium hominis
QTGSGKTA

SEQ ID NO: 2158400 - protein, 24 aa, Cryptosporidium hominis
QTGTDEHGQKIAATAEKKGISPKE

SEQ ID NO: 2158401 - protein, 11 aa, Cryptosporidium hominis
QTGTGKTYTME

SEQ ID NO: 2158402 - protein, 6 aa, Cryptosporidium hominis
QTHSRK

SEQ ID NO: 2158403 - protein, 25 aa, Cryptosporidium hominis
QTHTNTRSSSLSPSNQFAQSNNTQA

SEQ ID NO: 2158404 - protein, 6 aa, Cryptosporidium hominis
QTIETP

SEQ ID NO: 2158405 - protein, 13 aa, Cryptosporidium hominis
QTIGESEPTQQVP

SEQ ID NO: 2158406 - protein, 12 aa, Cryptosporidium hominis
QTKDEESGQVTS

SEQ ID NO: 2158407 - protein, 4 aa, Cryptosporidium hominis
QTKF

SEQ ID NO: 2158408 - protein, 14 aa, Cryptosporidium hominis
QTKQHSSNANSNSQ

SEQ ID NO: 2158409 - protein, 5 aa, Cryptosporidium hominis
QTKRI

SEQ ID NO: 2158410 - protein, 5 aa, Cryptosporidium hominis
QTKRK

SEQ ID NO: 2158411 - protein, 13 aa, Cryptosporidium hominis
QTKSEAEEDKNEV

SEQ ID NO: 2158412 - protein, 51 aa, Cryptosporidium hominis
QTKSQNSKYSLRNKSQISASSTNNSPKKGGRGSGLNHNKANSNSQNRQFTN

SEQ ID NO: 2158413 - protein, 8 aa, Cryptosporidium hominis
QTKSWENS

SEQ ID NO: 2158414 - protein, 4 aa, Cryptosporidium hominis
QTKY

SEQ ID NO: 2158415 - protein, 13 aa, Cryptosporidium hominis
QTKYQQQDQAETV

SEQ ID NO: 2158416 - protein, 26 aa, Cryptosporidium hominis
QTLPQGLTDENDEEMTSASNLGRSGC

SEQ ID NO: 2158417 - protein, 4 aa, Cryptosporidium hominis
QTLS

SEQ ID NO: 2158418 - protein, 9 aa, Cryptosporidium hominis
QTLSTEKSK

SEQ ID NO: 2158419 - protein, 4 aa, Cryptosporidium hominis
QTMS

SEQ ID NO: 2158420 - protein, 4 aa, Cryptosporidium hominis
QTMT

SEQ ID NO: 2158421 - protein, 19 aa, Cryptosporidium hominis
QTNEVKEVEQKQGEIESKR

SEQ ID NO: 2158422 - protein, 4 aa, Cryptosporidium hominis
QTNF

SEQ ID NO: 2158423 - protein, 41 aa, Cryptosporidium hominis
QTNLQTQQQQYQQQQQQQQQQQQQQQQQQQQQQHLAENSTN

SEQ ID NO: 2158424 - protein, 14 aa, Cryptosporidium hominis
QTNNSAISKKRSKI

SEQ ID NO: 2158425 - protein, 6 aa, Cryptosporidium hominis
QTNPNI

SEQ ID NO: 2158426 - protein, 8 aa, Cryptosporidium hominis
QTNQFAND

SEQ ID NO: 2158427 - protein, 7 aa, Cryptosporidium hominis
QTNSDAE

SEQ ID NO: 2158428 - protein, 28 aa, Cryptosporidium hominis
QTNSDKTRQDLEQNKEVVERKDEEIANS

SEQ ID NO: 2158429 - protein, 10 aa, Cryptosporidium hominis
QTNSESNPIS

SEQ ID NO: 2158430 - protein, 8 aa, Cryptosporidium hominis
QTNTPGRY

SEQ ID NO: 2158431 - protein, 5 aa, Cryptosporidium hominis
QTNTQ

SEQ ID NO: 2158432 - protein, 6 aa, Cryptosporidium hominis
QTPDGL

SEQ ID NO: 2158433 - protein, 5 aa, Cryptosporidium hominis
QTPEE

SEQ ID NO: 2158434 - protein, 12 aa, Cryptosporidium hominis
QTPGEGNNGDNK

SEQ ID NO: 2158435 - protein, 13 aa, Cryptosporidium hominis
QTPGRSSNIESAK

SEQ ID NO: 2158436 - protein, 4 aa, Cryptosporidium hominis
QTPI

SEQ ID NO: 2158437 - protein, 13 aa, Cryptosporidium hominis
QTPQQSQANSINN

SEQ ID NO: 2158438 - protein, 18 aa, Cryptosporidium hominis
QTPRKPSPASNNISSQSI

SEQ ID NO: 2158439 - protein, 4 aa, Cryptosporidium hominis
QTPS

SEQ ID NO: 2158440 - protein, 9 aa, Cryptosporidium hominis
QTPSQTTYG

SEQ ID NO: 2158441 - protein, 9 aa, Cryptosporidium hominis
QTPTAIQSK

SEQ ID NO: 2158442 - protein, 10 aa, Cryptosporidium hominis
QTQENSYKKN

SEQ ID NO: 2158443 - protein, 4 aa, Cryptosporidium hominis
QTQF

SEQ ID NO: 2158444 - protein, 7 aa, Cryptosporidium hominis
QTQSGNL

SEQ ID NO: 2158445 - protein, 18 aa, Cryptosporidium hominis
QTQSPCNPCKGTGKTIPV

SEQ ID NO: 2158446 - protein, 8 aa, Cryptosporidium hominis
QTQSPTMS

SEQ ID NO: 2158447 - protein, 32 aa, Cryptosporidium hominis
QTQSTQRTTRSSKQKERKMNSDANSDKSSCPS

SEQ ID NO: 2158448 - protein, 4 aa, Cryptosporidium hominis
QTQT

SEQ ID NO: 2158449 - protein, 19 aa, Cryptosporidium hominis
QTQTKSKKTSRGTISRDGK

SEQ ID NO: 2158450 - protein, 34 aa, Cryptosporidium hominis
QTQTKTQAQIHSQSHSQSHVKAPNQTQTQTQVHS

SEQ ID NO: 2158451 - protein, 16 aa, Cryptosporidium hominis
QTQYEQKTFSSKTDWR

SEQ ID NO: 2158452 - protein, 7 aa, Cryptosporidium hominis
QTRESYD

SEQ ID NO: 2158453 - protein, 4 aa, Cryptosporidium hominis
QTRK

SEQ ID NO: 2158454 - protein, 13 aa, Cryptosporidium hominis
QTRKDQDSAQRSF

SEQ ID NO: 2158455 - protein, 20 aa, Cryptosporidium hominis
QTRNSSKDHSITSVYNNNGR

SEQ ID NO: 2158456 - protein, 6 aa, Cryptosporidium hominis
QTRNVS

SEQ ID NO: 2158457 - protein, 9 aa, Cryptosporidium hominis
QTRRPELGD

SEQ ID NO: 2158458 - protein, 18 aa, Cryptosporidium hominis
QTSAEKAKYYGPCKRSVD

SEQ ID NO: 2158459 - protein, 14 aa, Cryptosporidium hominis
QTSEDNSITGGSIG

SEQ ID NO: 2158460 - protein, 9 aa, Cryptosporidium hominis
QTSEETLQS

SEQ ID NO: 2158461 - protein, 26 aa, Cryptosporidium hominis
QTSETKPELPPSQRPAMAGTEIKGQD

SEQ ID NO: 2158462 - protein, 8 aa, Cryptosporidium hominis
QTSKSGEE

SEQ ID NO: 2158463 - protein, 5 aa, Cryptosporidium hominis
QTSQM

SEQ ID NO: 2158464 - protein, 18 aa, Cryptosporidium hominis
QTSQTNQVTQIGEGTDPS

SEQ ID NO: 2158465 - protein, 9 aa, Cryptosporidium hominis
QTSQYDDKN

SEQ ID NO: 2158466 - protein, 18 aa, Cryptosporidium hominis
QTSRSGKKNSSGSLTGSM

SEQ ID NO: 2158467 - protein, 9 aa, Cryptosporidium hominis
QTSSGKTHT

SEQ ID NO: 2158468 - protein, 7 aa, Cryptosporidium hominis
QTSSSIS

SEQ ID NO: 2158469 - protein, 4 aa, Cryptosporidium hominis
QTST

SEQ ID NO: 2158470 - protein, 7 aa, Cryptosporidium hominis
QTTGLED

SEQ ID NO: 2158471 - protein, 12 aa, Cryptosporidium hominis
QTTKKDTIASRE

SEQ ID NO: 2158472 - protein, 32 aa, Cryptosporidium hominis
QTTPYSSSGAPIKATSLKRTRSSGEATEVPSL

SEQ ID NO: 2158473 - protein, 6 aa, Cryptosporidium hominis
QTTQDG

SEQ ID NO: 2158474 - protein, 5 aa, Cryptosporidium hominis
QTTTE

SEQ ID NO: 2158475 - protein, 9 aa, Cryptosporidium hominis
QTVDPKAQL

SEQ ID NO: 2158476 - protein, 13 aa, Cryptosporidium hominis
QTVDSQRAKIEDE

SEQ ID NO: 2158477 - protein, 6 aa, Cryptosporidium hominis
QTVEPT

SEQ ID NO: 2158478 - protein, 11 aa, Cryptosporidium hominis
QTVKEGQSLQK

SEQ ID NO: 2158479 - protein, 15 aa, Cryptosporidium hominis
QTWEDPNKKGDENVD

SEQ ID NO: 2158480 - protein, 4 aa, Cryptosporidium hominis
QTYE

SEQ ID NO: 2158481 - protein, 7 aa, Cryptosporidium hominis
QTYEGNS

SEQ ID NO: 2158482 - protein, 5 aa, Cryptosporidium hominis
QTYTP

SEQ ID NO: 2158483 - protein, 6 aa, Cryptosporidium hominis
QVAPSN

SEQ ID NO: 2158484 - protein, 24 aa, Cryptosporidium hominis
QVDSQNCEKDNQIRETGNDKTKNI

SEQ ID NO: 2158485 - protein, 11 aa, Cryptosporidium hominis
QVEEDNNEGTN

SEQ ID NO: 2158486 - protein, 19 aa, Cryptosporidium hominis
QVEESKMNSTISNLESDQT

SEQ ID NO: 2158487 - protein, 5 aa, Cryptosporidium hominis
QVEEV

SEQ ID NO: 2158488 - protein, 6 aa, Cryptosporidium hominis
QVEGTI

SEQ ID NO: 2158489 - protein, 10 aa, Cryptosporidium hominis
QVENQKPTNI

SEQ ID NO: 2158490 - protein, 8 aa, Cryptosporidium hominis
QVESSNSE

SEQ ID NO: 2158491 - protein, 5 aa, Cryptosporidium hominis
QVETE

SEQ ID NO: 2158492 - protein, 5 aa, Cryptosporidium hominis
QVFTS

SEQ ID NO: 2158493 - protein, 8 aa, Cryptosporidium hominis
QVGNSGGE

SEQ ID NO: 2158494 - protein, 13 aa, Cryptosporidium hominis
QVINPADQERNRN

SEQ ID NO: 2158495 - protein, 10 aa, Cryptosporidium hominis
QVKDSTSIEE

SEQ ID NO: 2158496 - protein, 5 aa, Cryptosporidium hominis
QVKRI

SEQ ID NO: 2158497 - protein, 11 aa, Cryptosporidium hominis
QVNEKDQNWER

SEQ ID NO: 2158498 - protein, 29 aa, Cryptosporidium hominis
QVNSQNTRGSAQQGPKLAGAQPIRQGGCC

SEQ ID NO: 2158499 - protein, 7 aa, Cryptosporidium hominis
QVQHESD

SEQ ID NO: 2158500 - protein, 5 aa, Cryptosporidium hominis
QVQNG

SEQ ID NO: 2158501 - protein, 8 aa, Cryptosporidium hominis
QVRATGPI

SEQ ID NO: 2158502 - protein, 11 aa, Cryptosporidium hominis
QVSDEKTNEQI

SEQ ID NO: 2158503 - protein, 42 aa, Cryptosporidium hominis
QVSGSPVGQFPSTSRFTNSKYSRELDSTGAVNSGKLQTSNAV

SEQ ID NO: 2158504 - protein, 14 aa, Cryptosporidium hominis
QVSITNSNSTPNAD

SEQ ID NO: 2158505 - protein, 8 aa, Cryptosporidium hominis
QVSKNQSI

SEQ ID NO: 2158506 - protein, 16 aa, Cryptosporidium hominis
QVSKRKKRFQEQPSSK

SEQ ID NO: 2158507 - protein, 33 aa, Cryptosporidium hominis
QVSNNNNNNNNNNNSNSNGSNTNSNNTNGNNSS

SEQ ID NO: 2158508 - protein, 6 aa, Cryptosporidium hominis
QVSRKE

SEQ ID NO: 2158509 - protein, 7 aa, Cryptosporidium hominis
QVSRYDS

SEQ ID NO: 2158510 - protein, 12 aa, Cryptosporidium hominis
QVSSSDQIDEEQ

SEQ ID NO: 2158511 - protein, 5 aa, Cryptosporidium hominis
QVTSS

SEQ ID NO: 2158512 - protein, 6 aa, Cryptosporidium hominis
QVYEGE

SEQ ID NO: 2158513 - protein, 10 aa, Cryptosporidium hominis
QVYNSNPNVT

SEQ ID NO: 2158514 - protein, 4 aa, Cryptosporidium hominis
QVYQ

SEQ ID NO: 2158515 - protein, 8 aa, Cryptosporidium hominis
QVYTAEER

SEQ ID NO: 2158516 - protein, 5 aa, Cryptosporidium hominis
QWGDY

SEQ ID NO: 2158517 - protein, 7 aa, Cryptosporidium hominis
QWREQQQ

SEQ ID NO: 2158518 - protein, 9 aa, Cryptosporidium hominis
QWSPETSKV

SEQ ID NO: 2158519 - protein, 8 aa, Cryptosporidium hominis
QWTEEEKS

SEQ ID NO: 2158520 - protein, 13 aa, Cryptosporidium hominis
QYAEQARKRTNSL

SEQ ID NO: 2158521 - protein, 14 aa, Cryptosporidium hominis
QYAPENSESLPKPQ

SEQ ID NO: 2158522 - protein, 13 aa, Cryptosporidium hominis
QYAPYSRLGTPDD

SEQ ID NO: 2158523 - protein, 7 aa, Cryptosporidium hominis
QYDGIDS

SEQ ID NO: 2158524 - protein, 5 aa, Cryptosporidium hominis
QYDPQ

SEQ ID NO: 2158525 - protein, 16 aa, Cryptosporidium hominis
QYEDTSHKDHSQNNPR

SEQ ID NO: 2158526 - protein, 11 aa, Cryptosporidium hominis
QYENSLTNRPC

SEQ ID NO: 2158527 - protein, 13 aa, Cryptosporidium hominis
QYESKQRKNDKDF

SEQ ID NO: 2158528 - protein, 6 aa, Cryptosporidium hominis
QYGDNI

SEQ ID NO: 2158529 - protein, 5 aa, Cryptosporidium hominis
QYGEY

SEQ ID NO: 2158530 - protein, 6 aa, Cryptosporidium hominis
QYGGSG

SEQ ID NO: 2158531 - protein, 15 aa, Cryptosporidium hominis
QYGQGQNANRNVNNN

SEQ ID NO: 2158532 - protein, 22 aa, Cryptosporidium hominis
QYGSEGLQAGFGGPTSDQGGMG

SEQ ID NO: 2158533 - protein, 20 aa, Cryptosporidium hominis
QYGTETSDDLHTTDVRGANQ

SEQ ID NO: 2158534 - protein, 16 aa, Cryptosporidium hominis
QYKEDYEKKNETILQD

SEQ ID NO: 2158535 - protein, 10 aa, Cryptosporidium hominis
QYKPKNIQDR

SEQ ID NO: 2158536 - protein, 14 aa, Cryptosporidium hominis
QYKSDSSLTPEEQK

SEQ ID NO: 2158537 - protein, 10 aa, Cryptosporidium hominis
QYKSKISEKP

SEQ ID NO: 2158538 - protein, 12 aa, Cryptosporidium hominis
QYNNGNGGLNSP

SEQ ID NO: 2158539 - protein, 9 aa, Cryptosporidium hominis
QYNNNNNNI

SEQ ID NO: 2158540 - protein, 9 aa, Cryptosporidium hominis
QYNSEGRRI

SEQ ID NO: 2158541 - protein, 20 aa, Cryptosporidium hominis
QYNYRRDEDFRREDYPRSHN

SEQ ID NO: 2158542 - protein, 17 aa, Cryptosporidium hominis
QYPSDYKQKGTQNTEYD

SEQ ID NO: 2158543 - protein, 6 aa, Cryptosporidium hominis
QYRRRE

SEQ ID NO: 2158544 - protein, 6 aa, Cryptosporidium hominis
QYSDQN

SEQ ID NO: 2158545 - protein, 9 aa, Cryptosporidium hominis
QYSKPTITI

SEQ ID NO: 2158546 - protein, 5 aa, Cryptosporidium hominis
QYSSK

SEQ ID NO: 2158547 - protein, 12 aa, Cryptosporidium hominis
QYSSKQKEPREF

SEQ ID NO: 2158548 - protein, 8 aa, Cryptosporidium hominis
QYSTTTGG

SEQ ID NO: 2158549 - protein, 4 aa, Cryptosporidium hominis
QYTE

SEQ ID NO: 2158550 - protein, 11 aa, Cryptosporidium hominis
QYTGNKATRVE

SEQ ID NO: 2158551 - protein, 5 aa, Cryptosporidium hominis
QYTPL

SEQ ID NO: 2158552 - protein, 7 aa, Cryptosporidium hominis
QYTPPLA

SEQ ID NO: 2158553 - protein, 14 aa, Cryptosporidium hominis
QYYNSDSNSLTPRC

SEQ ID NO: 2158554 - protein, 16 aa, Cryptosporidium hominis
RACTLGSASSGRGRRA

SEQ ID NO: 2158555 - protein, 12 aa, Cryptosporidium hominis
RADFNSSSNITR

SEQ ID NO: 2158556 - protein, 7 aa, Cryptosporidium hominis
RADFPSR

SEQ ID NO: 2158557 - protein, 4 aa, Cryptosporidium hominis
RADQ

SEQ ID NO: 2158558 - protein, 6 aa, Cryptosporidium hominis
RADTLD

SEQ ID NO: 2158559 - protein, 20 aa, Cryptosporidium hominis
RAEKSPAQKNLRGRARRSNL

SEQ ID NO: 2158560 - protein, 11 aa, Cryptosporidium hominis
RAENTNSPIET

SEQ ID NO: 2158561 - protein, 5 aa, Cryptosporidium hominis
RAERN

SEQ ID NO: 2158562 - protein, 5 aa, Cryptosporidium hominis
RAGAA

SEQ ID NO: 2158563 - protein, 6 aa, Cryptosporidium hominis
RAGENE

SEQ ID NO: 2158564 - protein, 13 aa, Cryptosporidium hominis
RAGGKHNDLDDVG

SEQ ID NO: 2158565 - protein, 8 aa, Cryptosporidium hominis
RAGKDTKI

SEQ ID NO: 2158566 - protein, 4 aa, Cryptosporidium hominis
RAGP

SEQ ID NO: 2158567 - protein, 5 aa, Cryptosporidium hominis
RAGRT

SEQ ID NO: 2158568 - protein, 11 aa, Cryptosporidium hominis
RAGSFGDEEGS

SEQ ID NO: 2158569 - protein, 4 aa, Cryptosporidium hominis
RAGV

SEQ ID NO: 2158570 - protein, 4 aa, Cryptosporidium hominis
RAID

SEQ ID NO: 2158571 - protein, 60 aa, Cryptosporidium hominis
RAIKKQQKSQISISNPNLPLNTNSSNSSSLPLPNQQSTNNISTTSNSNSSSAVPIESYPG

SEQ ID NO: 2158572 - protein, 10 aa, Cryptosporidium hominis
RAKNGTGKTA

SEQ ID NO: 2158573 - protein, 4 aa, Cryptosporidium hominis
RAKS

SEQ ID NO: 2158574 - protein, 9 aa, Cryptosporidium hominis
RAKSGSKKK

SEQ ID NO: 2158575 - protein, 11 aa, Cryptosporidium hominis
RALTPQQAKKM

SEQ ID NO: 2158576 - protein, 10 aa, Cryptosporidium hominis
RAMNQTKTMD

SEQ ID NO: 2158577 - protein, 8 aa, Cryptosporidium hominis
RANALSSE

SEQ ID NO: 2158578 - protein, 8 aa, Cryptosporidium hominis
RANDVKQR

SEQ ID NO: 2158579 - protein, 7 aa, Cryptosporidium hominis
RANKTQI

SEQ ID NO: 2158580 - protein, 11 aa, Cryptosporidium hominis
RANNQKNGEFD

SEQ ID NO: 2158581 - protein, 11 aa, Cryptosporidium hominis
RANNSNKLEES

SEQ ID NO: 2158582 - protein, 32 aa, Cryptosporidium hominis
RANSNSNTSPTFDTNSSSKSSSPRKLSKATRS

SEQ ID NO: 2158583 - protein, 9 aa, Cryptosporidium hominis
RAPEKVRES

SEQ ID NO: 2158584 - protein, 34 aa, Cryptosporidium hominis
RAPGLPKSTSRPRVQSKGRKFEKARGRRASRAYK

SEQ ID NO: 2158585 - protein, 6 aa, Cryptosporidium hominis
RAPKGR

SEQ ID NO: 2158586 - protein, 6 aa, Cryptosporidium hominis
RAPKGS

SEQ ID NO: 2158587 - protein, 12 aa, Cryptosporidium hominis
RAPPSEVESLPQ

SEQ ID NO: 2158588 - protein, 9 aa, Cryptosporidium hominis
RAPSENIDE

SEQ ID NO: 2158589 - protein, 8 aa, Cryptosporidium hominis
RAQDAQDV

SEQ ID NO: 2158590 - protein, 24 aa, Cryptosporidium hominis
RAQETFESKAEEVIGNDSGNSELQ

SEQ ID NO: 2158591 - protein, 14 aa, Cryptosporidium hominis
RAQHSSENKEFDAN

SEQ ID NO: 2158592 - protein, 9 aa, Cryptosporidium hominis
RAQNSGSPQ

SEQ ID NO: 2158593 - protein, 23 aa, Cryptosporidium hominis
RAQNTAGQAGQVGSAQSKQTSVN

SEQ ID NO: 2158594 - protein, 7 aa, Cryptosporidium hominis
RAQRAKS

SEQ ID NO: 2158595 - protein, 24 aa, Cryptosporidium hominis
RAQSQIDNPPPIQETSNNTSSSTI

SEQ ID NO: 2158596 - protein, 12 aa, Cryptosporidium hominis
RAQYEPSDGEIE

SEQ ID NO: 2158597 - protein, 9 aa, Cryptosporidium hominis
RARPTPLDE

SEQ ID NO: 2158598 - protein, 11 aa, Cryptosporidium hominis
RARSQEKKLQS

SEQ ID NO: 2158599 - protein, 5 aa, Cryptosporidium hominis
RASGG

SEQ ID NO: 2158600 - protein, 30 aa, Cryptosporidium hominis
RASGPTSVGGGPSPSAQQQMQPFSSTSMTG

SEQ ID NO: 2158601 - protein, 9 aa, Cryptosporidium hominis
RASGRKPET

SEQ ID NO: 2158602 - protein, 7 aa, Cryptosporidium hominis
RASPRNT

SEQ ID NO: 2158603 - protein, 82 aa, Cryptosporidium hominis
RASSKKNISADNSEDSKLKKSESKKDIIKDEAKDESKTNKDGKDLKKTLKEGEGSISKVKGKGKVKTKAKAKETPPPAEESS

SEQ ID NO: 2158604 - protein, 5 aa, Cryptosporidium hominis
RASSL

SEQ ID NO: 2158605 - protein, 44 aa, Cryptosporidium hominis
RASTTQKKQDLQESIKRRDEEAQDRTNRKRLKKSSTSKEQAKTV

SEQ ID NO: 2158606 - protein, 13 aa, Cryptosporidium hominis
RATFKRSPSPRKD

SEQ ID NO: 2158607 - protein, 14 aa, Cryptosporidium hominis
RATFKRSPSPRKDW

SEQ ID NO: 2158608 - protein, 6 aa, Cryptosporidium hominis
RATGGR

SEQ ID NO: 2158609 - protein, 4 aa, Cryptosporidium hominis
RATI

SEQ ID NO: 2158610 - protein, 9 aa, Cryptosporidium hominis
RATLKNSKK

SEQ ID NO: 2158611 - protein, 6 aa, Cryptosporidium hominis
RATPYV

SEQ ID NO: 2158612 - protein, 14 aa, Cryptosporidium hominis
RATTRSKNSQNSDS

SEQ ID NO: 2158613 - protein, 6 aa, Cryptosporidium hominis
RAVQNG

SEQ ID NO: 2158614 - protein, 21 aa, Cryptosporidium hominis
RAVSKSRNGVEIPENATTAEI

SEQ ID NO: 2158615 - protein, 12 aa, Cryptosporidium hominis
RAYSPEEVKSNG

SEQ ID NO: 2158616 - protein, 7 aa, Cryptosporidium hominis
RCGGEQS

SEQ ID NO: 2158617 - protein, 4 aa, Cryptosporidium hominis
RCGK

SEQ ID NO: 2158618 - protein, 9 aa, Cryptosporidium hominis
RCKKPPQRI

SEQ ID NO: 2158619 - protein, 10 aa, Cryptosporidium hominis
RCKPKNCRQE

SEQ ID NO: 2158620 - protein, 5 aa, Cryptosporidium hominis
RCPSK

SEQ ID NO: 2158621 - protein, 9 aa, Cryptosporidium hominis
RCRGGRGGG

SEQ ID NO: 2158622 - protein, 4 aa, Cryptosporidium hominis
RCSQ

SEQ ID NO: 2158623 - protein, 7 aa, Cryptosporidium hominis
RDANTIQ

SEQ ID NO: 2158624 - protein, 7 aa, Cryptosporidium hominis
RDAYNKS

SEQ ID NO: 2158625 - protein, 15 aa, Cryptosporidium hominis
RDDAGRSTEKPKPEL

SEQ ID NO: 2158626 - protein, 7 aa, Cryptosporidium hominis
RDDAYSN

SEQ ID NO: 2158627 - protein, 49 aa, Cryptosporidium hominis
RDDEEEEDDDENEDNNHDKNIKNNPLYNETSISSDGKKYNDTASPIKTP

SEQ ID NO: 2158628 - protein, 27 aa, Cryptosporidium hominis
RDDGSNTITNKNNKNKANKNNTKSDKG

SEQ ID NO: 2158629 - protein, 9 aa, Cryptosporidium hominis
RDDGTSTAN

SEQ ID NO: 2158630 - protein, 6 aa, Cryptosporidium hominis
RDDKEQ

SEQ ID NO: 2158631 - protein, 11 aa, Cryptosporidium hominis
RDDKRHGKGTV

SEQ ID NO: 2158632 - protein, 6 aa, Cryptosporidium hominis
RDDQLG

SEQ ID NO: 2158633 - protein, 4 aa, Cryptosporidium hominis
RDDT

SEQ ID NO: 2158634 - protein, 36 aa, Cryptosporidium hominis
RDEDDSDDNDESDNYEEDVTGSSFRYDPDSKSSLEE

SEQ ID NO: 2158635 - protein, 5 aa, Cryptosporidium hominis
RDEEC

SEQ ID NO: 2158636 - protein, 9 aa, Cryptosporidium hominis
RDEIPPTKH

SEQ ID NO: 2158637 - protein, 11 aa, Cryptosporidium hominis
RDEKKNVSNTF

SEQ ID NO: 2158638 - protein, 8 aa, Cryptosporidium hominis
RDEKNELG

SEQ ID NO: 2158639 - protein, 7 aa, Cryptosporidium hominis
RDELEGG

SEQ ID NO: 2158640 - protein, 8 aa, Cryptosporidium hominis
RDELSSEV

SEQ ID NO: 2158641 - protein, 6 aa, Cryptosporidium hominis
RDEREY

SEQ ID NO: 2158642 - protein, 5 aa, Cryptosporidium hominis
RDESF

SEQ ID NO: 2158643 - protein, 12 aa, Cryptosporidium hominis
RDESKNSENSDH

SEQ ID NO: 2158644 - protein, 5 aa, Cryptosporidium hominis
RDEVL

SEQ ID NO: 2158645 - protein, 7 aa, Cryptosporidium hominis
RDEYERR

SEQ ID NO: 2158646 - protein, 18 aa, Cryptosporidium hominis
RDFSQNSQSTIESENMEA

SEQ ID NO: 2158647 - protein, 5 aa, Cryptosporidium hominis
RDGDG

SEQ ID NO: 2158648 - protein, 4 aa, Cryptosporidium hominis
RDGI

SEQ ID NO: 2158649 - protein, 7 aa, Cryptosporidium hominis
RDGPGGA

SEQ ID NO: 2158650 - protein, 6 aa, Cryptosporidium hominis
RDGRSQ

SEQ ID NO: 2158651 - protein, 7 aa, Cryptosporidium hominis
RDGYDTK

SEQ ID NO: 2158652 - protein, 5 aa, Cryptosporidium hominis
RDHYK

SEQ ID NO: 2158653 - protein, 4 aa, Cryptosporidium hominis
RDID

SEQ ID NO: 2158654 - protein, 10 aa, Cryptosporidium hominis
RDIQKDGETL

SEQ ID NO: 2158655 - protein, 9 aa, Cryptosporidium hominis
RDISPNNSK

SEQ ID NO: 2158656 - protein, 4 aa, Cryptosporidium hominis
RDIT

SEQ ID NO: 2158657 - protein, 5 aa, Cryptosporidium hominis
RDKEA

SEQ ID NO: 2158658 - protein, 10 aa, Cryptosporidium hominis
RDKESDETIN

SEQ ID NO: 2158659 - protein, 8 aa, Cryptosporidium hominis
RDKESGTL

SEQ ID NO: 2158660 - protein, 7 aa, Cryptosporidium hominis
RDKNTMK

SEQ ID NO: 2158661 - protein, 28 aa, Cryptosporidium hominis
RDKRRSRRNFTESDYDTSSECSSESNSI

SEQ ID NO: 2158662 - protein, 20 aa, Cryptosporidium hominis
RDKSKEADYAKSSFVDPDGD

SEQ ID NO: 2158663 - protein, 9 aa, Cryptosporidium hominis
RDKSKYKNI

SEQ ID NO: 2158664 - protein, 9 aa, Cryptosporidium hominis
RDKSNYSDM

SEQ ID NO: 2158665 - protein, 6 aa, Cryptosporidium hominis
RDKTGS

SEQ ID NO: 2158666 - protein, 5 aa, Cryptosporidium hominis
RDLNE

SEQ ID NO: 2158667 - protein, 9 aa, Cryptosporidium hominis
RDNARLTRD

SEQ ID NO: 2158668 - protein, 9 aa, Cryptosporidium hominis
RDNDSAYTK

SEQ ID NO: 2158669 - protein, 6 aa, Cryptosporidium hominis
RDNKTT

SEQ ID NO: 2158670 - protein, 11 aa, Cryptosporidium hominis
RDNNETKKNES

SEQ ID NO: 2158671 - protein, 4 aa, Cryptosporidium hominis
RDNP

SEQ ID NO: 2158672 - protein, 12 aa, Cryptosporidium hominis
RDNSFENEQNVN

SEQ ID NO: 2158673 - protein, 5 aa, Cryptosporidium hominis
RDNSL

SEQ ID NO: 2158674 - protein, 33 aa, Cryptosporidium hominis
RDNSSNKSDKFENKSTEVKNIEEKNKKQKTSIN

SEQ ID NO: 2158675 - protein, 12 aa, Cryptosporidium hominis
RDNTENEREDGE

SEQ ID NO: 2158676 - protein, 10 aa, Cryptosporidium hominis
RDPEKGSIAN

SEQ ID NO: 2158677 - protein, 8 aa, Cryptosporidium hominis
RDPEKPEN

SEQ ID NO: 2158678 - protein, 4 aa, Cryptosporidium hominis
RDPK

SEQ ID NO: 2158679 - protein, 12 aa, Cryptosporidium hominis
RDPKGYKTSNCE

SEQ ID NO: 2158680 - protein, 9 aa, Cryptosporidium hominis
RDPKYANSE

SEQ ID NO: 2158681 - protein, 32 aa, Cryptosporidium hominis
RDPSSTGFERESKRKDYSRSSTSIKDLSPSKS

SEQ ID NO: 2158682 - protein, 22 aa, Cryptosporidium hominis
RDQKQNSGSKKAPLSQEPTSFS

SEQ ID NO: 2158683 - protein, 6 aa, Cryptosporidium hominis
RDQLHS

SEQ ID NO: 2158684 - protein, 10 aa, Cryptosporidium hominis
RDQNTSEVTL

SEQ ID NO: 2158685 - protein, 10 aa, Cryptosporidium hominis
RDQQNVENST

SEQ ID NO: 2158686 - protein, 4 aa, Cryptosporidium hominis
RDRN

SEQ ID NO: 2158687 - protein, 6 aa, Cryptosporidium hominis
RDRSYS

SEQ ID NO: 2158688 - protein, 9 aa, Cryptosporidium hominis
RDSDTNLVT

SEQ ID NO: 2158689 - protein, 17 aa, Cryptosporidium hominis
RDSEELKPGEKPFPEGV

SEQ ID NO: 2158690 - protein, 5 aa, Cryptosporidium hominis
RDSEN

SEQ ID NO: 2158691 - protein, 17 aa, Cryptosporidium hominis
RDSERPRDSNKEKSNEL

SEQ ID NO: 2158692 - protein, 9 aa, Cryptosporidium hominis
RDSGIPKEK

SEQ ID NO: 2158693 - protein, 92 aa, Cryptosporidium hominis
RDSGRGPRMGGPPSRYDHRPSGGYPPEHGYRGGRYRDDYYGGRRQGGYRDDDRNYRPKRRYSSRSPSYHSPRGRSVSRSPYRGGSISREHSH

SEQ ID NO: 2158694 - protein, 8 aa, Cryptosporidium hominis
RDSIPQEQ

SEQ ID NO: 2158695 - protein, 11 aa, Cryptosporidium hominis
RDSKGTRPLDP

SEQ ID NO: 2158696 - protein, 68 aa, Cryptosporidium hominis
RDSKMTGVESSENLETSEKSDKKSEKKSEKKSEHKSESKSDNKSEKNKSNLRPEKESNESQKEKSGSR

SEQ ID NO: 2158697 - protein, 6 aa, Cryptosporidium hominis
RDSKTL

SEQ ID NO: 2158698 - protein, 4 aa, Cryptosporidium hominis
RDSL

SEQ ID NO: 2158699 - protein, 8 aa, Cryptosporidium hominis
RDSNSSSI

SEQ ID NO: 2158700 - protein, 6 aa, Cryptosporidium hominis
RDSPVA

SEQ ID NO: 2158701 - protein, 18 aa, Cryptosporidium hominis
RDSQPELKDEIRKKGGIQ

SEQ ID NO: 2158702 - protein, 4 aa, Cryptosporidium hominis
RDSS

SEQ ID NO: 2158703 - protein, 7 aa, Cryptosporidium hominis
RDSSEVK

SEQ ID NO: 2158704 - protein, 7 aa, Cryptosporidium hominis
RDSSGCT

SEQ ID NO: 2158705 - protein, 8 aa, Cryptosporidium hominis
RDSSNSEL

SEQ ID NO: 2158706 - protein, 16 aa, Cryptosporidium hominis
RDSSSPIIDNADVTEF

SEQ ID NO: 2158707 - protein, 4 aa, Cryptosporidium hominis
RDSY

SEQ ID NO: 2158708 - protein, 5 aa, Cryptosporidium hominis
RDTAR

SEQ ID NO: 2158709 - protein, 10 aa, Cryptosporidium hominis
RDTEKPEYNP

SEQ ID NO: 2158710 - protein, 11 aa, Cryptosporidium hominis
RDTPKVPFSPY

SEQ ID NO: 2158711 - protein, 10 aa, Cryptosporidium hominis
RDYEKELEGA

SEQ ID NO: 2158712 - protein, 6 aa, Cryptosporidium hominis
RDYGSQ

SEQ ID NO: 2158713 - protein, 9 aa, Cryptosporidium hominis
RDYNKAQDK

SEQ ID NO: 2158714 - protein, 9 aa, Cryptosporidium hominis
REAEELTET

SEQ ID NO: 2158715 - protein, 11 aa, Cryptosporidium hominis
REAENKMKAED

SEQ ID NO: 2158716 - protein, 13 aa, Cryptosporidium hominis
REAIKKQRENEKL

SEQ ID NO: 2158717 - protein, 9 aa, Cryptosporidium hominis
REAKTQERL

SEQ ID NO: 2158718 - protein, 4 aa, Cryptosporidium hominis
REAL

SEQ ID NO: 2158719 - protein, 10 aa, Cryptosporidium hominis
REANETLENT

SEQ ID NO: 2158720 - protein, 10 aa, Cryptosporidium hominis
REANMNQTAE

SEQ ID NO: 2158721 - protein, 7 aa, Cryptosporidium hominis
REASSDQ

SEQ ID NO: 2158722 - protein, 5 aa, Cryptosporidium hominis
RECSS

SEQ ID NO: 2158723 - protein, 4 aa, Cryptosporidium hominis
REDD

SEQ ID NO: 2158724 - protein, 4 aa, Cryptosporidium hominis
REDE

SEQ ID NO: 2158725 - protein, 8 aa, Cryptosporidium hominis
REDGNYPP

SEQ ID NO: 2158726 - protein, 5 aa, Cryptosporidium hominis
REDSL

SEQ ID NO: 2158727 - protein, 11 aa, Cryptosporidium hominis
REDSPTRDNTI

SEQ ID NO: 2158728 - protein, 9 aa, Cryptosporidium hominis
REDTDDPDS

SEQ ID NO: 2158729 - protein, 6 aa, Cryptosporidium hominis
REDYTK

SEQ ID NO: 2158730 - protein, 4 aa, Cryptosporidium hominis
REEA

SEQ ID NO: 2158731 - protein, 11 aa, Cryptosporidium hominis
REEAETKIRDH

SEQ ID NO: 2158732 - protein, 10 aa, Cryptosporidium hominis
REEEDSSGKV

SEQ ID NO: 2158733 - protein, 8 aa, Cryptosporidium hominis
REEEEKRM

SEQ ID NO: 2158734 - protein, 30 aa, Cryptosporidium hominis
REEERKKKIEEQKRREEEELKNMSTKSVPK

SEQ ID NO: 2158735 - protein, 5 aa, Cryptosporidium hominis
REEGS

SEQ ID NO: 2158736 - protein, 11 aa, Cryptosporidium hominis
REEKPYSPMSA

SEQ ID NO: 2158737 - protein, 17 aa, Cryptosporidium hominis
REELNGQDEDKEPKRGL

SEQ ID NO: 2158738 - protein, 9 aa, Cryptosporidium hominis
REELQGKKS

SEQ ID NO: 2158739 - protein, 12 aa, Cryptosporidium hominis
REEQEKSTKQLN

SEQ ID NO: 2158740 - protein, 5 aa, Cryptosporidium hominis
REERA

SEQ ID NO: 2158741 - protein, 5 aa, Cryptosporidium hominis
REERI

SEQ ID NO: 2158742 - protein, 7 aa, Cryptosporidium hominis
REERIGD

SEQ ID NO: 2158743 - protein, 13 aa, Cryptosporidium hominis
REERRQLNPTGVP

SEQ ID NO: 2158744 - protein, 21 aa, Cryptosporidium hominis
REESNFRKNGDNIKESSKSIS

SEQ ID NO: 2158745 - protein, 10 aa, Cryptosporidium hominis
REESNTDHGD

SEQ ID NO: 2158746 - protein, 5 aa, Cryptosporidium hominis
REEYL

SEQ ID NO: 2158747 - protein, 7 aa, Cryptosporidium hominis
REEYPLP

SEQ ID NO: 2158748 - protein, 4 aa, Cryptosporidium hominis
REFA

SEQ ID NO: 2158749 - protein, 6 aa, Cryptosporidium hominis
REFSSQ

SEQ ID NO: 2158750 - protein, 11 aa, Cryptosporidium hominis
REFTNDEKQGI

SEQ ID NO: 2158751 - protein, 4 aa, Cryptosporidium hominis
REGC

SEQ ID NO: 2158752 - protein, 5 aa, Cryptosporidium hominis
REGEN

SEQ ID NO: 2158753 - protein, 44 aa, Cryptosporidium hominis
REGEQEGEGEREGEREREEGEGEGGEGDEYEEGEGEEKKEKVRH

SEQ ID NO: 2158754 - protein, 5 aa, Cryptosporidium hominis
REGGI

SEQ ID NO: 2158755 - protein, 5 aa, Cryptosporidium hominis
REGKQ

SEQ ID NO: 2158756 - protein, 4 aa, Cryptosporidium hominis
REGL

SEQ ID NO: 2158757 - protein, 4 aa, Cryptosporidium hominis
REGN

SEQ ID NO: 2158758 - protein, 9 aa, Cryptosporidium hominis
REGRKRSTN

SEQ ID NO: 2158759 - protein, 17 aa, Cryptosporidium hominis
REGSAPDPLIESGIERV

SEQ ID NO: 2158760 - protein, 12 aa, Cryptosporidium hominis
REGSKSEFNHPN

SEQ ID NO: 2158761 - protein, 9 aa, Cryptosporidium hominis
REGTNLSEK

SEQ ID NO: 2158762 - protein, 9 aa, Cryptosporidium hominis
REGVEEETF

SEQ ID NO: 2158763 - protein, 10 aa, Cryptosporidium hominis
REHQERTQEA

SEQ ID NO: 2158764 - protein, 6 aa, Cryptosporidium hominis
REINGE

SEQ ID NO: 2158765 - protein, 7 aa, Cryptosporidium hominis
REIPNYN

SEQ ID NO: 2158766 - protein, 21 aa, Cryptosporidium hominis
REIQGQPKNNYGNSSPSSTRE

SEQ ID NO: 2158767 - protein, 4 aa, Cryptosporidium hominis
REKA

SEQ ID NO: 2158768 - protein, 28 aa, Cryptosporidium hominis
REKARLEEYGNSVENFEKEDKESKGETI

SEQ ID NO: 2158769 - protein, 10 aa, Cryptosporidium hominis
REKDNDEVSA

SEQ ID NO: 2158770 - protein, 7 aa, Cryptosporidium hominis
REKDQAI

SEQ ID NO: 2158771 - protein, 9 aa, Cryptosporidium hominis
REKEEAQFE

SEQ ID NO: 2158772 - protein, 17 aa, Cryptosporidium hominis
REKEEEIEKEKRRIAST

SEQ ID NO: 2158773 - protein, 8 aa, Cryptosporidium hominis
REKGGSGN

SEQ ID NO: 2158774 - protein, 7 aa, Cryptosporidium hominis
REKHAGS

SEQ ID NO: 2158775 - protein, 15 aa, Cryptosporidium hominis
REKKEDLRISDKEEP

SEQ ID NO: 2158776 - protein, 9 aa, Cryptosporidium hominis
REKKRKKAL

SEQ ID NO: 2158777 - protein, 5 aa, Cryptosporidium hominis
REKLE

SEQ ID NO: 2158778 - protein, 6 aa, Cryptosporidium hominis
REKLRQ

SEQ ID NO: 2158779 - protein, 19 aa, Cryptosporidium hominis
REKLTSRSIYNPKPNNASE

SEQ ID NO: 2158780 - protein, 10 aa, Cryptosporidium hominis
REKNIKGRYE

SEQ ID NO: 2158781 - protein, 7 aa, Cryptosporidium hominis
REKPSRF

SEQ ID NO: 2158782 - protein, 7 aa, Cryptosporidium hominis
REKQGHP

SEQ ID NO: 2158783 - protein, 27 aa, Cryptosporidium hominis
REKQNISSTGDNDNGNNNSYSDMGESD

SEQ ID NO: 2158784 - protein, 13 aa, Cryptosporidium hominis
REKQRKEENERKR

SEQ ID NO: 2158785 - protein, 7 aa, Cryptosporidium hominis
REKRASE

SEQ ID NO: 2158786 - protein, 11 aa, Cryptosporidium hominis
REKSSDRKPLE

SEQ ID NO: 2158787 - protein, 15 aa, Cryptosporidium hominis
REKSSTSESVKNLFE

SEQ ID NO: 2158788 - protein, 6 aa, Cryptosporidium hominis
REKVNR

SEQ ID NO: 2158789 - protein, 9 aa, Cryptosporidium hominis
RELAEQSEK

SEQ ID NO: 2158790 - protein, 12 aa, Cryptosporidium hominis
RELSSGDESGAP

SEQ ID NO: 2158791 - protein, 22 aa, Cryptosporidium hominis
REMASDAKQKEREKHKQESLEA

SEQ ID NO: 2158792 - protein, 8 aa, Cryptosporidium hominis
REMQTSST

SEQ ID NO: 2158793 - protein, 9 aa, Cryptosporidium hominis
RENGKENNY

SEQ ID NO: 2158794 - protein, 7 aa, Cryptosporidium hominis
RENKRLK

SEQ ID NO: 2158795 - protein, 5 aa, Cryptosporidium hominis
RENLR

SEQ ID NO: 2158796 - protein, 14 aa, Cryptosporidium hominis
RENNQDNKATNPSD

SEQ ID NO: 2158797 - protein, 8 aa, Cryptosporidium hominis
RENQQINK

SEQ ID NO: 2158798 - protein, 5 aa, Cryptosporidium hominis
RENSP

SEQ ID NO: 2158799 - protein, 17 aa, Cryptosporidium hominis
RENYRRRSIDGGPTPRG

SEQ ID NO: 2158800 - protein, 5 aa, Cryptosporidium hominis
REPDK

SEQ ID NO: 2158801 - protein, 4 aa, Cryptosporidium hominis
REPG

SEQ ID NO: 2158802 - protein, 8 aa, Cryptosporidium hominis
REPGGTIR

SEQ ID NO: 2158803 - protein, 10 aa, Cryptosporidium hominis
REPKSIDSNT

SEQ ID NO: 2158804 - protein, 34 aa, Cryptosporidium hominis
REPPKRTRDKFNNETSKNDSLKRGSQESKSAYSF

SEQ ID NO: 2158805 - protein, 5 aa, Cryptosporidium hominis
REQGQ

SEQ ID NO: 2158806 - protein, 6 aa, Cryptosporidium hominis
REQNPE

SEQ ID NO: 2158807 - protein, 27 aa, Cryptosporidium hominis
REQNSEKQIENKSKDVEKKETEQSDYS

SEQ ID NO: 2158808 - protein, 8 aa, Cryptosporidium hominis
REQQQRKE

SEQ ID NO: 2158809 - protein, 37 aa, Cryptosporidium hominis
REQSLSTSNEIDSIDTEHKDSSNFTTESELTNTKDKV

SEQ ID NO: 2158810 - protein, 60 aa, Cryptosporidium hominis
REREKERDRDRERDRERDRERDRERDRERDRERGRERDRERDRERDRDRERDRDRCKERI

SEQ ID NO: 2158811 - protein, 9 aa, Cryptosporidium hominis
RERGPFPTI

SEQ ID NO: 2158812 - protein, 28 aa, Cryptosporidium hominis
RERKNQQQNNAREHNTDSNHSDDETYEL

SEQ ID NO: 2158813 - protein, 8 aa, Cryptosporidium hominis
RERRGEYL

SEQ ID NO: 2158814 - protein, 4 aa, Cryptosporidium hominis
RERS

SEQ ID NO: 2158815 - protein, 17 aa, Cryptosporidium hominis
RESAKIANQLDNQASRL

SEQ ID NO: 2158816 - protein, 4 aa, Cryptosporidium hominis
RESC

SEQ ID NO: 2158817 - protein, 9 aa, Cryptosporidium hominis
RESERTPKE

SEQ ID NO: 2158818 - protein, 8 aa, Cryptosporidium hominis
RESGKINK

SEQ ID NO: 2158819 - protein, 9 aa, Cryptosporidium hominis
RESGSLPTI

SEQ ID NO: 2158820 - protein, 4 aa, Cryptosporidium hominis
RESL

SEQ ID NO: 2158821 - protein, 7 aa, Cryptosporidium hominis
RESLEEL

SEQ ID NO: 2158822 - protein, 11 aa, Cryptosporidium hominis
RESLESRAERS

SEQ ID NO: 2158823 - protein, 12 aa, Cryptosporidium hominis
RESMSNTSDVST

SEQ ID NO: 2158824 - protein, 23 aa, Cryptosporidium hominis
RESNEDFNSDISNGFSDTSVENG

SEQ ID NO: 2158825 - protein, 7 aa, Cryptosporidium hominis
RESNGDG

SEQ ID NO: 2158826 - protein, 7 aa, Cryptosporidium hominis
RESNNPQ

SEQ ID NO: 2158827 - protein, 5 aa, Cryptosporidium hominis
RESNQ

SEQ ID NO: 2158828 - protein, 5 aa, Cryptosporidium hominis
RESRE

SEQ ID NO: 2158829 - protein, 10 aa, Cryptosporidium hominis
RESSDGSKSV

SEQ ID NO: 2158830 - protein, 13 aa, Cryptosporidium hominis
RESSHSKSSVGNS

SEQ ID NO: 2158831 - protein, 25 aa, Cryptosporidium hominis
RESTGGQIKDESDELGMESQTDSVH

SEQ ID NO: 2158832 - protein, 23 aa, Cryptosporidium hominis
RESTSTNSIRNNANEPRKANRRG

SEQ ID NO: 2158833 - protein, 5 aa, Cryptosporidium hominis
RESVN

SEQ ID NO: 2158834 - protein, 4 aa, Cryptosporidium hominis
RETL

SEQ ID NO: 2158835 - protein, 6 aa, Cryptosporidium hominis
RETRTY

SEQ ID NO: 2158836 - protein, 7 aa, Cryptosporidium hominis
RETSEDQ

SEQ ID NO: 2158837 - protein, 18 aa, Cryptosporidium hominis
RETSKQFGANIPNKDLGQ

SEQ ID NO: 2158838 - protein, 12 aa, Cryptosporidium hominis
RETSSKSSKSRG

SEQ ID NO: 2158839 - protein, 16 aa, Cryptosporidium hominis
REVEKSKRALSSAPQV

SEQ ID NO: 2158840 - protein, 14 aa, Cryptosporidium hominis
REVGNEPAFHHPIV

SEQ ID NO: 2158841 - protein, 9 aa, Cryptosporidium hominis
REVKDKDRF

SEQ ID NO: 2158842 - protein, 6 aa, Cryptosporidium hominis
REVNKG

SEQ ID NO: 2158843 - protein, 9 aa, Cryptosporidium hominis
REVPKESEM

SEQ ID NO: 2158844 - protein, 10 aa, Cryptosporidium hominis
RFDDNSDENS

SEQ ID NO: 2158845 - protein, 12 aa, Cryptosporidium hominis
RFERSKNMASSE

SEQ ID NO: 2158846 - protein, 11 aa, Cryptosporidium hominis
RFESKSSFGSS

SEQ ID NO: 2158847 - protein, 12 aa, Cryptosporidium hominis
RFNSDTDVPKLG

SEQ ID NO: 2158848 - protein, 5 aa, Cryptosporidium hominis
RFPSE

SEQ ID NO: 2158849 - protein, 6 aa, Cryptosporidium hominis
RFPYND

SEQ ID NO: 2158850 - protein, 4 aa, Cryptosporidium hominis
RFSD

SEQ ID NO: 2158851 - protein, 4 aa, Cryptosporidium hominis
RFSE

SEQ ID NO: 2158852 - protein, 6 aa, Cryptosporidium hominis
RFSGNG

SEQ ID NO: 2158853 - protein, 11 aa, Cryptosporidium hominis
RFSNSNCKVNS

SEQ ID NO: 2158854 - protein, 27 aa, Cryptosporidium hominis
RFYQRNNNNVGSSSNKHNPTQNTQVTS

SEQ ID NO: 2158855 - protein, 4 aa, Cryptosporidium hominis
RGAD

SEQ ID NO: 2158856 - protein, 6 aa, Cryptosporidium hominis
RGAENI

SEQ ID NO: 2158857 - protein, 8 aa, Cryptosporidium hominis
RGAGQITP

SEQ ID NO: 2158858 - protein, 11 aa, Cryptosporidium hominis
RGANVDPTGEW

SEQ ID NO: 2158859 - protein, 4 aa, Cryptosporidium hominis
RGAR

SEQ ID NO: 2158860 - protein, 10 aa, Cryptosporidium hominis
RGASEFGTPN

SEQ ID NO: 2158861 - protein, 7 aa, Cryptosporidium hominis
RGASESI

SEQ ID NO: 2158862 - protein, 6 aa, Cryptosporidium hominis
RGDATN

SEQ ID NO: 2158863 - protein, 22 aa, Cryptosporidium hominis
RGDDPRNASTSADLTEKTITPM

SEQ ID NO: 2158864 - protein, 8 aa, Cryptosporidium hominis
RGDGCSEA

SEQ ID NO: 2158865 - protein, 6 aa, Cryptosporidium hominis
RGDIEN

SEQ ID NO: 2158866 - protein, 11 aa, Cryptosporidium hominis
RGDKESKGLDK

SEQ ID NO: 2158867 - protein, 5 aa, Cryptosporidium hominis
RGDSI

SEQ ID NO: 2158868 - protein, 7 aa, Cryptosporidium hominis
RGDTPGR

SEQ ID NO: 2158869 - protein, 6 aa, Cryptosporidium hominis
RGDYDT

SEQ ID NO: 2158870 - protein, 6 aa, Cryptosporidium hominis
RGEASI

SEQ ID NO: 2158871 - protein, 6 aa, Cryptosporidium hominis
RGECKK

SEQ ID NO: 2158872 - protein, 5 aa, Cryptosporidium hominis
RGEES

SEQ ID NO: 2158873 - protein, 15 aa, Cryptosporidium hominis
RGEEVESSDFTSGDH

SEQ ID NO: 2158874 - protein, 4 aa, Cryptosporidium hominis
RGEF

SEQ ID NO: 2158875 - protein, 20 aa, Cryptosporidium hominis
RGEKKGSLSHRSNLKPAPSM

SEQ ID NO: 2158876 - protein, 4 aa, Cryptosporidium hominis
RGEP

SEQ ID NO: 2158877 - protein, 16 aa, Cryptosporidium hominis
RGERENGTNDPRLNTP

SEQ ID NO: 2158878 - protein, 9 aa, Cryptosporidium hominis
RGERYSPSQ

SEQ ID NO: 2158879 - protein, 10 aa, Cryptosporidium hominis
RGESIPSGMP

SEQ ID NO: 2158880 - protein, 14 aa, Cryptosporidium hominis
RGEVNSKESPKDNY

SEQ ID NO: 2158881 - protein, 13 aa, Cryptosporidium hominis
RGEYNNLGTSSRE

SEQ ID NO: 2158882 - protein, 4 aa, Cryptosporidium hominis
RGGE

SEQ ID NO: 2158883 - protein, 4 aa, Cryptosporidium hominis
RGGF

SEQ ID NO: 2158884 - protein, 8 aa, Cryptosporidium hominis
RGGGDYSF

SEQ ID NO: 2158885 - protein, 15 aa, Cryptosporidium hominis
RGGKEGGSNQLSDER

SEQ ID NO: 2158886 - protein, 5 aa, Cryptosporidium hominis
RGGNI

SEQ ID NO: 2158887 - protein, 7 aa, Cryptosporidium hominis
RGGPISS

SEQ ID NO: 2158888 - protein, 14 aa, Cryptosporidium hominis
RGGRKTAKDKVEKG

SEQ ID NO: 2158889 - protein, 10 aa, Cryptosporidium hominis
RGGSKKEWGI

SEQ ID NO: 2158890 - protein, 7 aa, Cryptosporidium hominis
RGGSNTV

SEQ ID NO: 2158891 - protein, 10 aa, Cryptosporidium hominis
RGGSRGQEVR

SEQ ID NO: 2158892 - protein, 4 aa, Cryptosporidium hominis
RGGV

SEQ ID NO: 2158893 - protein, 19 aa, Cryptosporidium hominis
RGGYESQRSESDTSEESVR

SEQ ID NO: 2158894 - protein, 11 aa, Cryptosporidium hominis
RGIDRGSNTIA

SEQ ID NO: 2158895 - protein, 11 aa, Cryptosporidium hominis
RGIEEDEEETC

SEQ ID NO: 2158896 - protein, 11 aa, Cryptosporidium hominis
RGISSTESLEY

SEQ ID NO: 2158897 - protein, 19 aa, Cryptosporidium hominis
RGKGTTKEGKKCDHQTEEE

SEQ ID NO: 2158898 - protein, 8 aa, Cryptosporidium hominis
RGKKDIPP

SEQ ID NO: 2158899 - protein, 11 aa, Cryptosporidium hominis
RGKKGTDRQEQ

SEQ ID NO: 2158900 - protein, 8 aa, Cryptosporidium hominis
RGLPSRKN

SEQ ID NO: 2158901 - protein, 11 aa, Cryptosporidium hominis
RGLSSNTSSCG

SEQ ID NO: 2158902 - protein, 8 aa, Cryptosporidium hominis
RGNGKISR

SEQ ID NO: 2158903 - protein, 10 aa, Cryptosporidium hominis
RGNNNSSKKF

SEQ ID NO: 2158904 - protein, 8 aa, Cryptosporidium hominis
RGNSPPGK

SEQ ID NO: 2158905 - protein, 7 aa, Cryptosporidium hominis
RGNSQGI

SEQ ID NO: 2158906 - protein, 12 aa, Cryptosporidium hominis
RGPCNESSDSWS

SEQ ID NO: 2158907 - protein, 8 aa, Cryptosporidium hominis
RGPKDKPI

SEQ ID NO: 2158908 - protein, 9 aa, Cryptosporidium hominis
RGPQAYSSD

SEQ ID NO: 2158909 - protein, 7 aa, Cryptosporidium hominis
RGPSNVV

SEQ ID NO: 2158910 - protein, 5 aa, Cryptosporidium hominis
RGPSR

SEQ ID NO: 2158911 - protein, 6 aa, Cryptosporidium hominis
RGPTNE

SEQ ID NO: 2158912 - protein, 5 aa, Cryptosporidium hominis
RGPTQ

SEQ ID NO: 2158913 - protein, 13 aa, Cryptosporidium hominis
RGPTVGAAREKRI

SEQ ID NO: 2158914 - protein, 8 aa, Cryptosporidium hominis
RGPYSPYS

SEQ ID NO: 2158915 - protein, 8 aa, Cryptosporidium hominis
RGQGQTIT

SEQ ID NO: 2158916 - protein, 13 aa, Cryptosporidium hominis
RGRARQASAGELT

SEQ ID NO: 2158917 - protein, 19 aa, Cryptosporidium hominis
RGRGRPPRNANRADIGPSG

SEQ ID NO: 2158918 - protein, 7 aa, Cryptosporidium hominis
RGRKNIN

SEQ ID NO: 2158919 - protein, 12 aa, Cryptosporidium hominis
RGRPKKNQPKPS

SEQ ID NO: 2158920 - protein, 8 aa, Cryptosporidium hominis
RGRPPPPF

SEQ ID NO: 2158921 - protein, 17 aa, Cryptosporidium hominis
RGRQRTENQKPSHEKTN

SEQ ID NO: 2158922 - protein, 4 aa, Cryptosporidium hominis
RGRR

SEQ ID NO: 2158923 - protein, 14 aa, Cryptosporidium hominis
RGRSPVKHTSPRKI

SEQ ID NO: 2158924 - protein, 16 aa, Cryptosporidium hominis
RGRSYSNGNEGGNYRS

SEQ ID NO: 2158925 - protein, 4 aa, Cryptosporidium hominis
RGRT

SEQ ID NO: 2158926 - protein, 4 aa, Cryptosporidium hominis
RGRV

SEQ ID NO: 2158927 - protein, 15 aa, Cryptosporidium hominis
RGSAEQDSFSYNKNS

SEQ ID NO: 2158928 - protein, 9 aa, Cryptosporidium hominis
RGSDGNQGQ

SEQ ID NO: 2158929 - protein, 4 aa, Cryptosporidium hominis
RGSG

SEQ ID NO: 2158930 - protein, 9 aa, Cryptosporidium hominis
RGSGQAKNL

SEQ ID NO: 2158931 - protein, 9 aa, Cryptosporidium hominis
RGSKGGIQV

SEQ ID NO: 2158932 - protein, 12 aa, Cryptosporidium hominis
RGSKSITRSRRK

SEQ ID NO: 2158933 - protein, 4 aa, Cryptosporidium hominis
RGSQ

SEQ ID NO: 2158934 - protein, 21 aa, Cryptosporidium hominis
RGSRGDSLSMPHSASSTFSKF

SEQ ID NO: 2158935 - protein, 11 aa, Cryptosporidium hominis
RGSRPGKPVQL

SEQ ID NO: 2158936 - protein, 19 aa, Cryptosporidium hominis
RGSRTSKNRSSSVDSGSCG

SEQ ID NO: 2158937 - protein, 12 aa, Cryptosporidium hominis
RGSTGSSSISSI

SEQ ID NO: 2158938 - protein, 7 aa, Cryptosporidium hominis
RGTDASK

SEQ ID NO: 2158939 - protein, 11 aa, Cryptosporidium hominis
RGTDYKSPHGI

SEQ ID NO: 2158940 - protein, 20 aa, Cryptosporidium hominis
RGTKDGTQLKLSSEGNFVSG

SEQ ID NO: 2158941 - protein, 18 aa, Cryptosporidium hominis
RGTKSSESLPAIKTSDHN

SEQ ID NO: 2158942 - protein, 7 aa, Cryptosporidium hominis
RGTPAYE

SEQ ID NO: 2158943 - protein, 16 aa, Cryptosporidium hominis
RGTSKNYDNSSEPSSI

SEQ ID NO: 2158944 - protein, 16 aa, Cryptosporidium hominis
RGTSRGRSGRGLAVQN

SEQ ID NO: 2158945 - protein, 4 aa, Cryptosporidium hominis
RGTT

SEQ ID NO: 2158946 - protein, 5 aa, Cryptosporidium hominis
RGVEG

SEQ ID NO: 2158947 - protein, 7 aa, Cryptosporidium hominis
RGVTPDE

SEQ ID NO: 2158948 - protein, 8 aa, Cryptosporidium hominis
RGYGYNAN

SEQ ID NO: 2158949 - protein, 27 aa, Cryptosporidium hominis
RGYNNNNNSNNNTDSAKNNDKENHDSF

SEQ ID NO: 2158950 - protein, 17 aa, Cryptosporidium hominis
RGYPNQINPKTLNSPTR

SEQ ID NO: 2158951 - protein, 16 aa, Cryptosporidium hominis
RHAQHKDDMTGTGSFN

SEQ ID NO: 2158952 - protein, 6 aa, Cryptosporidium hominis
RHDESI

SEQ ID NO: 2158953 - protein, 28 aa, Cryptosporidium hominis
RHDNKGGNSQSSVGQRGNVEDSQKRLPD

SEQ ID NO: 2158954 - protein, 7 aa, Cryptosporidium hominis
RHDNSSN

SEQ ID NO: 2158955 - protein, 4 aa, Cryptosporidium hominis
RHDQ

SEQ ID NO: 2158956 - protein, 4 aa, Cryptosporidium hominis
RHEN

SEQ ID NO: 2158957 - protein, 9 aa, Cryptosporidium hominis
RHENLGKGN

SEQ ID NO: 2158958 - protein, 18 aa, Cryptosporidium hominis
RHGKPGVGSTSSSRFIPL

SEQ ID NO: 2158959 - protein, 4 aa, Cryptosporidium hominis
RHHR

SEQ ID NO: 2158960 - protein, 4 aa, Cryptosporidium hominis
RHKF

SEQ ID NO: 2158961 - protein, 7 aa, Cryptosporidium hominis
RHKPESL

SEQ ID NO: 2158962 - protein, 4 aa, Cryptosporidium hominis
RHNG

SEQ ID NO: 2158963 - protein, 8 aa, Cryptosporidium hominis
RHNKPHPC

SEQ ID NO: 2158964 - protein, 8 aa, Cryptosporidium hominis
RHNPQRVG

SEQ ID NO: 2158965 - protein, 7 aa, Cryptosporidium hominis
RHPDMPK

SEQ ID NO: 2158966 - protein, 4 aa, Cryptosporidium hominis
RHPG

SEQ ID NO: 2158967 - protein, 8 aa, Cryptosporidium hominis
RHPGIPSS

SEQ ID NO: 2158968 - protein, 8 aa, Cryptosporidium hominis
RHPNPSDF

SEQ ID NO: 2158969 - protein, 8 aa, Cryptosporidium hominis
RHPPGNEI

SEQ ID NO: 2158970 - protein, 8 aa, Cryptosporidium hominis
RHPRDSGF

SEQ ID NO: 2158971 - protein, 6 aa, Cryptosporidium hominis
RHRGLP

SEQ ID NO: 2158972 - protein, 9 aa, Cryptosporidium hominis
RHSGNQNLD

SEQ ID NO: 2158973 - protein, 14 aa, Cryptosporidium hominis
RHSGNRSFGRPEES

SEQ ID NO: 2158974 - protein, 8 aa, Cryptosporidium hominis
RHSKEEQG

SEQ ID NO: 2158975 - protein, 19 aa, Cryptosporidium hominis
RHSKENKRARSLSRSLSPD

SEQ ID NO: 2158976 - protein, 4 aa, Cryptosporidium hominis
RHYP

SEQ ID NO: 2158977 - protein, 5 aa, Cryptosporidium hominis
RIDES

SEQ ID NO: 2158978 - protein, 8 aa, Cryptosporidium hominis
RIDPNNEY

SEQ ID NO: 2158979 - protein, 10 aa, Cryptosporidium hominis
RIEEQEKERS

SEQ ID NO: 2158980 - protein, 37 aa, Cryptosporidium hominis
RIEKEEKEKSNNEIISRNSSERKVKRSRNESTEDIEN

SEQ ID NO: 2158981 - protein, 14 aa, Cryptosporidium hominis
RIEKSVKNDNISSQ

SEQ ID NO: 2158982 - protein, 5 aa, Cryptosporidium hominis
RIEPE

SEQ ID NO: 2158983 - protein, 12 aa, Cryptosporidium hominis
RIEREEKERIER

SEQ ID NO: 2158984 - protein, 13 aa, Cryptosporidium hominis
RIEREEKERIERE

SEQ ID NO: 2158985 - protein, 23 aa, Cryptosporidium hominis
RIETNNRHTDRYNNQISSTENHP

SEQ ID NO: 2158986 - protein, 18 aa, Cryptosporidium hominis
RIEYNGGNPECEHNIRIQ

SEQ ID NO: 2158987 - protein, 5 aa, Cryptosporidium hominis
RIGEY

SEQ ID NO: 2158988 - protein, 7 aa, Cryptosporidium hominis
RIGNQYP

SEQ ID NO: 2158989 - protein, 7 aa, Cryptosporidium hominis
RIGQKKP

SEQ ID NO: 2158990 - protein, 11 aa, Cryptosporidium hominis
RIGSSAPEECR

SEQ ID NO: 2158991 - protein, 13 aa, Cryptosporidium hominis
RIHDQEKSSKFDN

SEQ ID NO: 2158992 - protein, 9 aa, Cryptosporidium hominis
RIKDTRELS

SEQ ID NO: 2158993 - protein, 9 aa, Cryptosporidium hominis
RINSGGTTV

SEQ ID NO: 2158994 - protein, 6 aa, Cryptosporidium hominis
RIPANK

SEQ ID NO: 2158995 - protein, 20 aa, Cryptosporidium hominis
RIPNPTPIKTSAQPVEIPKT

SEQ ID NO: 2158996 - protein, 4 aa, Cryptosporidium hominis
RIPP

SEQ ID NO: 2158997 - protein, 8 aa, Cryptosporidium hominis
RIQESSNK

SEQ ID NO: 2158998 - protein, 11 aa, Cryptosporidium hominis
RIQETNEAYSE

SEQ ID NO: 2158999 - protein, 6 aa, Cryptosporidium hominis
RIRPNT

SEQ ID NO: 2159000 - protein, 19 aa, Cryptosporidium hominis
RIRYDEDDDEENIDLGRNE

SEQ ID NO: 2159001 - protein, 6 aa, Cryptosporidium hominis
RISDVE

SEQ ID NO: 2159002 - protein, 8 aa, Cryptosporidium hominis
RISGKQAD

SEQ ID NO: 2159003 - protein, 12 aa, Cryptosporidium hominis
RISNKGGAYYSS

SEQ ID NO: 2159004 - protein, 6 aa, Cryptosporidium hominis
RISPQE

SEQ ID NO: 2159005 - protein, 4 aa, Cryptosporidium hominis
RISR

SEQ ID NO: 2159006 - protein, 13 aa, Cryptosporidium hominis
RISRGSGTSNQDV

SEQ ID NO: 2159007 - protein, 10 aa, Cryptosporidium hominis
RISSATKIER

SEQ ID NO: 2159008 - protein, 7 aa, Cryptosporidium hominis
RISSNGE

SEQ ID NO: 2159009 - protein, 17 aa, Cryptosporidium hominis
RITNNESNKLQNDNHDT

SEQ ID NO: 2159010 - protein, 6 aa, Cryptosporidium hominis
RITQQE

SEQ ID NO: 2159011 - protein, 15 aa, Cryptosporidium hominis
RITRNQKETSDKSLS

SEQ ID NO: 2159012 - protein, 16 aa, Cryptosporidium hominis
RIYTNSSDISQFSSKT

SEQ ID NO: 2159013 - protein, 13 aa, Cryptosporidium hominis
RKADLKSTGDLKP

SEQ ID NO: 2159014 - protein, 12 aa, Cryptosporidium hominis
RKAGKKAKKEYT

SEQ ID NO: 2159015 - protein, 16 aa, Cryptosporidium hominis
RKAHAEDGANSEKSIK

SEQ ID NO: 2159016 - protein, 10 aa, Cryptosporidium hominis
RKAKNKEYKT

SEQ ID NO: 2159017 - protein, 25 aa, Cryptosporidium hominis
RKAKQIKERISEQKEKKNEKHKERE

SEQ ID NO: 2159018 - protein, 18 aa, Cryptosporidium hominis
RKALSSNSFNNREDRSAF

SEQ ID NO: 2159019 - protein, 8 aa, Cryptosporidium hominis
RKASDEIQ

SEQ ID NO: 2159020 - protein, 8 aa, Cryptosporidium hominis
RKASDGSG

SEQ ID NO: 2159021 - protein, 12 aa, Cryptosporidium hominis
RKASSAYKNVPQ

SEQ ID NO: 2159022 - protein, 8 aa, Cryptosporidium hominis
RKATQKVA

SEQ ID NO: 2159023 - protein, 6 aa, Cryptosporidium hominis
RKCSSS

SEQ ID NO: 2159024 - protein, 9 aa, Cryptosporidium hominis
RKDEETLNK

SEQ ID NO: 2159025 - protein, 12 aa, Cryptosporidium hominis
RKDEVERVAKAN

SEQ ID NO: 2159026 - protein, 4 aa, Cryptosporidium hominis
RKDF

SEQ ID NO: 2159027 - protein, 8 aa, Cryptosporidium hominis
RKDGKRKH

SEQ ID NO: 2159028 - protein, 8 aa, Cryptosporidium hominis
RKDGSKEI

SEQ ID NO: 2159029 - protein, 7 aa, Cryptosporidium hominis
RKDHPKF

SEQ ID NO: 2159030 - protein, 8 aa, Cryptosporidium hominis
RKDQKEKV

SEQ ID NO: 2159031 - protein, 8 aa, Cryptosporidium hominis
RKDRGGIT

SEQ ID NO: 2159032 - protein, 6 aa, Cryptosporidium hominis
RKDTAA

SEQ ID NO: 2159033 - protein, 17 aa, Cryptosporidium hominis
RKDVNSIGEQIKRLDLN

SEQ ID NO: 2159034 - protein, 5 aa, Cryptosporidium hominis
RKDYG

SEQ ID NO: 2159035 - protein, 16 aa, Cryptosporidium hominis
RKEDNTLEEKDLNSLG

SEQ ID NO: 2159036 - protein, 7 aa, Cryptosporidium hominis
RKEDQAE

SEQ ID NO: 2159037 - protein, 20 aa, Cryptosporidium hominis
RKEETKYEDIPSQISKRDPL

SEQ ID NO: 2159038 - protein, 10 aa, Cryptosporidium hominis
RKEKSNDEEI

SEQ ID NO: 2159039 - protein, 5 aa, Cryptosporidium hominis
RKELT

SEQ ID NO: 2159040 - protein, 5 aa, Cryptosporidium hominis
RKEPI

SEQ ID NO: 2159041 - protein, 6 aa, Cryptosporidium hominis
RKEQRA

SEQ ID NO: 2159042 - protein, 14 aa, Cryptosporidium hominis
RKERKKQLSSDREK

SEQ ID NO: 2159043 - protein, 5 aa, Cryptosporidium hominis
RKERM

SEQ ID NO: 2159044 - protein, 13 aa, Cryptosporidium hominis
RKESGSYRSGDNH

SEQ ID NO: 2159045 - protein, 17 aa, Cryptosporidium hominis
RKESQETTGKKSEGEIN

SEQ ID NO: 2159046 - protein, 7 aa, Cryptosporidium hominis
RKESQST

SEQ ID NO: 2159047 - protein, 7 aa, Cryptosporidium hominis
RKESTSG

SEQ ID NO: 2159048 - protein, 9 aa, Cryptosporidium hominis
RKETDTGPV

SEQ ID NO: 2159049 - protein, 17 aa, Cryptosporidium hominis
RKEVDRARGASPNTRSA

SEQ ID NO: 2159050 - protein, 17 aa, Cryptosporidium hominis
RKFEAEKFTKDQNLRRG

SEQ ID NO: 2159051 - protein, 18 aa, Cryptosporidium hominis
RKFEEDTEEGFEKGNRKK

SEQ ID NO: 2159052 - protein, 12 aa, Cryptosporidium hominis
RKFEEKEKAPVN

SEQ ID NO: 2159053 - protein, 18 aa, Cryptosporidium hominis
RKFESRKVHKDSQHAQKL

SEQ ID NO: 2159054 - protein, 6 aa, Cryptosporidium hominis
RKFSSD

SEQ ID NO: 2159055 - protein, 12 aa, Cryptosporidium hominis
RKFSSSKTKEGK

SEQ ID NO: 2159056 - protein, 7 aa, Cryptosporidium hominis
RKFSTPI

SEQ ID NO: 2159057 - protein, 12 aa, Cryptosporidium hominis
RKGANEATKALN

SEQ ID NO: 2159058 - protein, 10 aa, Cryptosporidium hominis
RKGDNNQAES

SEQ ID NO: 2159059 - protein, 7 aa, Cryptosporidium hominis
RKGGDRL

SEQ ID NO: 2159060 - protein, 9 aa, Cryptosporidium hominis
RKGGPPAQR

SEQ ID NO: 2159061 - protein, 34 aa, Cryptosporidium hominis
RKGIQGGTGGLNKINNGEEEDEDDEEEDEDSREF

SEQ ID NO: 2159062 - protein, 7 aa, Cryptosporidium hominis
RKGLPTQ

SEQ ID NO: 2159063 - protein, 9 aa, Cryptosporidium hominis
RKGLTPSQI

SEQ ID NO: 2159064 - protein, 17 aa, Cryptosporidium hominis
RKGNHEVKGDKAPTKDM

SEQ ID NO: 2159065 - protein, 23 aa, Cryptosporidium hominis
RKGNTDGRGEKKETGKSIRTEQK

SEQ ID NO: 2159066 - protein, 7 aa, Cryptosporidium hominis
RKGPISI

SEQ ID NO: 2159067 - protein, 13 aa, Cryptosporidium hominis
RKGPVSSPDKSFE

SEQ ID NO: 2159068 - protein, 4 aa, Cryptosporidium hominis
RKGQ

SEQ ID NO: 2159069 - protein, 5 aa, Cryptosporidium hominis
RKGQR

SEQ ID NO: 2159070 - protein, 25 aa, Cryptosporidium hominis
RKGRDGGDLQRTNSKSGRDRFNRPD

SEQ ID NO: 2159071 - protein, 8 aa, Cryptosporidium hominis
RKGVSNPP

SEQ ID NO: 2159072 - protein, 7 aa, Cryptosporidium hominis
RKGYPPQ

SEQ ID NO: 2159073 - protein, 19 aa, Cryptosporidium hominis
RKHSPSGKKMNKFSRKSRL

SEQ ID NO: 2159074 - protein, 8 aa, Cryptosporidium hominis
RKHTNNIS

SEQ ID NO: 2159075 - protein, 7 aa, Cryptosporidium hominis
RKIPKGP

SEQ ID NO: 2159076 - protein, 6 aa, Cryptosporidium hominis
RKIQSE

SEQ ID NO: 2159077 - protein, 7 aa, Cryptosporidium hominis
RKKAECD

SEQ ID NO: 2159078 - protein, 15 aa, Cryptosporidium hominis
RKKAKKEMEEATDPT

SEQ ID NO: 2159079 - protein, 17 aa, Cryptosporidium hominis
RKKAKTGIGPSTRESLR

SEQ ID NO: 2159080 - protein, 38 aa, Cryptosporidium hominis
RKKAQAELAQKSKYKPEYDSKSADYNDSVDESYAEAEK

SEQ ID NO: 2159081 - protein, 8 aa, Cryptosporidium hominis
RKKCSDSS

SEQ ID NO: 2159082 - protein, 26 aa, Cryptosporidium hominis
RKKDETPEDRRNRKQAVKQAKREMRD

SEQ ID NO: 2159083 - protein, 37 aa, Cryptosporidium hominis
RKKFKKNKKAVNRKLSDNRKKDDDIISSGRTSLILRS

SEQ ID NO: 2159084 - protein, 17 aa, Cryptosporidium hominis
RKKGNFGGTLSKDSIPE

SEQ ID NO: 2159085 - protein, 7 aa, Cryptosporidium hominis
RKKIQKS

SEQ ID NO: 2159086 - protein, 8 aa, Cryptosporidium hominis
RKKKDGKL

SEQ ID NO: 2159087 - protein, 15 aa, Cryptosporidium hominis
RKKMTSGDITQRQLG

SEQ ID NO: 2159088 - protein, 4 aa, Cryptosporidium hominis
RKKN

SEQ ID NO: 2159089 - protein, 8 aa, Cryptosporidium hominis
RKKNDLKV

SEQ ID NO: 2159090 - protein, 9 aa, Cryptosporidium hominis
RKKNGDELS

SEQ ID NO: 2159091 - protein, 12 aa, Cryptosporidium hominis
RKKNQENNERIY

SEQ ID NO: 2159092 - protein, 6 aa, Cryptosporidium hominis
RKKNYC

SEQ ID NO: 2159093 - protein, 7 aa, Cryptosporidium hominis
RKKRDGK

SEQ ID NO: 2159094 - protein, 6 aa, Cryptosporidium hominis
RKKRNN

SEQ ID NO: 2159095 - protein, 4 aa, Cryptosporidium hominis
RKKS

SEQ ID NO: 2159096 - protein, 7 aa, Cryptosporidium hominis
RKKSDGV

SEQ ID NO: 2159097 - protein, 5 aa, Cryptosporidium hominis
RKKSN

SEQ ID NO: 2159098 - protein, 25 aa, Cryptosporidium hominis
RKKVAEKKSPSKKRLQKQNSGVHEG

SEQ ID NO: 2159099 - protein, 14 aa, Cryptosporidium hominis
RKKVGEDENRARSL

SEQ ID NO: 2159100 - protein, 5 aa, Cryptosporidium hominis
RKKYG

SEQ ID NO: 2159101 - protein, 6 aa, Cryptosporidium hominis
RKLNKE

SEQ ID NO: 2159102 - protein, 10 aa, Cryptosporidium hominis
RKLRKEKKFD

SEQ ID NO: 2159103 - protein, 7 aa, Cryptosporidium hominis
RKNANLQ

SEQ ID NO: 2159104 - protein, 7 aa, Cryptosporidium hominis
RKNDHDK

SEQ ID NO: 2159105 - protein, 4 aa, Cryptosporidium hominis
RKNE

SEQ ID NO: 2159106 - protein, 11 aa, Cryptosporidium hominis
RKNEELNDEEF

SEQ ID NO: 2159107 - protein, 8 aa, Cryptosporidium hominis
RKNELTSS

SEQ ID NO: 2159108 - protein, 16 aa, Cryptosporidium hominis
RKNENKSKSHEKESII

SEQ ID NO: 2159109 - protein, 8 aa, Cryptosporidium hominis
RKNGGENN

SEQ ID NO: 2159110 - protein, 9 aa, Cryptosporidium hominis
RKNGTAGRL

SEQ ID NO: 2159111 - protein, 7 aa, Cryptosporidium hominis
RKNKDAD

SEQ ID NO: 2159112 - protein, 8 aa, Cryptosporidium hominis
RKNKLGDE

SEQ ID NO: 2159113 - protein, 8 aa, Cryptosporidium hominis
RKNKPEQT

SEQ ID NO: 2159114 - protein, 12 aa, Cryptosporidium hominis
RKNKQDTKNIKK

SEQ ID NO: 2159115 - protein, 8 aa, Cryptosporidium hominis
RKNNQYVN

SEQ ID NO: 2159116 - protein, 13 aa, Cryptosporidium hominis
RKNRGDSNTPAVE

SEQ ID NO: 2159117 - protein, 9 aa, Cryptosporidium hominis
RKNRGMDLT

SEQ ID NO: 2159118 - protein, 19 aa, Cryptosporidium hominis
RKNRSTKKGKYTNADAADL

SEQ ID NO: 2159119 - protein, 5 aa, Cryptosporidium hominis
RKNSM

SEQ ID NO: 2159120 - protein, 7 aa, Cryptosporidium hominis
RKNSNKQ

SEQ ID NO: 2159121 - protein, 29 aa, Cryptosporidium hominis
RKNSYENSNIENSNISSDFTDSKVNKNNS

SEQ ID NO: 2159122 - protein, 11 aa, Cryptosporidium hominis
RKNTSGSTEDK

SEQ ID NO: 2159123 - protein, 5 aa, Cryptosporidium hominis
RKPDQ

SEQ ID NO: 2159124 - protein, 30 aa, Cryptosporidium hominis
RKPGRHGSHKPDVTGLSAPGVPGGSEPASV

SEQ ID NO: 2159125 - protein, 15 aa, Cryptosporidium hominis
RKPITGDPRRRLPSN

SEQ ID NO: 2159126 - protein, 4 aa, Cryptosporidium hominis
RKPN

SEQ ID NO: 2159127 - protein, 5 aa, Cryptosporidium hominis
RKPPI

SEQ ID NO: 2159128 - protein, 6 aa, Cryptosporidium hominis
RKPPYI

SEQ ID NO: 2159129 - protein, 5 aa, Cryptosporidium hominis
RKPRV

SEQ ID NO: 2159130 - protein, 6 aa, Cryptosporidium hominis
RKPSNS

SEQ ID NO: 2159131 - protein, 9 aa, Cryptosporidium hominis
RKPVSPTLT

SEQ ID NO: 2159132 - protein, 4 aa, Cryptosporidium hominis
RKQC

SEQ ID NO: 2159133 - protein, 5 aa, Cryptosporidium hominis
RKQDL

SEQ ID NO: 2159134 - protein, 4 aa, Cryptosporidium hominis
RKQE

SEQ ID NO: 2159135 - protein, 9 aa, Cryptosporidium hominis
RKQEVPHDG

SEQ ID NO: 2159136 - protein, 8 aa, Cryptosporidium hominis
RKQEYGPE

SEQ ID NO: 2159137 - protein, 9 aa, Cryptosporidium hominis
RKQGNAPPR

SEQ ID NO: 2159138 - protein, 8 aa, Cryptosporidium hominis
RKQINEGK

SEQ ID NO: 2159139 - protein, 7 aa, Cryptosporidium hominis
RKQKKEV

SEQ ID NO: 2159140 - protein, 6 aa, Cryptosporidium hominis
RKQNVE

SEQ ID NO: 2159141 - protein, 4 aa, Cryptosporidium hominis
RKQP

SEQ ID NO: 2159142 - protein, 68 aa, Cryptosporidium hominis
RKQPPPSNSGGGAGGTLHNSQSKLNQHNKSQQHFQNGPSNNTAVENTTSISSEVEATSTSSKPANTTV

SEQ ID NO: 2159143 - protein, 4 aa, Cryptosporidium hominis
RKQS

SEQ ID NO: 2159144 - protein, 7 aa, Cryptosporidium hominis
RKQSDGV

SEQ ID NO: 2159145 - protein, 5 aa, Cryptosporidium hominis
RKRDA

SEQ ID NO: 2159146 - protein, 8 aa, Cryptosporidium hominis
RKRDRETI

SEQ ID NO: 2159147 - protein, 9 aa, Cryptosporidium hominis
RKREELRKS

SEQ ID NO: 2159148 - protein, 7 aa, Cryptosporidium hominis
RKRNISN

SEQ ID NO: 2159149 - protein, 5 aa, Cryptosporidium hominis
RKRRK

SEQ ID NO: 2159150 - protein, 8 aa, Cryptosporidium hominis
RKRRTAET

SEQ ID NO: 2159151 - protein, 5 aa, Cryptosporidium hominis
RKRSP

SEQ ID NO: 2159152 - protein, 9 aa, Cryptosporidium hominis
RKRSSNQSF

SEQ ID NO: 2159153 - protein, 8 aa, Cryptosporidium hominis
RKRTQRLE

SEQ ID NO: 2159154 - protein, 4 aa, Cryptosporidium hominis
RKRY

SEQ ID NO: 2159155 - protein, 5 aa, Cryptosporidium hominis
RKSAL

SEQ ID NO: 2159156 - protein, 9 aa, Cryptosporidium hominis
RKSDNNRIA

SEQ ID NO: 2159157 - protein, 6 aa, Cryptosporidium hominis
RKSEEL

SEQ ID NO: 2159158 - protein, 13 aa, Cryptosporidium hominis
RKSERQRIDQSGV

SEQ ID NO: 2159159 - protein, 7 aa, Cryptosporidium hominis
RKSESHA

SEQ ID NO: 2159160 - protein, 9 aa, Cryptosporidium hominis
RKSGENNVG

SEQ ID NO: 2159161 - protein, 14 aa, Cryptosporidium hominis
RKSGRFGGTLSPPY

SEQ ID NO: 2159162 - protein, 7 aa, Cryptosporidium hominis
RKSGSAY

SEQ ID NO: 2159163 - protein, 8 aa, Cryptosporidium hominis
RKSGSGVI

SEQ ID NO: 2159164 - protein, 7 aa, Cryptosporidium hominis
RKSISEK

SEQ ID NO: 2159165 - protein, 14 aa, Cryptosporidium hominis
RKSKEKETSNSQEI

SEQ ID NO: 2159166 - protein, 9 aa, Cryptosporidium hominis
RKSKKNATN

SEQ ID NO: 2159167 - protein, 15 aa, Cryptosporidium hominis
RKSKKNLSSSERRSK

SEQ ID NO: 2159168 - protein, 16 aa, Cryptosporidium hominis
RKSKMAELQGETEELG

SEQ ID NO: 2159169 - protein, 7 aa, Cryptosporidium hominis
RKSKRIQ

SEQ ID NO: 2159170 - protein, 9 aa, Cryptosporidium hominis
RKSKTFSSR

SEQ ID NO: 2159171 - protein, 9 aa, Cryptosporidium hominis
RKSKTSDIS

SEQ ID NO: 2159172 - protein, 7 aa, Cryptosporidium hominis
RKSNGDI

SEQ ID NO: 2159173 - protein, 5 aa, Cryptosporidium hominis
RKSNK

SEQ ID NO: 2159174 - protein, 28 aa, Cryptosporidium hominis
RKSQKLVKKEDSSNSLKENDTEEKIQKT

SEQ ID NO: 2159175 - protein, 9 aa, Cryptosporidium hominis
RKSRQDEIN

SEQ ID NO: 2159176 - protein, 14 aa, Cryptosporidium hominis
RKSRRDGKKNPATI

SEQ ID NO: 2159177 - protein, 7 aa, Cryptosporidium hominis
RKSSEHI

SEQ ID NO: 2159178 - protein, 16 aa, Cryptosporidium hominis
RKSSGSTSNLSNPTSI

SEQ ID NO: 2159179 - protein, 6 aa, Cryptosporidium hominis
RKSSQS

SEQ ID NO: 2159180 - protein, 10 aa, Cryptosporidium hominis
RKSSQVITDS

SEQ ID NO: 2159181 - protein, 8 aa, Cryptosporidium hominis
RKSYKDSK

SEQ ID NO: 2159182 - protein, 7 aa, Cryptosporidium hominis
RKTHKDL

SEQ ID NO: 2159183 - protein, 4 aa, Cryptosporidium hominis
RKTN

SEQ ID NO: 2159184 - protein, 9 aa, Cryptosporidium hominis
RKTNNISSN

SEQ ID NO: 2159185 - protein, 8 aa, Cryptosporidium hominis
RKTPEPMK

SEQ ID NO: 2159186 - protein, 7 aa, Cryptosporidium hominis
RKTPGFV

SEQ ID NO: 2159187 - protein, 17 aa, Cryptosporidium hominis
RKTQFTKNQSFIIDLPN

SEQ ID NO: 2159188 - protein, 12 aa, Cryptosporidium hominis
RKTQSGAPKDAL

SEQ ID NO: 2159189 - protein, 11 aa, Cryptosporidium hominis
RKTSDGRDNTL

SEQ ID NO: 2159190 - protein, 7 aa, Cryptosporidium hominis
RKTSQQP

SEQ ID NO: 2159191 - protein, 4 aa, Cryptosporidium hominis
RKTV

SEQ ID NO: 2159192 - protein, 6 aa, Cryptosporidium hominis
RKVSRH

SEQ ID NO: 2159193 - protein, 7 aa, Cryptosporidium hominis
RKYDEGM

SEQ ID NO: 2159194 - protein, 12 aa, Cryptosporidium hominis
RKYERNNQSSIS

SEQ ID NO: 2159195 - protein, 9 aa, Cryptosporidium hominis
RKYNTNERA

SEQ ID NO: 2159196 - protein, 13 aa, Cryptosporidium hominis
RKYRSKAEDSKNF

SEQ ID NO: 2159197 - protein, 12 aa, Cryptosporidium hominis
RLAKTGKKFDSG

SEQ ID NO: 2159198 - protein, 18 aa, Cryptosporidium hominis
RLANTNGRKAKRKARERY

SEQ ID NO: 2159199 - protein, 5 aa, Cryptosporidium hominis
RLASG

SEQ ID NO: 2159200 - protein, 6 aa, Cryptosporidium hominis
RLASNK

SEQ ID NO: 2159201 - protein, 17 aa, Cryptosporidium hominis
RLDNTDLKNKDENQKMD

SEQ ID NO: 2159202 - protein, 12 aa, Cryptosporidium hominis
RLEDPSDNEKCK

SEQ ID NO: 2159203 - protein, 10 aa, Cryptosporidium hominis
RLEEQKANNR

SEQ ID NO: 2159204 - protein, 12 aa, Cryptosporidium hominis
RLEKERKERMNL

SEQ ID NO: 2159205 - protein, 9 aa, Cryptosporidium hominis
RLEKQEDTL

SEQ ID NO: 2159206 - protein, 15 aa, Cryptosporidium hominis
RLERSDKEKEDYKRL

SEQ ID NO: 2159207 - protein, 10 aa, Cryptosporidium hominis
RLETGRKVSP

SEQ ID NO: 2159208 - protein, 7 aa, Cryptosporidium hominis
RLGDQGR

SEQ ID NO: 2159209 - protein, 4 aa, Cryptosporidium hominis
RLKD

SEQ ID NO: 2159210 - protein, 10 aa, Cryptosporidium hominis
RLKGKDGRIR

SEQ ID NO: 2159211 - protein, 20 aa, Cryptosporidium hominis
RLKGQSSAQSSGLENSALSK

SEQ ID NO: 2159212 - protein, 33 aa, Cryptosporidium hominis
RLKGTQRSMRDYEGSYSGESTGLKDNVKRSTNL

SEQ ID NO: 2159213 - protein, 18 aa, Cryptosporidium hominis
RLKNKDKKPYLTPKKTNG

SEQ ID NO: 2159214 - protein, 11 aa, Cryptosporidium hominis
RLKNKDSDTIS

SEQ ID NO: 2159215 - protein, 7 aa, Cryptosporidium hominis
RLKNSKS

SEQ ID NO: 2159216 - protein, 4 aa, Cryptosporidium hominis
RLKQ

SEQ ID NO: 2159217 - protein, 4 aa, Cryptosporidium hominis
RLNK

SEQ ID NO: 2159218 - protein, 10 aa, Cryptosporidium hominis
RLNPNRREKL

SEQ ID NO: 2159219 - protein, 9 aa, Cryptosporidium hominis
RLNRSQREE

SEQ ID NO: 2159220 - protein, 6 aa, Cryptosporidium hominis
RLPKNI

SEQ ID NO: 2159221 - protein, 17 aa, Cryptosporidium hominis
RLPPPPPPISPSPPTYK

SEQ ID NO: 2159222 - protein, 14 aa, Cryptosporidium hominis
RLPRGHSPAPNRID

SEQ ID NO: 2159223 - protein, 6 aa, Cryptosporidium hominis
RLPSNI

SEQ ID NO: 2159224 - protein, 8 aa, Cryptosporidium hominis
RLPSPTQS

SEQ ID NO: 2159225 - protein, 9 aa, Cryptosporidium hominis
RLQGKSYSF

SEQ ID NO: 2159226 - protein, 36 aa, Cryptosporidium hominis
RLQGSTGGKAETGNPEDSNLSNNKDNSNIKDGLSTD

SEQ ID NO: 2159227 - protein, 6 aa, Cryptosporidium hominis
RLRGTS

SEQ ID NO: 2159228 - protein, 21 aa, Cryptosporidium hominis
RLRKKEEDGNAFENKQDSHIY

SEQ ID NO: 2159229 - protein, 25 aa, Cryptosporidium hominis
RLRRPQNEDSSESKKSISKDTESII

SEQ ID NO: 2159230 - protein, 7 aa, Cryptosporidium hominis
RLRTDTA

SEQ ID NO: 2159231 - protein, 4 aa, Cryptosporidium hominis
RLSE

SEQ ID NO: 2159232 - protein, 4 aa, Cryptosporidium hominis
RLSG

SEQ ID NO: 2159233 - protein, 10 aa, Cryptosporidium hominis
RLSKNLDKGI

SEQ ID NO: 2159234 - protein, 12 aa, Cryptosporidium hominis
RLSNEKKIKDLQ

SEQ ID NO: 2159235 - protein, 36 aa, Cryptosporidium hominis
RMEDKVENKIEDSNQLEAKPEELQDSEASLKKKERR

SEQ ID NO: 2159236 - protein, 5 aa, Cryptosporidium hominis
RMERK

SEQ ID NO: 2159237 - protein, 10 aa, Cryptosporidium hominis
RMERNENKIS

SEQ ID NO: 2159238 - protein, 27 aa, Cryptosporidium hominis
RMKKGGKHQRDEEKKEKTKHGKKKRAP

SEQ ID NO: 2159239 - protein, 4 aa, Cryptosporidium hominis
RMNG

SEQ ID NO: 2159240 - protein, 7 aa, Cryptosporidium hominis
RMNPRQT

SEQ ID NO: 2159241 - protein, 11 aa, Cryptosporidium hominis
RMNTGKENKVD

SEQ ID NO: 2159242 - protein, 6 aa, Cryptosporidium hominis
RMRPGA

SEQ ID NO: 2159243 - protein, 9 aa, Cryptosporidium hominis
RNADNGEST

SEQ ID NO: 2159244 - protein, 9 aa, Cryptosporidium hominis
RNAETYSQN

SEQ ID NO: 2159245 - protein, 9 aa, Cryptosporidium hominis
RNAEYNPKK

SEQ ID NO: 2159246 - protein, 10 aa, Cryptosporidium hominis
RNARKMEPIS

SEQ ID NO: 2159247 - protein, 7 aa, Cryptosporidium hominis
RNASERD

SEQ ID NO: 2159248 - protein, 5 aa, Cryptosporidium hominis
RNDAG

SEQ ID NO: 2159249 - protein, 7 aa, Cryptosporidium hominis
RNDDGRQ

SEQ ID NO: 2159250 - protein, 7 aa, Cryptosporidium hominis
RNDEKKC

SEQ ID NO: 2159251 - protein, 9 aa, Cryptosporidium hominis
RNDNREKRS

SEQ ID NO: 2159252 - protein, 8 aa, Cryptosporidium hominis
RNDQEKIN

SEQ ID NO: 2159253 - protein, 7 aa, Cryptosporidium hominis
RNDQGQI

SEQ ID NO: 2159254 - protein, 6 aa, Cryptosporidium hominis
RNDSYN

SEQ ID NO: 2159255 - protein, 5 aa, Cryptosporidium hominis
RNDTG

SEQ ID NO: 2159256 - protein, 17 aa, Cryptosporidium hominis
RNEAGKASHISLPPSNK

SEQ ID NO: 2159257 - protein, 8 aa, Cryptosporidium hominis
RNEASSET

SEQ ID NO: 2159258 - protein, 6 aa, Cryptosporidium hominis
RNEDAQ

SEQ ID NO: 2159259 - protein, 20 aa, Cryptosporidium hominis
RNEDEVSDDEMEEINQEKKA

SEQ ID NO: 2159260 - protein, 9 aa, Cryptosporidium hominis
RNEDNSRGK

SEQ ID NO: 2159261 - protein, 14 aa, Cryptosporidium hominis
RNEDVNKEQTNTIR

SEQ ID NO: 2159262 - protein, 18 aa, Cryptosporidium hominis
RNEELSTFNSENTIENSQ

SEQ ID NO: 2159263 - protein, 6 aa, Cryptosporidium hominis
RNEESK

SEQ ID NO: 2159264 - protein, 9 aa, Cryptosporidium hominis
RNEIRPYGY

SEQ ID NO: 2159265 - protein, 10 aa, Cryptosporidium hominis
RNEKEKIKEW

SEQ ID NO: 2159266 - protein, 5 aa, Cryptosporidium hominis
RNELS

SEQ ID NO: 2159267 - protein, 7 aa, Cryptosporidium hominis
RNENIPV

SEQ ID NO: 2159268 - protein, 5 aa, Cryptosporidium hominis
RNENV

SEQ ID NO: 2159269 - protein, 15 aa, Cryptosporidium hominis
RNERYGDYQDEEEYN

SEQ ID NO: 2159270 - protein, 7 aa, Cryptosporidium hominis
RNESKNP

SEQ ID NO: 2159271 - protein, 7 aa, Cryptosporidium hominis
RNESNAY

SEQ ID NO: 2159272 - protein, 14 aa, Cryptosporidium hominis
RNESNNLPELKTST

SEQ ID NO: 2159273 - protein, 7 aa, Cryptosporidium hominis
RNESPQI

SEQ ID NO: 2159274 - protein, 15 aa, Cryptosporidium hominis
RNETPDLIPKDKGNM

SEQ ID NO: 2159275 - protein, 5 aa, Cryptosporidium hominis
RNEVK

SEQ ID NO: 2159276 - protein, 6 aa, Cryptosporidium hominis
RNFHRN

SEQ ID NO: 2159277 - protein, 6 aa, Cryptosporidium hominis
RNFNSD

SEQ ID NO: 2159278 - protein, 6 aa, Cryptosporidium hominis
RNFSRS

SEQ ID NO: 2159279 - protein, 5 aa, Cryptosporidium hominis
RNGAE

SEQ ID NO: 2159280 - protein, 4 aa, Cryptosporidium hominis
RNGE

SEQ ID NO: 2159281 - protein, 6 aa, Cryptosporidium hominis
RNGEIS

SEQ ID NO: 2159282 - protein, 20 aa, Cryptosporidium hominis
RNGGFQQKPGENSGLTNSGH

SEQ ID NO: 2159283 - protein, 5 aa, Cryptosporidium hominis
RNGHP

SEQ ID NO: 2159284 - protein, 11 aa, Cryptosporidium hominis
RNGLDPEDPEE

SEQ ID NO: 2159285 - protein, 7 aa, Cryptosporidium hominis
RNGNNEG

SEQ ID NO: 2159286 - protein, 6 aa, Cryptosporidium hominis
RNGRHS

SEQ ID NO: 2159287 - protein, 6 aa, Cryptosporidium hominis
RNHSNY

SEQ ID NO: 2159288 - protein, 9 aa, Cryptosporidium hominis
RNIDSKSKD

SEQ ID NO: 2159289 - protein, 7 aa, Cryptosporidium hominis
RNIEEDD

SEQ ID NO: 2159290 - protein, 5 aa, Cryptosporidium hominis
RNIET

SEQ ID NO: 2159291 - protein, 8 aa, Cryptosporidium hominis
RNIRKGDQ

SEQ ID NO: 2159292 - protein, 13 aa, Cryptosporidium hominis
RNISNSNEKNRDI

SEQ ID NO: 2159293 - protein, 6 aa, Cryptosporidium hominis
RNITED

SEQ ID NO: 2159294 - protein, 14 aa, Cryptosporidium hominis
RNKDKEEAKQVKVT

SEQ ID NO: 2159295 - protein, 19 aa, Cryptosporidium hominis
RNKDRNNDPISIGEAIKMC

SEQ ID NO: 2159296 - protein, 6 aa, Cryptosporidium hominis
RNKEKM

SEQ ID NO: 2159297 - protein, 4 aa, Cryptosporidium hominis
RNKK

SEQ ID NO: 2159298 - protein, 7 aa, Cryptosporidium hominis
RNKKELA

SEQ ID NO: 2159299 - protein, 5 aa, Cryptosporidium hominis
RNKNA

SEQ ID NO: 2159300 - protein, 16 aa, Cryptosporidium hominis
RNKNDTAIGNSENMSR

SEQ ID NO: 2159301 - protein, 9 aa, Cryptosporidium hominis
RNKPPSRKL

SEQ ID NO: 2159302 - protein, 8 aa, Cryptosporidium hominis
RNKPPTKA

SEQ ID NO: 2159303 - protein, 5 aa, Cryptosporidium hominis
RNKRR

SEQ ID NO: 2159304 - protein, 10 aa, Cryptosporidium hominis
RNKSEESGYD

SEQ ID NO: 2159305 - protein, 8 aa, Cryptosporidium hominis
RNKSGQTT

SEQ ID NO: 2159306 - protein, 11 aa, Cryptosporidium hominis
RNKSQPPQQNL

SEQ ID NO: 2159307 - protein, 6 aa, Cryptosporidium hominis
RNKYNS

SEQ ID NO: 2159308 - protein, 34 aa, Cryptosporidium hominis
RNLGRARAQTRGPFSRTAASRSTTPTPMNRTTNL

SEQ ID NO: 2159309 - protein, 6 aa, Cryptosporidium hominis
RNLPPI

SEQ ID NO: 2159310 - protein, 18 aa, Cryptosporidium hominis
RNLQAGENTNMEDGGEAS

SEQ ID NO: 2159311 - protein, 6 aa, Cryptosporidium hominis
RNLRDN

SEQ ID NO: 2159312 - protein, 23 aa, Cryptosporidium hominis
RNLSETTNTNINTNNINNSSTPV

SEQ ID NO: 2159313 - protein, 13 aa, Cryptosporidium hominis
RNMKSKTENIING

SEQ ID NO: 2159314 - protein, 16 aa, Cryptosporidium hominis
RNMTPTDEEREKYDSE

SEQ ID NO: 2159315 - protein, 10 aa, Cryptosporidium hominis
RNNAKNTELN

SEQ ID NO: 2159316 - protein, 5 aa, Cryptosporidium hominis
RNNDE

SEQ ID NO: 2159317 - protein, 17 aa, Cryptosporidium hominis
RNNEFPNATKPSQIGGD

SEQ ID NO: 2159318 - protein, 9 aa, Cryptosporidium hominis
RNNGKKNQA

SEQ ID NO: 2159319 - protein, 7 aa, Cryptosporidium hominis
RNNKSIE

SEQ ID NO: 2159320 - protein, 4 aa, Cryptosporidium hominis
RNNL

SEQ ID NO: 2159321 - protein, 21 aa, Cryptosporidium hominis
RNNLSNNTLNKDYDPGSEPNC

SEQ ID NO: 2159322 - protein, 6 aa, Cryptosporidium hominis
RNNNNT

SEQ ID NO: 2159323 - protein, 10 aa, Cryptosporidium hominis
RNNQGKITRE

SEQ ID NO: 2159324 - protein, 5 aa, Cryptosporidium hominis
RNNSP

SEQ ID NO: 2159325 - protein, 5 aa, Cryptosporidium hominis
RNNTN

SEQ ID NO: 2159326 - protein, 4 aa, Cryptosporidium hominis
RNNV

SEQ ID NO: 2159327 - protein, 6 aa, Cryptosporidium hominis
RNPIEG

SEQ ID NO: 2159328 - protein, 5 aa, Cryptosporidium hominis
RNPQL

SEQ ID NO: 2159329 - protein, 10 aa, Cryptosporidium hominis
RNPSDKDKIC

SEQ ID NO: 2159330 - protein, 7 aa, Cryptosporidium hominis
RNPTNHV

SEQ ID NO: 2159331 - protein, 4 aa, Cryptosporidium hominis
RNPV

SEQ ID NO: 2159332 - protein, 4 aa, Cryptosporidium hominis
RNQE

SEQ ID NO: 2159333 - protein, 4 aa, Cryptosporidium hominis
RNQI

SEQ ID NO: 2159334 - protein, 5 aa, Cryptosporidium hominis
RNQKR

SEQ ID NO: 2159335 - protein, 7 aa, Cryptosporidium hominis
RNQNGIK

SEQ ID NO: 2159336 - protein, 6 aa, Cryptosporidium hominis
RNQNKH

SEQ ID NO: 2159337 - protein, 17 aa, Cryptosporidium hominis
RNQNQAQTSSCSRSGRV

SEQ ID NO: 2159338 - protein, 4 aa, Cryptosporidium hominis
RNQP

SEQ ID NO: 2159339 - protein, 20 aa, Cryptosporidium hominis
RNQQQVNTSSAATLSYTNNG

SEQ ID NO: 2159340 - protein, 11 aa, Cryptosporidium hominis
RNQRKKKEKTL

SEQ ID NO: 2159341 - protein, 7 aa, Cryptosporidium hominis
RNQRYQP

SEQ ID NO: 2159342 - protein, 13 aa, Cryptosporidium hominis
RNQTSSSGNNPVN

SEQ ID NO: 2159343 - protein, 23 aa, Cryptosporidium hominis
RNRISGSSNSQQAVNDSAQGKLE

SEQ ID NO: 2159344 - protein, 19 aa, Cryptosporidium hominis
RNRNNSVPPPRPKNELNSE

SEQ ID NO: 2159345 - protein, 17 aa, Cryptosporidium hominis
RNRPRYRNGKKVPPPLP

SEQ ID NO: 2159346 - protein, 4 aa, Cryptosporidium hominis
RNRR

SEQ ID NO: 2159347 - protein, 15 aa, Cryptosporidium hominis
RNRRGKSSKGRKVSG

SEQ ID NO: 2159348 - protein, 5 aa, Cryptosporidium hominis
RNRSK

SEQ ID NO: 2159349 - protein, 9 aa, Cryptosporidium hominis
RNRSNKAIK

SEQ ID NO: 2159350 - protein, 7 aa, Cryptosporidium hominis
RNRSSST

SEQ ID NO: 2159351 - protein, 14 aa, Cryptosporidium hominis
RNRVLKDSDEKNIV

SEQ ID NO: 2159352 - protein, 14 aa, Cryptosporidium hominis
RNSAKSKPEKSYGE

SEQ ID NO: 2159353 - protein, 13 aa, Cryptosporidium hominis
RNSDNSSGSSRNR

SEQ ID NO: 2159354 - protein, 12 aa, Cryptosporidium hominis
RNSDRLNGENAI

SEQ ID NO: 2159355 - protein, 12 aa, Cryptosporidium hominis
RNSEADVSKDSD

SEQ ID NO: 2159356 - protein, 5 aa, Cryptosporidium hominis
RNSGF

SEQ ID NO: 2159357 - protein, 9 aa, Cryptosporidium hominis
RNSGRNRGL

SEQ ID NO: 2159358 - protein, 7 aa, Cryptosporidium hominis
RNSGSLV

SEQ ID NO: 2159359 - protein, 6 aa, Cryptosporidium hominis
RNSHPD

SEQ ID NO: 2159360 - protein, 9 aa, Cryptosporidium hominis
RNSINGNNI

SEQ ID NO: 2159361 - protein, 11 aa, Cryptosporidium hominis
RNSKDVDKSRL

SEQ ID NO: 2159362 - protein, 7 aa, Cryptosporidium hominis
RNSKVDP

SEQ ID NO: 2159363 - protein, 15 aa, Cryptosporidium hominis
RNSLNASRKVTEKSE

SEQ ID NO: 2159364 - protein, 6 aa, Cryptosporidium hominis
RNSLNY

SEQ ID NO: 2159365 - protein, 5 aa, Cryptosporidium hominis
RNSPL

SEQ ID NO: 2159366 - protein, 15 aa, Cryptosporidium hominis
RNSRSKGTTEEINPN

SEQ ID NO: 2159367 - protein, 15 aa, Cryptosporidium hominis
RNSSERKHSKEHDKR

SEQ ID NO: 2159368 - protein, 21 aa, Cryptosporidium hominis
RNSSNNSNNSNNIGSSSPADI

SEQ ID NO: 2159369 - protein, 6 aa, Cryptosporidium hominis
RNSSST

SEQ ID NO: 2159370 - protein, 5 aa, Cryptosporidium hominis
RNSTK

SEQ ID NO: 2159371 - protein, 5 aa, Cryptosporidium hominis
RNSTV

SEQ ID NO: 2159372 - protein, 10 aa, Cryptosporidium hominis
RNTAENSLNE

SEQ ID NO: 2159373 - protein, 15 aa, Cryptosporidium hominis
RNTDKINGSSTSTVA

SEQ ID NO: 2159374 - protein, 16 aa, Cryptosporidium hominis
RNTDKYKTVIKKITTK

SEQ ID NO: 2159375 - protein, 5 aa, Cryptosporidium hominis
RNTEI

SEQ ID NO: 2159376 - protein, 16 aa, Cryptosporidium hominis
RNTENGENHASPSHYQ

SEQ ID NO: 2159377 - protein, 4 aa, Cryptosporidium hominis
RNTF

SEQ ID NO: 2159378 - protein, 9 aa, Cryptosporidium hominis
RNTGTVSQT

SEQ ID NO: 2159379 - protein, 5 aa, Cryptosporidium hominis
RNTND

SEQ ID NO: 2159380 - protein, 30 aa, Cryptosporidium hominis
RNTRRGKATLEKADDAEKTHGEGAERGDEL

SEQ ID NO: 2159381 - protein, 4 aa, Cryptosporidium hominis
RNVA

SEQ ID NO: 2159382 - protein, 16 aa, Cryptosporidium hominis
RNVNPNRRGGKLKPRH

SEQ ID NO: 2159383 - protein, 6 aa, Cryptosporidium hominis
RNYEEN

SEQ ID NO: 2159384 - protein, 4 aa, Cryptosporidium hominis
RNYP

SEQ ID NO: 2159385 - protein, 5 aa, Cryptosporidium hominis
RNYQS

SEQ ID NO: 2159386 - protein, 4 aa, Cryptosporidium hominis
RNYY

SEQ ID NO: 2159387 - protein, 5 aa, Cryptosporidium hominis
RPANS

SEQ ID NO: 2159388 - protein, 6 aa, Cryptosporidium hominis
RPARSS

SEQ ID NO: 2159389 - protein, 5 aa, Cryptosporidium hominis
RPDET

SEQ ID NO: 2159390 - protein, 4 aa, Cryptosporidium hominis
RPDV

SEQ ID NO: 2159391 - protein, 4 aa, Cryptosporidium hominis
RPDY

SEQ ID NO: 2159392 - protein, 5 aa, Cryptosporidium hominis
RPEKL

SEQ ID NO: 2159393 - protein, 14 aa, Cryptosporidium hominis
RPEMTAEDAGLQEG

SEQ ID NO: 2159394 - protein, 8 aa, Cryptosporidium hominis
RPENPNSP

SEQ ID NO: 2159395 - protein, 5 aa, Cryptosporidium hominis
RPENR

SEQ ID NO: 2159396 - protein, 5 aa, Cryptosporidium hominis
RPEVD

SEQ ID NO: 2159397 - protein, 6 aa, Cryptosporidium hominis
RPFPKT

SEQ ID NO: 2159398 - protein, 5 aa, Cryptosporidium hominis
RPGDL

SEQ ID NO: 2159399 - protein, 4 aa, Cryptosporidium hominis
RPGF

SEQ ID NO: 2159400 - protein, 12 aa, Cryptosporidium hominis
RPGGFNRPLSPT

SEQ ID NO: 2159401 - protein, 9 aa, Cryptosporidium hominis
RPGHSKEQC

SEQ ID NO: 2159402 - protein, 8 aa, Cryptosporidium hominis
RPGKLSQR

SEQ ID NO: 2159403 - protein, 6 aa, Cryptosporidium hominis
RPGNRV

SEQ ID NO: 2159404 - protein, 5 aa, Cryptosporidium hominis
RPGQS

SEQ ID NO: 2159405 - protein, 8 aa, Cryptosporidium hominis
RPGSESSF

SEQ ID NO: 2159406 - protein, 9 aa, Cryptosporidium hominis
RPGSVLGPQ

SEQ ID NO: 2159407 - protein, 5 aa, Cryptosporidium hominis
RPGTS

SEQ ID NO: 2159408 - protein, 14 aa, Cryptosporidium hominis
RPGTSPPANYGANR

SEQ ID NO: 2159409 - protein, 61 aa, Cryptosporidium hominis
RPHTNGGITSSSSIQANTSSNTNISTSNTKLEQQQITGSGISGGGIGGGMGSSSAYNHQNH

SEQ ID NO: 2159410 - protein, 5 aa, Cryptosporidium hominis
RPIAN

SEQ ID NO: 2159411 - protein, 8 aa, Cryptosporidium hominis
RPISTSRE

SEQ ID NO: 2159412 - protein, 4 aa, Cryptosporidium hominis
RPIT

SEQ ID NO: 2159413 - protein, 20 aa, Cryptosporidium hominis
RPITRQPLEDPNKPKRPHNA

SEQ ID NO: 2159414 - protein, 7 aa, Cryptosporidium hominis
RPKDGRS

SEQ ID NO: 2159415 - protein, 9 aa, Cryptosporidium hominis
RPKDNKELP

SEQ ID NO: 2159416 - protein, 8 aa, Cryptosporidium hominis
RPKDPLEL

SEQ ID NO: 2159417 - protein, 5 aa, Cryptosporidium hominis
RPKDV

SEQ ID NO: 2159418 - protein, 10 aa, Cryptosporidium hominis
RPKERSPEEV

SEQ ID NO: 2159419 - protein, 7 aa, Cryptosporidium hominis
RPKKDGA

SEQ ID NO: 2159420 - protein, 4 aa, Cryptosporidium hominis
RPKM

SEQ ID NO: 2159421 - protein, 10 aa, Cryptosporidium hominis
RPKREEKNRV

SEQ ID NO: 2159422 - protein, 9 aa, Cryptosporidium hominis
RPKSFSERA

SEQ ID NO: 2159423 - protein, 5 aa, Cryptosporidium hominis
RPLEG

SEQ ID NO: 2159424 - protein, 6 aa, Cryptosporidium hominis
RPLTEN

SEQ ID NO: 2159425 - protein, 6 aa, Cryptosporidium hominis
RPNLGD

SEQ ID NO: 2159426 - protein, 5 aa, Cryptosporidium hominis
RPNQC

SEQ ID NO: 2159427 - protein, 17 aa, Cryptosporidium hominis
RPNSGSATSNSVVPNKD

SEQ ID NO: 2159428 - protein, 8 aa, Cryptosporidium hominis
RPNTFTNN

SEQ ID NO: 2159429 - protein, 5 aa, Cryptosporidium hominis
RPPDL

SEQ ID NO: 2159430 - protein, 15 aa, Cryptosporidium hominis
RPPEAYETGSLYDPT

SEQ ID NO: 2159431 - protein, 14 aa, Cryptosporidium hominis
RPPEQFSESPENRD

SEQ ID NO: 2159432 - protein, 9 aa, Cryptosporidium hominis
RPPGQVEER

SEQ ID NO: 2159433 - protein, 7 aa, Cryptosporidium hominis
RPPKEEL

SEQ ID NO: 2159434 - protein, 12 aa, Cryptosporidium hominis
RPPNEAEKTHGN

SEQ ID NO: 2159435 - protein, 8 aa, Cryptosporidium hominis
RPPPPPPL

SEQ ID NO: 2159436 - protein, 6 aa, Cryptosporidium hominis
RPPRDR

SEQ ID NO: 2159437 - protein, 4 aa, Cryptosporidium hominis
RPPS

SEQ ID NO: 2159438 - protein, 17 aa, Cryptosporidium hominis
RPPTAPNSISKSSSLPK

SEQ ID NO: 2159439 - protein, 12 aa, Cryptosporidium hominis
RPQFANSSALGG

SEQ ID NO: 2159440 - protein, 43 aa, Cryptosporidium hominis
RPQMKHKEKEGAEHDKAKNTHSTGDTVITGGTEERDSASPSIK

SEQ ID NO: 2159441 - protein, 18 aa, Cryptosporidium hominis
RPQRPRPSSRKGKLSARN

SEQ ID NO: 2159442 - protein, 5 aa, Cryptosporidium hominis
RPRGN

SEQ ID NO: 2159443 - protein, 4 aa, Cryptosporidium hominis
RPRR

SEQ ID NO: 2159444 - protein, 6 aa, Cryptosporidium hominis
RPRRRC

SEQ ID NO: 2159445 - protein, 11 aa, Cryptosporidium hominis
RPRRTGEMKRK

SEQ ID NO: 2159446 - protein, 6 aa, Cryptosporidium hominis
RPRTIE

SEQ ID NO: 2159447 - protein, 7 aa, Cryptosporidium hominis
RPSCGHK

SEQ ID NO: 2159448 - protein, 7 aa, Cryptosporidium hominis
RPSEQVP

SEQ ID NO: 2159449 - protein, 31 aa, Cryptosporidium hominis
RPSFGHSNENSSTERNFEHDDNDEDRTYLDE

SEQ ID NO: 2159450 - protein, 5 aa, Cryptosporidium hominis
RPSGL

SEQ ID NO: 2159451 - protein, 4 aa, Cryptosporidium hominis
RPSI

SEQ ID NO: 2159452 - protein, 7 aa, Cryptosporidium hominis
RPSIYKS

SEQ ID NO: 2159453 - protein, 6 aa, Cryptosporidium hominis
RPSNQL

SEQ ID NO: 2159454 - protein, 7 aa, Cryptosporidium hominis
RPSPSHS

SEQ ID NO: 2159455 - protein, 4 aa, Cryptosporidium hominis
RPSR

SEQ ID NO: 2159456 - protein, 8 aa, Cryptosporidium hominis
RPSSGPHK

SEQ ID NO: 2159457 - protein, 5 aa, Cryptosporidium hominis
RPSSK

SEQ ID NO: 2159458 - protein, 6 aa, Cryptosporidium hominis
RPSSVQ

SEQ ID NO: 2159459 - protein, 5 aa, Cryptosporidium hominis
RPSVE

SEQ ID NO: 2159460 - protein, 4 aa, Cryptosporidium hominis
RPTI

SEQ ID NO: 2159461 - protein, 10 aa, Cryptosporidium hominis
RPTIGQGRRQ

SEQ ID NO: 2159462 - protein, 5 aa, Cryptosporidium hominis
RPTPD

SEQ ID NO: 2159463 - protein, 5 aa, Cryptosporidium hominis
RPTPL

SEQ ID NO: 2159464 - protein, 7 aa, Cryptosporidium hominis
RPTSSNI

SEQ ID NO: 2159465 - protein, 8 aa, Cryptosporidium hominis
RPTTQNAL

SEQ ID NO: 2159466 - protein, 4 aa, Cryptosporidium hominis
RPTV

SEQ ID NO: 2159467 - protein, 4 aa, Cryptosporidium hominis
RPTY

SEQ ID NO: 2159468 - protein, 5 aa, Cryptosporidium hominis
RPWER

SEQ ID NO: 2159469 - protein, 4 aa, Cryptosporidium hominis
RPYA

SEQ ID NO: 2159470 - protein, 8 aa, Cryptosporidium hominis
RPYGSRPA

SEQ ID NO: 2159471 - protein, 25 aa, Cryptosporidium hominis
RQAGQRRQSGAGLTSTASGRNLGSN

SEQ ID NO: 2159472 - protein, 14 aa, Cryptosporidium hominis
RQDDKEDPITGEKR

SEQ ID NO: 2159473 - protein, 10 aa, Cryptosporidium hominis
RQDKTTTQRE

SEQ ID NO: 2159474 - protein, 10 aa, Cryptosporidium hominis
RQDPNSNSNS

SEQ ID NO: 2159475 - protein, 5 aa, Cryptosporidium hominis
RQDQT

SEQ ID NO: 2159476 - protein, 7 aa, Cryptosporidium hominis
RQDSHPV

SEQ ID NO: 2159477 - protein, 6 aa, Cryptosporidium hominis
RQDSSQ

SEQ ID NO: 2159478 - protein, 10 aa, Cryptosporidium hominis
RQEDPTTKKL

SEQ ID NO: 2159479 - protein, 9 aa, Cryptosporidium hominis
RQEKEMERQ

SEQ ID NO: 2159480 - protein, 7 aa, Cryptosporidium hominis
RQEPKSE

SEQ ID NO: 2159481 - protein, 63 aa, Cryptosporidium hominis
RQEPSGNKSISQINGDKPKKYDGQSEISHNNKYSRKNSESKNLASSSSKSQDNSRNVESEAAS

SEQ ID NO: 2159482 - protein, 27 aa, Cryptosporidium hominis
RQESRKAEKSRKSIKSNIGGRRKIDKS

SEQ ID NO: 2159483 - protein, 11 aa, Cryptosporidium hominis
RQFTNKPQGRK

SEQ ID NO: 2159484 - protein, 4 aa, Cryptosporidium hominis
RQGE

SEQ ID NO: 2159485 - protein, 16 aa, Cryptosporidium hominis
RQGKDESETKNNGLSQ

SEQ ID NO: 2159486 - protein, 16 aa, Cryptosporidium hominis
RQGSKLSRTSFNTART

SEQ ID NO: 2159487 - protein, 21 aa, Cryptosporidium hominis
RQGSTGGSLQRPKTITATPRQ

SEQ ID NO: 2159488 - protein, 6 aa, Cryptosporidium hominis
RQHDPS

SEQ ID NO: 2159489 - protein, 4 aa, Cryptosporidium hominis
RQIH

SEQ ID NO: 2159490 - protein, 11 aa, Cryptosporidium hominis
RQINPKDVERI

SEQ ID NO: 2159491 - protein, 10 aa, Cryptosporidium hominis
RQKATKRHID

SEQ ID NO: 2159492 - protein, 6 aa, Cryptosporidium hominis
RQKEER

SEQ ID NO: 2159493 - protein, 17 aa, Cryptosporidium hominis
RQKGGGSYKPKKMKEMP

SEQ ID NO: 2159494 - protein, 21 aa, Cryptosporidium hominis
RQKKKKEESKEKQTNTHRNQI

SEQ ID NO: 2159495 - protein, 20 aa, Cryptosporidium hominis
RQKLKSKDEDMSSVNTDKRP

SEQ ID NO: 2159496 - protein, 9 aa, Cryptosporidium hominis
RQKNSTEVI

SEQ ID NO: 2159497 - protein, 11 aa, Cryptosporidium hominis
RQKSAQKSLGK

SEQ ID NO: 2159498 - protein, 9 aa, Cryptosporidium hominis
RQLTANQHD

SEQ ID NO: 2159499 - protein, 5 aa, Cryptosporidium hominis
RQNEK

SEQ ID NO: 2159500 - protein, 10 aa, Cryptosporidium hominis
RQNHSTQSKN

SEQ ID NO: 2159501 - protein, 4 aa, Cryptosporidium hominis
RQNM

SEQ ID NO: 2159502 - protein, 6 aa, Cryptosporidium hominis
RQNNDS

SEQ ID NO: 2159503 - protein, 8 aa, Cryptosporidium hominis
RQNNGKEG

SEQ ID NO: 2159504 - protein, 5 aa, Cryptosporidium hominis
RQNPK

SEQ ID NO: 2159505 - protein, 6 aa, Cryptosporidium hominis
RQNQEV

SEQ ID NO: 2159506 - protein, 8 aa, Cryptosporidium hominis
RQNSARGI

SEQ ID NO: 2159507 - protein, 25 aa, Cryptosporidium hominis
RQNSMGNSKNNNNNNNNNINNSNNS

SEQ ID NO: 2159508 - protein, 5 aa, Cryptosporidium hominis
RQNSS

SEQ ID NO: 2159509 - protein, 15 aa, Cryptosporidium hominis
RQNSSLSKRSIQNNN

SEQ ID NO: 2159510 - protein, 9 aa, Cryptosporidium hominis
RQNTKTDRL

SEQ ID NO: 2159511 - protein, 8 aa, Cryptosporidium hominis
RQNYSSAN

SEQ ID NO: 2159512 - protein, 5 aa, Cryptosporidium hominis
RQPEK

SEQ ID NO: 2159513 - protein, 4 aa, Cryptosporidium hominis
RQPN

SEQ ID NO: 2159514 - protein, 6 aa, Cryptosporidium hominis
RQPSNE

SEQ ID NO: 2159515 - protein, 12 aa, Cryptosporidium hominis
RQPVKGRKRHGG

SEQ ID NO: 2159516 - protein, 7 aa, Cryptosporidium hominis
RQQAQLQ

SEQ ID NO: 2159517 - protein, 7 aa, Cryptosporidium hominis
RQQEKVR

SEQ ID NO: 2159518 - protein, 5 aa, Cryptosporidium hominis
RQQNS

SEQ ID NO: 2159519 - protein, 30 aa, Cryptosporidium hominis
RQQRGLTAAGRKSRGLQVRGGRAARLRPSR

SEQ ID NO: 2159520 - protein, 8 aa, Cryptosporidium hominis
RQQYDNAR

SEQ ID NO: 2159521 - protein, 12 aa, Cryptosporidium hominis
RQRAMGSASDEY

SEQ ID NO: 2159522 - protein, 5 aa, Cryptosporidium hominis
RQRDE

SEQ ID NO: 2159523 - protein, 21 aa, Cryptosporidium hominis
RQRSKKKNNKEKNLENSQNPT

SEQ ID NO: 2159524 - protein, 15 aa, Cryptosporidium hominis
RQSAQKHRDKQKIER

SEQ ID NO: 2159525 - protein, 12 aa, Cryptosporidium hominis
RQSEYENKLQQE

SEQ ID NO: 2159526 - protein, 18 aa, Cryptosporidium hominis
RQSHSHSNLHSNSRTGLG

SEQ ID NO: 2159527 - protein, 6 aa, Cryptosporidium hominis
RQSHWD

SEQ ID NO: 2159528 - protein, 4 aa, Cryptosporidium hominis
RQSK

SEQ ID NO: 2159529 - protein, 4 aa, Cryptosporidium hominis
RQSS

SEQ ID NO: 2159530 - protein, 9 aa, Cryptosporidium hominis
RQSSEKGAS

SEQ ID NO: 2159531 - protein, 11 aa, Cryptosporidium hominis
RQSTTIYESSN

SEQ ID NO: 2159532 - protein, 51 aa, Cryptosporidium hominis
RQTEDKDSKEEVQQLSGSSGISGGKGSGYFQSQSGGQQISQGSLASGTGHH

SEQ ID NO: 2159533 - protein, 5 aa, Cryptosporidium hominis
RQTEI

SEQ ID NO: 2159534 - protein, 5 aa, Cryptosporidium hominis
RQTPT

SEQ ID NO: 2159535 - protein, 7 aa, Cryptosporidium hominis
RQTQEDL

SEQ ID NO: 2159536 - protein, 5 aa, Cryptosporidium hominis
RQTRI

SEQ ID NO: 2159537 - protein, 6 aa, Cryptosporidium hominis
RQTSNL

SEQ ID NO: 2159538 - protein, 4 aa, Cryptosporidium hominis
RQYR

SEQ ID NO: 2159539 - protein, 18 aa, Cryptosporidium hominis
RRAAGRGTGASRSSGRFQ

SEQ ID NO: 2159540 - protein, 11 aa, Cryptosporidium hominis
RRAEEKNLSNK

SEQ ID NO: 2159541 - protein, 13 aa, Cryptosporidium hominis
RRAESATNKNVVA

SEQ ID NO: 2159542 - protein, 31 aa, Cryptosporidium hominis
RRAIKSKGRRPYSNTNNQNYNSTDKNEDEIR

SEQ ID NO: 2159543 - protein, 14 aa, Cryptosporidium hominis
RRAKLKGSSTNPAM

SEQ ID NO: 2159544 - protein, 9 aa, Cryptosporidium hominis
RRANNPTDK

SEQ ID NO: 2159545 - protein, 22 aa, Cryptosporidium hominis
RRDASGKAHRVSKQNDSAGIED

SEQ ID NO: 2159546 - protein, 6 aa, Cryptosporidium hominis
RRDDPN

SEQ ID NO: 2159547 - protein, 8 aa, Cryptosporidium hominis
RRDEPQMA

SEQ ID NO: 2159548 - protein, 5 aa, Cryptosporidium hominis
RRDEQ

SEQ ID NO: 2159549 - protein, 4 aa, Cryptosporidium hominis
RRDG

SEQ ID NO: 2159550 - protein, 6 aa, Cryptosporidium hominis
RRDGRR

SEQ ID NO: 2159551 - protein, 5 aa, Cryptosporidium hominis
RRDHK

SEQ ID NO: 2159552 - protein, 4 aa, Cryptosporidium hominis
RRDN

SEQ ID NO: 2159553 - protein, 6 aa, Cryptosporidium hominis
RRDPIS

SEQ ID NO: 2159554 - protein, 6 aa, Cryptosporidium hominis
RREEEI

SEQ ID NO: 2159555 - protein, 4 aa, Cryptosporidium hominis
RREI

SEQ ID NO: 2159556 - protein, 4 aa, Cryptosporidium hominis
RREK

SEQ ID NO: 2159557 - protein, 6 aa, Cryptosporidium hominis
RREKDN

SEQ ID NO: 2159558 - protein, 5 aa, Cryptosporidium hominis
RREKI

SEQ ID NO: 2159559 - protein, 13 aa, Cryptosporidium hominis
RREKQQKAFRGRK

SEQ ID NO: 2159560 - protein, 7 aa, Cryptosporidium hominis
RREKVEK

SEQ ID NO: 2159561 - protein, 6 aa, Cryptosporidium hominis
RRENFE

SEQ ID NO: 2159562 - protein, 15 aa, Cryptosporidium hominis
RRENMDNKARNAPIL

SEQ ID NO: 2159563 - protein, 7 aa, Cryptosporidium hominis
RRERETV

SEQ ID NO: 2159564 - protein, 8 aa, Cryptosporidium hominis
RRFPSDNR

SEQ ID NO: 2159565 - protein, 8 aa, Cryptosporidium hominis
RRGATVDK

SEQ ID NO: 2159566 - protein, 10 aa, Cryptosporidium hominis
RRGDRKKRVA

SEQ ID NO: 2159567 - protein, 18 aa, Cryptosporidium hominis
RRGEKRGERFATGETWSE

SEQ ID NO: 2159568 - protein, 9 aa, Cryptosporidium hominis
RRGITEKGG

SEQ ID NO: 2159569 - protein, 6 aa, Cryptosporidium hominis
RRGRGG

SEQ ID NO: 2159570 - protein, 5 aa, Cryptosporidium hominis
RRGSS

SEQ ID NO: 2159571 - protein, 4 aa, Cryptosporidium hominis
RRGY

SEQ ID NO: 2159572 - protein, 6 aa, Cryptosporidium hominis
RRGYTE

SEQ ID NO: 2159573 - protein, 5 aa, Cryptosporidium hominis
RRHQS

SEQ ID NO: 2159574 - protein, 6 aa, Cryptosporidium hominis
RRHSAS

SEQ ID NO: 2159575 - protein, 6 aa, Cryptosporidium hominis
RRHSNE

SEQ ID NO: 2159576 - protein, 4 aa, Cryptosporidium hominis
RRIE

SEQ ID NO: 2159577 - protein, 21 aa, Cryptosporidium hominis
RRIENEQRKLKGETPLPIDTE

SEQ ID NO: 2159578 - protein, 12 aa, Cryptosporidium hominis
RRIPSSSRNISS

SEQ ID NO: 2159579 - protein, 10 aa, Cryptosporidium hominis
RRKAEEGGAD

SEQ ID NO: 2159580 - protein, 7 aa, Cryptosporidium hominis
RRKEENS

SEQ ID NO: 2159581 - protein, 8 aa, Cryptosporidium hominis
RRKGLSDD

SEQ ID NO: 2159582 - protein, 13 aa, Cryptosporidium hominis
RRKKGNSRREKNK

SEQ ID NO: 2159583 - protein, 11 aa, Cryptosporidium hominis
RRKKQKERKLR

SEQ ID NO: 2159584 - protein, 5 aa, Cryptosporidium hominis
RRKKV

SEQ ID NO: 2159585 - protein, 19 aa, Cryptosporidium hominis
RRKNADEKSDEKDAQKASG

SEQ ID NO: 2159586 - protein, 9 aa, Cryptosporidium hominis
RRKPSLKEN

SEQ ID NO: 2159587 - protein, 4 aa, Cryptosporidium hominis
RRKS

SEQ ID NO: 2159588 - protein, 6 aa, Cryptosporidium hominis
RRKSDG

SEQ ID NO: 2159589 - protein, 6 aa, Cryptosporidium hominis
RRKSGV

SEQ ID NO: 2159590 - protein, 8 aa, Cryptosporidium hominis
RRKSPETM

SEQ ID NO: 2159591 - protein, 15 aa, Cryptosporidium hominis
RRKTFKKENNGCNYK

SEQ ID NO: 2159592 - protein, 5 aa, Cryptosporidium hominis
RRKTI

SEQ ID NO: 2159593 - protein, 10 aa, Cryptosporidium hominis
RRLQKNERKA

SEQ ID NO: 2159594 - protein, 5 aa, Cryptosporidium hominis
RRNEA

SEQ ID NO: 2159595 - protein, 36 aa, Cryptosporidium hominis
RRNGNRKESSEKNGHKEGNKNGIIENSKVTGNHSST

SEQ ID NO: 2159596 - protein, 6 aa, Cryptosporidium hominis
RRNGYI

SEQ ID NO: 2159597 - protein, 7 aa, Cryptosporidium hominis
RRNHPEN

SEQ ID NO: 2159598 - protein, 4 aa, Cryptosporidium hominis
RRNI

SEQ ID NO: 2159599 - protein, 4 aa, Cryptosporidium hominis
RRNK

SEQ ID NO: 2159600 - protein, 8 aa, Cryptosporidium hominis
RRNKSKGL

SEQ ID NO: 2159601 - protein, 7 aa, Cryptosporidium hominis
RRNNTQY

SEQ ID NO: 2159602 - protein, 8 aa, Cryptosporidium hominis
RRNPNDHY

SEQ ID NO: 2159603 - protein, 9 aa, Cryptosporidium hominis
RRNPTKYKY

SEQ ID NO: 2159604 - protein, 7 aa, Cryptosporidium hominis
RRNRDKQ

SEQ ID NO: 2159605 - protein, 17 aa, Cryptosporidium hominis
RRNRYIPSDEEYQEEES

SEQ ID NO: 2159606 - protein, 11 aa, Cryptosporidium hominis
RRNSGSNSREN

SEQ ID NO: 2159607 - protein, 7 aa, Cryptosporidium hominis
RRNSSEL

SEQ ID NO: 2159608 - protein, 5 aa, Cryptosporidium hominis
RRPKL

SEQ ID NO: 2159609 - protein, 4 aa, Cryptosporidium hominis
RRPR

SEQ ID NO: 2159610 - protein, 10 aa, Cryptosporidium hominis
RRPREPRVTQ

SEQ ID NO: 2159611 - protein, 5 aa, Cryptosporidium hominis
RRPRH

SEQ ID NO: 2159612 - protein, 12 aa, Cryptosporidium hominis
RRPRRNNKETLE

SEQ ID NO: 2159613 - protein, 9 aa, Cryptosporidium hominis
RRPSPSPQL

SEQ ID NO: 2159614 - protein, 7 aa, Cryptosporidium hominis
RRQEAQR

SEQ ID NO: 2159615 - protein, 8 aa, Cryptosporidium hominis
RRQLPSRN

SEQ ID NO: 2159616 - protein, 13 aa, Cryptosporidium hominis
RRRAGNASKGGFR

SEQ ID NO: 2159617 - protein, 13 aa, Cryptosporidium hominis
RRRALGNSPDPSI

SEQ ID NO: 2159618 - protein, 5 aa, Cryptosporidium hominis
RRRDI

SEQ ID NO: 2159619 - protein, 5 aa, Cryptosporidium hominis
RRRDL

SEQ ID NO: 2159620 - protein, 10 aa, Cryptosporidium hominis
RRRDSTERNI

SEQ ID NO: 2159621 - protein, 21 aa, Cryptosporidium hominis
RRREKLEQKSLKEYDDGFEEP

SEQ ID NO: 2159622 - protein, 13 aa, Cryptosporidium hominis
RRRGKNDSEGDKR

SEQ ID NO: 2159623 - protein, 12 aa, Cryptosporidium hominis
RRRGRRRRPGKL

SEQ ID NO: 2159624 - protein, 10 aa, Cryptosporidium hominis
RRRGTSQRDR

SEQ ID NO: 2159625 - protein, 4 aa, Cryptosporidium hominis
RRRL

SEQ ID NO: 2159626 - protein, 8 aa, Cryptosporidium hominis
RRRQREMN

SEQ ID NO: 2159627 - protein, 21 aa, Cryptosporidium hominis
RRRRTNNRRNNTSRANNSNLD

SEQ ID NO: 2159628 - protein, 8 aa, Cryptosporidium hominis
RRRSIKGG

SEQ ID NO: 2159629 - protein, 5 aa, Cryptosporidium hominis
RRSDG

SEQ ID NO: 2159630 - protein, 17 aa, Cryptosporidium hominis
RRSGFGQDQRIQSHPNQ

SEQ ID NO: 2159631 - protein, 10 aa, Cryptosporidium hominis
RRSISSSSGL

SEQ ID NO: 2159632 - protein, 10 aa, Cryptosporidium hominis
RRSRESGIQL

SEQ ID NO: 2159633 - protein, 7 aa, Cryptosporidium hominis
RRSSDGC

SEQ ID NO: 2159634 - protein, 40 aa, Cryptosporidium hominis
RRSSLSSESSLTNHTSSTKPKNSYIQKNSSVSGGNGTSHN

SEQ ID NO: 2159635 - protein, 23 aa, Cryptosporidium hominis
RRSSRNSNKVQSSERNNAESELS

SEQ ID NO: 2159636 - protein, 14 aa, Cryptosporidium hominis
RRSSSISNNCNSNG

SEQ ID NO: 2159637 - protein, 12 aa, Cryptosporidium hominis
RRSSSNGDIYST

SEQ ID NO: 2159638 - protein, 14 aa, Cryptosporidium hominis
RRSSVGSRKSIGGN

SEQ ID NO: 2159639 - protein, 7 aa, Cryptosporidium hominis
RRSVNSD

SEQ ID NO: 2159640 - protein, 17 aa, Cryptosporidium hominis
RRTGSIASSTAGAFGNK

SEQ ID NO: 2159641 - protein, 7 aa, Cryptosporidium hominis
RRTGTGM

SEQ ID NO: 2159642 - protein, 16 aa, Cryptosporidium hominis
RRTKNDSLYRQTTSAF

SEQ ID NO: 2159643 - protein, 5 aa, Cryptosporidium hominis
RRVHS

SEQ ID NO: 2159644 - protein, 16 aa, Cryptosporidium hominis
RRVNPEDVERCEEKYS

SEQ ID NO: 2159645 - protein, 9 aa, Cryptosporidium hominis
RSAEGLASP

SEQ ID NO: 2159646 - protein, 7 aa, Cryptosporidium hominis
RSAMPSQ

SEQ ID NO: 2159647 - protein, 10 aa, Cryptosporidium hominis
RSANNDSLRD

SEQ ID NO: 2159648 - protein, 14 aa, Cryptosporidium hominis
RSASGESGGEYKKR

SEQ ID NO: 2159649 - protein, 21 aa, Cryptosporidium hominis
RSASNKSISPSKSKKSPIKSI

SEQ ID NO: 2159650 - protein, 33 aa, Cryptosporidium hominis
RSASRTYELTSRSSSSGNRAGIGSKGNKGKAVH

SEQ ID NO: 2159651 - protein, 9 aa, Cryptosporidium hominis
RSDEDGSVS

SEQ ID NO: 2159652 - protein, 9 aa, Cryptosporidium hominis
RSDEGEDLE

SEQ ID NO: 2159653 - protein, 5 aa, Cryptosporidium hominis
RSDIP

SEQ ID NO: 2159654 - protein, 9 aa, Cryptosporidium hominis
RSDIPGDTI

SEQ ID NO: 2159655 - protein, 7 aa, Cryptosporidium hominis
RSDITGR

SEQ ID NO: 2159656 - protein, 12 aa, Cryptosporidium hominis
RSDKPRNLNYDL

SEQ ID NO: 2159657 - protein, 9 aa, Cryptosporidium hominis
RSDKSGWSK

SEQ ID NO: 2159658 - protein, 8 aa, Cryptosporidium hominis
RSDNTQEG

SEQ ID NO: 2159659 - protein, 21 aa, Cryptosporidium hominis
RSDSKEPRRTSIQGKEPEGEH

SEQ ID NO: 2159660 - protein, 6 aa, Cryptosporidium hominis
RSEAVS

SEQ ID NO: 2159661 - protein, 33 aa, Cryptosporidium hominis
RSEDFESDNYSDSREEDNSDNYFNSQDDLEDDY

SEQ ID NO: 2159662 - protein, 5 aa, Cryptosporidium hominis
RSEDQ

SEQ ID NO: 2159663 - protein, 12 aa, Cryptosporidium hominis
RSEGTSEPKDIS

SEQ ID NO: 2159664 - protein, 8 aa, Cryptosporidium hominis
RSEIGGKK

SEQ ID NO: 2159665 - protein, 8 aa, Cryptosporidium hominis
RSEINEQQ

SEQ ID NO: 2159666 - protein, 6 aa, Cryptosporidium hominis
RSEIRH

SEQ ID NO: 2159667 - protein, 22 aa, Cryptosporidium hominis
RSEKRKLRKERRSTRKVVETSA

SEQ ID NO: 2159668 - protein, 8 aa, Cryptosporidium hominis
RSENIDNN

SEQ ID NO: 2159669 - protein, 23 aa, Cryptosporidium hominis
RSEPPTQATYSYSSSTQPGINNG

SEQ ID NO: 2159670 - protein, 20 aa, Cryptosporidium hominis
RSEQEKRQKQTQLTEKEAEC

SEQ ID NO: 2159671 - protein, 5 aa, Cryptosporidium hominis
RSERS

SEQ ID NO: 2159672 - protein, 8 aa, Cryptosporidium hominis
RSESKKEY

SEQ ID NO: 2159673 - protein, 6 aa, Cryptosporidium hominis
RSFDPS

SEQ ID NO: 2159674 - protein, 7 aa, Cryptosporidium hominis
RSFEENK

SEQ ID NO: 2159675 - protein, 13 aa, Cryptosporidium hominis
RSFKNSSGINLEK

SEQ ID NO: 2159676 - protein, 11 aa, Cryptosporidium hominis
RSFQDNMRKGK

SEQ ID NO: 2159677 - protein, 6 aa, Cryptosporidium hominis
RSFSEN

SEQ ID NO: 2159678 - protein, 10 aa, Cryptosporidium hominis
RSFSNKDKEI

SEQ ID NO: 2159679 - protein, 12 aa, Cryptosporidium hominis
RSFTRSKDYDAV

SEQ ID NO: 2159680 - protein, 10 aa, Cryptosporidium hominis
RSGDKERGRM

SEQ ID NO: 2159681 - protein, 38 aa, Cryptosporidium hominis
RSGHYGGSTRGYYRDDDRDRERDRERDRRSANDQYSNS

SEQ ID NO: 2159682 - protein, 5 aa, Cryptosporidium hominis
RSGIY

SEQ ID NO: 2159683 - protein, 18 aa, Cryptosporidium hominis
RSGKGFSKNHSRRRSQSI

SEQ ID NO: 2159684 - protein, 4 aa, Cryptosporidium hominis
RSGL

SEQ ID NO: 2159685 - protein, 70 aa, Cryptosporidium hominis
RSGNDSKKIRSKVNNLSNNKEFSNSLNKREISSRFNSSSSLTQSTRTESKQKPSLLKKSTSNNETSKNLS

SEQ ID NO: 2159686 - protein, 8 aa, Cryptosporidium hominis
RSGNGLSA

SEQ ID NO: 2159687 - protein, 7 aa, Cryptosporidium hominis
RSGPEIK

SEQ ID NO: 2159688 - protein, 24 aa, Cryptosporidium hominis
RSGPYGGGGMGSGQSKGPVSRNQE

SEQ ID NO: 2159689 - protein, 9 aa, Cryptosporidium hominis
RSGRFGKKG

SEQ ID NO: 2159690 - protein, 11 aa, Cryptosporidium hominis
RSGRGYKNEIE

SEQ ID NO: 2159691 - protein, 7 aa, Cryptosporidium hominis
RSGRPGI

SEQ ID NO: 2159692 - protein, 9 aa, Cryptosporidium hominis
RSGRPQYDS

SEQ ID NO: 2159693 - protein, 4 aa, Cryptosporidium hominis
RSGS

SEQ ID NO: 2159694 - protein, 7 aa, Cryptosporidium hominis
RSGSLTP

SEQ ID NO: 2159695 - protein, 9 aa, Cryptosporidium hominis
RSGSPNFQG

SEQ ID NO: 2159696 - protein, 4 aa, Cryptosporidium hominis
RSGT

SEQ ID NO: 2159697 - protein, 6 aa, Cryptosporidium hominis
RSGTYH

SEQ ID NO: 2159698 - protein, 5 aa, Cryptosporidium hominis
RSGYQ

SEQ ID NO: 2159699 - protein, 9 aa, Cryptosporidium hominis
RSHDPEKIK

SEQ ID NO: 2159700 - protein, 16 aa, Cryptosporidium hominis
RSHGGEGLPEDFESPD

SEQ ID NO: 2159701 - protein, 12 aa, Cryptosporidium hominis
RSIAEGEETEVV

SEQ ID NO: 2159702 - protein, 4 aa, Cryptosporidium hominis
RSIG

SEQ ID NO: 2159703 - protein, 6 aa, Cryptosporidium hominis
RSINNE

SEQ ID NO: 2159704 - protein, 9 aa, Cryptosporidium hominis
RSIPNSAEF

SEQ ID NO: 2159705 - protein, 9 aa, Cryptosporidium hominis
RSISNGSNP

SEQ ID NO: 2159706 - protein, 4 aa, Cryptosporidium hominis
RSIT

SEQ ID NO: 2159707 - protein, 4 aa, Cryptosporidium hominis
RSKF

SEQ ID NO: 2159708 - protein, 15 aa, Cryptosporidium hominis
RSKFQKSYTECSDYT

SEQ ID NO: 2159709 - protein, 5 aa, Cryptosporidium hominis
RSKGI

SEQ ID NO: 2159710 - protein, 10 aa, Cryptosporidium hominis
RSKGNGCSDN

SEQ ID NO: 2159711 - protein, 6 aa, Cryptosporidium hominis
RSKITP

SEQ ID NO: 2159712 - protein, 5 aa, Cryptosporidium hominis
RSKKI

SEQ ID NO: 2159713 - protein, 10 aa, Cryptosporidium hominis
RSKKNGHSRG

SEQ ID NO: 2159714 - protein, 10 aa, Cryptosporidium hominis
RSKKNSNNDY

SEQ ID NO: 2159715 - protein, 9 aa, Cryptosporidium hominis
RSKLSSSTL

SEQ ID NO: 2159716 - protein, 10 aa, Cryptosporidium hominis
RSKNKIKNGM

SEQ ID NO: 2159717 - protein, 8 aa, Cryptosporidium hominis
RSKRKAFT

SEQ ID NO: 2159718 - protein, 7 aa, Cryptosporidium hominis
RSKSAAS

SEQ ID NO: 2159719 - protein, 8 aa, Cryptosporidium hominis
RSKSAQEK

SEQ ID NO: 2159720 - protein, 8 aa, Cryptosporidium hominis
RSKSGSNM

SEQ ID NO: 2159721 - protein, 10 aa, Cryptosporidium hominis
RSKSNSQSSM

SEQ ID NO: 2159722 - protein, 7 aa, Cryptosporidium hominis
RSKSRRN

SEQ ID NO: 2159723 - protein, 9 aa, Cryptosporidium hominis
RSKTRSTYI

SEQ ID NO: 2159724 - protein, 13 aa, Cryptosporidium hominis
RSKVGKHGRVTKD

SEQ ID NO: 2159725 - protein, 4 aa, Cryptosporidium hominis
RSKY

SEQ ID NO: 2159726 - protein, 14 aa, Cryptosporidium hominis
RSKYNSGNQGVQRK

SEQ ID NO: 2159727 - protein, 5 aa, Cryptosporidium hominis
RSLGA

SEQ ID NO: 2159728 - protein, 9 aa, Cryptosporidium hominis
RSLKGRKKN

SEQ ID NO: 2159729 - protein, 7 aa, Cryptosporidium hominis
RSLSDSH

SEQ ID NO: 2159730 - protein, 6 aa, Cryptosporidium hominis
RSLTPD

SEQ ID NO: 2159731 - protein, 14 aa, Cryptosporidium hominis
RSMDRREADLKERD

SEQ ID NO: 2159732 - protein, 8 aa, Cryptosporidium hominis
RSMRKSGE

SEQ ID NO: 2159733 - protein, 6 aa, Cryptosporidium hominis
RSNEIH

SEQ ID NO: 2159734 - protein, 8 aa, Cryptosporidium hominis
RSNENMSS

SEQ ID NO: 2159735 - protein, 6 aa, Cryptosporidium hominis
RSNGAT

SEQ ID NO: 2159736 - protein, 11 aa, Cryptosporidium hominis
RSNGTSKEDIE

SEQ ID NO: 2159737 - protein, 13 aa, Cryptosporidium hominis
RSNHKDPITTSSV

SEQ ID NO: 2159738 - protein, 7 aa, Cryptosporidium hominis
RSNISGG

SEQ ID NO: 2159739 - protein, 9 aa, Cryptosporidium hominis
RSNNEKSID

SEQ ID NO: 2159740 - protein, 12 aa, Cryptosporidium hominis
RSNNPSQLVSDK

SEQ ID NO: 2159741 - protein, 8 aa, Cryptosporidium hominis
RSNPDNRG

SEQ ID NO: 2159742 - protein, 6 aa, Cryptosporidium hominis
RSNPFE

SEQ ID NO: 2159743 - protein, 71 aa, Cryptosporidium hominis
RSNQGGSNCSSVNSSYGYSGNNSSSGNQGSNNEQWRNRKGPGNHSYNGVAGNGNNASHSKVSNRDFDHDDA

SEQ ID NO: 2159744 - protein, 6 aa, Cryptosporidium hominis
RSNSES

SEQ ID NO: 2159745 - protein, 6 aa, Cryptosporidium hominis
RSNSIE

SEQ ID NO: 2159746 - protein, 11 aa, Cryptosporidium hominis
RSNTNSKGFAG

SEQ ID NO: 2159747 - protein, 11 aa, Cryptosporidium hominis
RSNTPTESQSN

SEQ ID NO: 2159748 - protein, 8 aa, Cryptosporidium hominis
RSNYDEEK

SEQ ID NO: 2159749 - protein, 5 aa, Cryptosporidium hominis
RSNYN

SEQ ID NO: 2159750 - protein, 7 aa, Cryptosporidium hominis
RSPDGEQ

SEQ ID NO: 2159751 - protein, 10 aa, Cryptosporidium hominis
RSPESGVSKG

SEQ ID NO: 2159752 - protein, 9 aa, Cryptosporidium hominis
RSPINRKKS

SEQ ID NO: 2159753 - protein, 4 aa, Cryptosporidium hominis
RSPL

SEQ ID NO: 2159754 - protein, 38 aa, Cryptosporidium hominis
RSPRNSYSKYKSLGSELRDSGYNQDNELDENEQSPLIE

SEQ ID NO: 2159755 - protein, 33 aa, Cryptosporidium hominis
RSPSISDTGSSSSSDDSSLGENDYDSDLTSEDS

SEQ ID NO: 2159756 - protein, 6 aa, Cryptosporidium hominis
RSQDNI

SEQ ID NO: 2159757 - protein, 6 aa, Cryptosporidium hominis
RSQESQ

SEQ ID NO: 2159758 - protein, 6 aa, Cryptosporidium hominis
RSQKPV

SEQ ID NO: 2159759 - protein, 14 aa, Cryptosporidium hominis
RSQNEGKLKDTGTV

SEQ ID NO: 2159760 - protein, 8 aa, Cryptosporidium hominis
RSQNGNDQ

SEQ ID NO: 2159761 - protein, 8 aa, Cryptosporidium hominis
RSQNLDDD

SEQ ID NO: 2159762 - protein, 10 aa, Cryptosporidium hominis
RSQNNAVTGS

SEQ ID NO: 2159763 - protein, 33 aa, Cryptosporidium hominis
RSQNVGNKEFEEEDGIEMDDEEENNSDNNNEYG

SEQ ID NO: 2159764 - protein, 13 aa, Cryptosporidium hominis
RSQTNTGHSRDKY

SEQ ID NO: 2159765 - protein, 6 aa, Cryptosporidium hominis
RSRASP

SEQ ID NO: 2159766 - protein, 23 aa, Cryptosporidium hominis
RSRGRPRATDRPEADEITSFEEE

SEQ ID NO: 2159767 - protein, 14 aa, Cryptosporidium hominis
RSRRGSINSDHNSK

SEQ ID NO: 2159768 - protein, 6 aa, Cryptosporidium hominis
RSRSKR

SEQ ID NO: 2159769 - protein, 17 aa, Cryptosporidium hominis
RSRSPSPIGGNCEPKRI

SEQ ID NO: 2159770 - protein, 8 aa, Cryptosporidium hominis
RSSALNSK

SEQ ID NO: 2159771 - protein, 18 aa, Cryptosporidium hominis
RSSHGPYKHESSESDDDD

SEQ ID NO: 2159772 - protein, 9 aa, Cryptosporidium hominis
RSSHIPPNV

SEQ ID NO: 2159773 - protein, 7 aa, Cryptosporidium hominis
RSSIHTS

SEQ ID NO: 2159774 - protein, 7 aa, Cryptosporidium hominis
RSSKARP

SEQ ID NO: 2159775 - protein, 6 aa, Cryptosporidium hominis
RSSKLE

SEQ ID NO: 2159776 - protein, 27 aa, Cryptosporidium hominis
RSSLGSANDDLELPKSACNSNKTVSQA

SEQ ID NO: 2159777 - protein, 17 aa, Cryptosporidium hominis
RSSLTKKSNKNHQKLRE

SEQ ID NO: 2159778 - protein, 6 aa, Cryptosporidium hominis
RSSNDI

SEQ ID NO: 2159779 - protein, 6 aa, Cryptosporidium hominis
RSSNVT

SEQ ID NO: 2159780 - protein, 20 aa, Cryptosporidium hominis
RSSRKIRSKNNKHALSFSFG

SEQ ID NO: 2159781 - protein, 16 aa, Cryptosporidium hominis
RSSRNNEGYLFLSIRI

SEQ ID NO: 2159782 - protein, 10 aa, Cryptosporidium hominis
RSSRTRNRSK

SEQ ID NO: 2159783 - protein, 4 aa, Cryptosporidium hominis
RSSS

SEQ ID NO: 2159784 - protein, 7 aa, Cryptosporidium hominis
RSSSFPK

SEQ ID NO: 2159785 - protein, 24 aa, Cryptosporidium hominis
RSSSNESFNDQSQGKGIQMRPPDV

SEQ ID NO: 2159786 - protein, 14 aa, Cryptosporidium hominis
RSSSSSECNDSAAE

SEQ ID NO: 2159787 - protein, 14 aa, Cryptosporidium hominis
RSSSYGVEDREGNI

SEQ ID NO: 2159788 - protein, 5 aa, Cryptosporidium hominis
RSSTI

SEQ ID NO: 2159789 - protein, 7 aa, Cryptosporidium hominis
RSSTKPI

SEQ ID NO: 2159790 - protein, 14 aa, Cryptosporidium hominis
RSSTLEGNSEVQTT

SEQ ID NO: 2159791 - protein, 10 aa, Cryptosporidium hominis
RSSTPPSSHN

SEQ ID NO: 2159792 - protein, 4 aa, Cryptosporidium hominis
RSSV

SEQ ID NO: 2159793 - protein, 8 aa, Cryptosporidium hominis
RSSVTSSK

SEQ ID NO: 2159794 - protein, 7 aa, Cryptosporidium hominis
RSTAINK

SEQ ID NO: 2159795 - protein, 6 aa, Cryptosporidium hominis
RSTEQR

SEQ ID NO: 2159796 - protein, 8 aa, Cryptosporidium hominis
RSTGEKEY

SEQ ID NO: 2159797 - protein, 5 aa, Cryptosporidium hominis
RSTPD

SEQ ID NO: 2159798 - protein, 8 aa, Cryptosporidium hominis
RSTPDLGN

SEQ ID NO: 2159799 - protein, 5 aa, Cryptosporidium hominis
RSTPL

SEQ ID NO: 2159800 - protein, 10 aa, Cryptosporidium hominis
RSTSKLAGYQ

SEQ ID NO: 2159801 - protein, 7 aa, Cryptosporidium hominis
RSTTNFS

SEQ ID NO: 2159802 - protein, 17 aa, Cryptosporidium hominis
RSVGREAFDRKKSEFQA

SEQ ID NO: 2159803 - protein, 12 aa, Cryptosporidium hominis
RSVNNGSTVNNN

SEQ ID NO: 2159804 - protein, 11 aa, Cryptosporidium hominis
RSVPKQHESSM

SEQ ID NO: 2159805 - protein, 8 aa, Cryptosporidium hominis
RSVSKTCQ

SEQ ID NO: 2159806 - protein, 19 aa, Cryptosporidium hominis
RSVSPGREFNSKPQPEKQI

SEQ ID NO: 2159807 - protein, 16 aa, Cryptosporidium hominis
RSWTNKRIGKENNSSH

SEQ ID NO: 2159808 - protein, 11 aa, Cryptosporidium hominis
RSYDSRGSSIT

SEQ ID NO: 2159809 - protein, 7 aa, Cryptosporidium hominis
RSYENGD

SEQ ID NO: 2159810 - protein, 9 aa, Cryptosporidium hominis
RSYKQNNSK

SEQ ID NO: 2159811 - protein, 8 aa, Cryptosporidium hominis
RTAENNDL

SEQ ID NO: 2159812 - protein, 5 aa, Cryptosporidium hominis
RTAES

SEQ ID NO: 2159813 - protein, 5 aa, Cryptosporidium hominis
RTANA

SEQ ID NO: 2159814 - protein, 11 aa, Cryptosporidium hominis
RTARAGRSGRA

SEQ ID NO: 2159815 - protein, 11 aa, Cryptosporidium hominis
RTARGAGGTGK

SEQ ID NO: 2159816 - protein, 15 aa, Cryptosporidium hominis
RTARRVNNSEHSEEL

SEQ ID NO: 2159817 - protein, 6 aa, Cryptosporidium hominis
RTDKRN

SEQ ID NO: 2159818 - protein, 7 aa, Cryptosporidium hominis
RTDLSEE

SEQ ID NO: 2159819 - protein, 5 aa, Cryptosporidium hominis
RTDNE

SEQ ID NO: 2159820 - protein, 5 aa, Cryptosporidium hominis
RTDNR

SEQ ID NO: 2159821 - protein, 18 aa, Cryptosporidium hominis
RTEDKEYFKPKGKSEKVH

SEQ ID NO: 2159822 - protein, 13 aa, Cryptosporidium hominis
RTENSYNTNLQSE

SEQ ID NO: 2159823 - protein, 10 aa, Cryptosporidium hominis
RTESKCPETL

SEQ ID NO: 2159824 - protein, 5 aa, Cryptosporidium hominis
RTESR

SEQ ID NO: 2159825 - protein, 6 aa, Cryptosporidium hominis
RTEVES

SEQ ID NO: 2159826 - protein, 14 aa, Cryptosporidium hominis
RTFSGSSKKIEQNK

SEQ ID NO: 2159827 - protein, 5 aa, Cryptosporidium hominis
RTGDG

SEQ ID NO: 2159828 - protein, 4 aa, Cryptosporidium hominis
RTGI

SEQ ID NO: 2159829 - protein, 8 aa, Cryptosporidium hominis
RTGQNEQS

SEQ ID NO: 2159830 - protein, 9 aa, Cryptosporidium hominis
RTGRAGATG

SEQ ID NO: 2159831 - protein, 9 aa, Cryptosporidium hominis
RTGRAGNFG

SEQ ID NO: 2159832 - protein, 10 aa, Cryptosporidium hominis
RTGRAGNTGL

SEQ ID NO: 2159833 - protein, 14 aa, Cryptosporidium hominis
RTGSGGGPSNATIQ

SEQ ID NO: 2159834 - protein, 7 aa, Cryptosporidium hominis
RTGSGKR

SEQ ID NO: 2159835 - protein, 8 aa, Cryptosporidium hominis
RTGSGKTA

SEQ ID NO: 2159836 - protein, 10 aa, Cryptosporidium hominis
RTGTSISNHE

SEQ ID NO: 2159837 - protein, 6 aa, Cryptosporidium hominis
RTHPTM

SEQ ID NO: 2159838 - protein, 6 aa, Cryptosporidium hominis
RTHSQL

SEQ ID NO: 2159839 - protein, 4 aa, Cryptosporidium hominis
RTID

SEQ ID NO: 2159840 - protein, 9 aa, Cryptosporidium hominis
RTIDPNAND

SEQ ID NO: 2159841 - protein, 9 aa, Cryptosporidium hominis
RTIENTREI

SEQ ID NO: 2159842 - protein, 8 aa, Cryptosporidium hominis
RTIQSTKA

SEQ ID NO: 2159843 - protein, 11 aa, Cryptosporidium hominis
RTISQEKSEIE

SEQ ID NO: 2159844 - protein, 4 aa, Cryptosporidium hominis
RTKD

SEQ ID NO: 2159845 - protein, 12 aa, Cryptosporidium hominis
RTKRGNRADSMG

SEQ ID NO: 2159846 - protein, 16 aa, Cryptosporidium hominis
RTKTTERLADGTVRET

SEQ ID NO: 2159847 - protein, 5 aa, Cryptosporidium hominis
RTLNG

SEQ ID NO: 2159848 - protein, 20 aa, Cryptosporidium hominis
RTLPRRNTSEDGSNENSIIT

SEQ ID NO: 2159849 - protein, 8 aa, Cryptosporidium hominis
RTLSGDSQ

SEQ ID NO: 2159850 - protein, 5 aa, Cryptosporidium hominis
RTLSS

SEQ ID NO: 2159851 - protein, 7 aa, Cryptosporidium hominis
RTNDDEA

SEQ ID NO: 2159852 - protein, 6 aa, Cryptosporidium hominis
RTNDRN

SEQ ID NO: 2159853 - protein, 4 aa, Cryptosporidium hominis
RTNE

SEQ ID NO: 2159854 - protein, 16 aa, Cryptosporidium hominis
RTNEVSNNSNEYQNDY

SEQ ID NO: 2159855 - protein, 13 aa, Cryptosporidium hominis
RTNGRKKSNPEFK

SEQ ID NO: 2159856 - protein, 25 aa, Cryptosporidium hominis
RTNKNESGREVPNSDRIQPNQETRI

SEQ ID NO: 2159857 - protein, 4 aa, Cryptosporidium hominis
RTNN

SEQ ID NO: 2159858 - protein, 78 aa, Cryptosporidium hominis
RTNQTSTTSVSDVNTTLSSSNMNNSNDKADSKKKFNISNNQSSSYNNNNNNNNNNNNNNNSNNNGSNNNNSGTARQNK

SEQ ID NO: 2159859 - protein, 6 aa, Cryptosporidium hominis
RTNRHN

SEQ ID NO: 2159860 - protein, 7 aa, Cryptosporidium hominis
RTNSSFN

SEQ ID NO: 2159861 - protein, 8 aa, Cryptosporidium hominis
RTNTTVKE

SEQ ID NO: 2159862 - protein, 8 aa, Cryptosporidium hominis
RTPGPREL

SEQ ID NO: 2159863 - protein, 9 aa, Cryptosporidium hominis
RTPGYQPNS

SEQ ID NO: 2159864 - protein, 4 aa, Cryptosporidium hominis
RTPH

SEQ ID NO: 2159865 - protein, 9 aa, Cryptosporidium hominis
RTPNDRESH

SEQ ID NO: 2159866 - protein, 4 aa, Cryptosporidium hominis
RTPS

SEQ ID NO: 2159867 - protein, 28 aa, Cryptosporidium hominis
RTPSHSVPGGQSPTVSQTHNISQQSGSS

SEQ ID NO: 2159868 - protein, 13 aa, Cryptosporidium hominis
RTPSSKESLKRSR

SEQ ID NO: 2159869 - protein, 4 aa, Cryptosporidium hominis
RTQA

SEQ ID NO: 2159870 - protein, 5 aa, Cryptosporidium hominis
RTQGN

SEQ ID NO: 2159871 - protein, 7 aa, Cryptosporidium hominis
RTQGTLS

SEQ ID NO: 2159872 - protein, 35 aa, Cryptosporidium hominis
RTQQQSNSGGNQISDNTKNSSYSDYISTESKENID

SEQ ID NO: 2159873 - protein, 5 aa, Cryptosporidium hominis
RTRNE

SEQ ID NO: 2159874 - protein, 5 aa, Cryptosporidium hominis
RTRNS

SEQ ID NO: 2159875 - protein, 5 aa, Cryptosporidium hominis
RTRSG

SEQ ID NO: 2159876 - protein, 5 aa, Cryptosporidium hominis
RTSLE

SEQ ID NO: 2159877 - protein, 13 aa, Cryptosporidium hominis
RTSNNFPSNAHLG

SEQ ID NO: 2159878 - protein, 21 aa, Cryptosporidium hominis
RTSNSDDSDTADNKSKGQTKL

SEQ ID NO: 2159879 - protein, 7 aa, Cryptosporidium hominis
RTSSPYA

SEQ ID NO: 2159880 - protein, 7 aa, Cryptosporidium hominis
RTSVSGK

SEQ ID NO: 2159881 - protein, 6 aa, Cryptosporidium hominis
RTTELP

SEQ ID NO: 2159882 - protein, 8 aa, Cryptosporidium hominis
RTTENEQS

SEQ ID NO: 2159883 - protein, 10 aa, Cryptosporidium hominis
RTTFESQKTI

SEQ ID NO: 2159884 - protein, 11 aa, Cryptosporidium hominis
RTTGKALESHE

SEQ ID NO: 2159885 - protein, 7 aa, Cryptosporidium hominis
RTTKPQR

SEQ ID NO: 2159886 - protein, 13 aa, Cryptosporidium hominis
RTTNEESDVRSQS

SEQ ID NO: 2159887 - protein, 11 aa, Cryptosporidium hominis
RTTPFSNNQTQ

SEQ ID NO: 2159888 - protein, 22 aa, Cryptosporidium hominis
RTTSGSPGHPQASSGTPPPNSM

SEQ ID NO: 2159889 - protein, 14 aa, Cryptosporidium hominis
RTTTTTSDNDKITS

SEQ ID NO: 2159890 - protein, 4 aa, Cryptosporidium hominis
RTTY

SEQ ID NO: 2159891 - protein, 9 aa, Cryptosporidium hominis
RTVASPQNY

SEQ ID NO: 2159892 - protein, 11 aa, Cryptosporidium hominis
RTVRNYNSSRF

SEQ ID NO: 2159893 - protein, 9 aa, Cryptosporidium hominis
RTVTSNPNL

SEQ ID NO: 2159894 - protein, 14 aa, Cryptosporidium hominis
RTYDKVDSKTKTTM

SEQ ID NO: 2159895 - protein, 10 aa, Cryptosporidium hominis
RTYKVSPKKK

SEQ ID NO: 2159896 - protein, 4 aa, Cryptosporidium hominis
RTYS

SEQ ID NO: 2159897 - protein, 4 aa, Cryptosporidium hominis
RVDS

SEQ ID NO: 2159898 - protein, 7 aa, Cryptosporidium hominis
RVEESIG

SEQ ID NO: 2159899 - protein, 9 aa, Cryptosporidium hominis
RVGRTDKGV

SEQ ID NO: 2159900 - protein, 8 aa, Cryptosporidium hominis
RVGTDTED

SEQ ID NO: 2159901 - protein, 8 aa, Cryptosporidium hominis
RVKPSKKV

SEQ ID NO: 2159902 - protein, 6 aa, Cryptosporidium hominis
RVNDEG

SEQ ID NO: 2159903 - protein, 13 aa, Cryptosporidium hominis
RVNGNGNPQGVYR

SEQ ID NO: 2159904 - protein, 4 aa, Cryptosporidium hominis
RVNK

SEQ ID NO: 2159905 - protein, 7 aa, Cryptosporidium hominis
RVNPPDN

SEQ ID NO: 2159906 - protein, 14 aa, Cryptosporidium hominis
RVNTRKKKKTPEQI

SEQ ID NO: 2159907 - protein, 46 aa, Cryptosporidium hominis
RVNTTSKEGSACKLSEDTDNKVECTSISNKQQFDQNSTQRKNLEEK

SEQ ID NO: 2159908 - protein, 7 aa, Cryptosporidium hominis
RVPDDGK

SEQ ID NO: 2159909 - protein, 5 aa, Cryptosporidium hominis
RVPDQ

SEQ ID NO: 2159910 - protein, 11 aa, Cryptosporidium hominis
RVPEDDRDHFG

SEQ ID NO: 2159911 - protein, 4 aa, Cryptosporidium hominis
RVPP

SEQ ID NO: 2159912 - protein, 8 aa, Cryptosporidium hominis
RVQKNGKN

SEQ ID NO: 2159913 - protein, 28 aa, Cryptosporidium hominis
RVQSKNATTEIKQSSKTVTKKVSSSSQV

SEQ ID NO: 2159914 - protein, 4 aa, Cryptosporidium hominis
RVSE

SEQ ID NO: 2159915 - protein, 6 aa, Cryptosporidium hominis
RVSEGS

SEQ ID NO: 2159916 - protein, 7 aa, Cryptosporidium hominis
RVSESDR

SEQ ID NO: 2159917 - protein, 6 aa, Cryptosporidium hominis
RVSTDG

SEQ ID NO: 2159918 - protein, 31 aa, Cryptosporidium hominis
RVSVEKDSNSQDCSSDEEENTAYVPRRDRDH

SEQ ID NO: 2159919 - protein, 4 aa, Cryptosporidium hominis
RVVG

SEQ ID NO: 2159920 - protein, 4 aa, Cryptosporidium hominis
RWEE

SEQ ID NO: 2159921 - protein, 15 aa, Cryptosporidium hominis
RYCPSTSKFYLRLNF

SEQ ID NO: 2159922 - protein, 25 aa, Cryptosporidium hominis
RYDNNSGGSSQSQGGQTNNTDSSSI

SEQ ID NO: 2159923 - protein, 28 aa, Cryptosporidium hominis
RYDSYNSNLSPNTNFQTPGRDPKRRNIS

SEQ ID NO: 2159924 - protein, 11 aa, Cryptosporidium hominis
RYEEEKKRRED

SEQ ID NO: 2159925 - protein, 5 aa, Cryptosporidium hominis
RYEEQ

SEQ ID NO: 2159926 - protein, 18 aa, Cryptosporidium hominis
RYEPDLKEKYDGLTDVED

SEQ ID NO: 2159927 - protein, 28 aa, Cryptosporidium hominis
RYEQKEGGEVSEVERETEFGSSEVTSSV

SEQ ID NO: 2159928 - protein, 6 aa, Cryptosporidium hominis
RYGITR

SEQ ID NO: 2159929 - protein, 7 aa, Cryptosporidium hominis
RYGPHNH

SEQ ID NO: 2159930 - protein, 9 aa, Cryptosporidium hominis
RYKGEEKEL

SEQ ID NO: 2159931 - protein, 5 aa, Cryptosporidium hominis
RYLPG

SEQ ID NO: 2159932 - protein, 5 aa, Cryptosporidium hominis
RYLQG

SEQ ID NO: 2159933 - protein, 4 aa, Cryptosporidium hominis
RYNN

SEQ ID NO: 2159934 - protein, 5 aa, Cryptosporidium hominis
RYQDK

SEQ ID NO: 2159935 - protein, 8 aa, Cryptosporidium hominis
RYREDQSA

SEQ ID NO: 2159936 - protein, 10 aa, Cryptosporidium hominis
RYRKESPYSK

SEQ ID NO: 2159937 - protein, 18 aa, Cryptosporidium hominis
RYSCDSDKLTKNSPVSHS

SEQ ID NO: 2159938 - protein, 7 aa, Cryptosporidium hominis
RYSGGEM

SEQ ID NO: 2159939 - protein, 9 aa, Cryptosporidium hominis
RYSGSDIKR

SEQ ID NO: 2159940 - protein, 8 aa, Cryptosporidium hominis
RYSKGREK

SEQ ID NO: 2159941 - protein, 6 aa, Cryptosporidium hominis
RYSNNF

SEQ ID NO: 2159942 - protein, 11 aa, Cryptosporidium hominis
RYTKNEKTGKT

SEQ ID NO: 2159943 - protein, 31 aa, Cryptosporidium hominis
SAAADNTTAVGASAPVEEEEEEEGDLGFSLF

SEQ ID NO: 2159944 - protein, 6 aa, Cryptosporidium hominis
SAAKGL

SEQ ID NO: 2159945 - protein, 7 aa, Cryptosporidium hominis
SAAKSAL

SEQ ID NO: 2159946 - protein, 18 aa, Cryptosporidium hominis
SAANDGYSQLDGSSIGQS

SEQ ID NO: 2159947 - protein, 7 aa, Cryptosporidium hominis
SAAPQRL

SEQ ID NO: 2159948 - protein, 11 aa, Cryptosporidium hominis
SAASTSVSNSQ

SEQ ID NO: 2159949 - protein, 4 aa, Cryptosporidium hominis
SAAT

SEQ ID NO: 2159950 - protein, 57 aa, Cryptosporidium hominis
SAATAATNAQLSSAAQTQPDAENHASKPVAKASGGGRASHGSGSRALNASSSVTAAA

SEQ ID NO: 2159951 - protein, 5 aa, Cryptosporidium hominis
SAATS

SEQ ID NO: 2159952 - protein, 4 aa, Cryptosporidium hominis
SADE

SEQ ID NO: 2159953 - protein, 16 aa, Cryptosporidium hominis
SADEDTNKENSFRVDT

SEQ ID NO: 2159954 - protein, 9 aa, Cryptosporidium hominis
SADKRREEK

SEQ ID NO: 2159955 - protein, 5 aa, Cryptosporidium hominis
SADKT

SEQ ID NO: 2159956 - protein, 4 aa, Cryptosporidium hominis
SADN

SEQ ID NO: 2159957 - protein, 8 aa, Cryptosporidium hominis
SADNKNVN

SEQ ID NO: 2159958 - protein, 5 aa, Cryptosporidium hominis
SADNT

SEQ ID NO: 2159959 - protein, 8 aa, Cryptosporidium hominis
SADNTVRK

SEQ ID NO: 2159960 - protein, 11 aa, Cryptosporidium hominis
SADSNNSRGIN

SEQ ID NO: 2159961 - protein, 6 aa, Cryptosporidium hominis
SAEEKF

SEQ ID NO: 2159962 - protein, 7 aa, Cryptosporidium hominis
SAEGGRT

SEQ ID NO: 2159963 - protein, 4 aa, Cryptosporidium hominis
SAEI

SEQ ID NO: 2159964 - protein, 8 aa, Cryptosporidium hominis
SAEKRLKQ

SEQ ID NO: 2159965 - protein, 5 aa, Cryptosporidium hominis
SAENK

SEQ ID NO: 2159966 - protein, 18 aa, Cryptosporidium hominis
SAEPEFKYNPDSNVDFKF

SEQ ID NO: 2159967 - protein, 9 aa, Cryptosporidium hominis
SAESDSEKK

SEQ ID NO: 2159968 - protein, 15 aa, Cryptosporidium hominis
SAESESGTKSTSLVT

SEQ ID NO: 2159969 - protein, 15 aa, Cryptosporidium hominis
SAESLEKAESSIKTA

SEQ ID NO: 2159970 - protein, 7 aa, Cryptosporidium hominis
SAETIEN

SEQ ID NO: 2159971 - protein, 8 aa, Cryptosporidium hominis
SAFDNDQS

SEQ ID NO: 2159972 - protein, 6 aa, Cryptosporidium hominis
SAFGSR

SEQ ID NO: 2159973 - protein, 6 aa, Cryptosporidium hominis
SAFKNK

SEQ ID NO: 2159974 - protein, 6 aa, Cryptosporidium hominis
SAFNGK

SEQ ID NO: 2159975 - protein, 22 aa, Cryptosporidium hominis
SAFNNGYARAQTDNSERAYNAN

SEQ ID NO: 2159976 - protein, 8 aa, Cryptosporidium hominis
SAGDEVSD

SEQ ID NO: 2159977 - protein, 7 aa, Cryptosporidium hominis
SAGGSFT

SEQ ID NO: 2159978 - protein, 23 aa, Cryptosporidium hominis
SAGGSTLTPWRNGKRSLSTNYGY

SEQ ID NO: 2159979 - protein, 4 aa, Cryptosporidium hominis
SAGI

SEQ ID NO: 2159980 - protein, 8 aa, Cryptosporidium hominis
SAGKSDTY

SEQ ID NO: 2159981 - protein, 31 aa, Cryptosporidium hominis
SAGKSRGHRNSKNSSNGGGNSEGKGNLEYSE

SEQ ID NO: 2159982 - protein, 10 aa, Cryptosporidium hominis
SAGNGPNNAV

SEQ ID NO: 2159983 - protein, 4 aa, Cryptosporidium hominis
SAGP

SEQ ID NO: 2159984 - protein, 13 aa, Cryptosporidium hominis
SAGSDGRVIVGEF

SEQ ID NO: 2159985 - protein, 8 aa, Cryptosporidium hominis
SAGSLTKE

SEQ ID NO: 2159986 - protein, 8 aa, Cryptosporidium hominis
SAGSSDFK

SEQ ID NO: 2159987 - protein, 12 aa, Cryptosporidium hominis
SAGSTATSSSTS

SEQ ID NO: 2159988 - protein, 17 aa, Cryptosporidium hominis
SAGTGIPSSGGSILGNS

SEQ ID NO: 2159989 - protein, 4 aa, Cryptosporidium hominis
SAHP

SEQ ID NO: 2159990 - protein, 14 aa, Cryptosporidium hominis
SAIGNTNGGVIPRG

SEQ ID NO: 2159991 - protein, 6 aa, Cryptosporidium hominis
SAINEG

SEQ ID NO: 2159992 - protein, 5 aa, Cryptosporidium hominis
SAIPK

SEQ ID NO: 2159993 - protein, 8 aa, Cryptosporidium hominis
SAKDGNIE

SEQ ID NO: 2159994 - protein, 6 aa, Cryptosporidium hominis
SAKDTI

SEQ ID NO: 2159995 - protein, 32 aa, Cryptosporidium hominis
SAKEADKERNSSGPSSSSKAEEIRRKNEEAKL

SEQ ID NO: 2159996 - protein, 7 aa, Cryptosporidium hominis
SAKEYSG

SEQ ID NO: 2159997 - protein, 7 aa, Cryptosporidium hominis
SAKGTKT

SEQ ID NO: 2159998 - protein, 6 aa, Cryptosporidium hominis
SAKIGK

SEQ ID NO: 2159999 - protein, 9 aa, Cryptosporidium hominis
SAKNATNVD

SEQ ID NO: 2160000 - protein, 8 aa, Cryptosporidium hominis
SAKNAYNV

SEQ ID NO: 2160001 - protein, 13 aa, Cryptosporidium hominis
SAKPIASQSPALK

SEQ ID NO: 2160002 - protein, 15 aa, Cryptosporidium hominis
SAKPKKAAEAAKKPK

SEQ ID NO: 2160003 - protein, 7 aa, Cryptosporidium hominis
SAKQENE

SEQ ID NO: 2160004 - protein, 10 aa, Cryptosporidium hominis
SAKQKDLKVT

SEQ ID NO: 2160005 - protein, 12 aa, Cryptosporidium hominis
SAKSKANHNSLN

SEQ ID NO: 2160006 - protein, 47 aa, Cryptosporidium hominis
SAKSTSSIIGTSNSHYSKLSGNNAIKQENSNTISSSNLSNNFTNSSN

SEQ ID NO: 2160007 - protein, 9 aa, Cryptosporidium hominis
SAKTSNNVE

SEQ ID NO: 2160008 - protein, 7 aa, Cryptosporidium hominis
SAKWPSS

SEQ ID NO: 2160009 - protein, 7 aa, Cryptosporidium hominis
SAKYGKL

SEQ ID NO: 2160010 - protein, 6 aa, Cryptosporidium hominis
SALENV

SEQ ID NO: 2160011 - protein, 8 aa, Cryptosporidium hominis
SALPSQSP

SEQ ID NO: 2160012 - protein, 9 aa, Cryptosporidium hominis
SALPTNHGN

SEQ ID NO: 2160013 - protein, 7 aa, Cryptosporidium hominis
SALSELG

SEQ ID NO: 2160014 - protein, 27 aa, Cryptosporidium hominis
SAMESNNKPRNFNTSSDLNTPNNNGNY

SEQ ID NO: 2160015 - protein, 7 aa, Cryptosporidium hominis
SANEVED

SEQ ID NO: 2160016 - protein, 7 aa, Cryptosporidium hominis
SANGDSI

SEQ ID NO: 2160017 - protein, 5 aa, Cryptosporidium hominis
SANGI

SEQ ID NO: 2160018 - protein, 6 aa, Cryptosporidium hominis
SANGTY

SEQ ID NO: 2160019 - protein, 14 aa, Cryptosporidium hominis
SANGVDGSSPRWAP

SEQ ID NO: 2160020 - protein, 5 aa, Cryptosporidium hominis
SANHA

SEQ ID NO: 2160021 - protein, 9 aa, Cryptosporidium hominis
SANNSTTKD

SEQ ID NO: 2160022 - protein, 5 aa, Cryptosporidium hominis
SANQE

SEQ ID NO: 2160023 - protein, 10 aa, Cryptosporidium hominis
SANSGLSDKD

SEQ ID NO: 2160024 - protein, 5 aa, Cryptosporidium hominis
SANTE

SEQ ID NO: 2160025 - protein, 8 aa, Cryptosporidium hominis
SANYSNQC

SEQ ID NO: 2160026 - protein, 12 aa, Cryptosporidium hominis
SAPFQETNNLGE

SEQ ID NO: 2160027 - protein, 6 aa, Cryptosporidium hominis
SAPGGK

SEQ ID NO: 2160028 - protein, 7 aa, Cryptosporidium hominis
SAPGSKS

SEQ ID NO: 2160029 - protein, 8 aa, Cryptosporidium hominis
SAPIQPKP

SEQ ID NO: 2160030 - protein, 24 aa, Cryptosporidium hominis
SAPNYGRSSSAGRPTFTNSSTLNP

SEQ ID NO: 2160031 - protein, 8 aa, Cryptosporidium hominis
SAPPKDNV

SEQ ID NO: 2160032 - protein, 9 aa, Cryptosporidium hominis
SAPQPSIDS

SEQ ID NO: 2160033 - protein, 6 aa, Cryptosporidium hominis
SAPRPD

SEQ ID NO: 2160034 - protein, 8 aa, Cryptosporidium hominis
SAPSMSTP

SEQ ID NO: 2160035 - protein, 7 aa, Cryptosporidium hominis
SAPTDAT

SEQ ID NO: 2160036 - protein, 25 aa, Cryptosporidium hominis
SAPTNPLNSQKDANFSNSFSISSND

SEQ ID NO: 2160037 - protein, 38 aa, Cryptosporidium hominis
SAPTPTPASGNPEDSNSNDAQSNESKPEEQPAVPQPTM

SEQ ID NO: 2160038 - protein, 9 aa, Cryptosporidium hominis
SAPTSGGKT

SEQ ID NO: 2160039 - protein, 9 aa, Cryptosporidium hominis
SAPYSSTSL

SEQ ID NO: 2160040 - protein, 6 aa, Cryptosporidium hominis
SAQANT

SEQ ID NO: 2160041 - protein, 9 aa, Cryptosporidium hominis
SAQEQEENI

SEQ ID NO: 2160042 - protein, 8 aa, Cryptosporidium hominis
SAQGSSLA

SEQ ID NO: 2160043 - protein, 4 aa, Cryptosporidium hominis
SAQI

SEQ ID NO: 2160044 - protein, 6 aa, Cryptosporidium hominis
SAQISE

SEQ ID NO: 2160045 - protein, 8 aa, Cryptosporidium hominis
SAQKGQKM

SEQ ID NO: 2160046 - protein, 18 aa, Cryptosporidium hominis
SAQPASSVISKERADTLR

SEQ ID NO: 2160047 - protein, 7 aa, Cryptosporidium hominis
SAQPSVG

SEQ ID NO: 2160048 - protein, 4 aa, Cryptosporidium hominis
SAQQ

SEQ ID NO: 2160049 - protein, 4 aa, Cryptosporidium hominis
SAQS

SEQ ID NO: 2160050 - protein, 6 aa, Cryptosporidium hominis
SARKGH

SEQ ID NO: 2160051 - protein, 5 aa, Cryptosporidium hominis
SARKN

SEQ ID NO: 2160052 - protein, 7 aa, Cryptosporidium hominis
SARKNIP

SEQ ID NO: 2160053 - protein, 14 aa, Cryptosporidium hominis
SARNNTSFKSISNE

SEQ ID NO: 2160054 - protein, 10 aa, Cryptosporidium hominis
SARRGDPQGA

SEQ ID NO: 2160055 - protein, 7 aa, Cryptosporidium hominis
SASDSKL

SEQ ID NO: 2160056 - protein, 9 aa, Cryptosporidium hominis
SASEEESTI

SEQ ID NO: 2160057 - protein, 8 aa, Cryptosporidium hominis
SASEKINQ

SEQ ID NO: 2160058 - protein, 17 aa, Cryptosporidium hominis
SASESLLSQKSAQIDPA

SEQ ID NO: 2160059 - protein, 5 aa, Cryptosporidium hominis
SASFD

SEQ ID NO: 2160060 - protein, 13 aa, Cryptosporidium hominis
SASGGVDKSVNNS

SEQ ID NO: 2160061 - protein, 8 aa, Cryptosporidium hominis
SASGSDGY

SEQ ID NO: 2160062 - protein, 4 aa, Cryptosporidium hominis
SASI

SEQ ID NO: 2160063 - protein, 14 aa, Cryptosporidium hominis
SASISRSPSTKMSK

SEQ ID NO: 2160064 - protein, 7 aa, Cryptosporidium hominis
SASKDPR

SEQ ID NO: 2160065 - protein, 37 aa, Cryptosporidium hominis
SASNERKNTHKTPSRPPLSEKQKLETRKEVDSSLSCD

SEQ ID NO: 2160066 - protein, 21 aa, Cryptosporidium hominis
SASNHIEKNEINDGRSNGDPI

SEQ ID NO: 2160067 - protein, 20 aa, Cryptosporidium hominis
SASNKEVNKKSNTSENKEND

SEQ ID NO: 2160068 - protein, 9 aa, Cryptosporidium hominis
SASNNKQIS

SEQ ID NO: 2160069 - protein, 13 aa, Cryptosporidium hominis
SASNSGESYGTEA

SEQ ID NO: 2160070 - protein, 7 aa, Cryptosporidium hominis
SASPCCT

SEQ ID NO: 2160071 - protein, 5 aa, Cryptosporidium hominis
SASPK

SEQ ID NO: 2160072 - protein, 19 aa, Cryptosporidium hominis
SASPPSPPPPPPLSPLPPP

SEQ ID NO: 2160073 - protein, 9 aa, Cryptosporidium hominis
SASQGEGDL

SEQ ID NO: 2160074 - protein, 7 aa, Cryptosporidium hominis
SASSDST

SEQ ID NO: 2160075 - protein, 7 aa, Cryptosporidium hominis
SASSFEE

SEQ ID NO: 2160076 - protein, 5 aa, Cryptosporidium hominis
SASSI

SEQ ID NO: 2160077 - protein, 18 aa, Cryptosporidium hominis
SASSTASTTPSSTPGGLA

SEQ ID NO: 2160078 - protein, 13 aa, Cryptosporidium hominis
SASSVSVSGNIKS

SEQ ID NO: 2160079 - protein, 6 aa, Cryptosporidium hominis
SASTES

SEQ ID NO: 2160080 - protein, 7 aa, Cryptosporidium hominis
SASTLGN

SEQ ID NO: 2160081 - protein, 13 aa, Cryptosporidium hominis
SASTTNAGEKNLK

SEQ ID NO: 2160082 - protein, 12 aa, Cryptosporidium hominis
SASVTDQKPCPG

SEQ ID NO: 2160083 - protein, 5 aa, Cryptosporidium hominis
SATAS

SEQ ID NO: 2160084 - protein, 4 aa, Cryptosporidium hominis
SATE

SEQ ID NO: 2160085 - protein, 9 aa, Cryptosporidium hominis
SATESYSPL

SEQ ID NO: 2160086 - protein, 10 aa, Cryptosporidium hominis
SATKAIKNIN

SEQ ID NO: 2160087 - protein, 11 aa, Cryptosporidium hominis
SATLDGSRSAQ

SEQ ID NO: 2160088 - protein, 8 aa, Cryptosporidium hominis
SATNNQTN

SEQ ID NO: 2160089 - protein, 40 aa, Cryptosporidium hominis
SATPSDGSAFEGAQTSTTASTASSSEASTYPSTIGQQNDP

SEQ ID NO: 2160090 - protein, 4 aa, Cryptosporidium hominis
SATS

SEQ ID NO: 2160091 - protein, 9 aa, Cryptosporidium hominis
SATSEFSTT

SEQ ID NO: 2160092 - protein, 9 aa, Cryptosporidium hominis
SATTGKPKG

SEQ ID NO: 2160093 - protein, 6 aa, Cryptosporidium hominis
SATTNI

SEQ ID NO: 2160094 - protein, 20 aa, Cryptosporidium hominis
SATVSNNNIQSTNSESQEPL

SEQ ID NO: 2160095 - protein, 4 aa, Cryptosporidium hominis
SAVG

SEQ ID NO: 2160096 - protein, 16 aa, Cryptosporidium hominis
SAVQTNRTTTTSNAKR

SEQ ID NO: 2160097 - protein, 7 aa, Cryptosporidium hominis
SAVSSST

SEQ ID NO: 2160098 - protein, 7 aa, Cryptosporidium hominis
SAVTTND

SEQ ID NO: 2160099 - protein, 29 aa, Cryptosporidium hominis
SAWKGNKGGNNDLENGNKNGSDGFKPSEK

SEQ ID NO: 2160100 - protein, 5 aa, Cryptosporidium hominis
SAYLD

SEQ ID NO: 2160101 - protein, 4 aa, Cryptosporidium hominis
SAYN

SEQ ID NO: 2160102 - protein, 8 aa, Cryptosporidium hominis
SAYNQRSI

SEQ ID NO: 2160103 - protein, 6 aa, Cryptosporidium hominis
SAYSNI

SEQ ID NO: 2160104 - protein, 25 aa, Cryptosporidium hominis
SAYSSALKKRASGKTAVNSNSSRSH

SEQ ID NO: 2160105 - protein, 9 aa, Cryptosporidium hominis
SAYSSATEA

SEQ ID NO: 2160106 - protein, 9 aa, Cryptosporidium hominis
SCADESNHL

SEQ ID NO: 2160107 - protein, 5 aa, Cryptosporidium hominis
SCDNT

SEQ ID NO: 2160108 - protein, 4 aa, Cryptosporidium hominis
SCDP

SEQ ID NO: 2160109 - protein, 9 aa, Cryptosporidium hominis
SCEKAEDNP

SEQ ID NO: 2160110 - protein, 7 aa, Cryptosporidium hominis
SCENGKE

SEQ ID NO: 2160111 - protein, 6 aa, Cryptosporidium hominis
SCGASA

SEQ ID NO: 2160112 - protein, 4 aa, Cryptosporidium hominis
SCGD

SEQ ID NO: 2160113 - protein, 7 aa, Cryptosporidium hominis
SCGSNYS

SEQ ID NO: 2160114 - protein, 12 aa, Cryptosporidium hominis
SCGSPNYAAPEV

SEQ ID NO: 2160115 - protein, 8 aa, Cryptosporidium hominis
SCGYPSAK

SEQ ID NO: 2160116 - protein, 4 aa, Cryptosporidium hominis
SCHR

SEQ ID NO: 2160117 - protein, 7 aa, Cryptosporidium hominis
SCISSSH

SEQ ID NO: 2160118 - protein, 4 aa, Cryptosporidium hominis
SCIT

SEQ ID NO: 2160119 - protein, 8 aa, Cryptosporidium hominis
SCKEIRQS

SEQ ID NO: 2160120 - protein, 7 aa, Cryptosporidium hominis
SCKKEKE

SEQ ID NO: 2160121 - protein, 18 aa, Cryptosporidium hominis
SCNKKGSKKGLDKEYQSK

SEQ ID NO: 2160122 - protein, 9 aa, Cryptosporidium hominis
SCNNENGDF

SEQ ID NO: 2160123 - protein, 7 aa, Cryptosporidium hominis
SCNQDSS

SEQ ID NO: 2160124 - protein, 8 aa, Cryptosporidium hominis
SCNTNTNN

SEQ ID NO: 2160125 - protein, 7 aa, Cryptosporidium hominis
SCQKTPQ

SEQ ID NO: 2160126 - protein, 13 aa, Cryptosporidium hominis
SCQNNKGGASIGS

SEQ ID NO: 2160127 - protein, 5 aa, Cryptosporidium hominis
SCQPN

SEQ ID NO: 2160128 - protein, 7 aa, Cryptosporidium hominis
SCSEAAP

SEQ ID NO: 2160129 - protein, 31 aa, Cryptosporidium hominis
SCSGSEDDGSLTKNVENSQSQNSDSDLDIDN

SEQ ID NO: 2160130 - protein, 12 aa, Cryptosporidium hominis
SCSGSGLPQHGK

SEQ ID NO: 2160131 - protein, 21 aa, Cryptosporidium hominis
SCSNGGNNISNNSKSSTSELA

SEQ ID NO: 2160132 - protein, 17 aa, Cryptosporidium hominis
SCSNIEKSNQNSARATD

SEQ ID NO: 2160133 - protein, 9 aa, Cryptosporidium hominis
SCSPATGAQ

SEQ ID NO: 2160134 - protein, 8 aa, Cryptosporidium hominis
SCSSAAGS

SEQ ID NO: 2160135 - protein, 11 aa, Cryptosporidium hominis
SCSSGDLQENA

SEQ ID NO: 2160136 - protein, 6 aa, Cryptosporidium hominis
SCSSPS

SEQ ID NO: 2160137 - protein, 9 aa, Cryptosporidium hominis
SCSSSNNIK

SEQ ID NO: 2160138 - protein, 15 aa, Cryptosporidium hominis
SCSTTTNSIPNTSDI

SEQ ID NO: 2160139 - protein, 5 aa, Cryptosporidium hominis
SCTGR

SEQ ID NO: 2160140 - protein, 7 aa, Cryptosporidium hominis
SCTSDDW

SEQ ID NO: 2160141 - protein, 8 aa, Cryptosporidium hominis
SCTSGSGS

SEQ ID NO: 2160142 - protein, 8 aa, Cryptosporidium hominis
SDAAVPKE

SEQ ID NO: 2160143 - protein, 25 aa, Cryptosporidium hominis
SDADPNVTYASSTSGFSSGSASVGL

SEQ ID NO: 2160144 - protein, 8 aa, Cryptosporidium hominis
SDADSRLS

SEQ ID NO: 2160145 - protein, 11 aa, Cryptosporidium hominis
SDAEDNEENFT

SEQ ID NO: 2160146 - protein, 5 aa, Cryptosporidium hominis
SDAEF

SEQ ID NO: 2160147 - protein, 6 aa, Cryptosporidium hominis
SDAEID

SEQ ID NO: 2160148 - protein, 15 aa, Cryptosporidium hominis
SDAETNKGERVSPCP

SEQ ID NO: 2160149 - protein, 13 aa, Cryptosporidium hominis
SDAKNDPAKGCED

SEQ ID NO: 2160150 - protein, 5 aa, Cryptosporidium hominis
SDANA

SEQ ID NO: 2160151 - protein, 5 aa, Cryptosporidium hominis
SDAQE

SEQ ID NO: 2160152 - protein, 11 aa, Cryptosporidium hominis
SDATPTHSKSN

SEQ ID NO: 2160153 - protein, 8 aa, Cryptosporidium hominis
SDATSSNI

SEQ ID NO: 2160154 - protein, 5 aa, Cryptosporidium hominis
SDAYK

SEQ ID NO: 2160155 - protein, 5 aa, Cryptosporidium hominis
SDCDT

SEQ ID NO: 2160156 - protein, 17 aa, Cryptosporidium hominis
SDCNKESNSEIKTSNKK

SEQ ID NO: 2160157 - protein, 11 aa, Cryptosporidium hominis
SDCNNRLAESD

SEQ ID NO: 2160158 - protein, 15 aa, Cryptosporidium hominis
SDDAHDNQNNESSLN

SEQ ID NO: 2160159 - protein, 6 aa, Cryptosporidium hominis
SDDAKD

SEQ ID NO: 2160160 - protein, 8 aa, Cryptosporidium hominis
SDDDCTAF

SEQ ID NO: 2160161 - protein, 9 aa, Cryptosporidium hominis
SDDDDENEM

SEQ ID NO: 2160162 - protein, 8 aa, Cryptosporidium hominis
SDDDVSKQ

SEQ ID NO: 2160163 - protein, 7 aa, Cryptosporidium hominis
SDDENVE

SEQ ID NO: 2160164 - protein, 9 aa, Cryptosporidium hominis
SDDETEDEF

SEQ ID NO: 2160165 - protein, 4 aa, Cryptosporidium hominis
SDDG

SEQ ID NO: 2160166 - protein, 7 aa, Cryptosporidium hominis
SDDGDIT

SEQ ID NO: 2160167 - protein, 8 aa, Cryptosporidium hominis
SDDGHLRD

SEQ ID NO: 2160168 - protein, 10 aa, Cryptosporidium hominis
SDDGSGIDKN

SEQ ID NO: 2160169 - protein, 8 aa, Cryptosporidium hominis
SDDHSDQN

SEQ ID NO: 2160170 - protein, 6 aa, Cryptosporidium hominis
SDDHTQ

SEQ ID NO: 2160171 - protein, 6 aa, Cryptosporidium hominis
SDDLRQ

SEQ ID NO: 2160172 - protein, 4 aa, Cryptosporidium hominis
SDDN

SEQ ID NO: 2160173 - protein, 9 aa, Cryptosporidium hominis
SDDNESDIE

SEQ ID NO: 2160174 - protein, 27 aa, Cryptosporidium hominis
SDDNIKNNVKNSNNDNSGNNRNIPDKN

SEQ ID NO: 2160175 - protein, 5 aa, Cryptosporidium hominis
SDDNK

SEQ ID NO: 2160176 - protein, 6 aa, Cryptosporidium hominis
SDDRWK

SEQ ID NO: 2160177 - protein, 6 aa, Cryptosporidium hominis
SDDSNS

SEQ ID NO: 2160178 - protein, 4 aa, Cryptosporidium hominis
SDDT

SEQ ID NO: 2160179 - protein, 13 aa, Cryptosporidium hominis
SDDTLDDDEFGNN

SEQ ID NO: 2160180 - protein, 6 aa, Cryptosporidium hominis
SDDVST

SEQ ID NO: 2160181 - protein, 4 aa, Cryptosporidium hominis
SDEA

SEQ ID NO: 2160182 - protein, 5 aa, Cryptosporidium hominis
SDEAK

SEQ ID NO: 2160183 - protein, 10 aa, Cryptosporidium hominis
SDEAMESSET

SEQ ID NO: 2160184 - protein, 58 aa, Cryptosporidium hominis
SDEEEDEEEEEEEEEPELENSKIDNKKSLKRKLPSKSDESTEEEIDDEEIDSDEADDL

SEQ ID NO: 2160185 - protein, 11 aa, Cryptosporidium hominis
SDEEETIRSSQ

SEQ ID NO: 2160186 - protein, 7 aa, Cryptosporidium hominis
SDEEKSN

SEQ ID NO: 2160187 - protein, 5 aa, Cryptosporidium hominis
SDEEL

SEQ ID NO: 2160188 - protein, 10 aa, Cryptosporidium hominis
SDEELNSDSE

SEQ ID NO: 2160189 - protein, 8 aa, Cryptosporidium hominis
SDEETHRL

SEQ ID NO: 2160190 - protein, 6 aa, Cryptosporidium hominis
SDEEVK

SEQ ID NO: 2160191 - protein, 4 aa, Cryptosporidium hominis
SDEL

SEQ ID NO: 2160192 - protein, 8 aa, Cryptosporidium hominis
SDELRGNH

SEQ ID NO: 2160193 - protein, 5 aa, Cryptosporidium hominis
SDELT

SEQ ID NO: 2160194 - protein, 10 aa, Cryptosporidium hominis
SDENNESIDE

SEQ ID NO: 2160195 - protein, 11 aa, Cryptosporidium hominis
SDENSAQDKST

SEQ ID NO: 2160196 - protein, 12 aa, Cryptosporidium hominis
SDENYTSSTDEF

SEQ ID NO: 2160197 - protein, 13 aa, Cryptosporidium hominis
SDEPESRKVLSSQ

SEQ ID NO: 2160198 - protein, 19 aa, Cryptosporidium hominis
SDEQENEGEGMEFDGDKND

SEQ ID NO: 2160199 - protein, 17 aa, Cryptosporidium hominis
SDESRNGSFGASKDQID

SEQ ID NO: 2160200 - protein, 9 aa, Cryptosporidium hominis
SDESRQSLK

SEQ ID NO: 2160201 - protein, 11 aa, Cryptosporidium hominis
SDESSKSSINE

SEQ ID NO: 2160202 - protein, 16 aa, Cryptosporidium hominis
SDFGSSQANEYGESDI

SEQ ID NO: 2160203 - protein, 4 aa, Cryptosporidium hominis
SDFN

SEQ ID NO: 2160204 - protein, 8 aa, Cryptosporidium hominis
SDFNSDSD

SEQ ID NO: 2160205 - protein, 9 aa, Cryptosporidium hominis
SDFQEPPNY

SEQ ID NO: 2160206 - protein, 5 aa, Cryptosporidium hominis
SDFSN

SEQ ID NO: 2160207 - protein, 6 aa, Cryptosporidium hominis
SDFTQT

SEQ ID NO: 2160208 - protein, 12 aa, Cryptosporidium hominis
SDGDKENNPNTF

SEQ ID NO: 2160209 - protein, 7 aa, Cryptosporidium hominis
SDGEARE

SEQ ID NO: 2160210 - protein, 12 aa, Cryptosporidium hominis
SDGEDPDEHEGM

SEQ ID NO: 2160211 - protein, 12 aa, Cryptosporidium hominis
SDGESLLLDYGF

SEQ ID NO: 2160212 - protein, 9 aa, Cryptosporidium hominis
SDGGKKDII

SEQ ID NO: 2160213 - protein, 10 aa, Cryptosporidium hominis
SDGGYGYDST

SEQ ID NO: 2160214 - protein, 5 aa, Cryptosporidium hominis
SDGIN

SEQ ID NO: 2160215 - protein, 7 aa, Cryptosporidium hominis
SDGKIRT

SEQ ID NO: 2160216 - protein, 44 aa, Cryptosporidium hominis
SDGKSETFGNNSNSIAADLTNDSDKITEKDAISGTSKAKVETSN

SEQ ID NO: 2160217 - protein, 14 aa, Cryptosporidium hominis
SDGKSLTANKQRSN

SEQ ID NO: 2160218 - protein, 7 aa, Cryptosporidium hominis
SDGNKGE

SEQ ID NO: 2160219 - protein, 5 aa, Cryptosporidium hominis
SDGNN

SEQ ID NO: 2160220 - protein, 6 aa, Cryptosporidium hominis
SDGNSL

SEQ ID NO: 2160221 - protein, 8 aa, Cryptosporidium hominis
SDGPNDRV

SEQ ID NO: 2160222 - protein, 9 aa, Cryptosporidium hominis
SDGQAKADY

SEQ ID NO: 2160223 - protein, 6 aa, Cryptosporidium hominis
SDGSGC

SEQ ID NO: 2160224 - protein, 5 aa, Cryptosporidium hominis
SDGSH

SEQ ID NO: 2160225 - protein, 12 aa, Cryptosporidium hominis
SDGSNSKNVGQK

SEQ ID NO: 2160226 - protein, 6 aa, Cryptosporidium hominis
SDGSSN

SEQ ID NO: 2160227 - protein, 8 aa, Cryptosporidium hominis
SDGSSSWK

SEQ ID NO: 2160228 - protein, 6 aa, Cryptosporidium hominis
SDGTVE

SEQ ID NO: 2160229 - protein, 8 aa, Cryptosporidium hominis
SDGVSEAA

SEQ ID NO: 2160230 - protein, 8 aa, Cryptosporidium hominis
SDHETQNR

SEQ ID NO: 2160231 - protein, 7 aa, Cryptosporidium hominis
SDHFSKG

SEQ ID NO: 2160232 - protein, 49 aa, Cryptosporidium hominis
SDHPTLSDHTNSQEKSSRVDVADNKSSAANQEHSPADSFDGSKYSSKMT

SEQ ID NO: 2160233 - protein, 9 aa, Cryptosporidium hominis
SDHQNVPDT

SEQ ID NO: 2160234 - protein, 5 aa, Cryptosporidium hominis
SDHRK

SEQ ID NO: 2160235 - protein, 44 aa, Cryptosporidium hominis
SDHSSIPESSVDITSTNNTCNSSSCNKDNKEVGITKSQTPSKSI

SEQ ID NO: 2160236 - protein, 15 aa, Cryptosporidium hominis
SDIDSKIKSNNQISS

SEQ ID NO: 2160237 - protein, 6 aa, Cryptosporidium hominis
SDIDTI

SEQ ID NO: 2160238 - protein, 8 aa, Cryptosporidium hominis
SDIEDKSR

SEQ ID NO: 2160239 - protein, 9 aa, Cryptosporidium hominis
SDIFGSEKS

SEQ ID NO: 2160240 - protein, 5 aa, Cryptosporidium hominis
SDIGQ

SEQ ID NO: 2160241 - protein, 8 aa, Cryptosporidium hominis
SDINDKEE

SEQ ID NO: 2160242 - protein, 11 aa, Cryptosporidium hominis
SDINNDGSEDE

SEQ ID NO: 2160243 - protein, 4 aa, Cryptosporidium hominis
SDIQ

SEQ ID NO: 2160244 - protein, 7 aa, Cryptosporidium hominis
SDIQEDD

SEQ ID NO: 2160245 - protein, 4 aa, Cryptosporidium hominis
SDIS

SEQ ID NO: 2160246 - protein, 6 aa, Cryptosporidium hominis
SDISPI

SEQ ID NO: 2160247 - protein, 9 aa, Cryptosporidium hominis
SDKDQSCQK

SEQ ID NO: 2160248 - protein, 7 aa, Cryptosporidium hominis
SDKEEDM

SEQ ID NO: 2160249 - protein, 7 aa, Cryptosporidium hominis
SDKEGFK

SEQ ID NO: 2160250 - protein, 11 aa, Cryptosporidium hominis
SDKHDQNSSLN

SEQ ID NO: 2160251 - protein, 7 aa, Cryptosporidium hominis
SDKISNN

SEQ ID NO: 2160252 - protein, 10 aa, Cryptosporidium hominis
SDKKSENTLS

SEQ ID NO: 2160253 - protein, 7 aa, Cryptosporidium hominis
SDKNIGF

SEQ ID NO: 2160254 - protein, 10 aa, Cryptosporidium hominis
SDKNSPNDIN

SEQ ID NO: 2160255 - protein, 9 aa, Cryptosporidium hominis
SDKNTSKID

SEQ ID NO: 2160256 - protein, 5 aa, Cryptosporidium hominis
SDKPM

SEQ ID NO: 2160257 - protein, 7 aa, Cryptosporidium hominis
SDKPSFT

SEQ ID NO: 2160258 - protein, 6 aa, Cryptosporidium hominis
SDKPYK

SEQ ID NO: 2160259 - protein, 11 aa, Cryptosporidium hominis
SDKQAKEEDLK

SEQ ID NO: 2160260 - protein, 19 aa, Cryptosporidium hominis
SDKQQDVEKKKKEERERRI

SEQ ID NO: 2160261 - protein, 8 aa, Cryptosporidium hominis
SDKQREKV

SEQ ID NO: 2160262 - protein, 6 aa, Cryptosporidium hominis
SDKRFE

SEQ ID NO: 2160263 - protein, 7 aa, Cryptosporidium hominis
SDKRKLS

SEQ ID NO: 2160264 - protein, 8 aa, Cryptosporidium hominis
SDKRPTII

SEQ ID NO: 2160265 - protein, 8 aa, Cryptosporidium hominis
SDKRQSTI

SEQ ID NO: 2160266 - protein, 8 aa, Cryptosporidium hominis
SDKSEDKH

SEQ ID NO: 2160267 - protein, 9 aa, Cryptosporidium hominis
SDKSHSIEE

SEQ ID NO: 2160268 - protein, 16 aa, Cryptosporidium hominis
SDKSLSNNNNFTPTKD

SEQ ID NO: 2160269 - protein, 12 aa, Cryptosporidium hominis
SDKSSGKPAGLY

SEQ ID NO: 2160270 - protein, 8 aa, Cryptosporidium hominis
SDKTKLSS

SEQ ID NO: 2160271 - protein, 4 aa, Cryptosporidium hominis
SDKV

SEQ ID NO: 2160272 - protein, 10 aa, Cryptosporidium hominis
SDLDDEEPEC

SEQ ID NO: 2160273 - protein, 10 aa, Cryptosporidium hominis
SDLKEDFPSE

SEQ ID NO: 2160274 - protein, 8 aa, Cryptosporidium hominis
SDLNEGEE

SEQ ID NO: 2160275 - protein, 5 aa, Cryptosporidium hominis
SDLNS

SEQ ID NO: 2160276 - protein, 4 aa, Cryptosporidium hominis
SDLP

SEQ ID NO: 2160277 - protein, 14 aa, Cryptosporidium hominis
SDLPSNEASLELSE

SEQ ID NO: 2160278 - protein, 6 aa, Cryptosporidium hominis
SDLQDR

SEQ ID NO: 2160279 - protein, 5 aa, Cryptosporidium hominis
SDLQI

SEQ ID NO: 2160280 - protein, 8 aa, Cryptosporidium hominis
SDLSNEAS

SEQ ID NO: 2160281 - protein, 7 aa, Cryptosporidium hominis
SDLSSTH

SEQ ID NO: 2160282 - protein, 13 aa, Cryptosporidium hominis
SDMESKNPASDVS

SEQ ID NO: 2160283 - protein, 26 aa, Cryptosporidium hominis
SDMKKQKNKEPDYQSDYSNLSSPLKS

SEQ ID NO: 2160284 - protein, 5 aa, Cryptosporidium hominis
SDMNG

SEQ ID NO: 2160285 - protein, 7 aa, Cryptosporidium hominis
SDNADTL

SEQ ID NO: 2160286 - protein, 15 aa, Cryptosporidium hominis
SDNAISSSPSASSSI

SEQ ID NO: 2160287 - protein, 17 aa, Cryptosporidium hominis
SDNANSSNTFDEPKDKT

SEQ ID NO: 2160288 - protein, 6 aa, Cryptosporidium hominis
SDNEDH

SEQ ID NO: 2160289 - protein, 7 aa, Cryptosporidium hominis
SDNEGKC

SEQ ID NO: 2160290 - protein, 12 aa, Cryptosporidium hominis
SDNENDSNVNKR

SEQ ID NO: 2160291 - protein, 9 aa, Cryptosporidium hominis
SDNFDKSKI

SEQ ID NO: 2160292 - protein, 24 aa, Cryptosporidium hominis
SDNIETELGEKEQEEESLGGRKRS

SEQ ID NO: 2160293 - protein, 20 aa, Cryptosporidium hominis
SDNISKEGVNRNSNSLMNNF

SEQ ID NO: 2160294 - protein, 6 aa, Cryptosporidium hominis
SDNITS

SEQ ID NO: 2160295 - protein, 9 aa, Cryptosporidium hominis
SDNKEKLNS

SEQ ID NO: 2160296 - protein, 9 aa, Cryptosporidium hominis
SDNKENSEK

SEQ ID NO: 2160297 - protein, 7 aa, Cryptosporidium hominis
SDNKNEE

SEQ ID NO: 2160298 - protein, 6 aa, Cryptosporidium hominis
SDNLRR

SEQ ID NO: 2160299 - protein, 6 aa, Cryptosporidium hominis
SDNNGS

SEQ ID NO: 2160300 - protein, 13 aa, Cryptosporidium hominis
SDNNGSIKNNFGQ

SEQ ID NO: 2160301 - protein, 8 aa, Cryptosporidium hominis
SDNNISID

SEQ ID NO: 2160302 - protein, 13 aa, Cryptosporidium hominis
SDNPFNNNDRNYN

SEQ ID NO: 2160303 - protein, 6 aa, Cryptosporidium hominis
SDNPIQ

SEQ ID NO: 2160304 - protein, 7 aa, Cryptosporidium hominis
SDNPQKI

SEQ ID NO: 2160305 - protein, 11 aa, Cryptosporidium hominis
SDNQKKARDEV

SEQ ID NO: 2160306 - protein, 9 aa, Cryptosporidium hominis
SDNQKNKEF

SEQ ID NO: 2160307 - protein, 6 aa, Cryptosporidium hominis
SDNQNF

SEQ ID NO: 2160308 - protein, 10 aa, Cryptosporidium hominis
SDNQNGSKMQ

SEQ ID NO: 2160309 - protein, 4 aa, Cryptosporidium hominis
SDNS

SEQ ID NO: 2160310 - protein, 21 aa, Cryptosporidium hominis
SDNSQISDSESEFSSDNSTIK

SEQ ID NO: 2160311 - protein, 8 aa, Cryptosporidium hominis
SDNSREQC

SEQ ID NO: 2160312 - protein, 36 aa, Cryptosporidium hominis
SDNSSTSLFSDSSTSLNSKYKSKYSSDTQSSTYRSN

SEQ ID NO: 2160313 - protein, 4 aa, Cryptosporidium hominis
SDNY

SEQ ID NO: 2160314 - protein, 8 aa, Cryptosporidium hominis
SDPEKRKI

SEQ ID NO: 2160315 - protein, 21 aa, Cryptosporidium hominis
SDPEKRNRYDTYGADGVSADF

SEQ ID NO: 2160316 - protein, 6 aa, Cryptosporidium hominis
SDPELE

SEQ ID NO: 2160317 - protein, 5 aa, Cryptosporidium hominis
SDPEN

SEQ ID NO: 2160318 - protein, 9 aa, Cryptosporidium hominis
SDPFPQEQY

SEQ ID NO: 2160319 - protein, 17 aa, Cryptosporidium hominis
SDPGNKSNSTFGNPQAT

SEQ ID NO: 2160320 - protein, 6 aa, Cryptosporidium hominis
SDPGNW

SEQ ID NO: 2160321 - protein, 10 aa, Cryptosporidium hominis
SDPGSDLENV

SEQ ID NO: 2160322 - protein, 4 aa, Cryptosporidium hominis
SDPH

SEQ ID NO: 2160323 - protein, 15 aa, Cryptosporidium hominis
SDPHMSEYTPDKYKR

SEQ ID NO: 2160324 - protein, 12 aa, Cryptosporidium hominis
SDPKKRPTAENA

SEQ ID NO: 2160325 - protein, 4 aa, Cryptosporidium hominis
SDPL

SEQ ID NO: 2160326 - protein, 7 aa, Cryptosporidium hominis
SDPLDSK

SEQ ID NO: 2160327 - protein, 6 aa, Cryptosporidium hominis
SDPNAL

SEQ ID NO: 2160328 - protein, 12 aa, Cryptosporidium hominis
SDPNPNSPANTI

SEQ ID NO: 2160329 - protein, 7 aa, Cryptosporidium hominis
SDPNQVN

SEQ ID NO: 2160330 - protein, 5 aa, Cryptosporidium hominis
SDPNS

SEQ ID NO: 2160331 - protein, 8 aa, Cryptosporidium hominis
SDPPSSNL

SEQ ID NO: 2160332 - protein, 4 aa, Cryptosporidium hominis
SDPQ

SEQ ID NO: 2160333 - protein, 6 aa, Cryptosporidium hominis
SDPQEA

SEQ ID NO: 2160334 - protein, 5 aa, Cryptosporidium hominis
SDPSK

SEQ ID NO: 2160335 - protein, 5 aa, Cryptosporidium hominis
SDPTD

SEQ ID NO: 2160336 - protein, 14 aa, Cryptosporidium hominis
SDPVSKDEVKREQM

SEQ ID NO: 2160337 - protein, 9 aa, Cryptosporidium hominis
SDPYTRDYY

SEQ ID NO: 2160338 - protein, 12 aa, Cryptosporidium hominis
SDQAYSRNQSEF

SEQ ID NO: 2160339 - protein, 21 aa, Cryptosporidium hominis
SDQDVTSPSGSKKDNETITSN

SEQ ID NO: 2160340 - protein, 5 aa, Cryptosporidium hominis
SDQEE

SEQ ID NO: 2160341 - protein, 7 aa, Cryptosporidium hominis
SDQEPVQ

SEQ ID NO: 2160342 - protein, 8 aa, Cryptosporidium hominis
SDQESESL

SEQ ID NO: 2160343 - protein, 4 aa, Cryptosporidium hominis
SDQK

SEQ ID NO: 2160344 - protein, 8 aa, Cryptosporidium hominis
SDQKESQN

SEQ ID NO: 2160345 - protein, 14 aa, Cryptosporidium hominis
SDQMSDEPRNSSLS

SEQ ID NO: 2160346 - protein, 19 aa, Cryptosporidium hominis
SDQSKSKESEVVPSNETEI

SEQ ID NO: 2160347 - protein, 4 aa, Cryptosporidium hominis
SDQV

SEQ ID NO: 2160348 - protein, 6 aa, Cryptosporidium hominis
SDQYSS

SEQ ID NO: 2160349 - protein, 5 aa, Cryptosporidium hominis
SDRAI

SEQ ID NO: 2160350 - protein, 27 aa, Cryptosporidium hominis
SDRALKKEKKKLAMDSQKISSALSNEI

SEQ ID NO: 2160351 - protein, 8 aa, Cryptosporidium hominis
SDRESNDD

SEQ ID NO: 2160352 - protein, 5 aa, Cryptosporidium hominis
SDRPR

SEQ ID NO: 2160353 - protein, 5 aa, Cryptosporidium hominis
SDRQV

SEQ ID NO: 2160354 - protein, 8 aa, Cryptosporidium hominis
SDRSEDDL

SEQ ID NO: 2160355 - protein, 13 aa, Cryptosporidium hominis
SDSADKDERNQSL

SEQ ID NO: 2160356 - protein, 6 aa, Cryptosporidium hominis
SDSAEH

SEQ ID NO: 2160357 - protein, 6 aa, Cryptosporidium hominis
SDSAKD

SEQ ID NO: 2160358 - protein, 8 aa, Cryptosporidium hominis
SDSANKKE

SEQ ID NO: 2160359 - protein, 10 aa, Cryptosporidium hominis
SDSAPKALQG

SEQ ID NO: 2160360 - protein, 11 aa, Cryptosporidium hominis
SDSASAPSGYQ

SEQ ID NO: 2160361 - protein, 7 aa, Cryptosporidium hominis
SDSDEKT

SEQ ID NO: 2160362 - protein, 6 aa, Cryptosporidium hominis
SDSDFG

SEQ ID NO: 2160363 - protein, 22 aa, Cryptosporidium hominis
SDSDVSSDKSDNEHLDPSNTEE

SEQ ID NO: 2160364 - protein, 16 aa, Cryptosporidium hominis
SDSEDELNNNVASKRS

SEQ ID NO: 2160365 - protein, 8 aa, Cryptosporidium hominis
SDSEESYD

SEQ ID NO: 2160366 - protein, 8 aa, Cryptosporidium hominis
SDSEKSSL

SEQ ID NO: 2160367 - protein, 6 aa, Cryptosporidium hominis
SDSELK

SEQ ID NO: 2160368 - protein, 5 aa, Cryptosporidium hominis
SDSEM

SEQ ID NO: 2160369 - protein, 7 aa, Cryptosporidium hominis
SDSFEKN

SEQ ID NO: 2160370 - protein, 48 aa, Cryptosporidium hominis
SDSFSEGEISDSSDHIKQNKRSRENKNITNQRKSVKNEKMGEISDSEW

SEQ ID NO: 2160371 - protein, 5 aa, Cryptosporidium hominis
SDSFT

SEQ ID NO: 2160372 - protein, 11 aa, Cryptosporidium hominis
SDSGACGPEHC

SEQ ID NO: 2160373 - protein, 5 aa, Cryptosporidium hominis
SDSGD

SEQ ID NO: 2160374 - protein, 8 aa, Cryptosporidium hominis
SDSGMETL

SEQ ID NO: 2160375 - protein, 8 aa, Cryptosporidium hominis
SDSHQSVT

SEQ ID NO: 2160376 - protein, 4 aa, Cryptosporidium hominis
SDSI

SEQ ID NO: 2160377 - protein, 9 aa, Cryptosporidium hominis
SDSIEDNSI

SEQ ID NO: 2160378 - protein, 5 aa, Cryptosporidium hominis
SDSIG

SEQ ID NO: 2160379 - protein, 4 aa, Cryptosporidium hominis
SDSK

SEQ ID NO: 2160380 - protein, 8 aa, Cryptosporidium hominis
SDSKGRPF

SEQ ID NO: 2160381 - protein, 24 aa, Cryptosporidium hominis
SDSLGNKEFGQDTSNALSQSSSQS

SEQ ID NO: 2160382 - protein, 5 aa, Cryptosporidium hominis
SDSLN

SEQ ID NO: 2160383 - protein, 5 aa, Cryptosporidium hominis
SDSNA

SEQ ID NO: 2160384 - protein, 7 aa, Cryptosporidium hominis
SDSNHGK

SEQ ID NO: 2160385 - protein, 5 aa, Cryptosporidium hominis
SDSNI

SEQ ID NO: 2160386 - protein, 8 aa, Cryptosporidium hominis
SDSNPLKP

SEQ ID NO: 2160387 - protein, 16 aa, Cryptosporidium hominis
SDSNSEISNKSQNLKD

SEQ ID NO: 2160388 - protein, 16 aa, Cryptosporidium hominis
SDSNTGNVSSQEITPN

SEQ ID NO: 2160389 - protein, 8 aa, Cryptosporidium hominis
SDSPDLKD

SEQ ID NO: 2160390 - protein, 9 aa, Cryptosporidium hominis
SDSPINQRP

SEQ ID NO: 2160391 - protein, 25 aa, Cryptosporidium hominis
SDSPSSRNSSSKVSRIPKYTGTISR

SEQ ID NO: 2160392 - protein, 5 aa, Cryptosporidium hominis
SDSQE

SEQ ID NO: 2160393 - protein, 7 aa, Cryptosporidium hominis
SDSQNTD

SEQ ID NO: 2160394 - protein, 11 aa, Cryptosporidium hominis
SDSSKDGGRLT

SEQ ID NO: 2160395 - protein, 6 aa, Cryptosporidium hominis
SDSSLL

SEQ ID NO: 2160396 - protein, 4 aa, Cryptosporidium hominis
SDST

SEQ ID NO: 2160397 - protein, 7 aa, Cryptosporidium hominis
SDSTGLT

SEQ ID NO: 2160398 - protein, 9 aa, Cryptosporidium hominis
SDSTHPNDI

SEQ ID NO: 2160399 - protein, 11 aa, Cryptosporidium hominis
SDSTKKKIFES

SEQ ID NO: 2160400 - protein, 7 aa, Cryptosporidium hominis
SDSTPIE

SEQ ID NO: 2160401 - protein, 10 aa, Cryptosporidium hominis
SDSVSQGEGV

SEQ ID NO: 2160402 - protein, 6 aa, Cryptosporidium hominis
SDSWGA

SEQ ID NO: 2160403 - protein, 13 aa, Cryptosporidium hominis
SDSYKQTSPFGKA

SEQ ID NO: 2160404 - protein, 5 aa, Cryptosporidium hominis
SDSYR

SEQ ID NO: 2160405 - protein, 7 aa, Cryptosporidium hominis
SDTASIE

SEQ ID NO: 2160406 - protein, 6 aa, Cryptosporidium hominis
SDTDFH

SEQ ID NO: 2160407 - protein, 21 aa, Cryptosporidium hominis
SDTDIQEDATIEGEGNSGGQI

SEQ ID NO: 2160408 - protein, 15 aa, Cryptosporidium hominis
SDTDKDDNTSLTSLD

SEQ ID NO: 2160409 - protein, 26 aa, Cryptosporidium hominis
SDTDTNFGKKDNETHNNGNDEKTDSY

SEQ ID NO: 2160410 - protein, 5 aa, Cryptosporidium hominis
SDTEA

SEQ ID NO: 2160411 - protein, 21 aa, Cryptosporidium hominis
SDTEESKSKYIKPSGNPGYNK

SEQ ID NO: 2160412 - protein, 16 aa, Cryptosporidium hominis
SDTEIDDENNNINTPV

SEQ ID NO: 2160413 - protein, 10 aa, Cryptosporidium hominis
SDTENNEESF

SEQ ID NO: 2160414 - protein, 11 aa, Cryptosporidium hominis
SDTESEEQLKN

SEQ ID NO: 2160415 - protein, 10 aa, Cryptosporidium hominis
SDTESLENPI

SEQ ID NO: 2160416 - protein, 6 aa, Cryptosporidium hominis
SDTETP

SEQ ID NO: 2160417 - protein, 19 aa, Cryptosporidium hominis
SDTGSKKGVISQKDNSISE

SEQ ID NO: 2160418 - protein, 12 aa, Cryptosporidium hominis
SDTGYTNKTDYA

SEQ ID NO: 2160419 - protein, 9 aa, Cryptosporidium hominis
SDTKNNGSD

SEQ ID NO: 2160420 - protein, 19 aa, Cryptosporidium hominis
SDTKYQSKSDISEHNINDN

SEQ ID NO: 2160421 - protein, 8 aa, Cryptosporidium hominis
SDTNNSYI

SEQ ID NO: 2160422 - protein, 7 aa, Cryptosporidium hominis
SDTPDVN

SEQ ID NO: 2160423 - protein, 8 aa, Cryptosporidium hominis
SDTSPEEL

SEQ ID NO: 2160424 - protein, 13 aa, Cryptosporidium hominis
SDTTNNAFLPPIT

SEQ ID NO: 2160425 - protein, 15 aa, Cryptosporidium hominis
SDTVRNDSLLIQQFI

SEQ ID NO: 2160426 - protein, 25 aa, Cryptosporidium hominis
SDTWETDGLNQHGYKKGIDRKHDNN

SEQ ID NO: 2160427 - protein, 6 aa, Cryptosporidium hominis
SDVRDR

SEQ ID NO: 2160428 - protein, 12 aa, Cryptosporidium hominis
SDVSISKGTFSK

SEQ ID NO: 2160429 - protein, 5 aa, Cryptosporidium hominis
SDVSK

SEQ ID NO: 2160430 - protein, 5 aa, Cryptosporidium hominis
SDYDE

SEQ ID NO: 2160431 - protein, 4 aa, Cryptosporidium hominis
SDYG

SEQ ID NO: 2160432 - protein, 7 aa, Cryptosporidium hominis
SDYGNET

SEQ ID NO: 2160433 - protein, 4 aa, Cryptosporidium hominis
SDYR

SEQ ID NO: 2160434 - protein, 10 aa, Cryptosporidium hominis
SDYSGKIRGH

SEQ ID NO: 2160435 - protein, 8 aa, Cryptosporidium hominis
SEAAAKKL

SEQ ID NO: 2160436 - protein, 4 aa, Cryptosporidium hominis
SEAD

SEQ ID NO: 2160437 - protein, 5 aa, Cryptosporidium hominis
SEADQ

SEQ ID NO: 2160438 - protein, 6 aa, Cryptosporidium hominis
SEAEIR

SEQ ID NO: 2160439 - protein, 6 aa, Cryptosporidium hominis
SEAISE

SEQ ID NO: 2160440 - protein, 4 aa, Cryptosporidium hominis
SEAK

SEQ ID NO: 2160441 - protein, 11 aa, Cryptosporidium hominis
SEALDSPNKTL

SEQ ID NO: 2160442 - protein, 9 aa, Cryptosporidium hominis
SEANSHASK

SEQ ID NO: 2160443 - protein, 8 aa, Cryptosporidium hominis
SEANVPKN

SEQ ID NO: 2160444 - protein, 8 aa, Cryptosporidium hominis
SEAPEEPL

SEQ ID NO: 2160445 - protein, 7 aa, Cryptosporidium hominis
SEAPELQ

SEQ ID NO: 2160446 - protein, 5 aa, Cryptosporidium hominis
SEAPK

SEQ ID NO: 2160447 - protein, 6 aa, Cryptosporidium hominis
SEAPNY

SEQ ID NO: 2160448 - protein, 7 aa, Cryptosporidium hominis
SEARRTI

SEQ ID NO: 2160449 - protein, 11 aa, Cryptosporidium hominis
SEARSFSETYS

SEQ ID NO: 2160450 - protein, 14 aa, Cryptosporidium hominis
SEASHESPLSDGKS

SEQ ID NO: 2160451 - protein, 23 aa, Cryptosporidium hominis
SEASIYSSGSGNYDNNNNNNNSN

SEQ ID NO: 2160452 - protein, 5 aa, Cryptosporidium hominis
SEASN

SEQ ID NO: 2160453 - protein, 13 aa, Cryptosporidium hominis
SEASPSLEDILQV

SEQ ID NO: 2160454 - protein, 10 aa, Cryptosporidium hominis
SEASRQFQES

SEQ ID NO: 2160455 - protein, 5 aa, Cryptosporidium hominis
SEATI

SEQ ID NO: 2160456 - protein, 30 aa, Cryptosporidium hominis
SEAYNSNDNCNNESHNGDKNIESHNKPSFA

SEQ ID NO: 2160457 - protein, 6 aa, Cryptosporidium hominis
SECDNK

SEQ ID NO: 2160458 - protein, 12 aa, Cryptosporidium hominis
SECNEQESPNYL

SEQ ID NO: 2160459 - protein, 6 aa, Cryptosporidium hominis
SECQET

SEQ ID NO: 2160460 - protein, 8 aa, Cryptosporidium hominis
SEDAGPEE

SEQ ID NO: 2160461 - protein, 8 aa, Cryptosporidium hominis
SEDASTIT

SEQ ID NO: 2160462 - protein, 9 aa, Cryptosporidium hominis
SEDATEEDL

SEQ ID NO: 2160463 - protein, 8 aa, Cryptosporidium hominis
SEDDEISR

SEQ ID NO: 2160464 - protein, 5 aa, Cryptosporidium hominis
SEDDH

SEQ ID NO: 2160465 - protein, 10 aa, Cryptosporidium hominis
SEDDLENSEQ

SEQ ID NO: 2160466 - protein, 6 aa, Cryptosporidium hominis
SEDELR

SEQ ID NO: 2160467 - protein, 6 aa, Cryptosporidium hominis
SEDEMN

SEQ ID NO: 2160468 - protein, 19 aa, Cryptosporidium hominis
SEDEQQNCGVGGNGGGELK

SEQ ID NO: 2160469 - protein, 9 aa, Cryptosporidium hominis
SEDESDSEN

SEQ ID NO: 2160470 - protein, 15 aa, Cryptosporidium hominis
SEDGGVRGNNTGFGA

SEQ ID NO: 2160471 - protein, 7 aa, Cryptosporidium hominis
SEDGKTL

SEQ ID NO: 2160472 - protein, 6 aa, Cryptosporidium hominis
SEDGSL

SEQ ID NO: 2160473 - protein, 10 aa, Cryptosporidium hominis
SEDIKTESID

SEQ ID NO: 2160474 - protein, 6 aa, Cryptosporidium hominis
SEDKQM

SEQ ID NO: 2160475 - protein, 18 aa, Cryptosporidium hominis
SEDKQVSNYQTQDGNDFN

SEQ ID NO: 2160476 - protein, 8 aa, Cryptosporidium hominis
SEDLRTPV

SEQ ID NO: 2160477 - protein, 20 aa, Cryptosporidium hominis
SEDNFQDQKMDSSESEVEDY

SEQ ID NO: 2160478 - protein, 16 aa, Cryptosporidium hominis
SEDNGITSDSQSNNVT

SEQ ID NO: 2160479 - protein, 19 aa, Cryptosporidium hominis
SEDQETDNLTNSEQLDSTN

SEQ ID NO: 2160480 - protein, 9 aa, Cryptosporidium hominis
SEDQLGSQK

SEQ ID NO: 2160481 - protein, 7 aa, Cryptosporidium hominis
SEDQLND

SEQ ID NO: 2160482 - protein, 14 aa, Cryptosporidium hominis
SEDREKNIKNQSLN

SEQ ID NO: 2160483 - protein, 7 aa, Cryptosporidium hominis
SEDSSFQ

SEQ ID NO: 2160484 - protein, 7 aa, Cryptosporidium hominis
SEDTSDL

SEQ ID NO: 2160485 - protein, 12 aa, Cryptosporidium hominis
SEEAEDSQLDDE

SEQ ID NO: 2160486 - protein, 16 aa, Cryptosporidium hominis
SEEASDENNSKESTHK

SEQ ID NO: 2160487 - protein, 9 aa, Cryptosporidium hominis
SEEDAKSAF

SEQ ID NO: 2160488 - protein, 9 aa, Cryptosporidium hominis
SEEDDEKAL

SEQ ID NO: 2160489 - protein, 9 aa, Cryptosporidium hominis
SEEDKISTE

SEQ ID NO: 2160490 - protein, 13 aa, Cryptosporidium hominis
SEEDLELSKSDDA

SEQ ID NO: 2160491 - protein, 9 aa, Cryptosporidium hominis
SEEDLNPTI

SEQ ID NO: 2160492 - protein, 7 aa, Cryptosporidium hominis
SEEEEIN

SEQ ID NO: 2160493 - protein, 5 aa, Cryptosporidium hominis
SEEEI

SEQ ID NO: 2160494 - protein, 24 aa, Cryptosporidium hominis
SEEELNNNIDSGKISDVEQEYFKV

SEQ ID NO: 2160495 - protein, 14 aa, Cryptosporidium hominis
SEEEPEPPNQEIDI

SEQ ID NO: 2160496 - protein, 13 aa, Cryptosporidium hominis
SEEEQGKSISNPL

SEQ ID NO: 2160497 - protein, 4 aa, Cryptosporidium hominis
SEEF

SEQ ID NO: 2160498 - protein, 6 aa, Cryptosporidium hominis
SEEFDD

SEQ ID NO: 2160499 - protein, 4 aa, Cryptosporidium hominis
SEEI

SEQ ID NO: 2160500 - protein, 8 aa, Cryptosporidium hominis
SEEINSKI

SEQ ID NO: 2160501 - protein, 5 aa, Cryptosporidium hominis
SEEIQ

SEQ ID NO: 2160502 - protein, 5 aa, Cryptosporidium hominis
SEEKE

SEQ ID NO: 2160503 - protein, 21 aa, Cryptosporidium hominis
SEEKFQYSQKEDTVSSKSTGE

SEQ ID NO: 2160504 - protein, 8 aa, Cryptosporidium hominis
SEEKHNTY

SEQ ID NO: 2160505 - protein, 20 aa, Cryptosporidium hominis
SEELERASEFASKAEANEST

SEQ ID NO: 2160506 - protein, 10 aa, Cryptosporidium hominis
SEELKKEVRR

SEQ ID NO: 2160507 - protein, 5 aa, Cryptosporidium hominis
SEEMR

SEQ ID NO: 2160508 - protein, 27 aa, Cryptosporidium hominis
SEENKSSSNSFNSSIGGGNSISTNSHE

SEQ ID NO: 2160509 - protein, 18 aa, Cryptosporidium hominis
SEENLSKTTIRENSSNNK

SEQ ID NO: 2160510 - protein, 10 aa, Cryptosporidium hominis
SEENQDTNIE

SEQ ID NO: 2160511 - protein, 16 aa, Cryptosporidium hominis
SEEPIKDSINNETEEK

SEQ ID NO: 2160512 - protein, 16 aa, Cryptosporidium hominis
SEEPINVNSENPNATN

SEQ ID NO: 2160513 - protein, 8 aa, Cryptosporidium hominis
SEEQGFED

SEQ ID NO: 2160514 - protein, 5 aa, Cryptosporidium hominis
SEEQK

SEQ ID NO: 2160515 - protein, 31 aa, Cryptosporidium hominis
SEERGEGEEEEEQEEGGTRRRKGRDGEEEEE

SEQ ID NO: 2160516 - protein, 12 aa, Cryptosporidium hominis
SEESKDLNNEKN

SEQ ID NO: 2160517 - protein, 6 aa, Cryptosporidium hominis
SEETDE

SEQ ID NO: 2160518 - protein, 5 aa, Cryptosporidium hominis
SEETG

SEQ ID NO: 2160519 - protein, 8 aa, Cryptosporidium hominis
SEETKRSY

SEQ ID NO: 2160520 - protein, 9 aa, Cryptosporidium hominis
SEETPEKRR

SEQ ID NO: 2160521 - protein, 5 aa, Cryptosporidium hominis
SEETV

SEQ ID NO: 2160522 - protein, 20 aa, Cryptosporidium hominis
SEEVQMTNGDSSANNTSLTQ

SEQ ID NO: 2160523 - protein, 5 aa, Cryptosporidium hominis
SEFDK

SEQ ID NO: 2160524 - protein, 6 aa, Cryptosporidium hominis
SEFDNV

SEQ ID NO: 2160525 - protein, 4 aa, Cryptosporidium hominis
SEFG

SEQ ID NO: 2160526 - protein, 8 aa, Cryptosporidium hominis
SEFGNPDS

SEQ ID NO: 2160527 - protein, 6 aa, Cryptosporidium hominis
SEFNNQ

SEQ ID NO: 2160528 - protein, 12 aa, Cryptosporidium hominis
SEFQNKENEINQ

SEQ ID NO: 2160529 - protein, 6 aa, Cryptosporidium hominis
SEFQNS

SEQ ID NO: 2160530 - protein, 19 aa, Cryptosporidium hominis
SEFSSTIHKPSKESDNEEV

SEQ ID NO: 2160531 - protein, 8 aa, Cryptosporidium hominis
SEGEIQKP

SEQ ID NO: 2160532 - protein, 7 aa, Cryptosporidium hominis
SEGFPRS

SEQ ID NO: 2160533 - protein, 66 aa, Cryptosporidium hominis
SEGGGGGGTGAGGGGTGAGGGTGTGMGTGGGGGSSSLVATSSVNSINPSESVGTEGNSGGVTGDNA

SEQ ID NO: 2160534 - protein, 9 aa, Cryptosporidium hominis
SEGGKGSDI

SEQ ID NO: 2160535 - protein, 6 aa, Cryptosporidium hominis
SEGGLS

SEQ ID NO: 2160536 - protein, 9 aa, Cryptosporidium hominis
SEGKAPNGV

SEQ ID NO: 2160537 - protein, 18 aa, Cryptosporidium hominis
SEGKDGNSIDSKDLDDSE

SEQ ID NO: 2160538 - protein, 5 aa, Cryptosporidium hominis
SEGKN

SEQ ID NO: 2160539 - protein, 6 aa, Cryptosporidium hominis
SEGKSG

SEQ ID NO: 2160540 - protein, 5 aa, Cryptosporidium hominis
SEGLD

SEQ ID NO: 2160541 - protein, 13 aa, Cryptosporidium hominis
SEGRKSEFNDERE

SEQ ID NO: 2160542 - protein, 8 aa, Cryptosporidium hominis
SEGSETNR

SEQ ID NO: 2160543 - protein, 7 aa, Cryptosporidium hominis
SEGSIKN

SEQ ID NO: 2160544 - protein, 12 aa, Cryptosporidium hominis
SEGYKSIQENPQ

SEQ ID NO: 2160545 - protein, 4 aa, Cryptosporidium hominis
SEHE

SEQ ID NO: 2160546 - protein, 6 aa, Cryptosporidium hominis
SEHENK

SEQ ID NO: 2160547 - protein, 10 aa, Cryptosporidium hominis
SEHNKSQLKS

SEQ ID NO: 2160548 - protein, 11 aa, Cryptosporidium hominis
SEIDDCEKTQF

SEQ ID NO: 2160549 - protein, 21 aa, Cryptosporidium hominis
SEIEASSSNASSSTSSSSNLY

SEQ ID NO: 2160550 - protein, 5 aa, Cryptosporidium hominis
SEIEN

SEQ ID NO: 2160551 - protein, 25 aa, Cryptosporidium hominis
SEIENSGITSGKETIKQSLKDDAKL

SEQ ID NO: 2160552 - protein, 4 aa, Cryptosporidium hominis
SEIG

SEQ ID NO: 2160553 - protein, 5 aa, Cryptosporidium hominis
SEIGD

SEQ ID NO: 2160554 - protein, 5 aa, Cryptosporidium hominis
SEIGS

SEQ ID NO: 2160555 - protein, 13 aa, Cryptosporidium hominis
SEIGSGDDISSRY

SEQ ID NO: 2160556 - protein, 16 aa, Cryptosporidium hominis
SEINDNSKNIIGGPPG

SEQ ID NO: 2160557 - protein, 12 aa, Cryptosporidium hominis
SEINKENYQGNT

SEQ ID NO: 2160558 - protein, 7 aa, Cryptosporidium hominis
SEINSNG

SEQ ID NO: 2160559 - protein, 4 aa, Cryptosporidium hominis
SEIP

SEQ ID NO: 2160560 - protein, 5 aa, Cryptosporidium hominis
SEIPK

SEQ ID NO: 2160561 - protein, 5 aa, Cryptosporidium hominis
SEIPQ

SEQ ID NO: 2160562 - protein, 24 aa, Cryptosporidium hominis
SEIQISNKEAKDLDNSERHDTKNE

SEQ ID NO: 2160563 - protein, 9 aa, Cryptosporidium hominis
SEIQSEKEI

SEQ ID NO: 2160564 - protein, 12 aa, Cryptosporidium hominis
SEIRDSRRNRSD

SEQ ID NO: 2160565 - protein, 7 aa, Cryptosporidium hominis
SEISKSQ

SEQ ID NO: 2160566 - protein, 8 aa, Cryptosporidium hominis
SEISNAKK

SEQ ID NO: 2160567 - protein, 12 aa, Cryptosporidium hominis
SEISPGRFPESQ

SEQ ID NO: 2160568 - protein, 58 aa, Cryptosporidium hominis
SEISPSDVEGRHGLSTEEGLGNEHMSEKDINSDNENGSSNNNLECNNSNEETNAETGF

SEQ ID NO: 2160569 - protein, 5 aa, Cryptosporidium hominis
SEITG

SEQ ID NO: 2160570 - protein, 4 aa, Cryptosporidium hominis
SEIY

SEQ ID NO: 2160571 - protein, 4 aa, Cryptosporidium hominis
SEKA

SEQ ID NO: 2160572 - protein, 11 aa, Cryptosporidium hominis
SEKARTRNPDE

SEQ ID NO: 2160573 - protein, 7 aa, Cryptosporidium hominis
SEKDHRK

SEQ ID NO: 2160574 - protein, 29 aa, Cryptosporidium hominis
SEKDSQTLSEGGAFGRPTPTPESVEKTPF

SEQ ID NO: 2160575 - protein, 5 aa, Cryptosporidium hominis
SEKEE

SEQ ID NO: 2160576 - protein, 13 aa, Cryptosporidium hominis
SEKEGEKSDDDFF

SEQ ID NO: 2160577 - protein, 5 aa, Cryptosporidium hominis
SEKER

SEQ ID NO: 2160578 - protein, 7 aa, Cryptosporidium hominis
SEKEYDT

SEQ ID NO: 2160579 - protein, 6 aa, Cryptosporidium hominis
SEKFPS

SEQ ID NO: 2160580 - protein, 4 aa, Cryptosporidium hominis
SEKG

SEQ ID NO: 2160581 - protein, 5 aa, Cryptosporidium hominis
SEKGE

SEQ ID NO: 2160582 - protein, 19 aa, Cryptosporidium hominis
SEKIGSESESSDNEKENKY

SEQ ID NO: 2160583 - protein, 16 aa, Cryptosporidium hominis
SEKISKRENIRSNSSE

SEQ ID NO: 2160584 - protein, 22 aa, Cryptosporidium hominis
SEKKKEKRSKEVEKNSKKKVSE

SEQ ID NO: 2160585 - protein, 22 aa, Cryptosporidium hominis
SEKKSVSQPKRGTTESRPTLQK

SEQ ID NO: 2160586 - protein, 9 aa, Cryptosporidium hominis
SEKKSYSSY

SEQ ID NO: 2160587 - protein, 10 aa, Cryptosporidium hominis
SEKKTSNSAN

SEQ ID NO: 2160588 - protein, 4 aa, Cryptosporidium hominis
SEKL

SEQ ID NO: 2160589 - protein, 17 aa, Cryptosporidium hominis
SEKLDNKTEITREITEE

SEQ ID NO: 2160590 - protein, 11 aa, Cryptosporidium hominis
SEKLKNKSDIQ

SEQ ID NO: 2160591 - protein, 10 aa, Cryptosporidium hominis
SEKNNSDEIL

SEQ ID NO: 2160592 - protein, 9 aa, Cryptosporidium hominis
SEKNSNNNL

SEQ ID NO: 2160593 - protein, 7 aa, Cryptosporidium hominis
SEKPVTS

SEQ ID NO: 2160594 - protein, 5 aa, Cryptosporidium hominis
SEKQG

SEQ ID NO: 2160595 - protein, 8 aa, Cryptosporidium hominis
SEKRKERT

SEQ ID NO: 2160596 - protein, 13 aa, Cryptosporidium hominis
SEKRNDTNKFPDS

SEQ ID NO: 2160597 - protein, 5 aa, Cryptosporidium hominis
SEKRR

SEQ ID NO: 2160598 - protein, 9 aa, Cryptosporidium hominis
SEKSSDINQ

SEQ ID NO: 2160599 - protein, 17 aa, Cryptosporidium hominis
SEKTKSFSESGPSRSSK

SEQ ID NO: 2160600 - protein, 8 aa, Cryptosporidium hominis
SEKTTSKI

SEQ ID NO: 2160601 - protein, 7 aa, Cryptosporidium hominis
SEKYTET

SEQ ID NO: 2160602 - protein, 4 aa, Cryptosporidium hominis
SELD

SEQ ID NO: 2160603 - protein, 12 aa, Cryptosporidium hominis
SELEDYKKTNCE

SEQ ID NO: 2160604 - protein, 6 aa, Cryptosporidium hominis
SELISD

SEQ ID NO: 2160605 - protein, 18 aa, Cryptosporidium hominis
SELNNSNNFKSKSALDNI

SEQ ID NO: 2160606 - protein, 19 aa, Cryptosporidium hominis
SELPKENIPTRSLQPNDEI

SEQ ID NO: 2160607 - protein, 25 aa, Cryptosporidium hominis
SELQSNKRSSINKNPPADNSKKGGI

SEQ ID NO: 2160608 - protein, 10 aa, Cryptosporidium hominis
SELSDTDFGN

SEQ ID NO: 2160609 - protein, 14 aa, Cryptosporidium hominis
SELSEKEQKKMEQK

SEQ ID NO: 2160610 - protein, 7 aa, Cryptosporidium hominis
SELSGEI

SEQ ID NO: 2160611 - protein, 10 aa, Cryptosporidium hominis
SELSKPQKIE

SEQ ID NO: 2160612 - protein, 10 aa, Cryptosporidium hominis
SELSQDSKEH

SEQ ID NO: 2160613 - protein, 13 aa, Cryptosporidium hominis
SELTDPEKITGGW

SEQ ID NO: 2160614 - protein, 7 aa, Cryptosporidium hominis
SELTNES

SEQ ID NO: 2160615 - protein, 8 aa, Cryptosporidium hominis
SEMPHSLD

SEQ ID NO: 2160616 - protein, 5 aa, Cryptosporidium hominis
SENAI

SEQ ID NO: 2160617 - protein, 14 aa, Cryptosporidium hominis
SENAKEVIKAVERA

SEQ ID NO: 2160618 - protein, 23 aa, Cryptosporidium hominis
SENCRSKSASPTSSENREKNNYG

SEQ ID NO: 2160619 - protein, 12 aa, Cryptosporidium hominis
SENDENNNINSQ

SEQ ID NO: 2160620 - protein, 12 aa, Cryptosporidium hominis
SENDQLKRILES

SEQ ID NO: 2160621 - protein, 9 aa, Cryptosporidium hominis
SENEIPESK

SEQ ID NO: 2160622 - protein, 6 aa, Cryptosporidium hominis
SENEKD

SEQ ID NO: 2160623 - protein, 13 aa, Cryptosporidium hominis
SENESENSDPDLG

SEQ ID NO: 2160624 - protein, 5 aa, Cryptosporidium hominis
SENEV

SEQ ID NO: 2160625 - protein, 15 aa, Cryptosporidium hominis
SENGACASDSEVDDE

SEQ ID NO: 2160626 - protein, 5 aa, Cryptosporidium hominis
SENGE

SEQ ID NO: 2160627 - protein, 11 aa, Cryptosporidium hominis
SENGKEYQTQV

SEQ ID NO: 2160628 - protein, 8 aa, Cryptosporidium hominis
SENGSSKT

SEQ ID NO: 2160629 - protein, 13 aa, Cryptosporidium hominis
SENKANERNQEIS

SEQ ID NO: 2160630 - protein, 22 aa, Cryptosporidium hominis
SENKGEILENSGADSSNSKLDS

SEQ ID NO: 2160631 - protein, 5 aa, Cryptosporidium hominis
SENNI

SEQ ID NO: 2160632 - protein, 13 aa, Cryptosporidium hominis
SENNKLKKENQKL

SEQ ID NO: 2160633 - protein, 8 aa, Cryptosporidium hominis
SENNPKEI

SEQ ID NO: 2160634 - protein, 13 aa, Cryptosporidium hominis
SENNSDESKENME

SEQ ID NO: 2160635 - protein, 22 aa, Cryptosporidium hominis
SENNSSASTGKINKEIVLNSIE

SEQ ID NO: 2160636 - protein, 5 aa, Cryptosporidium hominis
SENNY

SEQ ID NO: 2160637 - protein, 5 aa, Cryptosporidium hominis
SENPK

SEQ ID NO: 2160638 - protein, 7 aa, Cryptosporidium hominis
SENPVKG

SEQ ID NO: 2160639 - protein, 4 aa, Cryptosporidium hominis
SENQ

SEQ ID NO: 2160640 - protein, 7 aa, Cryptosporidium hominis
SENQNFD

SEQ ID NO: 2160641 - protein, 5 aa, Cryptosporidium hominis
SENQQ

SEQ ID NO: 2160642 - protein, 4 aa, Cryptosporidium hominis
SENR

SEQ ID NO: 2160643 - protein, 6 aa, Cryptosporidium hominis
SENRDS

SEQ ID NO: 2160644 - protein, 6 aa, Cryptosporidium hominis
SENREI

SEQ ID NO: 2160645 - protein, 5 aa, Cryptosporidium hominis
SENRM

SEQ ID NO: 2160646 - protein, 8 aa, Cryptosporidium hominis
SENSENNQ

SEQ ID NO: 2160647 - protein, 11 aa, Cryptosporidium hominis
SENSISCNNSN

SEQ ID NO: 2160648 - protein, 8 aa, Cryptosporidium hominis
SENSNHDD

SEQ ID NO: 2160649 - protein, 7 aa, Cryptosporidium hominis
SENSSFA

SEQ ID NO: 2160650 - protein, 13 aa, Cryptosporidium hominis
SENSSKVTSQLSN

SEQ ID NO: 2160651 - protein, 5 aa, Cryptosporidium hominis
SENTI

SEQ ID NO: 2160652 - protein, 5 aa, Cryptosporidium hominis
SENTL

SEQ ID NO: 2160653 - protein, 7 aa, Cryptosporidium hominis
SENTNMK

SEQ ID NO: 2160654 - protein, 14 aa, Cryptosporidium hominis
SENTTNTPYNLQTQ

SEQ ID NO: 2160655 - protein, 10 aa, Cryptosporidium hominis
SENYGKNSSV

SEQ ID NO: 2160656 - protein, 9 aa, Cryptosporidium hominis
SENYNNAKF

SEQ ID NO: 2160657 - protein, 17 aa, Cryptosporidium hominis
SENYRELQKKKDEEEVR

SEQ ID NO: 2160658 - protein, 5 aa, Cryptosporidium hominis
SEPAH

SEQ ID NO: 2160659 - protein, 6 aa, Cryptosporidium hominis
SEPAQL

SEQ ID NO: 2160660 - protein, 8 aa, Cryptosporidium hominis
SEPDRGYD

SEQ ID NO: 2160661 - protein, 6 aa, Cryptosporidium hominis
SEPENG

SEQ ID NO: 2160662 - protein, 8 aa, Cryptosporidium hominis
SEPHKESA

SEQ ID NO: 2160663 - protein, 4 aa, Cryptosporidium hominis
SEPI

SEQ ID NO: 2160664 - protein, 5 aa, Cryptosporidium hominis
SEPIP

SEQ ID NO: 2160665 - protein, 17 aa, Cryptosporidium hominis
SEPKGDESTNNISNPEE

SEQ ID NO: 2160666 - protein, 5 aa, Cryptosporidium hominis
SEPNA

SEQ ID NO: 2160667 - protein, 7 aa, Cryptosporidium hominis
SEPNRDV

SEQ ID NO: 2160668 - protein, 15 aa, Cryptosporidium hominis
SEPNSKSSSRSPSIS

SEQ ID NO: 2160669 - protein, 6 aa, Cryptosporidium hominis
SEPQMI

SEQ ID NO: 2160670 - protein, 7 aa, Cryptosporidium hominis
SEPQRCN

SEQ ID NO: 2160671 - protein, 17 aa, Cryptosporidium hominis
SEPRNYTPVSSKNISDI

SEQ ID NO: 2160672 - protein, 9 aa, Cryptosporidium hominis
SEPSNATEM

SEQ ID NO: 2160673 - protein, 4 aa, Cryptosporidium hominis
SEPV

SEQ ID NO: 2160674 - protein, 9 aa, Cryptosporidium hominis
SEPYGKSGC

SEQ ID NO: 2160675 - protein, 10 aa, Cryptosporidium hominis
SEQAKAKAGT

SEQ ID NO: 2160676 - protein, 6 aa, Cryptosporidium hominis
SEQDGT

SEQ ID NO: 2160677 - protein, 30 aa, Cryptosporidium hominis
SEQEEKNDQSTTNSSGMSPKKFPFGIKNPL

SEQ ID NO: 2160678 - protein, 6 aa, Cryptosporidium hominis
SEQEEP

SEQ ID NO: 2160679 - protein, 6 aa, Cryptosporidium hominis
SEQEEY

SEQ ID NO: 2160680 - protein, 6 aa, Cryptosporidium hominis
SEQEIK

SEQ ID NO: 2160681 - protein, 9 aa, Cryptosporidium hominis
SEQEQKSLE

SEQ ID NO: 2160682 - protein, 42 aa, Cryptosporidium hominis
SEQEQTSTEHGDNKSSNNDDQERNNKRISYSNLDDSGISSQM

SEQ ID NO: 2160683 - protein, 7 aa, Cryptosporidium hominis
SEQIPDN

SEQ ID NO: 2160684 - protein, 4 aa, Cryptosporidium hominis
SEQK

SEQ ID NO: 2160685 - protein, 4 aa, Cryptosporidium hominis
SEQN

SEQ ID NO: 2160686 - protein, 17 aa, Cryptosporidium hominis
SEQNSTSNSFSNNSSSN

SEQ ID NO: 2160687 - protein, 7 aa, Cryptosporidium hominis
SEQRITA

SEQ ID NO: 2160688 - protein, 14 aa, Cryptosporidium hominis
SEQSNPNNSLPSKI

SEQ ID NO: 2160689 - protein, 7 aa, Cryptosporidium hominis
SEQSNTQ

SEQ ID NO: 2160690 - protein, 17 aa, Cryptosporidium hominis
SEQTDVNNTVNSEEADN

SEQ ID NO: 2160691 - protein, 7 aa, Cryptosporidium hominis
SEQVNGG

SEQ ID NO: 2160692 - protein, 13 aa, Cryptosporidium hominis
SEQYDTEKQMSDE

SEQ ID NO: 2160693 - protein, 4 aa, Cryptosporidium hominis
SERD

SEQ ID NO: 2160694 - protein, 9 aa, Cryptosporidium hominis
SERDSGSGE

SEQ ID NO: 2160695 - protein, 7 aa, Cryptosporidium hominis
SERELER

SEQ ID NO: 2160696 - protein, 6 aa, Cryptosporidium hominis
SERERK

SEQ ID NO: 2160697 - protein, 14 aa, Cryptosporidium hominis
SERESKGNTRIKYE

SEQ ID NO: 2160698 - protein, 9 aa, Cryptosporidium hominis
SERGDVNTK

SEQ ID NO: 2160699 - protein, 7 aa, Cryptosporidium hominis
SERKRAK

SEQ ID NO: 2160700 - protein, 6 aa, Cryptosporidium hominis
SERKSI

SEQ ID NO: 2160701 - protein, 11 aa, Cryptosporidium hominis
SERPPTPPRSA

SEQ ID NO: 2160702 - protein, 6 aa, Cryptosporidium hominis
SERPRT

SEQ ID NO: 2160703 - protein, 10 aa, Cryptosporidium hominis
SERPSPRISS

SEQ ID NO: 2160704 - protein, 10 aa, Cryptosporidium hominis
SERRAKEKNI

SEQ ID NO: 2160705 - protein, 14 aa, Cryptosporidium hominis
SERRNEDKQNEESR

SEQ ID NO: 2160706 - protein, 11 aa, Cryptosporidium hominis
SERRQYYSETD

SEQ ID NO: 2160707 - protein, 10 aa, Cryptosporidium hominis
SERSEVSENE

SEQ ID NO: 2160708 - protein, 38 aa, Cryptosporidium hominis
SERTVDDQNMPPPTYTPKKNKLDRSNEKGGIQRESSIT

SEQ ID NO: 2160709 - protein, 6 aa, Cryptosporidium hominis
SERVKE

SEQ ID NO: 2160710 - protein, 4 aa, Cryptosporidium hominis
SESD

SEQ ID NO: 2160711 - protein, 10 aa, Cryptosporidium hominis
SESDGGDGSA

SEQ ID NO: 2160712 - protein, 5 aa, Cryptosporidium hominis
SESDI

SEQ ID NO: 2160713 - protein, 7 aa, Cryptosporidium hominis
SESDQLT

SEQ ID NO: 2160714 - protein, 11 aa, Cryptosporidium hominis
SESDTSKLETN

SEQ ID NO: 2160715 - protein, 12 aa, Cryptosporidium hominis
SESEESDYDESD

SEQ ID NO: 2160716 - protein, 7 aa, Cryptosporidium hominis
SESELPT

SEQ ID NO: 2160717 - protein, 8 aa, Cryptosporidium hominis
SESERENH

SEQ ID NO: 2160718 - protein, 17 aa, Cryptosporidium hominis
SESESDPDPDSDSDQDL

SEQ ID NO: 2160719 - protein, 6 aa, Cryptosporidium hominis
SESFDH

SEQ ID NO: 2160720 - protein, 6 aa, Cryptosporidium hominis
SESFRE

SEQ ID NO: 2160721 - protein, 5 aa, Cryptosporidium hominis
SESFS

SEQ ID NO: 2160722 - protein, 4 aa, Cryptosporidium hominis
SESG

SEQ ID NO: 2160723 - protein, 5 aa, Cryptosporidium hominis
SESGH

SEQ ID NO: 2160724 - protein, 9 aa, Cryptosporidium hominis
SESHENTKY

SEQ ID NO: 2160725 - protein, 8 aa, Cryptosporidium hominis
SESISDKP

SEQ ID NO: 2160726 - protein, 15 aa, Cryptosporidium hominis
SESITGTKDNNNNNI

SEQ ID NO: 2160727 - protein, 6 aa, Cryptosporidium hominis
SESITS

SEQ ID NO: 2160728 - protein, 6 aa, Cryptosporidium hominis
SESKNI

SEQ ID NO: 2160729 - protein, 4 aa, Cryptosporidium hominis
SESL

SEQ ID NO: 2160730 - protein, 10 aa, Cryptosporidium hominis
SESLATNSPE

SEQ ID NO: 2160731 - protein, 23 aa, Cryptosporidium hominis
SESLKRRRRRRRGSGCKLATIFI

SEQ ID NO: 2160732 - protein, 4 aa, Cryptosporidium hominis
SESN

SEQ ID NO: 2160733 - protein, 5 aa, Cryptosporidium hominis
SESNE

SEQ ID NO: 2160734 - protein, 15 aa, Cryptosporidium hominis
SESNNKKDSDTSLND

SEQ ID NO: 2160735 - protein, 6 aa, Cryptosporidium hominis
SESNRL

SEQ ID NO: 2160736 - protein, 8 aa, Cryptosporidium hominis
SESNSYDI

SEQ ID NO: 2160737 - protein, 8 aa, Cryptosporidium hominis
SESNTDRS

SEQ ID NO: 2160738 - protein, 7 aa, Cryptosporidium hominis
SESNTEW

SEQ ID NO: 2160739 - protein, 7 aa, Cryptosporidium hominis
SESPNLA

SEQ ID NO: 2160740 - protein, 8 aa, Cryptosporidium hominis
SESQETVN

SEQ ID NO: 2160741 - protein, 7 aa, Cryptosporidium hominis
SESRKTD

SEQ ID NO: 2160742 - protein, 5 aa, Cryptosporidium hominis
SESSE

SEQ ID NO: 2160743 - protein, 9 aa, Cryptosporidium hominis
SESSETLNS

SEQ ID NO: 2160744 - protein, 17 aa, Cryptosporidium hominis
SESSGTKLTPQHARNGH

SEQ ID NO: 2160745 - protein, 13 aa, Cryptosporidium hominis
SESSKESNSFTDE

SEQ ID NO: 2160746 - protein, 8 aa, Cryptosporidium hominis
SESSKSQL

SEQ ID NO: 2160747 - protein, 8 aa, Cryptosporidium hominis
SESSLTPN

SEQ ID NO: 2160748 - protein, 10 aa, Cryptosporidium hominis
SESSNKYGIG

SEQ ID NO: 2160749 - protein, 8 aa, Cryptosporidium hominis
SESSVQDK

SEQ ID NO: 2160750 - protein, 15 aa, Cryptosporidium hominis
SESTDASGSNGEESE

SEQ ID NO: 2160751 - protein, 17 aa, Cryptosporidium hominis
SESTGVPSGATFDESQL

SEQ ID NO: 2160752 - protein, 9 aa, Cryptosporidium hominis
SESTTNESL

SEQ ID NO: 2160753 - protein, 4 aa, Cryptosporidium hominis
SESV

SEQ ID NO: 2160754 - protein, 12 aa, Cryptosporidium hominis
SESVRGRTSRIP

SEQ ID NO: 2160755 - protein, 4 aa, Cryptosporidium hominis
SESY

SEQ ID NO: 2160756 - protein, 6 aa, Cryptosporidium hominis
SESYDS

SEQ ID NO: 2160757 - protein, 10 aa, Cryptosporidium hominis
SETASQDSNF

SEQ ID NO: 2160758 - protein, 6 aa, Cryptosporidium hominis
SETDHC

SEQ ID NO: 2160759 - protein, 5 aa, Cryptosporidium hominis
SETDL

SEQ ID NO: 2160760 - protein, 6 aa, Cryptosporidium hominis
SETENL

SEQ ID NO: 2160761 - protein, 5 aa, Cryptosporidium hominis
SETIG

SEQ ID NO: 2160762 - protein, 7 aa, Cryptosporidium hominis
SETMEPE

SEQ ID NO: 2160763 - protein, 8 aa, Cryptosporidium hominis
SETNKQIN

SEQ ID NO: 2160764 - protein, 16 aa, Cryptosporidium hominis
SETNLDSEKTETEKNE

SEQ ID NO: 2160765 - protein, 18 aa, Cryptosporidium hominis
SETNNSDYYENSNKENYP

SEQ ID NO: 2160766 - protein, 4 aa, Cryptosporidium hominis
SETP

SEQ ID NO: 2160767 - protein, 15 aa, Cryptosporidium hominis
SETPTVVSSSETQLE

SEQ ID NO: 2160768 - protein, 12 aa, Cryptosporidium hominis
SETQPSRPLGCM

SEQ ID NO: 2160769 - protein, 5 aa, Cryptosporidium hominis
SETRK

SEQ ID NO: 2160770 - protein, 4 aa, Cryptosporidium hominis
SETS

SEQ ID NO: 2160771 - protein, 8 aa, Cryptosporidium hominis
SETSVNTD

SEQ ID NO: 2160772 - protein, 6 aa, Cryptosporidium hominis
SETTIP

SEQ ID NO: 2160773 - protein, 15 aa, Cryptosporidium hominis
SETTNNGNHSNYNNN

SEQ ID NO: 2160774 - protein, 178 aa, Cryptosporidium hominis
SETTNSNTANSETTNSNTANSNTANSETTNSNTLNSNTANSNTANSNTSNSNTANSNTANSNTSNSSTANSETTNSNTLNSNTANSNTANSNTSNSNTANSNTSNSETTNSNTSNSNTANSNTANSNTANSNTSNSNTANSNTSNSETTNSNTSNSNTANSNTANSNTTTSSNCSRSK

SEQ ID NO: 2160775 - protein, 6 aa, Cryptosporidium hominis
SEVARQ

SEQ ID NO: 2160776 - protein, 8 aa, Cryptosporidium hominis
SEVDSSPY

SEQ ID NO: 2160777 - protein, 9 aa, Cryptosporidium hominis
SEVESQNIK

SEQ ID NO: 2160778 - protein, 6 aa, Cryptosporidium hominis
SEVNSL

SEQ ID NO: 2160779 - protein, 6 aa, Cryptosporidium hominis
SEVPST

SEQ ID NO: 2160780 - protein, 22 aa, Cryptosporidium hominis
SEVQDQSTGNKNTNNSPDNEMQ

SEQ ID NO: 2160781 - protein, 4 aa, Cryptosporidium hominis
SEVR

SEQ ID NO: 2160782 - protein, 6 aa, Cryptosporidium hominis
SEVTGE

SEQ ID NO: 2160783 - protein, 9 aa, Cryptosporidium hominis
SEWTSEQQS

SEQ ID NO: 2160784 - protein, 13 aa, Cryptosporidium hominis
SEYASKLKDDEDN

SEQ ID NO: 2160785 - protein, 28 aa, Cryptosporidium hominis
SEYDPDKTYETEYTSSLEPIQPPINAPY

SEQ ID NO: 2160786 - protein, 7 aa, Cryptosporidium hominis
SEYEGMP

SEQ ID NO: 2160787 - protein, 18 aa, Cryptosporidium hominis
SEYGQHGSKGEEVSPGPH

SEQ ID NO: 2160788 - protein, 15 aa, Cryptosporidium hominis
SEYKDPNSNKSLQKL

SEQ ID NO: 2160789 - protein, 10 aa, Cryptosporidium hominis
SEYKDSPHLE

SEQ ID NO: 2160790 - protein, 9 aa, Cryptosporidium hominis
SEYKGTDYR

SEQ ID NO: 2160791 - protein, 9 aa, Cryptosporidium hominis
SEYKSDKQK

SEQ ID NO: 2160792 - protein, 13 aa, Cryptosporidium hominis
SEYKSRKSASFRS

SEQ ID NO: 2160793 - protein, 14 aa, Cryptosporidium hominis
SEYNGRGELATRQS

SEQ ID NO: 2160794 - protein, 12 aa, Cryptosporidium hominis
SEYQQHPISESE

SEQ ID NO: 2160795 - protein, 13 aa, Cryptosporidium hominis
SEYSDKNNAGTYY

SEQ ID NO: 2160796 - protein, 4 aa, Cryptosporidium hominis
SEYT

SEQ ID NO: 2160797 - protein, 15 aa, Cryptosporidium hominis
SEYTKNYGNLIIFIN

SEQ ID NO: 2160798 - protein, 5 aa, Cryptosporidium hominis
SEYTN

SEQ ID NO: 2160799 - protein, 14 aa, Cryptosporidium hominis
SFAEKSSSETNSVP

SEQ ID NO: 2160800 - protein, 6 aa, Cryptosporidium hominis
SFAKNN

SEQ ID NO: 2160801 - protein, 25 aa, Cryptosporidium hominis
SFDCDSDSNIEDNSNVFNPEEIISH

SEQ ID NO: 2160802 - protein, 5 aa, Cryptosporidium hominis
SFDDK

SEQ ID NO: 2160803 - protein, 11 aa, Cryptosporidium hominis
SFDNSKATCET

SEQ ID NO: 2160804 - protein, 6 aa, Cryptosporidium hominis
SFDPSK

SEQ ID NO: 2160805 - protein, 14 aa, Cryptosporidium hominis
SFEDKISKGENKER

SEQ ID NO: 2160806 - protein, 17 aa, Cryptosporidium hominis
SFEGKEFQEKEPENKSS

SEQ ID NO: 2160807 - protein, 10 aa, Cryptosporidium hominis
SFENQVGNSL

SEQ ID NO: 2160808 - protein, 5 aa, Cryptosporidium hominis
SFENS

SEQ ID NO: 2160809 - protein, 30 aa, Cryptosporidium hominis
SFENSPEDEADNVGEEDDNSENVETLGENR

SEQ ID NO: 2160810 - protein, 5 aa, Cryptosporidium hominis
SFESL

SEQ ID NO: 2160811 - protein, 9 aa, Cryptosporidium hominis
SFESTEDDA

SEQ ID NO: 2160812 - protein, 5 aa, Cryptosporidium hominis
SFETT

SEQ ID NO: 2160813 - protein, 16 aa, Cryptosporidium hominis
SFGGGGGGEGELGQYE

SEQ ID NO: 2160814 - protein, 45 aa, Cryptosporidium hominis
SFGGKRKDKDGSIQKKIKDKKEKNDDETKKGKKTSKKEIESYFKF

SEQ ID NO: 2160815 - protein, 21 aa, Cryptosporidium hominis
SFGPSHSDYNYEDDEYREETV

SEQ ID NO: 2160816 - protein, 15 aa, Cryptosporidium hominis
SFGSDSNAKERIAKE

SEQ ID NO: 2160817 - protein, 9 aa, Cryptosporidium hominis
SFGSEGSVN

SEQ ID NO: 2160818 - protein, 9 aa, Cryptosporidium hominis
SFGSSPGMY

SEQ ID NO: 2160819 - protein, 37 aa, Cryptosporidium hominis
SFGSSSSLESSPCSQYKPKSQTNYKLDSNSNSEENIS

SEQ ID NO: 2160820 - protein, 5 aa, Cryptosporidium hominis
SFGYK

SEQ ID NO: 2160821 - protein, 4 aa, Cryptosporidium hominis
SFHN

SEQ ID NO: 2160822 - protein, 14 aa, Cryptosporidium hominis
SFIGNEDSQYYTRE

SEQ ID NO: 2160823 - protein, 10 aa, Cryptosporidium hominis
SFKDNEKTFE

SEQ ID NO: 2160824 - protein, 6 aa, Cryptosporidium hominis
SFKNHP

SEQ ID NO: 2160825 - protein, 9 aa, Cryptosporidium hominis
SFKSKVDRV

SEQ ID NO: 2160826 - protein, 21 aa, Cryptosporidium hominis
SFNDASEYVRERRSTSSPNIG

SEQ ID NO: 2160827 - protein, 12 aa, Cryptosporidium hominis
SFNGDNSKVSKG

SEQ ID NO: 2160828 - protein, 10 aa, Cryptosporidium hominis
SFNGKQRKYP

SEQ ID NO: 2160829 - protein, 19 aa, Cryptosporidium hominis
SFNKENPNQPKGKNSSPVS

SEQ ID NO: 2160830 - protein, 49 aa, Cryptosporidium hominis
SFNNGNTSGNSGSSSTGNNNNNNNNNNNSTSTNTSSQSTLGSGSGRNGM

SEQ ID NO: 2160831 - protein, 17 aa, Cryptosporidium hominis
SFNPQSAIRAETKEKIR

SEQ ID NO: 2160832 - protein, 18 aa, Cryptosporidium hominis
SFNRGTSCSDNNNQEFDG

SEQ ID NO: 2160833 - protein, 19 aa, Cryptosporidium hominis
SFNTPQQTDEITGKPVDTV

SEQ ID NO: 2160834 - protein, 6 aa, Cryptosporidium hominis
SFPNEQ

SEQ ID NO: 2160835 - protein, 12 aa, Cryptosporidium hominis
SFPNSSKFHSNS

SEQ ID NO: 2160836 - protein, 9 aa, Cryptosporidium hominis
SFPSNLGND

SEQ ID NO: 2160837 - protein, 7 aa, Cryptosporidium hominis
SFPSNNL

SEQ ID NO: 2160838 - protein, 4 aa, Cryptosporidium hominis
SFPT

SEQ ID NO: 2160839 - protein, 8 aa, Cryptosporidium hominis
SFPTPGTE

SEQ ID NO: 2160840 - protein, 46 aa, Cryptosporidium hominis
SFQDDGDYNDRDRDRDHDRDHDRDHDHDHDHYQGNNKKGKDSEKRI

SEQ ID NO: 2160841 - protein, 5 aa, Cryptosporidium hominis
SFRDT

SEQ ID NO: 2160842 - protein, 6 aa, Cryptosporidium hominis
SFRGRK

SEQ ID NO: 2160843 - protein, 5 aa, Cryptosporidium hominis
SFSEG

SEQ ID NO: 2160844 - protein, 10 aa, Cryptosporidium hominis
SFSEKENNSL

SEQ ID NO: 2160845 - protein, 11 aa, Cryptosporidium hominis
SFSENSSASTS

SEQ ID NO: 2160846 - protein, 19 aa, Cryptosporidium hominis
SFSESASTTLNHSGGTNSN

SEQ ID NO: 2160847 - protein, 6 aa, Cryptosporidium hominis
SFSGPS

SEQ ID NO: 2160848 - protein, 7 aa, Cryptosporidium hominis
SFSKENS

SEQ ID NO: 2160849 - protein, 11 aa, Cryptosporidium hominis
SFSKSDKETRV

SEQ ID NO: 2160850 - protein, 4 aa, Cryptosporidium hominis
SFSN

SEQ ID NO: 2160851 - protein, 18 aa, Cryptosporidium hominis
SFSNEDNSPKKELKKTSI

SEQ ID NO: 2160852 - protein, 6 aa, Cryptosporidium hominis
SFSNGK

SEQ ID NO: 2160853 - protein, 5 aa, Cryptosporidium hominis
SFSNL

SEQ ID NO: 2160854 - protein, 7 aa, Cryptosporidium hominis
SFSNTSI

SEQ ID NO: 2160855 - protein, 6 aa, Cryptosporidium hominis
SFSPDQ

SEQ ID NO: 2160856 - protein, 6 aa, Cryptosporidium hominis
SFSPGP

SEQ ID NO: 2160857 - protein, 8 aa, Cryptosporidium hominis
SFSPNQPH

SEQ ID NO: 2160858 - protein, 23 aa, Cryptosporidium hominis
SFSPQRTSRNAKYEPGNDEEFIS

SEQ ID NO: 2160859 - protein, 8 aa, Cryptosporidium hominis
SFSPTGAR

SEQ ID NO: 2160860 - protein, 9 aa, Cryptosporidium hominis
SFSQNNTIN

SEQ ID NO: 2160861 - protein, 5 aa, Cryptosporidium hominis
SFSSG

SEQ ID NO: 2160862 - protein, 12 aa, Cryptosporidium hominis
SFSSGSQSTGIR

SEQ ID NO: 2160863 - protein, 8 aa, Cryptosporidium hominis
SFSSTNDV

SEQ ID NO: 2160864 - protein, 36 aa, Cryptosporidium hominis
SFSTTKSDVSKEDKESKSQELCSGKDENSDSRDNIK

SEQ ID NO: 2160865 - protein, 6 aa, Cryptosporidium hominis
SFTGKE

SEQ ID NO: 2160866 - protein, 5 aa, Cryptosporidium hominis
SFTSQ

SEQ ID NO: 2160867 - protein, 14 aa, Cryptosporidium hominis
SFTTSGIKDSTENA

SEQ ID NO: 2160868 - protein, 5 aa, Cryptosporidium hominis
SGAEF

SEQ ID NO: 2160869 - protein, 4 aa, Cryptosporidium hominis
SGAI

SEQ ID NO: 2160870 - protein, 7 aa, Cryptosporidium hominis
SGAIDQG

SEQ ID NO: 2160871 - protein, 5 aa, Cryptosporidium hominis
SGAKG

SEQ ID NO: 2160872 - protein, 4 aa, Cryptosporidium hominis
SGAN

SEQ ID NO: 2160873 - protein, 6 aa, Cryptosporidium hominis
SGAPPI

SEQ ID NO: 2160874 - protein, 8 aa, Cryptosporidium hominis
SGAPSIPT

SEQ ID NO: 2160875 - protein, 5 aa, Cryptosporidium hominis
SGARM

SEQ ID NO: 2160876 - protein, 8 aa, Cryptosporidium hominis
SGARTTKF

SEQ ID NO: 2160877 - protein, 4 aa, Cryptosporidium hominis
SGAS

SEQ ID NO: 2160878 - protein, 8 aa, Cryptosporidium hominis
SGASPPIE

SEQ ID NO: 2160879 - protein, 8 aa, Cryptosporidium hominis
SGASTGIY

SEQ ID NO: 2160880 - protein, 8 aa, Cryptosporidium hominis
SGATGIEK

SEQ ID NO: 2160881 - protein, 8 aa, Cryptosporidium hominis
SGATKNNS

SEQ ID NO: 2160882 - protein, 4 aa, Cryptosporidium hominis
SGAY

SEQ ID NO: 2160883 - protein, 19 aa, Cryptosporidium hominis
SGCDQKTSGTQKPKGLQSE

SEQ ID NO: 2160884 - protein, 17 aa, Cryptosporidium hominis
SGCKNATFEKKSESKME

SEQ ID NO: 2160885 - protein, 8 aa, Cryptosporidium hominis
SGCKSTDC

SEQ ID NO: 2160886 - protein, 9 aa, Cryptosporidium hominis
SGDEELRSK

SEQ ID NO: 2160887 - protein, 9 aa, Cryptosporidium hominis
SGDGTLRKN

SEQ ID NO: 2160888 - protein, 7 aa, Cryptosporidium hominis
SGDGVSH

SEQ ID NO: 2160889 - protein, 6 aa, Cryptosporidium hominis
SGDGVT

SEQ ID NO: 2160890 - protein, 15 aa, Cryptosporidium hominis
SGDLDDDENEDYQNK

SEQ ID NO: 2160891 - protein, 10 aa, Cryptosporidium hominis
SGDNNNNNKK

SEQ ID NO: 2160892 - protein, 8 aa, Cryptosporidium hominis
SGDNPPYS

SEQ ID NO: 2160893 - protein, 7 aa, Cryptosporidium hominis
SGDQKVS

SEQ ID NO: 2160894 - protein, 5 aa, Cryptosporidium hominis
SGDSF

SEQ ID NO: 2160895 - protein, 7 aa, Cryptosporidium hominis
SGDSGGA

SEQ ID NO: 2160896 - protein, 11 aa, Cryptosporidium hominis
SGDSNKTHNSN

SEQ ID NO: 2160897 - protein, 11 aa, Cryptosporidium hominis
SGDTHLGGEDF

SEQ ID NO: 2160898 - protein, 7 aa, Cryptosporidium hominis
SGDVKSY

SEQ ID NO: 2160899 - protein, 5 aa, Cryptosporidium hominis
SGDWN

SEQ ID NO: 2160900 - protein, 6 aa, Cryptosporidium hominis
SGDYST

SEQ ID NO: 2160901 - protein, 5 aa, Cryptosporidium hominis
SGEAM

SEQ ID NO: 2160902 - protein, 7 aa, Cryptosporidium hominis
SGEAMDQ

SEQ ID NO: 2160903 - protein, 23 aa, Cryptosporidium hominis
SGEASNYHKNMSDGKIKEKSIGI

SEQ ID NO: 2160904 - protein, 4 aa, Cryptosporidium hominis
SGEC

SEQ ID NO: 2160905 - protein, 8 aa, Cryptosporidium hominis
SGEDGEQV

SEQ ID NO: 2160906 - protein, 18 aa, Cryptosporidium hominis
SGEDISGSRRYGRGNSGF

SEQ ID NO: 2160907 - protein, 13 aa, Cryptosporidium hominis
SGEGVTRESDYRS

SEQ ID NO: 2160908 - protein, 15 aa, Cryptosporidium hominis
SGEISKKEAHEQESG

SEQ ID NO: 2160909 - protein, 6 aa, Cryptosporidium hominis
SGEKIE

SEQ ID NO: 2160910 - protein, 5 aa, Cryptosporidium hominis
SGEKN

SEQ ID NO: 2160911 - protein, 7 aa, Cryptosporidium hominis
SGEKNLK

SEQ ID NO: 2160912 - protein, 6 aa, Cryptosporidium hominis
SGEKSL

SEQ ID NO: 2160913 - protein, 6 aa, Cryptosporidium hominis
SGELKG

SEQ ID NO: 2160914 - protein, 8 aa, Cryptosporidium hominis
SGENEDVT

SEQ ID NO: 2160915 - protein, 6 aa, Cryptosporidium hominis
SGENGR

SEQ ID NO: 2160916 - protein, 6 aa, Cryptosporidium hominis
SGENQH

SEQ ID NO: 2160917 - protein, 34 aa, Cryptosporidium hominis
SGENSEVNNAASNEEMSDQSIPRQGSSEKTENID

SEQ ID NO: 2160918 - protein, 13 aa, Cryptosporidium hominis
SGEPRSRRSDNQL

SEQ ID NO: 2160919 - protein, 8 aa, Cryptosporidium hominis
SGERDRIS

SEQ ID NO: 2160920 - protein, 13 aa, Cryptosporidium hominis
SGESGAGKTETAR

SEQ ID NO: 2160921 - protein, 7 aa, Cryptosporidium hominis
SGESSDL

SEQ ID NO: 2160922 - protein, 10 aa, Cryptosporidium hominis
SGETEDYKGC

SEQ ID NO: 2160923 - protein, 7 aa, Cryptosporidium hominis
SGETPIN

SEQ ID NO: 2160924 - protein, 5 aa, Cryptosporidium hominis
SGETS

SEQ ID NO: 2160925 - protein, 5 aa, Cryptosporidium hominis
SGEVD

SEQ ID NO: 2160926 - protein, 4 aa, Cryptosporidium hominis
SGEW

SEQ ID NO: 2160927 - protein, 6 aa, Cryptosporidium hominis
SGFEES

SEQ ID NO: 2160928 - protein, 13 aa, Cryptosporidium hominis
SGFESGSETASQS

SEQ ID NO: 2160929 - protein, 8 aa, Cryptosporidium hominis
SGFGGETP

SEQ ID NO: 2160930 - protein, 6 aa, Cryptosporidium hominis
SGFKGM

SEQ ID NO: 2160931 - protein, 21 aa, Cryptosporidium hominis
SGFNQDSHQPQISHSFSFPSS

SEQ ID NO: 2160932 - protein, 12 aa, Cryptosporidium hominis
SGFQRPSWSSQQ

SEQ ID NO: 2160933 - protein, 6 aa, Cryptosporidium hominis
SGFTKP

SEQ ID NO: 2160934 - protein, 14 aa, Cryptosporidium hominis
SGGADPLKETTSTA

SEQ ID NO: 2160935 - protein, 7 aa, Cryptosporidium hominis
SGGAGTV

SEQ ID NO: 2160936 - protein, 11 aa, Cryptosporidium hominis
SGGAMKRTNKD

SEQ ID NO: 2160937 - protein, 10 aa, Cryptosporidium hominis
SGGATGEGGK

SEQ ID NO: 2160938 - protein, 8 aa, Cryptosporidium hominis
SGGDAYRA

SEQ ID NO: 2160939 - protein, 6 aa, Cryptosporidium hominis
SGGDDG

SEQ ID NO: 2160940 - protein, 5 aa, Cryptosporidium hominis
SGGDG

SEQ ID NO: 2160941 - protein, 6 aa, Cryptosporidium hominis
SGGDGI

SEQ ID NO: 2160942 - protein, 25 aa, Cryptosporidium hominis
SGGDGRGGGGGGNEGWDVSKTGEAR

SEQ ID NO: 2160943 - protein, 10 aa, Cryptosporidium hominis
SGGEKKTESL

SEQ ID NO: 2160944 - protein, 8 aa, Cryptosporidium hominis
SGGEKTLS

SEQ ID NO: 2160945 - protein, 14 aa, Cryptosporidium hominis
SGGGGGAENSEYSI

SEQ ID NO: 2160946 - protein, 5 aa, Cryptosporidium hominis
SGGGH

SEQ ID NO: 2160947 - protein, 6 aa, Cryptosporidium hominis
SGGGQI

SEQ ID NO: 2160948 - protein, 8 aa, Cryptosporidium hominis
SGGHGPNM

SEQ ID NO: 2160949 - protein, 6 aa, Cryptosporidium hominis
SGGIPE

SEQ ID NO: 2160950 - protein, 6 aa, Cryptosporidium hominis
SGGKNN

SEQ ID NO: 2160951 - protein, 9 aa, Cryptosporidium hominis
SGGKVEYDN

SEQ ID NO: 2160952 - protein, 5 aa, Cryptosporidium hominis
SGGNI

SEQ ID NO: 2160953 - protein, 13 aa, Cryptosporidium hominis
SGGNIGSSPDKRF

SEQ ID NO: 2160954 - protein, 12 aa, Cryptosporidium hominis
SGGNNELKDSIS

SEQ ID NO: 2160955 - protein, 11 aa, Cryptosporidium hominis
SGGPNSPDNKN

SEQ ID NO: 2160956 - protein, 7 aa, Cryptosporidium hominis
SGGRNAK

SEQ ID NO: 2160957 - protein, 10 aa, Cryptosporidium hominis
SGGRTKRKAA

SEQ ID NO: 2160958 - protein, 6 aa, Cryptosporidium hominis
SGGRYV

SEQ ID NO: 2160959 - protein, 11 aa, Cryptosporidium hominis
SGGTEKTISTL

SEQ ID NO: 2160960 - protein, 5 aa, Cryptosporidium hominis
SGGTT

SEQ ID NO: 2160961 - protein, 4 aa, Cryptosporidium hominis
SGGV

SEQ ID NO: 2160962 - protein, 7 aa, Cryptosporidium hominis
SGGYIDP

SEQ ID NO: 2160963 - protein, 5 aa, Cryptosporidium hominis
SGGYN

SEQ ID NO: 2160964 - protein, 5 aa, Cryptosporidium hominis
SGHCS

SEQ ID NO: 2160965 - protein, 6 aa, Cryptosporidium hominis
SGHDQK

SEQ ID NO: 2160966 - protein, 6 aa, Cryptosporidium hominis
SGHEDG

SEQ ID NO: 2160967 - protein, 10 aa, Cryptosporidium hominis
SGHESGQWTK

SEQ ID NO: 2160968 - protein, 13 aa, Cryptosporidium hominis
SGHQGETGVGASI

SEQ ID NO: 2160969 - protein, 4 aa, Cryptosporidium hominis
SGHS

SEQ ID NO: 2160970 - protein, 11 aa, Cryptosporidium hominis
SGHSISRSKEP

SEQ ID NO: 2160971 - protein, 8 aa, Cryptosporidium hominis
SGIAENTS

SEQ ID NO: 2160972 - protein, 39 aa, Cryptosporidium hominis
SGIASSSSLTSSNYIESSNIDSANNSRPTTNNTCDQEDD

SEQ ID NO: 2160973 - protein, 7 aa, Cryptosporidium hominis
SGIDEKD

SEQ ID NO: 2160974 - protein, 18 aa, Cryptosporidium hominis
SGIDGSPKVSFGKSRRNT

SEQ ID NO: 2160975 - protein, 4 aa, Cryptosporidium hominis
SGIE

SEQ ID NO: 2160976 - protein, 12 aa, Cryptosporidium hominis
SGIEGGFQGRTN

SEQ ID NO: 2160977 - protein, 4 aa, Cryptosporidium hominis
SGIG

SEQ ID NO: 2160978 - protein, 5 aa, Cryptosporidium hominis
SGIGM

SEQ ID NO: 2160979 - protein, 13 aa, Cryptosporidium hominis
SGIKSAGSSGESE

SEQ ID NO: 2160980 - protein, 7 aa, Cryptosporidium hominis
SGIKTKS

SEQ ID NO: 2160981 - protein, 5 aa, Cryptosporidium hominis
SGILS

SEQ ID NO: 2160982 - protein, 4 aa, Cryptosporidium hominis
SGIN

SEQ ID NO: 2160983 - protein, 8 aa, Cryptosporidium hominis
SGIPAQTL

SEQ ID NO: 2160984 - protein, 14 aa, Cryptosporidium hominis
SGIPGNLGAPTGVT

SEQ ID NO: 2160985 - protein, 5 aa, Cryptosporidium hominis
SGIPK

SEQ ID NO: 2160986 - protein, 6 aa, Cryptosporidium hominis
SGIRGQ

SEQ ID NO: 2160987 - protein, 5 aa, Cryptosporidium hominis
SGISK

SEQ ID NO: 2160988 - protein, 6 aa, Cryptosporidium hominis
SGISNQ

SEQ ID NO: 2160989 - protein, 8 aa, Cryptosporidium hominis
SGISSGLS

SEQ ID NO: 2160990 - protein, 6 aa, Cryptosporidium hominis
SGITEL

SEQ ID NO: 2160991 - protein, 8 aa, Cryptosporidium hominis
SGITNTGI

SEQ ID NO: 2160992 - protein, 9 aa, Cryptosporidium hominis
SGKEAESAV

SEQ ID NO: 2160993 - protein, 6 aa, Cryptosporidium hominis
SGKEYT

SEQ ID NO: 2160994 - protein, 7 aa, Cryptosporidium hominis
SGKGKHG

SEQ ID NO: 2160995 - protein, 10 aa, Cryptosporidium hominis
SGKGSSAAGL

SEQ ID NO: 2160996 - protein, 9 aa, Cryptosporidium hominis
SGKGSSAVG

SEQ ID NO: 2160997 - protein, 7 aa, Cryptosporidium hominis
SGKHSNV

SEQ ID NO: 2160998 - protein, 24 aa, Cryptosporidium hominis
SGKIPCQKSNSINISDSEGNNIGG

SEQ ID NO: 2160999 - protein, 5 aa, Cryptosporidium hominis
SGKNI

SEQ ID NO: 2161000 - protein, 10 aa, Cryptosporidium hominis
SGKNRVSQLS

SEQ ID NO: 2161001 - protein, 21 aa, Cryptosporidium hominis
SGKNSSFSKTSFRSDNALPDL

SEQ ID NO: 2161002 - protein, 4 aa, Cryptosporidium hominis
SGKP

SEQ ID NO: 2161003 - protein, 28 aa, Cryptosporidium hominis
SGKPGLPPIKDENGNLFDPSTNLPIDGN

SEQ ID NO: 2161004 - protein, 8 aa, Cryptosporidium hominis
SGKQEIAE

SEQ ID NO: 2161005 - protein, 6 aa, Cryptosporidium hominis
SGKRKE

SEQ ID NO: 2161006 - protein, 4 aa, Cryptosporidium hominis
SGKT

SEQ ID NO: 2161007 - protein, 7 aa, Cryptosporidium hominis
SGKYDPG

SEQ ID NO: 2161008 - protein, 16 aa, Cryptosporidium hominis
SGKYEDGFKKTEIGQL

SEQ ID NO: 2161009 - protein, 6 aa, Cryptosporidium hominis
SGKYEP

SEQ ID NO: 2161010 - protein, 7 aa, Cryptosporidium hominis
SGLAYSG

SEQ ID NO: 2161011 - protein, 5 aa, Cryptosporidium hominis
SGLGE

SEQ ID NO: 2161012 - protein, 11 aa, Cryptosporidium hominis
SGLGQKSFKNL

SEQ ID NO: 2161013 - protein, 8 aa, Cryptosporidium hominis
SGLGSKSL

SEQ ID NO: 2161014 - protein, 30 aa, Cryptosporidium hominis
SGLGVEDDERGGRRGRGVGGRGRGRGGMGG

SEQ ID NO: 2161015 - protein, 12 aa, Cryptosporidium hominis
SGLKEKKDNEIF

SEQ ID NO: 2161016 - protein, 7 aa, Cryptosporidium hominis
SGLKSAE

SEQ ID NO: 2161017 - protein, 12 aa, Cryptosporidium hominis
SGLNDDLSGYEE

SEQ ID NO: 2161018 - protein, 17 aa, Cryptosporidium hominis
SGLPSETVKRSREKAEE

SEQ ID NO: 2161019 - protein, 5 aa, Cryptosporidium hominis
SGLRE

SEQ ID NO: 2161020 - protein, 5 aa, Cryptosporidium hominis
SGLSL

SEQ ID NO: 2161021 - protein, 6 aa, Cryptosporidium hominis
SGLSPK

SEQ ID NO: 2161022 - protein, 9 aa, Cryptosporidium hominis
SGLSPSTGL

SEQ ID NO: 2161023 - protein, 9 aa, Cryptosporidium hominis
SGLSSRTDS

SEQ ID NO: 2161024 - protein, 7 aa, Cryptosporidium hominis
SGLSSSF

SEQ ID NO: 2161025 - protein, 30 aa, Cryptosporidium hominis
SGLSTTATSSTNLETSSKKYSLGKTLGTGS

SEQ ID NO: 2161026 - protein, 9 aa, Cryptosporidium hominis
SGMGSDNKV

SEQ ID NO: 2161027 - protein, 13 aa, Cryptosporidium hominis
SGNAIEEETLNSK

SEQ ID NO: 2161028 - protein, 14 aa, Cryptosporidium hominis
SGNAIGNSGGSSHY

SEQ ID NO: 2161029 - protein, 5 aa, Cryptosporidium hominis
SGNCL

SEQ ID NO: 2161030 - protein, 7 aa, Cryptosporidium hominis
SGNDDLD

SEQ ID NO: 2161031 - protein, 20 aa, Cryptosporidium hominis
SGNDHNGVQTEGSNSHTIPG

SEQ ID NO: 2161032 - protein, 5 aa, Cryptosporidium hominis
SGNEI

SEQ ID NO: 2161033 - protein, 8 aa, Cryptosporidium hominis
SGNEIEEE

SEQ ID NO: 2161034 - protein, 8 aa, Cryptosporidium hominis
SGNELGNN

SEQ ID NO: 2161035 - protein, 56 aa, Cryptosporidium hominis
SGNEQHQQQQQQHIGSEPSNDFQSGMNTQHQTQEPSLQEQGGQNSGTIGAQTPSQF

SEQ ID NO: 2161036 - protein, 4 aa, Cryptosporidium hominis
SGNG

SEQ ID NO: 2161037 - protein, 11 aa, Cryptosporidium hominis
SGNINQASGQQ

SEQ ID NO: 2161038 - protein, 21 aa, Cryptosporidium hominis
SGNNNNNNNNNNNNNNNNNNM

SEQ ID NO: 2161039 - protein, 8 aa, Cryptosporidium hominis
SGNNPAVQ

SEQ ID NO: 2161040 - protein, 9 aa, Cryptosporidium hominis
SGNNSISAK

SEQ ID NO: 2161041 - protein, 8 aa, Cryptosporidium hominis
SGNNSVDI

SEQ ID NO: 2161042 - protein, 6 aa, Cryptosporidium hominis
SGNQND

SEQ ID NO: 2161043 - protein, 6 aa, Cryptosporidium hominis
SGNRTF

SEQ ID NO: 2161044 - protein, 12 aa, Cryptosporidium hominis
SGNSNNSRSSSS

SEQ ID NO: 2161045 - protein, 9 aa, Cryptosporidium hominis
SGNSNQGYP

SEQ ID NO: 2161046 - protein, 7 aa, Cryptosporidium hominis
SGNSNSI

SEQ ID NO: 2161047 - protein, 15 aa, Cryptosporidium hominis
SGNSPDDVTITNDGA

SEQ ID NO: 2161048 - protein, 19 aa, Cryptosporidium hominis
SGNSSQQPQNQLNQSQSQL

SEQ ID NO: 2161049 - protein, 9 aa, Cryptosporidium hominis
SGNSSTKNA

SEQ ID NO: 2161050 - protein, 5 aa, Cryptosporidium hominis
SGNTD

SEQ ID NO: 2161051 - protein, 29 aa, Cryptosporidium hominis
SGNVSGPGSTIGGNCSASDAGNDQTKISS

SEQ ID NO: 2161052 - protein, 14 aa, Cryptosporidium hominis
SGNYSWGSQGVTRK

SEQ ID NO: 2161053 - protein, 7 aa, Cryptosporidium hominis
SGPEETY

SEQ ID NO: 2161054 - protein, 11 aa, Cryptosporidium hominis
SGPFSGFPDSP

SEQ ID NO: 2161055 - protein, 6 aa, Cryptosporidium hominis
SGPIYN

SEQ ID NO: 2161056 - protein, 9 aa, Cryptosporidium hominis
SGPLPGAKE

SEQ ID NO: 2161057 - protein, 4 aa, Cryptosporidium hominis
SGPM

SEQ ID NO: 2161058 - protein, 6 aa, Cryptosporidium hominis
SGPNGQ

SEQ ID NO: 2161059 - protein, 6 aa, Cryptosporidium hominis
SGPNNH

SEQ ID NO: 2161060 - protein, 7 aa, Cryptosporidium hominis
SGPNRKT

SEQ ID NO: 2161061 - protein, 4 aa, Cryptosporidium hominis
SGPP

SEQ ID NO: 2161062 - protein, 9 aa, Cryptosporidium hominis
SGPPGIGKS

SEQ ID NO: 2161063 - protein, 6 aa, Cryptosporidium hominis
SGPQIS

SEQ ID NO: 2161064 - protein, 14 aa, Cryptosporidium hominis
SGPQYSQSSDDENS

SEQ ID NO: 2161065 - protein, 11 aa, Cryptosporidium hominis
SGPSGTSVDED

SEQ ID NO: 2161066 - protein, 8 aa, Cryptosporidium hominis
SGPSSENN

SEQ ID NO: 2161067 - protein, 6 aa, Cryptosporidium hominis
SGPTAT

SEQ ID NO: 2161068 - protein, 15 aa, Cryptosporidium hominis
SGPVKSDSINDDTRI

SEQ ID NO: 2161069 - protein, 7 aa, Cryptosporidium hominis
SGPYPES

SEQ ID NO: 2161070 - protein, 7 aa, Cryptosporidium hominis
SGPYPNG

SEQ ID NO: 2161071 - protein, 9 aa, Cryptosporidium hominis
SGQAGISKA

SEQ ID NO: 2161072 - protein, 6 aa, Cryptosporidium hominis
SGQDSR

SEQ ID NO: 2161073 - protein, 5 aa, Cryptosporidium hominis
SGQKE

SEQ ID NO: 2161074 - protein, 8 aa, Cryptosporidium hominis
SGQKKPIK

SEQ ID NO: 2161075 - protein, 19 aa, Cryptosporidium hominis
SGQKSLESQITDSASVNGT

SEQ ID NO: 2161076 - protein, 4 aa, Cryptosporidium hominis
SGQN

SEQ ID NO: 2161077 - protein, 12 aa, Cryptosporidium hominis
SGQTNSSVRSSS

SEQ ID NO: 2161078 - protein, 8 aa, Cryptosporidium hominis
SGQTPESL

SEQ ID NO: 2161079 - protein, 4 aa, Cryptosporidium hominis
SGQV

SEQ ID NO: 2161080 - protein, 5 aa, Cryptosporidium hominis
SGRAF

SEQ ID NO: 2161081 - protein, 8 aa, Cryptosporidium hominis
SGRCEQQN

SEQ ID NO: 2161082 - protein, 6 aa, Cryptosporidium hominis
SGRDEH

SEQ ID NO: 2161083 - protein, 16 aa, Cryptosporidium hominis
SGRDGKTKYAIENSTR

SEQ ID NO: 2161084 - protein, 7 aa, Cryptosporidium hominis
SGRDRAT

SEQ ID NO: 2161085 - protein, 7 aa, Cryptosporidium hominis
SGRFGRS

SEQ ID NO: 2161086 - protein, 7 aa, Cryptosporidium hominis
SGRGDKD

SEQ ID NO: 2161087 - protein, 8 aa, Cryptosporidium hominis
SGRGEDPR

SEQ ID NO: 2161088 - protein, 9 aa, Cryptosporidium hominis
SGRGELAER

SEQ ID NO: 2161089 - protein, 6 aa, Cryptosporidium hominis
SGRGGL

SEQ ID NO: 2161090 - protein, 6 aa, Cryptosporidium hominis
SGRGVP

SEQ ID NO: 2161091 - protein, 7 aa, Cryptosporidium hominis
SGRKTPK

SEQ ID NO: 2161092 - protein, 19 aa, Cryptosporidium hominis
SGRLPSSNTGSVNGGTGSF

SEQ ID NO: 2161093 - protein, 4 aa, Cryptosporidium hominis
SGRN

SEQ ID NO: 2161094 - protein, 6 aa, Cryptosporidium hominis
SGRSRG

SEQ ID NO: 2161095 - protein, 10 aa, Cryptosporidium hominis
SGRTGRAGKF

SEQ ID NO: 2161096 - protein, 6 aa, Cryptosporidium hominis
SGRTTG

SEQ ID NO: 2161097 - protein, 6 aa, Cryptosporidium hominis
SGRYGS

SEQ ID NO: 2161098 - protein, 9 aa, Cryptosporidium hominis
SGSAFDDKN

SEQ ID NO: 2161099 - protein, 9 aa, Cryptosporidium hominis
SGSAGYNGQ

SEQ ID NO: 2161100 - protein, 7 aa, Cryptosporidium hominis
SGSAINN

SEQ ID NO: 2161101 - protein, 6 aa, Cryptosporidium hominis
SGSDDN

SEQ ID NO: 2161102 - protein, 5 aa, Cryptosporidium hominis
SGSDE

SEQ ID NO: 2161103 - protein, 5 aa, Cryptosporidium hominis
SGSDI

SEQ ID NO: 2161104 - protein, 6 aa, Cryptosporidium hominis
SGSDYS

SEQ ID NO: 2161105 - protein, 13 aa, Cryptosporidium hominis
SGSEASNGNMSRE

SEQ ID NO: 2161106 - protein, 13 aa, Cryptosporidium hominis
SGSEASYERSSEV

SEQ ID NO: 2161107 - protein, 5 aa, Cryptosporidium hominis
SGSEN

SEQ ID NO: 2161108 - protein, 6 aa, Cryptosporidium hominis
SGSGFG

SEQ ID NO: 2161109 - protein, 7 aa, Cryptosporidium hominis
SGSGKTT

SEQ ID NO: 2161110 - protein, 9 aa, Cryptosporidium hominis
SGSGLSDGD

SEQ ID NO: 2161111 - protein, 8 aa, Cryptosporidium hominis
SGSGNNIG

SEQ ID NO: 2161112 - protein, 7 aa, Cryptosporidium hominis
SGSGTPN

SEQ ID NO: 2161113 - protein, 7 aa, Cryptosporidium hominis
SGSHSTN

SEQ ID NO: 2161114 - protein, 7 aa, Cryptosporidium hominis
SGSHTRS

SEQ ID NO: 2161115 - protein, 4 aa, Cryptosporidium hominis
SGSI

SEQ ID NO: 2161116 - protein, 14 aa, Cryptosporidium hominis
SGSIRDPKSTVDAP

SEQ ID NO: 2161117 - protein, 10 aa, Cryptosporidium hominis
SGSKNISGED

SEQ ID NO: 2161118 - protein, 6 aa, Cryptosporidium hominis
SGSLGV

SEQ ID NO: 2161119 - protein, 8 aa, Cryptosporidium hominis
SGSNNDQN

SEQ ID NO: 2161120 - protein, 7 aa, Cryptosporidium hominis
SGSNQKW

SEQ ID NO: 2161121 - protein, 7 aa, Cryptosporidium hominis
SGSNTRQ

SEQ ID NO: 2161122 - protein, 7 aa, Cryptosporidium hominis
SGSNYGG

SEQ ID NO: 2161123 - protein, 16 aa, Cryptosporidium hominis
SGSQKISTIEYPEDGI

SEQ ID NO: 2161124 - protein, 7 aa, Cryptosporidium hominis
SGSQQFG

SEQ ID NO: 2161125 - protein, 6 aa, Cryptosporidium hominis
SGSRDH

SEQ ID NO: 2161126 - protein, 6 aa, Cryptosporidium hominis
SGSRDI

SEQ ID NO: 2161127 - protein, 12 aa, Cryptosporidium hominis
SGSRNEDPGKNG

SEQ ID NO: 2161128 - protein, 4 aa, Cryptosporidium hominis
SGSS

SEQ ID NO: 2161129 - protein, 10 aa, Cryptosporidium hominis
SGSSDNNSVY

SEQ ID NO: 2161130 - protein, 7 aa, Cryptosporidium hominis
SGSSIQE

SEQ ID NO: 2161131 - protein, 8 aa, Cryptosporidium hominis
SGSSQLEE

SEQ ID NO: 2161132 - protein, 14 aa, Cryptosporidium hominis
SGSTGTPKGVQHST

SEQ ID NO: 2161133 - protein, 13 aa, Cryptosporidium hominis
SGSTITGKSDDTY

SEQ ID NO: 2161134 - protein, 4 aa, Cryptosporidium hominis
SGSV

SEQ ID NO: 2161135 - protein, 12 aa, Cryptosporidium hominis
SGSYSSCKENDL

SEQ ID NO: 2161136 - protein, 15 aa, Cryptosporidium hominis
SGSYSSKNNTSSKRS

SEQ ID NO: 2161137 - protein, 6 aa, Cryptosporidium hominis
SGTADN

SEQ ID NO: 2161138 - protein, 5 aa, Cryptosporidium hominis
SGTAG

SEQ ID NO: 2161139 - protein, 7 aa, Cryptosporidium hominis
SGTCESK

SEQ ID NO: 2161140 - protein, 45 aa, Cryptosporidium hominis
SGTDNDDEECIDQEKEKDSLSKDEGIPDQTPDNNLETSTNLESSH

SEQ ID NO: 2161141 - protein, 8 aa, Cryptosporidium hominis
SGTDTSFQ

SEQ ID NO: 2161142 - protein, 6 aa, Cryptosporidium hominis
SGTENC

SEQ ID NO: 2161143 - protein, 9 aa, Cryptosporidium hominis
SGTGAAGTM

SEQ ID NO: 2161144 - protein, 7 aa, Cryptosporidium hominis
SGTGSKF

SEQ ID NO: 2161145 - protein, 7 aa, Cryptosporidium hominis
SGTISSG

SEQ ID NO: 2161146 - protein, 23 aa, Cryptosporidium hominis
SGTISSNNNNNSDKKNKSSFTPI

SEQ ID NO: 2161147 - protein, 6 aa, Cryptosporidium hominis
SGTITS

SEQ ID NO: 2161148 - protein, 9 aa, Cryptosporidium hominis
SGTKAPQAA

SEQ ID NO: 2161149 - protein, 14 aa, Cryptosporidium hominis
SGTLGTKANSETYL

SEQ ID NO: 2161150 - protein, 55 aa, Cryptosporidium hominis
SGTLTGNNGVVTNSNSNLGMGPGHSTIGSGNSIGANSTVSSGTTTGAGPRQSSQI

SEQ ID NO: 2161151 - protein, 13 aa, Cryptosporidium hominis
SGTLTKDQNLEKS

SEQ ID NO: 2161152 - protein, 22 aa, Cryptosporidium hominis
SGTNESNSSIEFNESQKESCTS

SEQ ID NO: 2161153 - protein, 10 aa, Cryptosporidium hominis
SGTPAQSNSR

SEQ ID NO: 2161154 - protein, 6 aa, Cryptosporidium hominis
SGTPGR

SEQ ID NO: 2161155 - protein, 6 aa, Cryptosporidium hominis
SGTPIS

SEQ ID NO: 2161156 - protein, 6 aa, Cryptosporidium hominis
SGTQEK

SEQ ID NO: 2161157 - protein, 11 aa, Cryptosporidium hominis
SGTRISSSNYN

SEQ ID NO: 2161158 - protein, 8 aa, Cryptosporidium hominis
SGTSMNGR

SEQ ID NO: 2161159 - protein, 5 aa, Cryptosporidium hominis
SGTSP

SEQ ID NO: 2161160 - protein, 5 aa, Cryptosporidium hominis
SGTTA

SEQ ID NO: 2161161 - protein, 9 aa, Cryptosporidium hominis
SGTTGYPKG

SEQ ID NO: 2161162 - protein, 18 aa, Cryptosporidium hominis
SGTTTNTAETLHAGTEAA

SEQ ID NO: 2161163 - protein, 12 aa, Cryptosporidium hominis
SGTVEESGTPGL

SEQ ID NO: 2161164 - protein, 10 aa, Cryptosporidium hominis
SGTVNRGSDV

SEQ ID NO: 2161165 - protein, 8 aa, Cryptosporidium hominis
SGTVTDTK

SEQ ID NO: 2161166 - protein, 4 aa, Cryptosporidium hominis
SGTW

SEQ ID NO: 2161167 - protein, 5 aa, Cryptosporidium hominis
SGVAG

SEQ ID NO: 2161168 - protein, 21 aa, Cryptosporidium hominis
SGVATPGSASLKSANSADALS

SEQ ID NO: 2161169 - protein, 6 aa, Cryptosporidium hominis
SGVDND

SEQ ID NO: 2161170 - protein, 15 aa, Cryptosporidium hominis
SGVGKTCNKTISRKE

SEQ ID NO: 2161171 - protein, 5 aa, Cryptosporidium hominis
SGVGL

SEQ ID NO: 2161172 - protein, 10 aa, Cryptosporidium hominis
SGVGTSEHDL

SEQ ID NO: 2161173 - protein, 4 aa, Cryptosporidium hominis
SGVK

SEQ ID NO: 2161174 - protein, 13 aa, Cryptosporidium hominis
SGVPSEDGQGNKM

SEQ ID NO: 2161175 - protein, 5 aa, Cryptosporidium hominis
SGVQP

SEQ ID NO: 2161176 - protein, 7 aa, Cryptosporidium hominis
SGVQTSE

SEQ ID NO: 2161177 - protein, 15 aa, Cryptosporidium hominis
SGVRPGDLDPKTSSH

SEQ ID NO: 2161178 - protein, 6 aa, Cryptosporidium hominis
SGVSIE

SEQ ID NO: 2161179 - protein, 8 aa, Cryptosporidium hominis
SGVTMGPG

SEQ ID NO: 2161180 - protein, 7 aa, Cryptosporidium hominis
SGYDPIS

SEQ ID NO: 2161181 - protein, 17 aa, Cryptosporidium hominis
SGYNGSLSEEQLNPTDF

SEQ ID NO: 2161182 - protein, 4 aa, Cryptosporidium hominis
SGYP

SEQ ID NO: 2161183 - protein, 7 aa, Cryptosporidium hominis
SGYPANS

SEQ ID NO: 2161184 - protein, 7 aa, Cryptosporidium hominis
SGYPKEN

SEQ ID NO: 2161185 - protein, 9 aa, Cryptosporidium hominis
SGYSDQAKQ

SEQ ID NO: 2161186 - protein, 8 aa, Cryptosporidium hominis
SGYSKDPR

SEQ ID NO: 2161187 - protein, 10 aa, Cryptosporidium hominis
SGYSPSPQVV

SEQ ID NO: 2161188 - protein, 9 aa, Cryptosporidium hominis
SGYSTEGGS

SEQ ID NO: 2161189 - protein, 5 aa, Cryptosporidium hominis
SGYSV

SEQ ID NO: 2161190 - protein, 9 aa, Cryptosporidium hominis
SGYTQSEGK

SEQ ID NO: 2161191 - protein, 4 aa, Cryptosporidium hominis
SGYV

SEQ ID NO: 2161192 - protein, 4 aa, Cryptosporidium hominis
SGYY

SEQ ID NO: 2161193 - protein, 4 aa, Cryptosporidium hominis
SHAN

SEQ ID NO: 2161194 - protein, 16 aa, Cryptosporidium hominis
SHANPTQKNANLAGSE

SEQ ID NO: 2161195 - protein, 6 aa, Cryptosporidium hominis
SHDDGK

SEQ ID NO: 2161196 - protein, 10 aa, Cryptosporidium hominis
SHDGNDRISV

SEQ ID NO: 2161197 - protein, 8 aa, Cryptosporidium hominis
SHDQESPI

SEQ ID NO: 2161198 - protein, 5 aa, Cryptosporidium hominis
SHDTP

SEQ ID NO: 2161199 - protein, 9 aa, Cryptosporidium hominis
SHENSSSEI

SEQ ID NO: 2161200 - protein, 4 aa, Cryptosporidium hominis
SHES

SEQ ID NO: 2161201 - protein, 6 aa, Cryptosporidium hominis
SHESSK

SEQ ID NO: 2161202 - protein, 7 aa, Cryptosporidium hominis
SHETRSE

SEQ ID NO: 2161203 - protein, 6 aa, Cryptosporidium hominis
SHEYRG

SEQ ID NO: 2161204 - protein, 41 aa, Cryptosporidium hominis
SHFGDSASAENEKESEDDNLNSNDLKTGLQDYDQDQEQIEQ

SEQ ID NO: 2161205 - protein, 9 aa, Cryptosporidium hominis
SHGDNDPLD

SEQ ID NO: 2161206 - protein, 5 aa, Cryptosporidium hominis
SHGKR

SEQ ID NO: 2161207 - protein, 21 aa, Cryptosporidium hominis
SHGNIKQDQPVCPNGKAGQGI

SEQ ID NO: 2161208 - protein, 18 aa, Cryptosporidium hominis
SHGNKKGRKYGDKDNTEL

SEQ ID NO: 2161209 - protein, 10 aa, Cryptosporidium hominis
SHGTGTPLGD

SEQ ID NO: 2161210 - protein, 5 aa, Cryptosporidium hominis
SHIES

SEQ ID NO: 2161211 - protein, 6 aa, Cryptosporidium hominis
SHIQNQ

SEQ ID NO: 2161212 - protein, 22 aa, Cryptosporidium hominis
SHKGGSNNTSIETRNRFAALDE

SEQ ID NO: 2161213 - protein, 5 aa, Cryptosporidium hominis
SHKGR

SEQ ID NO: 2161214 - protein, 15 aa, Cryptosporidium hominis
SHKKQIGSDYLPSDE

SEQ ID NO: 2161215 - protein, 5 aa, Cryptosporidium hominis
SHKKT

SEQ ID NO: 2161216 - protein, 8 aa, Cryptosporidium hominis
SHKNQSNI

SEQ ID NO: 2161217 - protein, 4 aa, Cryptosporidium hominis
SHKP

SEQ ID NO: 2161218 - protein, 6 aa, Cryptosporidium hominis
SHKPNR

SEQ ID NO: 2161219 - protein, 9 aa, Cryptosporidium hominis
SHKRSSEEI

SEQ ID NO: 2161220 - protein, 25 aa, Cryptosporidium hominis
SHKTEKSDFQYNNTPQNKLPSDRSN

SEQ ID NO: 2161221 - protein, 7 aa, Cryptosporidium hominis
SHLKPKK

SEQ ID NO: 2161222 - protein, 7 aa, Cryptosporidium hominis
SHLPSNT

SEQ ID NO: 2161223 - protein, 7 aa, Cryptosporidium hominis
SHNEDDL

SEQ ID NO: 2161224 - protein, 5 aa, Cryptosporidium hominis
SHNER

SEQ ID NO: 2161225 - protein, 11 aa, Cryptosporidium hominis
SHNGCDSEISN

SEQ ID NO: 2161226 - protein, 21 aa, Cryptosporidium hominis
SHNGSNISRDGLVDDNGESLI

SEQ ID NO: 2161227 - protein, 6 aa, Cryptosporidium hominis
SHNKNQ

SEQ ID NO: 2161228 - protein, 9 aa, Cryptosporidium hominis
SHNNRRKKR

SEQ ID NO: 2161229 - protein, 10 aa, Cryptosporidium hominis
SHNNSEVQNS

SEQ ID NO: 2161230 - protein, 9 aa, Cryptosporidium hominis
SHNPGGIDE

SEQ ID NO: 2161231 - protein, 6 aa, Cryptosporidium hominis
SHNQHD

SEQ ID NO: 2161232 - protein, 6 aa, Cryptosporidium hominis
SHNSNQ

SEQ ID NO: 2161233 - protein, 10 aa, Cryptosporidium hominis
SHNSSTKYSN

SEQ ID NO: 2161234 - protein, 6 aa, Cryptosporidium hominis
SHPEFQ

SEQ ID NO: 2161235 - protein, 7 aa, Cryptosporidium hominis
SHPEPFE

SEQ ID NO: 2161236 - protein, 6 aa, Cryptosporidium hominis
SHPHPS

SEQ ID NO: 2161237 - protein, 6 aa, Cryptosporidium hominis
SHPHTG

SEQ ID NO: 2161238 - protein, 5 aa, Cryptosporidium hominis
SHPKD

SEQ ID NO: 2161239 - protein, 4 aa, Cryptosporidium hominis
SHPN

SEQ ID NO: 2161240 - protein, 8 aa, Cryptosporidium hominis
SHPNDQRP

SEQ ID NO: 2161241 - protein, 5 aa, Cryptosporidium hominis
SHPQM

SEQ ID NO: 2161242 - protein, 4 aa, Cryptosporidium hominis
SHPR

SEQ ID NO: 2161243 - protein, 13 aa, Cryptosporidium hominis
SHQKKSENKNRNK

SEQ ID NO: 2161244 - protein, 7 aa, Cryptosporidium hominis
SHQNNNF

SEQ ID NO: 2161245 - protein, 13 aa, Cryptosporidium hominis
SHQSRQYQQNNAN

SEQ ID NO: 2161246 - protein, 4 aa, Cryptosporidium hominis
SHQT

SEQ ID NO: 2161247 - protein, 8 aa, Cryptosporidium hominis
SHRGGGGC

SEQ ID NO: 2161248 - protein, 6 aa, Cryptosporidium hominis
SHRKQN

SEQ ID NO: 2161249 - protein, 5 aa, Cryptosporidium hominis
SHRLP

SEQ ID NO: 2161250 - protein, 13 aa, Cryptosporidium hominis
SHRNLTNNSHSEM

SEQ ID NO: 2161251 - protein, 13 aa, Cryptosporidium hominis
SHRQSYSSEGRAY

SEQ ID NO: 2161252 - protein, 8 aa, Cryptosporidium hominis
SHRSKKGD

SEQ ID NO: 2161253 - protein, 4 aa, Cryptosporidium hominis
SHSA

SEQ ID NO: 2161254 - protein, 10 aa, Cryptosporidium hominis
SHSDNRENLN

SEQ ID NO: 2161255 - protein, 6 aa, Cryptosporidium hominis
SHSKGV

SEQ ID NO: 2161256 - protein, 7 aa, Cryptosporidium hominis
SHSKPFS

SEQ ID NO: 2161257 - protein, 6 aa, Cryptosporidium hominis
SHSKSG

SEQ ID NO: 2161258 - protein, 5 aa, Cryptosporidium hominis
SHSSK

SEQ ID NO: 2161259 - protein, 7 aa, Cryptosporidium hominis
SHSTPCK

SEQ ID NO: 2161260 - protein, 8 aa, Cryptosporidium hominis
SHTADECE

SEQ ID NO: 2161261 - protein, 6 aa, Cryptosporidium hominis
SHTDSP

SEQ ID NO: 2161262 - protein, 11 aa, Cryptosporidium hominis
SHTQGRKHQTN

SEQ ID NO: 2161263 - protein, 8 aa, Cryptosporidium hominis
SHTSDSSL

SEQ ID NO: 2161264 - protein, 5 aa, Cryptosporidium hominis
SHTTI

SEQ ID NO: 2161265 - protein, 13 aa, Cryptosporidium hominis
SHTVNPQSEHNLY

SEQ ID NO: 2161266 - protein, 10 aa, Cryptosporidium hominis
SHVSTGGGAS

SEQ ID NO: 2161267 - protein, 13 aa, Cryptosporidium hominis
SIAGDTAGTPSAL

SEQ ID NO: 2161268 - protein, 11 aa, Cryptosporidium hominis
SIANSGSPKEI

SEQ ID NO: 2161269 - protein, 65 aa, Cryptosporidium hominis
SIDANSGKEDKNLGNKSSEQHDSSLSGGKPKRLSDSSAKITKTTNKNKSSTSNSKSGIGQNNPDD

SEQ ID NO: 2161270 - protein, 6 aa, Cryptosporidium hominis
SIDKKT

SEQ ID NO: 2161271 - protein, 5 aa, Cryptosporidium hominis
SIDKN

SEQ ID NO: 2161272 - protein, 8 aa, Cryptosporidium hominis
SIDQAKSS

SEQ ID NO: 2161273 - protein, 28 aa, Cryptosporidium hominis
SIDQESNRHTPTTASSSTKSPAKIEEPT

SEQ ID NO: 2161274 - protein, 4 aa, Cryptosporidium hominis
SIDS

SEQ ID NO: 2161275 - protein, 4 aa, Cryptosporidium hominis
SIEA

SEQ ID NO: 2161276 - protein, 18 aa, Cryptosporidium hominis
SIEANISKNQDETEANAT

SEQ ID NO: 2161277 - protein, 14 aa, Cryptosporidium hominis
SIEDQGELGSNEDR

SEQ ID NO: 2161278 - protein, 4 aa, Cryptosporidium hominis
SIEG

SEQ ID NO: 2161279 - protein, 20 aa, Cryptosporidium hominis
SIEGESPCDKEIAAGDDEEV

SEQ ID NO: 2161280 - protein, 12 aa, Cryptosporidium hominis
SIEKNIDDSLNS

SEQ ID NO: 2161281 - protein, 4 aa, Cryptosporidium hominis
SIEN

SEQ ID NO: 2161282 - protein, 5 aa, Cryptosporidium hominis
SIENP

SEQ ID NO: 2161283 - protein, 9 aa, Cryptosporidium hominis
SIERDSTEC

SEQ ID NO: 2161284 - protein, 12 aa, Cryptosporidium hominis
SIESSKRYNHTS

SEQ ID NO: 2161285 - protein, 9 aa, Cryptosporidium hominis
SIESSSNNN

SEQ ID NO: 2161286 - protein, 51 aa, Cryptosporidium hominis
SIESTNQQNISTVNTSSSLAVSSNSGVDPAQTQEAPPEPPKKRGRGRPRIN

SEQ ID NO: 2161287 - protein, 5 aa, Cryptosporidium hominis
SIETP

SEQ ID NO: 2161288 - protein, 8 aa, Cryptosporidium hominis
SIETTEDG

SEQ ID NO: 2161289 - protein, 4 aa, Cryptosporidium hominis
SIGE

SEQ ID NO: 2161290 - protein, 5 aa, Cryptosporidium hominis
SIGEN

SEQ ID NO: 2161291 - protein, 6 aa, Cryptosporidium hominis
SIGGKG

SEQ ID NO: 2161292 - protein, 11 aa, Cryptosporidium hominis
SIGNNNSFEVG

SEQ ID NO: 2161293 - protein, 6 aa, Cryptosporidium hominis
SIGRSN

SEQ ID NO: 2161294 - protein, 4 aa, Cryptosporidium hominis
SIGS

SEQ ID NO: 2161295 - protein, 11 aa, Cryptosporidium hominis
SIGSRTEEGLL

SEQ ID NO: 2161296 - protein, 6 aa, Cryptosporidium hominis
SIGTGL

SEQ ID NO: 2161297 - protein, 5 aa, Cryptosporidium hominis
SIHSE

SEQ ID NO: 2161298 - protein, 11 aa, Cryptosporidium hominis
SIHSNTPLPPS

SEQ ID NO: 2161299 - protein, 4 aa, Cryptosporidium hominis
SIIE

SEQ ID NO: 2161300 - protein, 5 aa, Cryptosporidium hominis
SIIQE

SEQ ID NO: 2161301 - protein, 5 aa, Cryptosporidium hominis
SIKDG

SEQ ID NO: 2161302 - protein, 5 aa, Cryptosporidium hominis
SIKDS

SEQ ID NO: 2161303 - protein, 5 aa, Cryptosporidium hominis
SIKEQ

SEQ ID NO: 2161304 - protein, 17 aa, Cryptosporidium hominis
SIKGRSENEILANDKPL

SEQ ID NO: 2161305 - protein, 4 aa, Cryptosporidium hominis
SIKK

SEQ ID NO: 2161306 - protein, 10 aa, Cryptosporidium hominis
SIKPKKGRKR

SEQ ID NO: 2161307 - protein, 9 aa, Cryptosporidium hominis
SIKQDDEGI

SEQ ID NO: 2161308 - protein, 9 aa, Cryptosporidium hominis
SIKQEDNNI

SEQ ID NO: 2161309 - protein, 5 aa, Cryptosporidium hominis
SIKRN

SEQ ID NO: 2161310 - protein, 7 aa, Cryptosporidium hominis
SIKSDSK

SEQ ID NO: 2161311 - protein, 7 aa, Cryptosporidium hominis
SIKSEQG

SEQ ID NO: 2161312 - protein, 16 aa, Cryptosporidium hominis
SIKSQEEKLRKEKSLN

SEQ ID NO: 2161313 - protein, 16 aa, Cryptosporidium hominis
SIKSSDKKDYSDVTPD

SEQ ID NO: 2161314 - protein, 5 aa, Cryptosporidium hominis
SIKTD

SEQ ID NO: 2161315 - protein, 15 aa, Cryptosporidium hominis
SIKTRIEEESDESLT

SEQ ID NO: 2161316 - protein, 10 aa, Cryptosporidium hominis
SILGGSGNHH

SEQ ID NO: 2161317 - protein, 12 aa, Cryptosporidium hominis
SILSTKYDGGYV

SEQ ID NO: 2161318 - protein, 16 aa, Cryptosporidium hominis
SINAKQKNSNETGKFT

SEQ ID NO: 2161319 - protein, 16 aa, Cryptosporidium hominis
SINEEENELDNEKKDY

SEQ ID NO: 2161320 - protein, 6 aa, Cryptosporidium hominis
SINGGT

SEQ ID NO: 2161321 - protein, 12 aa, Cryptosporidium hominis
SINGNGDSKNEW

SEQ ID NO: 2161322 - protein, 5 aa, Cryptosporidium hominis
SINGR

SEQ ID NO: 2161323 - protein, 9 aa, Cryptosporidium hominis
SINNNNNSF

SEQ ID NO: 2161324 - protein, 5 aa, Cryptosporidium hominis
SINNS

SEQ ID NO: 2161325 - protein, 16 aa, Cryptosporidium hominis
SINNSGNNSSFSKQNI

SEQ ID NO: 2161326 - protein, 11 aa, Cryptosporidium hominis
SINNTASEKLT

SEQ ID NO: 2161327 - protein, 19 aa, Cryptosporidium hominis
SINNTTDDLSNQELEDSKF

SEQ ID NO: 2161328 - protein, 5 aa, Cryptosporidium hominis
SINPD

SEQ ID NO: 2161329 - protein, 11 aa, Cryptosporidium hominis
SINPGQSNSKL

SEQ ID NO: 2161330 - protein, 6 aa, Cryptosporidium hominis
SINSEP

SEQ ID NO: 2161331 - protein, 10 aa, Cryptosporidium hominis
SINSEQKSLR

SEQ ID NO: 2161332 - protein, 16 aa, Cryptosporidium hominis
SINSNQNTEQIPDCKS

SEQ ID NO: 2161333 - protein, 33 aa, Cryptosporidium hominis
SINSNTNSSGSNSGNNNSSTNNNNINNACSDNA

SEQ ID NO: 2161334 - protein, 13 aa, Cryptosporidium hominis
SINSQTKNIKRPE

SEQ ID NO: 2161335 - protein, 4 aa, Cryptosporidium hominis
SINT

SEQ ID NO: 2161336 - protein, 22 aa, Cryptosporidium hominis
SINTKKDGPKLPTSDKKIPDRE

SEQ ID NO: 2161337 - protein, 5 aa, Cryptosporidium hominis
SINWT

SEQ ID NO: 2161338 - protein, 17 aa, Cryptosporidium hominis
SIPASISGVTDSPSISL

SEQ ID NO: 2161339 - protein, 9 aa, Cryptosporidium hominis
SIPASNSSY

SEQ ID NO: 2161340 - protein, 5 aa, Cryptosporidium hominis
SIPDE

SEQ ID NO: 2161341 - protein, 4 aa, Cryptosporidium hominis
SIPE

SEQ ID NO: 2161342 - protein, 5 aa, Cryptosporidium hominis
SIPGG

SEQ ID NO: 2161343 - protein, 4 aa, Cryptosporidium hominis
SIPN

SEQ ID NO: 2161344 - protein, 7 aa, Cryptosporidium hominis
SIPPINK

SEQ ID NO: 2161345 - protein, 17 aa, Cryptosporidium hominis
SIPPINKEADTSIQTKS

SEQ ID NO: 2161346 - protein, 19 aa, Cryptosporidium hominis
SIPSPPSVNTLNTTYRKGD

SEQ ID NO: 2161347 - protein, 12 aa, Cryptosporidium hominis
SIPSSSNSSSNL

SEQ ID NO: 2161348 - protein, 8 aa, Cryptosporidium hominis
SIPSTRKT

SEQ ID NO: 2161349 - protein, 4 aa, Cryptosporidium hominis
SIPT

SEQ ID NO: 2161350 - protein, 5 aa, Cryptosporidium hominis
SIPTD

SEQ ID NO: 2161351 - protein, 6 aa, Cryptosporidium hominis
SIPTKR

SEQ ID NO: 2161352 - protein, 13 aa, Cryptosporidium hominis
SIPTPTAQQKAGL

SEQ ID NO: 2161353 - protein, 7 aa, Cryptosporidium hominis
SIPTSSL

SEQ ID NO: 2161354 - protein, 11 aa, Cryptosporidium hominis
SIQDSDNENIS

SEQ ID NO: 2161355 - protein, 10 aa, Cryptosporidium hominis
SIQEDHSKSI

SEQ ID NO: 2161356 - protein, 17 aa, Cryptosporidium hominis
SIQGEDSETNKSKGITA

SEQ ID NO: 2161357 - protein, 10 aa, Cryptosporidium hominis
SIQGGDPIPN

SEQ ID NO: 2161358 - protein, 7 aa, Cryptosporidium hominis
SIQNENE

SEQ ID NO: 2161359 - protein, 12 aa, Cryptosporidium hominis
SIQNQGQQITTQ

SEQ ID NO: 2161360 - protein, 6 aa, Cryptosporidium hominis
SIQPNS

SEQ ID NO: 2161361 - protein, 18 aa, Cryptosporidium hominis
SIQPPTKKTRKSRSINSN

SEQ ID NO: 2161362 - protein, 15 aa, Cryptosporidium hominis
SIQPTGMTAPSGSQC

SEQ ID NO: 2161363 - protein, 4 aa, Cryptosporidium hominis
SIQR

SEQ ID NO: 2161364 - protein, 8 aa, Cryptosporidium hominis
SIQRPGMG

SEQ ID NO: 2161365 - protein, 14 aa, Cryptosporidium hominis
SIRAGYGGDDLPRS

SEQ ID NO: 2161366 - protein, 11 aa, Cryptosporidium hominis
SIRAKSNKRKT

SEQ ID NO: 2161367 - protein, 6 aa, Cryptosporidium hominis
SIRDPE

SEQ ID NO: 2161368 - protein, 5 aa, Cryptosporidium hominis
SIREN

SEQ ID NO: 2161369 - protein, 15 aa, Cryptosporidium hominis
SIRESDTGLAPPSQW

SEQ ID NO: 2161370 - protein, 7 aa, Cryptosporidium hominis
SIRKGQT

SEQ ID NO: 2161371 - protein, 13 aa, Cryptosporidium hominis
SIRRQDANSQKPE

SEQ ID NO: 2161372 - protein, 8 aa, Cryptosporidium hominis
SISDEREN

SEQ ID NO: 2161373 - protein, 5 aa, Cryptosporidium hominis
SISED

SEQ ID NO: 2161374 - protein, 11 aa, Cryptosporidium hominis
SISEREAKSRA

SEQ ID NO: 2161375 - protein, 6 aa, Cryptosporidium hominis
SISGLS

SEQ ID NO: 2161376 - protein, 19 aa, Cryptosporidium hominis
SISGNQGLYRNQSNGGTSN

SEQ ID NO: 2161377 - protein, 12 aa, Cryptosporidium hominis
SISGQDTPETCQ

SEQ ID NO: 2161378 - protein, 6 aa, Cryptosporidium hominis
SISGRR

SEQ ID NO: 2161379 - protein, 5 aa, Cryptosporidium hominis
SISGT

SEQ ID NO: 2161380 - protein, 6 aa, Cryptosporidium hominis
SISKSP

SEQ ID NO: 2161381 - protein, 35 aa, Cryptosporidium hominis
SISNEKLNGKNLEEEEEKREEEEIQRNQRGQGDRQ

SEQ ID NO: 2161382 - protein, 5 aa, Cryptosporidium hominis
SISNG

SEQ ID NO: 2161383 - protein, 12 aa, Cryptosporidium hominis
SISNKPNSSIPS

SEQ ID NO: 2161384 - protein, 6 aa, Cryptosporidium hominis
SISNRE

SEQ ID NO: 2161385 - protein, 15 aa, Cryptosporidium hominis
SISNSPAESKENLPC

SEQ ID NO: 2161386 - protein, 32 aa, Cryptosporidium hominis
SISNTGNALGGIEESTNESNTNLSNSTKNFPG

SEQ ID NO: 2161387 - protein, 8 aa, Cryptosporidium hominis
SISNTKKI

SEQ ID NO: 2161388 - protein, 9 aa, Cryptosporidium hominis
SISPEDSQS

SEQ ID NO: 2161389 - protein, 10 aa, Cryptosporidium hominis
SISPGNKSVS

SEQ ID NO: 2161390 - protein, 8 aa, Cryptosporidium hominis
SISQATEN

SEQ ID NO: 2161391 - protein, 13 aa, Cryptosporidium hominis
SISRDPYQGKRYR

SEQ ID NO: 2161392 - protein, 6 aa, Cryptosporidium hominis
SISRKH

SEQ ID NO: 2161393 - protein, 10 aa, Cryptosporidium hominis
SISSDFEKNT

SEQ ID NO: 2161394 - protein, 6 aa, Cryptosporidium hominis
SISSID

SEQ ID NO: 2161395 - protein, 13 aa, Cryptosporidium hominis
SISSQKARRNRVF

SEQ ID NO: 2161396 - protein, 7 aa, Cryptosporidium hominis
SISSSPN

SEQ ID NO: 2161397 - protein, 14 aa, Cryptosporidium hominis
SISSSSSSSFSSQS

SEQ ID NO: 2161398 - protein, 4 aa, Cryptosporidium hominis
SIST

SEQ ID NO: 2161399 - protein, 10 aa, Cryptosporidium hominis
SISTAENEQQ

SEQ ID NO: 2161400 - protein, 13 aa, Cryptosporidium hominis
SISTNKEYSEGSA

SEQ ID NO: 2161401 - protein, 18 aa, Cryptosporidium hominis
SISTQDDQQMEDPEKKGS

SEQ ID NO: 2161402 - protein, 26 aa, Cryptosporidium hominis
SISTTQAPYDTLSSQDSLQSQSNTQI

SEQ ID NO: 2161403 - protein, 6 aa, Cryptosporidium hominis
SITASG

SEQ ID NO: 2161404 - protein, 8 aa, Cryptosporidium hominis
SITGNAQS

SEQ ID NO: 2161405 - protein, 6 aa, Cryptosporidium hominis
SITKTN

SEQ ID NO: 2161406 - protein, 7 aa, Cryptosporidium hominis
SITNSQD

SEQ ID NO: 2161407 - protein, 4 aa, Cryptosporidium hominis
SITP

SEQ ID NO: 2161408 - protein, 6 aa, Cryptosporidium hominis
SITQEE

SEQ ID NO: 2161409 - protein, 7 aa, Cryptosporidium hominis
SITRNQE

SEQ ID NO: 2161410 - protein, 17 aa, Cryptosporidium hominis
SITSQTRKSYYKPKNED

SEQ ID NO: 2161411 - protein, 4 aa, Cryptosporidium hominis
SITY

SEQ ID NO: 2161412 - protein, 21 aa, Cryptosporidium hominis
SIVSPKSNDSEKLVKNNGNDN

SEQ ID NO: 2161413 - protein, 13 aa, Cryptosporidium hominis
SIYNSYSSNAKEI

SEQ ID NO: 2161414 - protein, 5 aa, Cryptosporidium hominis
SIYPP

SEQ ID NO: 2161415 - protein, 19 aa, Cryptosporidium hominis
SKAAGDARFTDTRADEQER

SEQ ID NO: 2161416 - protein, 45 aa, Cryptosporidium hominis
SKAAGGGPGDQKQPGVQNQMGASSSTPNSSHSTEPSSVSMQQQQQ

SEQ ID NO: 2161417 - protein, 8 aa, Cryptosporidium hominis
SKADGNRS

SEQ ID NO: 2161418 - protein, 49 aa, Cryptosporidium hominis
SKAEDLSSKLTKNIENSTLTPNSIKKKTNSEDPSISNEINTSNNQSPSK

SEQ ID NO: 2161419 - protein, 8 aa, Cryptosporidium hominis
SKAKRKLT

SEQ ID NO: 2161420 - protein, 11 aa, Cryptosporidium hominis
SKANKKNGEGQ

SEQ ID NO: 2161421 - protein, 9 aa, Cryptosporidium hominis
SKAQNGNNL

SEQ ID NO: 2161422 - protein, 9 aa, Cryptosporidium hominis
SKASNIRDK

SEQ ID NO: 2161423 - protein, 16 aa, Cryptosporidium hominis
SKASSHNNSMEGEDIE

SEQ ID NO: 2161424 - protein, 31 aa, Cryptosporidium hominis
SKASSSKIDRTEYQNKADYSQVNSDRNKRTK

SEQ ID NO: 2161425 - protein, 21 aa, Cryptosporidium hominis
  misc_feature (16)..(16): Xaa can be any naturally occurring amino acid
SKASTTFTKSYIETKXSWWSS

SEQ ID NO: 2161426 - protein, 8 aa, Cryptosporidium hominis
SKATETHK

SEQ ID NO: 2161427 - protein, 8 aa, Cryptosporidium hominis
SKATKTDL

SEQ ID NO: 2161428 - protein, 12 aa, Cryptosporidium hominis
SKCLPDGNRIRG

SEQ ID NO: 2161429 - protein, 34 aa, Cryptosporidium hominis
SKCPQSYTSQEPPVENETEKGDTNSNTLKEMTDR

SEQ ID NO: 2161430 - protein, 9 aa, Cryptosporidium hominis
SKCSPDLKK

SEQ ID NO: 2161431 - protein, 11 aa, Cryptosporidium hominis
SKDARPSRFPP

SEQ ID NO: 2161432 - protein, 5 aa, Cryptosporidium hominis
SKDDH

SEQ ID NO: 2161433 - protein, 5 aa, Cryptosporidium hominis
SKDDP

SEQ ID NO: 2161434 - protein, 11 aa, Cryptosporidium hominis
SKDDPKSNSSM

SEQ ID NO: 2161435 - protein, 4 aa, Cryptosporidium hominis
SKDE

SEQ ID NO: 2161436 - protein, 8 aa, Cryptosporidium hominis
SKDEEEKV

SEQ ID NO: 2161437 - protein, 9 aa, Cryptosporidium hominis
SKDEEGYDE

SEQ ID NO: 2161438 - protein, 6 aa, Cryptosporidium hominis
SKDEET

SEQ ID NO: 2161439 - protein, 8 aa, Cryptosporidium hominis
SKDEIKEL

SEQ ID NO: 2161440 - protein, 12 aa, Cryptosporidium hominis
SKDEISQSIRSN

SEQ ID NO: 2161441 - protein, 7 aa, Cryptosporidium hominis
SKDEKLV

SEQ ID NO: 2161442 - protein, 24 aa, Cryptosporidium hominis
SKDEKTVFESNPNVDSKADVSYNS

SEQ ID NO: 2161443 - protein, 5 aa, Cryptosporidium hominis
SKDEV

SEQ ID NO: 2161444 - protein, 8 aa, Cryptosporidium hominis
SKDGEFGG

SEQ ID NO: 2161445 - protein, 7 aa, Cryptosporidium hominis
SKDGQNE

SEQ ID NO: 2161446 - protein, 15 aa, Cryptosporidium hominis
SKDISENSQNTSNNL

SEQ ID NO: 2161447 - protein, 4 aa, Cryptosporidium hominis
SKDM

SEQ ID NO: 2161448 - protein, 5 aa, Cryptosporidium hominis
SKDNT

SEQ ID NO: 2161449 - protein, 5 aa, Cryptosporidium hominis
SKDPF

SEQ ID NO: 2161450 - protein, 7 aa, Cryptosporidium hominis
SKDPNMK

SEQ ID NO: 2161451 - protein, 8 aa, Cryptosporidium hominis
SKDPSHRQ

SEQ ID NO: 2161452 - protein, 11 aa, Cryptosporidium hominis
SKDPSSPFNPN

SEQ ID NO: 2161453 - protein, 5 aa, Cryptosporidium hominis
SKDQD

SEQ ID NO: 2161454 - protein, 16 aa, Cryptosporidium hominis
SKDQIPPGTANTPSLG

SEQ ID NO: 2161455 - protein, 17 aa, Cryptosporidium hominis
SKDRQKLSHNSQEQGLN

SEQ ID NO: 2161456 - protein, 9 aa, Cryptosporidium hominis
SKDSEDVEI

SEQ ID NO: 2161457 - protein, 6 aa, Cryptosporidium hominis
SKDSKS

SEQ ID NO: 2161458 - protein, 6 aa, Cryptosporidium hominis
SKDSNI

SEQ ID NO: 2161459 - protein, 23 aa, Cryptosporidium hominis
SKDSNMGIPSSASASSSSSSEVK

SEQ ID NO: 2161460 - protein, 11 aa, Cryptosporidium hominis
SKDSSSSNSCN

SEQ ID NO: 2161461 - protein, 8 aa, Cryptosporidium hominis
SKDTIEKT

SEQ ID NO: 2161462 - protein, 10 aa, Cryptosporidium hominis
SKDTNNPLQQ

SEQ ID NO: 2161463 - protein, 13 aa, Cryptosporidium hominis
SKDTTGDGSQIGK

SEQ ID NO: 2161464 - protein, 9 aa, Cryptosporidium hominis
SKDVNSEKT

SEQ ID NO: 2161465 - protein, 16 aa, Cryptosporidium hominis
SKDYSEQCNKKSTSRG

SEQ ID NO: 2161466 - protein, 5 aa, Cryptosporidium hominis
SKEAG

SEQ ID NO: 2161467 - protein, 5 aa, Cryptosporidium hominis
SKEAR

SEQ ID NO: 2161468 - protein, 15 aa, Cryptosporidium hominis
SKEATLTEDQKEING

SEQ ID NO: 2161469 - protein, 8 aa, Cryptosporidium hominis
SKEEDRID

SEQ ID NO: 2161470 - protein, 7 aa, Cryptosporidium hominis
SKEEKDV

SEQ ID NO: 2161471 - protein, 8 aa, Cryptosporidium hominis
SKEEKEKC

SEQ ID NO: 2161472 - protein, 7 aa, Cryptosporidium hominis
SKEEKYE

SEQ ID NO: 2161473 - protein, 13 aa, Cryptosporidium hominis
SKEEKYEINGYNR

SEQ ID NO: 2161474 - protein, 9 aa, Cryptosporidium hominis
SKEENQSIN

SEQ ID NO: 2161475 - protein, 5 aa, Cryptosporidium hominis
SKEGI

SEQ ID NO: 2161476 - protein, 13 aa, Cryptosporidium hominis
SKEGSGDWQMRTE

SEQ ID NO: 2161477 - protein, 8 aa, Cryptosporidium hominis
SKEGVNTS

SEQ ID NO: 2161478 - protein, 6 aa, Cryptosporidium hominis
SKEIPP

SEQ ID NO: 2161479 - protein, 15 aa, Cryptosporidium hominis
SKEIYSSNDELGGTE

SEQ ID NO: 2161480 - protein, 4 aa, Cryptosporidium hominis
SKEK

SEQ ID NO: 2161481 - protein, 8 aa, Cryptosporidium hominis
SKEKEEKI

SEQ ID NO: 2161482 - protein, 12 aa, Cryptosporidium hominis
SKEKLKKKSTIK

SEQ ID NO: 2161483 - protein, 5 aa, Cryptosporidium hominis
SKEKN

SEQ ID NO: 2161484 - protein, 7 aa, Cryptosporidium hominis
SKELGTW

SEQ ID NO: 2161485 - protein, 28 aa, Cryptosporidium hominis
SKENDESSVSSQDEYEGQTSEETSPNKC

SEQ ID NO: 2161486 - protein, 14 aa, Cryptosporidium hominis
SKENKEKMKNKPPI

SEQ ID NO: 2161487 - protein, 8 aa, Cryptosporidium hominis
SKENNSQC

SEQ ID NO: 2161488 - protein, 10 aa, Cryptosporidium hominis
SKENREIEKY

SEQ ID NO: 2161489 - protein, 7 aa, Cryptosporidium hominis
SKENSQN

SEQ ID NO: 2161490 - protein, 10 aa, Cryptosporidium hominis
SKENTKDGTV

SEQ ID NO: 2161491 - protein, 6 aa, Cryptosporidium hominis
SKEQIG

SEQ ID NO: 2161492 - protein, 7 aa, Cryptosporidium hominis
SKERMRP

SEQ ID NO: 2161493 - protein, 4 aa, Cryptosporidium hominis
SKES

SEQ ID NO: 2161494 - protein, 6 aa, Cryptosporidium hominis
SKESID

SEQ ID NO: 2161495 - protein, 11 aa, Cryptosporidium hominis
SKESRDGFSKT

SEQ ID NO: 2161496 - protein, 5 aa, Cryptosporidium hominis
SKETF

SEQ ID NO: 2161497 - protein, 6 aa, Cryptosporidium hominis
SKETGD

SEQ ID NO: 2161498 - protein, 50 aa, Cryptosporidium hominis
SKETTDTSVANNGYSGVNSKQTKCQETMKGTGYETSIQGQDQARKQLQKQ

SEQ ID NO: 2161499 - protein, 4 aa, Cryptosporidium hominis
SKFD

SEQ ID NO: 2161500 - protein, 21 aa, Cryptosporidium hominis
SKFDHSSDDVSSSIETSNSEI

SEQ ID NO: 2161501 - protein, 4 aa, Cryptosporidium hominis
SKFG

SEQ ID NO: 2161502 - protein, 9 aa, Cryptosporidium hominis
SKFGGKPAW

SEQ ID NO: 2161503 - protein, 21 aa, Cryptosporidium hominis
SKFSNGSDKWDRSNGERRNIG

SEQ ID NO: 2161504 - protein, 18 aa, Cryptosporidium hominis
SKFSSGASTRVNTPEDDL

SEQ ID NO: 2161505 - protein, 6 aa, Cryptosporidium hominis
SKFTEN

SEQ ID NO: 2161506 - protein, 6 aa, Cryptosporidium hominis
SKGAFN

SEQ ID NO: 2161507 - protein, 5 aa, Cryptosporidium hominis
SKGAI

SEQ ID NO: 2161508 - protein, 13 aa, Cryptosporidium hominis
SKGASKKPNTNGS

SEQ ID NO: 2161509 - protein, 5 aa, Cryptosporidium hominis
SKGDK

SEQ ID NO: 2161510 - protein, 5 aa, Cryptosporidium hominis
SKGEL

SEQ ID NO: 2161511 - protein, 5 aa, Cryptosporidium hominis
SKGFR

SEQ ID NO: 2161512 - protein, 13 aa, Cryptosporidium hominis
SKGGIKIQSSQGK

SEQ ID NO: 2161513 - protein, 9 aa, Cryptosporidium hominis
SKGGKEDVE

SEQ ID NO: 2161514 - protein, 11 aa, Cryptosporidium hominis
SKGHKDGSGGL

SEQ ID NO: 2161515 - protein, 15 aa, Cryptosporidium hominis
SKGIKNKNNKEDTLN

SEQ ID NO: 2161516 - protein, 8 aa, Cryptosporidium hominis
SKGKDYSQ

SEQ ID NO: 2161517 - protein, 13 aa, Cryptosporidium hominis
SKGKQKGNTQLKQ

SEQ ID NO: 2161518 - protein, 7 aa, Cryptosporidium hominis
SKGKTSL

SEQ ID NO: 2161519 - protein, 7 aa, Cryptosporidium hominis
SKGNAAE

SEQ ID NO: 2161520 - protein, 8 aa, Cryptosporidium hominis
SKGNQYKN

SEQ ID NO: 2161521 - protein, 9 aa, Cryptosporidium hominis
SKGNSTEKV

SEQ ID NO: 2161522 - protein, 13 aa, Cryptosporidium hominis
SKGPFTGTSGIGS

SEQ ID NO: 2161523 - protein, 5 aa, Cryptosporidium hominis
SKGPN

SEQ ID NO: 2161524 - protein, 7 aa, Cryptosporidium hominis
SKGRYES

SEQ ID NO: 2161525 - protein, 4 aa, Cryptosporidium hominis
SKGS

SEQ ID NO: 2161526 - protein, 32 aa, Cryptosporidium hominis
SKGSGGPGAIGGSSGAGTGISGERDSSTGPDF

SEQ ID NO: 2161527 - protein, 6 aa, Cryptosporidium hominis
SKGSIG

SEQ ID NO: 2161528 - protein, 6 aa, Cryptosporidium hominis
SKGSQS

SEQ ID NO: 2161529 - protein, 7 aa, Cryptosporidium hominis
SKGSRSM

SEQ ID NO: 2161530 - protein, 14 aa, Cryptosporidium hominis
SKGSVPGSSSQKNI

SEQ ID NO: 2161531 - protein, 39 aa, Cryptosporidium hominis
SKGSYSQSSQALQHSPSPSPQYSQSPHYSQPSRNSHPYQ

SEQ ID NO: 2161532 - protein, 6 aa, Cryptosporidium hominis
SKGTKF

SEQ ID NO: 2161533 - protein, 29 aa, Cryptosporidium hominis
SKGTNNVPAQSQSGSDSSCGQCADGQCGE

SEQ ID NO: 2161534 - protein, 6 aa, Cryptosporidium hominis
SKGTVA

SEQ ID NO: 2161535 - protein, 23 aa, Cryptosporidium hominis
SKGVTSSSRISPTLNSSSTNYYH

SEQ ID NO: 2161536 - protein, 4 aa, Cryptosporidium hominis
SKHE

SEQ ID NO: 2161537 - protein, 5 aa, Cryptosporidium hominis
SKHEY

SEQ ID NO: 2161538 - protein, 6 aa, Cryptosporidium hominis
SKHGIS

SEQ ID NO: 2161539 - protein, 7 aa, Cryptosporidium hominis
SKHLGQK

SEQ ID NO: 2161540 - protein, 14 aa, Cryptosporidium hominis
SKHLSEKEDISVGS

SEQ ID NO: 2161541 - protein, 15 aa, Cryptosporidium hominis
SKHNSKTSRKSKLKK

SEQ ID NO: 2161542 - protein, 8 aa, Cryptosporidium hominis
SKHPGDKN

SEQ ID NO: 2161543 - protein, 6 aa, Cryptosporidium hominis
SKIDDE

SEQ ID NO: 2161544 - protein, 4 aa, Cryptosporidium hominis
SKIE

SEQ ID NO: 2161545 - protein, 16 aa, Cryptosporidium hominis
SKIEPGSTSFDESTSS

SEQ ID NO: 2161546 - protein, 7 aa, Cryptosporidium hominis
SKIESEK

SEQ ID NO: 2161547 - protein, 37 aa, Cryptosporidium hominis
SKIETRTEEKSVYESNYDKVSKADARYNSDSSQIYPP

SEQ ID NO: 2161548 - protein, 5 aa, Cryptosporidium hominis
SKIEV

SEQ ID NO: 2161549 - protein, 6 aa, Cryptosporidium hominis
SKIGQP

SEQ ID NO: 2161550 - protein, 6 aa, Cryptosporidium hominis
SKIGTK

SEQ ID NO: 2161551 - protein, 13 aa, Cryptosporidium hominis
SKIGTTSPMSDSV

SEQ ID NO: 2161552 - protein, 5 aa, Cryptosporidium hominis
SKIKP

SEQ ID NO: 2161553 - protein, 6 aa, Cryptosporidium hominis
SKIKSR

SEQ ID NO: 2161554 - protein, 100 aa, Cryptosporidium hominis
SKINDESDINPESEYSKHKSQLESGKSDKLSTPKQSQSKMPSMDHSKSHSQASRSSLESSKALSQTLPQSKSNASVSKLNTSKSHIEQSKTDISKKEGSI

SEQ ID NO: 2161555 - protein, 12 aa, Cryptosporidium hominis
SKINSQSKSNKL

SEQ ID NO: 2161556 - protein, 7 aa, Cryptosporidium hominis
SKIPSTQ

SEQ ID NO: 2161557 - protein, 17 aa, Cryptosporidium hominis
SKIPTKINYDGTETQIS

SEQ ID NO: 2161558 - protein, 7 aa, Cryptosporidium hominis
SKIRSYG

SEQ ID NO: 2161559 - protein, 4 aa, Cryptosporidium hominis
SKIS

SEQ ID NO: 2161560 - protein, 7 aa, Cryptosporidium hominis
SKISKES

SEQ ID NO: 2161561 - protein, 11 aa, Cryptosporidium hominis
SKISNNQQGSI

SEQ ID NO: 2161562 - protein, 15 aa, Cryptosporidium hominis
SKISTGSEIKTQEAT

SEQ ID NO: 2161563 - protein, 14 aa, Cryptosporidium hominis
SKISTQGSHALSEE

SEQ ID NO: 2161564 - protein, 4 aa, Cryptosporidium hominis
SKIT

SEQ ID NO: 2161565 - protein, 8 aa, Cryptosporidium hominis
SKKADFSG

SEQ ID NO: 2161566 - protein, 8 aa, Cryptosporidium hominis
SKKAEEKV

SEQ ID NO: 2161567 - protein, 18 aa, Cryptosporidium hominis
SKKAEKKIKEAGGICVLS

SEQ ID NO: 2161568 - protein, 10 aa, Cryptosporidium hominis
SKKDEQEKLN

SEQ ID NO: 2161569 - protein, 9 aa, Cryptosporidium hominis
SKKDGKKFK

SEQ ID NO: 2161570 - protein, 7 aa, Cryptosporidium hominis
SKKDPKE

SEQ ID NO: 2161571 - protein, 122 aa, Cryptosporidium hominis
SKKEKEEEEERERERIRKEKEKEEEEEKERERERERIRKEKEEEEERERIRKEKEKEEEEEKERIRKEKEKEEEEKKERERERIRKEKEKEEEEEKERERERERIKKEKEREEEKEKIRQEM

SEQ ID NO: 2161572 - protein, 11 aa, Cryptosporidium hominis
SKKELDSLQTE

SEQ ID NO: 2161573 - protein, 6 aa, Cryptosporidium hominis
SKKENI

SEQ ID NO: 2161574 - protein, 7 aa, Cryptosporidium hominis
SKKETIS

SEQ ID NO: 2161575 - protein, 8 aa, Cryptosporidium hominis
SKKFQSKD

SEQ ID NO: 2161576 - protein, 8 aa, Cryptosporidium hominis
SKKHSYSS

SEQ ID NO: 2161577 - protein, 12 aa, Cryptosporidium hominis
SKKIGKLIKNEF

SEQ ID NO: 2161578 - protein, 6 aa, Cryptosporidium hominis
SKKIHQ

SEQ ID NO: 2161579 - protein, 6 aa, Cryptosporidium hominis
SKKKDG

SEQ ID NO: 2161580 - protein, 8 aa, Cryptosporidium hominis
SKKKERKH

SEQ ID NO: 2161581 - protein, 5 aa, Cryptosporidium hominis
SKKKT

SEQ ID NO: 2161582 - protein, 6 aa, Cryptosporidium hominis
SKKKTY

SEQ ID NO: 2161583 - protein, 7 aa, Cryptosporidium hominis
SKKKVGA

SEQ ID NO: 2161584 - protein, 13 aa, Cryptosporidium hominis
SKKLGYDKEQDEL

SEQ ID NO: 2161585 - protein, 11 aa, Cryptosporidium hominis
SKKLKNKIESL

SEQ ID NO: 2161586 - protein, 12 aa, Cryptosporidium hominis
SKKLQKDYSNNI

SEQ ID NO: 2161587 - protein, 26 aa, Cryptosporidium hominis
SKKNAGEDEDGKNMNDEEKEKPKETL

SEQ ID NO: 2161588 - protein, 7 aa, Cryptosporidium hominis
SKKNDSN

SEQ ID NO: 2161589 - protein, 6 aa, Cryptosporidium hominis
SKKNHS

SEQ ID NO: 2161590 - protein, 11 aa, Cryptosporidium hominis
SKKNKSIDNMK

SEQ ID NO: 2161591 - protein, 14 aa, Cryptosporidium hominis
SKKNNGKQLRNKME

SEQ ID NO: 2161592 - protein, 6 aa, Cryptosporidium hominis
SKKNNV

SEQ ID NO: 2161593 - protein, 4 aa, Cryptosporidium hominis
SKKP

SEQ ID NO: 2161594 - protein, 7 aa, Cryptosporidium hominis
SKKPFDF

SEQ ID NO: 2161595 - protein, 9 aa, Cryptosporidium hominis
SKKPSSSGM

SEQ ID NO: 2161596 - protein, 5 aa, Cryptosporidium hominis
SKKQE

SEQ ID NO: 2161597 - protein, 12 aa, Cryptosporidium hominis
SKKQIDKLQKLC

SEQ ID NO: 2161598 - protein, 9 aa, Cryptosporidium hominis
SKKRFDTDP

SEQ ID NO: 2161599 - protein, 8 aa, Cryptosporidium hominis
SKKRFRKA

SEQ ID NO: 2161600 - protein, 6 aa, Cryptosporidium hominis
SKKRNI

SEQ ID NO: 2161601 - protein, 7 aa, Cryptosporidium hominis
SKKRRSR

SEQ ID NO: 2161602 - protein, 8 aa, Cryptosporidium hominis
SKKSFELP

SEQ ID NO: 2161603 - protein, 8 aa, Cryptosporidium hominis
SKKSFGPG

SEQ ID NO: 2161604 - protein, 5 aa, Cryptosporidium hominis
SKKSI

SEQ ID NO: 2161605 - protein, 9 aa, Cryptosporidium hominis
SKKSISRHG

SEQ ID NO: 2161606 - protein, 16 aa, Cryptosporidium hominis
SKKSKEDFLNFALRMI

SEQ ID NO: 2161607 - protein, 18 aa, Cryptosporidium hominis
SKKSKTSQVDEKTSLPYG

SEQ ID NO: 2161608 - protein, 17 aa, Cryptosporidium hominis
SKKTQDYQGNTSPDKEM

SEQ ID NO: 2161609 - protein, 7 aa, Cryptosporidium hominis
SKKYNQT

SEQ ID NO: 2161610 - protein, 7 aa, Cryptosporidium hominis
SKKYPEA

SEQ ID NO: 2161611 - protein, 10 aa, Cryptosporidium hominis
SKKYSTYKDR

SEQ ID NO: 2161612 - protein, 10 aa, Cryptosporidium hominis
SKLDDPNTNK

SEQ ID NO: 2161613 - protein, 6 aa, Cryptosporidium hominis
SKLDET

SEQ ID NO: 2161614 - protein, 13 aa, Cryptosporidium hominis
SKLDNSKKKDNLK

SEQ ID NO: 2161615 - protein, 18 aa, Cryptosporidium hominis
SKLEDNNTRTLTDSTNRS

SEQ ID NO: 2161616 - protein, 26 aa, Cryptosporidium hominis
SKLEEKETNCYDSSNIHNNSEFEDND

SEQ ID NO: 2161617 - protein, 6 aa, Cryptosporidium hominis
SKLEES

SEQ ID NO: 2161618 - protein, 10 aa, Cryptosporidium hominis
SKLEKEGELE

SEQ ID NO: 2161619 - protein, 12 aa, Cryptosporidium hominis
SKLEQDDFDNEG

SEQ ID NO: 2161620 - protein, 10 aa, Cryptosporidium hominis
SKLGANATTA

SEQ ID NO: 2161621 - protein, 12 aa, Cryptosporidium hominis
SKLGDKDSREGI

SEQ ID NO: 2161622 - protein, 30 aa, Cryptosporidium hominis
SKLGSSSITVSSSTRPLTFPKSTNSDVDLT

SEQ ID NO: 2161623 - protein, 14 aa, Cryptosporidium hominis
SKLKEQNKSLENQL

SEQ ID NO: 2161624 - protein, 19 aa, Cryptosporidium hominis
SKLKKSKDAFMDQGEETKV

SEQ ID NO: 2161625 - protein, 18 aa, Cryptosporidium hominis
SKLKQTNERRAGRPPLDR

SEQ ID NO: 2161626 - protein, 16 aa, Cryptosporidium hominis
SKLNDESGKLSKSKKR

SEQ ID NO: 2161627 - protein, 7 aa, Cryptosporidium hominis
SKLPDSS

SEQ ID NO: 2161628 - protein, 48 aa, Cryptosporidium hominis
SKLPKANDSDSSSSSGSNSNSNSDSDSNSDSDSDSNSGSKPYSNYKPK

SEQ ID NO: 2161629 - protein, 5 aa, Cryptosporidium hominis
SKLPQ

SEQ ID NO: 2161630 - protein, 7 aa, Cryptosporidium hominis
SKLPRHS

SEQ ID NO: 2161631 - protein, 26 aa, Cryptosporidium hominis
SKLQEAIKDKGNSNIDNLGDDRFRDQ

SEQ ID NO: 2161632 - protein, 7 aa, Cryptosporidium hominis
SKLRSNY

SEQ ID NO: 2161633 - protein, 24 aa, Cryptosporidium hominis
SKLSSEVKLDEKTQESEVANTNSL

SEQ ID NO: 2161634 - protein, 24 aa, Cryptosporidium hominis
SKMADNSYEEAATKNCQYENRNSC

SEQ ID NO: 2161635 - protein, 7 aa, Cryptosporidium hominis
SKMNEKN

SEQ ID NO: 2161636 - protein, 5 aa, Cryptosporidium hominis
SKMQE

SEQ ID NO: 2161637 - protein, 7 aa, Cryptosporidium hominis
SKMSNSS

SEQ ID NO: 2161638 - protein, 15 aa, Cryptosporidium hominis
SKMTMKQKQRRKIRP

SEQ ID NO: 2161639 - protein, 7 aa, Cryptosporidium hominis
SKNEIPD

SEQ ID NO: 2161640 - protein, 33 aa, Cryptosporidium hominis
SKNEKKKNSCKKERKRSKSVDGYPKKKQSRGSF

SEQ ID NO: 2161641 - protein, 15 aa, Cryptosporidium hominis
SKNEQAGPKSQRGRE

SEQ ID NO: 2161642 - protein, 5 aa, Cryptosporidium hominis
SKNEY

SEQ ID NO: 2161643 - protein, 4 aa, Cryptosporidium hominis
SKNF

SEQ ID NO: 2161644 - protein, 7 aa, Cryptosporidium hominis
SKNFDGQ

SEQ ID NO: 2161645 - protein, 7 aa, Cryptosporidium hominis
SKNFPLE

SEQ ID NO: 2161646 - protein, 16 aa, Cryptosporidium hominis
SKNGDDNNSSNSSTFD

SEQ ID NO: 2161647 - protein, 9 aa, Cryptosporidium hominis
SKNGLSPAT

SEQ ID NO: 2161648 - protein, 34 aa, Cryptosporidium hominis
SKNGNSRPIGTTSKKIRTDTRKFDSDSTLSDLDG

SEQ ID NO: 2161649 - protein, 5 aa, Cryptosporidium hominis
SKNGT

SEQ ID NO: 2161650 - protein, 8 aa, Cryptosporidium hominis
SKNHPLEG

SEQ ID NO: 2161651 - protein, 9 aa, Cryptosporidium hominis
SKNHQVTDD

SEQ ID NO: 2161652 - protein, 44 aa, Cryptosporidium hominis
SKNIHPDDFNPNPKPPSNIETSKDQRDNFENTKKRKESKNIQVN

SEQ ID NO: 2161653 - protein, 8 aa, Cryptosporidium hominis
SKNIRSAS

SEQ ID NO: 2161654 - protein, 11 aa, Cryptosporidium hominis
SKNKDVLEGGP

SEQ ID NO: 2161655 - protein, 13 aa, Cryptosporidium hominis
SKNKISKFESEMS

SEQ ID NO: 2161656 - protein, 6 aa, Cryptosporidium hominis
SKNKLE

SEQ ID NO: 2161657 - protein, 8 aa, Cryptosporidium hominis
SKNKNQPE

SEQ ID NO: 2161658 - protein, 8 aa, Cryptosporidium hominis
SKNKNSIT

SEQ ID NO: 2161659 - protein, 6 aa, Cryptosporidium hominis
SKNKRL

SEQ ID NO: 2161660 - protein, 7 aa, Cryptosporidium hominis
SKNLNDD

SEQ ID NO: 2161661 - protein, 8 aa, Cryptosporidium hominis
SKNNEDKQ

SEQ ID NO: 2161662 - protein, 7 aa, Cryptosporidium hominis
SKNNESL

SEQ ID NO: 2161663 - protein, 12 aa, Cryptosporidium hominis
SKNNKESTELND

SEQ ID NO: 2161664 - protein, 6 aa, Cryptosporidium hominis
SKNNQI

SEQ ID NO: 2161665 - protein, 5 aa, Cryptosporidium hominis
SKNNW

SEQ ID NO: 2161666 - protein, 4 aa, Cryptosporidium hominis
SKNP

SEQ ID NO: 2161667 - protein, 6 aa, Cryptosporidium hominis
SKNPGL

SEQ ID NO: 2161668 - protein, 12 aa, Cryptosporidium hominis
SKNPRKPGEKSS

SEQ ID NO: 2161669 - protein, 6 aa, Cryptosporidium hominis
SKNPSE

SEQ ID NO: 2161670 - protein, 7 aa, Cryptosporidium hominis
SKNQDNI

SEQ ID NO: 2161671 - protein, 4 aa, Cryptosporidium hominis
SKNR

SEQ ID NO: 2161672 - protein, 10 aa, Cryptosporidium hominis
SKNRYSDYKP

SEQ ID NO: 2161673 - protein, 4 aa, Cryptosporidium hominis
SKNS

SEQ ID NO: 2161674 - protein, 15 aa, Cryptosporidium hominis
SKNSEIGSDDEEEEA

SEQ ID NO: 2161675 - protein, 5 aa, Cryptosporidium hominis
SKNSF

SEQ ID NO: 2161676 - protein, 10 aa, Cryptosporidium hominis
SKNSKSAITI

SEQ ID NO: 2161677 - protein, 5 aa, Cryptosporidium hominis
SKNSL

SEQ ID NO: 2161678 - protein, 12 aa, Cryptosporidium hominis
SKNSLGSIPKAP

SEQ ID NO: 2161679 - protein, 9 aa, Cryptosporidium hominis
SKNSQEIST

SEQ ID NO: 2161680 - protein, 10 aa, Cryptosporidium hominis
SKNSQFSQSQ

SEQ ID NO: 2161681 - protein, 7 aa, Cryptosporidium hominis
SKNSSGK

SEQ ID NO: 2161682 - protein, 8 aa, Cryptosporidium hominis
SKNSSNNN

SEQ ID NO: 2161683 - protein, 10 aa, Cryptosporidium hominis
SKNSTPEEIE

SEQ ID NO: 2161684 - protein, 4 aa, Cryptosporidium hominis
SKNT

SEQ ID NO: 2161685 - protein, 9 aa, Cryptosporidium hominis
SKNTEYTKD

SEQ ID NO: 2161686 - protein, 9 aa, Cryptosporidium hominis
SKNTSSIAT

SEQ ID NO: 2161687 - protein, 4 aa, Cryptosporidium hominis
SKNV

SEQ ID NO: 2161688 - protein, 15 aa, Cryptosporidium hominis
SKNVGPSISKTSSNL

SEQ ID NO: 2161689 - protein, 6 aa, Cryptosporidium hominis
SKNVPK

SEQ ID NO: 2161690 - protein, 7 aa, Cryptosporidium hominis
SKNVQAK

SEQ ID NO: 2161691 - protein, 4 aa, Cryptosporidium hominis
SKPA

SEQ ID NO: 2161692 - protein, 7 aa, Cryptosporidium hominis
SKPDDEI

SEQ ID NO: 2161693 - protein, 5 aa, Cryptosporidium hominis
SKPFS

SEQ ID NO: 2161694 - protein, 7 aa, Cryptosporidium hominis
SKPGKFE

SEQ ID NO: 2161695 - protein, 9 aa, Cryptosporidium hominis
SKPGKKNTY

SEQ ID NO: 2161696 - protein, 19 aa, Cryptosporidium hominis
SKPGPEDSDINSDEKYSDI

SEQ ID NO: 2161697 - protein, 23 aa, Cryptosporidium hominis
SKPIKNIDEKSPVFPTNRSTTSS

SEQ ID NO: 2161698 - protein, 14 aa, Cryptosporidium hominis
SKPITDKTELNEKE

SEQ ID NO: 2161699 - protein, 5 aa, Cryptosporidium hominis
SKPKL

SEQ ID NO: 2161700 - protein, 12 aa, Cryptosporidium hominis
SKPLENNEGLNK

SEQ ID NO: 2161701 - protein, 8 aa, Cryptosporidium hominis
SKPNNYER

SEQ ID NO: 2161702 - protein, 7 aa, Cryptosporidium hominis
SKPPFSY

SEQ ID NO: 2161703 - protein, 6 aa, Cryptosporidium hominis
SKPPKI

SEQ ID NO: 2161704 - protein, 6 aa, Cryptosporidium hominis
SKPPPV

SEQ ID NO: 2161705 - protein, 8 aa, Cryptosporidium hominis
SKPPSQHH

SEQ ID NO: 2161706 - protein, 9 aa, Cryptosporidium hominis
SKPQESKEN

SEQ ID NO: 2161707 - protein, 7 aa, Cryptosporidium hominis
SKPSENN

SEQ ID NO: 2161708 - protein, 5 aa, Cryptosporidium hominis
SKPSF

SEQ ID NO: 2161709 - protein, 13 aa, Cryptosporidium hominis
SKPSILGNKGQMV

SEQ ID NO: 2161710 - protein, 9 aa, Cryptosporidium hominis
SKPSIQESK

SEQ ID NO: 2161711 - protein, 10 aa, Cryptosporidium hominis
SKPTKSEDGN

SEQ ID NO: 2161712 - protein, 5 aa, Cryptosporidium hominis
SKPVE

SEQ ID NO: 2161713 - protein, 10 aa, Cryptosporidium hominis
SKPYSSSSPC

SEQ ID NO: 2161714 - protein, 5 aa, Cryptosporidium hominis
SKQDI

SEQ ID NO: 2161715 - protein, 10 aa, Cryptosporidium hominis
SKQDNSNGIA

SEQ ID NO: 2161716 - protein, 10 aa, Cryptosporidium hominis
SKQEDNEANT

SEQ ID NO: 2161717 - protein, 6 aa, Cryptosporidium hominis
SKQENM

SEQ ID NO: 2161718 - protein, 6 aa, Cryptosporidium hominis
SKQGRI

SEQ ID NO: 2161719 - protein, 7 aa, Cryptosporidium hominis
SKQGSIN

SEQ ID NO: 2161720 - protein, 8 aa, Cryptosporidium hominis
SKQGYNGL

SEQ ID NO: 2161721 - protein, 7 aa, Cryptosporidium hominis
SKQIKEK

SEQ ID NO: 2161722 - protein, 15 aa, Cryptosporidium hominis
SKQIKEKEIKKNRSI

SEQ ID NO: 2161723 - protein, 14 aa, Cryptosporidium hominis
SKQIKNDLRNEKSL

SEQ ID NO: 2161724 - protein, 14 aa, Cryptosporidium hominis
SKQKASNTKNRLEI

SEQ ID NO: 2161725 - protein, 7 aa, Cryptosporidium hominis
SKQKGTL

SEQ ID NO: 2161726 - protein, 8 aa, Cryptosporidium hominis
SKQKPKKI

SEQ ID NO: 2161727 - protein, 6 aa, Cryptosporidium hominis
SKQLSI

SEQ ID NO: 2161728 - protein, 4 aa, Cryptosporidium hominis
SKQN

SEQ ID NO: 2161729 - protein, 19 aa, Cryptosporidium hominis
SKQQTPEELASSRRGSESL

SEQ ID NO: 2161730 - protein, 9 aa, Cryptosporidium hominis
SKQRPVSSK

SEQ ID NO: 2161731 - protein, 9 aa, Cryptosporidium hominis
SKQRRLPQI

SEQ ID NO: 2161732 - protein, 8 aa, Cryptosporidium hominis
SKQRRNRE

SEQ ID NO: 2161733 - protein, 6 aa, Cryptosporidium hominis
SKQRVE

SEQ ID NO: 2161734 - protein, 10 aa, Cryptosporidium hominis
SKQSDQESGN

SEQ ID NO: 2161735 - protein, 6 aa, Cryptosporidium hominis
SKQSTA

SEQ ID NO: 2161736 - protein, 4 aa, Cryptosporidium hominis
SKQV

SEQ ID NO: 2161737 - protein, 9 aa, Cryptosporidium hominis
SKQYHESTK

SEQ ID NO: 2161738 - protein, 13 aa, Cryptosporidium hominis
SKRADEIRACLLG

SEQ ID NO: 2161739 - protein, 5 aa, Cryptosporidium hominis
SKRAY

SEQ ID NO: 2161740 - protein, 6 aa, Cryptosporidium hominis
SKRCSS

SEQ ID NO: 2161741 - protein, 7 aa, Cryptosporidium hominis
SKRDSQN

SEQ ID NO: 2161742 - protein, 4 aa, Cryptosporidium hominis
SKRE

SEQ ID NO: 2161743 - protein, 4 aa, Cryptosporidium hominis
SKRH

SEQ ID NO: 2161744 - protein, 9 aa, Cryptosporidium hominis
SKRINSQTS

SEQ ID NO: 2161745 - protein, 19 aa, Cryptosporidium hominis
SKRKPSGDSQEGSPDKRSK

SEQ ID NO: 2161746 - protein, 5 aa, Cryptosporidium hominis
SKRKR

SEQ ID NO: 2161747 - protein, 7 aa, Cryptosporidium hominis
SKRLDTL

SEQ ID NO: 2161748 - protein, 7 aa, Cryptosporidium hominis
SKRLSNG

SEQ ID NO: 2161749 - protein, 18 aa, Cryptosporidium hominis
SKRNKNQGNKGTKQDYGG

SEQ ID NO: 2161750 - protein, 8 aa, Cryptosporidium hominis
SKRNQVKD

SEQ ID NO: 2161751 - protein, 5 aa, Cryptosporidium hominis
SKRNS

SEQ ID NO: 2161752 - protein, 8 aa, Cryptosporidium hominis
SKRNTKIN

SEQ ID NO: 2161753 - protein, 5 aa, Cryptosporidium hominis
SKRPA

SEQ ID NO: 2161754 - protein, 10 aa, Cryptosporidium hominis
SKRPSTFSKA

SEQ ID NO: 2161755 - protein, 9 aa, Cryptosporidium hominis
SKRQKKNTF

SEQ ID NO: 2161756 - protein, 7 aa, Cryptosporidium hominis
SKRQRRV

SEQ ID NO: 2161757 - protein, 7 aa, Cryptosporidium hominis
SKRRGPV

SEQ ID NO: 2161758 - protein, 4 aa, Cryptosporidium hominis
SKRS

SEQ ID NO: 2161759 - protein, 11 aa, Cryptosporidium hominis
SKRSETSADGI

SEQ ID NO: 2161760 - protein, 7 aa, Cryptosporidium hominis
SKRSGNI

SEQ ID NO: 2161761 - protein, 9 aa, Cryptosporidium hominis
SKRSSINSM

SEQ ID NO: 2161762 - protein, 7 aa, Cryptosporidium hominis
SKRTDSE

SEQ ID NO: 2161763 - protein, 11 aa, Cryptosporidium hominis
SKRTELTEQQK

SEQ ID NO: 2161764 - protein, 9 aa, Cryptosporidium hominis
SKRVEGKKS

SEQ ID NO: 2161765 - protein, 8 aa, Cryptosporidium hominis
SKRYSRDC

SEQ ID NO: 2161766 - protein, 12 aa, Cryptosporidium hominis
SKSAKSESGFEP

SEQ ID NO: 2161767 - protein, 8 aa, Cryptosporidium hominis
SKSASSLN

SEQ ID NO: 2161768 - protein, 6 aa, Cryptosporidium hominis
SKSDGV

SEQ ID NO: 2161769 - protein, 23 aa, Cryptosporidium hominis
SKSDQLNNKRNSINCTSSTKKIS

SEQ ID NO: 2161770 - protein, 5 aa, Cryptosporidium hominis
SKSDR

SEQ ID NO: 2161771 - protein, 6 aa, Cryptosporidium hominis
SKSEAI

SEQ ID NO: 2161772 - protein, 5 aa, Cryptosporidium hominis
SKSEC

SEQ ID NO: 2161773 - protein, 7 aa, Cryptosporidium hominis
SKSEGED

SEQ ID NO: 2161774 - protein, 6 aa, Cryptosporidium hominis
SKSEHV

SEQ ID NO: 2161775 - protein, 6 aa, Cryptosporidium hominis
SKSEIE

SEQ ID NO: 2161776 - protein, 7 aa, Cryptosporidium hominis
SKSELEA

SEQ ID NO: 2161777 - protein, 8 aa, Cryptosporidium hominis
SKSETLKT

SEQ ID NO: 2161778 - protein, 10 aa, Cryptosporidium hominis
SKSGDNTPEN

SEQ ID NO: 2161779 - protein, 16 aa, Cryptosporidium hominis
SKSGEKNKESKNGANL

SEQ ID NO: 2161780 - protein, 6 aa, Cryptosporidium hominis
SKSGIQ

SEQ ID NO: 2161781 - protein, 8 aa, Cryptosporidium hominis
SKSGKEKV

SEQ ID NO: 2161782 - protein, 8 aa, Cryptosporidium hominis
SKSGKRVE

SEQ ID NO: 2161783 - protein, 35 aa, Cryptosporidium hominis
SKSGRKKSRKNSSNPSDGQTNESSSTFSSNNPFAS

SEQ ID NO: 2161784 - protein, 7 aa, Cryptosporidium hominis
SKSGSEI

SEQ ID NO: 2161785 - protein, 7 aa, Cryptosporidium hominis
SKSGTMD

SEQ ID NO: 2161786 - protein, 17 aa, Cryptosporidium hominis
SKSHSELDDAASELQET

SEQ ID NO: 2161787 - protein, 9 aa, Cryptosporidium hominis
SKSIQDDSN

SEQ ID NO: 2161788 - protein, 71 aa, Cryptosporidium hominis
SKSISSKSAISSLPKSKAKSAVKSAPATEENNGDQTISEPASISEVKSKAGSKSMPVSKSKSGIKAKSQVV

SEQ ID NO: 2161789 - protein, 13 aa, Cryptosporidium hominis
SKSITDPNLNSVS

SEQ ID NO: 2161790 - protein, 14 aa, Cryptosporidium hominis
SKSITKVKNESDSF

SEQ ID NO: 2161791 - protein, 15 aa, Cryptosporidium hominis
SKSKDGQFISFITDF

SEQ ID NO: 2161792 - protein, 8 aa, Cryptosporidium hominis
SKSKDLSV

SEQ ID NO: 2161793 - protein, 10 aa, Cryptosporidium hominis
SKSKEERDRI

SEQ ID NO: 2161794 - protein, 9 aa, Cryptosporidium hominis
SKSKEKGNN

SEQ ID NO: 2161795 - protein, 10 aa, Cryptosporidium hominis
SKSKIDAGYD

SEQ ID NO: 2161796 - protein, 6 aa, Cryptosporidium hominis
SKSKIK

SEQ ID NO: 2161797 - protein, 11 aa, Cryptosporidium hominis
SKSKNNENNSS

SEQ ID NO: 2161798 - protein, 7 aa, Cryptosporidium hominis
SKSKQKM

SEQ ID NO: 2161799 - protein, 11 aa, Cryptosporidium hominis
SKSKQQDKNNS

SEQ ID NO: 2161800 - protein, 16 aa, Cryptosporidium hominis
SKSLAEDDKLSGGGPK

SEQ ID NO: 2161801 - protein, 14 aa, Cryptosporidium hominis
SKSLRGQKGTNADL

SEQ ID NO: 2161802 - protein, 7 aa, Cryptosporidium hominis
SKSLTER

SEQ ID NO: 2161803 - protein, 15 aa, Cryptosporidium hominis
SKSMKNKIENNDKQK

SEQ ID NO: 2161804 - protein, 13 aa, Cryptosporidium hominis
SKSMKRSSSQITD

SEQ ID NO: 2161805 - protein, 4 aa, Cryptosporidium hominis
SKSN

SEQ ID NO: 2161806 - protein, 11 aa, Cryptosporidium hominis
SKSNDSENSGK

SEQ ID NO: 2161807 - protein, 12 aa, Cryptosporidium hominis
SKSNIDSEENRR

SEQ ID NO: 2161808 - protein, 6 aa, Cryptosporidium hominis
SKSNIP

SEQ ID NO: 2161809 - protein, 14 aa, Cryptosporidium hominis
SKSNLEENSSNCNN

SEQ ID NO: 2161810 - protein, 7 aa, Cryptosporidium hominis
SKSNLKP

SEQ ID NO: 2161811 - protein, 20 aa, Cryptosporidium hominis
SKSNNLSLNESTYEHASDLI

SEQ ID NO: 2161812 - protein, 7 aa, Cryptosporidium hominis
SKSNNYV

SEQ ID NO: 2161813 - protein, 6 aa, Cryptosporidium hominis
SKSNPN

SEQ ID NO: 2161814 - protein, 8 aa, Cryptosporidium hominis
SKSNTEVM

SEQ ID NO: 2161815 - protein, 6 aa, Cryptosporidium hominis
SKSNVR

SEQ ID NO: 2161816 - protein, 7 aa, Cryptosporidium hominis
SKSNYLE

SEQ ID NO: 2161817 - protein, 5 aa, Cryptosporidium hominis
SKSPF

SEQ ID NO: 2161818 - protein, 8 aa, Cryptosporidium hominis
SKSPKQGT

SEQ ID NO: 2161819 - protein, 8 aa, Cryptosporidium hominis
SKSPNKEF

SEQ ID NO: 2161820 - protein, 16 aa, Cryptosporidium hominis
SKSPVEIAGKPNLEVT

SEQ ID NO: 2161821 - protein, 8 aa, Cryptosporidium hominis
SKSQDEIP

SEQ ID NO: 2161822 - protein, 10 aa, Cryptosporidium hominis
SKSQDTASSA

SEQ ID NO: 2161823 - protein, 8 aa, Cryptosporidium hominis
SKSQKTNI

SEQ ID NO: 2161824 - protein, 8 aa, Cryptosporidium hominis
SKSRDEYG

SEQ ID NO: 2161825 - protein, 18 aa, Cryptosporidium hominis
SKSRDTETSLEENLSPSA

SEQ ID NO: 2161826 - protein, 49 aa, Cryptosporidium hominis
  misc_feature (27)..(27): Xaa can be any naturally occurring amino acid
  misc_feature (38)..(38): Xaa can be any naturally occurring amino acid
  misc_feature (49)..(49): Xaa can be any naturally occurring amino acid
SKSRTTDSKTNIEKNKDFNSKLYIDLXTFFVEGRTDIXRKVSQSDCILX

SEQ ID NO: 2161827 - protein, 15 aa, Cryptosporidium hominis
SKSSKYRDSIDKDDI

SEQ ID NO: 2161828 - protein, 6 aa, Cryptosporidium hominis
SKSSPY

SEQ ID NO: 2161829 - protein, 12 aa, Cryptosporidium hominis
SKSSSGIVSSQD

SEQ ID NO: 2161830 - protein, 10 aa, Cryptosporidium hominis
SKSSYEDSTS

SEQ ID NO: 2161831 - protein, 58 aa, Cryptosporidium hominis
SKSTGGSSFGGIGDGVAGTGTGTGIGTGIGNTNSSSTSNNTSTKKENIESSSSKPLES

SEQ ID NO: 2161832 - protein, 6 aa, Cryptosporidium hominis
SKSTGN

SEQ ID NO: 2161833 - protein, 10 aa, Cryptosporidium hominis
SKSTKNLKNP

SEQ ID NO: 2161834 - protein, 12 aa, Cryptosporidium hominis
SKSTSNKSNSRL

SEQ ID NO: 2161835 - protein, 22 aa, Cryptosporidium hominis
SKSTTKIENNTAINSNSSPSLN

SEQ ID NO: 2161836 - protein, 13 aa, Cryptosporidium hominis
SKSVTPLSSNHSE

SEQ ID NO: 2161837 - protein, 56 aa, Cryptosporidium hominis
SKSYTSSNNRDPEYSNDEYSYKDELESDESNDYSDNSSEQEDFSSRYSTNRVNTER

SEQ ID NO: 2161838 - protein, 6 aa, Cryptosporidium hominis
SKSYYD

SEQ ID NO: 2161839 - protein, 4 aa, Cryptosporidium hominis
SKTE

SEQ ID NO: 2161840 - protein, 13 aa, Cryptosporidium hominis
SKTEINELLEEKL

SEQ ID NO: 2161841 - protein, 8 aa, Cryptosporidium hominis
SKTESEDG

SEQ ID NO: 2161842 - protein, 4 aa, Cryptosporidium hominis
SKTF

SEQ ID NO: 2161843 - protein, 14 aa, Cryptosporidium hominis
SKTGKDVKSDKRAL

SEQ ID NO: 2161844 - protein, 20 aa, Cryptosporidium hominis
SKTGKLTEENISNNSGDTYI

SEQ ID NO: 2161845 - protein, 10 aa, Cryptosporidium hominis
SKTGLNKKKA

SEQ ID NO: 2161846 - protein, 9 aa, Cryptosporidium hominis
SKTGSQSFY

SEQ ID NO: 2161847 - protein, 7 aa, Cryptosporidium hominis
SKTITDK

SEQ ID NO: 2161848 - protein, 6 aa, Cryptosporidium hominis
SKTITQ

SEQ ID NO: 2161849 - protein, 9 aa, Cryptosporidium hominis
SKTKGKSFN

SEQ ID NO: 2161850 - protein, 8 aa, Cryptosporidium hominis
SKTNPDIQ

SEQ ID NO: 2161851 - protein, 15 aa, Cryptosporidium hominis
SKTNYLSAQNERDMS

SEQ ID NO: 2161852 - protein, 6 aa, Cryptosporidium hominis
SKTPKA

SEQ ID NO: 2161853 - protein, 10 aa, Cryptosporidium hominis
SKTQLNNGEI

SEQ ID NO: 2161854 - protein, 7 aa, Cryptosporidium hominis
SKTQSVS

SEQ ID NO: 2161855 - protein, 14 aa, Cryptosporidium hominis
SKTREGSFTSDTNL

SEQ ID NO: 2161856 - protein, 18 aa, Cryptosporidium hominis
SKTRKGSTNHSSNNLSGI

SEQ ID NO: 2161857 - protein, 8 aa, Cryptosporidium hominis
SKTSGNCG

SEQ ID NO: 2161858 - protein, 31 aa, Cryptosporidium hominis
SKTSKTKKKNKSITNSNSNINDTKTSPKEDF

SEQ ID NO: 2161859 - protein, 7 aa, Cryptosporidium hominis
SKTTGFI

SEQ ID NO: 2161860 - protein, 8 aa, Cryptosporidium hominis
SKTTPNNE

SEQ ID NO: 2161861 - protein, 11 aa, Cryptosporidium hominis
SKTTQNTIAGG

SEQ ID NO: 2161862 - protein, 31 aa, Cryptosporidium hominis
SKTYLSNDEKFKPPNLNDNTNKINSKTKHNR

SEQ ID NO: 2161863 - protein, 8 aa, Cryptosporidium hominis
SKTYSESS

SEQ ID NO: 2161864 - protein, 4 aa, Cryptosporidium hominis
SKVE

SEQ ID NO: 2161865 - protein, 6 aa, Cryptosporidium hominis
SKVEAE

SEQ ID NO: 2161866 - protein, 10 aa, Cryptosporidium hominis
SKVEKVQSDS

SEQ ID NO: 2161867 - protein, 7 aa, Cryptosporidium hominis
SKVENSI

SEQ ID NO: 2161868 - protein, 19 aa, Cryptosporidium hominis
SKVESNIDSNSNSNMGTEN

SEQ ID NO: 2161869 - protein, 4 aa, Cryptosporidium hominis
SKVG

SEQ ID NO: 2161870 - protein, 8 aa, Cryptosporidium hominis
SKVGRKGK

SEQ ID NO: 2161871 - protein, 8 aa, Cryptosporidium hominis
SKVNGNQI

SEQ ID NO: 2161872 - protein, 8 aa, Cryptosporidium hominis
SKVNQTPN

SEQ ID NO: 2161873 - protein, 6 aa, Cryptosporidium hominis
SKVSAG

SEQ ID NO: 2161874 - protein, 21 aa, Cryptosporidium hominis
SKVSERSHFEEQAKAEKTPNN

SEQ ID NO: 2161875 - protein, 6 aa, Cryptosporidium hominis
SKVSGK

SEQ ID NO: 2161876 - protein, 6 aa, Cryptosporidium hominis
SKWTKD

SEQ ID NO: 2161877 - protein, 6 aa, Cryptosporidium hominis
SKYEAQ

SEQ ID NO: 2161878 - protein, 10 aa, Cryptosporidium hominis
SKYEHKYPGA

SEQ ID NO: 2161879 - protein, 12 aa, Cryptosporidium hominis
SKYETCPSPRSG

SEQ ID NO: 2161880 - protein, 7 aa, Cryptosporidium hominis
SKYETGP

SEQ ID NO: 2161881 - protein, 6 aa, Cryptosporidium hominis
SKYGTL

SEQ ID NO: 2161882 - protein, 22 aa, Cryptosporidium hominis
SKYNKLEQDHEKLTDKYNEIDQ

SEQ ID NO: 2161883 - protein, 23 aa, Cryptosporidium hominis
SKYNRSAKDGNPYKPSVSTKNNV

SEQ ID NO: 2161884 - protein, 6 aa, Cryptosporidium hominis
SKYPSI

SEQ ID NO: 2161885 - protein, 4 aa, Cryptosporidium hominis
SKYS

SEQ ID NO: 2161886 - protein, 6 aa, Cryptosporidium hominis
SKYSAS

SEQ ID NO: 2161887 - protein, 8 aa, Cryptosporidium hominis
SKYSGDNN

SEQ ID NO: 2161888 - protein, 6 aa, Cryptosporidium hominis
SKYSNS

SEQ ID NO: 2161889 - protein, 7 aa, Cryptosporidium hominis
SKYTNSQ

SEQ ID NO: 2161890 - protein, 4 aa, Cryptosporidium hominis
SKYV

SEQ ID NO: 2161891 - protein, 33 aa, Cryptosporidium hominis
SLAGGAAGGVAGGVGGGAAGSLTGSGVAGGVTG

SEQ ID NO: 2161892 - protein, 11 aa, Cryptosporidium hominis
SLAKEESSKAP

SEQ ID NO: 2161893 - protein, 21 aa, Cryptosporidium hominis
SLAPKKPKPTNEDSLGSPVTA

SEQ ID NO: 2161894 - protein, 6 aa, Cryptosporidium hominis
SLAPST

SEQ ID NO: 2161895 - protein, 9 aa, Cryptosporidium hominis
SLASNSSSD

SEQ ID NO: 2161896 - protein, 9 aa, Cryptosporidium hominis
SLATNSGFD

SEQ ID NO: 2161897 - protein, 56 aa, Cryptosporidium hominis
SLATNTQQAPNNNEKLNNQNVSSTAKKLKKSEENKTKDIQESQDQVKNETKEEIKE

SEQ ID NO: 2161898 - protein, 6 aa, Cryptosporidium hominis
SLAYET

SEQ ID NO: 2161899 - protein, 7 aa, Cryptosporidium hominis
SLDAGSR

SEQ ID NO: 2161900 - protein, 11 aa, Cryptosporidium hominis
SLDDAKSTVSK

SEQ ID NO: 2161901 - protein, 13 aa, Cryptosporidium hominis
SLDDSSHENFGKY

SEQ ID NO: 2161902 - protein, 15 aa, Cryptosporidium hominis
SLDEDEEDEDDEDEL

SEQ ID NO: 2161903 - protein, 15 aa, Cryptosporidium hominis
SLDEITKSKSISSPN

SEQ ID NO: 2161904 - protein, 13 aa, Cryptosporidium hominis
SLDKDSTTNSCEP

SEQ ID NO: 2161905 - protein, 11 aa, Cryptosporidium hominis
SLDNDKEFGNN

SEQ ID NO: 2161906 - protein, 9 aa, Cryptosporidium hominis
SLDPENPEI

SEQ ID NO: 2161907 - protein, 23 aa, Cryptosporidium hominis
SLEDGRSIEEGSKYRNAKSKGVK

SEQ ID NO: 2161908 - protein, 6 aa, Cryptosporidium hominis
SLEEYQ

SEQ ID NO: 2161909 - protein, 4 aa, Cryptosporidium hominis
SLEG

SEQ ID NO: 2161910 - protein, 5 aa, Cryptosporidium hominis
SLEGS

SEQ ID NO: 2161911 - protein, 15 aa, Cryptosporidium hominis
SLEGSASNISTNRGY

SEQ ID NO: 2161912 - protein, 11 aa, Cryptosporidium hominis
SLEHSSKTAKR

SEQ ID NO: 2161913 - protein, 7 aa, Cryptosporidium hominis
SLEKKDS

SEQ ID NO: 2161914 - protein, 6 aa, Cryptosporidium hominis
SLENSS

SEQ ID NO: 2161915 - protein, 5 aa, Cryptosporidium hominis
SLEQN

SEQ ID NO: 2161916 - protein, 10 aa, Cryptosporidium hominis
SLEQSNDKRV

SEQ ID NO: 2161917 - protein, 24 aa, Cryptosporidium hominis
SLERKKKHRYRKPRRSRSPSTVSR

SEQ ID NO: 2161918 - protein, 20 aa, Cryptosporidium hominis
SLESNSLNATESFPNKESGI

SEQ ID NO: 2161919 - protein, 9 aa, Cryptosporidium hominis
SLETKEGEY

SEQ ID NO: 2161920 - protein, 4 aa, Cryptosporidium hominis
SLEY

SEQ ID NO: 2161921 - protein, 38 aa, Cryptosporidium hominis
SLEYGKSSKSSLKKHRSSSESSRSRSPQRKSSSKHVRK

SEQ ID NO: 2161922 - protein, 39 aa, Cryptosporidium hominis
SLFGGNASPGLFGSTGSSNSGFGNTGQSSVFGQSSNGLF

SEQ ID NO: 2161923 - protein, 5 aa, Cryptosporidium hominis
SLFPK

SEQ ID NO: 2161924 - protein, 12 aa, Cryptosporidium hominis
SLGATGNTTPIK

SEQ ID NO: 2161925 - protein, 7 aa, Cryptosporidium hominis
SLGDNSQ

SEQ ID NO: 2161926 - protein, 8 aa, Cryptosporidium hominis
SLGDSDGR

SEQ ID NO: 2161927 - protein, 8 aa, Cryptosporidium hominis
SLGGNSKA

SEQ ID NO: 2161928 - protein, 7 aa, Cryptosporidium hominis
SLGGNSR

SEQ ID NO: 2161929 - protein, 11 aa, Cryptosporidium hominis
SLGGRSPSQLT

SEQ ID NO: 2161930 - protein, 7 aa, Cryptosporidium hominis
SLGGRTK

SEQ ID NO: 2161931 - protein, 9 aa, Cryptosporidium hominis
SLGKDDYTA

SEQ ID NO: 2161932 - protein, 9 aa, Cryptosporidium hominis
SLGKGGNGE

SEQ ID NO: 2161933 - protein, 7 aa, Cryptosporidium hominis
SLGPQGL

SEQ ID NO: 2161934 - protein, 15 aa, Cryptosporidium hominis
SLGPSEQTPFSPEIE

SEQ ID NO: 2161935 - protein, 8 aa, Cryptosporidium hominis
SLGPYEDN

SEQ ID NO: 2161936 - protein, 23 aa, Cryptosporidium hominis
SLGRDYEGGGGGGGSSGGGSVED

SEQ ID NO: 2161937 - protein, 6 aa, Cryptosporidium hominis
SLGRGN

SEQ ID NO: 2161938 - protein, 11 aa, Cryptosporidium hominis
SLGRKFSETEV

SEQ ID NO: 2161939 - protein, 12 aa, Cryptosporidium hominis
SLGSKESEYSYE

SEQ ID NO: 2161940 - protein, 14 aa, Cryptosporidium hominis
SLGSYNNTNNGSGC

SEQ ID NO: 2161941 - protein, 7 aa, Cryptosporidium hominis
SLGTRNL

SEQ ID NO: 2161942 - protein, 13 aa, Cryptosporidium hominis
SLGTTEQNTTSDL

SEQ ID NO: 2161943 - protein, 4 aa, Cryptosporidium hominis
SLGY

SEQ ID NO: 2161944 - protein, 7 aa, Cryptosporidium hominis
SLHEGQS

SEQ ID NO: 2161945 - protein, 14 aa, Cryptosporidium hominis
SLIGDSGTQNRGGA

SEQ ID NO: 2161946 - protein, 5 aa, Cryptosporidium hominis
SLIKE

SEQ ID NO: 2161947 - protein, 26 aa, Cryptosporidium hominis
SLIPPKKDFSTPPIKKEADTSIQTKN

SEQ ID NO: 2161948 - protein, 5 aa, Cryptosporidium hominis
SLKDE

SEQ ID NO: 2161949 - protein, 11 aa, Cryptosporidium hominis
SLKDRNTPGYA

SEQ ID NO: 2161950 - protein, 7 aa, Cryptosporidium hominis
SLKEGSC

SEQ ID NO: 2161951 - protein, 9 aa, Cryptosporidium hominis
SLKGNHGKK

SEQ ID NO: 2161952 - protein, 6 aa, Cryptosporidium hominis
SLKGQN

SEQ ID NO: 2161953 - protein, 37 aa, Cryptosporidium hominis
SLKPGKQQEKAEKLRRKSQSKLGKLARRGEADRSIPT

SEQ ID NO: 2161954 - protein, 7 aa, Cryptosporidium hominis
SLKPLKT

SEQ ID NO: 2161955 - protein, 13 aa, Cryptosporidium hominis
SLKPTFAKIIESA

SEQ ID NO: 2161956 - protein, 5 aa, Cryptosporidium hominis
SLKTE

SEQ ID NO: 2161957 - protein, 9 aa, Cryptosporidium hominis
SLKTEDNLS

SEQ ID NO: 2161958 - protein, 9 aa, Cryptosporidium hominis
SLKTGRKSD

SEQ ID NO: 2161959 - protein, 4 aa, Cryptosporidium hominis
SLKV

SEQ ID NO: 2161960 - protein, 22 aa, Cryptosporidium hominis
SLLSKGKKTVNNVDRRASKGRK

SEQ ID NO: 2161961 - protein, 11 aa, Cryptosporidium hominis
SLNEDNDDNLE

SEQ ID NO: 2161962 - protein, 6 aa, Cryptosporidium hominis
SLNESE

SEQ ID NO: 2161963 - protein, 22 aa, Cryptosporidium hominis
SLNGDGTTFSISSNGSSYGSPQ

SEQ ID NO: 2161964 - protein, 38 aa, Cryptosporidium hominis
SLNITQPNENKDNFELKSKSDIQANSSGIVKASSKISD

SEQ ID NO: 2161965 - protein, 9 aa, Cryptosporidium hominis
SLNNSSGKQ

SEQ ID NO: 2161966 - protein, 8 aa, Cryptosporidium hominis
SLNPTTTL

SEQ ID NO: 2161967 - protein, 5 aa, Cryptosporidium hominis
SLNSI

SEQ ID NO: 2161968 - protein, 9 aa, Cryptosporidium hominis
SLNSLSSSL

SEQ ID NO: 2161969 - protein, 7 aa, Cryptosporidium hominis
SLNSNSV

SEQ ID NO: 2161970 - protein, 10 aa, Cryptosporidium hominis
SLNSSANNLK

SEQ ID NO: 2161971 - protein, 10 aa, Cryptosporidium hominis
SLNTENTNIS

SEQ ID NO: 2161972 - protein, 7 aa, Cryptosporidium hominis
SLNTPKE

SEQ ID NO: 2161973 - protein, 4 aa, Cryptosporidium hominis
SLPA

SEQ ID NO: 2161974 - protein, 11 aa, Cryptosporidium hominis
SLPAPPGSDPF

SEQ ID NO: 2161975 - protein, 5 aa, Cryptosporidium hominis
SLPDN

SEQ ID NO: 2161976 - protein, 6 aa, Cryptosporidium hominis
SLPDRQ

SEQ ID NO: 2161977 - protein, 5 aa, Cryptosporidium hominis
SLPDS

SEQ ID NO: 2161978 - protein, 8 aa, Cryptosporidium hominis
SLPEGNRA

SEQ ID NO: 2161979 - protein, 10 aa, Cryptosporidium hominis
SLPENSSTAL

SEQ ID NO: 2161980 - protein, 7 aa, Cryptosporidium hominis
SLPESTS

SEQ ID NO: 2161981 - protein, 5 aa, Cryptosporidium hominis
SLPEY

SEQ ID NO: 2161982 - protein, 11 aa, Cryptosporidium hominis
SLPGKCNNEEK

SEQ ID NO: 2161983 - protein, 5 aa, Cryptosporidium hominis
SLPGT

SEQ ID NO: 2161984 - protein, 7 aa, Cryptosporidium hominis
SLPIDPR

SEQ ID NO: 2161985 - protein, 17 aa, Cryptosporidium hominis
SLPKKTNSSDESLNEQR

SEQ ID NO: 2161986 - protein, 21 aa, Cryptosporidium hominis
SLPNVEENTVNPIEEENETVA

SEQ ID NO: 2161987 - protein, 6 aa, Cryptosporidium hominis
SLPPDL

SEQ ID NO: 2161988 - protein, 5 aa, Cryptosporidium hominis
SLPPN

SEQ ID NO: 2161989 - protein, 13 aa, Cryptosporidium hominis
SLPPNYSSSQPLY

SEQ ID NO: 2161990 - protein, 9 aa, Cryptosporidium hominis
SLPQDEADP

SEQ ID NO: 2161991 - protein, 10 aa, Cryptosporidium hominis
SLPREEESSI

SEQ ID NO: 2161992 - protein, 5 aa, Cryptosporidium hominis
SLPRF

SEQ ID NO: 2161993 - protein, 40 aa, Cryptosporidium hominis
SLPRQQSNPSSPSLPPPSLPPPPPQYSSYKSSNSSNNDSM

SEQ ID NO: 2161994 - protein, 7 aa, Cryptosporidium hominis
SLPSGAQ

SEQ ID NO: 2161995 - protein, 5 aa, Cryptosporidium hominis
SLPSH

SEQ ID NO: 2161996 - protein, 12 aa, Cryptosporidium hominis
SLPSPSSSISPL

SEQ ID NO: 2161997 - protein, 20 aa, Cryptosporidium hominis
SLPSRKDSTISKQPTRSGTV

SEQ ID NO: 2161998 - protein, 7 aa, Cryptosporidium hominis
SLPSSTI

SEQ ID NO: 2161999 - protein, 5 aa, Cryptosporidium hominis
SLPST

SEQ ID NO: 2162000 - protein, 12 aa, Cryptosporidium hominis
SLPSVADAESVR

SEQ ID NO: 2162001 - protein, 10 aa, Cryptosporidium hominis
SLPTPPKDYN

SEQ ID NO: 2162002 - protein, 17 aa, Cryptosporidium hominis
SLQANNNNYSASTYEDD

SEQ ID NO: 2162003 - protein, 5 aa, Cryptosporidium hominis
SLQDS

SEQ ID NO: 2162004 - protein, 12 aa, Cryptosporidium hominis
SLQEKSKRYTSV

SEQ ID NO: 2162005 - protein, 11 aa, Cryptosporidium hominis
SLQESSKRNKI

SEQ ID NO: 2162006 - protein, 19 aa, Cryptosporidium hominis
SLQGSNTVQQNDFTNNENI

SEQ ID NO: 2162007 - protein, 11 aa, Cryptosporidium hominis
SLQKKDQITPE

SEQ ID NO: 2162008 - protein, 7 aa, Cryptosporidium hominis
SLQKNET

SEQ ID NO: 2162009 - protein, 6 aa, Cryptosporidium hominis
SLQPGI

SEQ ID NO: 2162010 - protein, 11 aa, Cryptosporidium hominis
SLQPPTAYPST

SEQ ID NO: 2162011 - protein, 38 aa, Cryptosporidium hominis
SLQSSIKKKSSGTAENEHTYESNLEQDAEESARTQQQF

SEQ ID NO: 2162012 - protein, 7 aa, Cryptosporidium hominis
SLQTKRR

SEQ ID NO: 2162013 - protein, 11 aa, Cryptosporidium hominis
SLQTNGSEKVN

SEQ ID NO: 2162014 - protein, 11 aa, Cryptosporidium hominis
SLRRAEKNSEP

SEQ ID NO: 2162015 - protein, 25 aa, Cryptosporidium hominis
SLRRPDERRKLKRKEKKERKAEEKL

SEQ ID NO: 2162016 - protein, 8 aa, Cryptosporidium hominis
SLRSSEEG

SEQ ID NO: 2162017 - protein, 10 aa, Cryptosporidium hominis
SLSDDDENKT

SEQ ID NO: 2162018 - protein, 5 aa, Cryptosporidium hominis
SLSEE

SEQ ID NO: 2162019 - protein, 6 aa, Cryptosporidium hominis
SLSEKY

SEQ ID NO: 2162020 - protein, 4 aa, Cryptosporidium hominis
SLSG

SEQ ID NO: 2162021 - protein, 10 aa, Cryptosporidium hominis
SLSGGESSSI

SEQ ID NO: 2162022 - protein, 7 aa, Cryptosporidium hominis
SLSGNPD

SEQ ID NO: 2162023 - protein, 13 aa, Cryptosporidium hominis
SLSIESDDGSTIT

SEQ ID NO: 2162024 - protein, 10 aa, Cryptosporidium hominis
SLSKEIEEKE

SEQ ID NO: 2162025 - protein, 13 aa, Cryptosporidium hominis
SLSNASGGNSIAD

SEQ ID NO: 2162026 - protein, 8 aa, Cryptosporidium hominis
SLSNNDGI

SEQ ID NO: 2162027 - protein, 16 aa, Cryptosporidium hominis
SLSNSNTNTNNNNNNS

SEQ ID NO: 2162028 - protein, 27 aa, Cryptosporidium hominis
SLSNSNTTTCSEQSGPHSNKISAPESL

SEQ ID NO: 2162029 - protein, 15 aa, Cryptosporidium hominis
SLSNSSGGNSSKKEC

SEQ ID NO: 2162030 - protein, 6 aa, Cryptosporidium hominis
SLSNTV

SEQ ID NO: 2162031 - protein, 5 aa, Cryptosporidium hominis
SLSPK

SEQ ID NO: 2162032 - protein, 5 aa, Cryptosporidium hominis
SLSPR

SEQ ID NO: 2162033 - protein, 8 aa, Cryptosporidium hominis
SLSPSSYL

SEQ ID NO: 2162034 - protein, 7 aa, Cryptosporidium hominis
SLSPTSQ

SEQ ID NO: 2162035 - protein, 12 aa, Cryptosporidium hominis
SLSQSSGSFERE

SEQ ID NO: 2162036 - protein, 11 aa, Cryptosporidium hominis
SLSQVSSAPIP

SEQ ID NO: 2162037 - protein, 18 aa, Cryptosporidium hominis
SLSRRSSSLRKGSKSSGF

SEQ ID NO: 2162038 - protein, 5 aa, Cryptosporidium hominis
SLSRY

SEQ ID NO: 2162039 - protein, 6 aa, Cryptosporidium hominis
SLSSDE

SEQ ID NO: 2162040 - protein, 7 aa, Cryptosporidium hominis
SLSSEKK

SEQ ID NO: 2162041 - protein, 7 aa, Cryptosporidium hominis
SLSSENA

SEQ ID NO: 2162042 - protein, 8 aa, Cryptosporidium hominis
SLSSKETT

SEQ ID NO: 2162043 - protein, 9 aa, Cryptosporidium hominis
SLSSKKNIP

SEQ ID NO: 2162044 - protein, 5 aa, Cryptosporidium hominis
SLSSS

SEQ ID NO: 2162045 - protein, 27 aa, Cryptosporidium hominis
SLSSSIGANQEKRKENNERKSEKNNQS

SEQ ID NO: 2162046 - protein, 8 aa, Cryptosporidium hominis
SLSSSPPL

SEQ ID NO: 2162047 - protein, 21 aa, Cryptosporidium hominis
SLSSSSQISSNTNSNITTTSR

SEQ ID NO: 2162048 - protein, 31 aa, Cryptosporidium hominis
SLSSSSSSSTSSPASNSVLPGTSGIPTPSTV

SEQ ID NO: 2162049 - protein, 32 aa, Cryptosporidium hominis
SLSSTSSSSSSSSSSSSSSFSQSSQSSSYSSL

SEQ ID NO: 2162050 - protein, 10 aa, Cryptosporidium hominis
SLSSVPKSPM

SEQ ID NO: 2162051 - protein, 45 aa, Cryptosporidium hominis
SLSSYGSRKHFSEEPNSADSNSTSISSDENNNAVENKSKKTRERR

SEQ ID NO: 2162052 - protein, 7 aa, Cryptosporidium hominis
SLSTTTS

SEQ ID NO: 2162053 - protein, 5 aa, Cryptosporidium hominis
SLTEY

SEQ ID NO: 2162054 - protein, 7 aa, Cryptosporidium hominis
SLTKEKR

SEQ ID NO: 2162055 - protein, 8 aa, Cryptosporidium hominis
SLTNETEK

SEQ ID NO: 2162056 - protein, 7 aa, Cryptosporidium hominis
SLTNIPS

SEQ ID NO: 2162057 - protein, 17 aa, Cryptosporidium hominis
SLTNKGGISDVKTTVGG

SEQ ID NO: 2162058 - protein, 12 aa, Cryptosporidium hominis
SLTPFSASSNFD

SEQ ID NO: 2162059 - protein, 10 aa, Cryptosporidium hominis
SLTPGKDSAN

SEQ ID NO: 2162060 - protein, 7 aa, Cryptosporidium hominis
SLTSASS

SEQ ID NO: 2162061 - protein, 5 aa, Cryptosporidium hominis
SLTSN

SEQ ID NO: 2162062 - protein, 4 aa, Cryptosporidium hominis
SLTT

SEQ ID NO: 2162063 - protein, 10 aa, Cryptosporidium hominis
SLVSKKNQRA

SEQ ID NO: 2162064 - protein, 12 aa, Cryptosporidium hominis
SLYEGENKQKCS

SEQ ID NO: 2162065 - protein, 5 aa, Cryptosporidium hominis
SLYRA

SEQ ID NO: 2162066 - protein, 14 aa, Cryptosporidium hominis
SLYSSDGNTKTSNI

SEQ ID NO: 2162067 - protein, 10 aa, Cryptosporidium hominis
SMAPKASKSV

SEQ ID NO: 2162068 - protein, 10 aa, Cryptosporidium hominis
SMDESKQKQY

SEQ ID NO: 2162069 - protein, 7 aa, Cryptosporidium hominis
SMDGPKK

SEQ ID NO: 2162070 - protein, 6 aa, Cryptosporidium hominis
SMDSNG

SEQ ID NO: 2162071 - protein, 18 aa, Cryptosporidium hominis
SMEMGSENHSKEENEAKK

SEQ ID NO: 2162072 - protein, 4 aa, Cryptosporidium hominis
SMGG

SEQ ID NO: 2162073 - protein, 8 aa, Cryptosporidium hominis
SMGGSPAW

SEQ ID NO: 2162074 - protein, 15 aa, Cryptosporidium hominis
SMGGTQTFPPKDGNV

SEQ ID NO: 2162075 - protein, 5 aa, Cryptosporidium hominis
SMGKT

SEQ ID NO: 2162076 - protein, 25 aa, Cryptosporidium hominis
SMHPESKDDELKSGDDSKTKDLPTI

SEQ ID NO: 2162077 - protein, 21 aa, Cryptosporidium hominis
SMIEEKSSSVYNKKEGGRKLD

SEQ ID NO: 2162078 - protein, 27 aa, Cryptosporidium hominis
SMKNKKKREKRSLKNLEKSQAKNTNLN

SEQ ID NO: 2162079 - protein, 7 aa, Cryptosporidium hominis
SMNPTSS

SEQ ID NO: 2162080 - protein, 12 aa, Cryptosporidium hominis
SMNRENKELNDA

SEQ ID NO: 2162081 - protein, 10 aa, Cryptosporidium hominis
SMNRRSSDTF

SEQ ID NO: 2162082 - protein, 23 aa, Cryptosporidium hominis
SMNSNALSSYRSTGSGSMPTNRS

SEQ ID NO: 2162083 - protein, 9 aa, Cryptosporidium hominis
SMNTKTTKK

SEQ ID NO: 2162084 - protein, 4 aa, Cryptosporidium hominis
SMPN

SEQ ID NO: 2162085 - protein, 11 aa, Cryptosporidium hominis
SMPREKGHQNS

SEQ ID NO: 2162086 - protein, 13 aa, Cryptosporidium hominis
SMPRNPPSKESTL

SEQ ID NO: 2162087 - protein, 6 aa, Cryptosporidium hominis
SMQDDG

SEQ ID NO: 2162088 - protein, 20 aa, Cryptosporidium hominis
SMRRTTGFRDNSENGDLNSQ

SEQ ID NO: 2162089 - protein, 19 aa, Cryptosporidium hominis
SMRTAKQALTERKNEGLKK

SEQ ID NO: 2162090 - protein, 5 aa, Cryptosporidium hominis
SMSIT

SEQ ID NO: 2162091 - protein, 9 aa, Cryptosporidium hominis
SMSNDSLNS

SEQ ID NO: 2162092 - protein, 9 aa, Cryptosporidium hominis
SMTDSAQQA

SEQ ID NO: 2162093 - protein, 7 aa, Cryptosporidium hominis
SMTGGKT

SEQ ID NO: 2162094 - protein, 4 aa, Cryptosporidium hominis
SMTR

SEQ ID NO: 2162095 - protein, 12 aa, Cryptosporidium hominis
SMTSQSDNVTSI

SEQ ID NO: 2162096 - protein, 6 aa, Cryptosporidium hominis
SMTSSL

SEQ ID NO: 2162097 - protein, 22 aa, Cryptosporidium hominis
SMVESSTSKGLHTSKKMKPGRF

SEQ ID NO: 2162098 - protein, 9 aa, Cryptosporidium hominis
SNADNDPIE

SEQ ID NO: 2162099 - protein, 26 aa, Cryptosporidium hominis
SNADTKSQLQTEDKTGSSQSINNEDG

SEQ ID NO: 2162100 - protein, 6 aa, Cryptosporidium hominis
SNADVP

SEQ ID NO: 2162101 - protein, 16 aa, Cryptosporidium hominis
SNAESKKKTNYAHTSN

SEQ ID NO: 2162102 - protein, 5 aa, Cryptosporidium hominis
SNAKG

SEQ ID NO: 2162103 - protein, 7 aa, Cryptosporidium hominis
SNAKSQW

SEQ ID NO: 2162104 - protein, 7 aa, Cryptosporidium hominis
SNAKTYN

SEQ ID NO: 2162105 - protein, 15 aa, Cryptosporidium hominis
SNANEMPNIGRRGKK

SEQ ID NO: 2162106 - protein, 8 aa, Cryptosporidium hominis
SNANSSIN

SEQ ID NO: 2162107 - protein, 10 aa, Cryptosporidium hominis
SNAPSSSELQ

SEQ ID NO: 2162108 - protein, 4 aa, Cryptosporidium hominis
SNAR

SEQ ID NO: 2162109 - protein, 5 aa, Cryptosporidium hominis
SNASK

SEQ ID NO: 2162110 - protein, 7 aa, Cryptosporidium hominis
SNASPGS

SEQ ID NO: 2162111 - protein, 17 aa, Cryptosporidium hominis
SNAVPPQESHSGCNNCN

SEQ ID NO: 2162112 - protein, 7 aa, Cryptosporidium hominis
SNCGGSN

SEQ ID NO: 2162113 - protein, 5 aa, Cryptosporidium hominis
SNCQT

SEQ ID NO: 2162114 - protein, 4 aa, Cryptosporidium hominis
SNDA

SEQ ID NO: 2162115 - protein, 8 aa, Cryptosporidium hominis
SNDATSSS

SEQ ID NO: 2162116 - protein, 10 aa, Cryptosporidium hominis
SNDDGNNNNI

SEQ ID NO: 2162117 - protein, 5 aa, Cryptosporidium hominis
SNDDS

SEQ ID NO: 2162118 - protein, 12 aa, Cryptosporidium hominis
SNDDSSTIEKNS

SEQ ID NO: 2162119 - protein, 15 aa, Cryptosporidium hominis
SNDENSSNSEEETNL

SEQ ID NO: 2162120 - protein, 10 aa, Cryptosporidium hominis
SNDENYSAKT

SEQ ID NO: 2162121 - protein, 10 aa, Cryptosporidium hominis
SNDETHPELP

SEQ ID NO: 2162122 - protein, 5 aa, Cryptosporidium hominis
SNDGK

SEQ ID NO: 2162123 - protein, 15 aa, Cryptosporidium hominis
SNDGNDGNSKSRIGS

SEQ ID NO: 2162124 - protein, 8 aa, Cryptosporidium hominis
SNDHGSTI

SEQ ID NO: 2162125 - protein, 35 aa, Cryptosporidium hominis
SNDIENDDDQEDNESEELNQNSEGQKDTPTPVSTQ

SEQ ID NO: 2162126 - protein, 7 aa, Cryptosporidium hominis
SNDITYK

SEQ ID NO: 2162127 - protein, 11 aa, Cryptosporidium hominis
SNDKGKTGRKI

SEQ ID NO: 2162128 - protein, 8 aa, Cryptosporidium hominis
SNDMRSTN

SEQ ID NO: 2162129 - protein, 23 aa, Cryptosporidium hominis
SNDNLSKRESRWSKVSDGSTSRW

SEQ ID NO: 2162130 - protein, 5 aa, Cryptosporidium hominis
SNDNP

SEQ ID NO: 2162131 - protein, 4 aa, Cryptosporidium hominis
SNDP

SEQ ID NO: 2162132 - protein, 16 aa, Cryptosporidium hominis
SNDPDNPAQPDDQDVS

SEQ ID NO: 2162133 - protein, 35 aa, Cryptosporidium hominis
SNDPEHSENEHEQNHGHEYDQDLEDEGMHDNDGNI

SEQ ID NO: 2162134 - protein, 7 aa, Cryptosporidium hominis
SNDPIST

SEQ ID NO: 2162135 - protein, 8 aa, Cryptosporidium hominis
SNDPNKQV

SEQ ID NO: 2162136 - protein, 6 aa, Cryptosporidium hominis
SNDPTI

SEQ ID NO: 2162137 - protein, 13 aa, Cryptosporidium hominis
SNDQNTSTSQETL

SEQ ID NO: 2162138 - protein, 8 aa, Cryptosporidium hominis
SNDTENKM

SEQ ID NO: 2162139 - protein, 5 aa, Cryptosporidium hominis
SNDYR

SEQ ID NO: 2162140 - protein, 16 aa, Cryptosporidium hominis
SNEAITSKNKDCNTDN

SEQ ID NO: 2162141 - protein, 55 aa, Cryptosporidium hominis
SNEANGKRDDYNLSSNSNVESQTRRNKTNRFGAGKRKKKKIRFNSGTKNSFQENS

SEQ ID NO: 2162142 - protein, 4 aa, Cryptosporidium hominis
SNED

SEQ ID NO: 2162143 - protein, 9 aa, Cryptosporidium hominis
SNEDKSKIY

SEQ ID NO: 2162144 - protein, 11 aa, Cryptosporidium hominis
SNEDVESIQSP

SEQ ID NO: 2162145 - protein, 4 aa, Cryptosporidium hominis
SNEE

SEQ ID NO: 2162146 - protein, 12 aa, Cryptosporidium hominis
SNEEKKLNEEES

SEQ ID NO: 2162147 - protein, 8 aa, Cryptosporidium hominis
SNEEKKNV

SEQ ID NO: 2162148 - protein, 6 aa, Cryptosporidium hominis
SNEIES

SEQ ID NO: 2162149 - protein, 22 aa, Cryptosporidium hominis
SNEINDDVDGESDSSIENSASV

SEQ ID NO: 2162150 - protein, 5 aa, Cryptosporidium hominis
SNEIS

SEQ ID NO: 2162151 - protein, 12 aa, Cryptosporidium hominis
SNEISTSNSTRV

SEQ ID NO: 2162152 - protein, 4 aa, Cryptosporidium hominis
SNEK

SEQ ID NO: 2162153 - protein, 6 aa, Cryptosporidium hominis
SNEKFE

SEQ ID NO: 2162154 - protein, 23 aa, Cryptosporidium hominis
SNELAEDEEKDVELRQNSEERPT

SEQ ID NO: 2162155 - protein, 8 aa, Cryptosporidium hominis
SNENESLN

SEQ ID NO: 2162156 - protein, 6 aa, Cryptosporidium hominis
SNENFN

SEQ ID NO: 2162157 - protein, 5 aa, Cryptosporidium hominis
SNENG

SEQ ID NO: 2162158 - protein, 9 aa, Cryptosporidium hominis
SNENKNSIQ

SEQ ID NO: 2162159 - protein, 5 aa, Cryptosporidium hominis
SNENN

SEQ ID NO: 2162160 - protein, 6 aa, Cryptosporidium hominis
SNENVK

SEQ ID NO: 2162161 - protein, 4 aa, Cryptosporidium hominis
SNEP

SEQ ID NO: 2162162 - protein, 6 aa, Cryptosporidium hominis
SNEPET

SEQ ID NO: 2162163 - protein, 5 aa, Cryptosporidium hominis
SNERN

SEQ ID NO: 2162164 - protein, 6 aa, Cryptosporidium hominis
SNERYF

SEQ ID NO: 2162165 - protein, 4 aa, Cryptosporidium hominis
SNES

SEQ ID NO: 2162166 - protein, 5 aa, Cryptosporidium hominis
SNESA

SEQ ID NO: 2162167 - protein, 10 aa, Cryptosporidium hominis
SNESKGKSEK

SEQ ID NO: 2162168 - protein, 10 aa, Cryptosporidium hominis
SNESSSSISN

SEQ ID NO: 2162169 - protein, 8 aa, Cryptosporidium hominis
SNETDKRS

SEQ ID NO: 2162170 - protein, 6 aa, Cryptosporidium hominis
SNETDL

SEQ ID NO: 2162171 - protein, 9 aa, Cryptosporidium hominis
SNETEEIRT

SEQ ID NO: 2162172 - protein, 23 aa, Cryptosporidium hominis
SNETTSNCSNLDQNNNSQCTSAI

SEQ ID NO: 2162173 - protein, 8 aa, Cryptosporidium hominis
SNEYKETV

SEQ ID NO: 2162174 - protein, 6 aa, Cryptosporidium hominis
SNFAKD

SEQ ID NO: 2162175 - protein, 20 aa, Cryptosporidium hominis
SNFANKTSISASSNINPNNT

SEQ ID NO: 2162176 - protein, 7 aa, Cryptosporidium hominis
SNFEGSY

SEQ ID NO: 2162177 - protein, 12 aa, Cryptosporidium hominis
SNFENSEDLEET

SEQ ID NO: 2162178 - protein, 35 aa, Cryptosporidium hominis
SNFGQSSSSEPISSQESSSSSSSSTSKNSTENNGY

SEQ ID NO: 2162179 - protein, 10 aa, Cryptosporidium hominis
SNFKNSLESA

SEQ ID NO: 2162180 - protein, 7 aa, Cryptosporidium hominis
SNFKSQD

SEQ ID NO: 2162181 - protein, 4 aa, Cryptosporidium hominis
SNFQ

SEQ ID NO: 2162182 - protein, 32 aa, Cryptosporidium hominis
SNFREKGGTSVVSSRNSNKSQTVSSNTPGPAL

SEQ ID NO: 2162183 - protein, 4 aa, Cryptosporidium hominis
SNGA

SEQ ID NO: 2162184 - protein, 7 aa, Cryptosporidium hominis
SNGANHS

SEQ ID NO: 2162185 - protein, 5 aa, Cryptosporidium hominis
SNGCY

SEQ ID NO: 2162186 - protein, 7 aa, Cryptosporidium hominis
SNGDGQI

SEQ ID NO: 2162187 - protein, 8 aa, Cryptosporidium hominis
SNGEENKF

SEQ ID NO: 2162188 - protein, 7 aa, Cryptosporidium hominis
SNGEPVF

SEQ ID NO: 2162189 - protein, 25 aa, Cryptosporidium hominis
SNGFEDSNSNAETKEGTLQGSSKTV

SEQ ID NO: 2162190 - protein, 14 aa, Cryptosporidium hominis
SNGFKNEDKGGEAY

SEQ ID NO: 2162191 - protein, 11 aa, Cryptosporidium hominis
SNGFSANGGGV

SEQ ID NO: 2162192 - protein, 5 aa, Cryptosporidium hominis
SNGFT

SEQ ID NO: 2162193 - protein, 4 aa, Cryptosporidium hominis
SNGG

SEQ ID NO: 2162194 - protein, 8 aa, Cryptosporidium hominis
SNGGECPS

SEQ ID NO: 2162195 - protein, 7 aa, Cryptosporidium hominis
SNGGIGD

SEQ ID NO: 2162196 - protein, 11 aa, Cryptosporidium hominis
SNGGPTSSTGL

SEQ ID NO: 2162197 - protein, 9 aa, Cryptosporidium hominis
SNGIGDDEQ

SEQ ID NO: 2162198 - protein, 12 aa, Cryptosporidium hominis
SNGISAVPPDKY

SEQ ID NO: 2162199 - protein, 6 aa, Cryptosporidium hominis
SNGIYE

SEQ ID NO: 2162200 - protein, 10 aa, Cryptosporidium hominis
SNGKKRKVEK

SEQ ID NO: 2162201 - protein, 10 aa, Cryptosporidium hominis
SNGKSSSIDG

SEQ ID NO: 2162202 - protein, 17 aa, Cryptosporidium hominis
SNGKTIEVGNTDAEGRL

SEQ ID NO: 2162203 - protein, 4 aa, Cryptosporidium hominis
SNGL

SEQ ID NO: 2162204 - protein, 14 aa, Cryptosporidium hominis
SNGLESKNEYNGDN

SEQ ID NO: 2162205 - protein, 28 aa, Cryptosporidium hominis
SNGNAITSSTNITASTYGRYGGSNRING

SEQ ID NO: 2162206 - protein, 8 aa, Cryptosporidium hominis
SNGNDPPI

SEQ ID NO: 2162207 - protein, 10 aa, Cryptosporidium hominis
SNGPKRPSAA

SEQ ID NO: 2162208 - protein, 14 aa, Cryptosporidium hominis
SNGRNNSHKLTPIG

SEQ ID NO: 2162209 - protein, 15 aa, Cryptosporidium hominis
SNGSDINTGINKSQK

SEQ ID NO: 2162210 - protein, 7 aa, Cryptosporidium hominis
SNGSDLD

SEQ ID NO: 2162211 - protein, 13 aa, Cryptosporidium hominis
SNGSETVKTDGTY

SEQ ID NO: 2162212 - protein, 8 aa, Cryptosporidium hominis
SNGSITSR

SEQ ID NO: 2162213 - protein, 9 aa, Cryptosporidium hominis
SNGSKSFDN

SEQ ID NO: 2162214 - protein, 10 aa, Cryptosporidium hominis
SNGSKSSLRY

SEQ ID NO: 2162215 - protein, 19 aa, Cryptosporidium hominis
SNGSSSNLNSSSGTGSSRK

SEQ ID NO: 2162216 - protein, 16 aa, Cryptosporidium hominis
SNGTQSKNKEGDDSMR

SEQ ID NO: 2162217 - protein, 9 aa, Cryptosporidium hominis
SNGVRGSLV

SEQ ID NO: 2162218 - protein, 11 aa, Cryptosporidium hominis
SNGVSSKIEEK

SEQ ID NO: 2162219 - protein, 6 aa, Cryptosporidium hominis
SNGYRM

SEQ ID NO: 2162220 - protein, 8 aa, Cryptosporidium hominis
SNHGESLN

SEQ ID NO: 2162221 - protein, 12 aa, Cryptosporidium hominis
SNHNQGDDNSEY

SEQ ID NO: 2162222 - protein, 10 aa, Cryptosporidium hominis
SNHNSPNESR

SEQ ID NO: 2162223 - protein, 23 aa, Cryptosporidium hominis
SNHQPQHNRSNYGQRQQNYGGHQ

SEQ ID NO: 2162224 - protein, 11 aa, Cryptosporidium hominis
SNHTDSGKLSK

SEQ ID NO: 2162225 - protein, 22 aa, Cryptosporidium hominis
SNHYNEKDEDSSEAGTEKRSNA

SEQ ID NO: 2162226 - protein, 5 aa, Cryptosporidium hominis
SNIDD

SEQ ID NO: 2162227 - protein, 6 aa, Cryptosporidium hominis
SNIDRK

SEQ ID NO: 2162228 - protein, 15 aa, Cryptosporidium hominis
SNIDRSDDPITSGEE

SEQ ID NO: 2162229 - protein, 18 aa, Cryptosporidium hominis
SNIDSKVSKNNSFKSDEA

SEQ ID NO: 2162230 - protein, 5 aa, Cryptosporidium hominis
SNIED

SEQ ID NO: 2162231 - protein, 20 aa, Cryptosporidium hominis
SNIEQSHNNYNQEQPNSFES

SEQ ID NO: 2162232 - protein, 10 aa, Cryptosporidium hominis
SNIESETNTV

SEQ ID NO: 2162233 - protein, 13 aa, Cryptosporidium hominis
SNIGNGNSTTGLG

SEQ ID NO: 2162234 - protein, 4 aa, Cryptosporidium hominis
SNII

SEQ ID NO: 2162235 - protein, 12 aa, Cryptosporidium hominis
SNIKDESSNNIR

SEQ ID NO: 2162236 - protein, 10 aa, Cryptosporidium hominis
SNIKRENMNP

SEQ ID NO: 2162237 - protein, 10 aa, Cryptosporidium hominis
SNIMPPTTSK

SEQ ID NO: 2162238 - protein, 4 aa, Cryptosporidium hominis
SNIN

SEQ ID NO: 2162239 - protein, 5 aa, Cryptosporidium hominis
SNINI

SEQ ID NO: 2162240 - protein, 43 aa, Cryptosporidium hominis
SNINNSQFNQNNKLNQKSKGLKQVNSSKSNNKYASDSEDDPLA

SEQ ID NO: 2162241 - protein, 8 aa, Cryptosporidium hominis
SNINPTNK

SEQ ID NO: 2162242 - protein, 6 aa, Cryptosporidium hominis
SNINSE

SEQ ID NO: 2162243 - protein, 13 aa, Cryptosporidium hominis
SNINSKSKEIGID

SEQ ID NO: 2162244 - protein, 6 aa, Cryptosporidium hominis
SNINSQ

SEQ ID NO: 2162245 - protein, 4 aa, Cryptosporidium hominis
SNIP

SEQ ID NO: 2162246 - protein, 18 aa, Cryptosporidium hominis
SNIPEHREGPQSNQDNVG

SEQ ID NO: 2162247 - protein, 19 aa, Cryptosporidium hominis
SNIPRNKNIRSEACSSDEA

SEQ ID NO: 2162248 - protein, 12 aa, Cryptosporidium hominis
SNIPSNSHNQYS

SEQ ID NO: 2162249 - protein, 13 aa, Cryptosporidium hominis
SNIPTIPSSEVDL

SEQ ID NO: 2162250 - protein, 7 aa, Cryptosporidium hominis
SNIPTKN

SEQ ID NO: 2162251 - protein, 6 aa, Cryptosporidium hominis
SNIQEP

SEQ ID NO: 2162252 - protein, 7 aa, Cryptosporidium hominis
SNIRSPG

SEQ ID NO: 2162253 - protein, 7 aa, Cryptosporidium hominis
SNISENK

SEQ ID NO: 2162254 - protein, 6 aa, Cryptosporidium hominis
SNISGL

SEQ ID NO: 2162255 - protein, 7 aa, Cryptosporidium hominis
SNISGNV

SEQ ID NO: 2162256 - protein, 32 aa, Cryptosporidium hominis
SNISGQISENVKGKPQSGDYANDSEDQNASKI

SEQ ID NO: 2162257 - protein, 4 aa, Cryptosporidium hominis
SNIT

SEQ ID NO: 2162258 - protein, 7 aa, Cryptosporidium hominis
SNITDKK

SEQ ID NO: 2162259 - protein, 7 aa, Cryptosporidium hominis
SNITNES

SEQ ID NO: 2162260 - protein, 7 aa, Cryptosporidium hominis
SNKANFD

SEQ ID NO: 2162261 - protein, 9 aa, Cryptosporidium hominis
SNKAPSNLH

SEQ ID NO: 2162262 - protein, 7 aa, Cryptosporidium hominis
SNKASKY

SEQ ID NO: 2162263 - protein, 6 aa, Cryptosporidium hominis
SNKDEN

SEQ ID NO: 2162264 - protein, 7 aa, Cryptosporidium hominis
SNKDEYI

SEQ ID NO: 2162265 - protein, 5 aa, Cryptosporidium hominis
SNKDR

SEQ ID NO: 2162266 - protein, 6 aa, Cryptosporidium hominis
SNKDRE

SEQ ID NO: 2162267 - protein, 10 aa, Cryptosporidium hominis
SNKEGKKTNS

SEQ ID NO: 2162268 - protein, 5 aa, Cryptosporidium hominis
SNKER

SEQ ID NO: 2162269 - protein, 6 aa, Cryptosporidium hominis
SNKFEP

SEQ ID NO: 2162270 - protein, 22 aa, Cryptosporidium hominis
SNKFKENRFESKKDEAVSNTNL

SEQ ID NO: 2162271 - protein, 6 aa, Cryptosporidium hominis
SNKFSG

SEQ ID NO: 2162272 - protein, 6 aa, Cryptosporidium hominis
SNKGPS

SEQ ID NO: 2162273 - protein, 4 aa, Cryptosporidium hominis
SNKI

SEQ ID NO: 2162274 - protein, 8 aa, Cryptosporidium hominis
SNKIPNSV

SEQ ID NO: 2162275 - protein, 5 aa, Cryptosporidium hominis
SNKIS

SEQ ID NO: 2162276 - protein, 23 aa, Cryptosporidium hominis
SNKKGDSAQSMEGSSNNLQNGSR

SEQ ID NO: 2162277 - protein, 8 aa, Cryptosporidium hominis
SNKKNGDK

SEQ ID NO: 2162278 - protein, 15 aa, Cryptosporidium hominis
SNKKYPNKSSTPFDN

SEQ ID NO: 2162279 - protein, 7 aa, Cryptosporidium hominis
SNKLDTS

SEQ ID NO: 2162280 - protein, 5 aa, Cryptosporidium hominis
SNKND

SEQ ID NO: 2162281 - protein, 15 aa, Cryptosporidium hominis
SNKNESSNHENQKRT

SEQ ID NO: 2162282 - protein, 15 aa, Cryptosporidium hominis
SNKNETSSTKDIGNY

SEQ ID NO: 2162283 - protein, 8 aa, Cryptosporidium hominis
SNKPDSQW

SEQ ID NO: 2162284 - protein, 10 aa, Cryptosporidium hominis
SNKPKNIKEE

SEQ ID NO: 2162285 - protein, 18 aa, Cryptosporidium hominis
SNKQQESSSSDLDKDDER

SEQ ID NO: 2162286 - protein, 7 aa, Cryptosporidium hominis
SNKRANI

SEQ ID NO: 2162287 - protein, 10 aa, Cryptosporidium hominis
SNKSDAMEQG

SEQ ID NO: 2162288 - protein, 102 aa, Cryptosporidium hominis
SNKSDSKNETSMNGVNSSISSNMQEEKNLNKTSNQSLEHTTKKSAKRSQETKENNSNEIKETLKDQTRSDESKSIRKLSQNEEFERSCEQENANNSMKGGNQ

SEQ ID NO: 2162289 - protein, 6 aa, Cryptosporidium hominis
SNKSHP

SEQ ID NO: 2162290 - protein, 9 aa, Cryptosporidium hominis
SNKSKETLV

SEQ ID NO: 2162291 - protein, 13 aa, Cryptosporidium hominis
SNKSNQDASEAFT

SEQ ID NO: 2162292 - protein, 9 aa, Cryptosporidium hominis
SNKSSNSDK

SEQ ID NO: 2162293 - protein, 9 aa, Cryptosporidium hominis
SNKTDGDAT

SEQ ID NO: 2162294 - protein, 8 aa, Cryptosporidium hominis
SNKTQITP

SEQ ID NO: 2162295 - protein, 12 aa, Cryptosporidium hominis
SNKTRKARENDI

SEQ ID NO: 2162296 - protein, 12 aa, Cryptosporidium hominis
SNKWPKTKESIE

SEQ ID NO: 2162297 - protein, 59 aa, Cryptosporidium hominis
SNLANDKSKVPDGTKGNNGPNNQAAETGSNYHQRRRASRQINTGGGGGFGGRENEKFTH

SEQ ID NO: 2162298 - protein, 8 aa, Cryptosporidium hominis
SNLDPNNY

SEQ ID NO: 2162299 - protein, 6 aa, Cryptosporidium hominis
SNLDQN

SEQ ID NO: 2162300 - protein, 13 aa, Cryptosporidium hominis
SNLDRKKKNCDTI

SEQ ID NO: 2162301 - protein, 31 aa, Cryptosporidium hominis
SNLDSERDSNRASTFNHTGTSSNISGTTLTT

SEQ ID NO: 2162302 - protein, 9 aa, Cryptosporidium hominis
SNLDTNEHG

SEQ ID NO: 2162303 - protein, 4 aa, Cryptosporidium hominis
SNLE

SEQ ID NO: 2162304 - protein, 21 aa, Cryptosporidium hominis
SNLEERERVKNEGGTFDDEGY

SEQ ID NO: 2162305 - protein, 12 aa, Cryptosporidium hominis
SNLEGDQRETGD

SEQ ID NO: 2162306 - protein, 12 aa, Cryptosporidium hominis
SNLENVSSSNIN

SEQ ID NO: 2162307 - protein, 20 aa, Cryptosporidium hominis
SNLKGKDKIGNAAFNKGNSQ

SEQ ID NO: 2162308 - protein, 4 aa, Cryptosporidium hominis
SNLN

SEQ ID NO: 2162309 - protein, 9 aa, Cryptosporidium hominis
SNLNEKSQN

SEQ ID NO: 2162310 - protein, 32 aa, Cryptosporidium hominis
SNLNKKNKKIKSGYDEMNDEENDTNDNMESEH

SEQ ID NO: 2162311 - protein, 6 aa, Cryptosporidium hominis
SNLNKN

SEQ ID NO: 2162312 - protein, 6 aa, Cryptosporidium hominis
SNLNKS

SEQ ID NO: 2162313 - protein, 9 aa, Cryptosporidium hominis
SNLNPNPNN

SEQ ID NO: 2162314 - protein, 8 aa, Cryptosporidium hominis
SNLNPSDI

SEQ ID NO: 2162315 - protein, 13 aa, Cryptosporidium hominis
SNLNSGTRGLEGI

SEQ ID NO: 2162316 - protein, 21 aa, Cryptosporidium hominis
SNLNYNDSNGGHLNNSKQLNN

SEQ ID NO: 2162317 - protein, 8 aa, Cryptosporidium hominis
SNLPKPVS

SEQ ID NO: 2162318 - protein, 7 aa, Cryptosporidium hominis
SNLPTKK

SEQ ID NO: 2162319 - protein, 16 aa, Cryptosporidium hominis
SNLQDKSKKSNDESTN

SEQ ID NO: 2162320 - protein, 6 aa, Cryptosporidium hominis
SNLQNT

SEQ ID NO: 2162321 - protein, 14 aa, Cryptosporidium hominis
SNLQSNNGNSASRA

SEQ ID NO: 2162322 - protein, 46 aa, Cryptosporidium hominis
SNLSDTNSTISNSSISNSNLNDSTVSISNDNDNSTLKSSPYYNNKA

SEQ ID NO: 2162323 - protein, 15 aa, Cryptosporidium hominis
SNLSKQNIKSERDNV

SEQ ID NO: 2162324 - protein, 20 aa, Cryptosporidium hominis
SNLSKSNENSITQNKRNNIY

SEQ ID NO: 2162325 - protein, 8 aa, Cryptosporidium hominis
SNLSPGEY

SEQ ID NO: 2162326 - protein, 6 aa, Cryptosporidium hominis
SNLSSR

SEQ ID NO: 2162327 - protein, 9 aa, Cryptosporidium hominis
SNLSTTQNE

SEQ ID NO: 2162328 - protein, 9 aa, Cryptosporidium hominis
SNLTTESGL

SEQ ID NO: 2162329 - protein, 5 aa, Cryptosporidium hominis
SNMAG

SEQ ID NO: 2162330 - protein, 13 aa, Cryptosporidium hominis
SNMAREADHRDSE

SEQ ID NO: 2162331 - protein, 8 aa, Cryptosporidium hominis
SNMDEKPE

SEQ ID NO: 2162332 - protein, 12 aa, Cryptosporidium hominis
SNMENLNSRQDC

SEQ ID NO: 2162333 - protein, 4 aa, Cryptosporidium hominis
SNMG

SEQ ID NO: 2162334 - protein, 7 aa, Cryptosporidium hominis
SNMNENS

SEQ ID NO: 2162335 - protein, 15 aa, Cryptosporidium hominis
SNMNNRRNNNNNTNY

SEQ ID NO: 2162336 - protein, 43 aa, Cryptosporidium hominis
SNMNQQNQQQQQQQQQQQQQQKQQQQQQQQQQQQQQQQQQQQL

SEQ ID NO: 2162337 - protein, 5 aa, Cryptosporidium hominis
SNMPV

SEQ ID NO: 2162338 - protein, 4 aa, Cryptosporidium hominis
SNMS

SEQ ID NO: 2162339 - protein, 21 aa, Cryptosporidium hominis
SNMSNKQQKQLKQRNGVSPNL

SEQ ID NO: 2162340 - protein, 11 aa, Cryptosporidium hominis
SNMSSNSNSNL

SEQ ID NO: 2162341 - protein, 18 aa, Cryptosporidium hominis
SNMTKNEIKKNSHQNTEQ

SEQ ID NO: 2162342 - protein, 9 aa, Cryptosporidium hominis
SNNAGITNS

SEQ ID NO: 2162343 - protein, 30 aa, Cryptosporidium hominis
SNNDGQSYYQNGYDQQNYEYQTEMNNDSTN

SEQ ID NO: 2162344 - protein, 24 aa, Cryptosporidium hominis
SNNDIEQESISSKNTNYSSISNND

SEQ ID NO: 2162345 - protein, 5 aa, Cryptosporidium hominis
SNNDY

SEQ ID NO: 2162346 - protein, 4 aa, Cryptosporidium hominis
SNNE

SEQ ID NO: 2162347 - protein, 5 aa, Cryptosporidium hominis
SNNED

SEQ ID NO: 2162348 - protein, 5 aa, Cryptosporidium hominis
SNNEL

SEQ ID NO: 2162349 - protein, 5 aa, Cryptosporidium hominis
SNNEQ

SEQ ID NO: 2162350 - protein, 8 aa, Cryptosporidium hominis
SNNGTSKH

SEQ ID NO: 2162351 - protein, 14 aa, Cryptosporidium hominis
SNNHQTKISQETEQ

SEQ ID NO: 2162352 - protein, 7 aa, Cryptosporidium hominis
SNNISAE

SEQ ID NO: 2162353 - protein, 8 aa, Cryptosporidium hominis
SNNKQYNS

SEQ ID NO: 2162354 - protein, 9 aa, Cryptosporidium hominis
SNNKSFGDN

SEQ ID NO: 2162355 - protein, 6 aa, Cryptosporidium hominis
SNNLER

SEQ ID NO: 2162356 - protein, 11 aa, Cryptosporidium hominis
SNNLNDQETFN

SEQ ID NO: 2162357 - protein, 12 aa, Cryptosporidium hominis
SNNLQKAGNGCP

SEQ ID NO: 2162358 - protein, 12 aa, Cryptosporidium hominis
SNNMNSSATNSN

SEQ ID NO: 2162359 - protein, 8 aa, Cryptosporidium hominis
SNNMTDSD

SEQ ID NO: 2162360 - protein, 9 aa, Cryptosporidium hominis
SNNNASNRH

SEQ ID NO: 2162361 - protein, 14 aa, Cryptosporidium hominis
SNNNDIKSGVRYFR

SEQ ID NO: 2162362 - protein, 10 aa, Cryptosporidium hominis
SNNNDKKQNN

SEQ ID NO: 2162363 - protein, 5 aa, Cryptosporidium hominis
SNNNF

SEQ ID NO: 2162364 - protein, 9 aa, Cryptosporidium hominis
SNNNNNNIH

SEQ ID NO: 2162365 - protein, 21 aa, Cryptosporidium hominis
SNNNRGNKSQNMSNRDSSPDF

SEQ ID NO: 2162366 - protein, 19 aa, Cryptosporidium hominis
SNNNSIKELQDQNSNNKKY

SEQ ID NO: 2162367 - protein, 7 aa, Cryptosporidium hominis
SNNNSLK

SEQ ID NO: 2162368 - protein, 4 aa, Cryptosporidium hominis
SNNP

SEQ ID NO: 2162369 - protein, 8 aa, Cryptosporidium hominis
SNNPDEVI

SEQ ID NO: 2162370 - protein, 9 aa, Cryptosporidium hominis
SNNPDSTKR

SEQ ID NO: 2162371 - protein, 5 aa, Cryptosporidium hominis
SNNQD

SEQ ID NO: 2162372 - protein, 6 aa, Cryptosporidium hominis
SNNQKN

SEQ ID NO: 2162373 - protein, 7 aa, Cryptosporidium hominis
SNNRKSR

SEQ ID NO: 2162374 - protein, 9 aa, Cryptosporidium hominis
SNNRTNRIG

SEQ ID NO: 2162375 - protein, 6 aa, Cryptosporidium hominis
SNNSEI

SEQ ID NO: 2162376 - protein, 61 aa, Cryptosporidium hominis
SNNSGNGSQNHHYKGGEGGGLQGNQQEGGSISQGLRSRRVKSSNANCNNENNNKEDGSMQQ

SEQ ID NO: 2162377 - protein, 5 aa, Cryptosporidium hominis
SNNSH

SEQ ID NO: 2162378 - protein, 7 aa, Cryptosporidium hominis
SNNSIEP

SEQ ID NO: 2162379 - protein, 9 aa, Cryptosporidium hominis
SNNSNYEPS

SEQ ID NO: 2162380 - protein, 8 aa, Cryptosporidium hominis
SNNSTGNY

SEQ ID NO: 2162381 - protein, 6 aa, Cryptosporidium hominis
SNNTAF

SEQ ID NO: 2162382 - protein, 5 aa, Cryptosporidium hominis
SNNTD

SEQ ID NO: 2162383 - protein, 6 aa, Cryptosporidium hominis
SNNTEN

SEQ ID NO: 2162384 - protein, 23 aa, Cryptosporidium hominis
SNNTGIKNEKQALSYNQNQTKRR

SEQ ID NO: 2162385 - protein, 14 aa, Cryptosporidium hominis
SNNTGISNSNNQTI

SEQ ID NO: 2162386 - protein, 11 aa, Cryptosporidium hominis
SNNTSKNMSSK

SEQ ID NO: 2162387 - protein, 33 aa, Cryptosporidium hominis
SNNTSTSSTCTSNSNSTTTTTTTSGSLSGTVSR

SEQ ID NO: 2162388 - protein, 23 aa, Cryptosporidium hominis
SNNVLTSKQDQDEYGNSSNQGFN

SEQ ID NO: 2162389 - protein, 4 aa, Cryptosporidium hominis
SNNY

SEQ ID NO: 2162390 - protein, 23 aa, Cryptosporidium hominis
SNNYDKNKEHERIRSKTTPYKNN

SEQ ID NO: 2162391 - protein, 12 aa, Cryptosporidium hominis
SNNYTEKTKTQT

SEQ ID NO: 2162392 - protein, 9 aa, Cryptosporidium hominis
SNPADVAPF

SEQ ID NO: 2162393 - protein, 14 aa, Cryptosporidium hominis
SNPCQNPNMNSSTY

SEQ ID NO: 2162394 - protein, 6 aa, Cryptosporidium hominis
SNPCSP

SEQ ID NO: 2162395 - protein, 4 aa, Cryptosporidium hominis
SNPD

SEQ ID NO: 2162396 - protein, 8 aa, Cryptosporidium hominis
SNPDKTQM

SEQ ID NO: 2162397 - protein, 4 aa, Cryptosporidium hominis
SNPE

SEQ ID NO: 2162398 - protein, 11 aa, Cryptosporidium hominis
SNPGDITKPSD

SEQ ID NO: 2162399 - protein, 7 aa, Cryptosporidium hominis
SNPIDSE

SEQ ID NO: 2162400 - protein, 4 aa, Cryptosporidium hominis
SNPK

SEQ ID NO: 2162401 - protein, 10 aa, Cryptosporidium hominis
SNPKKISENN

SEQ ID NO: 2162402 - protein, 5 aa, Cryptosporidium hominis
SNPLD

SEQ ID NO: 2162403 - protein, 5 aa, Cryptosporidium hominis
SNPLG

SEQ ID NO: 2162404 - protein, 12 aa, Cryptosporidium hominis
SNPMEGATQTTK

SEQ ID NO: 2162405 - protein, 22 aa, Cryptosporidium hominis
SNPNADSNADVSYNSKLQPRKD

SEQ ID NO: 2162406 - protein, 10 aa, Cryptosporidium hominis
SNPNSGSSFE

SEQ ID NO: 2162407 - protein, 5 aa, Cryptosporidium hominis
SNPPA

SEQ ID NO: 2162408 - protein, 6 aa, Cryptosporidium hominis
SNPPIF

SEQ ID NO: 2162409 - protein, 5 aa, Cryptosporidium hominis
SNPQI

SEQ ID NO: 2162410 - protein, 8 aa, Cryptosporidium hominis
SNPRRRSY

SEQ ID NO: 2162411 - protein, 7 aa, Cryptosporidium hominis
SNPSDYD

SEQ ID NO: 2162412 - protein, 6 aa, Cryptosporidium hominis
SNPTAG

SEQ ID NO: 2162413 - protein, 5 aa, Cryptosporidium hominis
SNPTI

SEQ ID NO: 2162414 - protein, 31 aa, Cryptosporidium hominis
SNPTNKSTENPVGGTAEHDFDPNSMPNGQIS

SEQ ID NO: 2162415 - protein, 8 aa, Cryptosporidium hominis
SNPVTKPV

SEQ ID NO: 2162416 - protein, 10 aa, Cryptosporidium hominis
SNPYSNKTEK

SEQ ID NO: 2162417 - protein, 9 aa, Cryptosporidium hominis
SNQADDTNV

SEQ ID NO: 2162418 - protein, 25 aa, Cryptosporidium hominis
SNQAGNNSPMSLEDPDEPSPSPINP

SEQ ID NO: 2162419 - protein, 9 aa, Cryptosporidium hominis
SNQARSGDI

SEQ ID NO: 2162420 - protein, 8 aa, Cryptosporidium hominis
SNQATSQY

SEQ ID NO: 2162421 - protein, 5 aa, Cryptosporidium hominis
SNQDY

SEQ ID NO: 2162422 - protein, 17 aa, Cryptosporidium hominis
SNQEDLKKNQGVQTRSM

SEQ ID NO: 2162423 - protein, 7 aa, Cryptosporidium hominis
SNQGRGV

SEQ ID NO: 2162424 - protein, 9 aa, Cryptosporidium hominis
SNQIGNRKS

SEQ ID NO: 2162425 - protein, 12 aa, Cryptosporidium hominis
SNQISNKKVNET

SEQ ID NO: 2162426 - protein, 9 aa, Cryptosporidium hominis
SNQKTFTPI

SEQ ID NO: 2162427 - protein, 56 aa, Cryptosporidium hominis
SNQLDSDKKKKKKRKSHESIQNEQDEGDQQEQMRDNDESSEKKKKKKRKSSGKGDD

SEQ ID NO: 2162428 - protein, 26 aa, Cryptosporidium hominis
SNQLGSETANSSLKNKHNLENQAERA

SEQ ID NO: 2162429 - protein, 9 aa, Cryptosporidium hominis
SNQNEGSSQ

SEQ ID NO: 2162430 - protein, 13 aa, Cryptosporidium hominis
SNQNNKEKDDNEN

SEQ ID NO: 2162431 - protein, 9 aa, Cryptosporidium hominis
SNQNPGNEL

SEQ ID NO: 2162432 - protein, 6 aa, Cryptosporidium hominis
SNQNTN

SEQ ID NO: 2162433 - protein, 7 aa, Cryptosporidium hominis
SNQPNQI

SEQ ID NO: 2162434 - protein, 17 aa, Cryptosporidium hominis
SNQRKSLSDQYDQQIDN

SEQ ID NO: 2162435 - protein, 8 aa, Cryptosporidium hominis
SNQSEESM

SEQ ID NO: 2162436 - protein, 12 aa, Cryptosporidium hominis
SNQSKLKKVQNS

SEQ ID NO: 2162437 - protein, 30 aa, Cryptosporidium hominis
SNQSPTSTSSSSSSVSSPSAISTSCQNSSS

SEQ ID NO: 2162438 - protein, 5 aa, Cryptosporidium hominis
SNQSS

SEQ ID NO: 2162439 - protein, 35 aa, Cryptosporidium hominis
SNQTQETEISNQSGIVTSTGSLENLEKTQETKDIT

SEQ ID NO: 2162440 - protein, 4 aa, Cryptosporidium hominis
SNRA

SEQ ID NO: 2162441 - protein, 6 aa, Cryptosporidium hominis
SNRDDT

SEQ ID NO: 2162442 - protein, 8 aa, Cryptosporidium hominis
SNRDGRNL

SEQ ID NO: 2162443 - protein, 17 aa, Cryptosporidium hominis
SNRDSRKRKLISRQLKK

SEQ ID NO: 2162444 - protein, 11 aa, Cryptosporidium hominis
SNREGMQATSG

SEQ ID NO: 2162445 - protein, 8 aa, Cryptosporidium hominis
SNREMENT

SEQ ID NO: 2162446 - protein, 8 aa, Cryptosporidium hominis
SNRINGNY

SEQ ID NO: 2162447 - protein, 9 aa, Cryptosporidium hominis
SNRKEEVNP

SEQ ID NO: 2162448 - protein, 9 aa, Cryptosporidium hominis
SNRKISSDE

SEQ ID NO: 2162449 - protein, 22 aa, Cryptosporidium hominis
SNRKKEDSSHTSEAFSDSNNRS

SEQ ID NO: 2162450 - protein, 9 aa, Cryptosporidium hominis
SNRNKDLSY

SEQ ID NO: 2162451 - protein, 13 aa, Cryptosporidium hominis
SNRNSNRRGGRSN

SEQ ID NO: 2162452 - protein, 10 aa, Cryptosporidium hominis
SNRPKKEDNL

SEQ ID NO: 2162453 - protein, 4 aa, Cryptosporidium hominis
SNRQ

SEQ ID NO: 2162454 - protein, 4 aa, Cryptosporidium hominis
SNRS

SEQ ID NO: 2162455 - protein, 10 aa, Cryptosporidium hominis
SNRSELSQGA

SEQ ID NO: 2162456 - protein, 14 aa, Cryptosporidium hominis
SNRSGWDRKNKSKN

SEQ ID NO: 2162457 - protein, 7 aa, Cryptosporidium hominis
SNRSNDL

SEQ ID NO: 2162458 - protein, 29 aa, Cryptosporidium hominis
SNRSSLNTNSGSNTNRSKQSKRNKRRSYR

SEQ ID NO: 2162459 - protein, 7 aa, Cryptosporidium hominis
SNRTNSS

SEQ ID NO: 2162460 - protein, 22 aa, Cryptosporidium hominis
SNRTRHLGEDEEVNVNTGNNNE

SEQ ID NO: 2162461 - protein, 20 aa, Cryptosporidium hominis
SNRVPEDPDKISERNKRIKN

SEQ ID NO: 2162462 - protein, 5 aa, Cryptosporidium hominis
SNRYD

SEQ ID NO: 2162463 - protein, 22 aa, Cryptosporidium hominis
SNSAMSSNTNFPRNVNNQSQNV

SEQ ID NO: 2162464 - protein, 13 aa, Cryptosporidium hominis
SNSAQSNEDKTIS

SEQ ID NO: 2162465 - protein, 10 aa, Cryptosporidium hominis
SNSAVSSPYG

SEQ ID NO: 2162466 - protein, 5 aa, Cryptosporidium hominis
SNSCS

SEQ ID NO: 2162467 - protein, 8 aa, Cryptosporidium hominis
SNSDDGVQ

SEQ ID NO: 2162468 - protein, 5 aa, Cryptosporidium hominis
SNSDI

SEQ ID NO: 2162469 - protein, 7 aa, Cryptosporidium hominis
SNSDPEV

SEQ ID NO: 2162470 - protein, 17 aa, Cryptosporidium hominis
SNSDRKKNAVAKATGEM

SEQ ID NO: 2162471 - protein, 14 aa, Cryptosporidium hominis
SNSDSGNKRSHQSI

SEQ ID NO: 2162472 - protein, 8 aa, Cryptosporidium hominis
SNSEDNIS

SEQ ID NO: 2162473 - protein, 10 aa, Cryptosporidium hominis
SNSEKISEDA

SEQ ID NO: 2162474 - protein, 10 aa, Cryptosporidium hominis
SNSEKQVKDA

SEQ ID NO: 2162475 - protein, 7 aa, Cryptosporidium hominis
SNSELEY

SEQ ID NO: 2162476 - protein, 23 aa, Cryptosporidium hominis
SNSENFSKDDLKSPARNKINQER

SEQ ID NO: 2162477 - protein, 10 aa, Cryptosporidium hominis
SNSGDSNNKF

SEQ ID NO: 2162478 - protein, 5 aa, Cryptosporidium hominis
SNSGG

SEQ ID NO: 2162479 - protein, 9 aa, Cryptosporidium hominis
SNSGGLKGA

SEQ ID NO: 2162480 - protein, 8 aa, Cryptosporidium hominis
SNSGKKFE

SEQ ID NO: 2162481 - protein, 10 aa, Cryptosporidium hominis
SNSGNENETI

SEQ ID NO: 2162482 - protein, 8 aa, Cryptosporidium hominis
SNSGPLVP

SEQ ID NO: 2162483 - protein, 5 aa, Cryptosporidium hominis
SNSGS

SEQ ID NO: 2162484 - protein, 11 aa, Cryptosporidium hominis
SNSGSTPSTNC

SEQ ID NO: 2162485 - protein, 4 aa, Cryptosporidium hominis
SNSI

SEQ ID NO: 2162486 - protein, 14 aa, Cryptosporidium hominis
SNSIGNKKKRQKEF

SEQ ID NO: 2162487 - protein, 39 aa, Cryptosporidium hominis
SNSIKRANTNTSRRNNRISTRTNPYSTSSSSSSSSSSRG

SEQ ID NO: 2162488 - protein, 10 aa, Cryptosporidium hominis
SNSILSSERH

SEQ ID NO: 2162489 - protein, 12 aa, Cryptosporidium hominis
SNSINQHDLIDF

SEQ ID NO: 2162490 - protein, 17 aa, Cryptosporidium hominis
SNSISDSRQINPNFPDN

SEQ ID NO: 2162491 - protein, 13 aa, Cryptosporidium hominis
SNSKEKESSNYKP

SEQ ID NO: 2162492 - protein, 19 aa, Cryptosporidium hominis
SNSKKDQKEENSKIRDSNN

SEQ ID NO: 2162493 - protein, 6 aa, Cryptosporidium hominis
SNSKPL

SEQ ID NO: 2162494 - protein, 9 aa, Cryptosporidium hominis
SNSKQPEEL

SEQ ID NO: 2162495 - protein, 7 aa, Cryptosporidium hominis
SNSKSDV

SEQ ID NO: 2162496 - protein, 20 aa, Cryptosporidium hominis
SNSKTKYKDTTEKKLQEDMG

SEQ ID NO: 2162497 - protein, 12 aa, Cryptosporidium hominis
SNSLDNLKEKKT

SEQ ID NO: 2162498 - protein, 5 aa, Cryptosporidium hominis
SNSLN

SEQ ID NO: 2162499 - protein, 9 aa, Cryptosporidium hominis
SNSNDSKMS

SEQ ID NO: 2162500 - protein, 17 aa, Cryptosporidium hominis
SNSNHNNNSNLQNENKP

SEQ ID NO: 2162501 - protein, 14 aa, Cryptosporidium hominis
SNSNKSNAPQHSAA

SEQ ID NO: 2162502 - protein, 6 aa, Cryptosporidium hominis
SNSNLS

SEQ ID NO: 2162503 - protein, 12 aa, Cryptosporidium hominis
SNSNNPSPAISP

SEQ ID NO: 2162504 - protein, 7 aa, Cryptosporidium hominis
SNSNSGF

SEQ ID NO: 2162505 - protein, 7 aa, Cryptosporidium hominis
SNSNSHL

SEQ ID NO: 2162506 - protein, 13 aa, Cryptosporidium hominis
SNSNSNNKSKNTN

SEQ ID NO: 2162507 - protein, 10 aa, Cryptosporidium hominis
SNSNSPTYNN

SEQ ID NO: 2162508 - protein, 12 aa, Cryptosporidium hominis
SNSNTGKMNISN

SEQ ID NO: 2162509 - protein, 7 aa, Cryptosporidium hominis
SNSNTTF

SEQ ID NO: 2162510 - protein, 15 aa, Cryptosporidium hominis
SNSQGESANTIQKKD

SEQ ID NO: 2162511 - protein, 13 aa, Cryptosporidium hominis
SNSQIAQMISFNF

SEQ ID NO: 2162512 - protein, 21 aa, Cryptosporidium hominis
SNSQINSTNTQKKANGQAGNY

SEQ ID NO: 2162513 - protein, 4 aa, Cryptosporidium hominis
SNSR

SEQ ID NO: 2162514 - protein, 16 aa, Cryptosporidium hominis
SNSRENHFKNSQNNFN

SEQ ID NO: 2162515 - protein, 14 aa, Cryptosporidium hominis
SNSRNTAYYNSHEN

SEQ ID NO: 2162516 - protein, 8 aa, Cryptosporidium hominis
SNSSDNKL

SEQ ID NO: 2162517 - protein, 10 aa, Cryptosporidium hominis
SNSSENHNRQ

SEQ ID NO: 2162518 - protein, 10 aa, Cryptosporidium hominis
SNSSERKGTA

SEQ ID NO: 2162519 - protein, 7 aa, Cryptosporidium hominis
SNSSNHY

SEQ ID NO: 2162520 - protein, 5 aa, Cryptosporidium hominis
SNSSS

SEQ ID NO: 2162521 - protein, 9 aa, Cryptosporidium hominis
SNSSSNQRA

SEQ ID NO: 2162522 - protein, 6 aa, Cryptosporidium hominis
SNSSSV

SEQ ID NO: 2162523 - protein, 7 aa, Cryptosporidium hominis
SNSTKFA

SEQ ID NO: 2162524 - protein, 6 aa, Cryptosporidium hominis
SNSTLS

SEQ ID NO: 2162525 - protein, 6 aa, Cryptosporidium hominis
SNSTNK

SEQ ID NO: 2162526 - protein, 5 aa, Cryptosporidium hominis
SNSTP

SEQ ID NO: 2162527 - protein, 16 aa, Cryptosporidium hominis
SNSTSMVGANSTGILP

SEQ ID NO: 2162528 - protein, 6 aa, Cryptosporidium hominis
SNSTSN

SEQ ID NO: 2162529 - protein, 5 aa, Cryptosporidium hominis
SNSTT

SEQ ID NO: 2162530 - protein, 11 aa, Cryptosporidium hominis
SNSVKTIGSSE

SEQ ID NO: 2162531 - protein, 6 aa, Cryptosporidium hominis
SNSVNN

SEQ ID NO: 2162532 - protein, 25 aa, Cryptosporidium hominis
SNSVSNNNINNNNNNNNNNNSNNIH

SEQ ID NO: 2162533 - protein, 6 aa, Cryptosporidium hominis
SNSYES

SEQ ID NO: 2162534 - protein, 6 aa, Cryptosporidium hominis
SNTDKT

SEQ ID NO: 2162535 - protein, 14 aa, Cryptosporidium hominis
SNTDPKEDGAWSSE

SEQ ID NO: 2162536 - protein, 6 aa, Cryptosporidium hominis
SNTELK

SEQ ID NO: 2162537 - protein, 13 aa, Cryptosporidium hominis
SNTESISDTNTNI

SEQ ID NO: 2162538 - protein, 19 aa, Cryptosporidium hominis
SNTGDQNSKDSSKRENSNI

SEQ ID NO: 2162539 - protein, 13 aa, Cryptosporidium hominis
SNTGDTIYSTPRH

SEQ ID NO: 2162540 - protein, 6 aa, Cryptosporidium hominis
SNTING

SEQ ID NO: 2162541 - protein, 5 aa, Cryptosporidium hominis
SNTIT

SEQ ID NO: 2162542 - protein, 7 aa, Cryptosporidium hominis
SNTKDLK

SEQ ID NO: 2162543 - protein, 7 aa, Cryptosporidium hominis
SNTKGSI

SEQ ID NO: 2162544 - protein, 7 aa, Cryptosporidium hominis
SNTKKSD

SEQ ID NO: 2162545 - protein, 6 aa, Cryptosporidium hominis
SNTKNI

SEQ ID NO: 2162546 - protein, 11 aa, Cryptosporidium hominis
SNTKPSEVKDR

SEQ ID NO: 2162547 - protein, 17 aa, Cryptosporidium hominis
SNTKSNFNEEVSNENNM

SEQ ID NO: 2162548 - protein, 9 aa, Cryptosporidium hominis
SNTLSSPYR

SEQ ID NO: 2162549 - protein, 16 aa, Cryptosporidium hominis
SNTNKHPRNDQNSSVI

SEQ ID NO: 2162550 - protein, 15 aa, Cryptosporidium hominis
SNTNNSSHGGSLTEK

SEQ ID NO: 2162551 - protein, 18 aa, Cryptosporidium hominis
SNTNQQQYQSLESTNIQN

SEQ ID NO: 2162552 - protein, 8 aa, Cryptosporidium hominis
SNTNSDIT

SEQ ID NO: 2162553 - protein, 10 aa, Cryptosporidium hominis
SNTNSGNQNI

SEQ ID NO: 2162554 - protein, 7 aa, Cryptosporidium hominis
SNTPKME

SEQ ID NO: 2162555 - protein, 4 aa, Cryptosporidium hominis
SNTQ

SEQ ID NO: 2162556 - protein, 30 aa, Cryptosporidium hominis
SNTQGDNNQTGDVNSQPSGSNVVTSVDLLS

SEQ ID NO: 2162557 - protein, 8 aa, Cryptosporidium hominis
SNTRRERV

SEQ ID NO: 2162558 - protein, 7 aa, Cryptosporidium hominis
SNTRSNH

SEQ ID NO: 2162559 - protein, 12 aa, Cryptosporidium hominis
SNTSDEKNTDPP

SEQ ID NO: 2162560 - protein, 26 aa, Cryptosporidium hominis
SNTSKNDFNLNPSNNSNSNALQSPSI

SEQ ID NO: 2162561 - protein, 19 aa, Cryptosporidium hominis
SNTSKPSKVSSIDEDLQND

SEQ ID NO: 2162562 - protein, 9 aa, Cryptosporidium hominis
SNTSNNSNN

SEQ ID NO: 2162563 - protein, 56 aa, Cryptosporidium hominis
SNTTTNATNNISTINESPALSKNAFDSNTEPKKTSSNSCKRSKDAIPEHKNDPESN

SEQ ID NO: 2162564 - protein, 26 aa, Cryptosporidium hominis
SNTTTTTTTTTTTTTSSFTKNNDNSI

SEQ ID NO: 2162565 - protein, 4 aa, Cryptosporidium hominis
SNTY

SEQ ID NO: 2162566 - protein, 9 aa, Cryptosporidium hominis
SNTYSYREK

SEQ ID NO: 2162567 - protein, 4 aa, Cryptosporidium hominis
SNVD

SEQ ID NO: 2162568 - protein, 6 aa, Cryptosporidium hominis
SNVDEN

SEQ ID NO: 2162569 - protein, 7 aa, Cryptosporidium hominis
SNVDPAL

SEQ ID NO: 2162570 - protein, 84 aa, Cryptosporidium hominis
SNVIETETSTAQEGHISRSKSRARSKSRSKSRARSKSRSKSRVRSRARTRSRTRSRKRSRTRSRSNIDSELDSRTSKTECTEGS

SEQ ID NO: 2162571 - protein, 12 aa, Cryptosporidium hominis
SNVNNQEEMREK

SEQ ID NO: 2162572 - protein, 6 aa, Cryptosporidium hominis
SNVNRN

SEQ ID NO: 2162573 - protein, 36 aa, Cryptosporidium hominis
SNVNSSSNQDNLNSRNSEYNSTASSKTIKSSNTSNA

SEQ ID NO: 2162574 - protein, 12 aa, Cryptosporidium hominis
SNVRADDRSGMQ

SEQ ID NO: 2162575 - protein, 4 aa, Cryptosporidium hominis
SNWP

SEQ ID NO: 2162576 - protein, 5 aa, Cryptosporidium hominis
SNYDL

SEQ ID NO: 2162577 - protein, 29 aa, Cryptosporidium hominis
SNYGCSTSSMTNSTSIQNQAVNSTNTGSG

SEQ ID NO: 2162578 - protein, 7 aa, Cryptosporidium hominis
SNYGKEL

SEQ ID NO: 2162579 - protein, 7 aa, Cryptosporidium hominis
SNYIPSK

SEQ ID NO: 2162580 - protein, 6 aa, Cryptosporidium hominis
SNYKNT

SEQ ID NO: 2162581 - protein, 11 aa, Cryptosporidium hominis
SNYNGNKMRPE

SEQ ID NO: 2162582 - protein, 5 aa, Cryptosporidium hominis
SNYNK

SEQ ID NO: 2162583 - protein, 10 aa, Cryptosporidium hominis
SNYNLQSGDV

SEQ ID NO: 2162584 - protein, 17 aa, Cryptosporidium hominis
SNYNQQLGDSNEYSAES

SEQ ID NO: 2162585 - protein, 8 aa, Cryptosporidium hominis
SNYPKNSC

SEQ ID NO: 2162586 - protein, 5 aa, Cryptosporidium hominis
SNYPY

SEQ ID NO: 2162587 - protein, 6 aa, Cryptosporidium hominis
SNYQNK

SEQ ID NO: 2162588 - protein, 20 aa, Cryptosporidium hominis
SNYQSREKYIPSGTGTGTVI

SEQ ID NO: 2162589 - protein, 4 aa, Cryptosporidium hominis
SNYR

SEQ ID NO: 2162590 - protein, 4 aa, Cryptosporidium hominis
SNYS

SEQ ID NO: 2162591 - protein, 12 aa, Cryptosporidium hominis
SNYSRNGDYGTS

SEQ ID NO: 2162592 - protein, 15 aa, Cryptosporidium hominis
SNYSSKYGMKPDGDF

SEQ ID NO: 2162593 - protein, 10 aa, Cryptosporidium hominis
SNYSSSTSSV

SEQ ID NO: 2162594 - protein, 5 aa, Cryptosporidium hominis
SNYST

SEQ ID NO: 2162595 - protein, 15 aa, Cryptosporidium hominis
SNYTFRGSKSSSPIH

SEQ ID NO: 2162596 - protein, 7 aa, Cryptosporidium hominis
SNYTGNK

SEQ ID NO: 2162597 - protein, 21 aa, Cryptosporidium hominis
SNYTGNSKDLTSNVNIVNNTN

SEQ ID NO: 2162598 - protein, 8 aa, Cryptosporidium hominis
SNYYSNND

SEQ ID NO: 2162599 - protein, 4 aa, Cryptosporidium hominis
SPAI

SEQ ID NO: 2162600 - protein, 6 aa, Cryptosporidium hominis
SPALER

SEQ ID NO: 2162601 - protein, 6 aa, Cryptosporidium hominis
SPAQQH

SEQ ID NO: 2162602 - protein, 8 aa, Cryptosporidium hominis
SPASIRGP

SEQ ID NO: 2162603 - protein, 6 aa, Cryptosporidium hominis
SPAVLE

SEQ ID NO: 2162604 - protein, 9 aa, Cryptosporidium hominis
SPDAGAAEI

SEQ ID NO: 2162605 - protein, 6 aa, Cryptosporidium hominis
SPDGIE

SEQ ID NO: 2162606 - protein, 15 aa, Cryptosporidium hominis
SPDGQTIVTGAGDET

SEQ ID NO: 2162607 - protein, 5 aa, Cryptosporidium hominis
SPDIN

SEQ ID NO: 2162608 - protein, 28 aa, Cryptosporidium hominis
SPDLSKIKSSGKQTSNSNNQAQANPIGG

SEQ ID NO: 2162609 - protein, 7 aa, Cryptosporidium hominis
SPDNEDI

SEQ ID NO: 2162610 - protein, 7 aa, Cryptosporidium hominis
SPDNRQI

SEQ ID NO: 2162611 - protein, 7 aa, Cryptosporidium hominis
SPDPNIE

SEQ ID NO: 2162612 - protein, 22 aa, Cryptosporidium hominis
SPDQDQDHDLEQEGYRNQDQNL

SEQ ID NO: 2162613 - protein, 9 aa, Cryptosporidium hominis
SPDQSKHTL

SEQ ID NO: 2162614 - protein, 6 aa, Cryptosporidium hominis
SPDSPL

SEQ ID NO: 2162615 - protein, 8 aa, Cryptosporidium hominis
SPDSPPTD

SEQ ID NO: 2162616 - protein, 13 aa, Cryptosporidium hominis
SPDSSNNGNSVSL

SEQ ID NO: 2162617 - protein, 9 aa, Cryptosporidium hominis
SPDTNFDDN

SEQ ID NO: 2162618 - protein, 8 aa, Cryptosporidium hominis
SPDTNRTY

SEQ ID NO: 2162619 - protein, 6 aa, Cryptosporidium hominis
SPEDFE

SEQ ID NO: 2162620 - protein, 7 aa, Cryptosporidium hominis
SPEDGAL

SEQ ID NO: 2162621 - protein, 5 aa, Cryptosporidium hominis
SPEDK

SEQ ID NO: 2162622 - protein, 7 aa, Cryptosporidium hominis
SPEDRNE

SEQ ID NO: 2162623 - protein, 5 aa, Cryptosporidium hominis
SPEEH

SEQ ID NO: 2162624 - protein, 6 aa, Cryptosporidium hominis
SPEEMN

SEQ ID NO: 2162625 - protein, 6 aa, Cryptosporidium hominis
SPEERK

SEQ ID NO: 2162626 - protein, 8 aa, Cryptosporidium hominis
SPEFDPQN

SEQ ID NO: 2162627 - protein, 4 aa, Cryptosporidium hominis
SPEG

SEQ ID NO: 2162628 - protein, 4 aa, Cryptosporidium hominis
SPEI

SEQ ID NO: 2162629 - protein, 4 aa, Cryptosporidium hominis
SPEK

SEQ ID NO: 2162630 - protein, 5 aa, Cryptosporidium hominis
SPEKC

SEQ ID NO: 2162631 - protein, 19 aa, Cryptosporidium hominis
SPEKLESLKENTDKNTEDC

SEQ ID NO: 2162632 - protein, 5 aa, Cryptosporidium hominis
SPELR

SEQ ID NO: 2162633 - protein, 5 aa, Cryptosporidium hominis
SPENC

SEQ ID NO: 2162634 - protein, 9 aa, Cryptosporidium hominis
SPENGENKT

SEQ ID NO: 2162635 - protein, 18 aa, Cryptosporidium hominis
SPENHKNHRSPDRGTSRF

SEQ ID NO: 2162636 - protein, 6 aa, Cryptosporidium hominis
SPENNS

SEQ ID NO: 2162637 - protein, 4 aa, Cryptosporidium hominis
SPER

SEQ ID NO: 2162638 - protein, 16 aa, Cryptosporidium hominis
SPESKEPIKQITQSQG

SEQ ID NO: 2162639 - protein, 6 aa, Cryptosporidium hominis
SPESKY

SEQ ID NO: 2162640 - protein, 8 aa, Cryptosporidium hominis
SPESRLTA

SEQ ID NO: 2162641 - protein, 28 aa, Cryptosporidium hominis
SPEVTTPNGERETSTDSNIKNTESTKVS

SEQ ID NO: 2162642 - protein, 13 aa, Cryptosporidium hominis
SPFGGGRAGRVRR

SEQ ID NO: 2162643 - protein, 15 aa, Cryptosporidium hominis
SPFGGTGGGNGIGSG

SEQ ID NO: 2162644 - protein, 6 aa, Cryptosporidium hominis
SPFGPE

SEQ ID NO: 2162645 - protein, 25 aa, Cryptosporidium hominis
SPFGSSVSGSGSSTISTTGPTTGSI

SEQ ID NO: 2162646 - protein, 13 aa, Cryptosporidium hominis
SPFNADNKDHSDP

SEQ ID NO: 2162647 - protein, 9 aa, Cryptosporidium hominis
SPGEAEAQA

SEQ ID NO: 2162648 - protein, 4 aa, Cryptosporidium hominis
SPGI

SEQ ID NO: 2162649 - protein, 5 aa, Cryptosporidium hominis
SPGLQ

SEQ ID NO: 2162650 - protein, 4 aa, Cryptosporidium hominis
SPGN

SEQ ID NO: 2162651 - protein, 28 aa, Cryptosporidium hominis
SPGNSSSNTNSIGISGKTNQSNRQGTTL

SEQ ID NO: 2162652 - protein, 4 aa, Cryptosporidium hominis
SPGS

SEQ ID NO: 2162653 - protein, 8 aa, Cryptosporidium hominis
SPGSSSIS

SEQ ID NO: 2162654 - protein, 6 aa, Cryptosporidium hominis
SPGTTL

SEQ ID NO: 2162655 - protein, 5 aa, Cryptosporidium hominis
SPGVQ

SEQ ID NO: 2162656 - protein, 7 aa, Cryptosporidium hominis
SPHDSSP

SEQ ID NO: 2162657 - protein, 21 aa, Cryptosporidium hominis
SPHFSDSDEFYSDSSSNSSES

SEQ ID NO: 2162658 - protein, 6 aa, Cryptosporidium hominis
SPHLPE

SEQ ID NO: 2162659 - protein, 5 aa, Cryptosporidium hominis
SPHNS

SEQ ID NO: 2162660 - protein, 10 aa, Cryptosporidium hominis
SPHSPQNNAY

SEQ ID NO: 2162661 - protein, 7 aa, Cryptosporidium hominis
SPIDKSS

SEQ ID NO: 2162662 - protein, 12 aa, Cryptosporidium hominis
SPIDSQDSNYPA

SEQ ID NO: 2162663 - protein, 19 aa, Cryptosporidium hominis
SPIEDHDPDQDQDKDQDYH

SEQ ID NO: 2162664 - protein, 5 aa, Cryptosporidium hominis
SPIGI

SEQ ID NO: 2162665 - protein, 8 aa, Cryptosporidium hominis
SPIGPVQR

SEQ ID NO: 2162666 - protein, 6 aa, Cryptosporidium hominis
SPIKSH

SEQ ID NO: 2162667 - protein, 5 aa, Cryptosporidium hominis
SPINS

SEQ ID NO: 2162668 - protein, 8 aa, Cryptosporidium hominis
SPINSPNF

SEQ ID NO: 2162669 - protein, 4 aa, Cryptosporidium hominis
SPIP

SEQ ID NO: 2162670 - protein, 8 aa, Cryptosporidium hominis
SPIPEESK

SEQ ID NO: 2162671 - protein, 6 aa, Cryptosporidium hominis
SPIPNS

SEQ ID NO: 2162672 - protein, 6 aa, Cryptosporidium hominis
SPIQEE

SEQ ID NO: 2162673 - protein, 6 aa, Cryptosporidium hominis
SPIQND

SEQ ID NO: 2162674 - protein, 4 aa, Cryptosporidium hominis
SPIS

SEQ ID NO: 2162675 - protein, 12 aa, Cryptosporidium hominis
SPISEKKYTQDI

SEQ ID NO: 2162676 - protein, 13 aa, Cryptosporidium hominis
SPISGSNRDSIGG

SEQ ID NO: 2162677 - protein, 18 aa, Cryptosporidium hominis
SPISQAPSSIGGVNDNEI

SEQ ID NO: 2162678 - protein, 13 aa, Cryptosporidium hominis
SPITNNVNNSTKQ

SEQ ID NO: 2162679 - protein, 7 aa, Cryptosporidium hominis
SPKANSI

SEQ ID NO: 2162680 - protein, 4 aa, Cryptosporidium hominis
SPKD

SEQ ID NO: 2162681 - protein, 13 aa, Cryptosporidium hominis
SPKDNDERRKTIE

SEQ ID NO: 2162682 - protein, 4 aa, Cryptosporidium hominis
SPKG

SEQ ID NO: 2162683 - protein, 13 aa, Cryptosporidium hominis
SPKKMRKTGINEA

SEQ ID NO: 2162684 - protein, 9 aa, Cryptosporidium hominis
SPKKPTDVL

SEQ ID NO: 2162685 - protein, 11 aa, Cryptosporidium hominis
SPKNNYNIPKN

SEQ ID NO: 2162686 - protein, 32 aa, Cryptosporidium hominis
SPKNPTKVKSTGTNKKKLQVSRGRSKTRVNSE

SEQ ID NO: 2162687 - protein, 12 aa, Cryptosporidium hominis
SPKNQKDKPTEA

SEQ ID NO: 2162688 - protein, 8 aa, Cryptosporidium hominis
SPKQAETP

SEQ ID NO: 2162689 - protein, 8 aa, Cryptosporidium hominis
SPKQISPK

SEQ ID NO: 2162690 - protein, 4 aa, Cryptosporidium hominis
SPKS

SEQ ID NO: 2162691 - protein, 8 aa, Cryptosporidium hominis
SPKSEVPA

SEQ ID NO: 2162692 - protein, 13 aa, Cryptosporidium hominis
SPKSLEPINNTKN

SEQ ID NO: 2162693 - protein, 9 aa, Cryptosporidium hominis
SPKTADYRR

SEQ ID NO: 2162694 - protein, 9 aa, Cryptosporidium hominis
SPKTKEYAS

SEQ ID NO: 2162695 - protein, 6 aa, Cryptosporidium hominis
SPKVEL

SEQ ID NO: 2162696 - protein, 7 aa, Cryptosporidium hominis
SPKVSDT

SEQ ID NO: 2162697 - protein, 4 aa, Cryptosporidium hominis
SPLE

SEQ ID NO: 2162698 - protein, 5 aa, Cryptosporidium hominis
SPLFP

SEQ ID NO: 2162699 - protein, 6 aa, Cryptosporidium hominis
SPLPES

SEQ ID NO: 2162700 - protein, 13 aa, Cryptosporidium hominis
SPLPSSASIKGSR

SEQ ID NO: 2162701 - protein, 6 aa, Cryptosporidium hominis
SPLPTG

SEQ ID NO: 2162702 - protein, 18 aa, Cryptosporidium hominis
SPLPTGQIPSTNDPPYVS

SEQ ID NO: 2162703 - protein, 10 aa, Cryptosporidium hominis
SPLSDASPNT

SEQ ID NO: 2162704 - protein, 6 aa, Cryptosporidium hominis
SPLSKN

SEQ ID NO: 2162705 - protein, 7 aa, Cryptosporidium hominis
SPLSSTE

SEQ ID NO: 2162706 - protein, 5 aa, Cryptosporidium hominis
SPMEA

SEQ ID NO: 2162707 - protein, 13 aa, Cryptosporidium hominis
SPMGQASSNIPNI

SEQ ID NO: 2162708 - protein, 8 aa, Cryptosporidium hominis
SPMGSSNQ

SEQ ID NO: 2162709 - protein, 9 aa, Cryptosporidium hominis
SPNADADEI

SEQ ID NO: 2162710 - protein, 5 aa, Cryptosporidium hominis
SPNDE

SEQ ID NO: 2162711 - protein, 5 aa, Cryptosporidium hominis
SPNEF

SEQ ID NO: 2162712 - protein, 12 aa, Cryptosporidium hominis
SPNFNKEKDPKR

SEQ ID NO: 2162713 - protein, 8 aa, Cryptosporidium hominis
SPNFTSPN

SEQ ID NO: 2162714 - protein, 4 aa, Cryptosporidium hominis
SPNG

SEQ ID NO: 2162715 - protein, 5 aa, Cryptosporidium hominis
SPNGA

SEQ ID NO: 2162716 - protein, 12 aa, Cryptosporidium hominis
SPNGPDVPRPTY

SEQ ID NO: 2162717 - protein, 8 aa, Cryptosporidium hominis
SPNHEPEH

SEQ ID NO: 2162718 - protein, 4 aa, Cryptosporidium hominis
SPNI

SEQ ID NO: 2162719 - protein, 14 aa, Cryptosporidium hominis
SPNIDSKEEKKMKS

SEQ ID NO: 2162720 - protein, 5 aa, Cryptosporidium hominis
SPNIG

SEQ ID NO: 2162721 - protein, 9 aa, Cryptosporidium hominis
SPNLPEGDA

SEQ ID NO: 2162722 - protein, 5 aa, Cryptosporidium hominis
SPNNK

SEQ ID NO: 2162723 - protein, 15 aa, Cryptosporidium hominis
SPNPESIPMPCGFPI

SEQ ID NO: 2162724 - protein, 12 aa, Cryptosporidium hominis
SPNRLKSKSTTN

SEQ ID NO: 2162725 - protein, 9 aa, Cryptosporidium hominis
SPNRTNEFS

SEQ ID NO: 2162726 - protein, 21 aa, Cryptosporidium hominis
SPNSDIQNDSELCSSDSCKNY

SEQ ID NO: 2162727 - protein, 13 aa, Cryptosporidium hominis
SPNSDITQKDDSL

SEQ ID NO: 2162728 - protein, 9 aa, Cryptosporidium hominis
SPNSEESDI

SEQ ID NO: 2162729 - protein, 7 aa, Cryptosporidium hominis
SPNSNRI

SEQ ID NO: 2162730 - protein, 8 aa, Cryptosporidium hominis
SPNSTVER

SEQ ID NO: 2162731 - protein, 8 aa, Cryptosporidium hominis
SPNTDIEL

SEQ ID NO: 2162732 - protein, 7 aa, Cryptosporidium hominis
SPNTMNI

SEQ ID NO: 2162733 - protein, 12 aa, Cryptosporidium hominis
SPNTRLERDNRT

SEQ ID NO: 2162734 - protein, 8 aa, Cryptosporidium hominis
SPNYTDSS

SEQ ID NO: 2162735 - protein, 13 aa, Cryptosporidium hominis
SPPEKNVPESEYE

SEQ ID NO: 2162736 - protein, 16 aa, Cryptosporidium hominis
SPPGKDSSDDSNARIS

SEQ ID NO: 2162737 - protein, 5 aa, Cryptosporidium hominis
SPPLI

SEQ ID NO: 2162738 - protein, 7 aa, Cryptosporidium hominis
SPPPDGR

SEQ ID NO: 2162739 - protein, 7 aa, Cryptosporidium hominis
SPPPREI

SEQ ID NO: 2162740 - protein, 6 aa, Cryptosporidium hominis
SPPSSW

SEQ ID NO: 2162741 - protein, 6 aa, Cryptosporidium hominis
SPPSYS

SEQ ID NO: 2162742 - protein, 7 aa, Cryptosporidium hominis
SPPVTGG

SEQ ID NO: 2162743 - protein, 21 aa, Cryptosporidium hominis
SPPYTSDESSHSNHQNNDRLN

SEQ ID NO: 2162744 - protein, 5 aa, Cryptosporidium hominis
SPQAE

SEQ ID NO: 2162745 - protein, 8 aa, Cryptosporidium hominis
SPQFRKGT

SEQ ID NO: 2162746 - protein, 21 aa, Cryptosporidium hominis
SPQGEGISSGNRISDSQRGGM

SEQ ID NO: 2162747 - protein, 7 aa, Cryptosporidium hominis
SPQGNKP

SEQ ID NO: 2162748 - protein, 10 aa, Cryptosporidium hominis
SPQGRGAEAE

SEQ ID NO: 2162749 - protein, 5 aa, Cryptosporidium hominis
SPQIV

SEQ ID NO: 2162750 - protein, 11 aa, Cryptosporidium hominis
SPQKDEDAQRG

SEQ ID NO: 2162751 - protein, 5 aa, Cryptosporidium hominis
SPQLS

SEQ ID NO: 2162752 - protein, 9 aa, Cryptosporidium hominis
SPQNNQKPK

SEQ ID NO: 2162753 - protein, 4 aa, Cryptosporidium hominis
SPQQ

SEQ ID NO: 2162754 - protein, 6 aa, Cryptosporidium hominis
SPQQTD

SEQ ID NO: 2162755 - protein, 8 aa, Cryptosporidium hominis
SPQVAPGV

SEQ ID NO: 2162756 - protein, 5 aa, Cryptosporidium hominis
SPRIQ

SEQ ID NO: 2162757 - protein, 4 aa, Cryptosporidium hominis
SPRL

SEQ ID NO: 2162758 - protein, 13 aa, Cryptosporidium hominis
SPRLSSTPNPGKK

SEQ ID NO: 2162759 - protein, 4 aa, Cryptosporidium hominis
SPRN

SEQ ID NO: 2162760 - protein, 8 aa, Cryptosporidium hominis
SPRSSPDV

SEQ ID NO: 2162761 - protein, 7 aa, Cryptosporidium hominis
SPSASPY

SEQ ID NO: 2162762 - protein, 6 aa, Cryptosporidium hominis
SPSDDV

SEQ ID NO: 2162763 - protein, 33 aa, Cryptosporidium hominis
SPSEAIRDSNIEESDSDLFGESDSTPDQIHNDG

SEQ ID NO: 2162764 - protein, 5 aa, Cryptosporidium hominis
SPSEN

SEQ ID NO: 2162765 - protein, 12 aa, Cryptosporidium hominis
SPSETNKPTSKV

SEQ ID NO: 2162766 - protein, 7 aa, Cryptosporidium hominis
SPSEWPG

SEQ ID NO: 2162767 - protein, 4 aa, Cryptosporidium hominis
SPSH

SEQ ID NO: 2162768 - protein, 10 aa, Cryptosporidium hominis
SPSISFPSDE

SEQ ID NO: 2162769 - protein, 7 aa, Cryptosporidium hominis
SPSISTP

SEQ ID NO: 2162770 - protein, 5 aa, Cryptosporidium hominis
SPSIT

SEQ ID NO: 2162771 - protein, 9 aa, Cryptosporidium hominis
SPSKNETNI

SEQ ID NO: 2162772 - protein, 8 aa, Cryptosporidium hominis
SPSLPSLD

SEQ ID NO: 2162773 - protein, 12 aa, Cryptosporidium hominis
SPSLSQEDRSLT

SEQ ID NO: 2162774 - protein, 6 aa, Cryptosporidium hominis
SPSLYS

SEQ ID NO: 2162775 - protein, 7 aa, Cryptosporidium hominis
SPSNIQK

SEQ ID NO: 2162776 - protein, 14 aa, Cryptosporidium hominis
SPSNKQDYSLPSDI

SEQ ID NO: 2162777 - protein, 10 aa, Cryptosporidium hominis
SPSNNGIQQK

SEQ ID NO: 2162778 - protein, 6 aa, Cryptosporidium hominis
SPSPFD

SEQ ID NO: 2162779 - protein, 4 aa, Cryptosporidium hominis
SPSR

SEQ ID NO: 2162780 - protein, 13 aa, Cryptosporidium hominis
SPSRSISSPIKSS

SEQ ID NO: 2162781 - protein, 39 aa, Cryptosporidium hominis
SPSRSSNSSSQRTGVSSNSSSSIQADSGGLFGESDTDDF

SEQ ID NO: 2162782 - protein, 4 aa, Cryptosporidium hominis
SPSS

SEQ ID NO: 2162783 - protein, 12 aa, Cryptosporidium hominis
SPSSKAFEESHN

SEQ ID NO: 2162784 - protein, 7 aa, Cryptosporidium hominis
SPSSSEI

SEQ ID NO: 2162785 - protein, 7 aa, Cryptosporidium hominis
SPSTSQP

SEQ ID NO: 2162786 - protein, 15 aa, Cryptosporidium hominis
SPSTVGGKVSGKTSI

SEQ ID NO: 2162787 - protein, 5 aa, Cryptosporidium hominis
SPSVS

SEQ ID NO: 2162788 - protein, 6 aa, Cryptosporidium hominis
SPSYTE

SEQ ID NO: 2162789 - protein, 6 aa, Cryptosporidium hominis
SPTAFK

SEQ ID NO: 2162790 - protein, 4 aa, Cryptosporidium hominis
SPTE

SEQ ID NO: 2162791 - protein, 19 aa, Cryptosporidium hominis
SPTEQHDESKFKDPETGAE

SEQ ID NO: 2162792 - protein, 7 aa, Cryptosporidium hominis
SPTEQSA

SEQ ID NO: 2162793 - protein, 9 aa, Cryptosporidium hominis
SPTESQIQQ

SEQ ID NO: 2162794 - protein, 4 aa, Cryptosporidium hominis
SPTG

SEQ ID NO: 2162795 - protein, 8 aa, Cryptosporidium hominis
SPTHQEKT

SEQ ID NO: 2162796 - protein, 4 aa, Cryptosporidium hominis
SPTI

SEQ ID NO: 2162797 - protein, 9 aa, Cryptosporidium hominis
SPTKNWTER

SEQ ID NO: 2162798 - protein, 9 aa, Cryptosporidium hominis
SPTKSGLNV

SEQ ID NO: 2162799 - protein, 5 aa, Cryptosporidium hominis
SPTLD

SEQ ID NO: 2162800 - protein, 7 aa, Cryptosporidium hominis
SPTLTPN

SEQ ID NO: 2162801 - protein, 12 aa, Cryptosporidium hominis
SPTQKKNINGRN

SEQ ID NO: 2162802 - protein, 7 aa, Cryptosporidium hominis
SPTSNDE

SEQ ID NO: 2162803 - protein, 24 aa, Cryptosporidium hominis
SPVEQKSNMENKGDKNPNETANSN

SEQ ID NO: 2162804 - protein, 4 aa, Cryptosporidium hominis
SPVI

SEQ ID NO: 2162805 - protein, 21 aa, Cryptosporidium hominis
SPVNRTLETTTSEVSTIPSAR

SEQ ID NO: 2162806 - protein, 6 aa, Cryptosporidium hominis
SPVNSN

SEQ ID NO: 2162807 - protein, 7 aa, Cryptosporidium hominis
SPYSSSI

SEQ ID NO: 2162808 - protein, 27 aa, Cryptosporidium hominis
SQADSGKRNKIPSEKASIKPTSTKSDE

SEQ ID NO: 2162809 - protein, 6 aa, Cryptosporidium hominis
SQADYQ

SEQ ID NO: 2162810 - protein, 13 aa, Cryptosporidium hominis
SQAKSINKSLPKE

SEQ ID NO: 2162811 - protein, 4 aa, Cryptosporidium hominis
SQAL

SEQ ID NO: 2162812 - protein, 8 aa, Cryptosporidium hominis
SQANKITK

SEQ ID NO: 2162813 - protein, 6 aa, Cryptosporidium hominis
SQANSK

SEQ ID NO: 2162814 - protein, 5 aa, Cryptosporidium hominis
SQARK

SEQ ID NO: 2162815 - protein, 14 aa, Cryptosporidium hominis
SQASKSDKIKNANF

SEQ ID NO: 2162816 - protein, 10 aa, Cryptosporidium hominis
SQATSSNPME

SEQ ID NO: 2162817 - protein, 22 aa, Cryptosporidium hominis
SQAYPETRKCTGGQDCMEESPG

SEQ ID NO: 2162818 - protein, 12 aa, Cryptosporidium hominis
SQCVSNNNSNSP

SEQ ID NO: 2162819 - protein, 9 aa, Cryptosporidium hominis
SQDCNEGYQ

SEQ ID NO: 2162820 - protein, 10 aa, Cryptosporidium hominis
SQDDSLEDND

SEQ ID NO: 2162821 - protein, 6 aa, Cryptosporidium hominis
SQDEAR

SEQ ID NO: 2162822 - protein, 9 aa, Cryptosporidium hominis
SQDKEEDFS

SEQ ID NO: 2162823 - protein, 6 aa, Cryptosporidium hominis
SQDKER

SEQ ID NO: 2162824 - protein, 9 aa, Cryptosporidium hominis
SQDKFKRTR

SEQ ID NO: 2162825 - protein, 6 aa, Cryptosporidium hominis
SQDKPY

SEQ ID NO: 2162826 - protein, 7 aa, Cryptosporidium hominis
SQDKSMQ

SEQ ID NO: 2162827 - protein, 5 aa, Cryptosporidium hominis
SQDKT

SEQ ID NO: 2162828 - protein, 7 aa, Cryptosporidium hominis
SQDLESN

SEQ ID NO: 2162829 - protein, 9 aa, Cryptosporidium hominis
SQDNVPGSA

SEQ ID NO: 2162830 - protein, 6 aa, Cryptosporidium hominis
SQEAGM

SEQ ID NO: 2162831 - protein, 10 aa, Cryptosporidium hominis
SQEASKEVEK

SEQ ID NO: 2162832 - protein, 21 aa, Cryptosporidium hominis
SQEDSSPNRDSDESGSDLDED

SEQ ID NO: 2162833 - protein, 8 aa, Cryptosporidium hominis
SQEEEQTN

SEQ ID NO: 2162834 - protein, 8 aa, Cryptosporidium hominis
SQEGNEGI

SEQ ID NO: 2162835 - protein, 7 aa, Cryptosporidium hominis
SQEIRNK

SEQ ID NO: 2162836 - protein, 4 aa, Cryptosporidium hominis
SQEK

SEQ ID NO: 2162837 - protein, 5 aa, Cryptosporidium hominis
SQELK

SEQ ID NO: 2162838 - protein, 9 aa, Cryptosporidium hominis
SQENAYKSS

SEQ ID NO: 2162839 - protein, 11 aa, Cryptosporidium hominis
SQENEIKPELE

SEQ ID NO: 2162840 - protein, 8 aa, Cryptosporidium hominis
SQENRSSL

SEQ ID NO: 2162841 - protein, 4 aa, Cryptosporidium hominis
SQEP

SEQ ID NO: 2162842 - protein, 4 aa, Cryptosporidium hominis
SQES

SEQ ID NO: 2162843 - protein, 6 aa, Cryptosporidium hominis
SQESAE

SEQ ID NO: 2162844 - protein, 11 aa, Cryptosporidium hominis
SQESPNNPYDR

SEQ ID NO: 2162845 - protein, 11 aa, Cryptosporidium hominis
SQESSQNSSSL

SEQ ID NO: 2162846 - protein, 4 aa, Cryptosporidium hominis
SQET

SEQ ID NO: 2162847 - protein, 5 aa, Cryptosporidium hominis
SQETI

SEQ ID NO: 2162848 - protein, 5 aa, Cryptosporidium hominis
SQETL

SEQ ID NO: 2162849 - protein, 16 aa, Cryptosporidium hominis
SQEWADSDSDTESNIS

SEQ ID NO: 2162850 - protein, 11 aa, Cryptosporidium hominis
SQFNKDETSNS

SEQ ID NO: 2162851 - protein, 10 aa, Cryptosporidium hominis
SQFNQNSSYI

SEQ ID NO: 2162852 - protein, 6 aa, Cryptosporidium hominis
SQFPPL

SEQ ID NO: 2162853 - protein, 7 aa, Cryptosporidium hominis
SQFVEGG

SEQ ID NO: 2162854 - protein, 7 aa, Cryptosporidium hominis
SQGAEPY

SEQ ID NO: 2162855 - protein, 9 aa, Cryptosporidium hominis
SQGAGQKDK

SEQ ID NO: 2162856 - protein, 13 aa, Cryptosporidium hominis
SQGAGVSSEYSDC

SEQ ID NO: 2162857 - protein, 4 aa, Cryptosporidium hominis
SQGE

SEQ ID NO: 2162858 - protein, 10 aa, Cryptosporidium hominis
SQGGCKENQD

SEQ ID NO: 2162859 - protein, 8 aa, Cryptosporidium hominis
SQGIGNAN

SEQ ID NO: 2162860 - protein, 12 aa, Cryptosporidium hominis
SQGKQGDRAARA

SEQ ID NO: 2162861 - protein, 15 aa, Cryptosporidium hominis
SQGPDKSNPKSTAPL

SEQ ID NO: 2162862 - protein, 7 aa, Cryptosporidium hominis
SQGPYEK

SEQ ID NO: 2162863 - protein, 7 aa, Cryptosporidium hominis
SQGSSHE

SEQ ID NO: 2162864 - protein, 8 aa, Cryptosporidium hominis
SQGSSHEG

SEQ ID NO: 2162865 - protein, 10 aa, Cryptosporidium hominis
SQGTGSNISN

SEQ ID NO: 2162866 - protein, 5 aa, Cryptosporidium hominis
SQHDA

SEQ ID NO: 2162867 - protein, 14 aa, Cryptosporidium hominis
SQHELKQQKSSINA

SEQ ID NO: 2162868 - protein, 9 aa, Cryptosporidium hominis
SQHGDEKNS

SEQ ID NO: 2162869 - protein, 10 aa, Cryptosporidium hominis
SQHKKPNKLK

SEQ ID NO: 2162870 - protein, 4 aa, Cryptosporidium hominis
SQID

SEQ ID NO: 2162871 - protein, 5 aa, Cryptosporidium hominis
SQIDT

SEQ ID NO: 2162872 - protein, 12 aa, Cryptosporidium hominis
SQIGETERQNDK

SEQ ID NO: 2162873 - protein, 25 aa, Cryptosporidium hominis
SQIGSSSNNINGTGTVNASNTGMGN

SEQ ID NO: 2162874 - protein, 9 aa, Cryptosporidium hominis
SQIKDDQTN

SEQ ID NO: 2162875 - protein, 8 aa, Cryptosporidium hominis
SQINSGEI

SEQ ID NO: 2162876 - protein, 6 aa, Cryptosporidium hominis
SQIRSN

SEQ ID NO: 2162877 - protein, 6 aa, Cryptosporidium hominis
SQISDG

SEQ ID NO: 2162878 - protein, 8 aa, Cryptosporidium hominis
SQISEENP

SEQ ID NO: 2162879 - protein, 6 aa, Cryptosporidium hominis
SQISND

SEQ ID NO: 2162880 - protein, 8 aa, Cryptosporidium hominis
SQITPGVG

SEQ ID NO: 2162881 - protein, 13 aa, Cryptosporidium hominis
SQKDSSSSKMRQE

SEQ ID NO: 2162882 - protein, 9 aa, Cryptosporidium hominis
SQKEHDGLR

SEQ ID NO: 2162883 - protein, 7 aa, Cryptosporidium hominis
SQKENNK

SEQ ID NO: 2162884 - protein, 25 aa, Cryptosporidium hominis
SQKENPTPKINNTTSGNSQENSSSI

SEQ ID NO: 2162885 - protein, 4 aa, Cryptosporidium hominis
SQKG

SEQ ID NO: 2162886 - protein, 10 aa, Cryptosporidium hominis
SQKINSSKSL

SEQ ID NO: 2162887 - protein, 7 aa, Cryptosporidium hominis
SQKISKS

SEQ ID NO: 2162888 - protein, 6 aa, Cryptosporidium hominis
SQKNEQ

SEQ ID NO: 2162889 - protein, 10 aa, Cryptosporidium hominis
SQKNSNKSWL

SEQ ID NO: 2162890 - protein, 7 aa, Cryptosporidium hominis
SQKNSNY

SEQ ID NO: 2162891 - protein, 20 aa, Cryptosporidium hominis
SQKSNNTDSTAKSNKSKTPF

SEQ ID NO: 2162892 - protein, 9 aa, Cryptosporidium hominis
SQKSSANSL

SEQ ID NO: 2162893 - protein, 15 aa, Cryptosporidium hominis
SQKSSISRTPGKTKH

SEQ ID NO: 2162894 - protein, 11 aa, Cryptosporidium hominis
SQLERQRKHGY

SEQ ID NO: 2162895 - protein, 6 aa, Cryptosporidium hominis
SQLFQD

SEQ ID NO: 2162896 - protein, 22 aa, Cryptosporidium hominis
SQLKKEPKSYEGTVPDELPAIS

SEQ ID NO: 2162897 - protein, 6 aa, Cryptosporidium hominis
SQLKNI

SEQ ID NO: 2162898 - protein, 6 aa, Cryptosporidium hominis
SQLKPT

SEQ ID NO: 2162899 - protein, 9 aa, Cryptosporidium hominis
SQLNESKSS

SEQ ID NO: 2162900 - protein, 22 aa, Cryptosporidium hominis
SQLQTNRDQGNIPQEKDEEELD

SEQ ID NO: 2162901 - protein, 18 aa, Cryptosporidium hominis
SQLRGDNSMNNSNKNTSH

SEQ ID NO: 2162902 - protein, 5 aa, Cryptosporidium hominis
SQLSH

SEQ ID NO: 2162903 - protein, 7 aa, Cryptosporidium hominis
SQLSNES

SEQ ID NO: 2162904 - protein, 5 aa, Cryptosporidium hominis
SQMAE

SEQ ID NO: 2162905 - protein, 10 aa, Cryptosporidium hominis
SQMATDKDQK

SEQ ID NO: 2162906 - protein, 4 aa, Cryptosporidium hominis
SQMG

SEQ ID NO: 2162907 - protein, 6 aa, Cryptosporidium hominis
SQMNAT

SEQ ID NO: 2162908 - protein, 5 aa, Cryptosporidium hominis
SQNAT

SEQ ID NO: 2162909 - protein, 7 aa, Cryptosporidium hominis
SQNCGSS

SEQ ID NO: 2162910 - protein, 10 aa, Cryptosporidium hominis
SQNDEEDNEI

SEQ ID NO: 2162911 - protein, 51 aa, Cryptosporidium hominis
SQNDQIEEPYNGVTQPGNLDTLEEKNQVHEKNQIQSPRKNMEKMSPEDERA

SEQ ID NO: 2162912 - protein, 14 aa, Cryptosporidium hominis
SQNDQNDDNSDLNK

SEQ ID NO: 2162913 - protein, 8 aa, Cryptosporidium hominis
SQNDSSRL

SEQ ID NO: 2162914 - protein, 8 aa, Cryptosporidium hominis
SQNEKNEY

SEQ ID NO: 2162915 - protein, 12 aa, Cryptosporidium hominis
SQNIQDTNSQAS

SEQ ID NO: 2162916 - protein, 8 aa, Cryptosporidium hominis
SQNKESNL

SEQ ID NO: 2162917 - protein, 5 aa, Cryptosporidium hominis
SQNKI

SEQ ID NO: 2162918 - protein, 6 aa, Cryptosporidium hominis
SQNKNN

SEQ ID NO: 2162919 - protein, 7 aa, Cryptosporidium hominis
SQNLSQA

SEQ ID NO: 2162920 - protein, 14 aa, Cryptosporidium hominis
SQNNHETQSIHEQE

SEQ ID NO: 2162921 - protein, 7 aa, Cryptosporidium hominis
SQNQNSY

SEQ ID NO: 2162922 - protein, 12 aa, Cryptosporidium hominis
SQNQVKSSVQRS

SEQ ID NO: 2162923 - protein, 12 aa, Cryptosporidium hominis
SQNSFKGRKNGW

SEQ ID NO: 2162924 - protein, 11 aa, Cryptosporidium hominis
SQNSGGSDRKN

SEQ ID NO: 2162925 - protein, 16 aa, Cryptosporidium hominis
SQNSNSISINNNNNNH

SEQ ID NO: 2162926 - protein, 9 aa, Cryptosporidium hominis
SQNSSKRKV

SEQ ID NO: 2162927 - protein, 19 aa, Cryptosporidium hominis
SQNSYNGFGGIPNNNNFGN

SEQ ID NO: 2162928 - protein, 5 aa, Cryptosporidium hominis
SQNTN

SEQ ID NO: 2162929 - protein, 9 aa, Cryptosporidium hominis
SQNTNNYTE

SEQ ID NO: 2162930 - protein, 15 aa, Cryptosporidium hominis
SQNVAKDSESEEEPV

SEQ ID NO: 2162931 - protein, 13 aa, Cryptosporidium hominis
SQNYETKEVNSSL

SEQ ID NO: 2162932 - protein, 8 aa, Cryptosporidium hominis
SQPAQNNQ

SEQ ID NO: 2162933 - protein, 5 aa, Cryptosporidium hominis
SQPIQ

SEQ ID NO: 2162934 - protein, 5 aa, Cryptosporidium hominis
SQPIV

SEQ ID NO: 2162935 - protein, 9 aa, Cryptosporidium hominis
SQPLPETET

SEQ ID NO: 2162936 - protein, 6 aa, Cryptosporidium hominis
SQPLTS

SEQ ID NO: 2162937 - protein, 5 aa, Cryptosporidium hominis
SQPNE

SEQ ID NO: 2162938 - protein, 5 aa, Cryptosporidium hominis
SQPPL

SEQ ID NO: 2162939 - protein, 4 aa, Cryptosporidium hominis
SQPS

SEQ ID NO: 2162940 - protein, 6 aa, Cryptosporidium hominis
SQPSEI

SEQ ID NO: 2162941 - protein, 6 aa, Cryptosporidium hominis
SQPSKY

SEQ ID NO: 2162942 - protein, 7 aa, Cryptosporidium hominis
SQPSNID

SEQ ID NO: 2162943 - protein, 13 aa, Cryptosporidium hominis
SQQAQGGEARNSI

SEQ ID NO: 2162944 - protein, 10 aa, Cryptosporidium hominis
SQQDISDSKC

SEQ ID NO: 2162945 - protein, 4 aa, Cryptosporidium hominis
SQQE

SEQ ID NO: 2162946 - protein, 20 aa, Cryptosporidium hominis
SQQERPESGNEQRNSINSSN

SEQ ID NO: 2162947 - protein, 19 aa, Cryptosporidium hominis
SQQHNNGLSGGAAVQGGIS

SEQ ID NO: 2162948 - protein, 4 aa, Cryptosporidium hominis
SQQN

SEQ ID NO: 2162949 - protein, 5 aa, Cryptosporidium hominis
SQQNH

SEQ ID NO: 2162950 - protein, 7 aa, Cryptosporidium hominis
SQQNLRD

SEQ ID NO: 2162951 - protein, 19 aa, Cryptosporidium hominis
SQQNNALQTNFQSNNPSNV

SEQ ID NO: 2162952 - protein, 13 aa, Cryptosporidium hominis
SQQQQHQHHQPMG

SEQ ID NO: 2162953 - protein, 6 aa, Cryptosporidium hominis
SQQTNN

SEQ ID NO: 2162954 - protein, 18 aa, Cryptosporidium hominis
SQRARKSDLIQSILSFQG

SEQ ID NO: 2162955 - protein, 9 aa, Cryptosporidium hominis
SQRATGGTS

SEQ ID NO: 2162956 - protein, 5 aa, Cryptosporidium hominis
SQRGR

SEQ ID NO: 2162957 - protein, 10 aa, Cryptosporidium hominis
SQRIKSAKEA

SEQ ID NO: 2162958 - protein, 7 aa, Cryptosporidium hominis
SQRISDS

SEQ ID NO: 2162959 - protein, 4 aa, Cryptosporidium hominis
SQRK

SEQ ID NO: 2162960 - protein, 25 aa, Cryptosporidium hominis
SQRKEGRSGAGTLESEEGNAVSNSG

SEQ ID NO: 2162961 - protein, 9 aa, Cryptosporidium hominis
SQRKSIDEL

SEQ ID NO: 2162962 - protein, 8 aa, Cryptosporidium hominis
SQRNSSLP

SEQ ID NO: 2162963 - protein, 10 aa, Cryptosporidium hominis
SQRPSISSNG

SEQ ID NO: 2162964 - protein, 16 aa, Cryptosporidium hominis
SQRRTFGGKISFIDIK

SEQ ID NO: 2162965 - protein, 9 aa, Cryptosporidium hominis
SQRSDQNLY

SEQ ID NO: 2162966 - protein, 6 aa, Cryptosporidium hominis
SQRTQR

SEQ ID NO: 2162967 - protein, 20 aa, Cryptosporidium hominis
SQRVEERKRQRSQASSQRKE

SEQ ID NO: 2162968 - protein, 5 aa, Cryptosporidium hominis
SQSDG

SEQ ID NO: 2162969 - protein, 4 aa, Cryptosporidium hominis
SQSF

SEQ ID NO: 2162970 - protein, 12 aa, Cryptosporidium hominis
SQSGVANYDQSK

SEQ ID NO: 2162971 - protein, 9 aa, Cryptosporidium hominis
SQSHNQKMG

SEQ ID NO: 2162972 - protein, 7 aa, Cryptosporidium hominis
SQSMGVQ

SEQ ID NO: 2162973 - protein, 4 aa, Cryptosporidium hominis
SQSN

SEQ ID NO: 2162974 - protein, 9 aa, Cryptosporidium hominis
SQSNVDTSH

SEQ ID NO: 2162975 - protein, 20 aa, Cryptosporidium hominis
SQSPLVSPAVSSKKNRKEVE

SEQ ID NO: 2162976 - protein, 24 aa, Cryptosporidium hominis
SQSPPPGKTLTPSQSSSNESNPIR

SEQ ID NO: 2162977 - protein, 10 aa, Cryptosporidium hominis
SQSQKKSQSK

SEQ ID NO: 2162978 - protein, 13 aa, Cryptosporidium hominis
SQSQNSISSQNSM

SEQ ID NO: 2162979 - protein, 23 aa, Cryptosporidium hominis
SQSQPQSRSHLQSQSLPGPQSQT

SEQ ID NO: 2162980 - protein, 15 aa, Cryptosporidium hominis
SQSQSQSQNHTQGHT

SEQ ID NO: 2162981 - protein, 19 aa, Cryptosporidium hominis
SQSQSQSQSQSQSQNQSQC

SEQ ID NO: 2162982 - protein, 8 aa, Cryptosporidium hominis
SQSQTERL

SEQ ID NO: 2162983 - protein, 4 aa, Cryptosporidium hominis
SQSR

SEQ ID NO: 2162984 - protein, 31 aa, Cryptosporidium hominis
SQSRKKKLTQMSHENGTETATINSKSVNSSQ

SEQ ID NO: 2162985 - protein, 5 aa, Cryptosporidium hominis
SQSRV

SEQ ID NO: 2162986 - protein, 4 aa, Cryptosporidium hominis
SQSS

SEQ ID NO: 2162987 - protein, 21 aa, Cryptosporidium hominis
SQSSGRLENTSNGDKTSISLR

SEQ ID NO: 2162988 - protein, 7 aa, Cryptosporidium hominis
SQSSNIE

SEQ ID NO: 2162989 - protein, 7 aa, Cryptosporidium hominis
SQSSPFN

SEQ ID NO: 2162990 - protein, 20 aa, Cryptosporidium hominis
SQTCSSVNPSIKDEEYSKFT

SEQ ID NO: 2162991 - protein, 7 aa, Cryptosporidium hominis
SQTDSQV

SEQ ID NO: 2162992 - protein, 17 aa, Cryptosporidium hominis
SQTDSVKQNSGITPREY

SEQ ID NO: 2162993 - protein, 4 aa, Cryptosporidium hominis
SQTK

SEQ ID NO: 2162994 - protein, 5 aa, Cryptosporidium hominis
SQTND

SEQ ID NO: 2162995 - protein, 5 aa, Cryptosporidium hominis
SQTNN

SEQ ID NO: 2162996 - protein, 6 aa, Cryptosporidium hominis
SQTNNC

SEQ ID NO: 2162997 - protein, 38 aa, Cryptosporidium hominis
SQTNNDETSSVEAQSYSSDFSNDEDFDINNSNATNTNR

SEQ ID NO: 2162998 - protein, 27 aa, Cryptosporidium hominis
SQTNQTNTIPHSDIGTETSLPQPEDSA

SEQ ID NO: 2162999 - protein, 11 aa, Cryptosporidium hominis
SQTPSNTQEPI

SEQ ID NO: 2163000 - protein, 17 aa, Cryptosporidium hominis
SQTQAQQMYPNSSQNSH

SEQ ID NO: 2163001 - protein, 7 aa, Cryptosporidium hominis
SQTSGVN

SEQ ID NO: 2163002 - protein, 5 aa, Cryptosporidium hominis
SQTVG

SEQ ID NO: 2163003 - protein, 11 aa, Cryptosporidium hominis
SQVEEDLTHPS

SEQ ID NO: 2163004 - protein, 7 aa, Cryptosporidium hominis
SQVGPQM

SEQ ID NO: 2163005 - protein, 4 aa, Cryptosporidium hominis
SQVS

SEQ ID NO: 2163006 - protein, 5 aa, Cryptosporidium hominis
SQVSN

SEQ ID NO: 2163007 - protein, 47 aa, Cryptosporidium hominis
SQVTAEGRHLPNGAVGSSSKRARMAERKAAAAAAAAAAASAAPDAPR

SEQ ID NO: 2163008 - protein, 5 aa, Cryptosporidium hominis
SQVTE

SEQ ID NO: 2163009 - protein, 11 aa, Cryptosporidium hominis
SQVTQNAENSN

SEQ ID NO: 2163010 - protein, 12 aa, Cryptosporidium hominis
SQWPNKDGRFSQ

SEQ ID NO: 2163011 - protein, 4 aa, Cryptosporidium hominis
SQYK

SEQ ID NO: 2163012 - protein, 9 aa, Cryptosporidium hominis
SQYKETQLK

SEQ ID NO: 2163013 - protein, 4 aa, Cryptosporidium hominis
SQYN

SEQ ID NO: 2163014 - protein, 6 aa, Cryptosporidium hominis
SQYPSP

SEQ ID NO: 2163015 - protein, 12 aa, Cryptosporidium hominis
SQYQDGYTKDST

SEQ ID NO: 2163016 - protein, 4 aa, Cryptosporidium hominis
SQYS

SEQ ID NO: 2163017 - protein, 13 aa, Cryptosporidium hominis
SQYSRGVTSNTSS

SEQ ID NO: 2163018 - protein, 6 aa, Cryptosporidium hominis
SRAEST

SEQ ID NO: 2163019 - protein, 4 aa, Cryptosporidium hominis
SRAP

SEQ ID NO: 2163020 - protein, 19 aa, Cryptosporidium hominis
SRARENEANDAHQEKDKKD

SEQ ID NO: 2163021 - protein, 7 aa, Cryptosporidium hominis
SRARRKN

SEQ ID NO: 2163022 - protein, 5 aa, Cryptosporidium hominis
SRASL

SEQ ID NO: 2163023 - protein, 9 aa, Cryptosporidium hominis
SRASQGNYI

SEQ ID NO: 2163024 - protein, 6 aa, Cryptosporidium hominis
SRDELE

SEQ ID NO: 2163025 - protein, 6 aa, Cryptosporidium hominis
SRDGNG

SEQ ID NO: 2163026 - protein, 4 aa, Cryptosporidium hominis
SRDH

SEQ ID NO: 2163027 - protein, 10 aa, Cryptosporidium hominis
SRDKKNLSKN

SEQ ID NO: 2163028 - protein, 14 aa, Cryptosporidium hominis
SRDKLRRSSGVSKE

SEQ ID NO: 2163029 - protein, 8 aa, Cryptosporidium hominis
SRDNFTTT

SEQ ID NO: 2163030 - protein, 9 aa, Cryptosporidium hominis
SRDNNIDKK

SEQ ID NO: 2163031 - protein, 8 aa, Cryptosporidium hominis
SRDPEGTR

SEQ ID NO: 2163032 - protein, 7 aa, Cryptosporidium hominis
SRDRPVK

SEQ ID NO: 2163033 - protein, 5 aa, Cryptosporidium hominis
SRDSL

SEQ ID NO: 2163034 - protein, 7 aa, Cryptosporidium hominis
SREATED

SEQ ID NO: 2163035 - protein, 9 aa, Cryptosporidium hominis
SREEEESRI

SEQ ID NO: 2163036 - protein, 10 aa, Cryptosporidium hominis
SREEGASKNL

SEQ ID NO: 2163037 - protein, 15 aa, Cryptosporidium hominis
SREEKIKYKNEELDT

SEQ ID NO: 2163038 - protein, 8 aa, Cryptosporidium hominis
SREENQIN

SEQ ID NO: 2163039 - protein, 8 aa, Cryptosporidium hominis
SREGELGT

SEQ ID NO: 2163040 - protein, 7 aa, Cryptosporidium hominis
SREKAGN

SEQ ID NO: 2163041 - protein, 8 aa, Cryptosporidium hominis
SREKELYE

SEQ ID NO: 2163042 - protein, 8 aa, Cryptosporidium hominis
SREKNETV

SEQ ID NO: 2163043 - protein, 4 aa, Cryptosporidium hominis
SREP

SEQ ID NO: 2163044 - protein, 8 aa, Cryptosporidium hominis
SREPGNNT

SEQ ID NO: 2163045 - protein, 19 aa, Cryptosporidium hominis
SREPNDNEKSHSSMDKGGG

SEQ ID NO: 2163046 - protein, 10 aa, Cryptosporidium hominis
SREPNSSKEV

SEQ ID NO: 2163047 - protein, 7 aa, Cryptosporidium hominis
SREQDEH

SEQ ID NO: 2163048 - protein, 22 aa, Cryptosporidium hominis
SRETDPSSSEDGNEEDNNSQVK

SEQ ID NO: 2163049 - protein, 4 aa, Cryptosporidium hominis
SREW

SEQ ID NO: 2163050 - protein, 7 aa, Cryptosporidium hominis
SRFESES

SEQ ID NO: 2163051 - protein, 11 aa, Cryptosporidium hominis
SRFNDESDNQQ

SEQ ID NO: 2163052 - protein, 13 aa, Cryptosporidium hominis
SRFPNTTNSNSRY

SEQ ID NO: 2163053 - protein, 15 aa, Cryptosporidium hominis
SRGAGSSGSTGVGDS

SEQ ID NO: 2163054 - protein, 5 aa, Cryptosporidium hominis
SRGAI

SEQ ID NO: 2163055 - protein, 6 aa, Cryptosporidium hominis
SRGAST

SEQ ID NO: 2163056 - protein, 8 aa, Cryptosporidium hominis
SRGEAWDS

SEQ ID NO: 2163057 - protein, 7 aa, Cryptosporidium hominis
SRGEHTV

SEQ ID NO: 2163058 - protein, 6 aa, Cryptosporidium hominis
SRGELG

SEQ ID NO: 2163059 - protein, 10 aa, Cryptosporidium hominis
SRGGAPISSH

SEQ ID NO: 2163060 - protein, 8 aa, Cryptosporidium hominis
SRGGDQQL

SEQ ID NO: 2163061 - protein, 11 aa, Cryptosporidium hominis
SRGINNSGGLN

SEQ ID NO: 2163062 - protein, 9 aa, Cryptosporidium hominis
SRGKETTSI

SEQ ID NO: 2163063 - protein, 13 aa, Cryptosporidium hominis
SRGKLNKGGIPDI

SEQ ID NO: 2163064 - protein, 14 aa, Cryptosporidium hominis
SRGKPDEKFSSNVN

SEQ ID NO: 2163065 - protein, 16 aa, Cryptosporidium hominis
SRGKTSGQLESSSTKK

SEQ ID NO: 2163066 - protein, 8 aa, Cryptosporidium hominis
SRGLRPSG

SEQ ID NO: 2163067 - protein, 4 aa, Cryptosporidium hominis
SRGT

SEQ ID NO: 2163068 - protein, 11 aa, Cryptosporidium hominis
SRGWNAPPLKQ

SEQ ID NO: 2163069 - protein, 18 aa, Cryptosporidium hominis
SRHDQSGRHLKTNGEFGY

SEQ ID NO: 2163070 - protein, 4 aa, Cryptosporidium hominis
SRHP

SEQ ID NO: 2163071 - protein, 10 aa, Cryptosporidium hominis
SRHQGKEKHI

SEQ ID NO: 2163072 - protein, 5 aa, Cryptosporidium hominis
SRHSR

SEQ ID NO: 2163073 - protein, 4 aa, Cryptosporidium hominis
SRID

SEQ ID NO: 2163074 - protein, 6 aa, Cryptosporidium hominis
SRIPSP

SEQ ID NO: 2163075 - protein, 8 aa, Cryptosporidium hominis
SRIRNQGT

SEQ ID NO: 2163076 - protein, 7 aa, Cryptosporidium hominis
SRIRPPA

SEQ ID NO: 2163077 - protein, 5 aa, Cryptosporidium hominis
SRISD

SEQ ID NO: 2163078 - protein, 19 aa, Cryptosporidium hominis
SRISQSHNSETLSGFNNSE

SEQ ID NO: 2163079 - protein, 5 aa, Cryptosporidium hominis
SRIYP

SEQ ID NO: 2163080 - protein, 26 aa, Cryptosporidium hominis
SRKALQKKNKPKNSGNSNNKNISEPS

SEQ ID NO: 2163081 - protein, 20 aa, Cryptosporidium hominis
SRKDYNQDIKADEGKKHENC

SEQ ID NO: 2163082 - protein, 7 aa, Cryptosporidium hominis
SRKEKQI

SEQ ID NO: 2163083 - protein, 7 aa, Cryptosporidium hominis
SRKFQNE

SEQ ID NO: 2163084 - protein, 9 aa, Cryptosporidium hominis
SRKGTKGRM

SEQ ID NO: 2163085 - protein, 60 aa, Cryptosporidium hominis
SRKHKKEAELKDTNSNSSNKESSDLSETQIDQTPKESSNDKNKKSGERKSNQNDNTVSGT

SEQ ID NO: 2163086 - protein, 9 aa, Cryptosporidium hominis
SRKKDGKNS

SEQ ID NO: 2163087 - protein, 9 aa, Cryptosporidium hominis
SRKKDSEIE

SEQ ID NO: 2163088 - protein, 8 aa, Cryptosporidium hominis
SRKKRRQV

SEQ ID NO: 2163089 - protein, 15 aa, Cryptosporidium hominis
SRKKVVSKKDATKNL

SEQ ID NO: 2163090 - protein, 15 aa, Cryptosporidium hominis
SRKNNWKSKNAKEGP

SEQ ID NO: 2163091 - protein, 5 aa, Cryptosporidium hominis
SRKNQ

SEQ ID NO: 2163092 - protein, 10 aa, Cryptosporidium hominis
SRKNQDNSVS

SEQ ID NO: 2163093 - protein, 9 aa, Cryptosporidium hominis
SRKPDGSYK

SEQ ID NO: 2163094 - protein, 7 aa, Cryptosporidium hominis
SRKPPRS

SEQ ID NO: 2163095 - protein, 9 aa, Cryptosporidium hominis
SRKRANNYI

SEQ ID NO: 2163096 - protein, 19 aa, Cryptosporidium hominis
SRKRKQKSSQSQKSDIHSC

SEQ ID NO: 2163097 - protein, 28 aa, Cryptosporidium hominis
SRKSKDTYSVGGDSISSIDSSSSKISRS

SEQ ID NO: 2163098 - protein, 17 aa, Cryptosporidium hominis
SRKSSLSGNNYSSFSDD

SEQ ID NO: 2163099 - protein, 4 aa, Cryptosporidium hominis
SRKV

SEQ ID NO: 2163100 - protein, 4 aa, Cryptosporidium hominis
SRLE

SEQ ID NO: 2163101 - protein, 8 aa, Cryptosporidium hominis
SRLESEIG

SEQ ID NO: 2163102 - protein, 4 aa, Cryptosporidium hominis
SRLK

SEQ ID NO: 2163103 - protein, 17 aa, Cryptosporidium hominis
SRLNGTNKKGGPMPETL

SEQ ID NO: 2163104 - protein, 7 aa, Cryptosporidium hominis
SRLPQVN

SEQ ID NO: 2163105 - protein, 12 aa, Cryptosporidium hominis
SRLSSPKDSRTQ

SEQ ID NO: 2163106 - protein, 11 aa, Cryptosporidium hominis
SRNADDDEEIQ

SEQ ID NO: 2163107 - protein, 25 aa, Cryptosporidium hominis
SRNADRGNHTADHGDDNVTTTSIQT

SEQ ID NO: 2163108 - protein, 9 aa, Cryptosporidium hominis
SRNASDEEI

SEQ ID NO: 2163109 - protein, 4 aa, Cryptosporidium hominis
SRNC

SEQ ID NO: 2163110 - protein, 5 aa, Cryptosporidium hominis
SRNEP

SEQ ID NO: 2163111 - protein, 14 aa, Cryptosporidium hominis
SRNERKFSKYKYET

SEQ ID NO: 2163112 - protein, 4 aa, Cryptosporidium hominis
SRNF

SEQ ID NO: 2163113 - protein, 7 aa, Cryptosporidium hominis
SRNHNES

SEQ ID NO: 2163114 - protein, 10 aa, Cryptosporidium hominis
SRNIASNNAP

SEQ ID NO: 2163115 - protein, 5 aa, Cryptosporidium hominis
SRNIS

SEQ ID NO: 2163116 - protein, 5 aa, Cryptosporidium hominis
SRNKS

SEQ ID NO: 2163117 - protein, 6 aa, Cryptosporidium hominis
SRNLPK

SEQ ID NO: 2163118 - protein, 7 aa, Cryptosporidium hominis
SRNNNAI

SEQ ID NO: 2163119 - protein, 8 aa, Cryptosporidium hominis
SRNPESLQ

SEQ ID NO: 2163120 - protein, 6 aa, Cryptosporidium hominis
SRNPKS

SEQ ID NO: 2163121 - protein, 18 aa, Cryptosporidium hominis
SRNPPLSSKLEEALIENG

SEQ ID NO: 2163122 - protein, 5 aa, Cryptosporidium hominis
SRNPT

SEQ ID NO: 2163123 - protein, 5 aa, Cryptosporidium hominis
SRNQP

SEQ ID NO: 2163124 - protein, 4 aa, Cryptosporidium hominis
SRNR

SEQ ID NO: 2163125 - protein, 21 aa, Cryptosporidium hominis
SRNRETVCSSDSESSDDEDFD

SEQ ID NO: 2163126 - protein, 6 aa, Cryptosporidium hominis
SRNRNP

SEQ ID NO: 2163127 - protein, 62 aa, Cryptosporidium hominis
SRNRRRRRSVSSSRSSSEVSSSSEYERRDRNYERGRGRDRDRYKRSRRNYSSDESSPERAYR

SEQ ID NO: 2163128 - protein, 5 aa, Cryptosporidium hominis
SRNSA

SEQ ID NO: 2163129 - protein, 8 aa, Cryptosporidium hominis
SRNSEKIP

SEQ ID NO: 2163130 - protein, 11 aa, Cryptosporidium hominis
SRNSNYSNNNT

SEQ ID NO: 2163131 - protein, 10 aa, Cryptosporidium hominis
SRNSQQDRKI

SEQ ID NO: 2163132 - protein, 9 aa, Cryptosporidium hominis
SRNSSISYK

SEQ ID NO: 2163133 - protein, 20 aa, Cryptosporidium hominis
SRNSSKIENSLDKRKDKLGF

SEQ ID NO: 2163134 - protein, 14 aa, Cryptosporidium hominis
SRNSSSSIKPPSAL

SEQ ID NO: 2163135 - protein, 4 aa, Cryptosporidium hominis
SRPE

SEQ ID NO: 2163136 - protein, 8 aa, Cryptosporidium hominis
SRPEEASK

SEQ ID NO: 2163137 - protein, 8 aa, Cryptosporidium hominis
SRPEKISA

SEQ ID NO: 2163138 - protein, 7 aa, Cryptosporidium hominis
SRPGQCG

SEQ ID NO: 2163139 - protein, 6 aa, Cryptosporidium hominis
SRPKCG

SEQ ID NO: 2163140 - protein, 10 aa, Cryptosporidium hominis
SRPKSSEGGV

SEQ ID NO: 2163141 - protein, 4 aa, Cryptosporidium hominis
SRPL

SEQ ID NO: 2163142 - protein, 7 aa, Cryptosporidium hominis
SRPMSPN

SEQ ID NO: 2163143 - protein, 6 aa, Cryptosporidium hominis
SRPQSE

SEQ ID NO: 2163144 - protein, 13 aa, Cryptosporidium hominis
SRPQVSSSSTQVA

SEQ ID NO: 2163145 - protein, 43 aa, Cryptosporidium hominis
SRPRSVSRSRSRPRSGSATNESPINERTRNNLRNKTKTPPDKR

SEQ ID NO: 2163146 - protein, 7 aa, Cryptosporidium hominis
SRPSDLA

SEQ ID NO: 2163147 - protein, 18 aa, Cryptosporidium hominis
SRPSIKYQSSVRRKNNSR

SEQ ID NO: 2163148 - protein, 11 aa, Cryptosporidium hominis
SRPSVEEREGV

SEQ ID NO: 2163149 - protein, 8 aa, Cryptosporidium hominis
SRPTDGSP

SEQ ID NO: 2163150 - protein, 10 aa, Cryptosporidium hominis
SRPTNDSSAD

SEQ ID NO: 2163151 - protein, 15 aa, Cryptosporidium hominis
SRPTRKTFESLKSTE

SEQ ID NO: 2163152 - protein, 9 aa, Cryptosporidium hominis
SRQEEEDSE

SEQ ID NO: 2163153 - protein, 15 aa, Cryptosporidium hominis
SRQELTKSSSISDNC

SEQ ID NO: 2163154 - protein, 11 aa, Cryptosporidium hominis
SRQNPEDPNIT

SEQ ID NO: 2163155 - protein, 39 aa, Cryptosporidium hominis
SRQSNENLAKRSSISRSGTGIKLSEDQSSNANSNTINRP

SEQ ID NO: 2163156 - protein, 13 aa, Cryptosporidium hominis
SRQWGNQKVTKKN

SEQ ID NO: 2163157 - protein, 10 aa, Cryptosporidium hominis
SRRDEDPKKL

SEQ ID NO: 2163158 - protein, 7 aa, Cryptosporidium hominis
SRRDEEI

SEQ ID NO: 2163159 - protein, 17 aa, Cryptosporidium hominis
SRRDETANQRSHPYSPT

SEQ ID NO: 2163160 - protein, 6 aa, Cryptosporidium hominis
SRRDSI

SEQ ID NO: 2163161 - protein, 20 aa, Cryptosporidium hominis
SRRGCEPEVDGDNKENDSKL

SEQ ID NO: 2163162 - protein, 7 aa, Cryptosporidium hominis
SRRKIKR

SEQ ID NO: 2163163 - protein, 21 aa, Cryptosporidium hominis
SRRNTKSMHQNSSSMEINLNK

SEQ ID NO: 2163164 - protein, 6 aa, Cryptosporidium hominis
SRRPRG

SEQ ID NO: 2163165 - protein, 16 aa, Cryptosporidium hominis
SRRQTLPEKLENERNY

SEQ ID NO: 2163166 - protein, 4 aa, Cryptosporidium hominis
SRRS

SEQ ID NO: 2163167 - protein, 9 aa, Cryptosporidium hominis
SRRSAQNLG

SEQ ID NO: 2163168 - protein, 18 aa, Cryptosporidium hominis
SRRSRNSRWRGASEDNFN

SEQ ID NO: 2163169 - protein, 15 aa, Cryptosporidium hominis
SRRTKTIRKSKGHDV

SEQ ID NO: 2163170 - protein, 28 aa, Cryptosporidium hominis
SRRYEKDSIEINKNKELRRKQNNKRGNF

SEQ ID NO: 2163171 - protein, 13 aa, Cryptosporidium hominis
SRSCESTELENES

SEQ ID NO: 2163172 - protein, 9 aa, Cryptosporidium hominis
SRSENSLKL

SEQ ID NO: 2163173 - protein, 9 aa, Cryptosporidium hominis
SRSGFGGNY

SEQ ID NO: 2163174 - protein, 6 aa, Cryptosporidium hominis
SRSIDT

SEQ ID NO: 2163175 - protein, 5 aa, Cryptosporidium hominis
SRSKE

SEQ ID NO: 2163176 - protein, 9 aa, Cryptosporidium hominis
SRSKEDKIG

SEQ ID NO: 2163177 - protein, 8 aa, Cryptosporidium hominis
SRSLASSR

SEQ ID NO: 2163178 - protein, 18 aa, Cryptosporidium hominis
SRSLNGAGFNSSSDVTSK

SEQ ID NO: 2163179 - protein, 13 aa, Cryptosporidium hominis
SRSNEDKKPTLKH

SEQ ID NO: 2163180 - protein, 8 aa, Cryptosporidium hominis
SRSNITEQ

SEQ ID NO: 2163181 - protein, 8 aa, Cryptosporidium hominis
SRSNKSSL

SEQ ID NO: 2163182 - protein, 5 aa, Cryptosporidium hominis
SRSNV

SEQ ID NO: 2163183 - protein, 9 aa, Cryptosporidium hominis
SRSPGNIPD

SEQ ID NO: 2163184 - protein, 27 aa, Cryptosporidium hominis
SRSPRRDPYDRRERSHHYPDDRYRRGY

SEQ ID NO: 2163185 - protein, 18 aa, Cryptosporidium hominis
SRSPRVVSQNGEGEGRAG

SEQ ID NO: 2163186 - protein, 8 aa, Cryptosporidium hominis
SRSPSLEK

SEQ ID NO: 2163187 - protein, 7 aa, Cryptosporidium hominis
SRSQKEE

SEQ ID NO: 2163188 - protein, 7 aa, Cryptosporidium hominis
SRSRKIE

SEQ ID NO: 2163189 - protein, 89 aa, Cryptosporidium hominis
SRSRSRSRSRSRSRSRSRSRSRSRSRSRSRSRSRSRSRSRSRSSSRSRSSSRSRSRSRSNSRSRSSLTAPVSRHSSSGYLEKTGGRYTS

SEQ ID NO: 2163190 - protein, 4 aa, Cryptosporidium hominis
SRSS

SEQ ID NO: 2163191 - protein, 10 aa, Cryptosporidium hominis
SRSSAIISPT

SEQ ID NO: 2163192 - protein, 10 aa, Cryptosporidium hominis
SRSSKQTRKR

SEQ ID NO: 2163193 - protein, 5 aa, Cryptosporidium hominis
SRSSQ

SEQ ID NO: 2163194 - protein, 22 aa, Cryptosporidium hominis
SRSYTDSNNNSYLQETETFRSG

SEQ ID NO: 2163195 - protein, 6 aa, Cryptosporidium hominis
SRTDPQ

SEQ ID NO: 2163196 - protein, 23 aa, Cryptosporidium hominis
SRTDTAKSLQEKQKNQCKRHKNK

SEQ ID NO: 2163197 - protein, 6 aa, Cryptosporidium hominis
SRTEIK

SEQ ID NO: 2163198 - protein, 5 aa, Cryptosporidium hominis
SRTEK

SEQ ID NO: 2163199 - protein, 10 aa, Cryptosporidium hominis
SRTGSSEPTL

SEQ ID NO: 2163200 - protein, 5 aa, Cryptosporidium hominis
SRTGY

SEQ ID NO: 2163201 - protein, 6 aa, Cryptosporidium hominis
SRTIGT

SEQ ID NO: 2163202 - protein, 10 aa, Cryptosporidium hominis
SRTKNRKRNI

SEQ ID NO: 2163203 - protein, 31 aa, Cryptosporidium hominis
SRTPTSLPVSSSPSPMPSSEAPTSRFPSSGC

SEQ ID NO: 2163204 - protein, 6 aa, Cryptosporidium hominis
SRTQAA

SEQ ID NO: 2163205 - protein, 9 aa, Cryptosporidium hominis
SRTQNENFQ

SEQ ID NO: 2163206 - protein, 20 aa, Cryptosporidium hominis
SRTRGNQNQTESSSDKAFTG

SEQ ID NO: 2163207 - protein, 5 aa, Cryptosporidium hominis
SRTRL

SEQ ID NO: 2163208 - protein, 23 aa, Cryptosporidium hominis
SRTRSISRSKSWDVTSPNMTKKT

SEQ ID NO: 2163209 - protein, 6 aa, Cryptosporidium hominis
SRTSHQ

SEQ ID NO: 2163210 - protein, 7 aa, Cryptosporidium hominis
SRTTRHE

SEQ ID NO: 2163211 - protein, 5 aa, Cryptosporidium hominis
SRTVT

SEQ ID NO: 2163212 - protein, 10 aa, Cryptosporidium hominis
SRVNNSSPHY

SEQ ID NO: 2163213 - protein, 7 aa, Cryptosporidium hominis
SRVPEPI

SEQ ID NO: 2163214 - protein, 5 aa, Cryptosporidium hominis
SRVPI

SEQ ID NO: 2163215 - protein, 5 aa, Cryptosporidium hominis
SRVTS

SEQ ID NO: 2163216 - protein, 5 aa, Cryptosporidium hominis
SRYER

SEQ ID NO: 2163217 - protein, 8 aa, Cryptosporidium hominis
SRYGGPSL

SEQ ID NO: 2163218 - protein, 11 aa, Cryptosporidium hominis
SRYNKNSKKSI

SEQ ID NO: 2163219 - protein, 32 aa, Cryptosporidium hominis
SRYPRPDDYHSSRYHSPPRYSRADPYDSRYSR

SEQ ID NO: 2163220 - protein, 12 aa, Cryptosporidium hominis
SRYRPDQRAYEN

SEQ ID NO: 2163221 - protein, 4 aa, Cryptosporidium hominis
SSAA

SEQ ID NO: 2163222 - protein, 7 aa, Cryptosporidium hominis
SSADGSF

SEQ ID NO: 2163223 - protein, 17 aa, Cryptosporidium hominis
SSAENTANEFDQYPRES

SEQ ID NO: 2163224 - protein, 4 aa, Cryptosporidium hominis
SSAF

SEQ ID NO: 2163225 - protein, 7 aa, Cryptosporidium hominis
SSAGGMN

SEQ ID NO: 2163226 - protein, 5 aa, Cryptosporidium hominis
SSAHL

SEQ ID NO: 2163227 - protein, 13 aa, Cryptosporidium hominis
SSAIESPEKGAFN

SEQ ID NO: 2163228 - protein, 4 aa, Cryptosporidium hominis
SSAK

SEQ ID NO: 2163229 - protein, 18 aa, Cryptosporidium hominis
SSAKHRGKNYDCEDNDGV

SEQ ID NO: 2163230 - protein, 9 aa, Cryptosporidium hominis
SSAKNSTNV

SEQ ID NO: 2163231 - protein, 12 aa, Cryptosporidium hominis
SSALKGSDTGID

SEQ ID NO: 2163232 - protein, 9 aa, Cryptosporidium hominis
SSALPGYPN

SEQ ID NO: 2163233 - protein, 4 aa, Cryptosporidium hominis
SSAN

SEQ ID NO: 2163234 - protein, 7 aa, Cryptosporidium hominis
SSANRNY

SEQ ID NO: 2163235 - protein, 15 aa, Cryptosporidium hominis
SSASATHGSAGQIPG

SEQ ID NO: 2163236 - protein, 7 aa, Cryptosporidium hominis
SSASLGF

SEQ ID NO: 2163237 - protein, 13 aa, Cryptosporidium hominis
SSASNLDEKIMEK

SEQ ID NO: 2163238 - protein, 27 aa, Cryptosporidium hominis
SSASPNENESKNISNKAQSGVTQHPSN

SEQ ID NO: 2163239 - protein, 7 aa, Cryptosporidium hominis
SSASRPC

SEQ ID NO: 2163240 - protein, 5 aa, Cryptosporidium hominis
SSATP

SEQ ID NO: 2163241 - protein, 8 aa, Cryptosporidium hominis
SSATQEKN

SEQ ID NO: 2163242 - protein, 5 aa, Cryptosporidium hominis
SSATS

SEQ ID NO: 2163243 - protein, 7 aa, Cryptosporidium hominis
SSCKSAS

SEQ ID NO: 2163244 - protein, 4 aa, Cryptosporidium hominis
SSCS

SEQ ID NO: 2163245 - protein, 5 aa, Cryptosporidium hominis
SSCTD

SEQ ID NO: 2163246 - protein, 5 aa, Cryptosporidium hominis
SSDAD

SEQ ID NO: 2163247 - protein, 19 aa, Cryptosporidium hominis
SSDAIKYDNSEKNSSDGCE

SEQ ID NO: 2163248 - protein, 7 aa, Cryptosporidium hominis
SSDDESI

SEQ ID NO: 2163249 - protein, 7 aa, Cryptosporidium hominis
SSDDSNM

SEQ ID NO: 2163250 - protein, 59 aa, Cryptosporidium hominis
SSDEDEEEDLKSPVSRRKKDVKVKAEKESSPKRSKSSSSKSNLNTKTDKISSNSQNDEE

SEQ ID NO: 2163251 - protein, 8 aa, Cryptosporidium hominis
SSDEGRCQ

SEQ ID NO: 2163252 - protein, 12 aa, Cryptosporidium hominis
SSDFDSDEVNAE

SEQ ID NO: 2163253 - protein, 27 aa, Cryptosporidium hominis
SSDFGNNARPTGNMNRRSRTCSSTEIK

SEQ ID NO: 2163254 - protein, 9 aa, Cryptosporidium hominis
SSDFKDTTL

SEQ ID NO: 2163255 - protein, 4 aa, Cryptosporidium hominis
SSDG

SEQ ID NO: 2163256 - protein, 9 aa, Cryptosporidium hominis
SSDGGDSIA

SEQ ID NO: 2163257 - protein, 11 aa, Cryptosporidium hominis
SSDGSEDFGPD

SEQ ID NO: 2163258 - protein, 6 aa, Cryptosporidium hominis
SSDGTI

SEQ ID NO: 2163259 - protein, 10 aa, Cryptosporidium hominis
SSDGTLRKNP

SEQ ID NO: 2163260 - protein, 5 aa, Cryptosporidium hominis
SSDIK

SEQ ID NO: 2163261 - protein, 7 aa, Cryptosporidium hominis
SSDKDKL

SEQ ID NO: 2163262 - protein, 13 aa, Cryptosporidium hominis
SSDKIYSSNRDEA

SEQ ID NO: 2163263 - protein, 5 aa, Cryptosporidium hominis
SSDKQ

SEQ ID NO: 2163264 - protein, 9 aa, Cryptosporidium hominis
SSDLESSAV

SEQ ID NO: 2163265 - protein, 5 aa, Cryptosporidium hominis
SSDLV

SEQ ID NO: 2163266 - protein, 6 aa, Cryptosporidium hominis
SSDNIG

SEQ ID NO: 2163267 - protein, 9 aa, Cryptosporidium hominis
SSDNLENEI

SEQ ID NO: 2163268 - protein, 9 aa, Cryptosporidium hominis
SSDNNKPQV

SEQ ID NO: 2163269 - protein, 6 aa, Cryptosporidium hominis
SSDNSV

SEQ ID NO: 2163270 - protein, 7 aa, Cryptosporidium hominis
SSDPTFK

SEQ ID NO: 2163271 - protein, 7 aa, Cryptosporidium hominis
SSDQKTK

SEQ ID NO: 2163272 - protein, 16 aa, Cryptosporidium hominis
SSDRDSNKNNQQTSIL

SEQ ID NO: 2163273 - protein, 4 aa, Cryptosporidium hominis
SSDS

SEQ ID NO: 2163274 - protein, 9 aa, Cryptosporidium hominis
SSDSATNSI

SEQ ID NO: 2163275 - protein, 7 aa, Cryptosporidium hominis
SSDSIQS

SEQ ID NO: 2163276 - protein, 8 aa, Cryptosporidium hominis
SSDSKIEK

SEQ ID NO: 2163277 - protein, 16 aa, Cryptosporidium hominis
SSDSSIESKLGDISSN

SEQ ID NO: 2163278 - protein, 11 aa, Cryptosporidium hominis
SSDSSQRATNF

SEQ ID NO: 2163279 - protein, 262 aa, Cryptosporidium hominis
SSDSSSSSEDEQPKKNTKPATSTTPKKTMSDSSSSSSDSSSSSEDEQPKKNTKTAAPTPAKKAMSDSSSSSSDSSSSSEDEQPKKNSKAAAPMKKNISNSSSSSSSSDSDSSSEDEQPKKNAKAATPMKKNISNSSLDSSSSSDSSSSEDEKPKKNTKATTSTTAKKTMSDSSSSDSSSSSDSDSDNEKAKKVSKAVKSSNSSSESEVEMNKSKRKAESELNNNKDNKITKNDTPKRSYQGNDDNSQPRKRQNTNNKDSREV

SEQ ID NO: 2163280 - protein, 8 aa, Cryptosporidium hominis
SSDTQRTI

SEQ ID NO: 2163281 - protein, 38 aa, Cryptosporidium hominis
SSDTRQIKKPKHAFGEDGEDLATPKSNNVKEEQDMSDD

SEQ ID NO: 2163282 - protein, 6 aa, Cryptosporidium hominis
SSDTVD

SEQ ID NO: 2163283 - protein, 5 aa, Cryptosporidium hominis
SSDVL

SEQ ID NO: 2163284 - protein, 5 aa, Cryptosporidium hominis
SSDYK

SEQ ID NO: 2163285 - protein, 20 aa, Cryptosporidium hominis
SSDYSNIRKTHANSAIGAGF

SEQ ID NO: 2163286 - protein, 6 aa, Cryptosporidium hominis
SSDYTE

SEQ ID NO: 2163287 - protein, 7 aa, Cryptosporidium hominis
SSEADEN

SEQ ID NO: 2163288 - protein, 20 aa, Cryptosporidium hominis
SSEAENNFPTSSTTSKNNYN

SEQ ID NO: 2163289 - protein, 6 aa, Cryptosporidium hominis
SSEAYT

SEQ ID NO: 2163290 - protein, 11 aa, Cryptosporidium hominis
SSEDEENEDYD

SEQ ID NO: 2163291 - protein, 22 aa, Cryptosporidium hominis
SSEDENNITDDDEGVYNRPNRK

SEQ ID NO: 2163292 - protein, 7 aa, Cryptosporidium hominis
SSEDGTQ

SEQ ID NO: 2163293 - protein, 10 aa, Cryptosporidium hominis
SSEDSKIRNS

SEQ ID NO: 2163294 - protein, 8 aa, Cryptosporidium hominis
SSEEECHD

SEQ ID NO: 2163295 - protein, 19 aa, Cryptosporidium hominis
SSEEENSKKQNDSNNKKLE

SEQ ID NO: 2163296 - protein, 8 aa, Cryptosporidium hominis
SSEEEYPD

SEQ ID NO: 2163297 - protein, 8 aa, Cryptosporidium hominis
SSEERGIG

SEQ ID NO: 2163298 - protein, 24 aa, Cryptosporidium hominis
SSEERYKQQSSLNTKKKYKPIKCG

SEQ ID NO: 2163299 - protein, 5 aa, Cryptosporidium hominis
SSEEV

SEQ ID NO: 2163300 - protein, 15 aa, Cryptosporidium hominis
SSEFSENGSLSPNTI

SEQ ID NO: 2163301 - protein, 6 aa, Cryptosporidium hominis
SSEFSP

SEQ ID NO: 2163302 - protein, 10 aa, Cryptosporidium hominis
SSEGNGELDV

SEQ ID NO: 2163303 - protein, 30 aa, Cryptosporidium hominis
SSEHQAQGQGQGQGQGQGQIQNENKIPSGP

SEQ ID NO: 2163304 - protein, 12 aa, Cryptosporidium hominis
SSEIARTEATRA

SEQ ID NO: 2163305 - protein, 7 aa, Cryptosporidium hominis
SSEIGKN

SEQ ID NO: 2163306 - protein, 10 aa, Cryptosporidium hominis
SSEISSKRNT

SEQ ID NO: 2163307 - protein, 4 aa, Cryptosporidium hominis
SSEK

SEQ ID NO: 2163308 - protein, 11 aa, Cryptosporidium hominis
SSEKEDNKADN

SEQ ID NO: 2163309 - protein, 10 aa, Cryptosporidium hominis
SSEKNDGFPV

SEQ ID NO: 2163310 - protein, 7 aa, Cryptosporidium hominis
SSEKQEM

SEQ ID NO: 2163311 - protein, 15 aa, Cryptosporidium hominis
SSEKSKKISQKREEM

SEQ ID NO: 2163312 - protein, 13 aa, Cryptosporidium hominis
SSEKTSSSAPIQG

SEQ ID NO: 2163313 - protein, 13 aa, Cryptosporidium hominis
SSELISNSKKVSQ

SEQ ID NO: 2163314 - protein, 10 aa, Cryptosporidium hominis
SSELNKTSND

SEQ ID NO: 2163315 - protein, 17 aa, Cryptosporidium hominis
SSELSNDQDEANSYGNF

SEQ ID NO: 2163316 - protein, 11 aa, Cryptosporidium hominis
SSELSTPSTQL

SEQ ID NO: 2163317 - protein, 8 aa, Cryptosporidium hominis
SSEMNSDS

SEQ ID NO: 2163318 - protein, 10 aa, Cryptosporidium hominis
SSENESSESR

SEQ ID NO: 2163319 - protein, 19 aa, Cryptosporidium hominis
SSENIERNSVSNTPNNNRI

SEQ ID NO: 2163320 - protein, 44 aa, Cryptosporidium hominis
SSENIRPSDQNDFKSVGGKSLSQIDASSINGGTGFGTSSQPEWD

SEQ ID NO: 2163321 - protein, 13 aa, Cryptosporidium hominis
SSENSEDGNIPIT

SEQ ID NO: 2163322 - protein, 9 aa, Cryptosporidium hominis
SSENSSNLA

SEQ ID NO: 2163323 - protein, 8 aa, Cryptosporidium hominis
SSEPSPIE

SEQ ID NO: 2163324 - protein, 9 aa, Cryptosporidium hominis
SSEQESKTI

SEQ ID NO: 2163325 - protein, 14 aa, Cryptosporidium hominis
SSERKESNNKVKEN

SEQ ID NO: 2163326 - protein, 11 aa, Cryptosporidium hominis
SSERKRRREEH

SEQ ID NO: 2163327 - protein, 20 aa, Cryptosporidium hominis
SSERQLKTHSNSDRRESESV

SEQ ID NO: 2163328 - protein, 40 aa, Cryptosporidium hominis
SSERSDKELDQERVSDGDVENEKNTVYPPLKKNNNKNDEN

SEQ ID NO: 2163329 - protein, 12 aa, Cryptosporidium hominis
SSESKDNKNYLN

SEQ ID NO: 2163330 - protein, 15 aa, Cryptosporidium hominis
SSETNKDFDNEGKFE

SEQ ID NO: 2163331 - protein, 9 aa, Cryptosporidium hominis
SSETPTISD

SEQ ID NO: 2163332 - protein, 6 aa, Cryptosporidium hominis
SSETSV

SEQ ID NO: 2163333 - protein, 4 aa, Cryptosporidium hominis
SSEV

SEQ ID NO: 2163334 - protein, 17 aa, Cryptosporidium hominis
SSEYKRDQQSCKFFQRR

SEQ ID NO: 2163335 - protein, 5 aa, Cryptosporidium hominis
SSEYS

SEQ ID NO: 2163336 - protein, 17 aa, Cryptosporidium hominis
SSEYSEVNKNPSLSQIE

SEQ ID NO: 2163337 - protein, 18 aa, Cryptosporidium hominis
SSFDDDVSLDDDDNETIA

SEQ ID NO: 2163338 - protein, 6 aa, Cryptosporidium hominis
SSFDPM

SEQ ID NO: 2163339 - protein, 11 aa, Cryptosporidium hominis
SSFGKNSNAFA

SEQ ID NO: 2163340 - protein, 6 aa, Cryptosporidium hominis
SSFGPT

SEQ ID NO: 2163341 - protein, 58 aa, Cryptosporidium hominis
SSFKGGGFNSSKASRSSSNSSYDRRRYAPAKTNTRQKFKSSSRSMSKSSSEYGCRSES

SEQ ID NO: 2163342 - protein, 25 aa, Cryptosporidium hominis
SSFKSNNKADVKTRVSDKSDKIMND

SEQ ID NO: 2163343 - protein, 15 aa, Cryptosporidium hominis
SSFNSNIDSNIPSAP

SEQ ID NO: 2163344 - protein, 5 aa, Cryptosporidium hominis
SSFPG

SEQ ID NO: 2163345 - protein, 5 aa, Cryptosporidium hominis
SSFPS

SEQ ID NO: 2163346 - protein, 7 aa, Cryptosporidium hominis
SSFQNSK

SEQ ID NO: 2163347 - protein, 4 aa, Cryptosporidium hominis
SSFS

SEQ ID NO: 2163348 - protein, 6 aa, Cryptosporidium hominis
SSFSEG

SEQ ID NO: 2163349 - protein, 6 aa, Cryptosporidium hominis
SSFSNE

SEQ ID NO: 2163350 - protein, 7 aa, Cryptosporidium hominis
SSFSPVG

SEQ ID NO: 2163351 - protein, 17 aa, Cryptosporidium hominis
SSFTGGFGSNASSSNGL

SEQ ID NO: 2163352 - protein, 6 aa, Cryptosporidium hominis
SSFTQR

SEQ ID NO: 2163353 - protein, 13 aa, Cryptosporidium hominis
SSFTSGGGTGMGP

SEQ ID NO: 2163354 - protein, 17 aa, Cryptosporidium hominis
SSFYTAPDYDSNNSIDR

SEQ ID NO: 2163355 - protein, 4 aa, Cryptosporidium hominis
SSGA

SEQ ID NO: 2163356 - protein, 9 aa, Cryptosporidium hominis
SSGDSSKDF

SEQ ID NO: 2163357 - protein, 7 aa, Cryptosporidium hominis
SSGDTKV

SEQ ID NO: 2163358 - protein, 4 aa, Cryptosporidium hominis
SSGE

SEQ ID NO: 2163359 - protein, 6 aa, Cryptosporidium hominis
SSGEEG

SEQ ID NO: 2163360 - protein, 6 aa, Cryptosporidium hominis
SSGEKG

SEQ ID NO: 2163361 - protein, 4 aa, Cryptosporidium hominis
SSGG

SEQ ID NO: 2163362 - protein, 10 aa, Cryptosporidium hominis
SSGGKDSNIS

SEQ ID NO: 2163363 - protein, 8 aa, Cryptosporidium hominis
SSGGRNCS

SEQ ID NO: 2163364 - protein, 5 aa, Cryptosporidium hominis
SSGHS

SEQ ID NO: 2163365 - protein, 11 aa, Cryptosporidium hominis
SSGIETTTPTE

SEQ ID NO: 2163366 - protein, 7 aa, Cryptosporidium hominis
SSGISDG

SEQ ID NO: 2163367 - protein, 8 aa, Cryptosporidium hominis
SSGKQIQT

SEQ ID NO: 2163368 - protein, 8 aa, Cryptosporidium hominis
SSGLRSSC

SEQ ID NO: 2163369 - protein, 27 aa, Cryptosporidium hominis
SSGNNSNNDNNNSNITNNNSNNNGPKY

SEQ ID NO: 2163370 - protein, 7 aa, Cryptosporidium hominis
SSGNSSL

SEQ ID NO: 2163371 - protein, 7 aa, Cryptosporidium hominis
SSGNTAI

SEQ ID NO: 2163372 - protein, 15 aa, Cryptosporidium hominis
SSGPPFGSANAKDLN

SEQ ID NO: 2163373 - protein, 7 aa, Cryptosporidium hominis
SSGPPNW

SEQ ID NO: 2163374 - protein, 7 aa, Cryptosporidium hominis
SSGPYSI

SEQ ID NO: 2163375 - protein, 5 aa, Cryptosporidium hominis
SSGQH

SEQ ID NO: 2163376 - protein, 5 aa, Cryptosporidium hominis
SSGQM

SEQ ID NO: 2163377 - protein, 9 aa, Cryptosporidium hominis
SSGQPVSSL

SEQ ID NO: 2163378 - protein, 6 aa, Cryptosporidium hominis
SSGQTN

SEQ ID NO: 2163379 - protein, 9 aa, Cryptosporidium hominis
SSGRSRVTI

SEQ ID NO: 2163380 - protein, 7 aa, Cryptosporidium hominis
SSGRTTG

SEQ ID NO: 2163381 - protein, 4 aa, Cryptosporidium hominis
SSGS

SEQ ID NO: 2163382 - protein, 13 aa, Cryptosporidium hominis
SSGSACTSASLEP

SEQ ID NO: 2163383 - protein, 9 aa, Cryptosporidium hominis
SSGSGKSTL

SEQ ID NO: 2163384 - protein, 33 aa, Cryptosporidium hominis
SSGSGSGGAGGNIGGGSSQMQNPNMNNPSSAKA

SEQ ID NO: 2163385 - protein, 28 aa, Cryptosporidium hominis
SSGSSSTGSSRTSHHSRSSGSSDSISEF

SEQ ID NO: 2163386 - protein, 5 aa, Cryptosporidium hominis
SSGST

SEQ ID NO: 2163387 - protein, 16 aa, Cryptosporidium hominis
SSGSYSEFEPSSNEGF

SEQ ID NO: 2163388 - protein, 15 aa, Cryptosporidium hominis
SSGTAVSGRTNDRFD

SEQ ID NO: 2163389 - protein, 7 aa, Cryptosporidium hominis
SSGTGKT

SEQ ID NO: 2163390 - protein, 6 aa, Cryptosporidium hominis
SSGTKQ

SEQ ID NO: 2163391 - protein, 9 aa, Cryptosporidium hominis
SSGTSNHHG

SEQ ID NO: 2163392 - protein, 18 aa, Cryptosporidium hominis
SSGVSTTINDSEKREVSA

SEQ ID NO: 2163393 - protein, 16 aa, Cryptosporidium hominis
SSGYYSSNNNQKSSST

SEQ ID NO: 2163394 - protein, 5 aa, Cryptosporidium hominis
SSHEN

SEQ ID NO: 2163395 - protein, 4 aa, Cryptosporidium hominis
SSHF

SEQ ID NO: 2163396 - protein, 5 aa, Cryptosporidium hominis
SSHGG

SEQ ID NO: 2163397 - protein, 10 aa, Cryptosporidium hominis
SSHGTKGGCE

SEQ ID NO: 2163398 - protein, 4 aa, Cryptosporidium hominis
SSHN

SEQ ID NO: 2163399 - protein, 8 aa, Cryptosporidium hominis
SSHNGKNN

SEQ ID NO: 2163400 - protein, 5 aa, Cryptosporidium hominis
SSHPD

SEQ ID NO: 2163401 - protein, 24 aa, Cryptosporidium hominis
SSHPQSPPVSPSDSSNLSSPLTSS

SEQ ID NO: 2163402 - protein, 5 aa, Cryptosporidium hominis
SSHQK

SEQ ID NO: 2163403 - protein, 7 aa, Cryptosporidium hominis
SSHSINE

SEQ ID NO: 2163404 - protein, 7 aa, Cryptosporidium hominis
SSHSISK

SEQ ID NO: 2163405 - protein, 10 aa, Cryptosporidium hominis
SSHSKSSNQS

SEQ ID NO: 2163406 - protein, 8 aa, Cryptosporidium hominis
SSHSNNSL

SEQ ID NO: 2163407 - protein, 15 aa, Cryptosporidium hominis
SSHSTNNPNNKSSIS

SEQ ID NO: 2163408 - protein, 6 aa, Cryptosporidium hominis
SSIDLE

SEQ ID NO: 2163409 - protein, 21 aa, Cryptosporidium hominis
SSIDQAKISKSPKSPNPKNIS

SEQ ID NO: 2163410 - protein, 7 aa, Cryptosporidium hominis
SSIDQED

SEQ ID NO: 2163411 - protein, 4 aa, Cryptosporidium hominis
SSIE

SEQ ID NO: 2163412 - protein, 5 aa, Cryptosporidium hominis
SSIET

SEQ ID NO: 2163413 - protein, 57 aa, Cryptosporidium hominis
SSIGESGNNNVTNNNNNNNNNGNNNNNSINNNNINNNNNNNNNNNNNNNNNNNNNCN

SEQ ID NO: 2163414 - protein, 5 aa, Cryptosporidium hominis
SSIKN

SEQ ID NO: 2163415 - protein, 15 aa, Cryptosporidium hominis
SSINASNSASESSFT

SEQ ID NO: 2163416 - protein, 10 aa, Cryptosporidium hominis
SSINKGNDDV

SEQ ID NO: 2163417 - protein, 6 aa, Cryptosporidium hominis
SSINNM

SEQ ID NO: 2163418 - protein, 29 aa, Cryptosporidium hominis
SSINNSNSNNNNNNNNINNINNSNNGNNM

SEQ ID NO: 2163419 - protein, 14 aa, Cryptosporidium hominis
SSIPAQKKRPLIGE

SEQ ID NO: 2163420 - protein, 6 aa, Cryptosporidium hominis
SSIPRY

SEQ ID NO: 2163421 - protein, 8 aa, Cryptosporidium hominis
SSIQDSQE

SEQ ID NO: 2163422 - protein, 11 aa, Cryptosporidium hominis
SSIQETKTAKE

SEQ ID NO: 2163423 - protein, 6 aa, Cryptosporidium hominis
SSIQGG

SEQ ID NO: 2163424 - protein, 12 aa, Cryptosporidium hominis
SSIQNNKRAEEL

SEQ ID NO: 2163425 - protein, 12 aa, Cryptosporidium hominis
SSIQPGSVEAEN

SEQ ID NO: 2163426 - protein, 12 aa, Cryptosporidium hominis
SSIRDSSRRSTY

SEQ ID NO: 2163427 - protein, 17 aa, Cryptosporidium hominis
SSISDSGLATNPGFGPG

SEQ ID NO: 2163428 - protein, 5 aa, Cryptosporidium hominis
SSISK

SEQ ID NO: 2163429 - protein, 6 aa, Cryptosporidium hominis
SSISNL

SEQ ID NO: 2163430 - protein, 8 aa, Cryptosporidium hominis
SSISNQYN

SEQ ID NO: 2163431 - protein, 6 aa, Cryptosporidium hominis
SSISQA

SEQ ID NO: 2163432 - protein, 13 aa, Cryptosporidium hominis
SSISSPSLYSNRE

SEQ ID NO: 2163433 - protein, 4 aa, Cryptosporidium hominis
SSIT

SEQ ID NO: 2163434 - protein, 5 aa, Cryptosporidium hominis
SSIYN

SEQ ID NO: 2163435 - protein, 13 aa, Cryptosporidium hominis
SSKAKKSDDELAQ

SEQ ID NO: 2163436 - protein, 8 aa, Cryptosporidium hominis
SSKDEECT

SEQ ID NO: 2163437 - protein, 9 aa, Cryptosporidium hominis
SSKDEENKA

SEQ ID NO: 2163438 - protein, 40 aa, Cryptosporidium hominis
SSKDKKKKSSGDSSGAGANSGMDAHGNSLDGENANTDENF

SEQ ID NO: 2163439 - protein, 11 aa, Cryptosporidium hominis
SSKDSQSTPVP

SEQ ID NO: 2163440 - protein, 10 aa, Cryptosporidium hominis
SSKEHTDQRN

SEQ ID NO: 2163441 - protein, 7 aa, Cryptosporidium hominis
SSKEKMD

SEQ ID NO: 2163442 - protein, 11 aa, Cryptosporidium hominis
SSKESKDSKLE

SEQ ID NO: 2163443 - protein, 10 aa, Cryptosporidium hominis
SSKESYFNSE

SEQ ID NO: 2163444 - protein, 13 aa, Cryptosporidium hominis
SSKFEENNDINQA

SEQ ID NO: 2163445 - protein, 6 aa, Cryptosporidium hominis
SSKFGH

SEQ ID NO: 2163446 - protein, 7 aa, Cryptosporidium hominis
SSKFPKR

SEQ ID NO: 2163447 - protein, 8 aa, Cryptosporidium hominis
SSKFQQQN

SEQ ID NO: 2163448 - protein, 7 aa, Cryptosporidium hominis
SSKGALE

SEQ ID NO: 2163449 - protein, 6 aa, Cryptosporidium hominis
SSKGEF

SEQ ID NO: 2163450 - protein, 6 aa, Cryptosporidium hominis
SSKGIN

SEQ ID NO: 2163451 - protein, 7 aa, Cryptosporidium hominis
SSKGTAK

SEQ ID NO: 2163452 - protein, 7 aa, Cryptosporidium hominis
SSKIDDN

SEQ ID NO: 2163453 - protein, 7 aa, Cryptosporidium hominis
SSKIGNH

SEQ ID NO: 2163454 - protein, 6 aa, Cryptosporidium hominis
SSKISD

SEQ ID NO: 2163455 - protein, 7 aa, Cryptosporidium hominis
SSKKASK

SEQ ID NO: 2163456 - protein, 33 aa, Cryptosporidium hominis
SSKKATTTSKISASSKNDKNKLHDDRDPGAPLR

SEQ ID NO: 2163457 - protein, 11 aa, Cryptosporidium hominis
SSKKESRGKKV

SEQ ID NO: 2163458 - protein, 9 aa, Cryptosporidium hominis
SSKKFPTKG

SEQ ID NO: 2163459 - protein, 5 aa, Cryptosporidium hominis
SSKKH

SEQ ID NO: 2163460 - protein, 4 aa, Cryptosporidium hominis
SSKL

SEQ ID NO: 2163461 - protein, 5 aa, Cryptosporidium hominis
SSKLE

SEQ ID NO: 2163462 - protein, 16 aa, Cryptosporidium hominis
SSKLPPIKKKPKKLSE

SEQ ID NO: 2163463 - protein, 4 aa, Cryptosporidium hominis
SSKN

SEQ ID NO: 2163464 - protein, 15 aa, Cryptosporidium hominis
SSKNDYSTNNNIPNI

SEQ ID NO: 2163465 - protein, 9 aa, Cryptosporidium hominis
SSKNGIESN

SEQ ID NO: 2163466 - protein, 8 aa, Cryptosporidium hominis
SSKNISSN

SEQ ID NO: 2163467 - protein, 13 aa, Cryptosporidium hominis
SSKNNTRRNSNTP

SEQ ID NO: 2163468 - protein, 10 aa, Cryptosporidium hominis
SSKPQKKASK

SEQ ID NO: 2163469 - protein, 11 aa, Cryptosporidium hominis
SSKPSGETNLS

SEQ ID NO: 2163470 - protein, 10 aa, Cryptosporidium hominis
SSKPTSNSEH

SEQ ID NO: 2163471 - protein, 8 aa, Cryptosporidium hominis
SSKRDERF

SEQ ID NO: 2163472 - protein, 15 aa, Cryptosporidium hominis
SSKRGTYGLASPSKK

SEQ ID NO: 2163473 - protein, 23 aa, Cryptosporidium hominis
SSKRPHTKRGRSTANTSNSSNQS

SEQ ID NO: 2163474 - protein, 5 aa, Cryptosporidium hominis
SSKRQ

SEQ ID NO: 2163475 - protein, 17 aa, Cryptosporidium hominis
SSKRTLDARDKEQKKKI

SEQ ID NO: 2163476 - protein, 6 aa, Cryptosporidium hominis
SSKSKR

SEQ ID NO: 2163477 - protein, 6 aa, Cryptosporidium hominis
SSKSLH

SEQ ID NO: 2163478 - protein, 9 aa, Cryptosporidium hominis
SSKSRHSLK

SEQ ID NO: 2163479 - protein, 9 aa, Cryptosporidium hominis
SSKTENCQE

SEQ ID NO: 2163480 - protein, 9 aa, Cryptosporidium hominis
SSKTSLNDS

SEQ ID NO: 2163481 - protein, 5 aa, Cryptosporidium hominis
SSKYP

SEQ ID NO: 2163482 - protein, 7 aa, Cryptosporidium hominis
SSLDGNI

SEQ ID NO: 2163483 - protein, 13 aa, Cryptosporidium hominis
SSLEKEALPSPNL

SEQ ID NO: 2163484 - protein, 9 aa, Cryptosporidium hominis
SSLEPFDSH

SEQ ID NO: 2163485 - protein, 29 aa, Cryptosporidium hominis
SSLGCGSSDGAGPHDNRDIRQNTASVQTP

SEQ ID NO: 2163486 - protein, 7 aa, Cryptosporidium hominis
SSLGQRT

SEQ ID NO: 2163487 - protein, 7 aa, Cryptosporidium hominis
SSLGSQI

SEQ ID NO: 2163488 - protein, 34 aa, Cryptosporidium hominis
SSLGSTATITPSKIQESQGSSNISTTPNLGNEPN

SEQ ID NO: 2163489 - protein, 13 aa, Cryptosporidium hominis
SSLISDPKSQGRY

SEQ ID NO: 2163490 - protein, 14 aa, Cryptosporidium hominis
SSLKGLKDKKLRSK

SEQ ID NO: 2163491 - protein, 7 aa, Cryptosporidium hominis
SSLKRKS

SEQ ID NO: 2163492 - protein, 41 aa, Cryptosporidium hominis
SSLKSAEINEQDDSKNKPASIEEPDSANEKTSDSKPETSPL

SEQ ID NO: 2163493 - protein, 10 aa, Cryptosporidium hominis
SSLKSKKSLE

SEQ ID NO: 2163494 - protein, 12 aa, Cryptosporidium hominis
SSLKTSKNEIQN

SEQ ID NO: 2163495 - protein, 13 aa, Cryptosporidium hominis
SSLNESVSAPQEE

SEQ ID NO: 2163496 - protein, 14 aa, Cryptosporidium hominis
SSLNKSESKEENVK

SEQ ID NO: 2163497 - protein, 7 aa, Cryptosporidium hominis
SSLNNNQ

SEQ ID NO: 2163498 - protein, 8 aa, Cryptosporidium hominis
SSLNQTNI

SEQ ID NO: 2163499 - protein, 5 aa, Cryptosporidium hominis
SSLNT

SEQ ID NO: 2163500 - protein, 5 aa, Cryptosporidium hominis
SSLNY

SEQ ID NO: 2163501 - protein, 6 aa, Cryptosporidium hominis
SSLPEP

SEQ ID NO: 2163502 - protein, 4 aa, Cryptosporidium hominis
SSLQ

SEQ ID NO: 2163503 - protein, 10 aa, Cryptosporidium hominis
SSLQGRKTVS

SEQ ID NO: 2163504 - protein, 6 aa, Cryptosporidium hominis
SSLREK

SEQ ID NO: 2163505 - protein, 12 aa, Cryptosporidium hominis
SSLSDENKNMSE

SEQ ID NO: 2163506 - protein, 7 aa, Cryptosporidium hominis
SSLSDEY

SEQ ID NO: 2163507 - protein, 16 aa, Cryptosporidium hominis
SSLSGENKSRTSKDMK

SEQ ID NO: 2163508 - protein, 11 aa, Cryptosporidium hominis
SSLSHNNDHLT

SEQ ID NO: 2163509 - protein, 6 aa, Cryptosporidium hominis
SSLSNR

SEQ ID NO: 2163510 - protein, 6 aa, Cryptosporidium hominis
SSLSPK

SEQ ID NO: 2163511 - protein, 5 aa, Cryptosporidium hominis
SSLSS

SEQ ID NO: 2163512 - protein, 12 aa, Cryptosporidium hominis
SSLSSEQEMNQE

SEQ ID NO: 2163513 - protein, 9 aa, Cryptosporidium hominis
SSLSSSQNF

SEQ ID NO: 2163514 - protein, 5 aa, Cryptosporidium hominis
SSLST

SEQ ID NO: 2163515 - protein, 6 aa, Cryptosporidium hominis
SSLSTS

SEQ ID NO: 2163516 - protein, 5 aa, Cryptosporidium hominis
SSLTG

SEQ ID NO: 2163517 - protein, 16 aa, Cryptosporidium hominis
SSLTNPEAGNSDCSSN

SEQ ID NO: 2163518 - protein, 4 aa, Cryptosporidium hominis
SSLY

SEQ ID NO: 2163519 - protein, 12 aa, Cryptosporidium hominis
SSMFPRDPKRLS

SEQ ID NO: 2163520 - protein, 6 aa, Cryptosporidium hominis
SSMPNV

SEQ ID NO: 2163521 - protein, 9 aa, Cryptosporidium hominis
SSMRKEDHS

SEQ ID NO: 2163522 - protein, 6 aa, Cryptosporidium hominis
SSMTER

SEQ ID NO: 2163523 - protein, 13 aa, Cryptosporidium hominis
SSMTKNEDKMTSD

SEQ ID NO: 2163524 - protein, 11 aa, Cryptosporidium hominis
SSMTVTTKSSL

SEQ ID NO: 2163525 - protein, 15 aa, Cryptosporidium hominis
SSNASDQSKSSSFDT

SEQ ID NO: 2163526 - protein, 34 aa, Cryptosporidium hominis
SSNCNPSNSCSASSSSSSSVSNYNTIKNNTKTLY

SEQ ID NO: 2163527 - protein, 10 aa, Cryptosporidium hominis
SSNDDDGFSE

SEQ ID NO: 2163528 - protein, 6 aa, Cryptosporidium hominis
SSNEEP

SEQ ID NO: 2163529 - protein, 7 aa, Cryptosporidium hominis
SSNEQTL

SEQ ID NO: 2163530 - protein, 11 aa, Cryptosporidium hominis
SSNESDEDHKE

SEQ ID NO: 2163531 - protein, 23 aa, Cryptosporidium hominis
SSNESQSTHQSSNNLNKDSSITT

SEQ ID NO: 2163532 - protein, 7 aa, Cryptosporidium hominis
SSNFEGN

SEQ ID NO: 2163533 - protein, 6 aa, Cryptosporidium hominis
SSNFES

SEQ ID NO: 2163534 - protein, 5 aa, Cryptosporidium hominis
SSNGV

SEQ ID NO: 2163535 - protein, 8 aa, Cryptosporidium hominis
SSNGVTKS

SEQ ID NO: 2163536 - protein, 7 aa, Cryptosporidium hominis
SSNHEKY

SEQ ID NO: 2163537 - protein, 4 aa, Cryptosporidium hominis
SSNI

SEQ ID NO: 2163538 - protein, 8 aa, Cryptosporidium hominis
SSNIDSDE

SEQ ID NO: 2163539 - protein, 28 aa, Cryptosporidium hominis
SSNIGVSPNLQGSINADGSVKGNLRHPT

SEQ ID NO: 2163540 - protein, 12 aa, Cryptosporidium hominis
SSNINRNRVPKG

SEQ ID NO: 2163541 - protein, 16 aa, Cryptosporidium hominis
SSNKDELNKSETFSNP

SEQ ID NO: 2163542 - protein, 34 aa, Cryptosporidium hominis
SSNKEIPNSSLSSNSTNAVSKAAELNNSLTGRGI

SEQ ID NO: 2163543 - protein, 9 aa, Cryptosporidium hominis
SSNKELKDD

SEQ ID NO: 2163544 - protein, 12 aa, Cryptosporidium hominis
SSNKEPLGPTSE

SEQ ID NO: 2163545 - protein, 21 aa, Cryptosporidium hominis
SSNKERNISSLSSSLNDSKRI

SEQ ID NO: 2163546 - protein, 9 aa, Cryptosporidium hominis
SSNKGSKYK

SEQ ID NO: 2163547 - protein, 7 aa, Cryptosporidium hominis
SSNKKTF

SEQ ID NO: 2163548 - protein, 7 aa, Cryptosporidium hominis
SSNKNTL

SEQ ID NO: 2163549 - protein, 6 aa, Cryptosporidium hominis
SSNKRI

SEQ ID NO: 2163550 - protein, 8 aa, Cryptosporidium hominis
SSNKRKRM

SEQ ID NO: 2163551 - protein, 5 aa, Cryptosporidium hominis
SSNLA

SEQ ID NO: 2163552 - protein, 14 aa, Cryptosporidium hominis
SSNLKGNKSDYEYN

SEQ ID NO: 2163553 - protein, 9 aa, Cryptosporidium hominis
SSNLPHSAY

SEQ ID NO: 2163554 - protein, 15 aa, Cryptosporidium hominis
SSNLPKSTIQTSNSN

SEQ ID NO: 2163555 - protein, 8 aa, Cryptosporidium hominis
SSNLSSYN

SEQ ID NO: 2163556 - protein, 4 aa, Cryptosporidium hominis
SSNN

SEQ ID NO: 2163557 - protein, 10 aa, Cryptosporidium hominis
SSNNDIEISD

SEQ ID NO: 2163558 - protein, 31 aa, Cryptosporidium hominis
SSNNNVPSTTASSINSSSSSSLLETNHTVMC

SEQ ID NO: 2163559 - protein, 9 aa, Cryptosporidium hominis
SSNNQGSVN

SEQ ID NO: 2163560 - protein, 20 aa, Cryptosporidium hominis
SSNNQIQSDPSKKSMNSSTP

SEQ ID NO: 2163561 - protein, 33 aa, Cryptosporidium hominis
SSNNRSDESIKVGNQSKGSGLKANGSANNSYKD

SEQ ID NO: 2163562 - protein, 7 aa, Cryptosporidium hominis
SSNNSDV

SEQ ID NO: 2163563 - protein, 8 aa, Cryptosporidium hominis
SSNNSEDY

SEQ ID NO: 2163564 - protein, 10 aa, Cryptosporidium hominis
SSNNSVSSGI

SEQ ID NO: 2163565 - protein, 5 aa, Cryptosporidium hominis
SSNNV

SEQ ID NO: 2163566 - protein, 13 aa, Cryptosporidium hominis
SSNPDADAQEIKD

SEQ ID NO: 2163567 - protein, 40 aa, Cryptosporidium hominis
SSNPDESNKDNSETVSGNKAIRSQDNDQELSSREKHEGSD

SEQ ID NO: 2163568 - protein, 8 aa, Cryptosporidium hominis
SSNPEQFR

SEQ ID NO: 2163569 - protein, 10 aa, Cryptosporidium hominis
SSNPETNSNL

SEQ ID NO: 2163570 - protein, 22 aa, Cryptosporidium hominis
SSNPRIVEDSNQDSVSSPGGNA

SEQ ID NO: 2163571 - protein, 16 aa, Cryptosporidium hominis
SSNSIDDQQKVQDKDP

SEQ ID NO: 2163572 - protein, 9 aa, Cryptosporidium hominis
SSNSISKHS

SEQ ID NO: 2163573 - protein, 24 aa, Cryptosporidium hominis
SSNSNNNNNINQSAPLNIAKKYEI

SEQ ID NO: 2163574 - protein, 5 aa, Cryptosporidium hominis
SSNSQ

SEQ ID NO: 2163575 - protein, 10 aa, Cryptosporidium hominis
SSNSREAKEE

SEQ ID NO: 2163576 - protein, 6 aa, Cryptosporidium hominis
SSNSRI

SEQ ID NO: 2163577 - protein, 6 aa, Cryptosporidium hominis
SSNSSD

SEQ ID NO: 2163578 - protein, 11 aa, Cryptosporidium hominis
SSNSSSSISNT

SEQ ID NO: 2163579 - protein, 10 aa, Cryptosporidium hominis
SSNSYDRSSI

SEQ ID NO: 2163580 - protein, 5 aa, Cryptosporidium hominis
SSNTI

SEQ ID NO: 2163581 - protein, 22 aa, Cryptosporidium hominis
SSNTNDFPNNVNNTELAGPPIL

SEQ ID NO: 2163582 - protein, 13 aa, Cryptosporidium hominis
SSNTPCNSQVESG

SEQ ID NO: 2163583 - protein, 9 aa, Cryptosporidium hominis
SSNTPEGNE

SEQ ID NO: 2163584 - protein, 6 aa, Cryptosporidium hominis
SSNVPE

SEQ ID NO: 2163585 - protein, 17 aa, Cryptosporidium hominis
SSNWSKSGITTSSGTYN

SEQ ID NO: 2163586 - protein, 19 aa, Cryptosporidium hominis
SSNYDGIHTESVNSNYEAR

SEQ ID NO: 2163587 - protein, 7 aa, Cryptosporidium hominis
SSNYRSG

SEQ ID NO: 2163588 - protein, 50 aa, Cryptosporidium hominis
SSNYSENQYRRKNSPPRSSREHSSKYSASRGASSSMYPEGRSKNEYRDHR

SEQ ID NO: 2163589 - protein, 7 aa, Cryptosporidium hominis
SSPCGST

SEQ ID NO: 2163590 - protein, 15 aa, Cryptosporidium hominis
SSPDGSIRQESETQF

SEQ ID NO: 2163591 - protein, 10 aa, Cryptosporidium hominis
SSPDTEKQTK

SEQ ID NO: 2163592 - protein, 7 aa, Cryptosporidium hominis
SSPEKGL

SEQ ID NO: 2163593 - protein, 25 aa, Cryptosporidium hominis
SSPELKNKIQEGSRINKDLDKPEQK

SEQ ID NO: 2163594 - protein, 10 aa, Cryptosporidium hominis
SSPEPNDPLD

SEQ ID NO: 2163595 - protein, 11 aa, Cryptosporidium hominis
SSPEPNDPQDA

SEQ ID NO: 2163596 - protein, 4 aa, Cryptosporidium hominis
SSPF

SEQ ID NO: 2163597 - protein, 23 aa, Cryptosporidium hominis
SSPFGGSISGSGSTSAIGSSPFG

SEQ ID NO: 2163598 - protein, 5 aa, Cryptosporidium hominis
SSPFL

SEQ ID NO: 2163599 - protein, 16 aa, Cryptosporidium hominis
SSPFPLPEGSQPVEPR

SEQ ID NO: 2163600 - protein, 14 aa, Cryptosporidium hominis
SSPFSSGTENSQEV

SEQ ID NO: 2163601 - protein, 5 aa, Cryptosporidium hominis
SSPGI

SEQ ID NO: 2163602 - protein, 6 aa, Cryptosporidium hominis
SSPHEE

SEQ ID NO: 2163603 - protein, 13 aa, Cryptosporidium hominis
SSPIGNSQYYPGK

SEQ ID NO: 2163604 - protein, 8 aa, Cryptosporidium hominis
SSPLDPNS

SEQ ID NO: 2163605 - protein, 15 aa, Cryptosporidium hominis
SSPLEGSSDISTPQS

SEQ ID NO: 2163606 - protein, 5 aa, Cryptosporidium hominis
SSPMN

SEQ ID NO: 2163607 - protein, 7 aa, Cryptosporidium hominis
SSPNGGF

SEQ ID NO: 2163608 - protein, 5 aa, Cryptosporidium hominis
SSPNK

SEQ ID NO: 2163609 - protein, 7 aa, Cryptosporidium hominis
SSPPELK

SEQ ID NO: 2163610 - protein, 12 aa, Cryptosporidium hominis
SSPPSITSAKSL

SEQ ID NO: 2163611 - protein, 6 aa, Cryptosporidium hominis
SSPQAQ

SEQ ID NO: 2163612 - protein, 8 aa, Cryptosporidium hominis
SSPRLSDS

SEQ ID NO: 2163613 - protein, 13 aa, Cryptosporidium hominis
SSPSLQNQNTLET

SEQ ID NO: 2163614 - protein, 26 aa, Cryptosporidium hominis
SSPSNNNGSAKYNETPNSKEIDSSTL

SEQ ID NO: 2163615 - protein, 12 aa, Cryptosporidium hominis
SSPSSSSSSSPH

SEQ ID NO: 2163616 - protein, 6 aa, Cryptosporidium hominis
SSPSSY

SEQ ID NO: 2163617 - protein, 7 aa, Cryptosporidium hominis
SSPSYSV

SEQ ID NO: 2163618 - protein, 6 aa, Cryptosporidium hominis
SSPSYT

SEQ ID NO: 2163619 - protein, 5 aa, Cryptosporidium hominis
SSPTM

SEQ ID NO: 2163620 - protein, 5 aa, Cryptosporidium hominis
SSPTN

SEQ ID NO: 2163621 - protein, 14 aa, Cryptosporidium hominis
SSPTSNNATREDLG

SEQ ID NO: 2163622 - protein, 6 aa, Cryptosporidium hominis
SSPVNQ

SEQ ID NO: 2163623 - protein, 6 aa, Cryptosporidium hominis
SSPYGN

SEQ ID NO: 2163624 - protein, 11 aa, Cryptosporidium hominis
SSPYNNESQEY

SEQ ID NO: 2163625 - protein, 10 aa, Cryptosporidium hominis
SSPYSASSNL

SEQ ID NO: 2163626 - protein, 9 aa, Cryptosporidium hominis
SSQAREIQP

SEQ ID NO: 2163627 - protein, 8 aa, Cryptosporidium hominis
SSQCDTNS

SEQ ID NO: 2163628 - protein, 39 aa, Cryptosporidium hominis
SSQDSIKLSTGGSREKLTDSITGLQNNSSSSSSSSTNSS

SEQ ID NO: 2163629 - protein, 17 aa, Cryptosporidium hominis
SSQDSVGYPAPQRGQSS

SEQ ID NO: 2163630 - protein, 7 aa, Cryptosporidium hominis
SSQDTRQ

SEQ ID NO: 2163631 - protein, 12 aa, Cryptosporidium hominis
SSQEDLPSEERQ

SEQ ID NO: 2163632 - protein, 12 aa, Cryptosporidium hominis
SSQGSERSSINS

SEQ ID NO: 2163633 - protein, 10 aa, Cryptosporidium hominis
SSQKIASKKM

SEQ ID NO: 2163634 - protein, 12 aa, Cryptosporidium hominis
SSQKRPRSCSSD

SEQ ID NO: 2163635 - protein, 9 aa, Cryptosporidium hominis
SSQNPSSYQ

SEQ ID NO: 2163636 - protein, 10 aa, Cryptosporidium hominis
SSQNQDKSSR

SEQ ID NO: 2163637 - protein, 5 aa, Cryptosporidium hominis
SSQNT

SEQ ID NO: 2163638 - protein, 7 aa, Cryptosporidium hominis
SSQPKSA

SEQ ID NO: 2163639 - protein, 7 aa, Cryptosporidium hominis
SSQPKSV

SEQ ID NO: 2163640 - protein, 10 aa, Cryptosporidium hominis
SSQQNALSSQ

SEQ ID NO: 2163641 - protein, 10 aa, Cryptosporidium hominis
SSQQRKHNSM

SEQ ID NO: 2163642 - protein, 23 aa, Cryptosporidium hominis
SSQQSTSSSNKRARNEDELTNTI

SEQ ID NO: 2163643 - protein, 9 aa, Cryptosporidium hominis
SSQSPKNKS

SEQ ID NO: 2163644 - protein, 25 aa, Cryptosporidium hominis
SSQVQAQNQNQSQTQSQPQTQTQPQ

SEQ ID NO: 2163645 - protein, 8 aa, Cryptosporidium hominis
SSQVSDRI

SEQ ID NO: 2163646 - protein, 10 aa, Cryptosporidium hominis
SSRAASSACA

SEQ ID NO: 2163647 - protein, 12 aa, Cryptosporidium hominis
SSRDLTKDCDKS

SEQ ID NO: 2163648 - protein, 7 aa, Cryptosporidium hominis
SSRDPDT

SEQ ID NO: 2163649 - protein, 6 aa, Cryptosporidium hominis
SSRENC

SEQ ID NO: 2163650 - protein, 4 aa, Cryptosporidium hominis
SSRG

SEQ ID NO: 2163651 - protein, 167 aa, Cryptosporidium hominis
SSRGRDSGRVGSGRVGSSRVGASSGAIGTIGGSGIGGSSRGRGASSGGNSMGRLTGRGGLGLGTAGSLSRGRGSDRRGLSSGAVGTIGSSGRGGSNRGRGSYRGGLSSGALGTIGGSGRGGSSRGRGSDRGGLNSGTVGTIEGSGRGGLGSGTTGSSSRGRGLARGG

SEQ ID NO: 2163652 - protein, 14 aa, Cryptosporidium hominis
SSRIETEENGEVAN

SEQ ID NO: 2163653 - protein, 10 aa, Cryptosporidium hominis
SSRKSSATMD

SEQ ID NO: 2163654 - protein, 14 aa, Cryptosporidium hominis
SSRLSPNNRRSTES

SEQ ID NO: 2163655 - protein, 14 aa, Cryptosporidium hominis
SSRNEQENEATRRI

SEQ ID NO: 2163656 - protein, 6 aa, Cryptosporidium hominis
SSRNKL

SEQ ID NO: 2163657 - protein, 17 aa, Cryptosporidium hominis
SSRNYPTNHSINNNSKN

SEQ ID NO: 2163658 - protein, 4 aa, Cryptosporidium hominis
SSRP

SEQ ID NO: 2163659 - protein, 11 aa, Cryptosporidium hominis
SSRPLENGDKS

SEQ ID NO: 2163660 - protein, 4 aa, Cryptosporidium hominis
SSRQ

SEQ ID NO: 2163661 - protein, 16 aa, Cryptosporidium hominis
SSRQNCQGRRQRSRNI

SEQ ID NO: 2163662 - protein, 6 aa, Cryptosporidium hominis
SSRQSN

SEQ ID NO: 2163663 - protein, 13 aa, Cryptosporidium hominis
SSRQSQTIGRHDA

SEQ ID NO: 2163664 - protein, 7 aa, Cryptosporidium hominis
SSRRKND

SEQ ID NO: 2163665 - protein, 5 aa, Cryptosporidium hominis
SSRSE

SEQ ID NO: 2163666 - protein, 18 aa, Cryptosporidium hominis
SSRSGNAGRDTTHSSESG

SEQ ID NO: 2163667 - protein, 9 aa, Cryptosporidium hominis
SSRSQHESK

SEQ ID NO: 2163668 - protein, 71 aa, Cryptosporidium hominis
SSRSRSSSRSITRTRSRSRTRSRTRTRTRTRSRSRSRSRSRSRSRSRSRSRTRTDPESNSRSSPKSGISSN

SEQ ID NO: 2163669 - protein, 9 aa, Cryptosporidium hominis
SSRTGSNSG

SEQ ID NO: 2163670 - protein, 5 aa, Cryptosporidium hominis
SSRTI

SEQ ID NO: 2163671 - protein, 6 aa, Cryptosporidium hominis
SSRTRQ

SEQ ID NO: 2163672 - protein, 5 aa, Cryptosporidium hominis
SSRVQ

SEQ ID NO: 2163673 - protein, 12 aa, Cryptosporidium hominis
SSSAKPYRRRPP

SEQ ID NO: 2163674 - protein, 13 aa, Cryptosporidium hominis
SSSAPPPRLPRPP

SEQ ID NO: 2163675 - protein, 13 aa, Cryptosporidium hominis
SSSASNSTQNAFG

SEQ ID NO: 2163676 - protein, 7 aa, Cryptosporidium hominis
SSSASPF

SEQ ID NO: 2163677 - protein, 10 aa, Cryptosporidium hominis
SSSASSSSIM

SEQ ID NO: 2163678 - protein, 35 aa, Cryptosporidium hominis
SSSCDQEDTSPQNNTINSQNQCDQQTSTQNNVDKD

SEQ ID NO: 2163679 - protein, 12 aa, Cryptosporidium hominis
SSSCRPKSQGLH

SEQ ID NO: 2163680 - protein, 25 aa, Cryptosporidium hominis
SSSDESSSSGSSSSDDSKEWSDDSI

SEQ ID NO: 2163681 - protein, 9 aa, Cryptosporidium hominis
SSSDSNIDT

SEQ ID NO: 2163682 - protein, 9 aa, Cryptosporidium hominis
SSSDTIGYD

SEQ ID NO: 2163683 - protein, 7 aa, Cryptosporidium hominis
SSSDVNE

SEQ ID NO: 2163684 - protein, 9 aa, Cryptosporidium hominis
SSSEESKIN

SEQ ID NO: 2163685 - protein, 14 aa, Cryptosporidium hominis
SSSEINSSNDSPLF

SEQ ID NO: 2163686 - protein, 6 aa, Cryptosporidium hominis
SSSEKF

SEQ ID NO: 2163687 - protein, 9 aa, Cryptosporidium hominis
SSSEKNFGM

SEQ ID NO: 2163688 - protein, 9 aa, Cryptosporidium hominis
SSSENSPSL

SEQ ID NO: 2163689 - protein, 15 aa, Cryptosporidium hominis
SSSESKSDSETKERT

SEQ ID NO: 2163690 - protein, 7 aa, Cryptosporidium hominis
SSSESYS

SEQ ID NO: 2163691 - protein, 5 aa, Cryptosporidium hominis
SSSET

SEQ ID NO: 2163692 - protein, 7 aa, Cryptosporidium hominis
SSSEVPS

SEQ ID NO: 2163693 - protein, 44 aa, Cryptosporidium hominis
SSSEYPERRISTRNSIHSSSDNKIDLNDSDEGFKDHSGIDNDEV

SEQ ID NO: 2163694 - protein, 14 aa, Cryptosporidium hominis
SSSFKNNGSGKSRE

SEQ ID NO: 2163695 - protein, 10 aa, Cryptosporidium hominis
SSSFQSGNNT

SEQ ID NO: 2163696 - protein, 7 aa, Cryptosporidium hominis
SSSGDPE

SEQ ID NO: 2163697 - protein, 18 aa, Cryptosporidium hominis
SSSGHPSHSGANNSGGIA

SEQ ID NO: 2163698 - protein, 13 aa, Cryptosporidium hominis
SSSGNSNGTQGNI

SEQ ID NO: 2163699 - protein, 8 aa, Cryptosporidium hominis
SSSGREDV

SEQ ID NO: 2163700 - protein, 23 aa, Cryptosporidium hominis
SSSGSNIQLQSKDQRASNRASNK

SEQ ID NO: 2163701 - protein, 13 aa, Cryptosporidium hominis
SSSHPKSRNESRV

SEQ ID NO: 2163702 - protein, 13 aa, Cryptosporidium hominis
SSSHTNKNTSITE

SEQ ID NO: 2163703 - protein, 20 aa, Cryptosporidium hominis
SSSIDSSNSESESSSDSEME

SEQ ID NO: 2163704 - protein, 7 aa, Cryptosporidium hominis
SSSIEPK

SEQ ID NO: 2163705 - protein, 9 aa, Cryptosporidium hominis
SSSIKNKTQ

SEQ ID NO: 2163706 - protein, 6 aa, Cryptosporidium hominis
SSSIKS

SEQ ID NO: 2163707 - protein, 24 aa, Cryptosporidium hominis
SSSISGSGIESNNSNNSENNKSMI

SEQ ID NO: 2163708 - protein, 8 aa, Cryptosporidium hominis
SSSKDKSN

SEQ ID NO: 2163709 - protein, 6 aa, Cryptosporidium hominis
SSSKEI

SEQ ID NO: 2163710 - protein, 10 aa, Cryptosporidium hominis
SSSKFDKDSQ

SEQ ID NO: 2163711 - protein, 8 aa, Cryptosporidium hominis
SSSKGETI

SEQ ID NO: 2163712 - protein, 8 aa, Cryptosporidium hominis
SSSKIASI

SEQ ID NO: 2163713 - protein, 8 aa, Cryptosporidium hominis
SSSKKEKN

SEQ ID NO: 2163714 - protein, 16 aa, Cryptosporidium hominis
SSSKKRLPSAISNSSL

SEQ ID NO: 2163715 - protein, 41 aa, Cryptosporidium hominis
SSSKNDEQSTAMTTESEIRENNVERPNDISSASSKISKSEK

SEQ ID NO: 2163716 - protein, 29 aa, Cryptosporidium hominis
SSSKNSVTSSSKYSYNHSRTQSQSNRDSI

SEQ ID NO: 2163717 - protein, 5 aa, Cryptosporidium hominis
SSSKP

SEQ ID NO: 2163718 - protein, 4 aa, Cryptosporidium hominis
SSSL

SEQ ID NO: 2163719 - protein, 28 aa, Cryptosporidium hominis
SSSLEDDNEGGDEDEGIQKEFEDQTNGL

SEQ ID NO: 2163720 - protein, 6 aa, Cryptosporidium hominis
SSSLGV

SEQ ID NO: 2163721 - protein, 6 aa, Cryptosporidium hominis
SSSLNN

SEQ ID NO: 2163722 - protein, 9 aa, Cryptosporidium hominis
SSSLPKSAN

SEQ ID NO: 2163723 - protein, 6 aa, Cryptosporidium hominis
SSSNEH

SEQ ID NO: 2163724 - protein, 21 aa, Cryptosporidium hominis
SSSNFYSNSGFGPEVRTGAGV

SEQ ID NO: 2163725 - protein, 16 aa, Cryptosporidium hominis
SSSNGPISSGKIAPKQ

SEQ ID NO: 2163726 - protein, 22 aa, Cryptosporidium hominis
SSSNIKNNSSYQIEKKSSQPLV

SEQ ID NO: 2163727 - protein, 21 aa, Cryptosporidium hominis
SSSNINQRQIGDNLKNPNHGI

SEQ ID NO: 2163728 - protein, 16 aa, Cryptosporidium hominis
SSSNLSSIDKPNEQNN

SEQ ID NO: 2163729 - protein, 7 aa, Cryptosporidium hominis
SSSNNYE

SEQ ID NO: 2163730 - protein, 15 aa, Cryptosporidium hominis
SSSNSNNSDFNNDKQ

SEQ ID NO: 2163731 - protein, 6 aa, Cryptosporidium hominis
SSSNSS

SEQ ID NO: 2163732 - protein, 17 aa, Cryptosporidium hominis
SSSNTRNLHKNKSKKIP

SEQ ID NO: 2163733 - protein, 43 aa, Cryptosporidium hominis
SSSNYKNKQCHPKQTSNDNFQSVSSRSSPLPPLANSPNHQPSF

SEQ ID NO: 2163734 - protein, 7 aa, Cryptosporidium hominis
SSSPEKA

SEQ ID NO: 2163735 - protein, 5 aa, Cryptosporidium hominis
SSSPI

SEQ ID NO: 2163736 - protein, 7 aa, Cryptosporidium hominis
SSSPQCG

SEQ ID NO: 2163737 - protein, 8 aa, Cryptosporidium hominis
SSSPRLSD

SEQ ID NO: 2163738 - protein, 16 aa, Cryptosporidium hominis
SSSPRNNSTTKIENSN

SEQ ID NO: 2163739 - protein, 20 aa, Cryptosporidium hominis
SSSPSSSFSYGTASLRPEKL

SEQ ID NO: 2163740 - protein, 14 aa, Cryptosporidium hominis
SSSPWLKNSPRTDW

SEQ ID NO: 2163741 - protein, 5 aa, Cryptosporidium hominis
SSSQS

SEQ ID NO: 2163742 - protein, 33 aa, Cryptosporidium hominis
SSSQSPGGALSRSNSLRYSSSSGGNNNNNNNIG

SEQ ID NO: 2163743 - protein, 5 aa, Cryptosporidium hominis
SSSRD

SEQ ID NO: 2163744 - protein, 9 aa, Cryptosporidium hominis
SSSREQFGE

SEQ ID NO: 2163745 - protein, 16 aa, Cryptosporidium hominis
SSSRPSPLALPPSPSP

SEQ ID NO: 2163746 - protein, 5 aa, Cryptosporidium hominis
SSSRR

SEQ ID NO: 2163747 - protein, 20 aa, Cryptosporidium hominis
SSSRTPSESSSSIPPSSPRL

SEQ ID NO: 2163748 - protein, 9 aa, Cryptosporidium hominis
SSSRYKTTY

SEQ ID NO: 2163749 - protein, 13 aa, Cryptosporidium hominis
SSSRYVKKSQADI

SEQ ID NO: 2163750 - protein, 4 aa, Cryptosporidium hominis
SSSS

SEQ ID NO: 2163751 - protein, 11 aa, Cryptosporidium hominis
SSSSASNESIV

SEQ ID NO: 2163752 - protein, 8 aa, Cryptosporidium hominis
SSSSEPLK

SEQ ID NO: 2163753 - protein, 5 aa, Cryptosporidium hominis
SSSSF

SEQ ID NO: 2163754 - protein, 8 aa, Cryptosporidium hominis
SSSSFSSG

SEQ ID NO: 2163755 - protein, 26 aa, Cryptosporidium hominis
SSSSGSGSITGTNLSSNSSKSMSKEQ

SEQ ID NO: 2163756 - protein, 5 aa, Cryptosporidium hominis
SSSSI

SEQ ID NO: 2163757 - protein, 9 aa, Cryptosporidium hominis
SSSSIDGQS

SEQ ID NO: 2163758 - protein, 5 aa, Cryptosporidium hominis
SSSSK

SEQ ID NO: 2163759 - protein, 45 aa, Cryptosporidium hominis
SSSSKALGATPSAQISSSLSSSSSSSSSSLASSSSSSSSSPSLTL

SEQ ID NO: 2163760 - protein, 5 aa, Cryptosporidium hominis
SSSSM

SEQ ID NO: 2163761 - protein, 11 aa, Cryptosporidium hominis
SSSSNESQIKE

SEQ ID NO: 2163762 - protein, 19 aa, Cryptosporidium hominis
SSSSPSPGNTNSNSSAKRL

SEQ ID NO: 2163763 - protein, 15 aa, Cryptosporidium hominis
SSSSRIANISEDNEV

SEQ ID NO: 2163764 - protein, 9 aa, Cryptosporidium hominis
SSSSSEEVL

SEQ ID NO: 2163765 - protein, 17 aa, Cryptosporidium hominis
SSSSSESEGEQKRTGKI

SEQ ID NO: 2163766 - protein, 8 aa, Cryptosporidium hominis
SSSSSFIG

SEQ ID NO: 2163767 - protein, 21 aa, Cryptosporidium hominis
SSSSSGAGAVTGSGGTQTNAM

SEQ ID NO: 2163768 - protein, 8 aa, Cryptosporidium hominis
SSSSSSLS

SEQ ID NO: 2163769 - protein, 12 aa, Cryptosporidium hominis
SSSSSSSFPVGT

SEQ ID NO: 2163770 - protein, 18 aa, Cryptosporidium hominis
SSSSSSSSEESENEYRDQ

SEQ ID NO: 2163771 - protein, 24 aa, Cryptosporidium hominis
SSSSSSSSSSSSSSSSSSNQGDVM

SEQ ID NO: 2163772 - protein, 34 aa, Cryptosporidium hominis
SSSSSSSSSSSSSSSSSSSSSSSSMITSTSASTI

SEQ ID NO: 2163773 - protein, 21 aa, Cryptosporidium hominis
SSSSTGIPRPGRPKRTVTAKK

SEQ ID NO: 2163774 - protein, 7 aa, Cryptosporidium hominis
SSSSYNL

SEQ ID NO: 2163775 - protein, 6 aa, Cryptosporidium hominis
SSSTIE

SEQ ID NO: 2163776 - protein, 42 aa, Cryptosporidium hominis
SSSTIETNSPNRRLTQSSIDNSDHSGNRTENSNNSNNDNSIC

SEQ ID NO: 2163777 - protein, 8 aa, Cryptosporidium hominis
SSSTLDYS

SEQ ID NO: 2163778 - protein, 19 aa, Cryptosporidium hominis
SSSTNNEAMTSSSMNTNSN

SEQ ID NO: 2163779 - protein, 11 aa, Cryptosporidium hominis
SSSTSTTTSSA

SEQ ID NO: 2163780 - protein, 8 aa, Cryptosporidium hominis
SSSTVEER

SEQ ID NO: 2163781 - protein, 4 aa, Cryptosporidium hominis
SSSV

SEQ ID NO: 2163782 - protein, 7 aa, Cryptosporidium hominis
SSSVDQA

SEQ ID NO: 2163783 - protein, 19 aa, Cryptosporidium hominis
SSSVPSNIEGRAIDSNSHE

SEQ ID NO: 2163784 - protein, 6 aa, Cryptosporidium hominis
SSSVTA

SEQ ID NO: 2163785 - protein, 5 aa, Cryptosporidium hominis
SSSYD

SEQ ID NO: 2163786 - protein, 9 aa, Cryptosporidium hominis
SSSYDGSLG

SEQ ID NO: 2163787 - protein, 7 aa, Cryptosporidium hominis
SSTAGSN

SEQ ID NO: 2163788 - protein, 9 aa, Cryptosporidium hominis
SSTAIEDNF

SEQ ID NO: 2163789 - protein, 8 aa, Cryptosporidium hominis
SSTAPLTP

SEQ ID NO: 2163790 - protein, 4 aa, Cryptosporidium hominis
SSTD

SEQ ID NO: 2163791 - protein, 20 aa, Cryptosporidium hominis
SSTDKESSKAHSSSRNGSLR

SEQ ID NO: 2163792 - protein, 8 aa, Cryptosporidium hominis
SSTDKNRH

SEQ ID NO: 2163793 - protein, 11 aa, Cryptosporidium hominis
SSTDKTPDHGV

SEQ ID NO: 2163794 - protein, 4 aa, Cryptosporidium hominis
SSTE

SEQ ID NO: 2163795 - protein, 21 aa, Cryptosporidium hominis
SSTFEENKIPEKIPPRYLRTY

SEQ ID NO: 2163796 - protein, 11 aa, Cryptosporidium hominis
SSTFYGDSGPL

SEQ ID NO: 2163797 - protein, 5 aa, Cryptosporidium hominis
SSTGA

SEQ ID NO: 2163798 - protein, 5 aa, Cryptosporidium hominis
SSTGK

SEQ ID NO: 2163799 - protein, 22 aa, Cryptosporidium hominis
SSTGNTNTVESENDSKNLENSV

SEQ ID NO: 2163800 - protein, 5 aa, Cryptosporidium hominis
SSTIE

SEQ ID NO: 2163801 - protein, 7 aa, Cryptosporidium hominis
SSTINNV

SEQ ID NO: 2163802 - protein, 14 aa, Cryptosporidium hominis
SSTIQKKQKGAMDT

SEQ ID NO: 2163803 - protein, 23 aa, Cryptosporidium hominis
SSTISKGGMSSNISNSSRFSNAS

SEQ ID NO: 2163804 - protein, 18 aa, Cryptosporidium hominis
SSTISNNGAGNSTIAQNT

SEQ ID NO: 2163805 - protein, 8 aa, Cryptosporidium hominis
SSTKESDS

SEQ ID NO: 2163806 - protein, 7 aa, Cryptosporidium hominis
SSTKNPN

SEQ ID NO: 2163807 - protein, 10 aa, Cryptosporidium hominis
SSTKSNNKVE

SEQ ID NO: 2163808 - protein, 4 aa, Cryptosporidium hominis
SSTL

SEQ ID NO: 2163809 - protein, 7 aa, Cryptosporidium hominis
SSTLNRD

SEQ ID NO: 2163810 - protein, 6 aa, Cryptosporidium hominis
SSTLPE

SEQ ID NO: 2163811 - protein, 9 aa, Cryptosporidium hominis
SSTLPKEYT

SEQ ID NO: 2163812 - protein, 26 aa, Cryptosporidium hominis
SSTLPNNLNSKNTKKVENTTKKLSNS

SEQ ID NO: 2163813 - protein, 6 aa, Cryptosporidium hominis
SSTLSH

SEQ ID NO: 2163814 - protein, 11 aa, Cryptosporidium hominis
SSTNENTGNGS

SEQ ID NO: 2163815 - protein, 14 aa, Cryptosporidium hominis
SSTNERNESSESDI

SEQ ID NO: 2163816 - protein, 12 aa, Cryptosporidium hominis
SSTNNTNNREEI

SEQ ID NO: 2163817 - protein, 7 aa, Cryptosporidium hominis
SSTNRRV

SEQ ID NO: 2163818 - protein, 22 aa, Cryptosporidium hominis
SSTNTDKLEKISDTIKEQQSIH

SEQ ID NO: 2163819 - protein, 5 aa, Cryptosporidium hominis
SSTNW

SEQ ID NO: 2163820 - protein, 8 aa, Cryptosporidium hominis
SSTPESYA

SEQ ID NO: 2163821 - protein, 16 aa, Cryptosporidium hominis
SSTPISDSSIKNDFES

SEQ ID NO: 2163822 - protein, 8 aa, Cryptosporidium hominis
SSTPTTKD

SEQ ID NO: 2163823 - protein, 8 aa, Cryptosporidium hominis
SSTREELK

SEQ ID NO: 2163824 - protein, 7 aa, Cryptosporidium hominis
SSTRSGF

SEQ ID NO: 2163825 - protein, 7 aa, Cryptosporidium hominis
SSTSGNS

SEQ ID NO: 2163826 - protein, 14 aa, Cryptosporidium hominis
SSTSLTEKQSQAIS

SEQ ID NO: 2163827 - protein, 15 aa, Cryptosporidium hominis
SSTTEQVTSEEDANS

SEQ ID NO: 2163828 - protein, 55 aa, Cryptosporidium hominis
SSTTNTSNITNVTPPTTTTKDEGGKHYSSQNNNGISTSRKDFHATPNRRGGDSHY

SEQ ID NO: 2163829 - protein, 15 aa, Cryptosporidium hominis
SSTTSSTMATTPAVN

SEQ ID NO: 2163830 - protein, 14 aa, Cryptosporidium hominis
SSTVEYEESSFDTN

SEQ ID NO: 2163831 - protein, 6 aa, Cryptosporidium hominis
SSTYTT

SEQ ID NO: 2163832 - protein, 6 aa, Cryptosporidium hominis
SSVANG

SEQ ID NO: 2163833 - protein, 13 aa, Cryptosporidium hominis
SSVARKGNTYGDI

SEQ ID NO: 2163834 - protein, 26 aa, Cryptosporidium hominis
SSVGKSNSNTNIGGTISTPPTSTSNN

SEQ ID NO: 2163835 - protein, 6 aa, Cryptosporidium hominis
SSVGSE

SEQ ID NO: 2163836 - protein, 14 aa, Cryptosporidium hominis
SSVLADTGQFTNNK

SEQ ID NO: 2163837 - protein, 7 aa, Cryptosporidium hominis
SSVNISK

SEQ ID NO: 2163838 - protein, 7 aa, Cryptosporidium hominis
SSVNNES

SEQ ID NO: 2163839 - protein, 15 aa, Cryptosporidium hominis
SSVNSKMDSLRNQTT

SEQ ID NO: 2163840 - protein, 5 aa, Cryptosporidium hominis
SSVNT

SEQ ID NO: 2163841 - protein, 8 aa, Cryptosporidium hominis
SSVPNNDS

SEQ ID NO: 2163842 - protein, 8 aa, Cryptosporidium hominis
SSVPNYNP

SEQ ID NO: 2163843 - protein, 7 aa, Cryptosporidium hominis
SSVPPLD

SEQ ID NO: 2163844 - protein, 12 aa, Cryptosporidium hominis
SSVPSDSPDDYA

SEQ ID NO: 2163845 - protein, 13 aa, Cryptosporidium hominis
SSVQGENSPLSPF

SEQ ID NO: 2163846 - protein, 5 aa, Cryptosporidium hominis
SSVQT

SEQ ID NO: 2163847 - protein, 12 aa, Cryptosporidium hominis
SSVQTVPSNTVK

SEQ ID NO: 2163848 - protein, 6 aa, Cryptosporidium hominis
SSVSGD

SEQ ID NO: 2163849 - protein, 11 aa, Cryptosporidium hominis
SSVSGSSNPVG

SEQ ID NO: 2163850 - protein, 7 aa, Cryptosporidium hominis
SSVSNGL

SEQ ID NO: 2163851 - protein, 5 aa, Cryptosporidium hominis
SSVSP

SEQ ID NO: 2163852 - protein, 26 aa, Cryptosporidium hominis
SSVSPKSTVSPETKRGSSSAPNESIQ

SEQ ID NO: 2163853 - protein, 17 aa, Cryptosporidium hominis
SSVSSNSSHSSLGARQI

SEQ ID NO: 2163854 - protein, 42 aa, Cryptosporidium hominis
SSVSSVKSKSVQSSGPSSSSSSSSSSSASSSASSSSSSKKAQ

SEQ ID NO: 2163855 - protein, 5 aa, Cryptosporidium hominis
SSVST

SEQ ID NO: 2163856 - protein, 9 aa, Cryptosporidium hominis
SSVSTSNDD

SEQ ID NO: 2163857 - protein, 5 aa, Cryptosporidium hominis
SSVTA

SEQ ID NO: 2163858 - protein, 4 aa, Cryptosporidium hominis
SSVW

SEQ ID NO: 2163859 - protein, 26 aa, Cryptosporidium hominis
SSWGGFNTNNNNNNNNDNNRKEKNVS

SEQ ID NO: 2163860 - protein, 11 aa, Cryptosporidium hominis
SSWSNKNTNTL

SEQ ID NO: 2163861 - protein, 5 aa, Cryptosporidium hominis
SSYDR

SEQ ID NO: 2163862 - protein, 17 aa, Cryptosporidium hominis
SSYEDDDYDDNDDNDGK

SEQ ID NO: 2163863 - protein, 4 aa, Cryptosporidium hominis
SSYF

SEQ ID NO: 2163864 - protein, 8 aa, Cryptosporidium hominis
SSYGPESI

SEQ ID NO: 2163865 - protein, 13 aa, Cryptosporidium hominis
SSYIENKEDELDE

SEQ ID NO: 2163866 - protein, 17 aa, Cryptosporidium hominis
SSYKSVKEYPKERSSSR

SEQ ID NO: 2163867 - protein, 10 aa, Cryptosporidium hominis
SSYNINSKER

SEQ ID NO: 2163868 - protein, 12 aa, Cryptosporidium hominis
SSYQQNSKEDGR

SEQ ID NO: 2163869 - protein, 8 aa, Cryptosporidium hominis
SSYQSNPN

SEQ ID NO: 2163870 - protein, 4 aa, Cryptosporidium hominis
SSYS

SEQ ID NO: 2163871 - protein, 13 aa, Cryptosporidium hominis
SSYSKRSSISQEN

SEQ ID NO: 2163872 - protein, 14 aa, Cryptosporidium hominis
SSYSNDSGHYNSVN

SEQ ID NO: 2163873 - protein, 10 aa, Cryptosporidium hominis
SSYTSGSNEK

SEQ ID NO: 2163874 - protein, 77 aa, Cryptosporidium hominis
SSYTSTTTTNTATTTATATTTTKTATNTSTTTTTNNSAQGVTTDSQRAVTQSDSKSKVQDQLKTQTTTQFQDQNVSG

SEQ ID NO: 2163875 - protein, 7 aa, Cryptosporidium hominis
STAGESK

SEQ ID NO: 2163876 - protein, 10 aa, Cryptosporidium hominis
STAGVTSEKE

SEQ ID NO: 2163877 - protein, 5 aa, Cryptosporidium hominis
STAKN

SEQ ID NO: 2163878 - protein, 13 aa, Cryptosporidium hominis
STAPSSKPSPQFS

SEQ ID NO: 2163879 - protein, 14 aa, Cryptosporidium hominis
STAQDSFNVFIPNN

SEQ ID NO: 2163880 - protein, 6 aa, Cryptosporidium hominis
STARAL

SEQ ID NO: 2163881 - protein, 14 aa, Cryptosporidium hominis
STARDGPAQNQGYI

SEQ ID NO: 2163882 - protein, 10 aa, Cryptosporidium hominis
STASATPIAE

SEQ ID NO: 2163883 - protein, 6 aa, Cryptosporidium hominis
STASDG

SEQ ID NO: 2163884 - protein, 9 aa, Cryptosporidium hominis
STASGEKMT

SEQ ID NO: 2163885 - protein, 7 aa, Cryptosporidium hominis
STASTET

SEQ ID NO: 2163886 - protein, 5 aa, Cryptosporidium hominis
STDEN

SEQ ID NO: 2163887 - protein, 15 aa, Cryptosporidium hominis
STDFPSKRKVPLDTN

SEQ ID NO: 2163888 - protein, 7 aa, Cryptosporidium hominis
STDHDPK

SEQ ID NO: 2163889 - protein, 9 aa, Cryptosporidium hominis
STDKRGDVG

SEQ ID NO: 2163890 - protein, 6 aa, Cryptosporidium hominis
STDKTY

SEQ ID NO: 2163891 - protein, 12 aa, Cryptosporidium hominis
STDLSGRIKGQN

SEQ ID NO: 2163892 - protein, 16 aa, Cryptosporidium hominis
STDNGTLNNIENTNNL

SEQ ID NO: 2163893 - protein, 16 aa, Cryptosporidium hominis
STDNHHRELPTGFKNS

SEQ ID NO: 2163894 - protein, 9 aa, Cryptosporidium hominis
STDNPGSLF

SEQ ID NO: 2163895 - protein, 16 aa, Cryptosporidium hominis
STDNPNSRPGKPSNRF

SEQ ID NO: 2163896 - protein, 17 aa, Cryptosporidium hominis
STDPKNLSAMKPTWMPW

SEQ ID NO: 2163897 - protein, 5 aa, Cryptosporidium hominis
STDRS

SEQ ID NO: 2163898 - protein, 10 aa, Cryptosporidium hominis
STDSIKKHNS

SEQ ID NO: 2163899 - protein, 13 aa, Cryptosporidium hominis
STDTTPQSLRPQL

SEQ ID NO: 2163900 - protein, 11 aa, Cryptosporidium hominis
STEATNVDPQQ

SEQ ID NO: 2163901 - protein, 4 aa, Cryptosporidium hominis
STEC

SEQ ID NO: 2163902 - protein, 15 aa, Cryptosporidium hominis
STECEQSKNETESSN

SEQ ID NO: 2163903 - protein, 4 aa, Cryptosporidium hominis
STED

SEQ ID NO: 2163904 - protein, 10 aa, Cryptosporidium hominis
STEDEEQFRS

SEQ ID NO: 2163905 - protein, 18 aa, Cryptosporidium hominis
STEDPNNRFGSPPASTQV

SEQ ID NO: 2163906 - protein, 5 aa, Cryptosporidium hominis
STEDS

SEQ ID NO: 2163907 - protein, 9 aa, Cryptosporidium hominis
STEGGTKNR

SEQ ID NO: 2163908 - protein, 13 aa, Cryptosporidium hominis
STEHPDAPERPGY

SEQ ID NO: 2163909 - protein, 6 aa, Cryptosporidium hominis
STEIGS

SEQ ID NO: 2163910 - protein, 8 aa, Cryptosporidium hominis
STEKESEQ

SEQ ID NO: 2163911 - protein, 11 aa, Cryptosporidium hominis
STELDQPKDNL

SEQ ID NO: 2163912 - protein, 8 aa, Cryptosporidium hominis
STENALEN

SEQ ID NO: 2163913 - protein, 6 aa, Cryptosporidium hominis
STEPIP

SEQ ID NO: 2163914 - protein, 5 aa, Cryptosporidium hominis
STEQL

SEQ ID NO: 2163915 - protein, 13 aa, Cryptosporidium hominis
STEQNNNKTLENQ

SEQ ID NO: 2163916 - protein, 9 aa, Cryptosporidium hominis
STEQVKGYG

SEQ ID NO: 2163917 - protein, 8 aa, Cryptosporidium hominis
STESENEY

SEQ ID NO: 2163918 - protein, 18 aa, Cryptosporidium hominis
STESTDFKADKKLNSVTD

SEQ ID NO: 2163919 - protein, 6 aa, Cryptosporidium hominis
STESTV

SEQ ID NO: 2163920 - protein, 8 aa, Cryptosporidium hominis
STETASLT

SEQ ID NO: 2163921 - protein, 12 aa, Cryptosporidium hominis
STETSYSTQTKN

SEQ ID NO: 2163922 - protein, 5 aa, Cryptosporidium hominis
STFDT

SEQ ID NO: 2163923 - protein, 21 aa, Cryptosporidium hominis
STFEGTDDKLGQEIKSKEESI

SEQ ID NO: 2163924 - protein, 25 aa, Cryptosporidium hominis
STFEQENKEDQDKEFKSEDSDHDNQ

SEQ ID NO: 2163925 - protein, 6 aa, Cryptosporidium hominis
STFNSP

SEQ ID NO: 2163926 - protein, 8 aa, Cryptosporidium hominis
STFSKTEP

SEQ ID NO: 2163927 - protein, 13 aa, Cryptosporidium hominis
STFSSENKPHTEI

SEQ ID NO: 2163928 - protein, 12 aa, Cryptosporidium hominis
STFTASRPTTFQ

SEQ ID NO: 2163929 - protein, 14 aa, Cryptosporidium hominis
STGDDGRCLLWDVR

SEQ ID NO: 2163930 - protein, 15 aa, Cryptosporidium hominis
STGDSKQSSAEDALR

SEQ ID NO: 2163931 - protein, 6 aa, Cryptosporidium hominis
STGEKR

SEQ ID NO: 2163932 - protein, 27 aa, Cryptosporidium hominis
STGEQLNQKAQNLSQSIKEKNKKLQEM

SEQ ID NO: 2163933 - protein, 11 aa, Cryptosporidium hominis
STGGLKEKNLN

SEQ ID NO: 2163934 - protein, 8 aa, Cryptosporidium hominis
STGIPEND

SEQ ID NO: 2163935 - protein, 5 aa, Cryptosporidium hominis
STGKC

SEQ ID NO: 2163936 - protein, 11 aa, Cryptosporidium hominis
STGKYGPTRSQ

SEQ ID NO: 2163937 - protein, 12 aa, Cryptosporidium hominis
STGLPSNRIGPS

SEQ ID NO: 2163938 - protein, 18 aa, Cryptosporidium hominis
STGNGKKVSIDEESLSRA

SEQ ID NO: 2163939 - protein, 6 aa, Cryptosporidium hominis
STGNLQ

SEQ ID NO: 2163940 - protein, 7 aa, Cryptosporidium hominis
STGPKTK

SEQ ID NO: 2163941 - protein, 7 aa, Cryptosporidium hominis
STGQKKK

SEQ ID NO: 2163942 - protein, 15 aa, Cryptosporidium hominis
STGQYVSTGGTDGTI

SEQ ID NO: 2163943 - protein, 21 aa, Cryptosporidium hominis
STGSGKKLSIDEENLNRGKQI

SEQ ID NO: 2163944 - protein, 16 aa, Cryptosporidium hominis
STGSGKKVSITEETLN

SEQ ID NO: 2163945 - protein, 6 aa, Cryptosporidium hominis
STGSSS

SEQ ID NO: 2163946 - protein, 9 aa, Cryptosporidium hominis
STGTAPNKL

SEQ ID NO: 2163947 - protein, 5 aa, Cryptosporidium hominis
STGTI

SEQ ID NO: 2163948 - protein, 11 aa, Cryptosporidium hominis
STGTPRGKTSQ

SEQ ID NO: 2163949 - protein, 10 aa, Cryptosporidium hominis
STGTRGAQSA

SEQ ID NO: 2163950 - protein, 11 aa, Cryptosporidium hominis
STGYNGTPKNM

SEQ ID NO: 2163951 - protein, 10 aa, Cryptosporidium hominis
STHENNSKQG

SEQ ID NO: 2163952 - protein, 16 aa, Cryptosporidium hominis
STHNGRSSTRHAPRSH

SEQ ID NO: 2163953 - protein, 5 aa, Cryptosporidium hominis
STHNQ

SEQ ID NO: 2163954 - protein, 7 aa, Cryptosporidium hominis
STHSKNC

SEQ ID NO: 2163955 - protein, 6 aa, Cryptosporidium hominis
STHYGR

SEQ ID NO: 2163956 - protein, 5 aa, Cryptosporidium hominis
STIEE

SEQ ID NO: 2163957 - protein, 5 aa, Cryptosporidium hominis
STIEN

SEQ ID NO: 2163958 - protein, 14 aa, Cryptosporidium hominis
STIENSINATSQEE

SEQ ID NO: 2163959 - protein, 11 aa, Cryptosporidium hominis
STIENSVSDEN

SEQ ID NO: 2163960 - protein, 15 aa, Cryptosporidium hominis
STIGNNRGGMTGGDI

SEQ ID NO: 2163961 - protein, 8 aa, Cryptosporidium hominis
STIGNTDL

SEQ ID NO: 2163962 - protein, 6 aa, Cryptosporidium hominis
STIKQD

SEQ ID NO: 2163963 - protein, 4 aa, Cryptosporidium hominis
STIL

SEQ ID NO: 2163964 - protein, 11 aa, Cryptosporidium hominis
STINSDSNHFE

SEQ ID NO: 2163965 - protein, 18 aa, Cryptosporidium hominis
STINSNNNQNEKLTDNQE

SEQ ID NO: 2163966 - protein, 4 aa, Cryptosporidium hominis
STIQ

SEQ ID NO: 2163967 - protein, 13 aa, Cryptosporidium hominis
STIQTLSSNPKSI

SEQ ID NO: 2163968 - protein, 4 aa, Cryptosporidium hominis
STIS

SEQ ID NO: 2163969 - protein, 9 aa, Cryptosporidium hominis
STISKSADY

SEQ ID NO: 2163970 - protein, 6 aa, Cryptosporidium hominis
STISSK

SEQ ID NO: 2163971 - protein, 14 aa, Cryptosporidium hominis
STITDTGHTDENDS

SEQ ID NO: 2163972 - protein, 15 aa, Cryptosporidium hominis
STKANNNKKSTSILR

SEQ ID NO: 2163973 - protein, 8 aa, Cryptosporidium hominis
STKDDSEL

SEQ ID NO: 2163974 - protein, 6 aa, Cryptosporidium hominis
STKDPL

SEQ ID NO: 2163975 - protein, 6 aa, Cryptosporidium hominis
STKDST

SEQ ID NO: 2163976 - protein, 7 aa, Cryptosporidium hominis
STKEGVD

SEQ ID NO: 2163977 - protein, 9 aa, Cryptosporidium hominis
STKEKYRWG

SEQ ID NO: 2163978 - protein, 7 aa, Cryptosporidium hominis
STKESYN

SEQ ID NO: 2163979 - protein, 13 aa, Cryptosporidium hominis
STKISAENTQSIT

SEQ ID NO: 2163980 - protein, 7 aa, Cryptosporidium hominis
STKNSNL

SEQ ID NO: 2163981 - protein, 9 aa, Cryptosporidium hominis
STKNSRDLQ

SEQ ID NO: 2163982 - protein, 10 aa, Cryptosporidium hominis
STKPNGHHHP

SEQ ID NO: 2163983 - protein, 9 aa, Cryptosporidium hominis
STKPSRRQC

SEQ ID NO: 2163984 - protein, 9 aa, Cryptosporidium hominis
STKSKSKLE

SEQ ID NO: 2163985 - protein, 13 aa, Cryptosporidium hominis
STKSNSAFAQNKK

SEQ ID NO: 2163986 - protein, 5 aa, Cryptosporidium hominis
STKSV

SEQ ID NO: 2163987 - protein, 10 aa, Cryptosporidium hominis
STKTTVSSVE

SEQ ID NO: 2163988 - protein, 17 aa, Cryptosporidium hominis
STKVNLSKKSKLENTHS

SEQ ID NO: 2163989 - protein, 4 aa, Cryptosporidium hominis
STKY

SEQ ID NO: 2163990 - protein, 5 aa, Cryptosporidium hominis
STLDI

SEQ ID NO: 2163991 - protein, 12 aa, Cryptosporidium hominis
STLDPEKNDQNE

SEQ ID NO: 2163992 - protein, 6 aa, Cryptosporidium hominis
STLDSG

SEQ ID NO: 2163993 - protein, 20 aa, Cryptosporidium hominis
STLDSGNIRSNLNGSQNNTL

SEQ ID NO: 2163994 - protein, 5 aa, Cryptosporidium hominis
STLDT

SEQ ID NO: 2163995 - protein, 6 aa, Cryptosporidium hominis
STLGSE

SEQ ID NO: 2163996 - protein, 4 aa, Cryptosporidium hominis
STLL

SEQ ID NO: 2163997 - protein, 12 aa, Cryptosporidium hominis
STLNTGNELEDL

SEQ ID NO: 2163998 - protein, 4 aa, Cryptosporidium hominis
STLP

SEQ ID NO: 2163999 - protein, 16 aa, Cryptosporidium hominis
STLPDTDLIEFSKYKT

SEQ ID NO: 2164000 - protein, 7 aa, Cryptosporidium hominis
STLPTPA

SEQ ID NO: 2164001 - protein, 8 aa, Cryptosporidium hominis
STLSDSQA

SEQ ID NO: 2164002 - protein, 8 aa, Cryptosporidium hominis
STLSNNKI

SEQ ID NO: 2164003 - protein, 7 aa, Cryptosporidium hominis
STLSPEQ

SEQ ID NO: 2164004 - protein, 14 aa, Cryptosporidium hominis
STLSTKNSAPSPSY

SEQ ID NO: 2164005 - protein, 18 aa, Cryptosporidium hominis
STNAGRKGTGKKRTRGMP

SEQ ID NO: 2164006 - protein, 12 aa, Cryptosporidium hominis
STNAPNDNIDLF

SEQ ID NO: 2164007 - protein, 35 aa, Cryptosporidium hominis
STNCQSSEGNNNKEIPTKTLPSNITTSKTTLYGRN

SEQ ID NO: 2164008 - protein, 4 aa, Cryptosporidium hominis
STND

SEQ ID NO: 2164009 - protein, 11 aa, Cryptosporidium hominis
STNDEKSRKKL

SEQ ID NO: 2164010 - protein, 8 aa, Cryptosporidium hominis
STNEDKKI

SEQ ID NO: 2164011 - protein, 14 aa, Cryptosporidium hominis
STNEEAGDGTTTAT

SEQ ID NO: 2164012 - protein, 56 aa, Cryptosporidium hominis
STNHGNRKSTVFTSSTSKSPFSNKEFKKDPKTKVSNVTNSNMKDGSSFKSEIENGE

SEQ ID NO: 2164013 - protein, 5 aa, Cryptosporidium hominis
STNHS

SEQ ID NO: 2164014 - protein, 28 aa, Cryptosporidium hominis
STNIEGSGSIGSVSGGLNSSSRGDDGGL

SEQ ID NO: 2164015 - protein, 12 aa, Cryptosporidium hominis
STNIERESQYKQ

SEQ ID NO: 2164016 - protein, 5 aa, Cryptosporidium hominis
STNIS

SEQ ID NO: 2164017 - protein, 4 aa, Cryptosporidium hominis
STNK

SEQ ID NO: 2164018 - protein, 9 aa, Cryptosporidium hominis
STNKRLDEL

SEQ ID NO: 2164019 - protein, 5 aa, Cryptosporidium hominis
STNKS

SEQ ID NO: 2164020 - protein, 11 aa, Cryptosporidium hominis
STNKSDSGNSD

SEQ ID NO: 2164021 - protein, 11 aa, Cryptosporidium hominis
STNKSQSQSEI

SEQ ID NO: 2164022 - protein, 25 aa, Cryptosporidium hominis
STNKTLKDCEKKNPKPNCKKAQNFD

SEQ ID NO: 2164023 - protein, 4 aa, Cryptosporidium hominis
STNL

SEQ ID NO: 2164024 - protein, 51 aa, Cryptosporidium hominis
STNLSRSQNVSLTKQNEGLNGSGVNNSSAGNSLSNNPSISNELKDKPQLSG

SEQ ID NO: 2164025 - protein, 7 aa, Cryptosporidium hominis
STNNERH

SEQ ID NO: 2164026 - protein, 7 aa, Cryptosporidium hominis
STNNGQI

SEQ ID NO: 2164027 - protein, 8 aa, Cryptosporidium hominis
STNNYGKT

SEQ ID NO: 2164028 - protein, 7 aa, Cryptosporidium hominis
STNPGGA

SEQ ID NO: 2164029 - protein, 15 aa, Cryptosporidium hominis
STNQENSDSKVDKGC

SEQ ID NO: 2164030 - protein, 10 aa, Cryptosporidium hominis
STNRNDRPIQ

SEQ ID NO: 2164031 - protein, 8 aa, Cryptosporidium hominis
STNSEQYI

SEQ ID NO: 2164032 - protein, 8 aa, Cryptosporidium hominis
STNSKQVF

SEQ ID NO: 2164033 - protein, 9 aa, Cryptosporidium hominis
STNSNSSMI

SEQ ID NO: 2164034 - protein, 27 aa, Cryptosporidium hominis
STNSNSTSHEATNSIPPNVSNQTSDSF

SEQ ID NO: 2164035 - protein, 12 aa, Cryptosporidium hominis
STNSNTGGGTLS

SEQ ID NO: 2164036 - protein, 8 aa, Cryptosporidium hominis
STNTGEKK

SEQ ID NO: 2164037 - protein, 19 aa, Cryptosporidium hominis
STNTTNGVSSIGTSTSSGQ

SEQ ID NO: 2164038 - protein, 4 aa, Cryptosporidium hominis
STPD

SEQ ID NO: 2164039 - protein, 7 aa, Cryptosporidium hominis
STPDGRR

SEQ ID NO: 2164040 - protein, 4 aa, Cryptosporidium hominis
STPE

SEQ ID NO: 2164041 - protein, 9 aa, Cryptosporidium hominis
STPEIEDDV

SEQ ID NO: 2164042 - protein, 6 aa, Cryptosporidium hominis
STPFTK

SEQ ID NO: 2164043 - protein, 6 aa, Cryptosporidium hominis
STPGTQ

SEQ ID NO: 2164044 - protein, 13 aa, Cryptosporidium hominis
STPHTTTSPAGIS

SEQ ID NO: 2164045 - protein, 4 aa, Cryptosporidium hominis
STPI

SEQ ID NO: 2164046 - protein, 7 aa, Cryptosporidium hominis
STPIRKS

SEQ ID NO: 2164047 - protein, 7 aa, Cryptosporidium hominis
STPNEEY

SEQ ID NO: 2164048 - protein, 6 aa, Cryptosporidium hominis
STPNEH

SEQ ID NO: 2164049 - protein, 6 aa, Cryptosporidium hominis
STPNNV

SEQ ID NO: 2164050 - protein, 5 aa, Cryptosporidium hominis
STPNS

SEQ ID NO: 2164051 - protein, 6 aa, Cryptosporidium hominis
STPPKV

SEQ ID NO: 2164052 - protein, 14 aa, Cryptosporidium hominis
STPQSNGKEGSKSI

SEQ ID NO: 2164053 - protein, 4 aa, Cryptosporidium hominis
STPR

SEQ ID NO: 2164054 - protein, 28 aa, Cryptosporidium hominis
STPRKRVRGTENGFNSSNNNNNSNTGLD

SEQ ID NO: 2164055 - protein, 12 aa, Cryptosporidium hominis
STPRRSKNIEDE

SEQ ID NO: 2164056 - protein, 17 aa, Cryptosporidium hominis
STPRSTSCQTPKTKNHM

SEQ ID NO: 2164057 - protein, 10 aa, Cryptosporidium hominis
STPSGTIPGL

SEQ ID NO: 2164058 - protein, 8 aa, Cryptosporidium hominis
STPTGPAI

SEQ ID NO: 2164059 - protein, 5 aa, Cryptosporidium hominis
STPTT

SEQ ID NO: 2164060 - protein, 7 aa, Cryptosporidium hominis
STPYSNI

SEQ ID NO: 2164061 - protein, 8 aa, Cryptosporidium hominis
STQCESDG

SEQ ID NO: 2164062 - protein, 6 aa, Cryptosporidium hominis
STQDRE

SEQ ID NO: 2164063 - protein, 14 aa, Cryptosporidium hominis
STQDTFEKAKKSCE

SEQ ID NO: 2164064 - protein, 17 aa, Cryptosporidium hominis
STQEESPFTGTKATEDI

SEQ ID NO: 2164065 - protein, 11 aa, Cryptosporidium hominis
STQGEKMSEAK

SEQ ID NO: 2164066 - protein, 18 aa, Cryptosporidium hominis
STQIGKDNMGYSNRKQRR

SEQ ID NO: 2164067 - protein, 5 aa, Cryptosporidium hominis
STQIN

SEQ ID NO: 2164068 - protein, 4 aa, Cryptosporidium hominis
STQP

SEQ ID NO: 2164069 - protein, 7 aa, Cryptosporidium hominis
STQPIDK

SEQ ID NO: 2164070 - protein, 6 aa, Cryptosporidium hominis
STQPLN

SEQ ID NO: 2164071 - protein, 10 aa, Cryptosporidium hominis
STQSNDEVNS

SEQ ID NO: 2164072 - protein, 23 aa, Cryptosporidium hominis
STQSTSKSGRRLATNHEAGSRQL

SEQ ID NO: 2164073 - protein, 6 aa, Cryptosporidium hominis
STQTGG

SEQ ID NO: 2164074 - protein, 8 aa, Cryptosporidium hominis
STRDPTTA

SEQ ID NO: 2164075 - protein, 7 aa, Cryptosporidium hominis
STRDQQQ

SEQ ID NO: 2164076 - protein, 10 aa, Cryptosporidium hominis
STRGGKKDRH

SEQ ID NO: 2164077 - protein, 10 aa, Cryptosporidium hominis
STRKGTGTRL

SEQ ID NO: 2164078 - protein, 15 aa, Cryptosporidium hominis
STRKIPSKTGLGSNE

SEQ ID NO: 2164079 - protein, 13 aa, Cryptosporidium hominis
STRKKFGYNRSEK

SEQ ID NO: 2164080 - protein, 5 aa, Cryptosporidium hominis
STRNL

SEQ ID NO: 2164081 - protein, 36 aa, Cryptosporidium hominis
STRSRRTRNSNDNSHSSNNIIGNEDHSISSNTGNAS

SEQ ID NO: 2164082 - protein, 12 aa, Cryptosporidium hominis
STRSTSAPYTPT

SEQ ID NO: 2164083 - protein, 7 aa, Cryptosporidium hominis
STRTISN

SEQ ID NO: 2164084 - protein, 10 aa, Cryptosporidium hominis
STSASDCTKI

SEQ ID NO: 2164085 - protein, 10 aa, Cryptosporidium hominis
STSASTSSSL

SEQ ID NO: 2164086 - protein, 5 aa, Cryptosporidium hominis
STSCD

SEQ ID NO: 2164087 - protein, 9 aa, Cryptosporidium hominis
STSDGSSGI

SEQ ID NO: 2164088 - protein, 6 aa, Cryptosporidium hominis
STSDNK

SEQ ID NO: 2164089 - protein, 6 aa, Cryptosporidium hominis
STSDTD

SEQ ID NO: 2164090 - protein, 38 aa, Cryptosporidium hominis
STSEASNHSSDCEYESEMDTSSPFNGETNSITNTPEIH

SEQ ID NO: 2164091 - protein, 6 aa, Cryptosporidium hominis
STSEFP

SEQ ID NO: 2164092 - protein, 12 aa, Cryptosporidium hominis
STSEHMNNPDKR

SEQ ID NO: 2164093 - protein, 8 aa, Cryptosporidium hominis
STSESNID

SEQ ID NO: 2164094 - protein, 6 aa, Cryptosporidium hominis
STSESR

SEQ ID NO: 2164095 - protein, 11 aa, Cryptosporidium hominis
STSETKIEAGR

SEQ ID NO: 2164096 - protein, 8 aa, Cryptosporidium hominis
STSFASKP

SEQ ID NO: 2164097 - protein, 5 aa, Cryptosporidium hominis
STSFN

SEQ ID NO: 2164098 - protein, 5 aa, Cryptosporidium hominis
STSGK

SEQ ID NO: 2164099 - protein, 5 aa, Cryptosporidium hominis
STSGT

SEQ ID NO: 2164100 - protein, 10 aa, Cryptosporidium hominis
STSHASIRSR

SEQ ID NO: 2164101 - protein, 10 aa, Cryptosporidium hominis
STSIKAESLD

SEQ ID NO: 2164102 - protein, 15 aa, Cryptosporidium hominis
STSKKSEKRKKKKMQ

SEQ ID NO: 2164103 - protein, 8 aa, Cryptosporidium hominis
STSKLNEL

SEQ ID NO: 2164104 - protein, 11 aa, Cryptosporidium hominis
STSKTGKHGHA

SEQ ID NO: 2164105 - protein, 14 aa, Cryptosporidium hominis
STSNDDHKNFSNTN

SEQ ID NO: 2164106 - protein, 9 aa, Cryptosporidium hominis
STSNFDRDS

SEQ ID NO: 2164107 - protein, 10 aa, Cryptosporidium hominis
STSPYNKPTH

SEQ ID NO: 2164108 - protein, 4 aa, Cryptosporidium hominis
STSQ

SEQ ID NO: 2164109 - protein, 6 aa, Cryptosporidium hominis
STSQNG

SEQ ID NO: 2164110 - protein, 26 aa, Cryptosporidium hominis
STSQSNLSHSNSSNSLSFGSSGTTTL

SEQ ID NO: 2164111 - protein, 20 aa, Cryptosporidium hominis
STSRNSKVERIPGKKLSTKL

SEQ ID NO: 2164112 - protein, 5 aa, Cryptosporidium hominis
STSRW

SEQ ID NO: 2164113 - protein, 22 aa, Cryptosporidium hominis
STSSENNDGENLDKNINKTKRQ

SEQ ID NO: 2164114 - protein, 21 aa, Cryptosporidium hominis
STSSGLNLNSGLGKNGIGSGD

SEQ ID NO: 2164115 - protein, 7 aa, Cryptosporidium hominis
STSSNHV

SEQ ID NO: 2164116 - protein, 6 aa, Cryptosporidium hominis
STSSPS

SEQ ID NO: 2164117 - protein, 13 aa, Cryptosporidium hominis
STSSSTNNSSSII

SEQ ID NO: 2164118 - protein, 13 aa, Cryptosporidium hominis
STSSSTSITPSNS

SEQ ID NO: 2164119 - protein, 7 aa, Cryptosporidium hominis
STSTGFA

SEQ ID NO: 2164120 - protein, 62 aa, Cryptosporidium hominis
STSTTTTTTTTTTTTTSTTTTTTTTTTTTTTTTTTTTTTTTTTTTTTTIATTEIGNSNRDNM

SEQ ID NO: 2164121 - protein, 9 aa, Cryptosporidium hominis
STTAPPSNY

SEQ ID NO: 2164122 - protein, 6 aa, Cryptosporidium hominis
STTEED

SEQ ID NO: 2164123 - protein, 6 aa, Cryptosporidium hominis
STTGED

SEQ ID NO: 2164124 - protein, 9 aa, Cryptosporidium hominis
STTGRGCSG

SEQ ID NO: 2164125 - protein, 6 aa, Cryptosporidium hominis
STTKIY

SEQ ID NO: 2164126 - protein, 5 aa, Cryptosporidium hominis
STTKK

SEQ ID NO: 2164127 - protein, 6 aa, Cryptosporidium hominis
STTKLI

SEQ ID NO: 2164128 - protein, 7 aa, Cryptosporidium hominis
STTKSIH

SEQ ID NO: 2164129 - protein, 12 aa, Cryptosporidium hominis
STTKSSNCSNNI

SEQ ID NO: 2164130 - protein, 5 aa, Cryptosporidium hominis
STTLK

SEQ ID NO: 2164131 - protein, 11 aa, Cryptosporidium hominis
STTNTNGIPTR

SEQ ID NO: 2164132 - protein, 5 aa, Cryptosporidium hominis
STTNV

SEQ ID NO: 2164133 - protein, 4 aa, Cryptosporidium hominis
STTQ

SEQ ID NO: 2164134 - protein, 6 aa, Cryptosporidium hominis
STTRIR

SEQ ID NO: 2164135 - protein, 10 aa, Cryptosporidium hominis
STTSSGESHG

SEQ ID NO: 2164136 - protein, 8 aa, Cryptosporidium hominis
STTSSSSI

SEQ ID NO: 2164137 - protein, 9 aa, Cryptosporidium hominis
STTTGGRVT

SEQ ID NO: 2164138 - protein, 4 aa, Cryptosporidium hominis
STTV

SEQ ID NO: 2164139 - protein, 8 aa, Cryptosporidium hominis
STVKENNR

SEQ ID NO: 2164140 - protein, 6 aa, Cryptosporidium hominis
STVNSL

SEQ ID NO: 2164141 - protein, 31 aa, Cryptosporidium hominis
STVPDSGSVSGSESESKLETIPEESSDSYEP

SEQ ID NO: 2164142 - protein, 9 aa, Cryptosporidium hominis
STYEKVENG

SEQ ID NO: 2164143 - protein, 4 aa, Cryptosporidium hominis
STYG

SEQ ID NO: 2164144 - protein, 5 aa, Cryptosporidium hominis
STYGQ

SEQ ID NO: 2164145 - protein, 6 aa, Cryptosporidium hominis
STYPPF

SEQ ID NO: 2164146 - protein, 9 aa, Cryptosporidium hominis
STYRNSNDC

SEQ ID NO: 2164147 - protein, 9 aa, Cryptosporidium hominis
SVAEATDEE

SEQ ID NO: 2164148 - protein, 10 aa, Cryptosporidium hominis
SVANINSSNQ

SEQ ID NO: 2164149 - protein, 31 aa, Cryptosporidium hominis
SVAPETNTNNVDNQNDVQTSAISTPVCKPKE

SEQ ID NO: 2164150 - protein, 8 aa, Cryptosporidium hominis
SVAPNSYY

SEQ ID NO: 2164151 - protein, 23 aa, Cryptosporidium hominis
SVASSGSKNEKQRSKQTLKSRNE

SEQ ID NO: 2164152 - protein, 10 aa, Cryptosporidium hominis
SVCKEGANEF

SEQ ID NO: 2164153 - protein, 12 aa, Cryptosporidium hominis
SVDGDNVAKEAI

SEQ ID NO: 2164154 - protein, 10 aa, Cryptosporidium hominis
SVDPKGKWKQ

SEQ ID NO: 2164155 - protein, 8 aa, Cryptosporidium hominis
SVDQGDSS

SEQ ID NO: 2164156 - protein, 8 aa, Cryptosporidium hominis
SVDQSSDI

SEQ ID NO: 2164157 - protein, 4 aa, Cryptosporidium hominis
SVDS

SEQ ID NO: 2164158 - protein, 9 aa, Cryptosporidium hominis
SVDSNAERN

SEQ ID NO: 2164159 - protein, 17 aa, Cryptosporidium hominis
SVDTNGNTSFGRTNMSR

SEQ ID NO: 2164160 - protein, 6 aa, Cryptosporidium hominis
SVEDSE

SEQ ID NO: 2164161 - protein, 13 aa, Cryptosporidium hominis
SVEEGYDSKRQEI

SEQ ID NO: 2164162 - protein, 8 aa, Cryptosporidium hominis
SVEEYRDQ

SEQ ID NO: 2164163 - protein, 6 aa, Cryptosporidium hominis
SVENKL

SEQ ID NO: 2164164 - protein, 9 aa, Cryptosporidium hominis
SVENPESKD

SEQ ID NO: 2164165 - protein, 5 aa, Cryptosporidium hominis
SVENT

SEQ ID NO: 2164166 - protein, 4 aa, Cryptosporidium hominis
SVES

SEQ ID NO: 2164167 - protein, 11 aa, Cryptosporidium hominis
SVESEKDGLGK

SEQ ID NO: 2164168 - protein, 8 aa, Cryptosporidium hominis
SVESQDVP

SEQ ID NO: 2164169 - protein, 5 aa, Cryptosporidium hominis
SVETE

SEQ ID NO: 2164170 - protein, 8 aa, Cryptosporidium hominis
SVETEKAD

SEQ ID NO: 2164171 - protein, 10 aa, Cryptosporidium hominis
SVFDSNSQSS

SEQ ID NO: 2164172 - protein, 9 aa, Cryptosporidium hominis
SVGDESDLE

SEQ ID NO: 2164173 - protein, 12 aa, Cryptosporidium hominis
SVGESNSNISNN

SEQ ID NO: 2164174 - protein, 7 aa, Cryptosporidium hominis
SVGGNKM

SEQ ID NO: 2164175 - protein, 6 aa, Cryptosporidium hominis
SVGNTI

SEQ ID NO: 2164176 - protein, 13 aa, Cryptosporidium hominis
SVGSNDPRCSENL

SEQ ID NO: 2164177 - protein, 36 aa, Cryptosporidium hominis
SVGSSQYNKRNNIKENTEVDEKEPITLSKEDDLKKE

SEQ ID NO: 2164178 - protein, 10 aa, Cryptosporidium hominis
SVGTEKDNEM

SEQ ID NO: 2164179 - protein, 8 aa, Cryptosporidium hominis
SVGTPDEL

SEQ ID NO: 2164180 - protein, 10 aa, Cryptosporidium hominis
SVKAGGTYIE

SEQ ID NO: 2164181 - protein, 14 aa, Cryptosporidium hominis
SVKDEKQDQGMTED

SEQ ID NO: 2164182 - protein, 17 aa, Cryptosporidium hominis
SVKDKEQKMSGNYFLLE

SEQ ID NO: 2164183 - protein, 17 aa, Cryptosporidium hominis
SVKKDTEIITQGDNGDK

SEQ ID NO: 2164184 - protein, 13 aa, Cryptosporidium hominis
SVKKKKKNKPIVS

SEQ ID NO: 2164185 - protein, 8 aa, Cryptosporidium hominis
SVKNESST

SEQ ID NO: 2164186 - protein, 8 aa, Cryptosporidium hominis
SVKPSKNL

SEQ ID NO: 2164187 - protein, 16 aa, Cryptosporidium hominis
SVKPSSTITHHRTFTS

SEQ ID NO: 2164188 - protein, 5 aa, Cryptosporidium hominis
SVKQN

SEQ ID NO: 2164189 - protein, 30 aa, Cryptosporidium hominis
SVKSQQSSRSHSVPPSLSPSPSSSPTLQAS

SEQ ID NO: 2164190 - protein, 4 aa, Cryptosporidium hominis
SVKV

SEQ ID NO: 2164191 - protein, 5 aa, Cryptosporidium hominis
SVLDG

SEQ ID NO: 2164192 - protein, 5 aa, Cryptosporidium hominis
SVLGS

SEQ ID NO: 2164193 - protein, 9 aa, Cryptosporidium hominis
SVLPPSPGK

SEQ ID NO: 2164194 - protein, 6 aa, Cryptosporidium hominis
SVNNEN

SEQ ID NO: 2164195 - protein, 11 aa, Cryptosporidium hominis
SVNNNNKNRNS

SEQ ID NO: 2164196 - protein, 9 aa, Cryptosporidium hominis
SVNPPPQIA

SEQ ID NO: 2164197 - protein, 9 aa, Cryptosporidium hominis
SVNSKNLSN

SEQ ID NO: 2164198 - protein, 15 aa, Cryptosporidium hominis
SVNSSEETNCTTSSE

SEQ ID NO: 2164199 - protein, 7 aa, Cryptosporidium hominis
SVNSSFQ

SEQ ID NO: 2164200 - protein, 8 aa, Cryptosporidium hominis
SVPEIQRT

SEQ ID NO: 2164201 - protein, 4 aa, Cryptosporidium hominis
SVPH

SEQ ID NO: 2164202 - protein, 31 aa, Cryptosporidium hominis
SVPINENDQEVDLTSKATGSSKTKKSKSMRK

SEQ ID NO: 2164203 - protein, 6 aa, Cryptosporidium hominis
SVPKSG

SEQ ID NO: 2164204 - protein, 23 aa, Cryptosporidium hominis
SVPNTIEQQPNEASSASNSNAGA

SEQ ID NO: 2164205 - protein, 4 aa, Cryptosporidium hominis
SVPQ

SEQ ID NO: 2164206 - protein, 20 aa, Cryptosporidium hominis
SVPQPPGSMPSGVGSSTNSD

SEQ ID NO: 2164207 - protein, 9 aa, Cryptosporidium hominis
SVPRSPSYS

SEQ ID NO: 2164208 - protein, 7 aa, Cryptosporidium hominis
SVPSGQG

SEQ ID NO: 2164209 - protein, 19 aa, Cryptosporidium hominis
SVPSKHRSKSKSRSSNSNI

SEQ ID NO: 2164210 - protein, 6 aa, Cryptosporidium hominis
SVPSLN

SEQ ID NO: 2164211 - protein, 13 aa, Cryptosporidium hominis
SVPSNVSKADVSY

SEQ ID NO: 2164212 - protein, 25 aa, Cryptosporidium hominis
SVPSNVSKADVSYNSKITNTSEKSI

SEQ ID NO: 2164213 - protein, 22 aa, Cryptosporidium hominis
SVPSPALNNSRSFSSKTRGKSI

SEQ ID NO: 2164214 - protein, 7 aa, Cryptosporidium hominis
SVPSSSI

SEQ ID NO: 2164215 - protein, 12 aa, Cryptosporidium hominis
SVPSTETGKGKL

SEQ ID NO: 2164216 - protein, 5 aa, Cryptosporidium hominis
SVPTE

SEQ ID NO: 2164217 - protein, 8 aa, Cryptosporidium hominis
SVPTKDIS

SEQ ID NO: 2164218 - protein, 8 aa, Cryptosporidium hominis
SVPVPSKL

SEQ ID NO: 2164219 - protein, 6 aa, Cryptosporidium hominis
SVPYDT

SEQ ID NO: 2164220 - protein, 5 aa, Cryptosporidium hominis
SVQEK

SEQ ID NO: 2164221 - protein, 17 aa, Cryptosporidium hominis
SVQGHNHGQNRNSSSQI

SEQ ID NO: 2164222 - protein, 15 aa, Cryptosporidium hominis
SVQKEQENIPVNGSR

SEQ ID NO: 2164223 - protein, 5 aa, Cryptosporidium hominis
SVQNG

SEQ ID NO: 2164224 - protein, 9 aa, Cryptosporidium hominis
SVQNPTEWG

SEQ ID NO: 2164225 - protein, 32 aa, Cryptosporidium hominis
SVQNSFGKSATQGSSNSGNGAESGTSNTSGNN

SEQ ID NO: 2164226 - protein, 19 aa, Cryptosporidium hominis
SVQSSENNPGNSNKVQGAQ

SEQ ID NO: 2164227 - protein, 48 aa, Cryptosporidium hominis
SVRKPRKFSQDGGFRGKKQSWNDSERNIEEKNQRFPAKYKGQKKDTLS

SEQ ID NO: 2164228 - protein, 11 aa, Cryptosporidium hominis
SVRSKKNLTIS

SEQ ID NO: 2164229 - protein, 5 aa, Cryptosporidium hominis
SVRSV

SEQ ID NO: 2164230 - protein, 12 aa, Cryptosporidium hominis
SVSDSENNNPHY

SEQ ID NO: 2164231 - protein, 17 aa, Cryptosporidium hominis
SVSDTKSLTETEEEIPV

SEQ ID NO: 2164232 - protein, 8 aa, Cryptosporidium hominis
SVSEHKQR

SEQ ID NO: 2164233 - protein, 12 aa, Cryptosporidium hominis
SVSENIHKDNSR

SEQ ID NO: 2164234 - protein, 8 aa, Cryptosporidium hominis
SVSENNDL

SEQ ID NO: 2164235 - protein, 21 aa, Cryptosporidium hominis
SVSEQYKIKGNESFKSGKYNE

SEQ ID NO: 2164236 - protein, 27 aa, Cryptosporidium hominis
SVSKKKDPVQNNIEQNPNMESFGDSRD

SEQ ID NO: 2164237 - protein, 11 aa, Cryptosporidium hominis
SVSNLNKPENI

SEQ ID NO: 2164238 - protein, 10 aa, Cryptosporidium hominis
SVSNTEYSDI

SEQ ID NO: 2164239 - protein, 20 aa, Cryptosporidium hominis
SVSPRKGCNSCNYSDPDEKK

SEQ ID NO: 2164240 - protein, 15 aa, Cryptosporidium hominis
SVSPTNKSKKNKEVK

SEQ ID NO: 2164241 - protein, 12 aa, Cryptosporidium hominis
SVSQPSNSQKSM

SEQ ID NO: 2164242 - protein, 6 aa, Cryptosporidium hominis
SVSRET

SEQ ID NO: 2164243 - protein, 9 aa, Cryptosporidium hominis
SVSSPSSIV

SEQ ID NO: 2164244 - protein, 15 aa, Cryptosporidium hominis
SVSTPGSPDISSDTM

SEQ ID NO: 2164245 - protein, 14 aa, Cryptosporidium hominis
SVSTSKSVNSRMNY

SEQ ID NO: 2164246 - protein, 5 aa, Cryptosporidium hominis
SVTEK

SEQ ID NO: 2164247 - protein, 19 aa, Cryptosporidium hominis
SVTNKDDAPRLNQSSFKTG

SEQ ID NO: 2164248 - protein, 7 aa, Cryptosporidium hominis
SVTPDNC

SEQ ID NO: 2164249 - protein, 8 aa, Cryptosporidium hominis
SVTPEAED

SEQ ID NO: 2164250 - protein, 12 aa, Cryptosporidium hominis
SVTRYDPNVRGR

SEQ ID NO: 2164251 - protein, 4 aa, Cryptosporidium hominis
SVVP

SEQ ID NO: 2164252 - protein, 12 aa, Cryptosporidium hominis
SVVPEAGRNSKL

SEQ ID NO: 2164253 - protein, 12 aa, Cryptosporidium hominis
SVVSKGDNMMGG

SEQ ID NO: 2164254 - protein, 29 aa, Cryptosporidium hominis
SVYTQRKIEEKGKVQVDEEGSIKDGGGAF

SEQ ID NO: 2164255 - protein, 20 aa, Cryptosporidium hominis
SWAPATNSVGNSPSNPSSQT

SEQ ID NO: 2164256 - protein, 4 aa, Cryptosporidium hominis
SWDG

SEQ ID NO: 2164257 - protein, 14 aa, Cryptosporidium hominis
SWGEKWENNNITEK

SEQ ID NO: 2164258 - protein, 21 aa, Cryptosporidium hominis
SWNSKGTTFEDKDVSETARST

SEQ ID NO: 2164259 - protein, 6 aa, Cryptosporidium hominis
SWTPDE

SEQ ID NO: 2164260 - protein, 4 aa, Cryptosporidium hominis
SWTS

SEQ ID NO: 2164261 - protein, 9 aa, Cryptosporidium hominis
SYANDQKDS

SEQ ID NO: 2164262 - protein, 6 aa, Cryptosporidium hominis
SYAPPH

SEQ ID NO: 2164263 - protein, 23 aa, Cryptosporidium hominis
SYAPYVPGAKNGIPVTENTSTPQ

SEQ ID NO: 2164264 - protein, 7 aa, Cryptosporidium hominis
SYDDELK

SEQ ID NO: 2164265 - protein, 5 aa, Cryptosporidium hominis
SYDDQ

SEQ ID NO: 2164266 - protein, 11 aa, Cryptosporidium hominis
SYDPKSSICQS

SEQ ID NO: 2164267 - protein, 5 aa, Cryptosporidium hominis
SYDRT

SEQ ID NO: 2164268 - protein, 6 aa, Cryptosporidium hominis
SYDTEN

SEQ ID NO: 2164269 - protein, 38 aa, Cryptosporidium hominis
SYDTETASGSAGVAEQASSSDSSFDSEPDKGSIEKDGV

SEQ ID NO: 2164270 - protein, 7 aa, Cryptosporidium hominis
SYEANEA

SEQ ID NO: 2164271 - protein, 15 aa, Cryptosporidium hominis
SYEEEFKEAEKAVKE

SEQ ID NO: 2164272 - protein, 7 aa, Cryptosporidium hominis
SYEEHEH

SEQ ID NO: 2164273 - protein, 14 aa, Cryptosporidium hominis
SYERKNGQNLGEST

SEQ ID NO: 2164274 - protein, 4 aa, Cryptosporidium hominis
SYES

SEQ ID NO: 2164275 - protein, 13 aa, Cryptosporidium hominis
SYEYGSSENDPEI

SEQ ID NO: 2164276 - protein, 5 aa, Cryptosporidium hominis
SYFGS

SEQ ID NO: 2164277 - protein, 17 aa, Cryptosporidium hominis
SYFPNGGSTSNNTGLGA

SEQ ID NO: 2164278 - protein, 9 aa, Cryptosporidium hominis
SYGAPNNPY

SEQ ID NO: 2164279 - protein, 9 aa, Cryptosporidium hominis
SYGASIKNG

SEQ ID NO: 2164280 - protein, 16 aa, Cryptosporidium hominis
SYGGGLGGGDSGMVSG

SEQ ID NO: 2164281 - protein, 7 aa, Cryptosporidium hominis
SYGNSGA

SEQ ID NO: 2164282 - protein, 11 aa, Cryptosporidium hominis
SYGQPRREYTP

SEQ ID NO: 2164283 - protein, 11 aa, Cryptosporidium hominis
SYGSNKEDEPM

SEQ ID NO: 2164284 - protein, 6 aa, Cryptosporidium hominis
SYGTNL

SEQ ID NO: 2164285 - protein, 12 aa, Cryptosporidium hominis
SYHGNGESLNSD

SEQ ID NO: 2164286 - protein, 24 aa, Cryptosporidium hominis
SYHSESQCQGSELDNSVNCSRKQR

SEQ ID NO: 2164287 - protein, 16 aa, Cryptosporidium hominis
SYKAEFERNKDEALKR

SEQ ID NO: 2164288 - protein, 10 aa, Cryptosporidium hominis
SYKDSGSSGI

SEQ ID NO: 2164289 - protein, 15 aa, Cryptosporidium hominis
SYKEVDDDGYGGGSI

SEQ ID NO: 2164290 - protein, 10 aa, Cryptosporidium hominis
SYKSADGSYS

SEQ ID NO: 2164291 - protein, 5 aa, Cryptosporidium hominis
SYKSG

SEQ ID NO: 2164292 - protein, 9 aa, Cryptosporidium hominis
SYKSGSFGG

SEQ ID NO: 2164293 - protein, 4 aa, Cryptosporidium hominis
SYLD

SEQ ID NO: 2164294 - protein, 5 aa, Cryptosporidium hominis
SYLTS

SEQ ID NO: 2164295 - protein, 13 aa, Cryptosporidium hominis
SYMDSSPKCTNSQ

SEQ ID NO: 2164296 - protein, 7 aa, Cryptosporidium hominis
SYNANGL

SEQ ID NO: 2164297 - protein, 13 aa, Cryptosporidium hominis
SYNEDNNSCRGTC

SEQ ID NO: 2164298 - protein, 5 aa, Cryptosporidium hominis
SYNEL

SEQ ID NO: 2164299 - protein, 8 aa, Cryptosporidium hominis
SYNGNNTL

SEQ ID NO: 2164300 - protein, 9 aa, Cryptosporidium hominis
SYNIENPDQ

SEQ ID NO: 2164301 - protein, 36 aa, Cryptosporidium hominis
SYNKNQELSNFGSNGEAAMGASIGSSNGHGNNLGNS

SEQ ID NO: 2164302 - protein, 30 aa, Cryptosporidium hominis
SYNNNSPQSLSPCSKSHCNNKQENTKYNSS

SEQ ID NO: 2164303 - protein, 8 aa, Cryptosporidium hominis
SYNPENTN

SEQ ID NO: 2164304 - protein, 4 aa, Cryptosporidium hominis
SYNT

SEQ ID NO: 2164305 - protein, 8 aa, Cryptosporidium hominis
SYNTPGIK

SEQ ID NO: 2164306 - protein, 12 aa, Cryptosporidium hominis
SYNTQKFPYNPE

SEQ ID NO: 2164307 - protein, 13 aa, Cryptosporidium hominis
SYNTTNNNSTSEI

SEQ ID NO: 2164308 - protein, 9 aa, Cryptosporidium hominis
SYPDPPPCI

SEQ ID NO: 2164309 - protein, 10 aa, Cryptosporidium hominis
SYPDTRQHGS

SEQ ID NO: 2164310 - protein, 4 aa, Cryptosporidium hominis
SYPI

SEQ ID NO: 2164311 - protein, 11 aa, Cryptosporidium hominis
SYPIPKNHTNN

SEQ ID NO: 2164312 - protein, 5 aa, Cryptosporidium hominis
SYPNI

SEQ ID NO: 2164313 - protein, 8 aa, Cryptosporidium hominis
SYPSPTVS

SEQ ID NO: 2164314 - protein, 5 aa, Cryptosporidium hominis
SYQNK

SEQ ID NO: 2164315 - protein, 8 aa, Cryptosporidium hominis
SYQQSERK

SEQ ID NO: 2164316 - protein, 11 aa, Cryptosporidium hominis
SYQSQNKTNYI

SEQ ID NO: 2164317 - protein, 11 aa, Cryptosporidium hominis
SYRQDSSCNSK

SEQ ID NO: 2164318 - protein, 7 aa, Cryptosporidium hominis
SYRSDVN

SEQ ID NO: 2164319 - protein, 23 aa, Cryptosporidium hominis
SYSGGGNRGQRVPRNEMSGTVGY

SEQ ID NO: 2164320 - protein, 6 aa, Cryptosporidium hominis
SYSGNS

SEQ ID NO: 2164321 - protein, 13 aa, Cryptosporidium hominis
SYSIGSDSTIYTQ

SEQ ID NO: 2164322 - protein, 8 aa, Cryptosporidium hominis
SYSKNSGT

SEQ ID NO: 2164323 - protein, 6 aa, Cryptosporidium hominis
SYSKSN

SEQ ID NO: 2164324 - protein, 5 aa, Cryptosporidium hominis
SYSQN

SEQ ID NO: 2164325 - protein, 17 aa, Cryptosporidium hominis
SYSRGRDAKSSQADNQD

SEQ ID NO: 2164326 - protein, 24 aa, Cryptosporidium hominis
SYSRKKKVVNKQGRANARQSNHEF

SEQ ID NO: 2164327 - protein, 32 aa, Cryptosporidium hominis
SYSSKTIPSQDPGTVDGAQNKSRKRKSSLELT

SEQ ID NO: 2164328 - protein, 9 aa, Cryptosporidium hominis
SYSTTTRTS

SEQ ID NO: 2164329 - protein, 4 aa, Cryptosporidium hominis
SYSY

SEQ ID NO: 2164330 - protein, 12 aa, Cryptosporidium hominis
SYTGSGGASSLV

SEQ ID NO: 2164331 - protein, 4 aa, Cryptosporidium hominis
SYTK

SEQ ID NO: 2164332 - protein, 10 aa, Cryptosporidium hominis
SYTSSPCQSF

SEQ ID NO: 2164333 - protein, 4 aa, Cryptosporidium hominis
SYTT

SEQ ID NO: 2164334 - protein, 8 aa, Cryptosporidium hominis
SYYGGEAA

SEQ ID NO: 2164335 - protein, 4 aa, Cryptosporidium hominis
SYYN

SEQ ID NO: 2164336 - protein, 11 aa, Cryptosporidium hominis
SYYNQNNQGGY

SEQ ID NO: 2164337 - protein, 12 aa, Cryptosporidium hominis
SYYSPTSEANDL

SEQ ID NO: 2164338 - protein, 8 aa, Cryptosporidium hominis
TAAAAAAA

SEQ ID NO: 2164339 - protein, 6 aa, Cryptosporidium hominis
TAAAQS

SEQ ID NO: 2164340 - protein, 4 aa, Cryptosporidium hominis
TAAN

SEQ ID NO: 2164341 - protein, 19 aa, Cryptosporidium hominis
TAATKRESREFPSLPSTSI

SEQ ID NO: 2164342 - protein, 4 aa, Cryptosporidium hominis
TACS

SEQ ID NO: 2164343 - protein, 5 aa, Cryptosporidium hominis
TADRF

SEQ ID NO: 2164344 - protein, 9 aa, Cryptosporidium hominis
TADRQKALE

SEQ ID NO: 2164345 - protein, 7 aa, Cryptosporidium hominis
TADSIGK

SEQ ID NO: 2164346 - protein, 8 aa, Cryptosporidium hominis
TAEEDTGV

SEQ ID NO: 2164347 - protein, 29 aa, Cryptosporidium hominis
TAEEEDAESKKQKDDEKKEDTNDRQNEEK

SEQ ID NO: 2164348 - protein, 13 aa, Cryptosporidium hominis
TAEGGELKAPSEK

SEQ ID NO: 2164349 - protein, 7 aa, Cryptosporidium hominis
TAEISPL

SEQ ID NO: 2164350 - protein, 9 aa, Cryptosporidium hominis
TAENGKGFS

SEQ ID NO: 2164351 - protein, 6 aa, Cryptosporidium hominis
TAEQNY

SEQ ID NO: 2164352 - protein, 5 aa, Cryptosporidium hominis
TAERE

SEQ ID NO: 2164353 - protein, 7 aa, Cryptosporidium hominis
TAESGLP

SEQ ID NO: 2164354 - protein, 8 aa, Cryptosporidium hominis
TAESSRMD

SEQ ID NO: 2164355 - protein, 5 aa, Cryptosporidium hominis
TAGDP

SEQ ID NO: 2164356 - protein, 4 aa, Cryptosporidium hominis
TAGG

SEQ ID NO: 2164357 - protein, 9 aa, Cryptosporidium hominis
TAGGPTPDL

SEQ ID NO: 2164358 - protein, 6 aa, Cryptosporidium hominis
TAGKPY

SEQ ID NO: 2164359 - protein, 7 aa, Cryptosporidium hominis
TAGNDNS

SEQ ID NO: 2164360 - protein, 8 aa, Cryptosporidium hominis
TAGNKEQI

SEQ ID NO: 2164361 - protein, 11 aa, Cryptosporidium hominis
TAGSKEKTEKE

SEQ ID NO: 2164362 - protein, 8 aa, Cryptosporidium hominis
TAIEESEE

SEQ ID NO: 2164363 - protein, 12 aa, Cryptosporidium hominis
TAIQSMNAPGKG

SEQ ID NO: 2164364 - protein, 4 aa, Cryptosporidium hominis
TAIR

SEQ ID NO: 2164365 - protein, 7 aa, Cryptosporidium hominis
TAISENN

SEQ ID NO: 2164366 - protein, 4 aa, Cryptosporidium hominis
TAIT

SEQ ID NO: 2164367 - protein, 9 aa, Cryptosporidium hominis
TAKDGYNDT

SEQ ID NO: 2164368 - protein, 5 aa, Cryptosporidium hominis
TAKER

SEQ ID NO: 2164369 - protein, 14 aa, Cryptosporidium hominis
TAKPKLDSEDREII

SEQ ID NO: 2164370 - protein, 8 aa, Cryptosporidium hominis
TAKRKSLP

SEQ ID NO: 2164371 - protein, 30 aa, Cryptosporidium hominis
TAKSGRQKKQNSQNSENEIVSRPKRGKRKT

SEQ ID NO: 2164372 - protein, 10 aa, Cryptosporidium hominis
TALNGGSQTC

SEQ ID NO: 2164373 - protein, 10 aa, Cryptosporidium hominis
TANENQSNEN

SEQ ID NO: 2164374 - protein, 7 aa, Cryptosporidium hominis
TANETLC

SEQ ID NO: 2164375 - protein, 4 aa, Cryptosporidium hominis
TANF

SEQ ID NO: 2164376 - protein, 5 aa, Cryptosporidium hominis
TANKN

SEQ ID NO: 2164377 - protein, 5 aa, Cryptosporidium hominis
TANPH

SEQ ID NO: 2164378 - protein, 14 aa, Cryptosporidium hominis
TANQESSLKDENNT

SEQ ID NO: 2164379 - protein, 21 aa, Cryptosporidium hominis
TAPATYQESERKLVTNIDSET

SEQ ID NO: 2164380 - protein, 91 aa, Cryptosporidium hominis
TAPETTTAGAASVTSSTNTTETTTRTTTGATAGSTTTTTTTTTTGATGTTTDTNTTTTTTTTGTTGTTGTSTTGTTDTSGFTTGATTTTTF

SEQ ID NO: 2164381 - protein, 12 aa, Cryptosporidium hominis
TAPGPQSSASVS

SEQ ID NO: 2164382 - protein, 6 aa, Cryptosporidium hominis
TAPSNG

SEQ ID NO: 2164383 - protein, 6 aa, Cryptosporidium hominis
TAPTHP

SEQ ID NO: 2164384 - protein, 4 aa, Cryptosporidium hominis
TAQK

SEQ ID NO: 2164385 - protein, 8 aa, Cryptosporidium hominis
TARAGKLG

SEQ ID NO: 2164386 - protein, 6 aa, Cryptosporidium hominis
TARDGS

SEQ ID NO: 2164387 - protein, 5 aa, Cryptosporidium hominis
TAREK

SEQ ID NO: 2164388 - protein, 9 aa, Cryptosporidium hominis
TARGGSSGV

SEQ ID NO: 2164389 - protein, 8 aa, Cryptosporidium hominis
TARIGSKG

SEQ ID NO: 2164390 - protein, 48 aa, Cryptosporidium hominis
TARKKRKFIPSSDQEYNDFNKNENSSSKRGKKVAKKCEDQNKDGTDLS

SEQ ID NO: 2164391 - protein, 9 aa, Cryptosporidium hominis
TARMGDKGT

SEQ ID NO: 2164392 - protein, 5 aa, Cryptosporidium hominis
TARQK

SEQ ID NO: 2164393 - protein, 7 aa, Cryptosporidium hominis
TARQSGY

SEQ ID NO: 2164394 - protein, 5 aa, Cryptosporidium hominis
TARRR

SEQ ID NO: 2164395 - protein, 6 aa, Cryptosporidium hominis
TASDDG

SEQ ID NO: 2164396 - protein, 7 aa, Cryptosporidium hominis
TASKNTK

SEQ ID NO: 2164397 - protein, 23 aa, Cryptosporidium hominis
TASKPKVADNHSKYKQEASYTQS

SEQ ID NO: 2164398 - protein, 4 aa, Cryptosporidium hominis
TASN

SEQ ID NO: 2164399 - protein, 8 aa, Cryptosporidium hominis
TASNNPNE

SEQ ID NO: 2164400 - protein, 5 aa, Cryptosporidium hominis
TASPV

SEQ ID NO: 2164401 - protein, 9 aa, Cryptosporidium hominis
TASSLKGGD

SEQ ID NO: 2164402 - protein, 9 aa, Cryptosporidium hominis
TASSSGNIS

SEQ ID NO: 2164403 - protein, 15 aa, Cryptosporidium hominis
TASSSSSSSSSSSFQ

SEQ ID NO: 2164404 - protein, 16 aa, Cryptosporidium hominis
TASTSKVPSLSKQGSG

SEQ ID NO: 2164405 - protein, 22 aa, Cryptosporidium hominis
TASYGRRDKALPDEDRTTNKVK

SEQ ID NO: 2164406 - protein, 12 aa, Cryptosporidium hominis
TATSGSSSSDML

SEQ ID NO: 2164407 - protein, 11 aa, Cryptosporidium hominis
TATSTGQNDPS

SEQ ID NO: 2164408 - protein, 8 aa, Cryptosporidium hominis
TATTMQNS

SEQ ID NO: 2164409 - protein, 26 aa, Cryptosporidium hominis
TATVKKPKQTESHLSSERNSTSCKDQ

SEQ ID NO: 2164410 - protein, 7 aa, Cryptosporidium hominis
TAYPKPQ

SEQ ID NO: 2164411 - protein, 11 aa, Cryptosporidium hominis
TCDQRGSVVDP

SEQ ID NO: 2164412 - protein, 7 aa, Cryptosporidium hominis
TCDSPGK

SEQ ID NO: 2164413 - protein, 7 aa, Cryptosporidium hominis
TCEKTHK

SEQ ID NO: 2164414 - protein, 5 aa, Cryptosporidium hominis
TCENG

SEQ ID NO: 2164415 - protein, 6 aa, Cryptosporidium hominis
TCGDYG

SEQ ID NO: 2164416 - protein, 5 aa, Cryptosporidium hominis
TCGGP

SEQ ID NO: 2164417 - protein, 6 aa, Cryptosporidium hominis
TCIEGG

SEQ ID NO: 2164418 - protein, 21 aa, Cryptosporidium hominis
TCNDDGNGNLYTKKQGKGREN

SEQ ID NO: 2164419 - protein, 17 aa, Cryptosporidium hominis
TCNKKSESRRSSAYNST

SEQ ID NO: 2164420 - protein, 16 aa, Cryptosporidium hominis
TCNSDNASNSISSQSI

SEQ ID NO: 2164421 - protein, 5 aa, Cryptosporidium hominis
TCSDR

SEQ ID NO: 2164422 - protein, 11 aa, Cryptosporidium hominis
TCTTSSDISTP

SEQ ID NO: 2164423 - protein, 22 aa, Cryptosporidium hominis
TDAENKAKIEKSTSKKRPVIKG

SEQ ID NO: 2164424 - protein, 7 aa, Cryptosporidium hominis
TDAHDQF

SEQ ID NO: 2164425 - protein, 9 aa, Cryptosporidium hominis
TDANPDDPL

SEQ ID NO: 2164426 - protein, 6 aa, Cryptosporidium hominis
TDARMT

SEQ ID NO: 2164427 - protein, 7 aa, Cryptosporidium hominis
TDASLGR

SEQ ID NO: 2164428 - protein, 5 aa, Cryptosporidium hominis
TDASP

SEQ ID NO: 2164429 - protein, 8 aa, Cryptosporidium hominis
TDASSKSL

SEQ ID NO: 2164430 - protein, 8 aa, Cryptosporidium hominis
TDASTLSS

SEQ ID NO: 2164431 - protein, 4 aa, Cryptosporidium hominis
TDCL

SEQ ID NO: 2164432 - protein, 7 aa, Cryptosporidium hominis
TDCQSKG

SEQ ID NO: 2164433 - protein, 8 aa, Cryptosporidium hominis
TDDDGAVT

SEQ ID NO: 2164434 - protein, 6 aa, Cryptosporidium hominis
TDDDPN

SEQ ID NO: 2164435 - protein, 56 aa, Cryptosporidium hominis
TDDEVEGQKDDQKETNQSTLEGGLENVGSGGGGGVGDSEEFMSQDDEKEEESHEGH

SEQ ID NO: 2164436 - protein, 4 aa, Cryptosporidium hominis
TDDL

SEQ ID NO: 2164437 - protein, 6 aa, Cryptosporidium hominis
TDDLPK

SEQ ID NO: 2164438 - protein, 4 aa, Cryptosporidium hominis
TDDS

SEQ ID NO: 2164439 - protein, 9 aa, Cryptosporidium hominis
TDDSNNPYK

SEQ ID NO: 2164440 - protein, 5 aa, Cryptosporidium hominis
TDDSQ

SEQ ID NO: 2164441 - protein, 27 aa, Cryptosporidium hominis
TDDSRNYVNNQYNKGNNTNEWGYEGYD

SEQ ID NO: 2164442 - protein, 4 aa, Cryptosporidium hominis
TDEE

SEQ ID NO: 2164443 - protein, 34 aa, Cryptosporidium hominis
TDEEDEDDDQEEAQDDNFENDPDEEMTPITGEND

SEQ ID NO: 2164444 - protein, 10 aa, Cryptosporidium hominis
TDEEENPSSK

SEQ ID NO: 2164445 - protein, 18 aa, Cryptosporidium hominis
TDEEWEEQFGGEDVENVD

SEQ ID NO: 2164446 - protein, 6 aa, Cryptosporidium hominis
TDEGKD

SEQ ID NO: 2164447 - protein, 15 aa, Cryptosporidium hominis
TDEKEYVDRSNSKIQ

SEQ ID NO: 2164448 - protein, 4 aa, Cryptosporidium hominis
TDEN

SEQ ID NO: 2164449 - protein, 9 aa, Cryptosporidium hominis
TDENGYKGD

SEQ ID NO: 2164450 - protein, 34 aa, Cryptosporidium hominis
TDENISEESTNQEQPPSHQNADQNPDNSLKQGYK

SEQ ID NO: 2164451 - protein, 8 aa, Cryptosporidium hominis
TDENQNQV

SEQ ID NO: 2164452 - protein, 8 aa, Cryptosporidium hominis
TDESTPEL

SEQ ID NO: 2164453 - protein, 10 aa, Cryptosporidium hominis
TDETAEIREE

SEQ ID NO: 2164454 - protein, 10 aa, Cryptosporidium hominis
TDEVNTEDPK

SEQ ID NO: 2164455 - protein, 6 aa, Cryptosporidium hominis
TDFSNG

SEQ ID NO: 2164456 - protein, 9 aa, Cryptosporidium hominis
TDGIGTGWS

SEQ ID NO: 2164457 - protein, 7 aa, Cryptosporidium hominis
TDGNGRI

SEQ ID NO: 2164458 - protein, 7 aa, Cryptosporidium hominis
TDGNQKI

SEQ ID NO: 2164459 - protein, 4 aa, Cryptosporidium hominis
TDGR

SEQ ID NO: 2164460 - protein, 12 aa, Cryptosporidium hominis
TDGSGTIDPKEM

SEQ ID NO: 2164461 - protein, 9 aa, Cryptosporidium hominis
TDGTSTCSE

SEQ ID NO: 2164462 - protein, 12 aa, Cryptosporidium hominis
TDHHDGNGCDSM

SEQ ID NO: 2164463 - protein, 7 aa, Cryptosporidium hominis
TDHLNSD

SEQ ID NO: 2164464 - protein, 6 aa, Cryptosporidium hominis
TDIENN

SEQ ID NO: 2164465 - protein, 6 aa, Cryptosporidium hominis
TDINEE

SEQ ID NO: 2164466 - protein, 13 aa, Cryptosporidium hominis
TDIPKEIEANTNK

SEQ ID NO: 2164467 - protein, 5 aa, Cryptosporidium hominis
TDISS

SEQ ID NO: 2164468 - protein, 6 aa, Cryptosporidium hominis
TDISTN

SEQ ID NO: 2164469 - protein, 15 aa, Cryptosporidium hominis
TDITAKPEMHASSNT

SEQ ID NO: 2164470 - protein, 8 aa, Cryptosporidium hominis
TDKDGNEI

SEQ ID NO: 2164471 - protein, 8 aa, Cryptosporidium hominis
TDKDHDKK

SEQ ID NO: 2164472 - protein, 21 aa, Cryptosporidium hominis
TDKEEKQSLSGCKNKSDEANQ

SEQ ID NO: 2164473 - protein, 10 aa, Cryptosporidium hominis
TDKEEQKEIR

SEQ ID NO: 2164474 - protein, 4 aa, Cryptosporidium hominis
TDKG

SEQ ID NO: 2164475 - protein, 7 aa, Cryptosporidium hominis
TDKQKSL

SEQ ID NO: 2164476 - protein, 5 aa, Cryptosporidium hominis
TDKRG

SEQ ID NO: 2164477 - protein, 14 aa, Cryptosporidium hominis
TDKTDSSKAVETQT

SEQ ID NO: 2164478 - protein, 4 aa, Cryptosporidium hominis
TDLA

SEQ ID NO: 2164479 - protein, 14 aa, Cryptosporidium hominis
TDLKPVKSANDNEQ

SEQ ID NO: 2164480 - protein, 25 aa, Cryptosporidium hominis
TDLSGSDKELDTNSQIPPHSEIGQN

SEQ ID NO: 2164481 - protein, 14 aa, Cryptosporidium hominis
TDLSQKNKLKDSMS

SEQ ID NO: 2164482 - protein, 7 aa, Cryptosporidium hominis
TDNDTNV

SEQ ID NO: 2164483 - protein, 14 aa, Cryptosporidium hominis
TDNEQSLCQSPRDE

SEQ ID NO: 2164484 - protein, 7 aa, Cryptosporidium hominis
TDNFSEE

SEQ ID NO: 2164485 - protein, 18 aa, Cryptosporidium hominis
TDNHSGSATGHNCPPSSI

SEQ ID NO: 2164486 - protein, 9 aa, Cryptosporidium hominis
TDNKNSGKK

SEQ ID NO: 2164487 - protein, 5 aa, Cryptosporidium hominis
TDNMH

SEQ ID NO: 2164488 - protein, 12 aa, Cryptosporidium hominis
TDNNADFGHNGR

SEQ ID NO: 2164489 - protein, 10 aa, Cryptosporidium hominis
TDNNNSQSSA

SEQ ID NO: 2164490 - protein, 6 aa, Cryptosporidium hominis
TDNPDA

SEQ ID NO: 2164491 - protein, 6 aa, Cryptosporidium hominis
TDNPEI

SEQ ID NO: 2164492 - protein, 4 aa, Cryptosporidium hominis
TDNS

SEQ ID NO: 2164493 - protein, 10 aa, Cryptosporidium hominis
TDNSSTDHSS

SEQ ID NO: 2164494 - protein, 6 aa, Cryptosporidium hominis
TDNSYP

SEQ ID NO: 2164495 - protein, 4 aa, Cryptosporidium hominis
TDNT

SEQ ID NO: 2164496 - protein, 13 aa, Cryptosporidium hominis
TDPAGVKARIGDN

SEQ ID NO: 2164497 - protein, 5 aa, Cryptosporidium hominis
TDPGQ

SEQ ID NO: 2164498 - protein, 4 aa, Cryptosporidium hominis
TDPK

SEQ ID NO: 2164499 - protein, 8 aa, Cryptosporidium hominis
TDPKSGDY

SEQ ID NO: 2164500 - protein, 6 aa, Cryptosporidium hominis
TDPLTG

SEQ ID NO: 2164501 - protein, 9 aa, Cryptosporidium hominis
TDPNLRPNS

SEQ ID NO: 2164502 - protein, 6 aa, Cryptosporidium hominis
TDPNPA

SEQ ID NO: 2164503 - protein, 12 aa, Cryptosporidium hominis
TDPNSDEGKRRI

SEQ ID NO: 2164504 - protein, 5 aa, Cryptosporidium hominis
TDPNY

SEQ ID NO: 2164505 - protein, 4 aa, Cryptosporidium hominis
TDPR

SEQ ID NO: 2164506 - protein, 8 aa, Cryptosporidium hominis
TDPSPNSE

SEQ ID NO: 2164507 - protein, 4 aa, Cryptosporidium hominis
TDQE

SEQ ID NO: 2164508 - protein, 8 aa, Cryptosporidium hominis
TDQGYPQD

SEQ ID NO: 2164509 - protein, 7 aa, Cryptosporidium hominis
TDQLNEK

SEQ ID NO: 2164510 - protein, 5 aa, Cryptosporidium hominis
TDQPT

SEQ ID NO: 2164511 - protein, 31 aa, Cryptosporidium hominis
TDQSLTEHTEINSANGQIHEGKNSRKANKKN

SEQ ID NO: 2164512 - protein, 78 aa, Cryptosporidium hominis
TDRHRGNYEWEDNDRRRVADNEGRRDRDFDSERGRRREHYGGRDRKRDFRRRSVENSRGGRHRDDENMDKGKNDDQNN

SEQ ID NO: 2164513 - protein, 6 aa, Cryptosporidium hominis
TDRNGL

SEQ ID NO: 2164514 - protein, 6 aa, Cryptosporidium hominis
TDRPGS

SEQ ID NO: 2164515 - protein, 6 aa, Cryptosporidium hominis
TDRSEL

SEQ ID NO: 2164516 - protein, 18 aa, Cryptosporidium hominis
TDRSKYEQTAREWTQKYA

SEQ ID NO: 2164517 - protein, 6 aa, Cryptosporidium hominis
TDRSLT

SEQ ID NO: 2164518 - protein, 5 aa, Cryptosporidium hominis
TDRTD

SEQ ID NO: 2164519 - protein, 12 aa, Cryptosporidium hominis
TDSDEVGETSQF

SEQ ID NO: 2164520 - protein, 23 aa, Cryptosporidium hominis
TDSKLYPESGSERGSVKKEYEQV

SEQ ID NO: 2164521 - protein, 11 aa, Cryptosporidium hominis
TDSMENKSFEE

SEQ ID NO: 2164522 - protein, 10 aa, Cryptosporidium hominis
TDSNDSNKSV

SEQ ID NO: 2164523 - protein, 6 aa, Cryptosporidium hominis
TDSNKY

SEQ ID NO: 2164524 - protein, 11 aa, Cryptosporidium hominis
TDSNTKDKSNI

SEQ ID NO: 2164525 - protein, 4 aa, Cryptosporidium hominis
TDSP

SEQ ID NO: 2164526 - protein, 16 aa, Cryptosporidium hominis
TDSPNINELGRNKTIS

SEQ ID NO: 2164527 - protein, 5 aa, Cryptosporidium hominis
TDSPP

SEQ ID NO: 2164528 - protein, 4 aa, Cryptosporidium hominis
TDSS

SEQ ID NO: 2164529 - protein, 7 aa, Cryptosporidium hominis
TDSSRGL

SEQ ID NO: 2164530 - protein, 6 aa, Cryptosporidium hominis
TDSSYK

SEQ ID NO: 2164531 - protein, 22 aa, Cryptosporidium hominis
TDSTSNMNTNNSNKRRSITEND

SEQ ID NO: 2164532 - protein, 7 aa, Cryptosporidium hominis
TDTDHYE

SEQ ID NO: 2164533 - protein, 16 aa, Cryptosporidium hominis
TDTNQTIKDLPQDPYH

SEQ ID NO: 2164534 - protein, 10 aa, Cryptosporidium hominis
TDVDKNSLGK

SEQ ID NO: 2164535 - protein, 8 aa, Cryptosporidium hominis
TDVEGKSL

SEQ ID NO: 2164536 - protein, 7 aa, Cryptosporidium hominis
TDVKDTS

SEQ ID NO: 2164537 - protein, 9 aa, Cryptosporidium hominis
TDYDKKNNI

SEQ ID NO: 2164538 - protein, 7 aa, Cryptosporidium hominis
TDYNGDD

SEQ ID NO: 2164539 - protein, 5 aa, Cryptosporidium hominis
TDYNR

SEQ ID NO: 2164540 - protein, 8 aa, Cryptosporidium hominis
TDYTKNDN

SEQ ID NO: 2164541 - protein, 9 aa, Cryptosporidium hominis
TEAERKRRM

SEQ ID NO: 2164542 - protein, 8 aa, Cryptosporidium hominis
TEAESQSL

SEQ ID NO: 2164543 - protein, 10 aa, Cryptosporidium hominis
TEAGKVEGLE

SEQ ID NO: 2164544 - protein, 4 aa, Cryptosporidium hominis
TEAL

SEQ ID NO: 2164545 - protein, 17 aa, Cryptosporidium hominis
TEANNEYSTSSSSSEIN

SEQ ID NO: 2164546 - protein, 5 aa, Cryptosporidium hominis
TEASD

SEQ ID NO: 2164547 - protein, 6 aa, Cryptosporidium hominis
TEASPY

SEQ ID NO: 2164548 - protein, 16 aa, Cryptosporidium hominis
TEASTTAELPHKEAHE

SEQ ID NO: 2164549 - protein, 47 aa, Cryptosporidium hominis
TEDDEDDYEDEDEDDEEENEEKEEERVDNNEYKKDCSGKKHKKNGAV

SEQ ID NO: 2164550 - protein, 11 aa, Cryptosporidium hominis
TEDDEGSNITD

SEQ ID NO: 2164551 - protein, 10 aa, Cryptosporidium hominis
TEDESKDYSL

SEQ ID NO: 2164552 - protein, 9 aa, Cryptosporidium hominis
TEDGKEKKV

SEQ ID NO: 2164553 - protein, 5 aa, Cryptosporidium hominis
TEDIS

SEQ ID NO: 2164554 - protein, 15 aa, Cryptosporidium hominis
TEDLGSQKPKMADQS

SEQ ID NO: 2164555 - protein, 14 aa, Cryptosporidium hominis
TEDLQRDLSSSSAD

SEQ ID NO: 2164556 - protein, 4 aa, Cryptosporidium hominis
TEDN

SEQ ID NO: 2164557 - protein, 21 aa, Cryptosporidium hominis
TEDNEDLENEDNDIADHRDSG

SEQ ID NO: 2164558 - protein, 9 aa, Cryptosporidium hominis
TEDNRRERR

SEQ ID NO: 2164559 - protein, 8 aa, Cryptosporidium hominis
TEDTDAQI

SEQ ID NO: 2164560 - protein, 6 aa, Cryptosporidium hominis
TEEDDR

SEQ ID NO: 2164561 - protein, 14 aa, Cryptosporidium hominis
TEEERSKRRSDAKR

SEQ ID NO: 2164562 - protein, 9 aa, Cryptosporidium hominis
TEEETRKST

SEQ ID NO: 2164563 - protein, 8 aa, Cryptosporidium hominis
TEEHNKEI

SEQ ID NO: 2164564 - protein, 30 aa, Cryptosporidium hominis
TEEINKKIKKSDEKQKESGEERTLSSSMNS

SEQ ID NO: 2164565 - protein, 8 aa, Cryptosporidium hominis
TEEINNSN

SEQ ID NO: 2164566 - protein, 17 aa, Cryptosporidium hominis
TEEINNSNSYSQSCNTI

SEQ ID NO: 2164567 - protein, 32 aa, Cryptosporidium hominis
TEEKEQVGFTSKGSSDSETDPTNLGKAQHPLS

SEQ ID NO: 2164568 - protein, 5 aa, Cryptosporidium hominis
TEELK

SEQ ID NO: 2164569 - protein, 5 aa, Cryptosporidium hominis
TEEQC

SEQ ID NO: 2164570 - protein, 7 aa, Cryptosporidium hominis
TEFENET

SEQ ID NO: 2164571 - protein, 4 aa, Cryptosporidium hominis
TEFS

SEQ ID NO: 2164572 - protein, 6 aa, Cryptosporidium hominis
TEGEFD

SEQ ID NO: 2164573 - protein, 7 aa, Cryptosporidium hominis
TEGFSGA

SEQ ID NO: 2164574 - protein, 9 aa, Cryptosporidium hominis
TEGKAKGSL

SEQ ID NO: 2164575 - protein, 11 aa, Cryptosporidium hominis
TEGKGLGKEEV

SEQ ID NO: 2164576 - protein, 7 aa, Cryptosporidium hominis
TEGLHPE

SEQ ID NO: 2164577 - protein, 7 aa, Cryptosporidium hominis
TEGPAAG

SEQ ID NO: 2164578 - protein, 18 aa, Cryptosporidium hominis
TEGTNSSSQANASECNPQ

SEQ ID NO: 2164579 - protein, 8 aa, Cryptosporidium hominis
TEGVSTTS

SEQ ID NO: 2164580 - protein, 4 aa, Cryptosporidium hominis
TEGY

SEQ ID NO: 2164581 - protein, 6 aa, Cryptosporidium hominis
TEHQRS

SEQ ID NO: 2164582 - protein, 5 aa, Cryptosporidium hominis
TEHSP

SEQ ID NO: 2164583 - protein, 6 aa, Cryptosporidium hominis
TEIHGS

SEQ ID NO: 2164584 - protein, 20 aa, Cryptosporidium hominis
TEIKSSKEAEEENQEYYPSE

SEQ ID NO: 2164585 - protein, 6 aa, Cryptosporidium hominis
TEINAG

SEQ ID NO: 2164586 - protein, 6 aa, Cryptosporidium hominis
TEINEG

SEQ ID NO: 2164587 - protein, 8 aa, Cryptosporidium hominis
TEINQRAK

SEQ ID NO: 2164588 - protein, 9 aa, Cryptosporidium hominis
TEIPPGSMP

SEQ ID NO: 2164589 - protein, 8 aa, Cryptosporidium hominis
TEIPPTPL

SEQ ID NO: 2164590 - protein, 5 aa, Cryptosporidium hominis
TEISG

SEQ ID NO: 2164591 - protein, 43 aa, Cryptosporidium hominis
TEITKANKTSENTHSGNNSKVSKFKQKEGKIGQTDNKSMPKST

SEQ ID NO: 2164592 - protein, 4 aa, Cryptosporidium hominis
TEKD

SEQ ID NO: 2164593 - protein, 9 aa, Cryptosporidium hominis
TEKDYEAED

SEQ ID NO: 2164594 - protein, 17 aa, Cryptosporidium hominis
TEKEKSEQSQKSEITEV

SEQ ID NO: 2164595 - protein, 6 aa, Cryptosporidium hominis
TEKESP

SEQ ID NO: 2164596 - protein, 8 aa, Cryptosporidium hominis
TEKETTLV

SEQ ID NO: 2164597 - protein, 4 aa, Cryptosporidium hominis
TEKF

SEQ ID NO: 2164598 - protein, 12 aa, Cryptosporidium hominis
TEKFNDKSAKLG

SEQ ID NO: 2164599 - protein, 9 aa, Cryptosporidium hominis
TEKIDSDAR

SEQ ID NO: 2164600 - protein, 6 aa, Cryptosporidium hominis
TEKING

SEQ ID NO: 2164601 - protein, 5 aa, Cryptosporidium hominis
TEKKG

SEQ ID NO: 2164602 - protein, 6 aa, Cryptosporidium hominis
TEKKTR

SEQ ID NO: 2164603 - protein, 7 aa, Cryptosporidium hominis
TEKNERF

SEQ ID NO: 2164604 - protein, 7 aa, Cryptosporidium hominis
TEKPDDY

SEQ ID NO: 2164605 - protein, 8 aa, Cryptosporidium hominis
TEKPEFKE

SEQ ID NO: 2164606 - protein, 24 aa, Cryptosporidium hominis
TEKPIDPLGKKTISDTLESIFNIN

SEQ ID NO: 2164607 - protein, 8 aa, Cryptosporidium hominis
TEKPSTQL

SEQ ID NO: 2164608 - protein, 5 aa, Cryptosporidium hominis
TEKPV

SEQ ID NO: 2164609 - protein, 6 aa, Cryptosporidium hominis
TEKQLD

SEQ ID NO: 2164610 - protein, 4 aa, Cryptosporidium hominis
TEKR

SEQ ID NO: 2164611 - protein, 8 aa, Cryptosporidium hominis
TEKRLGKA

SEQ ID NO: 2164612 - protein, 11 aa, Cryptosporidium hominis
TEKSKANSKTL

SEQ ID NO: 2164613 - protein, 11 aa, Cryptosporidium hominis
TEKSSNNGSCS

SEQ ID NO: 2164614 - protein, 7 aa, Cryptosporidium hominis
TEKYKHN

SEQ ID NO: 2164615 - protein, 12 aa, Cryptosporidium hominis
TEKYNSKEDSDF

SEQ ID NO: 2164616 - protein, 6 aa, Cryptosporidium hominis
TELENP

SEQ ID NO: 2164617 - protein, 14 aa, Cryptosporidium hominis
TELKKDEANSSTYI

SEQ ID NO: 2164618 - protein, 6 aa, Cryptosporidium hominis
TELNSE

SEQ ID NO: 2164619 - protein, 9 aa, Cryptosporidium hominis
TELSGGQRS

SEQ ID NO: 2164620 - protein, 5 aa, Cryptosporidium hominis
TENEE

SEQ ID NO: 2164621 - protein, 11 aa, Cryptosporidium hominis
TENENTPENYN

SEQ ID NO: 2164622 - protein, 6 aa, Cryptosporidium hominis
TENERR

SEQ ID NO: 2164623 - protein, 5 aa, Cryptosporidium hominis
TENGH

SEQ ID NO: 2164624 - protein, 23 aa, Cryptosporidium hominis
TENGSTKDDLALPTDAEGNPDEV

SEQ ID NO: 2164625 - protein, 7 aa, Cryptosporidium hominis
TENINNE

SEQ ID NO: 2164626 - protein, 10 aa, Cryptosporidium hominis
TENKGATPCE

SEQ ID NO: 2164627 - protein, 9 aa, Cryptosporidium hominis
TENKNEENL

SEQ ID NO: 2164628 - protein, 9 aa, Cryptosporidium hominis
TENNEDQED

SEQ ID NO: 2164629 - protein, 15 aa, Cryptosporidium hominis
TENNEFDKRTSKGSF

SEQ ID NO: 2164630 - protein, 7 aa, Cryptosporidium hominis
TENNKHS

SEQ ID NO: 2164631 - protein, 18 aa, Cryptosporidium hominis
TENPAKDKDNHESSGNSL

SEQ ID NO: 2164632 - protein, 24 aa, Cryptosporidium hominis
TENPSYGKKAKRTDSDSSDNESVI

SEQ ID NO: 2164633 - protein, 12 aa, Cryptosporidium hominis
TENQESAQANSE

SEQ ID NO: 2164634 - protein, 8 aa, Cryptosporidium hominis
TENSCSKR

SEQ ID NO: 2164635 - protein, 11 aa, Cryptosporidium hominis
TENSKDSIKDE

SEQ ID NO: 2164636 - protein, 28 aa, Cryptosporidium hominis
TENSNNSNSNVESTLKGEKQDENKENIE

SEQ ID NO: 2164637 - protein, 8 aa, Cryptosporidium hominis
TENSRDTI

SEQ ID NO: 2164638 - protein, 10 aa, Cryptosporidium hominis
TENSTDKKLA

SEQ ID NO: 2164639 - protein, 15 aa, Cryptosporidium hominis
TENTSAQKATSADEL

SEQ ID NO: 2164640 - protein, 4 aa, Cryptosporidium hominis
TENY

SEQ ID NO: 2164641 - protein, 7 aa, Cryptosporidium hominis
TEPGEAV

SEQ ID NO: 2164642 - protein, 6 aa, Cryptosporidium hominis
TEPISN

SEQ ID NO: 2164643 - protein, 6 aa, Cryptosporidium hominis
TEPNDQ

SEQ ID NO: 2164644 - protein, 6 aa, Cryptosporidium hominis
TEPNIN

SEQ ID NO: 2164645 - protein, 19 aa, Cryptosporidium hominis
TEPTNKDPSDGKPKTGINE

SEQ ID NO: 2164646 - protein, 12 aa, Cryptosporidium hominis
TEQEKKDPSNSN

SEQ ID NO: 2164647 - protein, 15 aa, Cryptosporidium hominis
TEQELDKNNLNHGTP

SEQ ID NO: 2164648 - protein, 7 aa, Cryptosporidium hominis
TEQFQQE

SEQ ID NO: 2164649 - protein, 6 aa, Cryptosporidium hominis
TEQGKP

SEQ ID NO: 2164650 - protein, 7 aa, Cryptosporidium hominis
TEQGTPN

SEQ ID NO: 2164651 - protein, 6 aa, Cryptosporidium hominis
TEQILG

SEQ ID NO: 2164652 - protein, 6 aa, Cryptosporidium hominis
TEQISE

SEQ ID NO: 2164653 - protein, 24 aa, Cryptosporidium hominis
TEQLNAEKEEANKPDEEKKKDAAL

SEQ ID NO: 2164654 - protein, 7 aa, Cryptosporidium hominis
TEQQREE

SEQ ID NO: 2164655 - protein, 11 aa, Cryptosporidium hominis
TEQSKISNPQL

SEQ ID NO: 2164656 - protein, 10 aa, Cryptosporidium hominis
TERENTEKEN

SEQ ID NO: 2164657 - protein, 20 aa, Cryptosporidium hominis
TERGVVQENSTEKMDATENL

SEQ ID NO: 2164658 - protein, 7 aa, Cryptosporidium hominis
TERHSNL

SEQ ID NO: 2164659 - protein, 34 aa, Cryptosporidium hominis
TERNSNVIPNRNSTSAPRSIQNDQISPATSSQNC

SEQ ID NO: 2164660 - protein, 4 aa, Cryptosporidium hominis
TERP

SEQ ID NO: 2164661 - protein, 9 aa, Cryptosporidium hominis
TERPTTVGD

SEQ ID NO: 2164662 - protein, 9 aa, Cryptosporidium hominis
TERSENPNL

SEQ ID NO: 2164663 - protein, 19 aa, Cryptosporidium hominis
TERTQPFPVDTSNVSEDMP

SEQ ID NO: 2164664 - protein, 17 aa, Cryptosporidium hominis
TESDGSINRAIDKLLNQ

SEQ ID NO: 2164665 - protein, 16 aa, Cryptosporidium hominis
TESDNDENGNIQDKSF

SEQ ID NO: 2164666 - protein, 11 aa, Cryptosporidium hominis
TESEESEIGDT

SEQ ID NO: 2164667 - protein, 18 aa, Cryptosporidium hominis
TESENTRNDREKSSNQIF

SEQ ID NO: 2164668 - protein, 5 aa, Cryptosporidium hominis
TESEV

SEQ ID NO: 2164669 - protein, 6 aa, Cryptosporidium hominis
TESGRA

SEQ ID NO: 2164670 - protein, 8 aa, Cryptosporidium hominis
TESGSITN

SEQ ID NO: 2164671 - protein, 7 aa, Cryptosporidium hominis
TESHDQN

SEQ ID NO: 2164672 - protein, 44 aa, Cryptosporidium hominis
TESHETQCVQESKKDQEVPKQEIPQEDDTSVAEEDDDDSSEYES

SEQ ID NO: 2164673 - protein, 6 aa, Cryptosporidium hominis
TESKSH

SEQ ID NO: 2164674 - protein, 5 aa, Cryptosporidium hominis
TESLE

SEQ ID NO: 2164675 - protein, 38 aa, Cryptosporidium hominis
TESNSKLSSSITTPKKSGDRSKTTSCNGNHAISDFLSH

SEQ ID NO: 2164676 - protein, 6 aa, Cryptosporidium hominis
TESQIS

SEQ ID NO: 2164677 - protein, 6 aa, Cryptosporidium hominis
TESQQE

SEQ ID NO: 2164678 - protein, 6 aa, Cryptosporidium hominis
TESQSN

SEQ ID NO: 2164679 - protein, 6 aa, Cryptosporidium hominis
TESRCK

SEQ ID NO: 2164680 - protein, 9 aa, Cryptosporidium hominis
TESSKKGAK

SEQ ID NO: 2164681 - protein, 9 aa, Cryptosporidium hominis
TESSSDERR

SEQ ID NO: 2164682 - protein, 9 aa, Cryptosporidium hominis
TESTLGNAG

SEQ ID NO: 2164683 - protein, 27 aa, Cryptosporidium hominis
TESTLKGKLDSKTNQFSQKKEYNEELA

SEQ ID NO: 2164684 - protein, 9 aa, Cryptosporidium hominis
TETALDNDT

SEQ ID NO: 2164685 - protein, 17 aa, Cryptosporidium hominis
TETAQDSSNCSSEQYKS

SEQ ID NO: 2164686 - protein, 8 aa, Cryptosporidium hominis
TETDYSSS

SEQ ID NO: 2164687 - protein, 8 aa, Cryptosporidium hominis
TETETKGE

SEQ ID NO: 2164688 - protein, 5 aa, Cryptosporidium hominis
TETEV

SEQ ID NO: 2164689 - protein, 4 aa, Cryptosporidium hominis
TETG

SEQ ID NO: 2164690 - protein, 9 aa, Cryptosporidium hominis
TETGSKSSL

SEQ ID NO: 2164691 - protein, 14 aa, Cryptosporidium hominis
TETKTISKEDSSGI

SEQ ID NO: 2164692 - protein, 7 aa, Cryptosporidium hominis
TETNEEV

SEQ ID NO: 2164693 - protein, 19 aa, Cryptosporidium hominis
TETNLEKNKKIPSFGSTKK

SEQ ID NO: 2164694 - protein, 5 aa, Cryptosporidium hominis
TETQS

SEQ ID NO: 2164695 - protein, 13 aa, Cryptosporidium hominis
TETSNINKEISNI

SEQ ID NO: 2164696 - protein, 16 aa, Cryptosporidium hominis
TETSSQQLSSVASESL

SEQ ID NO: 2164697 - protein, 4 aa, Cryptosporidium hominis
TETT

SEQ ID NO: 2164698 - protein, 5 aa, Cryptosporidium hominis
TETTT

SEQ ID NO: 2164699 - protein, 7 aa, Cryptosporidium hominis
TETVGNF

SEQ ID NO: 2164700 - protein, 9 aa, Cryptosporidium hominis
TEVDDEEEH

SEQ ID NO: 2164701 - protein, 22 aa, Cryptosporidium hominis
TEVDSEGNEEETSLKKNSVEVD

SEQ ID NO: 2164702 - protein, 14 aa, Cryptosporidium hominis
TEVESSQTHVSNTN

SEQ ID NO: 2164703 - protein, 4 aa, Cryptosporidium hominis
TEYG

SEQ ID NO: 2164704 - protein, 7 aa, Cryptosporidium hominis
TEYGGQT

SEQ ID NO: 2164705 - protein, 6 aa, Cryptosporidium hominis
TEYGPG

SEQ ID NO: 2164706 - protein, 11 aa, Cryptosporidium hominis
TFDQDSEQAQH

SEQ ID NO: 2164707 - protein, 6 aa, Cryptosporidium hominis
TFEASN

SEQ ID NO: 2164708 - protein, 6 aa, Cryptosporidium hominis
TFEGGG

SEQ ID NO: 2164709 - protein, 30 aa, Cryptosporidium hominis
TFEKKKKSKSKRLDENHEEKSIKNNNTLEC

SEQ ID NO: 2164710 - protein, 4 aa, Cryptosporidium hominis
TFGD

SEQ ID NO: 2164711 - protein, 19 aa, Cryptosporidium hominis
TFGGNQQISSTQPTMFGSS

SEQ ID NO: 2164712 - protein, 6 aa, Cryptosporidium hominis
TFGPKG

SEQ ID NO: 2164713 - protein, 11 aa, Cryptosporidium hominis
TFGTKNKKKFI

SEQ ID NO: 2164714 - protein, 7 aa, Cryptosporidium hominis
TFHDGDS

SEQ ID NO: 2164715 - protein, 5 aa, Cryptosporidium hominis
TFHDK

SEQ ID NO: 2164716 - protein, 5 aa, Cryptosporidium hominis
TFKTT

SEQ ID NO: 2164717 - protein, 33 aa, Cryptosporidium hominis
TFNESDDNSSTNVSESDLSSESNTDSEDNQELE

SEQ ID NO: 2164718 - protein, 4 aa, Cryptosporidium hominis
TFNS

SEQ ID NO: 2164719 - protein, 27 aa, Cryptosporidium hominis
TFNSYSSPSVVSNSQNEPSKGNSSAHN

SEQ ID NO: 2164720 - protein, 25 aa, Cryptosporidium hominis
TFPDGTQMDAQQARARRRRHVFGVC

SEQ ID NO: 2164721 - protein, 5 aa, Cryptosporidium hominis
TFPNK

SEQ ID NO: 2164722 - protein, 9 aa, Cryptosporidium hominis
TFQDDPDHI

SEQ ID NO: 2164723 - protein, 6 aa, Cryptosporidium hominis
TFQDRE

SEQ ID NO: 2164724 - protein, 11 aa, Cryptosporidium hominis
TFQGRKSRTGY

SEQ ID NO: 2164725 - protein, 17 aa, Cryptosporidium hominis
TFQNSISPKKKDIGLSS

SEQ ID NO: 2164726 - protein, 11 aa, Cryptosporidium hominis
TFQTNNPPFQN

SEQ ID NO: 2164727 - protein, 5 aa, Cryptosporidium hominis
TFSEG

SEQ ID NO: 2164728 - protein, 28 aa, Cryptosporidium hominis
TFSQAGNNQAINSNNYSNFRSSNRHNSS

SEQ ID NO: 2164729 - protein, 4 aa, Cryptosporidium hominis
TFSR

SEQ ID NO: 2164730 - protein, 5 aa, Cryptosporidium hominis
TFTGG

SEQ ID NO: 2164731 - protein, 5 aa, Cryptosporidium hominis
TFTPQ

SEQ ID NO: 2164732 - protein, 5 aa, Cryptosporidium hominis
TFTQN

SEQ ID NO: 2164733 - protein, 7 aa, Cryptosporidium hominis
TGADISQ

SEQ ID NO: 2164734 - protein, 4 aa, Cryptosporidium hominis
TGAE

SEQ ID NO: 2164735 - protein, 32 aa, Cryptosporidium hominis
TGAGIGTGAGIGTGAGIGTGAGIGTGAGIGAG

SEQ ID NO: 2164736 - protein, 12 aa, Cryptosporidium hominis
TGASSENPYKSN

SEQ ID NO: 2164737 - protein, 6 aa, Cryptosporidium hominis
TGCGKS

SEQ ID NO: 2164738 - protein, 6 aa, Cryptosporidium hominis
TGCSPT

SEQ ID NO: 2164739 - protein, 7 aa, Cryptosporidium hominis
TGCSRAK

SEQ ID NO: 2164740 - protein, 5 aa, Cryptosporidium hominis
TGDDE

SEQ ID NO: 2164741 - protein, 7 aa, Cryptosporidium hominis
TGDDRQT

SEQ ID NO: 2164742 - protein, 28 aa, Cryptosporidium hominis
TGDEEPKPPQPPDDHNKLGGKNNGVNNH

SEQ ID NO: 2164743 - protein, 16 aa, Cryptosporidium hominis
TGDHDDQNDEGKSITG

SEQ ID NO: 2164744 - protein, 9 aa, Cryptosporidium hominis
TGDLEETEK

SEQ ID NO: 2164745 - protein, 17 aa, Cryptosporidium hominis
TGDMSNISSKKTSNKKY

SEQ ID NO: 2164746 - protein, 5 aa, Cryptosporidium hominis
TGDPN

SEQ ID NO: 2164747 - protein, 10 aa, Cryptosporidium hominis
TGDPTGQGIG

SEQ ID NO: 2164748 - protein, 14 aa, Cryptosporidium hominis
TGDPTLSNGEIENA

SEQ ID NO: 2164749 - protein, 16 aa, Cryptosporidium hominis
TGDVYEGEYSNGLKNG

SEQ ID NO: 2164750 - protein, 5 aa, Cryptosporidium hominis
TGDYH

SEQ ID NO: 2164751 - protein, 5 aa, Cryptosporidium hominis
TGDYT

SEQ ID NO: 2164752 - protein, 8 aa, Cryptosporidium hominis
TGEEDEEE

SEQ ID NO: 2164753 - protein, 4 aa, Cryptosporidium hominis
TGEF

SEQ ID NO: 2164754 - protein, 7 aa, Cryptosporidium hominis
TGEIANS

SEQ ID NO: 2164755 - protein, 10 aa, Cryptosporidium hominis
TGENKNEYGE

SEQ ID NO: 2164756 - protein, 6 aa, Cryptosporidium hominis
TGETIT

SEQ ID NO: 2164757 - protein, 15 aa, Cryptosporidium hominis
TGETSSENKTNEYSL

SEQ ID NO: 2164758 - protein, 8 aa, Cryptosporidium hominis
TGEYKANE

SEQ ID NO: 2164759 - protein, 15 aa, Cryptosporidium hominis
TGFGSRGGRGGQRGR

SEQ ID NO: 2164760 - protein, 24 aa, Cryptosporidium hominis
TGFTNKANRDSSEVDSNKNTSIES

SEQ ID NO: 2164761 - protein, 6 aa, Cryptosporidium hominis
TGGCDG

SEQ ID NO: 2164762 - protein, 35 aa, Cryptosporidium hominis
TGGEAASEEGEEPGETETVTDNSASGKSDKQGIKG

SEQ ID NO: 2164763 - protein, 5 aa, Cryptosporidium hominis
TGGGK

SEQ ID NO: 2164764 - protein, 6 aa, Cryptosporidium hominis
TGGKLD

SEQ ID NO: 2164765 - protein, 9 aa, Cryptosporidium hominis
TGGNDKQGF

SEQ ID NO: 2164766 - protein, 11 aa, Cryptosporidium hominis
TGGNGSGKSSL

SEQ ID NO: 2164767 - protein, 5 aa, Cryptosporidium hominis
TGGNN

SEQ ID NO: 2164768 - protein, 5 aa, Cryptosporidium hominis
TGGRD

SEQ ID NO: 2164769 - protein, 8 aa, Cryptosporidium hominis
TGGRTRRK

SEQ ID NO: 2164770 - protein, 7 aa, Cryptosporidium hominis
TGGTSLR

SEQ ID NO: 2164771 - protein, 22 aa, Cryptosporidium hominis
TGGVSSSSISVNSSPIHSSQTI

SEQ ID NO: 2164772 - protein, 4 aa, Cryptosporidium hominis
TGHG

SEQ ID NO: 2164773 - protein, 12 aa, Cryptosporidium hominis
TGHGNTTTNGNH

SEQ ID NO: 2164774 - protein, 4 aa, Cryptosporidium hominis
TGHP

SEQ ID NO: 2164775 - protein, 9 aa, Cryptosporidium hominis
TGIENGPAM

SEQ ID NO: 2164776 - protein, 28 aa, Cryptosporidium hominis
TGIGTGTGTGSGTGTGTLTGSGTGTGST

SEQ ID NO: 2164777 - protein, 4 aa, Cryptosporidium hominis
TGIK

SEQ ID NO: 2164778 - protein, 13 aa, Cryptosporidium hominis
TGIKGPKEFETKQ

SEQ ID NO: 2164779 - protein, 4 aa, Cryptosporidium hominis
TGIR

SEQ ID NO: 2164780 - protein, 6 aa, Cryptosporidium hominis
TGISKS

SEQ ID NO: 2164781 - protein, 5 aa, Cryptosporidium hominis
TGISR

SEQ ID NO: 2164782 - protein, 24 aa, Cryptosporidium hominis
TGISSEKKKPGEDSNDTLMLNNTQ

SEQ ID NO: 2164783 - protein, 12 aa, Cryptosporidium hominis
TGISTGKESEKI

SEQ ID NO: 2164784 - protein, 24 aa, Cryptosporidium hominis
TGITTSGKSSSKKRLTKENINNSN

SEQ ID NO: 2164785 - protein, 36 aa, Cryptosporidium hominis
TGKASRKRNRLGNSDDEETEAESNINDNDMDDDMPE

SEQ ID NO: 2164786 - protein, 5 aa, Cryptosporidium hominis
TGKDS

SEQ ID NO: 2164787 - protein, 17 aa, Cryptosporidium hominis
TGKEKRREYTKGSDSSH

SEQ ID NO: 2164788 - protein, 5 aa, Cryptosporidium hominis
TGKEY

SEQ ID NO: 2164789 - protein, 4 aa, Cryptosporidium hominis
TGKG

SEQ ID NO: 2164790 - protein, 13 aa, Cryptosporidium hominis
TGKKSTDKRNSKN

SEQ ID NO: 2164791 - protein, 7 aa, Cryptosporidium hominis
TGKNHGN

SEQ ID NO: 2164792 - protein, 4 aa, Cryptosporidium hominis
TGKP

SEQ ID NO: 2164793 - protein, 13 aa, Cryptosporidium hominis
TGKPMGSYANTDF

SEQ ID NO: 2164794 - protein, 7 aa, Cryptosporidium hominis
TGKRVGQ

SEQ ID NO: 2164795 - protein, 5 aa, Cryptosporidium hominis
TGKTK

SEQ ID NO: 2164796 - protein, 14 aa, Cryptosporidium hominis
TGKYSYKSPYDKLN

SEQ ID NO: 2164797 - protein, 4 aa, Cryptosporidium hominis
TGLD

SEQ ID NO: 2164798 - protein, 24 aa, Cryptosporidium hominis
TGLPAPPTLATPPGLATPPSAPVL

SEQ ID NO: 2164799 - protein, 10 aa, Cryptosporidium hominis
TGLPKDPVSD

SEQ ID NO: 2164800 - protein, 23 aa, Cryptosporidium hominis
TGMDEDEQDEEDEEDEQEESVEY

SEQ ID NO: 2164801 - protein, 4 aa, Cryptosporidium hominis
TGND

SEQ ID NO: 2164802 - protein, 7 aa, Cryptosporidium hominis
TGNEEQF

SEQ ID NO: 2164803 - protein, 7 aa, Cryptosporidium hominis
TGNGKLR

SEQ ID NO: 2164804 - protein, 10 aa, Cryptosporidium hominis
TGNKETLEVK

SEQ ID NO: 2164805 - protein, 22 aa, Cryptosporidium hominis
TGNNGSSSTNLQETLQQFRGIK

SEQ ID NO: 2164806 - protein, 4 aa, Cryptosporidium hominis
TGNP

SEQ ID NO: 2164807 - protein, 9 aa, Cryptosporidium hominis
TGNPETQEI

SEQ ID NO: 2164808 - protein, 7 aa, Cryptosporidium hominis
TGNPSNI

SEQ ID NO: 2164809 - protein, 8 aa, Cryptosporidium hominis
TGNQDIQD

SEQ ID NO: 2164810 - protein, 5 aa, Cryptosporidium hominis
TGPAN

SEQ ID NO: 2164811 - protein, 6 aa, Cryptosporidium hominis
TGPCGP

SEQ ID NO: 2164812 - protein, 12 aa, Cryptosporidium hominis
TGPDVSKAKDTV

SEQ ID NO: 2164813 - protein, 5 aa, Cryptosporidium hominis
TGPPF

SEQ ID NO: 2164814 - protein, 6 aa, Cryptosporidium hominis
TGPSSY

SEQ ID NO: 2164815 - protein, 6 aa, Cryptosporidium hominis
TGQDGV

SEQ ID NO: 2164816 - protein, 15 aa, Cryptosporidium hominis
TGQDKQNFYFTALGI

SEQ ID NO: 2164817 - protein, 10 aa, Cryptosporidium hominis
TGQNQFNANT

SEQ ID NO: 2164818 - protein, 4 aa, Cryptosporidium hominis
TGQS

SEQ ID NO: 2164819 - protein, 15 aa, Cryptosporidium hominis
TGQVQTNKKTDSDGS

SEQ ID NO: 2164820 - protein, 9 aa, Cryptosporidium hominis
TGREADLTK

SEQ ID NO: 2164821 - protein, 10 aa, Cryptosporidium hominis
TGRPKGPKNL

SEQ ID NO: 2164822 - protein, 11 aa, Cryptosporidium hominis
TGRQGNQKNKP

SEQ ID NO: 2164823 - protein, 8 aa, Cryptosporidium hominis
TGRRPTGL

SEQ ID NO: 2164824 - protein, 4 aa, Cryptosporidium hominis
TGRT

SEQ ID NO: 2164825 - protein, 4 aa, Cryptosporidium hominis
TGSC

SEQ ID NO: 2164826 - protein, 5 aa, Cryptosporidium hominis
TGSDF

SEQ ID NO: 2164827 - protein, 10 aa, Cryptosporidium hominis
TGSDTNKIKP

SEQ ID NO: 2164828 - protein, 7 aa, Cryptosporidium hominis
TGSELSK

SEQ ID NO: 2164829 - protein, 5 aa, Cryptosporidium hominis
TGSEQ

SEQ ID NO: 2164830 - protein, 57 aa, Cryptosporidium hominis
TGSESILGNSNTLSGGSSLFGTSSSSLASTNLTSGVTTSLTSLSTSPSLANANTNSN

SEQ ID NO: 2164831 - protein, 36 aa, Cryptosporidium hominis
TGSGGTQKGRKGKSRRHSNQVRQTGISESKGGSMND

SEQ ID NO: 2164832 - protein, 6 aa, Cryptosporidium hominis
TGSGTV

SEQ ID NO: 2164833 - protein, 4 aa, Cryptosporidium hominis
TGSI

SEQ ID NO: 2164834 - protein, 5 aa, Cryptosporidium hominis
TGSPI

SEQ ID NO: 2164835 - protein, 8 aa, Cryptosporidium hominis
TGSPYHSV

SEQ ID NO: 2164836 - protein, 4 aa, Cryptosporidium hominis
TGSQ

SEQ ID NO: 2164837 - protein, 5 aa, Cryptosporidium hominis
TGSQT

SEQ ID NO: 2164838 - protein, 7 aa, Cryptosporidium hominis
TGSRDGS

SEQ ID NO: 2164839 - protein, 16 aa, Cryptosporidium hominis
TGSRDKYDQENIGNSI

SEQ ID NO: 2164840 - protein, 12 aa, Cryptosporidium hominis
TGSRTSSAQTSD

SEQ ID NO: 2164841 - protein, 26 aa, Cryptosporidium hominis
TGSSNLQGSEHDSKVESDSEASNDLE

SEQ ID NO: 2164842 - protein, 6 aa, Cryptosporidium hominis
TGSSQL

SEQ ID NO: 2164843 - protein, 17 aa, Cryptosporidium hominis
TGSTNSSSTTGFIIVWW

SEQ ID NO: 2164844 - protein, 12 aa, Cryptosporidium hominis
TGSTSSRYSNTE

SEQ ID NO: 2164845 - protein, 9 aa, Cryptosporidium hominis
TGSVDTPYN

SEQ ID NO: 2164846 - protein, 21 aa, Cryptosporidium hominis
TGTAISRPGTISGSVAGTGNV

SEQ ID NO: 2164847 - protein, 8 aa, Cryptosporidium hominis
TGTEAKGT

SEQ ID NO: 2164848 - protein, 6 aa, Cryptosporidium hominis
TGTESK

SEQ ID NO: 2164849 - protein, 12 aa, Cryptosporidium hominis
TGTKDIGKMTEG

SEQ ID NO: 2164850 - protein, 8 aa, Cryptosporidium hominis
TGTKRNSL

SEQ ID NO: 2164851 - protein, 4 aa, Cryptosporidium hominis
TGTM

SEQ ID NO: 2164852 - protein, 12 aa, Cryptosporidium hominis
TGTMEKNATDEK

SEQ ID NO: 2164853 - protein, 7 aa, Cryptosporidium hominis
TGTNNVE

SEQ ID NO: 2164854 - protein, 6 aa, Cryptosporidium hominis
TGTSQA

SEQ ID NO: 2164855 - protein, 5 aa, Cryptosporidium hominis
TGTTT

SEQ ID NO: 2164856 - protein, 10 aa, Cryptosporidium hominis
TGVDLKPDNT

SEQ ID NO: 2164857 - protein, 10 aa, Cryptosporidium hominis
TGVKSGKALS

SEQ ID NO: 2164858 - protein, 10 aa, Cryptosporidium hominis
TGVPASKQKL

SEQ ID NO: 2164859 - protein, 4 aa, Cryptosporidium hominis
TGVS

SEQ ID NO: 2164860 - protein, 20 aa, Cryptosporidium hominis
TGYETPTKLSYGAGDRSSSI

SEQ ID NO: 2164861 - protein, 4 aa, Cryptosporidium hominis
TGYI

SEQ ID NO: 2164862 - protein, 5 aa, Cryptosporidium hominis
TGYKE

SEQ ID NO: 2164863 - protein, 16 aa, Cryptosporidium hominis
THAPRPPLKEENKGKQ

SEQ ID NO: 2164864 - protein, 11 aa, Cryptosporidium hominis
THDGDNPEKLG

SEQ ID NO: 2164865 - protein, 13 aa, Cryptosporidium hominis
THDPDTKERRLEA

SEQ ID NO: 2164866 - protein, 4 aa, Cryptosporidium hominis
THEI

SEQ ID NO: 2164867 - protein, 9 aa, Cryptosporidium hominis
THENEELNN

SEQ ID NO: 2164868 - protein, 8 aa, Cryptosporidium hominis
THKDGGLG

SEQ ID NO: 2164869 - protein, 33 aa, Cryptosporidium hominis
THNQAQPQAQIQGHTHNTSLSSIPNQNRASEEG

SEQ ID NO: 2164870 - protein, 5 aa, Cryptosporidium hominis
THNSE

SEQ ID NO: 2164871 - protein, 11 aa, Cryptosporidium hominis
THNSGKTLENM

SEQ ID NO: 2164872 - protein, 12 aa, Cryptosporidium hominis
THNSHNSNHHNN

SEQ ID NO: 2164873 - protein, 14 aa, Cryptosporidium hominis
THNSNNSETKPAFV

SEQ ID NO: 2164874 - protein, 15 aa, Cryptosporidium hominis
THRTLPAEVKNNPAA

SEQ ID NO: 2164875 - protein, 9 aa, Cryptosporidium hominis
THSDSDGNI

SEQ ID NO: 2164876 - protein, 18 aa, Cryptosporidium hominis
THSKGDLTDEKSQHKKKR

SEQ ID NO: 2164877 - protein, 7 aa, Cryptosporidium hominis
THSSSND

SEQ ID NO: 2164878 - protein, 7 aa, Cryptosporidium hominis
THTSGMD

SEQ ID NO: 2164879 - protein, 8 aa, Cryptosporidium hominis
THYGSKTA

SEQ ID NO: 2164880 - protein, 5 aa, Cryptosporidium hominis
TIAND

SEQ ID NO: 2164881 - protein, 4 aa, Cryptosporidium hominis
TIAP

SEQ ID NO: 2164882 - protein, 14 aa, Cryptosporidium hominis
TIASRTEELTPNDL

SEQ ID NO: 2164883 - protein, 13 aa, Cryptosporidium hominis
TIDDSKDQNSTNE

SEQ ID NO: 2164884 - protein, 5 aa, Cryptosporidium hominis
TIDEA

SEQ ID NO: 2164885 - protein, 7 aa, Cryptosporidium hominis
TIDENED

SEQ ID NO: 2164886 - protein, 17 aa, Cryptosporidium hominis
TIDESENDHPGNSTNHY

SEQ ID NO: 2164887 - protein, 7 aa, Cryptosporidium hominis
TIDESSR

SEQ ID NO: 2164888 - protein, 6 aa, Cryptosporidium hominis
TIDGDL

SEQ ID NO: 2164889 - protein, 10 aa, Cryptosporidium hominis
TIDGDLKNPA

SEQ ID NO: 2164890 - protein, 9 aa, Cryptosporidium hominis
TIDSKLETT

SEQ ID NO: 2164891 - protein, 10 aa, Cryptosporidium hominis
TIDSRVGGDF

SEQ ID NO: 2164892 - protein, 7 aa, Cryptosporidium hominis
TIEAATP

SEQ ID NO: 2164893 - protein, 6 aa, Cryptosporidium hominis
TIEERE

SEQ ID NO: 2164894 - protein, 11 aa, Cryptosporidium hominis
TIENDDDISEL

SEQ ID NO: 2164895 - protein, 6 aa, Cryptosporidium hominis
TIENGE

SEQ ID NO: 2164896 - protein, 24 aa, Cryptosporidium hominis
TIENQFESSKSNNIDKMSSNNEKK

SEQ ID NO: 2164897 - protein, 7 aa, Cryptosporidium hominis
TIERGRQ

SEQ ID NO: 2164898 - protein, 6 aa, Cryptosporidium hominis
TIESAE

SEQ ID NO: 2164899 - protein, 7 aa, Cryptosporidium hominis
TIESEEK

SEQ ID NO: 2164900 - protein, 8 aa, Cryptosporidium hominis
TIETDDQE

SEQ ID NO: 2164901 - protein, 11 aa, Cryptosporidium hominis
TIGENKDSDID

SEQ ID NO: 2164902 - protein, 6 aa, Cryptosporidium hominis
TIGETR

SEQ ID NO: 2164903 - protein, 5 aa, Cryptosporidium hominis
TIGNA

SEQ ID NO: 2164904 - protein, 16 aa, Cryptosporidium hominis
TIGNNNNNNNKRNHEK

SEQ ID NO: 2164905 - protein, 18 aa, Cryptosporidium hominis
TIGQPSKSTSISKPGEIG

SEQ ID NO: 2164906 - protein, 7 aa, Cryptosporidium hominis
TIGRNVT

SEQ ID NO: 2164907 - protein, 11 aa, Cryptosporidium hominis
TIHPKPQENNL

SEQ ID NO: 2164908 - protein, 15 aa, Cryptosporidium hominis
TIHSSEDSQENSTCP

SEQ ID NO: 2164909 - protein, 6 aa, Cryptosporidium hominis
TIKNGT

SEQ ID NO: 2164910 - protein, 9 aa, Cryptosporidium hominis
TIKSSVTTN

SEQ ID NO: 2164911 - protein, 7 aa, Cryptosporidium hominis
TINCGEN

SEQ ID NO: 2164912 - protein, 10 aa, Cryptosporidium hominis
TINEENKKSM

SEQ ID NO: 2164913 - protein, 11 aa, Cryptosporidium hominis
TINEQGNKGKI

SEQ ID NO: 2164914 - protein, 12 aa, Cryptosporidium hominis
TINHESAKYNMK

SEQ ID NO: 2164915 - protein, 8 aa, Cryptosporidium hominis
TINKDEEI

SEQ ID NO: 2164916 - protein, 13 aa, Cryptosporidium hominis
TINKSSNNDQSLD

SEQ ID NO: 2164917 - protein, 10 aa, Cryptosporidium hominis
TINNEDNSNI

SEQ ID NO: 2164918 - protein, 12 aa, Cryptosporidium hominis
TINNNSEKVSHD

SEQ ID NO: 2164919 - protein, 14 aa, Cryptosporidium hominis
TINSDSDDQSESSM

SEQ ID NO: 2164920 - protein, 6 aa, Cryptosporidium hominis
TINTNY

SEQ ID NO: 2164921 - protein, 5 aa, Cryptosporidium hominis
TINTQ

SEQ ID NO: 2164922 - protein, 13 aa, Cryptosporidium hominis
TIPENGSGSDHPP

SEQ ID NO: 2164923 - protein, 13 aa, Cryptosporidium hominis
TIPENGSSSDHAP

SEQ ID NO: 2164924 - protein, 14 aa, Cryptosporidium hominis
TIPETGSDSDHAPV

SEQ ID NO: 2164925 - protein, 41 aa, Cryptosporidium hominis
TIPETGSNSNHPSVTIPETGSSSNHPSVTIPETGSGSDHAP

SEQ ID NO: 2164926 - protein, 42 aa, Cryptosporidium hominis
TIPETGSSSDHPSVTIPETDSGSDHPSDTEPETGPGSDHTPV

SEQ ID NO: 2164927 - protein, 81 aa, Cryptosporidium hominis
TIPGGVATSPLSSPTPEVGSPNASKTGDTEATKSPKNNRKRRGSKSSYISDSDTKSLSPNISNRRNSPDATNNVKTASEIE

SEQ ID NO: 2164928 - protein, 5 aa, Cryptosporidium hominis
TIPKE

SEQ ID NO: 2164929 - protein, 5 aa, Cryptosporidium hominis
TIPNQ

SEQ ID NO: 2164930 - protein, 6 aa, Cryptosporidium hominis
TIPQAE

SEQ ID NO: 2164931 - protein, 6 aa, Cryptosporidium hominis
TIPREN

SEQ ID NO: 2164932 - protein, 4 aa, Cryptosporidium hominis
TIPS

SEQ ID NO: 2164933 - protein, 13 aa, Cryptosporidium hominis
TIQATNELKENFG

SEQ ID NO: 2164934 - protein, 9 aa, Cryptosporidium hominis
TIQGLNNNK

SEQ ID NO: 2164935 - protein, 11 aa, Cryptosporidium hominis
TIQNANEQHQK

SEQ ID NO: 2164936 - protein, 12 aa, Cryptosporidium hominis
TISDNEGEEEEE

SEQ ID NO: 2164937 - protein, 51 aa, Cryptosporidium hominis
TISDSSVQKPLQTKRERAVRTSKNKLSGSSSHGGVGASSSSNSGGISAQDL

SEQ ID NO: 2164938 - protein, 7 aa, Cryptosporidium hominis
TISKNRP

SEQ ID NO: 2164939 - protein, 13 aa, Cryptosporidium hominis
TISKSGSYVEDDD

SEQ ID NO: 2164940 - protein, 12 aa, Cryptosporidium hominis
TISKTSKKGGEI

SEQ ID NO: 2164941 - protein, 11 aa, Cryptosporidium hominis
TISMSESKARE

SEQ ID NO: 2164942 - protein, 9 aa, Cryptosporidium hominis
TISPEECSH

SEQ ID NO: 2164943 - protein, 7 aa, Cryptosporidium hominis
TISPSEK

SEQ ID NO: 2164944 - protein, 18 aa, Cryptosporidium hominis
TISQHRKQEQAKIESGKK

SEQ ID NO: 2164945 - protein, 4 aa, Cryptosporidium hominis
TISR

SEQ ID NO: 2164946 - protein, 10 aa, Cryptosporidium hominis
TISRQTDSSL

SEQ ID NO: 2164947 - protein, 11 aa, Cryptosporidium hominis
TISSGSDLKQQ

SEQ ID NO: 2164948 - protein, 5 aa, Cryptosporidium hominis
TISSN

SEQ ID NO: 2164949 - protein, 7 aa, Cryptosporidium hominis
TISSTNN

SEQ ID NO: 2164950 - protein, 9 aa, Cryptosporidium hominis
TISTNTQKY

SEQ ID NO: 2164951 - protein, 6 aa, Cryptosporidium hominis
TITEPK

SEQ ID NO: 2164952 - protein, 7 aa, Cryptosporidium hominis
TITGGNI

SEQ ID NO: 2164953 - protein, 18 aa, Cryptosporidium hominis
TITNISGNKEIEREENYL

SEQ ID NO: 2164954 - protein, 6 aa, Cryptosporidium hominis
TITNKR

SEQ ID NO: 2164955 - protein, 23 aa, Cryptosporidium hominis
TITNYKSNKGQFNQSNFSANSSI

SEQ ID NO: 2164956 - protein, 13 aa, Cryptosporidium hominis
TITPGQNSSSTIS

SEQ ID NO: 2164957 - protein, 4 aa, Cryptosporidium hominis
TITQ

SEQ ID NO: 2164958 - protein, 10 aa, Cryptosporidium hominis
TKAEAKTSLD

SEQ ID NO: 2164959 - protein, 13 aa, Cryptosporidium hominis
TKAEDTEGTKNIE

SEQ ID NO: 2164960 - protein, 7 aa, Cryptosporidium hominis
TKAGSRS

SEQ ID NO: 2164961 - protein, 7 aa, Cryptosporidium hominis
TKAGTPY

SEQ ID NO: 2164962 - protein, 7 aa, Cryptosporidium hominis
TKAHPNP

SEQ ID NO: 2164963 - protein, 8 aa, Cryptosporidium hominis
TKANHESS

SEQ ID NO: 2164964 - protein, 16 aa, Cryptosporidium hominis
TKANSIENQNYLNPKS

SEQ ID NO: 2164965 - protein, 5 aa, Cryptosporidium hominis
TKAQK

SEQ ID NO: 2164966 - protein, 6 aa, Cryptosporidium hominis
TKARIQ

SEQ ID NO: 2164967 - protein, 11 aa, Cryptosporidium hominis
TKASANNETSV

SEQ ID NO: 2164968 - protein, 15 aa, Cryptosporidium hominis
TKASISNNPVDNTTT

SEQ ID NO: 2164969 - protein, 45 aa, Cryptosporidium hominis
TKASKTATQREMKQNSQKAGVKSPARTAKASKKTVTRNALERFKS

SEQ ID NO: 2164970 - protein, 6 aa, Cryptosporidium hominis
TKCSDK

SEQ ID NO: 2164971 - protein, 16 aa, Cryptosporidium hominis
TKDDINHEKGITSKAI

SEQ ID NO: 2164972 - protein, 9 aa, Cryptosporidium hominis
TKDDQVKTL

SEQ ID NO: 2164973 - protein, 9 aa, Cryptosporidium hominis
TKDDSQRRK

SEQ ID NO: 2164974 - protein, 8 aa, Cryptosporidium hominis
TKDENGNF

SEQ ID NO: 2164975 - protein, 7 aa, Cryptosporidium hominis
TKDEVSR

SEQ ID NO: 2164976 - protein, 5 aa, Cryptosporidium hominis
TKDGF

SEQ ID NO: 2164977 - protein, 8 aa, Cryptosporidium hominis
TKDGNLKG

SEQ ID NO: 2164978 - protein, 6 aa, Cryptosporidium hominis
TKDNSI

SEQ ID NO: 2164979 - protein, 8 aa, Cryptosporidium hominis
TKDPETKE

SEQ ID NO: 2164980 - protein, 8 aa, Cryptosporidium hominis
TKDTFDKG

SEQ ID NO: 2164981 - protein, 5 aa, Cryptosporidium hominis
TKDTI

SEQ ID NO: 2164982 - protein, 8 aa, Cryptosporidium hominis
TKDVTSQQ

SEQ ID NO: 2164983 - protein, 11 aa, Cryptosporidium hominis
TKDWNKESVES

SEQ ID NO: 2164984 - protein, 7 aa, Cryptosporidium hominis
TKEAEED

SEQ ID NO: 2164985 - protein, 9 aa, Cryptosporidium hominis
TKEALRQEK

SEQ ID NO: 2164986 - protein, 31 aa, Cryptosporidium hominis
TKEDEAISNKTDNLGNSEYFEDSNNKNPKIS

SEQ ID NO: 2164987 - protein, 21 aa, Cryptosporidium hominis
TKEEKKDGQLSSFSPDTGLDD

SEQ ID NO: 2164988 - protein, 5 aa, Cryptosporidium hominis
TKEEL

SEQ ID NO: 2164989 - protein, 9 aa, Cryptosporidium hominis
TKEEQAIER

SEQ ID NO: 2164990 - protein, 6 aa, Cryptosporidium hominis
TKEFSG

SEQ ID NO: 2164991 - protein, 9 aa, Cryptosporidium hominis
TKEGSGLVT

SEQ ID NO: 2164992 - protein, 9 aa, Cryptosporidium hominis
TKEIPGQSK

SEQ ID NO: 2164993 - protein, 5 aa, Cryptosporidium hominis
TKEKD

SEQ ID NO: 2164994 - protein, 11 aa, Cryptosporidium hominis
TKEKKSPNTTA

SEQ ID NO: 2164995 - protein, 5 aa, Cryptosporidium hominis
TKENE

SEQ ID NO: 2164996 - protein, 7 aa, Cryptosporidium hominis
TKENEVM

SEQ ID NO: 2164997 - protein, 9 aa, Cryptosporidium hominis
TKEQEKRIR

SEQ ID NO: 2164998 - protein, 7 aa, Cryptosporidium hominis
TKESESI

SEQ ID NO: 2164999 - protein, 8 aa, Cryptosporidium hominis
TKESNSSI

SEQ ID NO: 2165000 - protein, 11 aa, Cryptosporidium hominis
TKETDDSKGKY

SEQ ID NO: 2165001 - protein, 14 aa, Cryptosporidium hominis
TKETDNNCNEIERT

SEQ ID NO: 2165002 - protein, 22 aa, Cryptosporidium hominis
TKETNVAPKSPPRKTSKGMKPS

SEQ ID NO: 2165003 - protein, 5 aa, Cryptosporidium hominis
TKEVD

SEQ ID NO: 2165004 - protein, 11 aa, Cryptosporidium hominis
TKFEGNKTERG

SEQ ID NO: 2165005 - protein, 6 aa, Cryptosporidium hominis
TKFGRG

SEQ ID NO: 2165006 - protein, 5 aa, Cryptosporidium hominis
TKFNS

SEQ ID NO: 2165007 - protein, 15 aa, Cryptosporidium hominis
TKGACQKCKTKLLRL

SEQ ID NO: 2165008 - protein, 10 aa, Cryptosporidium hominis
TKGDEIDEEN

SEQ ID NO: 2165009 - protein, 8 aa, Cryptosporidium hominis
TKGQNKCR

SEQ ID NO: 2165010 - protein, 7 aa, Cryptosporidium hominis
TKGRSHE

SEQ ID NO: 2165011 - protein, 5 aa, Cryptosporidium hominis
TKHRM

SEQ ID NO: 2165012 - protein, 19 aa, Cryptosporidium hominis
TKIDSYKSSLQQSKKELVS

SEQ ID NO: 2165013 - protein, 13 aa, Cryptosporidium hominis
TKIEEGLGGNSRE

SEQ ID NO: 2165014 - protein, 9 aa, Cryptosporidium hominis
TKIEIKDKK

SEQ ID NO: 2165015 - protein, 22 aa, Cryptosporidium hominis
TKIEQSETKYTDVNSEYPSETF

SEQ ID NO: 2165016 - protein, 17 aa, Cryptosporidium hominis
TKIGQEYSQQLSSNNEF

SEQ ID NO: 2165017 - protein, 8 aa, Cryptosporidium hominis
TKIKGETI

SEQ ID NO: 2165018 - protein, 7 aa, Cryptosporidium hominis
TKINDET

SEQ ID NO: 2165019 - protein, 9 aa, Cryptosporidium hominis
TKINPKSQD

SEQ ID NO: 2165020 - protein, 5 aa, Cryptosporidium hominis
TKISN

SEQ ID NO: 2165021 - protein, 6 aa, Cryptosporidium hominis
TKISND

SEQ ID NO: 2165022 - protein, 21 aa, Cryptosporidium hominis
TKISSVKESRNSDDNKSISRL

SEQ ID NO: 2165023 - protein, 27 aa, Cryptosporidium hominis
TKIYPPSDGEISPESDSSRSLSRSISP

SEQ ID NO: 2165024 - protein, 11 aa, Cryptosporidium hominis
TKKDNPSEGPL

SEQ ID NO: 2165025 - protein, 4 aa, Cryptosporidium hominis
TKKE

SEQ ID NO: 2165026 - protein, 10 aa, Cryptosporidium hominis
TKKENKRSFS

SEQ ID NO: 2165027 - protein, 10 aa, Cryptosporidium hominis
TKKFSKKAYN

SEQ ID NO: 2165028 - protein, 6 aa, Cryptosporidium hominis
TKKGTL

SEQ ID NO: 2165029 - protein, 8 aa, Cryptosporidium hominis
TKKKDRLS

SEQ ID NO: 2165030 - protein, 11 aa, Cryptosporidium hominis
TKKKKFNKENI

SEQ ID NO: 2165031 - protein, 7 aa, Cryptosporidium hominis
TKKLNEE

SEQ ID NO: 2165032 - protein, 8 aa, Cryptosporidium hominis
TKKMGKKE

SEQ ID NO: 2165033 - protein, 17 aa, Cryptosporidium hominis
TKKQEIVNRENNSKLTS

SEQ ID NO: 2165034 - protein, 6 aa, Cryptosporidium hominis
TKKQIK

SEQ ID NO: 2165035 - protein, 6 aa, Cryptosporidium hominis
TKKSEY

SEQ ID NO: 2165036 - protein, 9 aa, Cryptosporidium hominis
TKKSHQVNS

SEQ ID NO: 2165037 - protein, 9 aa, Cryptosporidium hominis
TKKSNLDNS

SEQ ID NO: 2165038 - protein, 13 aa, Cryptosporidium hominis
TKKSNPLEDNTSQ

SEQ ID NO: 2165039 - protein, 15 aa, Cryptosporidium hominis
TKKSRGRGRPKSRPK

SEQ ID NO: 2165040 - protein, 8 aa, Cryptosporidium hominis
TKKSTPKY

SEQ ID NO: 2165041 - protein, 12 aa, Cryptosporidium hominis
TKKTENTSTQKV

SEQ ID NO: 2165042 - protein, 9 aa, Cryptosporidium hominis
TKKTSENKR

SEQ ID NO: 2165043 - protein, 4 aa, Cryptosporidium hominis
TKKV

SEQ ID NO: 2165044 - protein, 7 aa, Cryptosporidium hominis
TKKYGGA

SEQ ID NO: 2165045 - protein, 11 aa, Cryptosporidium hominis
TKLDGSSPIPA

SEQ ID NO: 2165046 - protein, 13 aa, Cryptosporidium hominis
TKLEEDRNSLEKQ

SEQ ID NO: 2165047 - protein, 7 aa, Cryptosporidium hominis
TKLEPTE

SEQ ID NO: 2165048 - protein, 6 aa, Cryptosporidium hominis
TKLGGR

SEQ ID NO: 2165049 - protein, 8 aa, Cryptosporidium hominis
TKLNPNNQ

SEQ ID NO: 2165050 - protein, 7 aa, Cryptosporidium hominis
TKLPTES

SEQ ID NO: 2165051 - protein, 10 aa, Cryptosporidium hominis
TKLSNSHNGS

SEQ ID NO: 2165052 - protein, 8 aa, Cryptosporidium hominis
TKMPATST

SEQ ID NO: 2165053 - protein, 7 aa, Cryptosporidium hominis
TKNDQNI

SEQ ID NO: 2165054 - protein, 13 aa, Cryptosporidium hominis
TKNDSISEHAHDS

SEQ ID NO: 2165055 - protein, 9 aa, Cryptosporidium hominis
TKNFNYTRE

SEQ ID NO: 2165056 - protein, 13 aa, Cryptosporidium hominis
TKNGTDRTKKEQV

SEQ ID NO: 2165057 - protein, 5 aa, Cryptosporidium hominis
TKNNH

SEQ ID NO: 2165058 - protein, 5 aa, Cryptosporidium hominis
TKNNS

SEQ ID NO: 2165059 - protein, 6 aa, Cryptosporidium hominis
TKNNYI

SEQ ID NO: 2165060 - protein, 4 aa, Cryptosporidium hominis
TKNQ

SEQ ID NO: 2165061 - protein, 8 aa, Cryptosporidium hominis
TKNQQDYN

SEQ ID NO: 2165062 - protein, 9 aa, Cryptosporidium hominis
TKNQRHDNH

SEQ ID NO: 2165063 - protein, 5 aa, Cryptosporidium hominis
TKNRD

SEQ ID NO: 2165064 - protein, 9 aa, Cryptosporidium hominis
TKNREPDNN

SEQ ID NO: 2165065 - protein, 5 aa, Cryptosporidium hominis
TKNSG

SEQ ID NO: 2165066 - protein, 9 aa, Cryptosporidium hominis
TKNSHTESG

SEQ ID NO: 2165067 - protein, 10 aa, Cryptosporidium hominis
TKNSNEISSF

SEQ ID NO: 2165068 - protein, 6 aa, Cryptosporidium hominis
TKNSNS

SEQ ID NO: 2165069 - protein, 7 aa, Cryptosporidium hominis
TKNSPSS

SEQ ID NO: 2165070 - protein, 5 aa, Cryptosporidium hominis
TKNYA

SEQ ID NO: 2165071 - protein, 8 aa, Cryptosporidium hominis
TKPENDLN

SEQ ID NO: 2165072 - protein, 9 aa, Cryptosporidium hominis
TKPGVDKNK

SEQ ID NO: 2165073 - protein, 6 aa, Cryptosporidium hominis
TKPIEN

SEQ ID NO: 2165074 - protein, 5 aa, Cryptosporidium hominis
TKPQV

SEQ ID NO: 2165075 - protein, 17 aa, Cryptosporidium hominis
TKPSGSESKNITSSTLP

SEQ ID NO: 2165076 - protein, 5 aa, Cryptosporidium hominis
TKPSR

SEQ ID NO: 2165077 - protein, 7 aa, Cryptosporidium hominis
TKPTASQ

SEQ ID NO: 2165078 - protein, 9 aa, Cryptosporidium hominis
TKQEDQNLS

SEQ ID NO: 2165079 - protein, 34 aa, Cryptosporidium hominis
TKQIPYSYSSNNNNNNSGSHTNSNSGSANLGQMQ

SEQ ID NO: 2165080 - protein, 4 aa, Cryptosporidium hominis
TKQK

SEQ ID NO: 2165081 - protein, 13 aa, Cryptosporidium hominis
TKQNGKATKRKQI

SEQ ID NO: 2165082 - protein, 7 aa, Cryptosporidium hominis
TKQTANE

SEQ ID NO: 2165083 - protein, 7 aa, Cryptosporidium hominis
TKQVENR

SEQ ID NO: 2165084 - protein, 8 aa, Cryptosporidium hominis
TKRRRDMR

SEQ ID NO: 2165085 - protein, 7 aa, Cryptosporidium hominis
TKRSDAI

SEQ ID NO: 2165086 - protein, 5 aa, Cryptosporidium hominis
TKRVN

SEQ ID NO: 2165087 - protein, 27 aa, Cryptosporidium hominis
TKSANSSNSSSGGNGNHGSDDDESIDD

SEQ ID NO: 2165088 - protein, 9 aa, Cryptosporidium hominis
TKSDNESAA

SEQ ID NO: 2165089 - protein, 16 aa, Cryptosporidium hominis
TKSEKRKKKKQKELEQ

SEQ ID NO: 2165090 - protein, 9 aa, Cryptosporidium hominis
TKSGESKGY

SEQ ID NO: 2165091 - protein, 6 aa, Cryptosporidium hominis
TKSGKT

SEQ ID NO: 2165092 - protein, 24 aa, Cryptosporidium hominis
TKSHKDSNKASEISFNENNENKRI

SEQ ID NO: 2165093 - protein, 25 aa, Cryptosporidium hominis
TKSIRNKRRKIEDSNSSYTNSENLN

SEQ ID NO: 2165094 - protein, 15 aa, Cryptosporidium hominis
TKSKCTEAKGSDERL

SEQ ID NO: 2165095 - protein, 22 aa, Cryptosporidium hominis
TKSKYKSSRSHEGELASTPVRS

SEQ ID NO: 2165096 - protein, 7 aa, Cryptosporidium hominis
TKSLPDT

SEQ ID NO: 2165097 - protein, 8 aa, Cryptosporidium hominis
TKSLTNSI

SEQ ID NO: 2165098 - protein, 5 aa, Cryptosporidium hominis
TKSMG

SEQ ID NO: 2165099 - protein, 7 aa, Cryptosporidium hominis
TKSNNSG

SEQ ID NO: 2165100 - protein, 6 aa, Cryptosporidium hominis
TKSNPF

SEQ ID NO: 2165101 - protein, 5 aa, Cryptosporidium hominis
TKSPK

SEQ ID NO: 2165102 - protein, 7 aa, Cryptosporidium hominis
TKSQPNA

SEQ ID NO: 2165103 - protein, 10 aa, Cryptosporidium hominis
TKSSAYQDGV

SEQ ID NO: 2165104 - protein, 7 aa, Cryptosporidium hominis
TKSSITN

SEQ ID NO: 2165105 - protein, 20 aa, Cryptosporidium hominis
TKSSSMPKSFTVNEDDGLFS

SEQ ID NO: 2165106 - protein, 9 aa, Cryptosporidium hominis
TKSTPEKLR

SEQ ID NO: 2165107 - protein, 4 aa, Cryptosporidium hominis
TKSV

SEQ ID NO: 2165108 - protein, 4 aa, Cryptosporidium hominis
TKTE

SEQ ID NO: 2165109 - protein, 5 aa, Cryptosporidium hominis
TKTIN

SEQ ID NO: 2165110 - protein, 9 aa, Cryptosporidium hominis
TKTLSENQN

SEQ ID NO: 2165111 - protein, 4 aa, Cryptosporidium hominis
TKTN

SEQ ID NO: 2165112 - protein, 9 aa, Cryptosporidium hominis
TKTNECDIT

SEQ ID NO: 2165113 - protein, 5 aa, Cryptosporidium hominis
TKTPQ

SEQ ID NO: 2165114 - protein, 8 aa, Cryptosporidium hominis
TKTPTPHA

SEQ ID NO: 2165115 - protein, 9 aa, Cryptosporidium hominis
TKTQSKINS

SEQ ID NO: 2165116 - protein, 17 aa, Cryptosporidium hominis
TKTRRNTTLPSNVQQKT

SEQ ID NO: 2165117 - protein, 8 aa, Cryptosporidium hominis
TKTSPPGV

SEQ ID NO: 2165118 - protein, 6 aa, Cryptosporidium hominis
TKTSSI

SEQ ID NO: 2165119 - protein, 17 aa, Cryptosporidium hominis
TKTSSLLSQNELPLRWY

SEQ ID NO: 2165120 - protein, 5 aa, Cryptosporidium hominis
TKTST

SEQ ID NO: 2165121 - protein, 17 aa, Cryptosporidium hominis
TKTSVDPENNIHLQVIS

SEQ ID NO: 2165122 - protein, 5 aa, Cryptosporidium hominis
TKTTF

SEQ ID NO: 2165123 - protein, 6 aa, Cryptosporidium hominis
TKTTKE

SEQ ID NO: 2165124 - protein, 13 aa, Cryptosporidium hominis
TKVDVSKADVSKF

SEQ ID NO: 2165125 - protein, 6 aa, Cryptosporidium hominis
TKVEKK

SEQ ID NO: 2165126 - protein, 15 aa, Cryptosporidium hominis
TKVSEDIDRAKEGNI

SEQ ID NO: 2165127 - protein, 5 aa, Cryptosporidium hominis
TKYCG

SEQ ID NO: 2165128 - protein, 7 aa, Cryptosporidium hominis
TKYNEKI

SEQ ID NO: 2165129 - protein, 34 aa, Cryptosporidium hominis
TKYQDTPSKKHNMKAHNTQKPSRLKRGFCSCTKV

SEQ ID NO: 2165130 - protein, 8 aa, Cryptosporidium hominis
TKYSDSQN

SEQ ID NO: 2165131 - protein, 15 aa, Cryptosporidium hominis
TKYSECPSNKDNGVN

SEQ ID NO: 2165132 - protein, 6 aa, Cryptosporidium hominis
TKYTKG

SEQ ID NO: 2165133 - protein, 11 aa, Cryptosporidium hominis
TLADSSSNTAI

SEQ ID NO: 2165134 - protein, 5 aa, Cryptosporidium hominis
TLASE

SEQ ID NO: 2165135 - protein, 82 aa, Cryptosporidium hominis
TLATEEKKGGDDNDATSQGIGISSAPSQVTNDSNGVAENSQPTKTKEESKETKGLSSQENTQLTEPKSDIDKADSNAITGPV

SEQ ID NO: 2165136 - protein, 5 aa, Cryptosporidium hominis
TLATN

SEQ ID NO: 2165137 - protein, 4 aa, Cryptosporidium hominis
TLDE

SEQ ID NO: 2165138 - protein, 5 aa, Cryptosporidium hominis
TLDEK

SEQ ID NO: 2165139 - protein, 72 aa, Cryptosporidium hominis
TLDPERSKKPQGSSDPQAKALREKQKQIDKETFGTSAVKPRTGSYNRGSHHRRGGGSHRGGYHGNNRFNKRE

SEQ ID NO: 2165140 - protein, 10 aa, Cryptosporidium hominis
TLDPSVDKSI

SEQ ID NO: 2165141 - protein, 9 aa, Cryptosporidium hominis
TLDSKDKCL

SEQ ID NO: 2165142 - protein, 8 aa, Cryptosporidium hominis
TLDTSNAR

SEQ ID NO: 2165143 - protein, 11 aa, Cryptosporidium hominis
TLEDENDEKNK

SEQ ID NO: 2165144 - protein, 8 aa, Cryptosporidium hominis
TLEEETEI

SEQ ID NO: 2165145 - protein, 6 aa, Cryptosporidium hominis
TLEGMT

SEQ ID NO: 2165146 - protein, 5 aa, Cryptosporidium hominis
TLEHT

SEQ ID NO: 2165147 - protein, 11 aa, Cryptosporidium hominis
TLESSSNETKE

SEQ ID NO: 2165148 - protein, 11 aa, Cryptosporidium hominis
TLGDPTKALSK

SEQ ID NO: 2165149 - protein, 5 aa, Cryptosporidium hominis
TLGEN

SEQ ID NO: 2165150 - protein, 17 aa, Cryptosporidium hominis
TLGGTKKTNDETDINSD

SEQ ID NO: 2165151 - protein, 8 aa, Cryptosporidium hominis
TLGKSSKL

SEQ ID NO: 2165152 - protein, 8 aa, Cryptosporidium hominis
TLGKSSQP

SEQ ID NO: 2165153 - protein, 4 aa, Cryptosporidium hominis
TLGP

SEQ ID NO: 2165154 - protein, 6 aa, Cryptosporidium hominis
TLGSRE

SEQ ID NO: 2165155 - protein, 6 aa, Cryptosporidium hominis
TLKEAV

SEQ ID NO: 2165156 - protein, 38 aa, Cryptosporidium hominis
TLKENQSIENSLSEFSDKKGVATQDDLNESSEGKSKIN

SEQ ID NO: 2165157 - protein, 5 aa, Cryptosporidium hominis
TLKGP

SEQ ID NO: 2165158 - protein, 11 aa, Cryptosporidium hominis
TLKKGSDPLDK

SEQ ID NO: 2165159 - protein, 11 aa, Cryptosporidium hominis
TLKKKDSEGYS

SEQ ID NO: 2165160 - protein, 12 aa, Cryptosporidium hominis
TLKNQSGGGEDE

SEQ ID NO: 2165161 - protein, 68 aa, Cryptosporidium hominis
TLKSNSPKNSTNQTGGSSKDNSDSNKTKDSKKSREKFNSLENSRSSKREASKKSDLDEKQKVKKPESS

SEQ ID NO: 2165162 - protein, 11 aa, Cryptosporidium hominis
TLNGEVPNDFR

SEQ ID NO: 2165163 - protein, 24 aa, Cryptosporidium hominis
TLNKKKKNKKKKDIKKGKHVTING

SEQ ID NO: 2165164 - protein, 15 aa, Cryptosporidium hominis
TLNKTNKPLRSSSIT

SEQ ID NO: 2165165 - protein, 7 aa, Cryptosporidium hominis
TLNNGSP

SEQ ID NO: 2165166 - protein, 8 aa, Cryptosporidium hominis
TLNNNVDD

SEQ ID NO: 2165167 - protein, 5 aa, Cryptosporidium hominis
TLNNP

SEQ ID NO: 2165168 - protein, 27 aa, Cryptosporidium hominis
TLNSEGVVGSGVGAGVGAGAGSGGVGA

SEQ ID NO: 2165169 - protein, 6 aa, Cryptosporidium hominis
TLPEIK

SEQ ID NO: 2165170 - protein, 9 aa, Cryptosporidium hominis
TLPEPHRTR

SEQ ID NO: 2165171 - protein, 5 aa, Cryptosporidium hominis
TLPNN

SEQ ID NO: 2165172 - protein, 5 aa, Cryptosporidium hominis
TLPPK

SEQ ID NO: 2165173 - protein, 5 aa, Cryptosporidium hominis
TLPRK

SEQ ID NO: 2165174 - protein, 9 aa, Cryptosporidium hominis
TLPSSSDKY

SEQ ID NO: 2165175 - protein, 11 aa, Cryptosporidium hominis
TLQEEKNNYNK

SEQ ID NO: 2165176 - protein, 24 aa, Cryptosporidium hominis
TLQNDLKSNSKTVTNKNKKRKLSQ

SEQ ID NO: 2165177 - protein, 9 aa, Cryptosporidium hominis
TLQSNEYSS

SEQ ID NO: 2165178 - protein, 4 aa, Cryptosporidium hominis
TLSD

SEQ ID NO: 2165179 - protein, 10 aa, Cryptosporidium hominis
TLSESTASDI

SEQ ID NO: 2165180 - protein, 15 aa, Cryptosporidium hominis
TLSETGNGVKSLPTN

SEQ ID NO: 2165181 - protein, 6 aa, Cryptosporidium hominis
TLSGLG

SEQ ID NO: 2165182 - protein, 9 aa, Cryptosporidium hominis
TLSNSRKEF

SEQ ID NO: 2165183 - protein, 5 aa, Cryptosporidium hominis
TLSPI

SEQ ID NO: 2165184 - protein, 29 aa, Cryptosporidium hominis
TLSQTTRSYSDSGAFESDSFESPMSPLSP

SEQ ID NO: 2165185 - protein, 4 aa, Cryptosporidium hominis
TLSR

SEQ ID NO: 2165186 - protein, 16 aa, Cryptosporidium hominis
TLSSMKDSSKKERSTW

SEQ ID NO: 2165187 - protein, 11 aa, Cryptosporidium hominis
TLSTPSTADYL

SEQ ID NO: 2165188 - protein, 5 aa, Cryptosporidium hominis
TLSTS

SEQ ID NO: 2165189 - protein, 4 aa, Cryptosporidium hominis
TLTN

SEQ ID NO: 2165190 - protein, 5 aa, Cryptosporidium hominis
TLTPL

SEQ ID NO: 2165191 - protein, 5 aa, Cryptosporidium hominis
TLTPS

SEQ ID NO: 2165192 - protein, 25 aa, Cryptosporidium hominis
TLTSSTSSMSQQAPGSSKSSVGIGG

SEQ ID NO: 2165193 - protein, 4 aa, Cryptosporidium hominis
TLTT

SEQ ID NO: 2165194 - protein, 13 aa, Cryptosporidium hominis
TLTTKERKKSRFG

SEQ ID NO: 2165195 - protein, 6 aa, Cryptosporidium hominis
TLTTPS

SEQ ID NO: 2165196 - protein, 5 aa, Cryptosporidium hominis
TLVNN

SEQ ID NO: 2165197 - protein, 17 aa, Cryptosporidium hominis
TMAPDTGARCERARSGF

SEQ ID NO: 2165198 - protein, 5 aa, Cryptosporidium hominis
TMDSE

SEQ ID NO: 2165199 - protein, 6 aa, Cryptosporidium hominis
TMDSSK

SEQ ID NO: 2165200 - protein, 13 aa, Cryptosporidium hominis
TMDSTQEDTPTCG

SEQ ID NO: 2165201 - protein, 7 aa, Cryptosporidium hominis
TMDTGGY

SEQ ID NO: 2165202 - protein, 11 aa, Cryptosporidium hominis
TMDTTSPTADK

SEQ ID NO: 2165203 - protein, 5 aa, Cryptosporidium hominis
TMEES

SEQ ID NO: 2165204 - protein, 10 aa, Cryptosporidium hominis
TMEKSNPDRV

SEQ ID NO: 2165205 - protein, 6 aa, Cryptosporidium hominis
TMGDED

SEQ ID NO: 2165206 - protein, 11 aa, Cryptosporidium hominis
TMGTERDSGPY

SEQ ID NO: 2165207 - protein, 21 aa, Cryptosporidium hominis
TMHSGSEKEVAQIPNAPNPNS

SEQ ID NO: 2165208 - protein, 4 aa, Cryptosporidium hominis
TMNE

SEQ ID NO: 2165209 - protein, 11 aa, Cryptosporidium hominis
TMNKDGEFKKA

SEQ ID NO: 2165210 - protein, 11 aa, Cryptosporidium hominis
TMNNPNSNLGA

SEQ ID NO: 2165211 - protein, 7 aa, Cryptosporidium hominis
TMNPPSQ

SEQ ID NO: 2165212 - protein, 17 aa, Cryptosporidium hominis
TMPTPRAHGSSTNLDNS

SEQ ID NO: 2165213 - protein, 5 aa, Cryptosporidium hominis
TMQGK

SEQ ID NO: 2165214 - protein, 9 aa, Cryptosporidium hominis
TMRDGKPVS

SEQ ID NO: 2165215 - protein, 4 aa, Cryptosporidium hominis
TMSP

SEQ ID NO: 2165216 - protein, 12 aa, Cryptosporidium hominis
TMTEDEKLALPL

SEQ ID NO: 2165217 - protein, 9 aa, Cryptosporidium hominis
TNAENPDVR

SEQ ID NO: 2165218 - protein, 10 aa, Cryptosporidium hominis
TNANTGGGLH

SEQ ID NO: 2165219 - protein, 8 aa, Cryptosporidium hominis
TNCEEEGR

SEQ ID NO: 2165220 - protein, 23 aa, Cryptosporidium hominis
TNCGEQQPKEEAGIESQNITSGT

SEQ ID NO: 2165221 - protein, 7 aa, Cryptosporidium hominis
TNCGGNS

SEQ ID NO: 2165222 - protein, 5 aa, Cryptosporidium hominis
TNCPR

SEQ ID NO: 2165223 - protein, 5 aa, Cryptosporidium hominis
TNCRN

SEQ ID NO: 2165224 - protein, 9 aa, Cryptosporidium hominis
TNCSKQSSV

SEQ ID NO: 2165225 - protein, 15 aa, Cryptosporidium hominis
TNCSPDENYISGREN

SEQ ID NO: 2165226 - protein, 9 aa, Cryptosporidium hominis
TNDDRNYKY

SEQ ID NO: 2165227 - protein, 4 aa, Cryptosporidium hominis
TNDE

SEQ ID NO: 2165228 - protein, 8 aa, Cryptosporidium hominis
TNDEKNKK

SEQ ID NO: 2165229 - protein, 5 aa, Cryptosporidium hominis
TNDFS

SEQ ID NO: 2165230 - protein, 10 aa, Cryptosporidium hominis
TNDGKDQTGI

SEQ ID NO: 2165231 - protein, 6 aa, Cryptosporidium hominis
TNDGMQ

SEQ ID NO: 2165232 - protein, 5 aa, Cryptosporidium hominis
TNDKL

SEQ ID NO: 2165233 - protein, 5 aa, Cryptosporidium hominis
TNDKV

SEQ ID NO: 2165234 - protein, 4 aa, Cryptosporidium hominis
TNDM

SEQ ID NO: 2165235 - protein, 9 aa, Cryptosporidium hominis
TNDNYNSMN

SEQ ID NO: 2165236 - protein, 7 aa, Cryptosporidium hominis
TNDSIDG

SEQ ID NO: 2165237 - protein, 10 aa, Cryptosporidium hominis
TNDSNNSTII

SEQ ID NO: 2165238 - protein, 8 aa, Cryptosporidium hominis
TNDTNNDI

SEQ ID NO: 2165239 - protein, 6 aa, Cryptosporidium hominis
TNDTTG

SEQ ID NO: 2165240 - protein, 7 aa, Cryptosporidium hominis
TNECNNE

SEQ ID NO: 2165241 - protein, 4 aa, Cryptosporidium hominis
TNED

SEQ ID NO: 2165242 - protein, 14 aa, Cryptosporidium hominis
TNEDSGKKTQPNDK

SEQ ID NO: 2165243 - protein, 27 aa, Cryptosporidium hominis
TNEDWENEQERERNERREGVSSKKGDI

SEQ ID NO: 2165244 - protein, 9 aa, Cryptosporidium hominis
TNEENDEEF

SEQ ID NO: 2165245 - protein, 6 aa, Cryptosporidium hominis
TNEESK

SEQ ID NO: 2165246 - protein, 10 aa, Cryptosporidium hominis
TNEGNQVQGK

SEQ ID NO: 2165247 - protein, 6 aa, Cryptosporidium hominis
TNEGSY

SEQ ID NO: 2165248 - protein, 19 aa, Cryptosporidium hominis
TNEISPSKCPKTSPPYPCR

SEQ ID NO: 2165249 - protein, 16 aa, Cryptosporidium hominis
TNEKNTREIISYTTSY

SEQ ID NO: 2165250 - protein, 9 aa, Cryptosporidium hominis
TNEKSNRIN

SEQ ID NO: 2165251 - protein, 6 aa, Cryptosporidium hominis
TNELSD

SEQ ID NO: 2165252 - protein, 6 aa, Cryptosporidium hominis
TNENDS

SEQ ID NO: 2165253 - protein, 9 aa, Cryptosporidium hominis
TNENNKNLE

SEQ ID NO: 2165254 - protein, 11 aa, Cryptosporidium hominis
TNENSNSALKQ

SEQ ID NO: 2165255 - protein, 5 aa, Cryptosporidium hominis
TNEPK

SEQ ID NO: 2165256 - protein, 14 aa, Cryptosporidium hominis
TNEPQVSENEISPE

SEQ ID NO: 2165257 - protein, 7 aa, Cryptosporidium hominis
TNEQNGI

SEQ ID NO: 2165258 - protein, 10 aa, Cryptosporidium hominis
TNESTGSISV

SEQ ID NO: 2165259 - protein, 4 aa, Cryptosporidium hominis
TNEV

SEQ ID NO: 2165260 - protein, 5 aa, Cryptosporidium hominis
TNEYN

SEQ ID NO: 2165261 - protein, 7 aa, Cryptosporidium hominis
TNEYSDR

SEQ ID NO: 2165262 - protein, 8 aa, Cryptosporidium hominis
TNFDKKDE

SEQ ID NO: 2165263 - protein, 7 aa, Cryptosporidium hominis
TNFGKDD

SEQ ID NO: 2165264 - protein, 6 aa, Cryptosporidium hominis
TNGDIS

SEQ ID NO: 2165265 - protein, 8 aa, Cryptosporidium hominis
TNGEISNT

SEQ ID NO: 2165266 - protein, 8 aa, Cryptosporidium hominis
TNGESNFD

SEQ ID NO: 2165267 - protein, 5 aa, Cryptosporidium hominis
TNGGM

SEQ ID NO: 2165268 - protein, 17 aa, Cryptosporidium hominis
TNGKEDTGELIDGNESY

SEQ ID NO: 2165269 - protein, 4 aa, Cryptosporidium hominis
TNGL

SEQ ID NO: 2165270 - protein, 11 aa, Cryptosporidium hominis
TNGSSIEGQNN

SEQ ID NO: 2165271 - protein, 6 aa, Cryptosporidium hominis
TNGTDS

SEQ ID NO: 2165272 - protein, 6 aa, Cryptosporidium hominis
TNGTTV

SEQ ID NO: 2165273 - protein, 7 aa, Cryptosporidium hominis
TNGTVNN

SEQ ID NO: 2165274 - protein, 10 aa, Cryptosporidium hominis
TNHDNKASYI

SEQ ID NO: 2165275 - protein, 4 aa, Cryptosporidium hominis
TNHF

SEQ ID NO: 2165276 - protein, 4 aa, Cryptosporidium hominis
TNHN

SEQ ID NO: 2165277 - protein, 8 aa, Cryptosporidium hominis
TNHSKYTL

SEQ ID NO: 2165278 - protein, 11 aa, Cryptosporidium hominis
TNHSPTKNPQV

SEQ ID NO: 2165279 - protein, 11 aa, Cryptosporidium hominis
TNIDESKSELK

SEQ ID NO: 2165280 - protein, 6 aa, Cryptosporidium hominis
TNIKGR

SEQ ID NO: 2165281 - protein, 10 aa, Cryptosporidium hominis
TNIKTKNADY

SEQ ID NO: 2165282 - protein, 22 aa, Cryptosporidium hominis
TNINSNNSRMKDQRTKLERFIG

SEQ ID NO: 2165283 - protein, 5 aa, Cryptosporidium hominis
TNINT

SEQ ID NO: 2165284 - protein, 8 aa, Cryptosporidium hominis
TNIRRNPT

SEQ ID NO: 2165285 - protein, 8 aa, Cryptosporidium hominis
TNISDDQI

SEQ ID NO: 2165286 - protein, 20 aa, Cryptosporidium hominis
TNISSNDNNNDENIESNKKD

SEQ ID NO: 2165287 - protein, 8 aa, Cryptosporidium hominis
TNKATSLT

SEQ ID NO: 2165288 - protein, 7 aa, Cryptosporidium hominis
TNKDGKV

SEQ ID NO: 2165289 - protein, 8 aa, Cryptosporidium hominis
TNKDHSRV

SEQ ID NO: 2165290 - protein, 11 aa, Cryptosporidium hominis
TNKDRIELETK

SEQ ID NO: 2165291 - protein, 7 aa, Cryptosporidium hominis
TNKEAEF

SEQ ID NO: 2165292 - protein, 5 aa, Cryptosporidium hominis
TNKET

SEQ ID NO: 2165293 - protein, 16 aa, Cryptosporidium hominis
TNKETTIESEKGNQDE

SEQ ID NO: 2165294 - protein, 5 aa, Cryptosporidium hominis
TNKEV

SEQ ID NO: 2165295 - protein, 9 aa, Cryptosporidium hominis
TNKGKTKDE

SEQ ID NO: 2165296 - protein, 4 aa, Cryptosporidium hominis
TNKK

SEQ ID NO: 2165297 - protein, 24 aa, Cryptosporidium hominis
TNKKNGKPKKKTQISSEKSKKLAS

SEQ ID NO: 2165298 - protein, 10 aa, Cryptosporidium hominis
TNKKNTSRSI

SEQ ID NO: 2165299 - protein, 8 aa, Cryptosporidium hominis
TNKKRKKD

SEQ ID NO: 2165300 - protein, 30 aa, Cryptosporidium hominis
TNKKSKGKKKGDKTGKGNTNSNKNDNNNKE

SEQ ID NO: 2165301 - protein, 6 aa, Cryptosporidium hominis
TNKNQG

SEQ ID NO: 2165302 - protein, 6 aa, Cryptosporidium hominis
TNKNRK

SEQ ID NO: 2165303 - protein, 12 aa, Cryptosporidium hominis
TNKNSLLNEKPQ

SEQ ID NO: 2165304 - protein, 13 aa, Cryptosporidium hominis
TNKQLDKSSSELS

SEQ ID NO: 2165305 - protein, 6 aa, Cryptosporidium hominis
TNKRAG

SEQ ID NO: 2165306 - protein, 19 aa, Cryptosporidium hominis
TNKRQISEEFTEKRDHEYD

SEQ ID NO: 2165307 - protein, 6 aa, Cryptosporidium hominis
TNLEDD

SEQ ID NO: 2165308 - protein, 6 aa, Cryptosporidium hominis
TNLEEP

SEQ ID NO: 2165309 - protein, 8 aa, Cryptosporidium hominis
TNLGENSK

SEQ ID NO: 2165310 - protein, 6 aa, Cryptosporidium hominis
TNLGNV

SEQ ID NO: 2165311 - protein, 9 aa, Cryptosporidium hominis
TNLKHESNA

SEQ ID NO: 2165312 - protein, 8 aa, Cryptosporidium hominis
TNLNNSSS

SEQ ID NO: 2165313 - protein, 7 aa, Cryptosporidium hominis
TNLPNPK

SEQ ID NO: 2165314 - protein, 12 aa, Cryptosporidium hominis
TNLRSESSAYKK

SEQ ID NO: 2165315 - protein, 9 aa, Cryptosporidium hominis
TNLSSEAQD

SEQ ID NO: 2165316 - protein, 24 aa, Cryptosporidium hominis
TNLSTSTTTSLFGSSSKPENNNTS

SEQ ID NO: 2165317 - protein, 4 aa, Cryptosporidium hominis
TNLT

SEQ ID NO: 2165318 - protein, 5 aa, Cryptosporidium hominis
TNLTH

SEQ ID NO: 2165319 - protein, 7 aa, Cryptosporidium hominis
TNNDFDD

SEQ ID NO: 2165320 - protein, 5 aa, Cryptosporidium hominis
TNNEL

SEQ ID NO: 2165321 - protein, 7 aa, Cryptosporidium hominis
TNNETKS

SEQ ID NO: 2165322 - protein, 5 aa, Cryptosporidium hominis
TNNFS

SEQ ID NO: 2165323 - protein, 13 aa, Cryptosporidium hominis
TNNKESNKKTSFS

SEQ ID NO: 2165324 - protein, 10 aa, Cryptosporidium hominis
TNNKRESTDR

SEQ ID NO: 2165325 - protein, 4 aa, Cryptosporidium hominis
TNNL

SEQ ID NO: 2165326 - protein, 13 aa, Cryptosporidium hominis
TNNNKYATTHGHP

SEQ ID NO: 2165327 - protein, 19 aa, Cryptosporidium hominis
TNNNRENGHVRTLRESGFC

SEQ ID NO: 2165328 - protein, 15 aa, Cryptosporidium hominis
TNNNYKAQSNHSVSR

SEQ ID NO: 2165329 - protein, 15 aa, Cryptosporidium hominis
TNNPSKTSSSSDEII

SEQ ID NO: 2165330 - protein, 5 aa, Cryptosporidium hominis
TNNQS

SEQ ID NO: 2165331 - protein, 7 aa, Cryptosporidium hominis
TNNQTKC

SEQ ID NO: 2165332 - protein, 8 aa, Cryptosporidium hominis
TNNRRNSQ

SEQ ID NO: 2165333 - protein, 9 aa, Cryptosporidium hominis
TNNSDIGDE

SEQ ID NO: 2165334 - protein, 14 aa, Cryptosporidium hominis
TNNSKDVKEGGSLV

SEQ ID NO: 2165335 - protein, 5 aa, Cryptosporidium hominis
TNNSN

SEQ ID NO: 2165336 - protein, 17 aa, Cryptosporidium hominis
TNNSNFGANTGNVGTNN

SEQ ID NO: 2165337 - protein, 17 aa, Cryptosporidium hominis
TNNTSVDDITVISCNIS

SEQ ID NO: 2165338 - protein, 4 aa, Cryptosporidium hominis
TNNV

SEQ ID NO: 2165339 - protein, 41 aa, Cryptosporidium hominis
TNNVSSSASSLSNSSISSSSPVSKTYSKSDILSSGSIGSGS

SEQ ID NO: 2165340 - protein, 4 aa, Cryptosporidium hominis
TNNY

SEQ ID NO: 2165341 - protein, 7 aa, Cryptosporidium hominis
TNPEETR

SEQ ID NO: 2165342 - protein, 7 aa, Cryptosporidium hominis
TNPFGGT

SEQ ID NO: 2165343 - protein, 5 aa, Cryptosporidium hominis
TNPKG

SEQ ID NO: 2165344 - protein, 6 aa, Cryptosporidium hominis
TNPKLD

SEQ ID NO: 2165345 - protein, 4 aa, Cryptosporidium hominis
TNPN

SEQ ID NO: 2165346 - protein, 7 aa, Cryptosporidium hominis
TNPNLKQ

SEQ ID NO: 2165347 - protein, 7 aa, Cryptosporidium hominis
TNPNNNI

SEQ ID NO: 2165348 - protein, 6 aa, Cryptosporidium hominis
TNPPAI

SEQ ID NO: 2165349 - protein, 7 aa, Cryptosporidium hominis
TNPPLFS

SEQ ID NO: 2165350 - protein, 6 aa, Cryptosporidium hominis
TNPPSF

SEQ ID NO: 2165351 - protein, 4 aa, Cryptosporidium hominis
TNPS

SEQ ID NO: 2165352 - protein, 7 aa, Cryptosporidium hominis
TNPSYGD

SEQ ID NO: 2165353 - protein, 10 aa, Cryptosporidium hominis
TNPTSLSASS

SEQ ID NO: 2165354 - protein, 5 aa, Cryptosporidium hominis
TNPTV

SEQ ID NO: 2165355 - protein, 7 aa, Cryptosporidium hominis
TNPVTTT

SEQ ID NO: 2165356 - protein, 8 aa, Cryptosporidium hominis
TNQDNAQK

SEQ ID NO: 2165357 - protein, 5 aa, Cryptosporidium hominis
TNQES

SEQ ID NO: 2165358 - protein, 9 aa, Cryptosporidium hominis
TNQESTKKT

SEQ ID NO: 2165359 - protein, 14 aa, Cryptosporidium hominis
TNQKNNKSNSLEDQ

SEQ ID NO: 2165360 - protein, 10 aa, Cryptosporidium hominis
TNQNLPGKNK

SEQ ID NO: 2165361 - protein, 13 aa, Cryptosporidium hominis
TNQNQESNTTAQR

SEQ ID NO: 2165362 - protein, 12 aa, Cryptosporidium hominis
TNQNSRAASSEI

SEQ ID NO: 2165363 - protein, 8 aa, Cryptosporidium hominis
TNQNTKKS

SEQ ID NO: 2165364 - protein, 4 aa, Cryptosporidium hominis
TNQP

SEQ ID NO: 2165365 - protein, 15 aa, Cryptosporidium hominis
TNQQNQTSNSGGTNI

SEQ ID NO: 2165366 - protein, 10 aa, Cryptosporidium hominis
TNQQRKERVQ

SEQ ID NO: 2165367 - protein, 8 aa, Cryptosporidium hominis
TNQSQLGS

SEQ ID NO: 2165368 - protein, 6 aa, Cryptosporidium hominis
TNQTCT

SEQ ID NO: 2165369 - protein, 7 aa, Cryptosporidium hominis
TNQVNDG

SEQ ID NO: 2165370 - protein, 11 aa, Cryptosporidium hominis
TNRKSKLSSNE

SEQ ID NO: 2165371 - protein, 7 aa, Cryptosporidium hominis
TNRPALG

SEQ ID NO: 2165372 - protein, 6 aa, Cryptosporidium hominis
TNRPDM

SEQ ID NO: 2165373 - protein, 8 aa, Cryptosporidium hominis
TNRPDTLD

SEQ ID NO: 2165374 - protein, 9 aa, Cryptosporidium hominis
TNRPNSIDP

SEQ ID NO: 2165375 - protein, 31 aa, Cryptosporidium hominis
TNRSSHQISDGAPNSSSFTNDQGIHETSGSM

SEQ ID NO: 2165376 - protein, 4 aa, Cryptosporidium hominis
TNSA

SEQ ID NO: 2165377 - protein, 9 aa, Cryptosporidium hominis
TNSARNGSS

SEQ ID NO: 2165378 - protein, 32 aa, Cryptosporidium hominis
TNSCGKSSARDDGKGSESSRPRKFQRQSSEER

SEQ ID NO: 2165379 - protein, 16 aa, Cryptosporidium hominis
TNSDCKTNHDLKNFVI

SEQ ID NO: 2165380 - protein, 8 aa, Cryptosporidium hominis
TNSDGERR

SEQ ID NO: 2165381 - protein, 9 aa, Cryptosporidium hominis
TNSEDSRFP

SEQ ID NO: 2165382 - protein, 7 aa, Cryptosporidium hominis
TNSEEFN

SEQ ID NO: 2165383 - protein, 9 aa, Cryptosporidium hominis
TNSELKDEI

SEQ ID NO: 2165384 - protein, 8 aa, Cryptosporidium hominis
TNSFNEDI

SEQ ID NO: 2165385 - protein, 15 aa, Cryptosporidium hominis
TNSGGNSSGNNGEIG

SEQ ID NO: 2165386 - protein, 7 aa, Cryptosporidium hominis
TNSGNYP

SEQ ID NO: 2165387 - protein, 12 aa, Cryptosporidium hominis
TNSIEQDYKTGA

SEQ ID NO: 2165388 - protein, 17 aa, Cryptosporidium hominis
TNSINNKSTNNNGANAN

SEQ ID NO: 2165389 - protein, 6 aa, Cryptosporidium hominis
TNSKNV

SEQ ID NO: 2165390 - protein, 14 aa, Cryptosporidium hominis
TNSKRTETEFDTNP

SEQ ID NO: 2165391 - protein, 6 aa, Cryptosporidium hominis
TNSNDK

SEQ ID NO: 2165392 - protein, 12 aa, Cryptosporidium hominis
TNSNENTPTNNL

SEQ ID NO: 2165393 - protein, 15 aa, Cryptosporidium hominis
TNSNNKGNLTCFLDW

SEQ ID NO: 2165394 - protein, 13 aa, Cryptosporidium hominis
TNSPNERKHPKGI

SEQ ID NO: 2165395 - protein, 13 aa, Cryptosporidium hominis
TNSPSSPRSPVIE

SEQ ID NO: 2165396 - protein, 4 aa, Cryptosporidium hominis
TNSQ

SEQ ID NO: 2165397 - protein, 5 aa, Cryptosporidium hominis
TNSRE

SEQ ID NO: 2165398 - protein, 12 aa, Cryptosporidium hominis
TNSRSNADSNNS

SEQ ID NO: 2165399 - protein, 4 aa, Cryptosporidium hominis
TNSS

SEQ ID NO: 2165400 - protein, 8 aa, Cryptosporidium hominis
TNSSEVTH

SEQ ID NO: 2165401 - protein, 7 aa, Cryptosporidium hominis
TNSSSKA

SEQ ID NO: 2165402 - protein, 19 aa, Cryptosporidium hominis
TNSTATVSSNDIGGLSVND

SEQ ID NO: 2165403 - protein, 10 aa, Cryptosporidium hominis
TNSTSDGLTS

SEQ ID NO: 2165404 - protein, 4 aa, Cryptosporidium hominis
TNSV

SEQ ID NO: 2165405 - protein, 6 aa, Cryptosporidium hominis
TNTAKF

SEQ ID NO: 2165406 - protein, 18 aa, Cryptosporidium hominis
TNTASSTNSSTKSKPNTN

SEQ ID NO: 2165407 - protein, 5 aa, Cryptosporidium hominis
TNTGG

SEQ ID NO: 2165408 - protein, 12 aa, Cryptosporidium hominis
TNTGKKSNQEIM

SEQ ID NO: 2165409 - protein, 6 aa, Cryptosporidium hominis
TNTGLE

SEQ ID NO: 2165410 - protein, 4 aa, Cryptosporidium hominis
TNTL

SEQ ID NO: 2165411 - protein, 13 aa, Cryptosporidium hominis
TNTNHQNNKLSGF

SEQ ID NO: 2165412 - protein, 10 aa, Cryptosporidium hominis
TNTNPDSSIS

SEQ ID NO: 2165413 - protein, 7 aa, Cryptosporidium hominis
TNTQGGC

SEQ ID NO: 2165414 - protein, 9 aa, Cryptosporidium hominis
TNTSNPNQM

SEQ ID NO: 2165415 - protein, 11 aa, Cryptosporidium hominis
TNTSQRRIPRG

SEQ ID NO: 2165416 - protein, 5 aa, Cryptosporidium hominis
TNTVK

SEQ ID NO: 2165417 - protein, 4 aa, Cryptosporidium hominis
TNVN

SEQ ID NO: 2165418 - protein, 11 aa, Cryptosporidium hominis
TNVQDSDSEVV

SEQ ID NO: 2165419 - protein, 5 aa, Cryptosporidium hominis
TNYEY

SEQ ID NO: 2165420 - protein, 12 aa, Cryptosporidium hominis
TNYQKGSSDKHS

SEQ ID NO: 2165421 - protein, 8 aa, Cryptosporidium hominis
TPAHDKND

SEQ ID NO: 2165422 - protein, 41 aa, Cryptosporidium hominis
TPAKSTSKIQTTPKKGDSPGKSMVKGETTKSGIKKEPSLGK

SEQ ID NO: 2165423 - protein, 9 aa, Cryptosporidium hominis
TPALNNPTE

SEQ ID NO: 2165424 - protein, 5 aa, Cryptosporidium hominis
TPARK

SEQ ID NO: 2165425 - protein, 12 aa, Cryptosporidium hominis
TPARPTSAYKTA

SEQ ID NO: 2165426 - protein, 12 aa, Cryptosporidium hominis
TPASKGNQFSTF

SEQ ID NO: 2165427 - protein, 23 aa, Cryptosporidium hominis
TPDEARALKSKGEIPETTKINES

SEQ ID NO: 2165428 - protein, 6 aa, Cryptosporidium hominis
TPDGEP

SEQ ID NO: 2165429 - protein, 11 aa, Cryptosporidium hominis
TPDLQSHGLND

SEQ ID NO: 2165430 - protein, 13 aa, Cryptosporidium hominis
TPDNSIANKSAQN

SEQ ID NO: 2165431 - protein, 11 aa, Cryptosporidium hominis
TPDPNNDDKVY

SEQ ID NO: 2165432 - protein, 5 aa, Cryptosporidium hominis
TPDSG

SEQ ID NO: 2165433 - protein, 7 aa, Cryptosporidium hominis
TPDTRSE

SEQ ID NO: 2165434 - protein, 4 aa, Cryptosporidium hominis
TPEA

SEQ ID NO: 2165435 - protein, 11 aa, Cryptosporidium hominis
TPEAINNKPSQ

SEQ ID NO: 2165436 - protein, 13 aa, Cryptosporidium hominis
TPEGSQLPEEKTG

SEQ ID NO: 2165437 - protein, 4 aa, Cryptosporidium hominis
TPEH

SEQ ID NO: 2165438 - protein, 6 aa, Cryptosporidium hominis
TPEIQP

SEQ ID NO: 2165439 - protein, 6 aa, Cryptosporidium hominis
TPEKEI

SEQ ID NO: 2165440 - protein, 7 aa, Cryptosporidium hominis
TPEMEKA

SEQ ID NO: 2165441 - protein, 39 aa, Cryptosporidium hominis
TPENRRSLSGASQDDSSSSSIASSSNVNRMESSYSTLNG

SEQ ID NO: 2165442 - protein, 8 aa, Cryptosporidium hominis
TPEQWEPA

SEQ ID NO: 2165443 - protein, 5 aa, Cryptosporidium hominis
TPERR

SEQ ID NO: 2165444 - protein, 11 aa, Cryptosporidium hominis
TPERTKQENII

SEQ ID NO: 2165445 - protein, 6 aa, Cryptosporidium hominis
TPFGNM

SEQ ID NO: 2165446 - protein, 11 aa, Cryptosporidium hominis
TPFNPRYATDD

SEQ ID NO: 2165447 - protein, 5 aa, Cryptosporidium hominis
TPFSK

SEQ ID NO: 2165448 - protein, 8 aa, Cryptosporidium hominis
TPFTKTST

SEQ ID NO: 2165449 - protein, 5 aa, Cryptosporidium hominis
TPGGV

SEQ ID NO: 2165450 - protein, 7 aa, Cryptosporidium hominis
TPGSTTL

SEQ ID NO: 2165451 - protein, 13 aa, Cryptosporidium hominis
TPGTGKTSLSKKL

SEQ ID NO: 2165452 - protein, 10 aa, Cryptosporidium hominis
TPHPNANVPG

SEQ ID NO: 2165453 - protein, 5 aa, Cryptosporidium hominis
TPHRD

SEQ ID NO: 2165454 - protein, 11 aa, Cryptosporidium hominis
TPHSPPENSEL

SEQ ID NO: 2165455 - protein, 11 aa, Cryptosporidium hominis
TPIDEKNSVQS

SEQ ID NO: 2165456 - protein, 5 aa, Cryptosporidium hominis
TPIEN

SEQ ID NO: 2165457 - protein, 36 aa, Cryptosporidium hominis
TPIETTKEKESQDLTTEPASSSASLSSPTEKPSIPG

SEQ ID NO: 2165458 - protein, 5 aa, Cryptosporidium hominis
TPIIT

SEQ ID NO: 2165459 - protein, 5 aa, Cryptosporidium hominis
TPINN

SEQ ID NO: 2165460 - protein, 21 aa, Cryptosporidium hominis
TPINNTNESPVTPSTGCETPL

SEQ ID NO: 2165461 - protein, 8 aa, Cryptosporidium hominis
TPIPESNN

SEQ ID NO: 2165462 - protein, 5 aa, Cryptosporidium hominis
TPIPG

SEQ ID NO: 2165463 - protein, 18 aa, Cryptosporidium hominis
TPIPTDSTRRKGGRRGRR

SEQ ID NO: 2165464 - protein, 4 aa, Cryptosporidium hominis
TPIQ

SEQ ID NO: 2165465 - protein, 22 aa, Cryptosporidium hominis
TPIRSSRRISSRTNYAKKEPNL

SEQ ID NO: 2165466 - protein, 8 aa, Cryptosporidium hominis
TPISNSIS

SEQ ID NO: 2165467 - protein, 12 aa, Cryptosporidium hominis
TPISQGVTNVDS

SEQ ID NO: 2165468 - protein, 8 aa, Cryptosporidium hominis
TPKDESNI

SEQ ID NO: 2165469 - protein, 7 aa, Cryptosporidium hominis
TPKDPNS

SEQ ID NO: 2165470 - protein, 14 aa, Cryptosporidium hominis
TPKERQKKRIGWND

SEQ ID NO: 2165471 - protein, 4 aa, Cryptosporidium hominis
TPKH

SEQ ID NO: 2165472 - protein, 8 aa, Cryptosporidium hominis
TPKNPENT

SEQ ID NO: 2165473 - protein, 4 aa, Cryptosporidium hominis
TPKQ

SEQ ID NO: 2165474 - protein, 11 aa, Cryptosporidium hominis
TPKREGSNREM

SEQ ID NO: 2165475 - protein, 8 aa, Cryptosporidium hominis
TPKRKTPV

SEQ ID NO: 2165476 - protein, 5 aa, Cryptosporidium hominis
TPKSV

SEQ ID NO: 2165477 - protein, 6 aa, Cryptosporidium hominis
TPKYNY

SEQ ID NO: 2165478 - protein, 9 aa, Cryptosporidium hominis
TPLEQGGIG

SEQ ID NO: 2165479 - protein, 14 aa, Cryptosporidium hominis
TPLGREGKFAKPRQ

SEQ ID NO: 2165480 - protein, 12 aa, Cryptosporidium hominis
TPLPAPPSPRYT

SEQ ID NO: 2165481 - protein, 4 aa, Cryptosporidium hominis
TPLQ

SEQ ID NO: 2165482 - protein, 13 aa, Cryptosporidium hominis
TPLQGKDTNFDDA

SEQ ID NO: 2165483 - protein, 6 aa, Cryptosporidium hominis
TPLQNR

SEQ ID NO: 2165484 - protein, 6 aa, Cryptosporidium hominis
TPLQNS

SEQ ID NO: 2165485 - protein, 5 aa, Cryptosporidium hominis
TPMDT

SEQ ID NO: 2165486 - protein, 8 aa, Cryptosporidium hominis
TPMSPRTA

SEQ ID NO: 2165487 - protein, 9 aa, Cryptosporidium hominis
TPNASQQFS

SEQ ID NO: 2165488 - protein, 10 aa, Cryptosporidium hominis
TPNEDNWPQA

SEQ ID NO: 2165489 - protein, 4 aa, Cryptosporidium hominis
TPNF

SEQ ID NO: 2165490 - protein, 9 aa, Cryptosporidium hominis
TPNGTLDNR

SEQ ID NO: 2165491 - protein, 8 aa, Cryptosporidium hominis
TPNNLSAN

SEQ ID NO: 2165492 - protein, 43 aa, Cryptosporidium hominis
TPNPATQEPKPSEDATAEGGNASGDERYYPEEELTEGNWNTPQ

SEQ ID NO: 2165493 - protein, 8 aa, Cryptosporidium hominis
TPNPREWP

SEQ ID NO: 2165494 - protein, 7 aa, Cryptosporidium hominis
TPNSGSN

SEQ ID NO: 2165495 - protein, 9 aa, Cryptosporidium hominis
TPNSSAIPN

SEQ ID NO: 2165496 - protein, 13 aa, Cryptosporidium hominis
TPNVQEDIKQGEG

SEQ ID NO: 2165497 - protein, 12 aa, Cryptosporidium hominis
TPPDNKSSKHNK

SEQ ID NO: 2165498 - protein, 7 aa, Cryptosporidium hominis
TPPDSPI

SEQ ID NO: 2165499 - protein, 8 aa, Cryptosporidium hominis
TPPESEIR

SEQ ID NO: 2165500 - protein, 6 aa, Cryptosporidium hominis
TPPFYG

SEQ ID NO: 2165501 - protein, 5 aa, Cryptosporidium hominis
TPPGK

SEQ ID NO: 2165502 - protein, 9 aa, Cryptosporidium hominis
TPPGTPSYS

SEQ ID NO: 2165503 - protein, 9 aa, Cryptosporidium hominis
TPPLKPNTH

SEQ ID NO: 2165504 - protein, 8 aa, Cryptosporidium hominis
TPPPFTGL

SEQ ID NO: 2165505 - protein, 8 aa, Cryptosporidium hominis
TPPPIPPS

SEQ ID NO: 2165506 - protein, 10 aa, Cryptosporidium hominis
TPPPLSPSKG

SEQ ID NO: 2165507 - protein, 22 aa, Cryptosporidium hominis
TPPPNRKGRYSVASSYGTNNPK

SEQ ID NO: 2165508 - protein, 6 aa, Cryptosporidium hominis
TPPQIP

SEQ ID NO: 2165509 - protein, 8 aa, Cryptosporidium hominis
TPPQTPNN

SEQ ID NO: 2165510 - protein, 9 aa, Cryptosporidium hominis
TPPSNTKNI

SEQ ID NO: 2165511 - protein, 9 aa, Cryptosporidium hominis
TPQEAESVE

SEQ ID NO: 2165512 - protein, 6 aa, Cryptosporidium hominis
TPQESI

SEQ ID NO: 2165513 - protein, 55 aa, Cryptosporidium hominis
TPQIATQSIQRPKHMTTSDLPQLEKKPSNSNYSSSTSADSKDMNNSVEKSEGPHF

SEQ ID NO: 2165514 - protein, 7 aa, Cryptosporidium hominis
TPQNPTK

SEQ ID NO: 2165515 - protein, 11 aa, Cryptosporidium hominis
TPQNTKISEES

SEQ ID NO: 2165516 - protein, 12 aa, Cryptosporidium hominis
TPQNVSLETKQY

SEQ ID NO: 2165517 - protein, 5 aa, Cryptosporidium hominis
TPQYP

SEQ ID NO: 2165518 - protein, 8 aa, Cryptosporidium hominis
TPRASSNG

SEQ ID NO: 2165519 - protein, 9 aa, Cryptosporidium hominis
TPRGLTASN

SEQ ID NO: 2165520 - protein, 4 aa, Cryptosporidium hominis
TPRL

SEQ ID NO: 2165521 - protein, 4 aa, Cryptosporidium hominis
TPRM

SEQ ID NO: 2165522 - protein, 8 aa, Cryptosporidium hominis
TPRNGEPL

SEQ ID NO: 2165523 - protein, 4 aa, Cryptosporidium hominis
TPRS

SEQ ID NO: 2165524 - protein, 6 aa, Cryptosporidium hominis
TPRSDE

SEQ ID NO: 2165525 - protein, 12 aa, Cryptosporidium hominis
TPRSPMSPVSPG

SEQ ID NO: 2165526 - protein, 6 aa, Cryptosporidium hominis
TPRTNN

SEQ ID NO: 2165527 - protein, 14 aa, Cryptosporidium hominis
TPSEMTDGGQTNTT

SEQ ID NO: 2165528 - protein, 4 aa, Cryptosporidium hominis
TPSF

SEQ ID NO: 2165529 - protein, 6 aa, Cryptosporidium hominis
TPSGSI

SEQ ID NO: 2165530 - protein, 13 aa, Cryptosporidium hominis
TPSGSTAYSMSAG

SEQ ID NO: 2165531 - protein, 8 aa, Cryptosporidium hominis
TPSGTAYI

SEQ ID NO: 2165532 - protein, 4 aa, Cryptosporidium hominis
TPSH

SEQ ID NO: 2165533 - protein, 5 aa, Cryptosporidium hominis
TPSKE

SEQ ID NO: 2165534 - protein, 13 aa, Cryptosporidium hominis
TPSNQHNNKPSDY

SEQ ID NO: 2165535 - protein, 9 aa, Cryptosporidium hominis
TPSPNPLAN

SEQ ID NO: 2165536 - protein, 7 aa, Cryptosporidium hominis
TPSRDDL

SEQ ID NO: 2165537 - protein, 5 aa, Cryptosporidium hominis
TPSRE

SEQ ID NO: 2165538 - protein, 5 aa, Cryptosporidium hominis
TPSRK

SEQ ID NO: 2165539 - protein, 6 aa, Cryptosporidium hominis
TPSSNL

SEQ ID NO: 2165540 - protein, 7 aa, Cryptosporidium hominis
TPSSPIK

SEQ ID NO: 2165541 - protein, 42 aa, Cryptosporidium hominis
TPSSVSLSKSNIKSARANGSTTAGISTNCESGFEQSSGKTAF

SEQ ID NO: 2165542 - protein, 4 aa, Cryptosporidium hominis
TPST

SEQ ID NO: 2165543 - protein, 5 aa, Cryptosporidium hominis
TPSTI

SEQ ID NO: 2165544 - protein, 4 aa, Cryptosporidium hominis
TPSV

SEQ ID NO: 2165545 - protein, 4 aa, Cryptosporidium hominis
TPSY

SEQ ID NO: 2165546 - protein, 5 aa, Cryptosporidium hominis
TPTDN

SEQ ID NO: 2165547 - protein, 9 aa, Cryptosporidium hominis
TPTEESWPE

SEQ ID NO: 2165548 - protein, 5 aa, Cryptosporidium hominis
TPTKE

SEQ ID NO: 2165549 - protein, 6 aa, Cryptosporidium hominis
TPTKEK

SEQ ID NO: 2165550 - protein, 16 aa, Cryptosporidium hominis
TPTKTYGRNKGEAPDL

SEQ ID NO: 2165551 - protein, 5 aa, Cryptosporidium hominis
TPTNL

SEQ ID NO: 2165552 - protein, 7 aa, Cryptosporidium hominis
TPTPNTV

SEQ ID NO: 2165553 - protein, 4 aa, Cryptosporidium hominis
TPTQ

SEQ ID NO: 2165554 - protein, 7 aa, Cryptosporidium hominis
TPTSDLS

SEQ ID NO: 2165555 - protein, 6 aa, Cryptosporidium hominis
TPTSKD

SEQ ID NO: 2165556 - protein, 7 aa, Cryptosporidium hominis
TPTSPIY

SEQ ID NO: 2165557 - protein, 6 aa, Cryptosporidium hominis
TPTTED

SEQ ID NO: 2165558 - protein, 8 aa, Cryptosporidium hominis
TPVQNNTE

SEQ ID NO: 2165559 - protein, 17 aa, Cryptosporidium hominis
TPVRGKKSQSQDFDEKD

SEQ ID NO: 2165560 - protein, 26 aa, Cryptosporidium hominis
TPVSNINSNKISSSQDMSSSNQVQSS

SEQ ID NO: 2165561 - protein, 5 aa, Cryptosporidium hominis
TPYGS

SEQ ID NO: 2165562 - protein, 4 aa, Cryptosporidium hominis
TQAE

SEQ ID NO: 2165563 - protein, 4 aa, Cryptosporidium hominis
TQAG

SEQ ID NO: 2165564 - protein, 4 aa, Cryptosporidium hominis
TQAK

SEQ ID NO: 2165565 - protein, 10 aa, Cryptosporidium hominis
TQAKQKQQSW

SEQ ID NO: 2165566 - protein, 6 aa, Cryptosporidium hominis
TQCKRD

SEQ ID NO: 2165567 - protein, 8 aa, Cryptosporidium hominis
TQDEITTR

SEQ ID NO: 2165568 - protein, 15 aa, Cryptosporidium hominis
TQDFGNSNEKKSKLF

SEQ ID NO: 2165569 - protein, 5 aa, Cryptosporidium hominis
TQDHA

SEQ ID NO: 2165570 - protein, 5 aa, Cryptosporidium hominis
TQDHF

SEQ ID NO: 2165571 - protein, 12 aa, Cryptosporidium hominis
TQDNNAAGEEYN

SEQ ID NO: 2165572 - protein, 11 aa, Cryptosporidium hominis
TQDSELKDSPF

SEQ ID NO: 2165573 - protein, 4 aa, Cryptosporidium hominis
TQEC

SEQ ID NO: 2165574 - protein, 5 aa, Cryptosporidium hominis
TQECG

SEQ ID NO: 2165575 - protein, 7 aa, Cryptosporidium hominis
TQEEGRK

SEQ ID NO: 2165576 - protein, 19 aa, Cryptosporidium hominis
TQEENKKGIQTNNENDNTI

SEQ ID NO: 2165577 - protein, 21 aa, Cryptosporidium hominis
TQEGDVSEPNENIQKRKQSCS

SEQ ID NO: 2165578 - protein, 100 aa, Cryptosporidium hominis
TQEGEGGRAGGGMEKGEHSCRGGHSSRGGHSGRGGHSGRGGHSSRGGHSGGRGGNSGREGNSGRGHSSRGHSSRGGGHSTRGGGKKGRGNGKSNHENSTK

SEQ ID NO: 2165579 - protein, 5 aa, Cryptosporidium hominis
TQEQR

SEQ ID NO: 2165580 - protein, 4 aa, Cryptosporidium hominis
TQES

SEQ ID NO: 2165581 - protein, 13 aa, Cryptosporidium hominis
TQESDYSKNDIDK

SEQ ID NO: 2165582 - protein, 9 aa, Cryptosporidium hominis
TQESSNEKS

SEQ ID NO: 2165583 - protein, 5 aa, Cryptosporidium hominis
TQFPD

SEQ ID NO: 2165584 - protein, 6 aa, Cryptosporidium hominis
TQFPNT

SEQ ID NO: 2165585 - protein, 9 aa, Cryptosporidium hominis
TQGFESSTK

SEQ ID NO: 2165586 - protein, 6 aa, Cryptosporidium hominis
TQGGFS

SEQ ID NO: 2165587 - protein, 8 aa, Cryptosporidium hominis
TQGQGERG

SEQ ID NO: 2165588 - protein, 6 aa, Cryptosporidium hominis
TQHPTY

SEQ ID NO: 2165589 - protein, 6 aa, Cryptosporidium hominis
TQHSCS

SEQ ID NO: 2165590 - protein, 8 aa, Cryptosporidium hominis
TQISTDNP

SEQ ID NO: 2165591 - protein, 7 aa, Cryptosporidium hominis
TQKDKEE

SEQ ID NO: 2165592 - protein, 4 aa, Cryptosporidium hominis
TQKM

SEQ ID NO: 2165593 - protein, 16 aa, Cryptosporidium hominis
TQKSNYDSDLNQSEKS

SEQ ID NO: 2165594 - protein, 8 aa, Cryptosporidium hominis
TQLENELD

SEQ ID NO: 2165595 - protein, 8 aa, Cryptosporidium hominis
TQLETQKG

SEQ ID NO: 2165596 - protein, 6 aa, Cryptosporidium hominis
TQLNDD

SEQ ID NO: 2165597 - protein, 8 aa, Cryptosporidium hominis
TQLPEETR

SEQ ID NO: 2165598 - protein, 6 aa, Cryptosporidium hominis
TQLQPG

SEQ ID NO: 2165599 - protein, 9 aa, Cryptosporidium hominis
TQLTNSKEK

SEQ ID NO: 2165600 - protein, 5 aa, Cryptosporidium hominis
TQLTT

SEQ ID NO: 2165601 - protein, 13 aa, Cryptosporidium hominis
TQMSGRAGRRGID

SEQ ID NO: 2165602 - protein, 7 aa, Cryptosporidium hominis
TQNCNSP

SEQ ID NO: 2165603 - protein, 9 aa, Cryptosporidium hominis
TQNDESNII

SEQ ID NO: 2165604 - protein, 22 aa, Cryptosporidium hominis
TQNEKQDNIEIEKKENNYYTTD

SEQ ID NO: 2165605 - protein, 8 aa, Cryptosporidium hominis
TQNKDENN

SEQ ID NO: 2165606 - protein, 9 aa, Cryptosporidium hominis
TQNKKHTEE

SEQ ID NO: 2165607 - protein, 13 aa, Cryptosporidium hominis
TQNNSSHVSQGNN

SEQ ID NO: 2165608 - protein, 13 aa, Cryptosporidium hominis
TQNQEYDNDNSNW

SEQ ID NO: 2165609 - protein, 5 aa, Cryptosporidium hominis
TQNRR

SEQ ID NO: 2165610 - protein, 4 aa, Cryptosporidium hominis
TQNS

SEQ ID NO: 2165611 - protein, 8 aa, Cryptosporidium hominis
TQNSGNEN

SEQ ID NO: 2165612 - protein, 20 aa, Cryptosporidium hominis
TQNSISKRSRPLISTPPDMN

SEQ ID NO: 2165613 - protein, 9 aa, Cryptosporidium hominis
TQNSLGRPE

SEQ ID NO: 2165614 - protein, 4 aa, Cryptosporidium hominis
TQNT

SEQ ID NO: 2165615 - protein, 6 aa, Cryptosporidium hominis
TQPDLE

SEQ ID NO: 2165616 - protein, 4 aa, Cryptosporidium hominis
TQPR

SEQ ID NO: 2165617 - protein, 26 aa, Cryptosporidium hominis
TQPSKRNLVETEEVKRESLTKPMDLN

SEQ ID NO: 2165618 - protein, 5 aa, Cryptosporidium hominis
TQPSN

SEQ ID NO: 2165619 - protein, 20 aa, Cryptosporidium hominis
TQPSQMSQQTQLQSSQPHKQ

SEQ ID NO: 2165620 - protein, 13 aa, Cryptosporidium hominis
TQPVHGGDSGNYN

SEQ ID NO: 2165621 - protein, 7 aa, Cryptosporidium hominis
TQQDENI

SEQ ID NO: 2165622 - protein, 12 aa, Cryptosporidium hominis
TQQEREKQQVGY

SEQ ID NO: 2165623 - protein, 4 aa, Cryptosporidium hominis
TQQG

SEQ ID NO: 2165624 - protein, 4 aa, Cryptosporidium hominis
TQQN

SEQ ID NO: 2165625 - protein, 9 aa, Cryptosporidium hominis
TQQSYGNSN

SEQ ID NO: 2165626 - protein, 13 aa, Cryptosporidium hominis
TQRLNNKQDAYSI

SEQ ID NO: 2165627 - protein, 4 aa, Cryptosporidium hominis
TQRS

SEQ ID NO: 2165628 - protein, 10 aa, Cryptosporidium hominis
TQSDKNGRVS

SEQ ID NO: 2165629 - protein, 4 aa, Cryptosporidium hominis
TQSE

SEQ ID NO: 2165630 - protein, 11 aa, Cryptosporidium hominis
TQSFSNPPSAL

SEQ ID NO: 2165631 - protein, 8 aa, Cryptosporidium hominis
TQSGGEGF

SEQ ID NO: 2165632 - protein, 7 aa, Cryptosporidium hominis
TQSGGVR

SEQ ID NO: 2165633 - protein, 12 aa, Cryptosporidium hominis
TQSLKDKNDNHN

SEQ ID NO: 2165634 - protein, 10 aa, Cryptosporidium hominis
TQSSLGGPKG

SEQ ID NO: 2165635 - protein, 11 aa, Cryptosporidium hominis
TQSSNNQNSGI

SEQ ID NO: 2165636 - protein, 6 aa, Cryptosporidium hominis
TQTGGV

SEQ ID NO: 2165637 - protein, 10 aa, Cryptosporidium hominis
TQTNSGEKMD

SEQ ID NO: 2165638 - protein, 4 aa, Cryptosporidium hominis
TQTS

SEQ ID NO: 2165639 - protein, 5 aa, Cryptosporidium hominis
TQTYW

SEQ ID NO: 2165640 - protein, 10 aa, Cryptosporidium hominis
TQVEKQGGIG

SEQ ID NO: 2165641 - protein, 5 aa, Cryptosporidium hominis
TQVNE

SEQ ID NO: 2165642 - protein, 11 aa, Cryptosporidium hominis
TQYNDGPVNSE

SEQ ID NO: 2165643 - protein, 18 aa, Cryptosporidium hominis
TRAISSKSKPTSVCEEEE

SEQ ID NO: 2165644 - protein, 6 aa, Cryptosporidium hominis
TRDEEY

SEQ ID NO: 2165645 - protein, 9 aa, Cryptosporidium hominis
TRDEQNPRS

SEQ ID NO: 2165646 - protein, 11 aa, Cryptosporidium hominis
TRDPTPPKSSC

SEQ ID NO: 2165647 - protein, 17 aa, Cryptosporidium hominis
TREDDGIATQPSKQESK

SEQ ID NO: 2165648 - protein, 10 aa, Cryptosporidium hominis
TREIKNSCDN

SEQ ID NO: 2165649 - protein, 4 aa, Cryptosporidium hominis
TREL

SEQ ID NO: 2165650 - protein, 18 aa, Cryptosporidium hominis
TRELTNGNCTYSQTKLEE

SEQ ID NO: 2165651 - protein, 5 aa, Cryptosporidium hominis
TRESG

SEQ ID NO: 2165652 - protein, 5 aa, Cryptosporidium hominis
TREYA

SEQ ID NO: 2165653 - protein, 25 aa, Cryptosporidium hominis
TRFTEARGGDCGNRENLINKLIDRM

SEQ ID NO: 2165654 - protein, 5 aa, Cryptosporidium hominis
TRGCR

SEQ ID NO: 2165655 - protein, 27 aa, Cryptosporidium hominis
TRGETSGNNNSNRSFGNNSRSNNGNSS

SEQ ID NO: 2165656 - protein, 6 aa, Cryptosporidium hominis
TRGGPV

SEQ ID NO: 2165657 - protein, 8 aa, Cryptosporidium hominis
TRGRRENT

SEQ ID NO: 2165658 - protein, 9 aa, Cryptosporidium hominis
TRGSGLSLS

SEQ ID NO: 2165659 - protein, 6 aa, Cryptosporidium hominis
TRGTKE

SEQ ID NO: 2165660 - protein, 7 aa, Cryptosporidium hominis
TRGVGGG

SEQ ID NO: 2165661 - protein, 4 aa, Cryptosporidium hominis
TRGY

SEQ ID NO: 2165662 - protein, 6 aa, Cryptosporidium hominis
TRHANG

SEQ ID NO: 2165663 - protein, 4 aa, Cryptosporidium hominis
TRHD

SEQ ID NO: 2165664 - protein, 9 aa, Cryptosporidium hominis
TRINNKQKQ

SEQ ID NO: 2165665 - protein, 5 aa, Cryptosporidium hominis
TRISN

SEQ ID NO: 2165666 - protein, 10 aa, Cryptosporidium hominis
TRKDFKDTPC

SEQ ID NO: 2165667 - protein, 7 aa, Cryptosporidium hominis
TRKEPSI

SEQ ID NO: 2165668 - protein, 27 aa, Cryptosporidium hominis
TRKGDSGNNNNINNNNNNNNNSNTSEF

SEQ ID NO: 2165669 - protein, 8 aa, Cryptosporidium hominis
TRKGYEPV

SEQ ID NO: 2165670 - protein, 10 aa, Cryptosporidium hominis
TRKKTNGESV

SEQ ID NO: 2165671 - protein, 7 aa, Cryptosporidium hominis
TRKPPKL

SEQ ID NO: 2165672 - protein, 9 aa, Cryptosporidium hominis
TRKSESLEN

SEQ ID NO: 2165673 - protein, 13 aa, Cryptosporidium hominis
TRKSPCGEGSKTW

SEQ ID NO: 2165674 - protein, 13 aa, Cryptosporidium hominis
TRLAPQEIKPQGR

SEQ ID NO: 2165675 - protein, 6 aa, Cryptosporidium hominis
TRNDTI

SEQ ID NO: 2165676 - protein, 4 aa, Cryptosporidium hominis
TRNL

SEQ ID NO: 2165677 - protein, 15 aa, Cryptosporidium hominis
TRNNSNDRSNKQVQD

SEQ ID NO: 2165678 - protein, 10 aa, Cryptosporidium hominis
TRNNSSISKF

SEQ ID NO: 2165679 - protein, 13 aa, Cryptosporidium hominis
TRNRSTGAEVPQK

SEQ ID NO: 2165680 - protein, 6 aa, Cryptosporidium hominis
TRNSRF

SEQ ID NO: 2165681 - protein, 7 aa, Cryptosporidium hominis
TRNSTGS

SEQ ID NO: 2165682 - protein, 4 aa, Cryptosporidium hominis
TRNT

SEQ ID NO: 2165683 - protein, 17 aa, Cryptosporidium hominis
TRPPGEVSKVGEDGHEE

SEQ ID NO: 2165684 - protein, 5 aa, Cryptosporidium hominis
TRPRE

SEQ ID NO: 2165685 - protein, 5 aa, Cryptosporidium hominis
TRPRI

SEQ ID NO: 2165686 - protein, 6 aa, Cryptosporidium hominis
TRPSSK

SEQ ID NO: 2165687 - protein, 13 aa, Cryptosporidium hominis
TRPYGPGEKLPPH

SEQ ID NO: 2165688 - protein, 7 aa, Cryptosporidium hominis
TRQRGNP

SEQ ID NO: 2165689 - protein, 6 aa, Cryptosporidium hominis
TRQYRS

SEQ ID NO: 2165690 - protein, 7 aa, Cryptosporidium hominis
TRRANEN

SEQ ID NO: 2165691 - protein, 4 aa, Cryptosporidium hominis
TRRF

SEQ ID NO: 2165692 - protein, 9 aa, Cryptosporidium hominis
TRRNESANA

SEQ ID NO: 2165693 - protein, 8 aa, Cryptosporidium hominis
TRRPRDAM

SEQ ID NO: 2165694 - protein, 7 aa, Cryptosporidium hominis
TRRQHRG

SEQ ID NO: 2165695 - protein, 11 aa, Cryptosporidium hominis
TRRRARGETPM

SEQ ID NO: 2165696 - protein, 14 aa, Cryptosporidium hominis
TRRRRRDKPTNMKD

SEQ ID NO: 2165697 - protein, 8 aa, Cryptosporidium hominis
TRSADEPM

SEQ ID NO: 2165698 - protein, 12 aa, Cryptosporidium hominis
TRSDSNSSSKVS

SEQ ID NO: 2165699 - protein, 6 aa, Cryptosporidium hominis
TRSDWD

SEQ ID NO: 2165700 - protein, 10 aa, Cryptosporidium hominis
TRSEENNPTN

SEQ ID NO: 2165701 - protein, 9 aa, Cryptosporidium hominis
TRSEIAGRN

SEQ ID NO: 2165702 - protein, 13 aa, Cryptosporidium hominis
TRSESYDDKRNES

SEQ ID NO: 2165703 - protein, 7 aa, Cryptosporidium hominis
TRSIDKG

SEQ ID NO: 2165704 - protein, 4 aa, Cryptosporidium hominis
TRSL

SEQ ID NO: 2165705 - protein, 8 aa, Cryptosporidium hominis
TRSPHRPV

SEQ ID NO: 2165706 - protein, 27 aa, Cryptosporidium hominis
TRSPKSSKGSRSSKPSSILPGSRHRSS

SEQ ID NO: 2165707 - protein, 9 aa, Cryptosporidium hominis
TRSPTARDV

SEQ ID NO: 2165708 - protein, 4 aa, Cryptosporidium hominis
TRSQ

SEQ ID NO: 2165709 - protein, 45 aa, Cryptosporidium hominis
TRSSRTGRSTRSSGTNTRSTRSNSSLRPNRERRPSSHNTEPNLTT

SEQ ID NO: 2165710 - protein, 8 aa, Cryptosporidium hominis
TRSSYDIN

SEQ ID NO: 2165711 - protein, 12 aa, Cryptosporidium hominis
TRSVSGPEVEGR

SEQ ID NO: 2165712 - protein, 15 aa, Cryptosporidium hominis
TRTGVSDRIKTDEEI

SEQ ID NO: 2165713 - protein, 8 aa, Cryptosporidium hominis
TRTKVGAR

SEQ ID NO: 2165714 - protein, 8 aa, Cryptosporidium hominis
TRTNENTV

SEQ ID NO: 2165715 - protein, 6 aa, Cryptosporidium hominis
TRTSAD

SEQ ID NO: 2165716 - protein, 5 aa, Cryptosporidium hominis
TRTSR

SEQ ID NO: 2165717 - protein, 7 aa, Cryptosporidium hominis
TRTTSGN

SEQ ID NO: 2165718 - protein, 5 aa, Cryptosporidium hominis
TRVEN

SEQ ID NO: 2165719 - protein, 9 aa, Cryptosporidium hominis
TRYNSSENC

SEQ ID NO: 2165720 - protein, 5 aa, Cryptosporidium hominis
TRYPE

SEQ ID NO: 2165721 - protein, 7 aa, Cryptosporidium hominis
TRYSPYQ

SEQ ID NO: 2165722 - protein, 6 aa, Cryptosporidium hominis
TSADKL

SEQ ID NO: 2165723 - protein, 8 aa, Cryptosporidium hominis
TSAERKKG

SEQ ID NO: 2165724 - protein, 8 aa, Cryptosporidium hominis
TSAGKTAV

SEQ ID NO: 2165725 - protein, 8 aa, Cryptosporidium hominis
TSAKTGYN

SEQ ID NO: 2165726 - protein, 20 aa, Cryptosporidium hominis
TSANSGKRISDIGDQAQDHS

SEQ ID NO: 2165727 - protein, 10 aa, Cryptosporidium hominis
TSAPDVVSGP

SEQ ID NO: 2165728 - protein, 20 aa, Cryptosporidium hominis
TSAPEEPPKEDPAKKPPKKH

SEQ ID NO: 2165729 - protein, 32 aa, Cryptosporidium hominis
TSAPEEPPKEEEKKEEKKEDEAPPAPPAEESS

SEQ ID NO: 2165730 - protein, 8 aa, Cryptosporidium hominis
TSAPPNYC

SEQ ID NO: 2165731 - protein, 9 aa, Cryptosporidium hominis
TSARLTPTV

SEQ ID NO: 2165732 - protein, 4 aa, Cryptosporidium hominis
TSAS

SEQ ID NO: 2165733 - protein, 8 aa, Cryptosporidium hominis
TSASSLSK

SEQ ID NO: 2165734 - protein, 18 aa, Cryptosporidium hominis
TSATISSKPVVKSAEPNY

SEQ ID NO: 2165735 - protein, 8 aa, Cryptosporidium hominis
TSAVSGRT

SEQ ID NO: 2165736 - protein, 9 aa, Cryptosporidium hominis
TSAVTGEGV

SEQ ID NO: 2165737 - protein, 9 aa, Cryptosporidium hominis
TSCNPENGG

SEQ ID NO: 2165738 - protein, 9 aa, Cryptosporidium hominis
TSCNSSSHI

SEQ ID NO: 2165739 - protein, 6 aa, Cryptosporidium hominis
TSCTEG

SEQ ID NO: 2165740 - protein, 6 aa, Cryptosporidium hominis
TSDDPV

SEQ ID NO: 2165741 - protein, 14 aa, Cryptosporidium hominis
TSDDVQDVSPDDAS

SEQ ID NO: 2165742 - protein, 9 aa, Cryptosporidium hominis
TSDEDMNTN

SEQ ID NO: 2165743 - protein, 5 aa, Cryptosporidium hominis
TSDEI

SEQ ID NO: 2165744 - protein, 33 aa, Cryptosporidium hominis
TSDEQKNKEKEEQKKKQEEQRKDKEKDKEQADL

SEQ ID NO: 2165745 - protein, 6 aa, Cryptosporidium hominis
TSDERA

SEQ ID NO: 2165746 - protein, 9 aa, Cryptosporidium hominis
TSDETGEEI

SEQ ID NO: 2165747 - protein, 8 aa, Cryptosporidium hominis
TSDGKPYY

SEQ ID NO: 2165748 - protein, 7 aa, Cryptosporidium hominis
TSDGNNF

SEQ ID NO: 2165749 - protein, 4 aa, Cryptosporidium hominis
TSDL

SEQ ID NO: 2165750 - protein, 8 aa, Cryptosporidium hominis
TSDLTKGD

SEQ ID NO: 2165751 - protein, 10 aa, Cryptosporidium hominis
TSDPNVQEEA

SEQ ID NO: 2165752 - protein, 11 aa, Cryptosporidium hominis
TSDPSSNTNLK

SEQ ID NO: 2165753 - protein, 8 aa, Cryptosporidium hominis
TSDTDKSD

SEQ ID NO: 2165754 - protein, 12 aa, Cryptosporidium hominis
TSEASSKLSDNE

SEQ ID NO: 2165755 - protein, 4 aa, Cryptosporidium hominis
TSED

SEQ ID NO: 2165756 - protein, 7 aa, Cryptosporidium hominis
TSEERSS

SEQ ID NO: 2165757 - protein, 6 aa, Cryptosporidium hominis
TSEERY

SEQ ID NO: 2165758 - protein, 12 aa, Cryptosporidium hominis
TSEHAEKGFTPT

SEQ ID NO: 2165759 - protein, 5 aa, Cryptosporidium hominis
TSEIP

SEQ ID NO: 2165760 - protein, 6 aa, Cryptosporidium hominis
TSEKAD

SEQ ID NO: 2165761 - protein, 8 aa, Cryptosporidium hominis
TSEKGKKQ

SEQ ID NO: 2165762 - protein, 5 aa, Cryptosporidium hominis
TSEKM

SEQ ID NO: 2165763 - protein, 5 aa, Cryptosporidium hominis
TSEKV

SEQ ID NO: 2165764 - protein, 7 aa, Cryptosporidium hominis
TSENAKE

SEQ ID NO: 2165765 - protein, 6 aa, Cryptosporidium hominis
TSENGN

SEQ ID NO: 2165766 - protein, 6 aa, Cryptosporidium hominis
TSENKS

SEQ ID NO: 2165767 - protein, 10 aa, Cryptosporidium hominis
TSENTPPGYH

SEQ ID NO: 2165768 - protein, 9 aa, Cryptosporidium hominis
TSEQKFTNY

SEQ ID NO: 2165769 - protein, 21 aa, Cryptosporidium hominis
TSERAEQRLKHNRSSSSGSNI

SEQ ID NO: 2165770 - protein, 9 aa, Cryptosporidium hominis
TSESDERNF

SEQ ID NO: 2165771 - protein, 5 aa, Cryptosporidium hominis
TSESI

SEQ ID NO: 2165772 - protein, 6 aa, Cryptosporidium hominis
TSESNQ

SEQ ID NO: 2165773 - protein, 11 aa, Cryptosporidium hominis
TSETKEINNGP

SEQ ID NO: 2165774 - protein, 8 aa, Cryptosporidium hominis
TSETNAGN

SEQ ID NO: 2165775 - protein, 9 aa, Cryptosporidium hominis
TSEVETDRE

SEQ ID NO: 2165776 - protein, 4 aa, Cryptosporidium hominis
TSEY

SEQ ID NO: 2165777 - protein, 5 aa, Cryptosporidium hominis
TSEYE

SEQ ID NO: 2165778 - protein, 5 aa, Cryptosporidium hominis
TSFDD

SEQ ID NO: 2165779 - protein, 8 aa, Cryptosporidium hominis
TSFDRRTQ

SEQ ID NO: 2165780 - protein, 4 aa, Cryptosporidium hominis
TSFE

SEQ ID NO: 2165781 - protein, 4 aa, Cryptosporidium hominis
TSFI

SEQ ID NO: 2165782 - protein, 5 aa, Cryptosporidium hominis
TSFSN

SEQ ID NO: 2165783 - protein, 7 aa, Cryptosporidium hominis
TSFSPPE

SEQ ID NO: 2165784 - protein, 11 aa, Cryptosporidium hominis
TSFTNGRKSRE

SEQ ID NO: 2165785 - protein, 7 aa, Cryptosporidium hominis
TSGETLT

SEQ ID NO: 2165786 - protein, 20 aa, Cryptosporidium hominis
TSGGNSNGKSGSGSSSNSML

SEQ ID NO: 2165787 - protein, 10 aa, Cryptosporidium hominis
TSGGYSPSNG

SEQ ID NO: 2165788 - protein, 5 aa, Cryptosporidium hominis
TSGKF

SEQ ID NO: 2165789 - protein, 30 aa, Cryptosporidium hominis
TSGKGKQKSPSNGKTNVEQKHKQEEKIEEP

SEQ ID NO: 2165790 - protein, 10 aa, Cryptosporidium hominis
TSGKIEPNFS

SEQ ID NO: 2165791 - protein, 8 aa, Cryptosporidium hominis
TSGKIGLS

SEQ ID NO: 2165792 - protein, 10 aa, Cryptosporidium hominis
TSGKNKSENH

SEQ ID NO: 2165793 - protein, 6 aa, Cryptosporidium hominis
TSGLYN

SEQ ID NO: 2165794 - protein, 7 aa, Cryptosporidium hominis
TSGMNGS

SEQ ID NO: 2165795 - protein, 5 aa, Cryptosporidium hominis
TSGNI

SEQ ID NO: 2165796 - protein, 8 aa, Cryptosporidium hominis
TSGPWGQS

SEQ ID NO: 2165797 - protein, 5 aa, Cryptosporidium hominis
TSGQA

SEQ ID NO: 2165798 - protein, 8 aa, Cryptosporidium hominis
TSGSESRK

SEQ ID NO: 2165799 - protein, 8 aa, Cryptosporidium hominis
TSGSGANV

SEQ ID NO: 2165800 - protein, 11 aa, Cryptosporidium hominis
TSGSGKSTISS

SEQ ID NO: 2165801 - protein, 14 aa, Cryptosporidium hominis
TSGSGRRKDGKYTM

SEQ ID NO: 2165802 - protein, 9 aa, Cryptosporidium hominis
TSGTSGTIK

SEQ ID NO: 2165803 - protein, 11 aa, Cryptosporidium hominis
TSGTTGNPKGA

SEQ ID NO: 2165804 - protein, 8 aa, Cryptosporidium hominis
TSHNVPSE

SEQ ID NO: 2165805 - protein, 5 aa, Cryptosporidium hominis
TSHPM

SEQ ID NO: 2165806 - protein, 13 aa, Cryptosporidium hominis
TSIASNNANRYQP

SEQ ID NO: 2165807 - protein, 5 aa, Cryptosporidium hominis
TSIDS

SEQ ID NO: 2165808 - protein, 4 aa, Cryptosporidium hominis
TSIG

SEQ ID NO: 2165809 - protein, 5 aa, Cryptosporidium hominis
TSIGP

SEQ ID NO: 2165810 - protein, 7 aa, Cryptosporidium hominis
TSINDDS

SEQ ID NO: 2165811 - protein, 5 aa, Cryptosporidium hominis
TSINP

SEQ ID NO: 2165812 - protein, 8 aa, Cryptosporidium hominis
TSIRSSSS

SEQ ID NO: 2165813 - protein, 22 aa, Cryptosporidium hominis
TSISESQNGISDEISSNNNISQ

SEQ ID NO: 2165814 - protein, 11 aa, Cryptosporidium hominis
TSISPASRKKG

SEQ ID NO: 2165815 - protein, 20 aa, Cryptosporidium hominis
TSISSKASDKIDNSERVPSS

SEQ ID NO: 2165816 - protein, 9 aa, Cryptosporidium hominis
TSITDREKN

SEQ ID NO: 2165817 - protein, 18 aa, Cryptosporidium hominis
TSITTQYSNGRIYSEGDD

SEQ ID NO: 2165818 - protein, 4 aa, Cryptosporidium hominis
TSKD

SEQ ID NO: 2165819 - protein, 21 aa, Cryptosporidium hominis
TSKDEDNKSSKLNNSQNCNSN

SEQ ID NO: 2165820 - protein, 11 aa, Cryptosporidium hominis
TSKDGSSLSSQ

SEQ ID NO: 2165821 - protein, 7 aa, Cryptosporidium hominis
TSKDIKS

SEQ ID NO: 2165822 - protein, 7 aa, Cryptosporidium hominis
TSKDLKE

SEQ ID NO: 2165823 - protein, 9 aa, Cryptosporidium hominis
TSKEAVQEI

SEQ ID NO: 2165824 - protein, 6 aa, Cryptosporidium hominis
TSKENE

SEQ ID NO: 2165825 - protein, 11 aa, Cryptosporidium hominis
TSKGSKRIKDT

SEQ ID NO: 2165826 - protein, 7 aa, Cryptosporidium hominis
TSKGSYE

SEQ ID NO: 2165827 - protein, 16 aa, Cryptosporidium hominis
TSKKKEIDSVGEKSNG

SEQ ID NO: 2165828 - protein, 11 aa, Cryptosporidium hominis
TSKNHNSPRNV

SEQ ID NO: 2165829 - protein, 7 aa, Cryptosporidium hominis
TSKNNNT

SEQ ID NO: 2165830 - protein, 8 aa, Cryptosporidium hominis
TSKPDFDS

SEQ ID NO: 2165831 - protein, 6 aa, Cryptosporidium hominis
TSKRRK

SEQ ID NO: 2165832 - protein, 4 aa, Cryptosporidium hominis
TSKS

SEQ ID NO: 2165833 - protein, 8 aa, Cryptosporidium hominis
TSKSGDST

SEQ ID NO: 2165834 - protein, 66 aa, Cryptosporidium hominis
TSKSKKSISSLKSKVSKLSSSISKANSSQEIQSQEDPNQEDPSQEDQSQEDQSQEDQSQEAKVEDN

SEQ ID NO: 2165835 - protein, 12 aa, Cryptosporidium hominis
TSKSNIKNDQPV

SEQ ID NO: 2165836 - protein, 9 aa, Cryptosporidium hominis
TSKSPLSKV

SEQ ID NO: 2165837 - protein, 15 aa, Cryptosporidium hominis
TSKSRADKKDNSIHS

SEQ ID NO: 2165838 - protein, 5 aa, Cryptosporidium hominis
TSKST

SEQ ID NO: 2165839 - protein, 8 aa, Cryptosporidium hominis
TSKTEMSD

SEQ ID NO: 2165840 - protein, 7 aa, Cryptosporidium hominis
TSKTNLN

SEQ ID NO: 2165841 - protein, 28 aa, Cryptosporidium hominis
TSKYSNERKRKRELSHRKKTKSQQNIST

SEQ ID NO: 2165842 - protein, 23 aa, Cryptosporidium hominis
TSLAPNNAQHRKKKPDKSNCGEI

SEQ ID NO: 2165843 - protein, 8 aa, Cryptosporidium hominis
TSLDDSDS

SEQ ID NO: 2165844 - protein, 6 aa, Cryptosporidium hominis
TSLDGK

SEQ ID NO: 2165845 - protein, 14 aa, Cryptosporidium hominis
TSLEDGKLSEKGLE

SEQ ID NO: 2165846 - protein, 4 aa, Cryptosporidium hominis
TSLG

SEQ ID NO: 2165847 - protein, 14 aa, Cryptosporidium hominis
TSLGNVDSKYKQQM

SEQ ID NO: 2165848 - protein, 30 aa, Cryptosporidium hominis
TSLNDESIKNSPSQAIPSPFENNQGRTLSP

SEQ ID NO: 2165849 - protein, 4 aa, Cryptosporidium hominis
TSLP

SEQ ID NO: 2165850 - protein, 9 aa, Cryptosporidium hominis
TSLQTQPQA

SEQ ID NO: 2165851 - protein, 6 aa, Cryptosporidium hominis
TSLRGA

SEQ ID NO: 2165852 - protein, 4 aa, Cryptosporidium hominis
TSLS

SEQ ID NO: 2165853 - protein, 6 aa, Cryptosporidium hominis
TSLSKN

SEQ ID NO: 2165854 - protein, 9 aa, Cryptosporidium hominis
TSLSNAKEL

SEQ ID NO: 2165855 - protein, 11 aa, Cryptosporidium hominis
TSLSSGNLSKS

SEQ ID NO: 2165856 - protein, 14 aa, Cryptosporidium hominis
TSLSSTSVSLGETS

SEQ ID NO: 2165857 - protein, 6 aa, Cryptosporidium hominis
TSLTST

SEQ ID NO: 2165858 - protein, 18 aa, Cryptosporidium hominis
TSLTSTMSSFSSSSSLSS

SEQ ID NO: 2165859 - protein, 5 aa, Cryptosporidium hominis
TSLYS

SEQ ID NO: 2165860 - protein, 5 aa, Cryptosporidium hominis
TSNCS

SEQ ID NO: 2165861 - protein, 4 aa, Cryptosporidium hominis
TSND

SEQ ID NO: 2165862 - protein, 8 aa, Cryptosporidium hominis
TSNDIRTN

SEQ ID NO: 2165863 - protein, 13 aa, Cryptosporidium hominis
TSNEVNKSGAKIS

SEQ ID NO: 2165864 - protein, 23 aa, Cryptosporidium hominis
TSNFESNNYLSESSEILRKRLNE

SEQ ID NO: 2165865 - protein, 4 aa, Cryptosporidium hominis
TSNG

SEQ ID NO: 2165866 - protein, 19 aa, Cryptosporidium hominis
TSNGESQSYNEQIEDETDE

SEQ ID NO: 2165867 - protein, 7 aa, Cryptosporidium hominis
TSNGNSL

SEQ ID NO: 2165868 - protein, 7 aa, Cryptosporidium hominis
TSNINPA

SEQ ID NO: 2165869 - protein, 20 aa, Cryptosporidium hominis
TSNISKSRNVPKSINSQQRS

SEQ ID NO: 2165870 - protein, 7 aa, Cryptosporidium hominis
TSNKQSI

SEQ ID NO: 2165871 - protein, 5 aa, Cryptosporidium hominis
TSNKY

SEQ ID NO: 2165872 - protein, 5 aa, Cryptosporidium hominis
TSNLE

SEQ ID NO: 2165873 - protein, 8 aa, Cryptosporidium hominis
TSNLNNSS

SEQ ID NO: 2165874 - protein, 5 aa, Cryptosporidium hominis
TSNLP

SEQ ID NO: 2165875 - protein, 20 aa, Cryptosporidium hominis
TSNLPGPQNSAIRSPPNVGS

SEQ ID NO: 2165876 - protein, 8 aa, Cryptosporidium hominis
TSNLSTPQ

SEQ ID NO: 2165877 - protein, 9 aa, Cryptosporidium hominis
TSNNLGISS

SEQ ID NO: 2165878 - protein, 6 aa, Cryptosporidium hominis
TSNNNK

SEQ ID NO: 2165879 - protein, 12 aa, Cryptosporidium hominis
TSNNTNKNLNKD

SEQ ID NO: 2165880 - protein, 8 aa, Cryptosporidium hominis
TSNPNNSI

SEQ ID NO: 2165881 - protein, 7 aa, Cryptosporidium hominis
TSNSDGF

SEQ ID NO: 2165882 - protein, 7 aa, Cryptosporidium hominis
TSNSNKF

SEQ ID NO: 2165883 - protein, 12 aa, Cryptosporidium hominis
TSNSTLESDSSS

SEQ ID NO: 2165884 - protein, 13 aa, Cryptosporidium hominis
TSNTGFGNNSSTK

SEQ ID NO: 2165885 - protein, 8 aa, Cryptosporidium hominis
TSNTNYGT

SEQ ID NO: 2165886 - protein, 5 aa, Cryptosporidium hominis
TSNTY

SEQ ID NO: 2165887 - protein, 4 aa, Cryptosporidium hominis
TSNW

SEQ ID NO: 2165888 - protein, 14 aa, Cryptosporidium hominis
TSNYNTQSNYNNNN

SEQ ID NO: 2165889 - protein, 5 aa, Cryptosporidium hominis
TSPAR

SEQ ID NO: 2165890 - protein, 7 aa, Cryptosporidium hominis
TSPDSLE

SEQ ID NO: 2165891 - protein, 6 aa, Cryptosporidium hominis
TSPEDL

SEQ ID NO: 2165892 - protein, 10 aa, Cryptosporidium hominis
TSPGDKPGVA

SEQ ID NO: 2165893 - protein, 11 aa, Cryptosporidium hominis
TSPGGRMEQVE

SEQ ID NO: 2165894 - protein, 6 aa, Cryptosporidium hominis
TSPIQE

SEQ ID NO: 2165895 - protein, 9 aa, Cryptosporidium hominis
TSPKHINSE

SEQ ID NO: 2165896 - protein, 17 aa, Cryptosporidium hominis
TSPKSTIEDYEEKVESN

SEQ ID NO: 2165897 - protein, 29 aa, Cryptosporidium hominis
TSPLSTSQHQNLQQKKQQIHQNNHQQSSA

SEQ ID NO: 2165898 - protein, 4 aa, Cryptosporidium hominis
TSPN

SEQ ID NO: 2165899 - protein, 5 aa, Cryptosporidium hominis
TSPNT

SEQ ID NO: 2165900 - protein, 6 aa, Cryptosporidium hominis
TSPPEV

SEQ ID NO: 2165901 - protein, 7 aa, Cryptosporidium hominis
TSPRKEI

SEQ ID NO: 2165902 - protein, 14 aa, Cryptosporidium hominis
TSPSGITSKTSSIN

SEQ ID NO: 2165903 - protein, 7 aa, Cryptosporidium hominis
TSPTETS

SEQ ID NO: 2165904 - protein, 4 aa, Cryptosporidium hominis
TSPV

SEQ ID NO: 2165905 - protein, 29 aa, Cryptosporidium hominis
TSPVSGLGSSVTRSSQNKRSSALRKAPQD

SEQ ID NO: 2165906 - protein, 11 aa, Cryptosporidium hominis
TSPYNADFDGD

SEQ ID NO: 2165907 - protein, 11 aa, Cryptosporidium hominis
TSQASNETQNK

SEQ ID NO: 2165908 - protein, 8 aa, Cryptosporidium hominis
TSQDASIT

SEQ ID NO: 2165909 - protein, 6 aa, Cryptosporidium hominis
TSQEFE

SEQ ID NO: 2165910 - protein, 15 aa, Cryptosporidium hominis
TSQINNSKGGQVNQE

SEQ ID NO: 2165911 - protein, 4 aa, Cryptosporidium hominis
TSQK

SEQ ID NO: 2165912 - protein, 15 aa, Cryptosporidium hominis
TSQQNKNVNKNYLYK

SEQ ID NO: 2165913 - protein, 15 aa, Cryptosporidium hominis
TSQQSNSISSNNNVY

SEQ ID NO: 2165914 - protein, 8 aa, Cryptosporidium hominis
TSRDGTLS

SEQ ID NO: 2165915 - protein, 10 aa, Cryptosporidium hominis
TSRDLESKKE

SEQ ID NO: 2165916 - protein, 4 aa, Cryptosporidium hominis
TSRE

SEQ ID NO: 2165917 - protein, 5 aa, Cryptosporidium hominis
TSRES

SEQ ID NO: 2165918 - protein, 10 aa, Cryptosporidium hominis
TSRESNTKSN

SEQ ID NO: 2165919 - protein, 6 aa, Cryptosporidium hominis
TSREYP

SEQ ID NO: 2165920 - protein, 15 aa, Cryptosporidium hominis
TSRGDTRNQMAEGSS

SEQ ID NO: 2165921 - protein, 15 aa, Cryptosporidium hominis
TSRNPTKPPGYENED

SEQ ID NO: 2165922 - protein, 6 aa, Cryptosporidium hominis
TSRNYT

SEQ ID NO: 2165923 - protein, 5 aa, Cryptosporidium hominis
TSRQE

SEQ ID NO: 2165924 - protein, 9 aa, Cryptosporidium hominis
TSRRADARS

SEQ ID NO: 2165925 - protein, 12 aa, Cryptosporidium hominis
TSRRDGLNAPPV

SEQ ID NO: 2165926 - protein, 9 aa, Cryptosporidium hominis
TSRREKEYD

SEQ ID NO: 2165927 - protein, 6 aa, Cryptosporidium hominis
TSRRRE

SEQ ID NO: 2165928 - protein, 29 aa, Cryptosporidium hominis
TSRSDKSFSLPGLQQSKSLKEISNLNKGS

SEQ ID NO: 2165929 - protein, 13 aa, Cryptosporidium hominis
TSRSPRGKESNGV

SEQ ID NO: 2165930 - protein, 8 aa, Cryptosporidium hominis
TSRSPSSR

SEQ ID NO: 2165931 - protein, 13 aa, Cryptosporidium hominis
TSRSSKFSDRMKS

SEQ ID NO: 2165932 - protein, 11 aa, Cryptosporidium hominis
TSRSSLPCDGR

SEQ ID NO: 2165933 - protein, 30 aa, Cryptosporidium hominis
TSSCLESSQEGNNPAKEYRKHDSKKGSCKN

SEQ ID NO: 2165934 - protein, 6 aa, Cryptosporidium hominis
TSSDDD

SEQ ID NO: 2165935 - protein, 8 aa, Cryptosporidium hominis
TSSDDRSI

SEQ ID NO: 2165936 - protein, 5 aa, Cryptosporidium hominis
TSSDI

SEQ ID NO: 2165937 - protein, 11 aa, Cryptosporidium hominis
TSSDSKPHVGF

SEQ ID NO: 2165938 - protein, 4 aa, Cryptosporidium hominis
TSSE

SEQ ID NO: 2165939 - protein, 16 aa, Cryptosporidium hominis
TSSEDNEYEKNKNKYG

SEQ ID NO: 2165940 - protein, 38 aa, Cryptosporidium hominis
TSSEQINGSCGNNHGKSAKSPKDDQNNQSNNSSSQKQL

SEQ ID NO: 2165941 - protein, 27 aa, Cryptosporidium hominis
TSSETENDNHLDESTNNYGETSKSCDQ

SEQ ID NO: 2165942 - protein, 9 aa, Cryptosporidium hominis
TSSGDSITV

SEQ ID NO: 2165943 - protein, 9 aa, Cryptosporidium hominis
TSSIGEDCS

SEQ ID NO: 2165944 - protein, 18 aa, Cryptosporidium hominis
TSSKTGNKKLGNQNTGKA

SEQ ID NO: 2165945 - protein, 9 aa, Cryptosporidium hominis
TSSKYSNSD

SEQ ID NO: 2165946 - protein, 8 aa, Cryptosporidium hominis
TSSLQGHK

SEQ ID NO: 2165947 - protein, 6 aa, Cryptosporidium hominis
TSSLSG

SEQ ID NO: 2165948 - protein, 49 aa, Cryptosporidium hominis
TSSNSQLEDSKKVQEEEERTSKEDDMERKDTENDDIDDFKSPKSDNSTF

SEQ ID NO: 2165949 - protein, 9 aa, Cryptosporidium hominis
TSSNSVNTS

SEQ ID NO: 2165950 - protein, 9 aa, Cryptosporidium hominis
TSSNTNVEL

SEQ ID NO: 2165951 - protein, 8 aa, Cryptosporidium hominis
TSSPAERV

SEQ ID NO: 2165952 - protein, 8 aa, Cryptosporidium hominis
TSSPDPNL

SEQ ID NO: 2165953 - protein, 5 aa, Cryptosporidium hominis
TSSPG

SEQ ID NO: 2165954 - protein, 5 aa, Cryptosporidium hominis
TSSPL

SEQ ID NO: 2165955 - protein, 6 aa, Cryptosporidium hominis
TSSPNY

SEQ ID NO: 2165956 - protein, 8 aa, Cryptosporidium hominis
TSSPQMSA

SEQ ID NO: 2165957 - protein, 4 aa, Cryptosporidium hominis
TSSQ

SEQ ID NO: 2165958 - protein, 5 aa, Cryptosporidium hominis
TSSQD

SEQ ID NO: 2165959 - protein, 10 aa, Cryptosporidium hominis
TSSRGCTKTR

SEQ ID NO: 2165960 - protein, 19 aa, Cryptosporidium hominis
TSSSAFERGSNLQSSHRDD

SEQ ID NO: 2165961 - protein, 9 aa, Cryptosporidium hominis
TSSSHTNYT

SEQ ID NO: 2165962 - protein, 22 aa, Cryptosporidium hominis
TSSSNSDKEMIDNSGEIKYEEE

SEQ ID NO: 2165963 - protein, 8 aa, Cryptosporidium hominis
TSSSPDIA

SEQ ID NO: 2165964 - protein, 15 aa, Cryptosporidium hominis
TSSTSTNSGNSGDIV

SEQ ID NO: 2165965 - protein, 4 aa, Cryptosporidium hominis
TSSY

SEQ ID NO: 2165966 - protein, 6 aa, Cryptosporidium hominis
TSTENA

SEQ ID NO: 2165967 - protein, 6 aa, Cryptosporidium hominis
TSTEYT

SEQ ID NO: 2165968 - protein, 12 aa, Cryptosporidium hominis
TSTFEDTQGLEK

SEQ ID NO: 2165969 - protein, 8 aa, Cryptosporidium hominis
TSTFGTDQ

SEQ ID NO: 2165970 - protein, 6 aa, Cryptosporidium hominis
TSTIQQ

SEQ ID NO: 2165971 - protein, 13 aa, Cryptosporidium hominis
TSTLTNSRTGKLS

SEQ ID NO: 2165972 - protein, 9 aa, Cryptosporidium hominis
TSTNEKLTS

SEQ ID NO: 2165973 - protein, 4 aa, Cryptosporidium hominis
TSTP

SEQ ID NO: 2165974 - protein, 5 aa, Cryptosporidium hominis
TSTQQ

SEQ ID NO: 2165975 - protein, 10 aa, Cryptosporidium hominis
TSTRNQNIPN

SEQ ID NO: 2165976 - protein, 4 aa, Cryptosporidium hominis
TSTS

SEQ ID NO: 2165977 - protein, 12 aa, Cryptosporidium hominis
TSTSDPSGNQKL

SEQ ID NO: 2165978 - protein, 13 aa, Cryptosporidium hominis
TSTVSVDTRARED

SEQ ID NO: 2165979 - protein, 5 aa, Cryptosporidium hominis
TSVNI

SEQ ID NO: 2165980 - protein, 10 aa, Cryptosporidium hominis
TSVNQKSNYS

SEQ ID NO: 2165981 - protein, 5 aa, Cryptosporidium hominis
TSYES

SEQ ID NO: 2165982 - protein, 13 aa, Cryptosporidium hominis
TSYLGSSAKFSND

SEQ ID NO: 2165983 - protein, 30 aa, Cryptosporidium hominis
TSYSGNSNNNNNSNNGHNNGSGSARGSQQL

SEQ ID NO: 2165984 - protein, 6 aa, Cryptosporidium hominis
TSYSIG

SEQ ID NO: 2165985 - protein, 14 aa, Cryptosporidium hominis
TTCKAGTVQSEAVT

SEQ ID NO: 2165986 - protein, 9 aa, Cryptosporidium hominis
TTCTNSNEK

SEQ ID NO: 2165987 - protein, 7 aa, Cryptosporidium hominis
TTDDPNY

SEQ ID NO: 2165988 - protein, 6 aa, Cryptosporidium hominis
TTDDTK

SEQ ID NO: 2165989 - protein, 4 aa, Cryptosporidium hominis
TTDE

SEQ ID NO: 2165990 - protein, 9 aa, Cryptosporidium hominis
TTDEGSVGG

SEQ ID NO: 2165991 - protein, 11 aa, Cryptosporidium hominis
TTDKDSKVTYK

SEQ ID NO: 2165992 - protein, 7 aa, Cryptosporidium hominis
TTEDAQE

SEQ ID NO: 2165993 - protein, 9 aa, Cryptosporidium hominis
TTEEEENKP

SEQ ID NO: 2165994 - protein, 10 aa, Cryptosporidium hominis
TTEGPRNVGG

SEQ ID NO: 2165995 - protein, 7 aa, Cryptosporidium hominis
TTEHPTG

SEQ ID NO: 2165996 - protein, 8 aa, Cryptosporidium hominis
TTEKNSMD

SEQ ID NO: 2165997 - protein, 6 aa, Cryptosporidium hominis
TTEKQQ

SEQ ID NO: 2165998 - protein, 11 aa, Cryptosporidium hominis
TTENMNSENTI

SEQ ID NO: 2165999 - protein, 10 aa, Cryptosporidium hominis
TTENNSTKNM

SEQ ID NO: 2166000 - protein, 8 aa, Cryptosporidium hominis
TTEQPESL

SEQ ID NO: 2166001 - protein, 14 aa, Cryptosporidium hominis
TTFEASDQDGDHIR

SEQ ID NO: 2166002 - protein, 7 aa, Cryptosporidium hominis
TTFQRSD

SEQ ID NO: 2166003 - protein, 6 aa, Cryptosporidium hominis
TTGFPN

SEQ ID NO: 2166004 - protein, 7 aa, Cryptosporidium hominis
TTGIDNQ

SEQ ID NO: 2166005 - protein, 11 aa, Cryptosporidium hominis
TTGKNSNSNTI

SEQ ID NO: 2166006 - protein, 12 aa, Cryptosporidium hominis
TTGLSPTPRSGH

SEQ ID NO: 2166007 - protein, 8 aa, Cryptosporidium hominis
TTGNDPEG

SEQ ID NO: 2166008 - protein, 24 aa, Cryptosporidium hominis
TTGTSGESSNTSCLSTSGTENIST

SEQ ID NO: 2166009 - protein, 6 aa, Cryptosporidium hominis
TTHTQE

SEQ ID NO: 2166010 - protein, 10 aa, Cryptosporidium hominis
TTHTTSPNIT

SEQ ID NO: 2166011 - protein, 4 aa, Cryptosporidium hominis
TTIE

SEQ ID NO: 2166012 - protein, 6 aa, Cryptosporidium hominis
TTIEAT

SEQ ID NO: 2166013 - protein, 4 aa, Cryptosporidium hominis
TTIP

SEQ ID NO: 2166014 - protein, 21 aa, Cryptosporidium hominis
TTIPTKKSQVFSTAADNQTQV

SEQ ID NO: 2166015 - protein, 8 aa, Cryptosporidium hominis
TTKARPQI

SEQ ID NO: 2166016 - protein, 9 aa, Cryptosporidium hominis
TTKEIENAS

SEQ ID NO: 2166017 - protein, 11 aa, Cryptosporidium hominis
TTKEKKREITD

SEQ ID NO: 2166018 - protein, 6 aa, Cryptosporidium hominis
TTKGEM

SEQ ID NO: 2166019 - protein, 7 aa, Cryptosporidium hominis
TTKGQDM

SEQ ID NO: 2166020 - protein, 5 aa, Cryptosporidium hominis
TTKGR

SEQ ID NO: 2166021 - protein, 8 aa, Cryptosporidium hominis
TTKNVEKK

SEQ ID NO: 2166022 - protein, 4 aa, Cryptosporidium hominis
TTKS

SEQ ID NO: 2166023 - protein, 7 aa, Cryptosporidium hominis
TTKSDST

SEQ ID NO: 2166024 - protein, 7 aa, Cryptosporidium hominis
TTKSEDD

SEQ ID NO: 2166025 - protein, 25 aa, Cryptosporidium hominis
TTKTITTQEVKPSSEGAKKSTSNMT

SEQ ID NO: 2166026 - protein, 6 aa, Cryptosporidium hominis
TTKTRY

SEQ ID NO: 2166027 - protein, 5 aa, Cryptosporidium hominis
TTKYE

SEQ ID NO: 2166028 - protein, 8 aa, Cryptosporidium hominis
TTLDETKQ

SEQ ID NO: 2166029 - protein, 5 aa, Cryptosporidium hominis
TTLGT

SEQ ID NO: 2166030 - protein, 12 aa, Cryptosporidium hominis
TTLPDPQTFGKA

SEQ ID NO: 2166031 - protein, 4 aa, Cryptosporidium hominis
TTLS

SEQ ID NO: 2166032 - protein, 8 aa, Cryptosporidium hominis
TTLSPTGG

SEQ ID NO: 2166033 - protein, 4 aa, Cryptosporidium hominis
TTLT

SEQ ID NO: 2166034 - protein, 4 aa, Cryptosporidium hominis
TTMY

SEQ ID NO: 2166035 - protein, 5 aa, Cryptosporidium hominis
TTNDS

SEQ ID NO: 2166036 - protein, 11 aa, Cryptosporidium hominis
TTNEKSPTNLQ

SEQ ID NO: 2166037 - protein, 10 aa, Cryptosporidium hominis
TTNESYGPKC

SEQ ID NO: 2166038 - protein, 13 aa, Cryptosporidium hominis
TTNGGDSKSKNRS

SEQ ID NO: 2166039 - protein, 5 aa, Cryptosporidium hominis
TTNHP

SEQ ID NO: 2166040 - protein, 7 aa, Cryptosporidium hominis
TTNIPSY

SEQ ID NO: 2166041 - protein, 5 aa, Cryptosporidium hominis
TTNIT

SEQ ID NO: 2166042 - protein, 5 aa, Cryptosporidium hominis
TTNKD

SEQ ID NO: 2166043 - protein, 6 aa, Cryptosporidium hominis
TTNKKK

SEQ ID NO: 2166044 - protein, 4 aa, Cryptosporidium hominis
TTNL

SEQ ID NO: 2166045 - protein, 10 aa, Cryptosporidium hominis
TTNLDEKRDR

SEQ ID NO: 2166046 - protein, 24 aa, Cryptosporidium hominis
TTNLEAGKSDVNKSIKPPNSQGSV

SEQ ID NO: 2166047 - protein, 14 aa, Cryptosporidium hominis
TTNNGQNGAGNSIE

SEQ ID NO: 2166048 - protein, 28 aa, Cryptosporidium hominis
TTNPVNIGSNSLNDSNQQSKGSFSQGIA

SEQ ID NO: 2166049 - protein, 14 aa, Cryptosporidium hominis
TTNSVRSKLNEPPI

SEQ ID NO: 2166050 - protein, 7 aa, Cryptosporidium hominis
TTPETPM

SEQ ID NO: 2166051 - protein, 7 aa, Cryptosporidium hominis
TTPHRPP

SEQ ID NO: 2166052 - protein, 4 aa, Cryptosporidium hominis
TTPI

SEQ ID NO: 2166053 - protein, 11 aa, Cryptosporidium hominis
TTPIGDAPKCP

SEQ ID NO: 2166054 - protein, 6 aa, Cryptosporidium hominis
TTPLSQ

SEQ ID NO: 2166055 - protein, 6 aa, Cryptosporidium hominis
TTPPNY

SEQ ID NO: 2166056 - protein, 24 aa, Cryptosporidium hominis
TTPQNQSLRRPKIPKGTQDVTPQK

SEQ ID NO: 2166057 - protein, 4 aa, Cryptosporidium hominis
TTPR

SEQ ID NO: 2166058 - protein, 5 aa, Cryptosporidium hominis
TTPRP

SEQ ID NO: 2166059 - protein, 13 aa, Cryptosporidium hominis
TTPTQLIRQVLHS

SEQ ID NO: 2166060 - protein, 6 aa, Cryptosporidium hominis
TTQEDL

SEQ ID NO: 2166061 - protein, 9 aa, Cryptosporidium hominis
TTQEGFEAS

SEQ ID NO: 2166062 - protein, 10 aa, Cryptosporidium hominis
TTQGEPQYNG

SEQ ID NO: 2166063 - protein, 5 aa, Cryptosporidium hominis
TTQLR

SEQ ID NO: 2166064 - protein, 8 aa, Cryptosporidium hominis
TTQNNTIT

SEQ ID NO: 2166065 - protein, 13 aa, Cryptosporidium hominis
TTQRKSNETDSEG

SEQ ID NO: 2166066 - protein, 12 aa, Cryptosporidium hominis
TTQTEKGKQAIK

SEQ ID NO: 2166067 - protein, 14 aa, Cryptosporidium hominis
TTRNNNEGIDNKGR

SEQ ID NO: 2166068 - protein, 4 aa, Cryptosporidium hominis
TTRS

SEQ ID NO: 2166069 - protein, 13 aa, Cryptosporidium hominis
TTSCGTSAEPQLS

SEQ ID NO: 2166070 - protein, 6 aa, Cryptosporidium hominis
TTSEKN

SEQ ID NO: 2166071 - protein, 42 aa, Cryptosporidium hominis
TTSENHSSQSDSSEISDDSRSEKRNRKRKSSVSKTQKKNREK

SEQ ID NO: 2166072 - protein, 48 aa, Cryptosporidium hominis
TTSGSPSSQRKRRGSAKSSYNFSPPPIPVTNSPIQSGDPKDISSLNPE

SEQ ID NO: 2166073 - protein, 9 aa, Cryptosporidium hominis
TTSGTGAEM

SEQ ID NO: 2166074 - protein, 4 aa, Cryptosporidium hominis
TTSI

SEQ ID NO: 2166075 - protein, 8 aa, Cryptosporidium hominis
TTSNVSPS

SEQ ID NO: 2166076 - protein, 13 aa, Cryptosporidium hominis
TTSPISPSNSPLH

SEQ ID NO: 2166077 - protein, 6 aa, Cryptosporidium hominis
TTSPRL

SEQ ID NO: 2166078 - protein, 8 aa, Cryptosporidium hominis
TTSRPDSI

SEQ ID NO: 2166079 - protein, 5 aa, Cryptosporidium hominis
TTSSA

SEQ ID NO: 2166080 - protein, 9 aa, Cryptosporidium hominis
TTSSAPNRA

SEQ ID NO: 2166081 - protein, 9 aa, Cryptosporidium hominis
TTSSKNKFS

SEQ ID NO: 2166082 - protein, 9 aa, Cryptosporidium hominis
TTSSRSERV

SEQ ID NO: 2166083 - protein, 6 aa, Cryptosporidium hominis
TTSSTN

SEQ ID NO: 2166084 - protein, 8 aa, Cryptosporidium hominis
TTSTEVSS

SEQ ID NO: 2166085 - protein, 9 aa, Cryptosporidium hominis
TTSTSSGKS

SEQ ID NO: 2166086 - protein, 12 aa, Cryptosporidium hominis
TTTDDASNKLEE

SEQ ID NO: 2166087 - protein, 8 aa, Cryptosporidium hominis
TTTDPSEF

SEQ ID NO: 2166088 - protein, 130 aa, Cryptosporidium hominis
TTTKAPNATTTSTTGHPTTSSTTGNPTTTTTKAPNVTTTSTTGYPTTTSTTGYPTATSTTVHPTTTSTTGYPTTTSTTGHPTTTSTTGYPTTTSTTGYPTTTTTTTVPDITTTTTEYPNTTTTTSEPPKY

SEQ ID NO: 2166089 - protein, 4 aa, Cryptosporidium hominis
TTTL

SEQ ID NO: 2166090 - protein, 20 aa, Cryptosporidium hominis
TTTMSDVSRQKALKKSERKM

SEQ ID NO: 2166091 - protein, 6 aa, Cryptosporidium hominis
TTTQEV

SEQ ID NO: 2166092 - protein, 19 aa, Cryptosporidium hominis
TTTTKSTSSGSWMDSFLSW

SEQ ID NO: 2166093 - protein, 24 aa, Cryptosporidium hominis
TTTTPSSRRFNEYDKENATHSTSP

SEQ ID NO: 2166094 - protein, 12 aa, Cryptosporidium hominis
TTTTSSDTGSVT

SEQ ID NO: 2166095 - protein, 50 aa, Cryptosporidium hominis
TTTTTRTTTTTRTTTTTRTTTSTRTTTSTKTTNNTKTTSEYFSSNEEEMD

SEQ ID NO: 2166096 - protein, 9 aa, Cryptosporidium hominis
TTTTTTPTN

SEQ ID NO: 2166097 - protein, 235 aa, Cryptosporidium hominis
TTTTTTTTTTTTTTTTTTTTTTTTTTTTTTTTTTTTTTTTTTTTTSTTTTTTTTSTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTNPPW

SEQ ID NO: 2166098 - protein, 151 aa, Cryptosporidium hominis
TTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTTAITNS

SEQ ID NO: 2166099 - protein, 5 aa, Cryptosporidium hominis
TTVDP

SEQ ID NO: 2166100 - protein, 20 aa, Cryptosporidium hominis
TTVNSKADVSYNSKSEPKMN

SEQ ID NO: 2166101 - protein, 20 aa, Cryptosporidium hominis
TTVSGTAGQFAHSNDTTVYE

SEQ ID NO: 2166102 - protein, 4 aa, Cryptosporidium hominis
TTYF

SEQ ID NO: 2166103 - protein, 4 aa, Cryptosporidium hominis
TVAN

SEQ ID NO: 2166104 - protein, 8 aa, Cryptosporidium hominis
TVASPGLS

SEQ ID NO: 2166105 - protein, 22 aa, Cryptosporidium hominis
TVATETNSNMDECSAKKKSINE

SEQ ID NO: 2166106 - protein, 7 aa, Cryptosporidium hominis
TVATGQK

SEQ ID NO: 2166107 - protein, 8 aa, Cryptosporidium hominis
TVATRSKN

SEQ ID NO: 2166108 - protein, 16 aa, Cryptosporidium hominis
TVDGPSKGGKDWRAGR

SEQ ID NO: 2166109 - protein, 4 aa, Cryptosporidium hominis
TVDK

SEQ ID NO: 2166110 - protein, 6 aa, Cryptosporidium hominis
TVDKTQ

SEQ ID NO: 2166111 - protein, 13 aa, Cryptosporidium hominis
TVDPNESIEMENS

SEQ ID NO: 2166112 - protein, 10 aa, Cryptosporidium hominis
TVDSSASESK

SEQ ID NO: 2166113 - protein, 9 aa, Cryptosporidium hominis
TVDTDETYG

SEQ ID NO: 2166114 - protein, 5 aa, Cryptosporidium hominis
TVENI

SEQ ID NO: 2166115 - protein, 9 aa, Cryptosporidium hominis
TVENKRREF

SEQ ID NO: 2166116 - protein, 10 aa, Cryptosporidium hominis
TVESGGRNFS

SEQ ID NO: 2166117 - protein, 5 aa, Cryptosporidium hominis
TVETD

SEQ ID NO: 2166118 - protein, 5 aa, Cryptosporidium hominis
TVEVS

SEQ ID NO: 2166119 - protein, 4 aa, Cryptosporidium hominis
TVEY

SEQ ID NO: 2166120 - protein, 9 aa, Cryptosporidium hominis
TVGAQYTST

SEQ ID NO: 2166121 - protein, 11 aa, Cryptosporidium hominis
TVGDAPEKSGS

SEQ ID NO: 2166122 - protein, 5 aa, Cryptosporidium hominis
TVGDI

SEQ ID NO: 2166123 - protein, 4 aa, Cryptosporidium hominis
TVGK

SEQ ID NO: 2166124 - protein, 4 aa, Cryptosporidium hominis
TVGN

SEQ ID NO: 2166125 - protein, 8 aa, Cryptosporidium hominis
TVGSMTNS

SEQ ID NO: 2166126 - protein, 8 aa, Cryptosporidium hominis
TVGSPQWG

SEQ ID NO: 2166127 - protein, 22 aa, Cryptosporidium hominis
TVGSSIRNSNRTGFSSKPNLSG

SEQ ID NO: 2166128 - protein, 14 aa, Cryptosporidium hominis
TVGTRSCYDEGKRI

SEQ ID NO: 2166129 - protein, 19 aa, Cryptosporidium hominis
TVKASKKALNFPKRKFAII

SEQ ID NO: 2166130 - protein, 18 aa, Cryptosporidium hominis
TVKNKSSEEDRMQGPLPG

SEQ ID NO: 2166131 - protein, 12 aa, Cryptosporidium hominis
TVKSPTALSSSI

SEQ ID NO: 2166132 - protein, 9 aa, Cryptosporidium hominis
TVKTTKSVS

SEQ ID NO: 2166133 - protein, 12 aa, Cryptosporidium hominis
TVLPDNTTFSRN

SEQ ID NO: 2166134 - protein, 12 aa, Cryptosporidium hominis
TVNEDNEEEKER

SEQ ID NO: 2166135 - protein, 21 aa, Cryptosporidium hominis
TVNESSNLNDHKSDFKNDLTS

SEQ ID NO: 2166136 - protein, 14 aa, Cryptosporidium hominis
TVNKTSTEDVTSTT

SEQ ID NO: 2166137 - protein, 7 aa, Cryptosporidium hominis
TVNNSTN

SEQ ID NO: 2166138 - protein, 6 aa, Cryptosporidium hominis
TVNSEL

SEQ ID NO: 2166139 - protein, 11 aa, Cryptosporidium hominis
TVPGAGSNSLN

SEQ ID NO: 2166140 - protein, 10 aa, Cryptosporidium hominis
TVPKQETCPS

SEQ ID NO: 2166141 - protein, 9 aa, Cryptosporidium hominis
TVPKSGIST

SEQ ID NO: 2166142 - protein, 10 aa, Cryptosporidium hominis
TVPNNNKGIP

SEQ ID NO: 2166143 - protein, 8 aa, Cryptosporidium hominis
TVPPPRRF

SEQ ID NO: 2166144 - protein, 10 aa, Cryptosporidium hominis
TVPPQLSSDD

SEQ ID NO: 2166145 - protein, 12 aa, Cryptosporidium hominis
TVPSRDSKENEL

SEQ ID NO: 2166146 - protein, 26 aa, Cryptosporidium hominis
TVPTQGNSGNNSSKFKSQLRADAQEF

SEQ ID NO: 2166147 - protein, 8 aa, Cryptosporidium hominis
TVPVKTSE

SEQ ID NO: 2166148 - protein, 8 aa, Cryptosporidium hominis
TVQEYEEY

SEQ ID NO: 2166149 - protein, 8 aa, Cryptosporidium hominis
TVQRGTEE

SEQ ID NO: 2166150 - protein, 10 aa, Cryptosporidium hominis
TVQSVNETNF

SEQ ID NO: 2166151 - protein, 11 aa, Cryptosporidium hominis
TVQTLQERTET

SEQ ID NO: 2166152 - protein, 7 aa, Cryptosporidium hominis
TVRNSNG

SEQ ID NO: 2166153 - protein, 10 aa, Cryptosporidium hominis
TVRPPTAPTF

SEQ ID NO: 2166154 - protein, 7 aa, Cryptosporidium hominis
TVRTSDG

SEQ ID NO: 2166155 - protein, 4 aa, Cryptosporidium hominis
TVSF

SEQ ID NO: 2166156 - protein, 4 aa, Cryptosporidium hominis
TVSG

SEQ ID NO: 2166157 - protein, 38 aa, Cryptosporidium hominis
TVSGTKYSEFQSNLSKKSNGYSPRSLTNTDRKIAPPET

SEQ ID NO: 2166158 - protein, 10 aa, Cryptosporidium hominis
TVSKSNGDEN

SEQ ID NO: 2166159 - protein, 5 aa, Cryptosporidium hominis
TWEGE

SEQ ID NO: 2166160 - protein, 4 aa, Cryptosporidium hominis
TWNE

SEQ ID NO: 2166161 - protein, 5 aa, Cryptosporidium hominis
TWNEE

SEQ ID NO: 2166162 - protein, 4 aa, Cryptosporidium hominis
TWSE

SEQ ID NO: 2166163 - protein, 14 aa, Cryptosporidium hominis
TWTGKSGQAGAPSS

SEQ ID NO: 2166164 - protein, 7 aa, Cryptosporidium hominis
TYANPGP

SEQ ID NO: 2166165 - protein, 11 aa, Cryptosporidium hominis
TYARNSPEIGE

SEQ ID NO: 2166166 - protein, 5 aa, Cryptosporidium hominis
TYDCR

SEQ ID NO: 2166167 - protein, 8 aa, Cryptosporidium hominis
TYDEAGRR

SEQ ID NO: 2166168 - protein, 14 aa, Cryptosporidium hominis
TYDPYKDKELKPLP

SEQ ID NO: 2166169 - protein, 6 aa, Cryptosporidium hominis
TYEDNS

SEQ ID NO: 2166170 - protein, 4 aa, Cryptosporidium hominis
TYEE

SEQ ID NO: 2166171 - protein, 13 aa, Cryptosporidium hominis
TYEETINEENFEE

SEQ ID NO: 2166172 - protein, 6 aa, Cryptosporidium hominis
TYGDGK

SEQ ID NO: 2166173 - protein, 9 aa, Cryptosporidium hominis
TYGGDRKAT

SEQ ID NO: 2166174 - protein, 4 aa, Cryptosporidium hominis
TYGL

SEQ ID NO: 2166175 - protein, 25 aa, Cryptosporidium hominis
TYGNELTEAAAKEATDCCENQDEAA

SEQ ID NO: 2166176 - protein, 6 aa, Cryptosporidium hominis
TYGNSC

SEQ ID NO: 2166177 - protein, 5 aa, Cryptosporidium hominis
TYGPC

SEQ ID NO: 2166178 - protein, 14 aa, Cryptosporidium hominis
TYHPNTSNNSHSHN

SEQ ID NO: 2166179 - protein, 13 aa, Cryptosporidium hominis
TYKDDVKKTSTDH

SEQ ID NO: 2166180 - protein, 4 aa, Cryptosporidium hominis
TYKK

SEQ ID NO: 2166181 - protein, 13 aa, Cryptosporidium hominis
TYKNNPSNPGKCL

SEQ ID NO: 2166182 - protein, 4 aa, Cryptosporidium hominis
TYLP

SEQ ID NO: 2166183 - protein, 5 aa, Cryptosporidium hominis
TYNEN

SEQ ID NO: 2166184 - protein, 4 aa, Cryptosporidium hominis
TYNI

SEQ ID NO: 2166185 - protein, 36 aa, Cryptosporidium hominis
  misc_feature (25)..(25): Xaa can be any naturally occurring amino acid
  misc_feature (30)..(30): Xaa can be any naturally occurring amino acid
TYNNSVSSRGSSSFAPVQNHSLSSXARRFXSLSSSR

SEQ ID NO: 2166186 - protein, 13 aa, Cryptosporidium hominis
TYNRSRKEIESQI

SEQ ID NO: 2166187 - protein, 4 aa, Cryptosporidium hominis
TYNS

SEQ ID NO: 2166188 - protein, 11 aa, Cryptosporidium hominis
TYNSDNNQLVS

SEQ ID NO: 2166189 - protein, 5 aa, Cryptosporidium hominis
TYNSH

SEQ ID NO: 2166190 - protein, 6 aa, Cryptosporidium hominis
TYNSSD

SEQ ID NO: 2166191 - protein, 4 aa, Cryptosporidium hominis
TYNT

SEQ ID NO: 2166192 - protein, 5 aa, Cryptosporidium hominis
TYPDP

SEQ ID NO: 2166193 - protein, 5 aa, Cryptosporidium hominis
TYPER

SEQ ID NO: 2166194 - protein, 5 aa, Cryptosporidium hominis
TYQDK

SEQ ID NO: 2166195 - protein, 6 aa, Cryptosporidium hominis
TYSKEG

SEQ ID NO: 2166196 - protein, 8 aa, Cryptosporidium hominis
TYSNENYP

SEQ ID NO: 2166197 - protein, 5 aa, Cryptosporidium hominis
TYSRC

SEQ ID NO: 2166198 - protein, 9 aa, Cryptosporidium hominis
TYTDLQTTS

SEQ ID NO: 2166199 - protein, 6 aa, Cryptosporidium hominis
TYTKSE

SEQ ID NO: 2166200 - protein, 13 aa, Cryptosporidium hominis
VAAKTGGAKTQSE

SEQ ID NO: 2166201 - protein, 6 aa, Cryptosporidium hominis
VAARTG

SEQ ID NO: 2166202 - protein, 5 aa, Cryptosporidium hominis
VAATG

SEQ ID NO: 2166203 - protein, 7 aa, Cryptosporidium hominis
VADAERA

SEQ ID NO: 2166204 - protein, 18 aa, Cryptosporidium hominis
VADKRESLYKSNGNRDGS

SEQ ID NO: 2166205 - protein, 6 aa, Cryptosporidium hominis
VADSVP

SEQ ID NO: 2166206 - protein, 7 aa, Cryptosporidium hominis
VAEGEAV

SEQ ID NO: 2166207 - protein, 18 aa, Cryptosporidium hominis
VAEIDPNNIQENKKPDID

SEQ ID NO: 2166208 - protein, 26 aa, Cryptosporidium hominis
VAENKSAADANKQRELAEKKAQLAKA

SEQ ID NO: 2166209 - protein, 28 aa, Cryptosporidium hominis
VAESTLSSENDGSAKNPGNISFSSSNGL

SEQ ID NO: 2166210 - protein, 7 aa, Cryptosporidium hominis
VAGDDAP

SEQ ID NO: 2166211 - protein, 23 aa, Cryptosporidium hominis
VAGEGGQDVYHESQQDEQWGGVV

SEQ ID NO: 2166212 - protein, 4 aa, Cryptosporidium hominis
VAGG

SEQ ID NO: 2166213 - protein, 42 aa, Cryptosporidium hominis
VAGGAGAGAGAAQDSGASAAADDKKKKEEEEEEEGDLGFSLF

SEQ ID NO: 2166214 - protein, 10 aa, Cryptosporidium hominis
VAGYESNEVE

SEQ ID NO: 2166215 - protein, 8 aa, Cryptosporidium hominis
VAKSGTAN

SEQ ID NO: 2166216 - protein, 9 aa, Cryptosporidium hominis
VAKTDPELD

SEQ ID NO: 2166217 - protein, 17 aa, Cryptosporidium hominis
VAKTSSALATSTYELPD

SEQ ID NO: 2166218 - protein, 7 aa, Cryptosporidium hominis
VANETSA

SEQ ID NO: 2166219 - protein, 8 aa, Cryptosporidium hominis
VANGPPGV

SEQ ID NO: 2166220 - protein, 10 aa, Cryptosporidium hominis
VANPESQNID

SEQ ID NO: 2166221 - protein, 5 aa, Cryptosporidium hominis
VANRT

SEQ ID NO: 2166222 - protein, 34 aa, Cryptosporidium hominis
VANSSKNKLNSASNLSNEQNTIQPKKRPRRNGEI

SEQ ID NO: 2166223 - protein, 9 aa, Cryptosporidium hominis
VANTENIDE

SEQ ID NO: 2166224 - protein, 21 aa, Cryptosporidium hominis
VANTPEAITESNKGRKWDKKN

SEQ ID NO: 2166225 - protein, 8 aa, Cryptosporidium hominis
VAPDRYTG

SEQ ID NO: 2166226 - protein, 5 aa, Cryptosporidium hominis
VAPGM

SEQ ID NO: 2166227 - protein, 14 aa, Cryptosporidium hominis
VAPGSPKSDRVGRS

SEQ ID NO: 2166228 - protein, 5 aa, Cryptosporidium hominis
VAPNP

SEQ ID NO: 2166229 - protein, 7 aa, Cryptosporidium hominis
VAPNPKD

SEQ ID NO: 2166230 - protein, 38 aa, Cryptosporidium hominis
VAPPPPPPPPSSQGITSNKGANTNGGIRSRYVDIFQSK

SEQ ID NO: 2166231 - protein, 11 aa, Cryptosporidium hominis
VAPSQERSSEG

SEQ ID NO: 2166232 - protein, 27 aa, Cryptosporidium hominis
VAPSSPLNKSEVNDKENISSNTLGKQL

SEQ ID NO: 2166233 - protein, 7 aa, Cryptosporidium hominis
VARAKKE

SEQ ID NO: 2166234 - protein, 34 aa, Cryptosporidium hominis
VARSETAQSGLDTNGSGGVNITADERAMDLVLDL

SEQ ID NO: 2166235 - protein, 31 aa, Cryptosporidium hominis
VASDQRSRSLSSYYSESTSRKNFSPGYRSNS

SEQ ID NO: 2166236 - protein, 6 aa, Cryptosporidium hominis
VASKGL

SEQ ID NO: 2166237 - protein, 14 aa, Cryptosporidium hominis
VASNNNNNNNNSVV

SEQ ID NO: 2166238 - protein, 8 aa, Cryptosporidium hominis
VASQGSKN

SEQ ID NO: 2166239 - protein, 11 aa, Cryptosporidium hominis
VASTGEIESNY

SEQ ID NO: 2166240 - protein, 12 aa, Cryptosporidium hominis
VASTNMNSYSSR

SEQ ID NO: 2166241 - protein, 9 aa, Cryptosporidium hominis
VASTNTPVS

SEQ ID NO: 2166242 - protein, 5 aa, Cryptosporidium hominis
VATDK

SEQ ID NO: 2166243 - protein, 10 aa, Cryptosporidium hominis
VATDPATERC

SEQ ID NO: 2166244 - protein, 5 aa, Cryptosporidium hominis
VATES

SEQ ID NO: 2166245 - protein, 11 aa, Cryptosporidium hominis
VATGTGTTTGA

SEQ ID NO: 2166246 - protein, 11 aa, Cryptosporidium hominis
VATPTNSAQNE

SEQ ID NO: 2166247 - protein, 28 aa, Cryptosporidium hominis
VATSKEEGEIKDEDDVQNNKSNNEATSI

SEQ ID NO: 2166248 - protein, 9 aa, Cryptosporidium hominis
VCGGNGGNL

SEQ ID NO: 2166249 - protein, 9 aa, Cryptosporidium hominis
VCKSQDDDP

SEQ ID NO: 2166250 - protein, 6 aa, Cryptosporidium hominis
VCSGHP

SEQ ID NO: 2166251 - protein, 40 aa, Cryptosporidium hominis
VCSSGSSSCSTGVGGSTCSLAGNNSSGAYGMKRSSKSNSL

SEQ ID NO: 2166252 - protein, 11 aa, Cryptosporidium hominis
VDAEDDDLQQI

SEQ ID NO: 2166253 - protein, 13 aa, Cryptosporidium hominis
VDAENAENLIENV

SEQ ID NO: 2166254 - protein, 11 aa, Cryptosporidium hominis
VDAGKAETEKL

SEQ ID NO: 2166255 - protein, 4 aa, Cryptosporidium hominis
VDDD

SEQ ID NO: 2166256 - protein, 13 aa, Cryptosporidium hominis
VDDGRFDNIPEGR

SEQ ID NO: 2166257 - protein, 7 aa, Cryptosporidium hominis
VDDKNYN

SEQ ID NO: 2166258 - protein, 6 aa, Cryptosporidium hominis
VDDKVG

SEQ ID NO: 2166259 - protein, 10 aa, Cryptosporidium hominis
VDDSQSSSTI

SEQ ID NO: 2166260 - protein, 9 aa, Cryptosporidium hominis
VDEFTQRKN

SEQ ID NO: 2166261 - protein, 10 aa, Cryptosporidium hominis
VDEGSAGGAH

SEQ ID NO: 2166262 - protein, 15 aa, Cryptosporidium hominis
VDEGSLKSKVDSSNS

SEQ ID NO: 2166263 - protein, 5 aa, Cryptosporidium hominis
VDEKS

SEQ ID NO: 2166264 - protein, 4 aa, Cryptosporidium hominis
VDEP

SEQ ID NO: 2166265 - protein, 24 aa, Cryptosporidium hominis
VDEPNQAWETGDEGGGRDDGQDED

SEQ ID NO: 2166266 - protein, 8 aa, Cryptosporidium hominis
VDESGKHS

SEQ ID NO: 2166267 - protein, 7 aa, Cryptosporidium hominis
VDGDGEI

SEQ ID NO: 2166268 - protein, 6 aa, Cryptosporidium hominis
VDGEKS

SEQ ID NO: 2166269 - protein, 8 aa, Cryptosporidium hominis
VDGKDTSY

SEQ ID NO: 2166270 - protein, 4 aa, Cryptosporidium hominis
VDGR

SEQ ID NO: 2166271 - protein, 4 aa, Cryptosporidium hominis
VDGS

SEQ ID NO: 2166272 - protein, 8 aa, Cryptosporidium hominis
VDGTPGKL

SEQ ID NO: 2166273 - protein, 4 aa, Cryptosporidium hominis
VDHA

SEQ ID NO: 2166274 - protein, 19 aa, Cryptosporidium hominis
VDITSGSGSGSGSGSGNGI

SEQ ID NO: 2166275 - protein, 9 aa, Cryptosporidium hominis
VDKDTETKN

SEQ ID NO: 2166276 - protein, 10 aa, Cryptosporidium hominis
VDKKNSPDNN

SEQ ID NO: 2166277 - protein, 7 aa, Cryptosporidium hominis
VDKNSIK

SEQ ID NO: 2166278 - protein, 14 aa, Cryptosporidium hominis
VDKPGSSKFICFDV

SEQ ID NO: 2166279 - protein, 21 aa, Cryptosporidium hominis
VDKSELENNISKNEKIANSTH

SEQ ID NO: 2166280 - protein, 16 aa, Cryptosporidium hominis
VDKSNEQIKQKKEDLN

SEQ ID NO: 2166281 - protein, 55 aa, Cryptosporidium hominis
VDKSSNKPVSKQQTEEQTSEQIPEMSPEPASETSSPTKKACKDTNPSVDQPTTAW

SEQ ID NO: 2166282 - protein, 24 aa, Cryptosporidium hominis
VDKSTGKSSKITITNDKGRLSKDD

SEQ ID NO: 2166283 - protein, 9 aa, Cryptosporidium hominis
VDLENKQKE

SEQ ID NO: 2166284 - protein, 10 aa, Cryptosporidium hominis
VDNNKDGEVD

SEQ ID NO: 2166285 - protein, 7 aa, Cryptosporidium hominis
VDNNSND

SEQ ID NO: 2166286 - protein, 14 aa, Cryptosporidium hominis
VDNNTNTNNNSNSK

SEQ ID NO: 2166287 - protein, 6 aa, Cryptosporidium hominis
VDNNTP

SEQ ID NO: 2166288 - protein, 5 aa, Cryptosporidium hominis
VDNPY

SEQ ID NO: 2166289 - protein, 11 aa, Cryptosporidium hominis
VDNRDYSNTSL

SEQ ID NO: 2166290 - protein, 4 aa, Cryptosporidium hominis
VDNS

SEQ ID NO: 2166291 - protein, 7 aa, Cryptosporidium hominis
VDNTGLN

SEQ ID NO: 2166292 - protein, 4 aa, Cryptosporidium hominis
VDPE

SEQ ID NO: 2166293 - protein, 6 aa, Cryptosporidium hominis
VDPKGL

SEQ ID NO: 2166294 - protein, 8 aa, Cryptosporidium hominis
VDPPPNKG

SEQ ID NO: 2166295 - protein, 9 aa, Cryptosporidium hominis
VDPPSQLTN

SEQ ID NO: 2166296 - protein, 12 aa, Cryptosporidium hominis
VDPVTSATSEIE

SEQ ID NO: 2166297 - protein, 25 aa, Cryptosporidium hominis
VDQESAAFNKDNVGNLNQVPNNEYI

SEQ ID NO: 2166298 - protein, 12 aa, Cryptosporidium hominis
VDQKKEKKCNFP

SEQ ID NO: 2166299 - protein, 6 aa, Cryptosporidium hominis
VDQQTQ

SEQ ID NO: 2166300 - protein, 6 aa, Cryptosporidium hominis
VDRDGR

SEQ ID NO: 2166301 - protein, 8 aa, Cryptosporidium hominis
VDRNGKRS

SEQ ID NO: 2166302 - protein, 18 aa, Cryptosporidium hominis
VDRNISGNSQTMNATPSL

SEQ ID NO: 2166303 - protein, 8 aa, Cryptosporidium hominis
VDRPSDLA

SEQ ID NO: 2166304 - protein, 20 aa, Cryptosporidium hominis
VDRRNQRRSDQTIKSNTDVE

SEQ ID NO: 2166305 - protein, 7 aa, Cryptosporidium hominis
VDRSKNT

SEQ ID NO: 2166306 - protein, 7 aa, Cryptosporidium hominis
VDRTGNG

SEQ ID NO: 2166307 - protein, 8 aa, Cryptosporidium hominis
VDSAESYE

SEQ ID NO: 2166308 - protein, 8 aa, Cryptosporidium hominis
VDSATTED

SEQ ID NO: 2166309 - protein, 7 aa, Cryptosporidium hominis
VDSDSRQ

SEQ ID NO: 2166310 - protein, 8 aa, Cryptosporidium hominis
VDSGDNSM

SEQ ID NO: 2166311 - protein, 6 aa, Cryptosporidium hominis
VDSGIQ

SEQ ID NO: 2166312 - protein, 11 aa, Cryptosporidium hominis
VDSGTGNEKRY

SEQ ID NO: 2166313 - protein, 33 aa, Cryptosporidium hominis
VDSHEAKSTNNENIAPSGDENNANDSKAEGTIT

SEQ ID NO: 2166314 - protein, 5 aa, Cryptosporidium hominis
VDSIQ

SEQ ID NO: 2166315 - protein, 8 aa, Cryptosporidium hominis
VDSNATFE

SEQ ID NO: 2166316 - protein, 15 aa, Cryptosporidium hominis
VDSNKDRGMTGGNSA

SEQ ID NO: 2166317 - protein, 22 aa, Cryptosporidium hominis
VDSNNSSEKMPENISKAEKSNV

SEQ ID NO: 2166318 - protein, 9 aa, Cryptosporidium hominis
VDSTAKPEA

SEQ ID NO: 2166319 - protein, 4 aa, Cryptosporidium hominis
VDSY

SEQ ID NO: 2166320 - protein, 8 aa, Cryptosporidium hominis
VDTENKSS

SEQ ID NO: 2166321 - protein, 5 aa, Cryptosporidium hominis
VDTET

SEQ ID NO: 2166322 - protein, 6 aa, Cryptosporidium hominis
VDTKEI

SEQ ID NO: 2166323 - protein, 7 aa, Cryptosporidium hominis
VDTSIQA

SEQ ID NO: 2166324 - protein, 16 aa, Cryptosporidium hominis
VDTSSASIGRRYARTD

SEQ ID NO: 2166325 - protein, 9 aa, Cryptosporidium hominis
VEAAKQYTR

SEQ ID NO: 2166326 - protein, 38 aa, Cryptosporidium hominis
VEAEREVETERELETEREVETEREVETEKTMKTEKEMD

SEQ ID NO: 2166327 - protein, 5 aa, Cryptosporidium hominis
VEAQK

SEQ ID NO: 2166328 - protein, 15 aa, Cryptosporidium hominis
VEARGDDSDDQNISS

SEQ ID NO: 2166329 - protein, 10 aa, Cryptosporidium hominis
VEARKKNAGF

SEQ ID NO: 2166330 - protein, 5 aa, Cryptosporidium hominis
VEASD

SEQ ID NO: 2166331 - protein, 7 aa, Cryptosporidium hominis
VEDDDSQ

SEQ ID NO: 2166332 - protein, 13 aa, Cryptosporidium hominis
VEDDLGSSKGVAE

SEQ ID NO: 2166333 - protein, 5 aa, Cryptosporidium hominis
VEDKS

SEQ ID NO: 2166334 - protein, 17 aa, Cryptosporidium hominis
VEDSSSEVNQDQENETI

SEQ ID NO: 2166335 - protein, 7 aa, Cryptosporidium hominis
VEDTANT

SEQ ID NO: 2166336 - protein, 16 aa, Cryptosporidium hominis
VEDYPGKKKSYEAEED

SEQ ID NO: 2166337 - protein, 5 aa, Cryptosporidium hominis
VEEAC

SEQ ID NO: 2166338 - protein, 14 aa, Cryptosporidium hominis
VEEDEYPDDEHHIE

SEQ ID NO: 2166339 - protein, 7 aa, Cryptosporidium hominis
VEEDGID

SEQ ID NO: 2166340 - protein, 8 aa, Cryptosporidium hominis
VEEDSIHS

SEQ ID NO: 2166341 - protein, 10 aa, Cryptosporidium hominis
VEEEAEDRRP

SEQ ID NO: 2166342 - protein, 7 aa, Cryptosporidium hominis
VEEECGK

SEQ ID NO: 2166343 - protein, 47 aa, Cryptosporidium hominis
VEEEDEEEDEDDDDEEEGKENDRRKNNNKYHEKEQNEDETKSLDHGK

SEQ ID NO: 2166344 - protein, 11 aa, Cryptosporidium hominis
VEEEQKSGTKM

SEQ ID NO: 2166345 - protein, 5 aa, Cryptosporidium hominis
VEEIA

SEQ ID NO: 2166346 - protein, 7 aa, Cryptosporidium hominis
VEEINSK

SEQ ID NO: 2166347 - protein, 7 aa, Cryptosporidium hominis
VEEPEKP

SEQ ID NO: 2166348 - protein, 4 aa, Cryptosporidium hominis
VEEQ

SEQ ID NO: 2166349 - protein, 9 aa, Cryptosporidium hominis
VEERDTDGS

SEQ ID NO: 2166350 - protein, 4 aa, Cryptosporidium hominis
VEES

SEQ ID NO: 2166351 - protein, 6 aa, Cryptosporidium hominis
VEETND

SEQ ID NO: 2166352 - protein, 9 aa, Cryptosporidium hominis
VEETSARTE

SEQ ID NO: 2166353 - protein, 24 aa, Cryptosporidium hominis
VEEYEEKKKAGEIISDSEPESQPI

SEQ ID NO: 2166354 - protein, 7 aa, Cryptosporidium hominis
VEGEGDQ

SEQ ID NO: 2166355 - protein, 16 aa, Cryptosporidium hominis
VEGGKQGKHEEAEGSK

SEQ ID NO: 2166356 - protein, 6 aa, Cryptosporidium hominis
VEGSLR

SEQ ID NO: 2166357 - protein, 24 aa, Cryptosporidium hominis
VEHGQVNQVDSESLSNINNESCQG

SEQ ID NO: 2166358 - protein, 6 aa, Cryptosporidium hominis
VEHTRD

SEQ ID NO: 2166359 - protein, 14 aa, Cryptosporidium hominis
VEIPTSVNPNEEFS

SEQ ID NO: 2166360 - protein, 10 aa, Cryptosporidium hominis
VEKGEDPNEV

SEQ ID NO: 2166361 - protein, 8 aa, Cryptosporidium hominis
VEKNDYGL

SEQ ID NO: 2166362 - protein, 13 aa, Cryptosporidium hominis
VEKNGDSNQRDNN

SEQ ID NO: 2166363 - protein, 6 aa, Cryptosporidium hominis
VEKPDG

SEQ ID NO: 2166364 - protein, 8 aa, Cryptosporidium hominis
VEKPNPKY

SEQ ID NO: 2166365 - protein, 9 aa, Cryptosporidium hominis
VEKSKSPNF

SEQ ID NO: 2166366 - protein, 11 aa, Cryptosporidium hominis
VEKSQSRSKVS

SEQ ID NO: 2166367 - protein, 11 aa, Cryptosporidium hominis
VEKTGGRYTSA

SEQ ID NO: 2166368 - protein, 17 aa, Cryptosporidium hominis
VELKPNGANIPVNDENK

SEQ ID NO: 2166369 - protein, 11 aa, Cryptosporidium hominis
VELNRDAQTPC

SEQ ID NO: 2166370 - protein, 7 aa, Cryptosporidium hominis
VENETRK

SEQ ID NO: 2166371 - protein, 6 aa, Cryptosporidium hominis
VENGGE

SEQ ID NO: 2166372 - protein, 7 aa, Cryptosporidium hominis
VENGGEL

SEQ ID NO: 2166373 - protein, 14 aa, Cryptosporidium hominis
VENGYIDKDTTLSL

SEQ ID NO: 2166374 - protein, 34 aa, Cryptosporidium hominis
VENKENSQFKSQNKIELGDEKSPRLKTKRVNTTK

SEQ ID NO: 2166375 - protein, 11 aa, Cryptosporidium hominis
VENKETNSRVN

SEQ ID NO: 2166376 - protein, 4 aa, Cryptosporidium hominis
VENL

SEQ ID NO: 2166377 - protein, 5 aa, Cryptosporidium hominis
VENNA

SEQ ID NO: 2166378 - protein, 6 aa, Cryptosporidium hominis
VENNQD

SEQ ID NO: 2166379 - protein, 7 aa, Cryptosporidium hominis
VENNQSS

SEQ ID NO: 2166380 - protein, 10 aa, Cryptosporidium hominis
VENRTQNPDI

SEQ ID NO: 2166381 - protein, 7 aa, Cryptosporidium hominis
VENSGGL

SEQ ID NO: 2166382 - protein, 6 aa, Cryptosporidium hominis
VEPESR

SEQ ID NO: 2166383 - protein, 5 aa, Cryptosporidium hominis
VEPGI

SEQ ID NO: 2166384 - protein, 5 aa, Cryptosporidium hominis
VEPGK

SEQ ID NO: 2166385 - protein, 7 aa, Cryptosporidium hominis
VEPNNKK

SEQ ID NO: 2166386 - protein, 9 aa, Cryptosporidium hominis
VEPNNNPKE

SEQ ID NO: 2166387 - protein, 6 aa, Cryptosporidium hominis
VEQGEL

SEQ ID NO: 2166388 - protein, 4 aa, Cryptosporidium hominis
VEQS

SEQ ID NO: 2166389 - protein, 4 aa, Cryptosporidium hominis
VEQT

SEQ ID NO: 2166390 - protein, 11 aa, Cryptosporidium hominis
VEQTSNREKKR

SEQ ID NO: 2166391 - protein, 9 aa, Cryptosporidium hominis
VERDLPPKR

SEQ ID NO: 2166392 - protein, 6 aa, Cryptosporidium hominis
VERELS

SEQ ID NO: 2166393 - protein, 10 aa, Cryptosporidium hominis
VERTTAPSSM

SEQ ID NO: 2166394 - protein, 16 aa, Cryptosporidium hominis
VERVSSSRNADKFKED

SEQ ID NO: 2166395 - protein, 9 aa, Cryptosporidium hominis
VESDGLGNL

SEQ ID NO: 2166396 - protein, 16 aa, Cryptosporidium hominis
VESDSGDDADEESDFE

SEQ ID NO: 2166397 - protein, 12 aa, Cryptosporidium hominis
VESEKEDVTPDY

SEQ ID NO: 2166398 - protein, 8 aa, Cryptosporidium hominis
VESENNVF

SEQ ID NO: 2166399 - protein, 8 aa, Cryptosporidium hominis
VESGGNEV

SEQ ID NO: 2166400 - protein, 5 aa, Cryptosporidium hominis
VESLG

SEQ ID NO: 2166401 - protein, 15 aa, Cryptosporidium hominis
VESNTNDDDLLNEFN

SEQ ID NO: 2166402 - protein, 17 aa, Cryptosporidium hominis
VESPGDGQISLDGTSTL

SEQ ID NO: 2166403 - protein, 7 aa, Cryptosporidium hominis
VESRKSK

SEQ ID NO: 2166404 - protein, 10 aa, Cryptosporidium hominis
VESSDPNSLG

SEQ ID NO: 2166405 - protein, 24 aa, Cryptosporidium hominis
VESSSPMKEKTTHNQNDLNHSKAE

SEQ ID NO: 2166406 - protein, 11 aa, Cryptosporidium hominis
VESTKKKSIEI

SEQ ID NO: 2166407 - protein, 11 aa, Cryptosporidium hominis
VESTSNSNSYI

SEQ ID NO: 2166408 - protein, 8 aa, Cryptosporidium hominis
VESVSEEA

SEQ ID NO: 2166409 - protein, 20 aa, Cryptosporidium hominis
VESYSNNDENVCKNSKINQQ

SEQ ID NO: 2166410 - protein, 23 aa, Cryptosporidium hominis
VETARRAKPYDPTPGEYKGPQYR

SEQ ID NO: 2166411 - protein, 7 aa, Cryptosporidium hominis
VETDRRK

SEQ ID NO: 2166412 - protein, 4 aa, Cryptosporidium hominis
VETE

SEQ ID NO: 2166413 - protein, 16 aa, Cryptosporidium hominis
VETQNKDKRGSLADEL

SEQ ID NO: 2166414 - protein, 6 aa, Cryptosporidium hominis
VETSEG

SEQ ID NO: 2166415 - protein, 9 aa, Cryptosporidium hominis
VEVDPETEF

SEQ ID NO: 2166416 - protein, 21 aa, Cryptosporidium hominis
VEVTEEDSDGGKGVYKAPKNL

SEQ ID NO: 2166417 - protein, 12 aa, Cryptosporidium hominis
VEYSWPTSGGNV

SEQ ID NO: 2166418 - protein, 5 aa, Cryptosporidium hominis
VFDGT

SEQ ID NO: 2166419 - protein, 13 aa, Cryptosporidium hominis
VFQGSSTNNNSTS

SEQ ID NO: 2166420 - protein, 4 aa, Cryptosporidium hominis
VFSS

SEQ ID NO: 2166421 - protein, 21 aa, Cryptosporidium hominis
VGAEYQESSPVEGTEQKQERH

SEQ ID NO: 2166422 - protein, 10 aa, Cryptosporidium hominis
VGARQGGGIG

SEQ ID NO: 2166423 - protein, 9 aa, Cryptosporidium hominis
VGDGISSSK

SEQ ID NO: 2166424 - protein, 20 aa, Cryptosporidium hominis
VGDQNDDSKSINSNQNLDTS

SEQ ID NO: 2166425 - protein, 8 aa, Cryptosporidium hominis
VGDSPIGD

SEQ ID NO: 2166426 - protein, 10 aa, Cryptosporidium hominis
VGDTAPYKQV

SEQ ID NO: 2166427 - protein, 8 aa, Cryptosporidium hominis
VGDYSDTK

SEQ ID NO: 2166428 - protein, 6 aa, Cryptosporidium hominis
VGEEGF

SEQ ID NO: 2166429 - protein, 5 aa, Cryptosporidium hominis
VGERS

SEQ ID NO: 2166430 - protein, 5 aa, Cryptosporidium hominis
VGESN

SEQ ID NO: 2166431 - protein, 10 aa, Cryptosporidium hominis
VGESNNFNDQ

SEQ ID NO: 2166432 - protein, 14 aa, Cryptosporidium hominis
VGGASSGAASRRRR

SEQ ID NO: 2166433 - protein, 8 aa, Cryptosporidium hominis
VGGEQEKP

SEQ ID NO: 2166434 - protein, 5 aa, Cryptosporidium hominis
VGGGG

SEQ ID NO: 2166435 - protein, 13 aa, Cryptosporidium hominis
VGGGGGVRGEGIE

SEQ ID NO: 2166436 - protein, 5 aa, Cryptosporidium hominis
VGGGS

SEQ ID NO: 2166437 - protein, 9 aa, Cryptosporidium hominis
VGGGSGGGG

SEQ ID NO: 2166438 - protein, 5 aa, Cryptosporidium hominis
VGGGY

SEQ ID NO: 2166439 - protein, 7 aa, Cryptosporidium hominis
VGGKSAV

SEQ ID NO: 2166440 - protein, 14 aa, Cryptosporidium hominis
VGGNQQRTTFTKDD

SEQ ID NO: 2166441 - protein, 11 aa, Cryptosporidium hominis
VGGNSSRRSLN

SEQ ID NO: 2166442 - protein, 15 aa, Cryptosporidium hominis
VGGNTKNPSKVLLCD

SEQ ID NO: 2166443 - protein, 4 aa, Cryptosporidium hominis
VGGP

SEQ ID NO: 2166444 - protein, 6 aa, Cryptosporidium hominis
VGGPFS

SEQ ID NO: 2166445 - protein, 7 aa, Cryptosporidium hominis
VGGPNFA

SEQ ID NO: 2166446 - protein, 8 aa, Cryptosporidium hominis
VGGSDPMN

SEQ ID NO: 2166447 - protein, 13 aa, Cryptosporidium hominis
VGGSPLGGSPIGG

SEQ ID NO: 2166448 - protein, 13 aa, Cryptosporidium hominis
VGGSPLGGSPIGN

SEQ ID NO: 2166449 - protein, 13 aa, Cryptosporidium hominis
VGGSPLKGSPIRG

SEQ ID NO: 2166450 - protein, 23 aa, Cryptosporidium hominis
VGGSTGSNGGNSSSASNGNNSNM

SEQ ID NO: 2166451 - protein, 9 aa, Cryptosporidium hominis
VGGSTTQQS

SEQ ID NO: 2166452 - protein, 26 aa, Cryptosporidium hominis
VGGTGGGTPVQGGITGNPGPQEPSMT

SEQ ID NO: 2166453 - protein, 5 aa, Cryptosporidium hominis
VGHST

SEQ ID NO: 2166454 - protein, 6 aa, Cryptosporidium hominis
VGIEEE

SEQ ID NO: 2166455 - protein, 19 aa, Cryptosporidium hominis
VGIPSDQTIGNNGNNNGNN

SEQ ID NO: 2166456 - protein, 17 aa, Cryptosporidium hominis
VGKDTEKSVKEKETQEV

SEQ ID NO: 2166457 - protein, 9 aa, Cryptosporidium hominis
VGKENGTIT

SEQ ID NO: 2166458 - protein, 85 aa, Cryptosporidium hominis
VGKNRTNGGLKQNNTNSTNVNNNNVNRNKNSNNTNSIKSGKQAYLQNNQSQIQNQNQNQTQSQSQSQNHVEGTNTNYNKSNNKSI

SEQ ID NO: 2166459 - protein, 7 aa, Cryptosporidium hominis
VGKPSDS

SEQ ID NO: 2166460 - protein, 4 aa, Cryptosporidium hominis
VGKS

SEQ ID NO: 2166461 - protein, 7 aa, Cryptosporidium hominis
VGKSTNL

SEQ ID NO: 2166462 - protein, 9 aa, Cryptosporidium hominis
VGLPENKPR

SEQ ID NO: 2166463 - protein, 16 aa, Cryptosporidium hominis
VGLSKSHTSGDDIRKN

SEQ ID NO: 2166464 - protein, 8 aa, Cryptosporidium hominis
VGLTGEQI

SEQ ID NO: 2166465 - protein, 4 aa, Cryptosporidium hominis
VGMS

SEQ ID NO: 2166466 - protein, 7 aa, Cryptosporidium hominis
VGNDGSL

SEQ ID NO: 2166467 - protein, 7 aa, Cryptosporidium hominis
VGNEEEE

SEQ ID NO: 2166468 - protein, 7 aa, Cryptosporidium hominis
VGNGKTV

SEQ ID NO: 2166469 - protein, 7 aa, Cryptosporidium hominis
VGNKSGM

SEQ ID NO: 2166470 - protein, 10 aa, Cryptosporidium hominis
VGNNEGGKAI

SEQ ID NO: 2166471 - protein, 20 aa, Cryptosporidium hominis
VGNNKRIYNNNNNNNNNNNN

SEQ ID NO: 2166472 - protein, 10 aa, Cryptosporidium hominis
VGNNQTPVSI

SEQ ID NO: 2166473 - protein, 14 aa, Cryptosporidium hominis
VGNPGTDNSGVGIS

SEQ ID NO: 2166474 - protein, 11 aa, Cryptosporidium hominis
VGNSGNVTLPD

SEQ ID NO: 2166475 - protein, 7 aa, Cryptosporidium hominis
VGNSNNY

SEQ ID NO: 2166476 - protein, 17 aa, Cryptosporidium hominis
VGNSNSRENEEKAETLS

SEQ ID NO: 2166477 - protein, 8 aa, Cryptosporidium hominis
VGNSPDRY

SEQ ID NO: 2166478 - protein, 5 aa, Cryptosporidium hominis
VGPDE

SEQ ID NO: 2166479 - protein, 11 aa, Cryptosporidium hominis
VGPDGRETNMA

SEQ ID NO: 2166480 - protein, 6 aa, Cryptosporidium hominis
VGPDLS

SEQ ID NO: 2166481 - protein, 6 aa, Cryptosporidium hominis
VGPEGS

SEQ ID NO: 2166482 - protein, 5 aa, Cryptosporidium hominis
VGPEQ

SEQ ID NO: 2166483 - protein, 13 aa, Cryptosporidium hominis
VGPETLSNSNKKR

SEQ ID NO: 2166484 - protein, 4 aa, Cryptosporidium hominis
VGPG

SEQ ID NO: 2166485 - protein, 10 aa, Cryptosporidium hominis
VGPGGNVSSQ

SEQ ID NO: 2166486 - protein, 12 aa, Cryptosporidium hominis
VGPIGGNGSMNV

SEQ ID NO: 2166487 - protein, 8 aa, Cryptosporidium hominis
VGPNGSTL

SEQ ID NO: 2166488 - protein, 6 aa, Cryptosporidium hominis
VGPPGA

SEQ ID NO: 2166489 - protein, 5 aa, Cryptosporidium hominis
VGPSQ

SEQ ID NO: 2166490 - protein, 10 aa, Cryptosporidium hominis
VGQPHSPNPM

SEQ ID NO: 2166491 - protein, 29 aa, Cryptosporidium hominis
VGQSQNNELHQSETKGELMDSQGNNSNKP

SEQ ID NO: 2166492 - protein, 6 aa, Cryptosporidium hominis
VGQTHA

SEQ ID NO: 2166493 - protein, 6 aa, Cryptosporidium hominis
VGREIS

SEQ ID NO: 2166494 - protein, 5 aa, Cryptosporidium hominis
VGRHG

SEQ ID NO: 2166495 - protein, 6 aa, Cryptosporidium hominis
VGRNED

SEQ ID NO: 2166496 - protein, 29 aa, Cryptosporidium hominis
VGRPTNAASSNGNQSGSGGIGGGGSGNVI

SEQ ID NO: 2166497 - protein, 17 aa, Cryptosporidium hominis
VGSEEKIDYKDNTKRES

SEQ ID NO: 2166498 - protein, 35 aa, Cryptosporidium hominis
VGSEHSPNKDFNGVENPVKPKKPRKSNSSSSGEKQ

SEQ ID NO: 2166499 - protein, 12 aa, Cryptosporidium hominis
VGSEPKKPTKKI

SEQ ID NO: 2166500 - protein, 8 aa, Cryptosporidium hominis
VGSGHLDS

SEQ ID NO: 2166501 - protein, 13 aa, Cryptosporidium hominis
VGSIEKENVSKEP

SEQ ID NO: 2166502 - protein, 14 aa, Cryptosporidium hominis
VGSLDNKDINDINE

SEQ ID NO: 2166503 - protein, 8 aa, Cryptosporidium hominis
VGSNPEEK

SEQ ID NO: 2166504 - protein, 8 aa, Cryptosporidium hominis
VGSPKSAI

SEQ ID NO: 2166505 - protein, 6 aa, Cryptosporidium hominis
VGSTAS

SEQ ID NO: 2166506 - protein, 38 aa, Cryptosporidium hominis
VGTGTGTGTGTGTGGLGSGQGGGTGGDVGSGVGMTKSQ

SEQ ID NO: 2166507 - protein, 16 aa, Cryptosporidium hominis
VGTKRHDSQSGGERDI

SEQ ID NO: 2166508 - protein, 8 aa, Cryptosporidium hominis
VGTPNNNN

SEQ ID NO: 2166509 - protein, 18 aa, Cryptosporidium hominis
VGTPNVNIPNSQPSPFGG

SEQ ID NO: 2166510 - protein, 7 aa, Cryptosporidium hominis
VGVSPSP

SEQ ID NO: 2166511 - protein, 8 aa, Cryptosporidium hominis
VGYAPKDL

SEQ ID NO: 2166512 - protein, 16 aa, Cryptosporidium hominis
VGYNTKGVGMTEEKSV

SEQ ID NO: 2166513 - protein, 4 aa, Cryptosporidium hominis
VHDE

SEQ ID NO: 2166514 - protein, 7 aa, Cryptosporidium hominis
VHDTQGL

SEQ ID NO: 2166515 - protein, 13 aa, Cryptosporidium hominis
VHEQNQLNAQASK

SEQ ID NO: 2166516 - protein, 4 aa, Cryptosporidium hominis
VHGE

SEQ ID NO: 2166517 - protein, 5 aa, Cryptosporidium hominis
VHYPG

SEQ ID NO: 2166518 - protein, 4 aa, Cryptosporidium hominis
VIDD

SEQ ID NO: 2166519 - protein, 28 aa, Cryptosporidium hominis
VIEEDDSEEEKDSVKKEERNKNKKPENI

SEQ ID NO: 2166520 - protein, 12 aa, Cryptosporidium hominis
VIEPGTGTATSG

SEQ ID NO: 2166521 - protein, 15 aa, Cryptosporidium hominis
VIGDQGSISSMDPIG

SEQ ID NO: 2166522 - protein, 18 aa, Cryptosporidium hominis
VINGNNSSIISDTKLDKD

SEQ ID NO: 2166523 - protein, 16 aa, Cryptosporidium hominis
VIPRKRGAKKRLFKFC

SEQ ID NO: 2166524 - protein, 8 aa, Cryptosporidium hominis
VIPSPNSL

SEQ ID NO: 2166525 - protein, 8 aa, Cryptosporidium hominis
VIPSPTKN

SEQ ID NO: 2166526 - protein, 9 aa, Cryptosporidium hominis
VISPKPPNA

SEQ ID NO: 2166527 - protein, 5 aa, Cryptosporidium hominis
VITET

SEQ ID NO: 2166528 - protein, 14 aa, Cryptosporidium hominis
VKAEDKKKASALTK

SEQ ID NO: 2166529 - protein, 32 aa, Cryptosporidium hominis
VKAISSASNEVKSSNINSREANNSEAINYTTN

SEQ ID NO: 2166530 - protein, 22 aa, Cryptosporidium hominis
VKAKTKSKAKAKAREEPTSCTT

SEQ ID NO: 2166531 - protein, 9 aa, Cryptosporidium hominis
VKARAGKAT

SEQ ID NO: 2166532 - protein, 19 aa, Cryptosporidium hominis
VKDEDKSFDISSKNRQITN

SEQ ID NO: 2166533 - protein, 5 aa, Cryptosporidium hominis
VKDEN

SEQ ID NO: 2166534 - protein, 8 aa, Cryptosporidium hominis
VKDEPEEN

SEQ ID NO: 2166535 - protein, 47 aa, Cryptosporidium hominis
VKDKVRKRKDKKLSDEEYKNQIDNGESEEEKEEEQVQEQDESESEKI

SEQ ID NO: 2166536 - protein, 10 aa, Cryptosporidium hominis
VKDNGENTDY

SEQ ID NO: 2166537 - protein, 7 aa, Cryptosporidium hominis
VKDNNKL

SEQ ID NO: 2166538 - protein, 7 aa, Cryptosporidium hominis
VKDRQVK

SEQ ID NO: 2166539 - protein, 15 aa, Cryptosporidium hominis
VKDSIEKSCKAYNSK

SEQ ID NO: 2166540 - protein, 10 aa, Cryptosporidium hominis
VKDSSQQQQK

SEQ ID NO: 2166541 - protein, 291 aa, Cryptosporidium hominis
VKEDNETKDNEDEAAKVRAQKEKEEAEAKALKEKEEAEAKANKEKEEAEAKALKEKEEAEAKAKKEKEEAEAKAKKEKEEAEAKAKKEKEEAEAKALKEKEEAEAKAKKEKEEAEAKAKKEKEEAEAKALKEKEEAEAKAKKEKEETEAKAKKEKEEAEAKAKKEKEEAEAKAKKEKEEAEAKALKEKEEAEAKAKKEKEEAEAKAKKEKEEAEAKAKKEKEEAEAKALKEKEEAEAKGKKEKEEAEAKAKKEKEETDAKEKEKTKIKEDSKIDSDSEENSESKEKKSTGL

SEQ ID NO: 2166542 - protein, 4 aa, Cryptosporidium hominis
VKEG

SEQ ID NO: 2166543 - protein, 21 aa, Cryptosporidium hominis
VKEHEKEITKTRVDQKVNDYN

SEQ ID NO: 2166544 - protein, 7 aa, Cryptosporidium hominis
VKEKNSK

SEQ ID NO: 2166545 - protein, 8 aa, Cryptosporidium hominis
VKERYDKK

SEQ ID NO: 2166546 - protein, 7 aa, Cryptosporidium hominis
VKESESA

SEQ ID NO: 2166547 - protein, 8 aa, Cryptosporidium hominis
VKESGDKR

SEQ ID NO: 2166548 - protein, 18 aa, Cryptosporidium hominis
VKESSNTQEKIKSENEHD

SEQ ID NO: 2166549 - protein, 8 aa, Cryptosporidium hominis
VKEYPSSP

SEQ ID NO: 2166550 - protein, 15 aa, Cryptosporidium hominis
VKGGLKKDYLDSNDV

SEQ ID NO: 2166551 - protein, 80 aa, Cryptosporidium hominis
VKGKPPGPPPPLKSKSALSLKSSGNIGTESAAASKVPGSSGKRAPPPKAPPPLKPPPKRGATSQGFGGPPGASDPEISGG

SEQ ID NO: 2166552 - protein, 14 aa, Cryptosporidium hominis
VKGNTTAKDFEKEG

SEQ ID NO: 2166553 - protein, 4 aa, Cryptosporidium hominis
VKGR

SEQ ID NO: 2166554 - protein, 15 aa, Cryptosporidium hominis
VKGSSGGGRGNESMG

SEQ ID NO: 2166555 - protein, 11 aa, Cryptosporidium hominis
VKGTSGKPDHI

SEQ ID NO: 2166556 - protein, 19 aa, Cryptosporidium hominis
VKHRKRSEATFDANSVNRK

SEQ ID NO: 2166557 - protein, 29 aa, Cryptosporidium hominis
VKKAKYSKRKYNNNNAYSYNANNQKPQYN

SEQ ID NO: 2166558 - protein, 8 aa, Cryptosporidium hominis
VKKANGEI

SEQ ID NO: 2166559 - protein, 10 aa, Cryptosporidium hominis
VKKENKKNKL

SEQ ID NO: 2166560 - protein, 7 aa, Cryptosporidium hominis
VKKGDRL

SEQ ID NO: 2166561 - protein, 9 aa, Cryptosporidium hominis
VKKGLNSQD

SEQ ID NO: 2166562 - protein, 4 aa, Cryptosporidium hominis
VKKN

SEQ ID NO: 2166563 - protein, 21 aa, Cryptosporidium hominis
VKKPSIASSLPKRVANYNYPG

SEQ ID NO: 2166564 - protein, 8 aa, Cryptosporidium hominis
VKKSRTSL

SEQ ID NO: 2166565 - protein, 7 aa, Cryptosporidium hominis
VKKTEER

SEQ ID NO: 2166566 - protein, 12 aa, Cryptosporidium hominis
VKLEENNTFENN

SEQ ID NO: 2166567 - protein, 48 aa, Cryptosporidium hominis
VKLTSDKQAISESKEESFENNELEAETVEDEVPTMKQDSAPEHNQFLD

SEQ ID NO: 2166568 - protein, 17 aa, Cryptosporidium hominis
VKNDNLNALDNGNQTEN

SEQ ID NO: 2166569 - protein, 7 aa, Cryptosporidium hominis
VKNESVE

SEQ ID NO: 2166570 - protein, 10 aa, Cryptosporidium hominis
VKNEVKSSGI

SEQ ID NO: 2166571 - protein, 14 aa, Cryptosporidium hominis
VKNKNYTDKTARSS

SEQ ID NO: 2166572 - protein, 7 aa, Cryptosporidium hominis
VKNNPEK

SEQ ID NO: 2166573 - protein, 73 aa, Cryptosporidium hominis
VKNPAPISNQAQQKPEEPKKSEPASNNPPAADAPAAQAPPAPAEPAPQDKPAEAPAAEAPAAEPAAQQDKPAD

SEQ ID NO: 2166574 - protein, 6 aa, Cryptosporidium hominis
VKNPSS

SEQ ID NO: 2166575 - protein, 22 aa, Cryptosporidium hominis
VKNRSSADLKAGKSIKDALEDE

SEQ ID NO: 2166576 - protein, 6 aa, Cryptosporidium hominis
VKNSRQ

SEQ ID NO: 2166577 - protein, 15 aa, Cryptosporidium hominis
VKPALEKEKAALDSA

SEQ ID NO: 2166578 - protein, 7 aa, Cryptosporidium hominis
VKPDSKE

SEQ ID NO: 2166579 - protein, 9 aa, Cryptosporidium hominis
VKPGNTNTY

SEQ ID NO: 2166580 - protein, 9 aa, Cryptosporidium hominis
VKPKESHSI

SEQ ID NO: 2166581 - protein, 5 aa, Cryptosporidium hominis
VKPLA

SEQ ID NO: 2166582 - protein, 5 aa, Cryptosporidium hominis
VKPPR

SEQ ID NO: 2166583 - protein, 15 aa, Cryptosporidium hominis
VKPSAETAEEEHNKV

SEQ ID NO: 2166584 - protein, 6 aa, Cryptosporidium hominis
VKPSDV

SEQ ID NO: 2166585 - protein, 7 aa, Cryptosporidium hominis
VKPSSSL

SEQ ID NO: 2166586 - protein, 10 aa, Cryptosporidium hominis
VKQEGSTIKE

SEQ ID NO: 2166587 - protein, 10 aa, Cryptosporidium hominis
VKQEGYSVDH

SEQ ID NO: 2166588 - protein, 9 aa, Cryptosporidium hominis
VKRPKGPKD

SEQ ID NO: 2166589 - protein, 8 aa, Cryptosporidium hominis
VKRPKWTD

SEQ ID NO: 2166590 - protein, 8 aa, Cryptosporidium hominis
VKRPTDTI

SEQ ID NO: 2166591 - protein, 11 aa, Cryptosporidium hominis
VKRTSNPSIKA

SEQ ID NO: 2166592 - protein, 13 aa, Cryptosporidium hominis
VKSEFQESIQNLL

SEQ ID NO: 2166593 - protein, 17 aa, Cryptosporidium hominis
VKSGGGFGSGSSNQQMT

SEQ ID NO: 2166594 - protein, 4 aa, Cryptosporidium hominis
VKSK

SEQ ID NO: 2166595 - protein, 43 aa, Cryptosporidium hominis
VKSPKKKTSQIHGESKTNKKKGNLSSASKNLKKNDLKDSKKQT

SEQ ID NO: 2166596 - protein, 10 aa, Cryptosporidium hominis
VKSPSTEKIE

SEQ ID NO: 2166597 - protein, 14 aa, Cryptosporidium hominis
VKSREGGKHHYDPK

SEQ ID NO: 2166598 - protein, 12 aa, Cryptosporidium hominis
VKSSSSQSPEYD

SEQ ID NO: 2166599 - protein, 20 aa, Cryptosporidium hominis
VKSTKKTSENPVPYRNSKKR

SEQ ID NO: 2166600 - protein, 12 aa, Cryptosporidium hominis
VKSTMGKSVRIY

SEQ ID NO: 2166601 - protein, 8 aa, Cryptosporidium hominis
VKSTTDNL

SEQ ID NO: 2166602 - protein, 7 aa, Cryptosporidium hominis
VKTKEDA

SEQ ID NO: 2166603 - protein, 73 aa, Cryptosporidium hominis
VKTNQGNESNQDNGPNQDSESNQDNESNQDNESNQGSSSGNTPKIPTPMPRTKCSGDQGKKPIPKPRTKYSGG

SEQ ID NO: 2166604 - protein, 4 aa, Cryptosporidium hominis
VKTP

SEQ ID NO: 2166605 - protein, 7 aa, Cryptosporidium hominis
VKTQIQT

SEQ ID NO: 2166606 - protein, 11 aa, Cryptosporidium hominis
VKTSKNNINNR

SEQ ID NO: 2166607 - protein, 7 aa, Cryptosporidium hominis
VKTTGKS

SEQ ID NO: 2166608 - protein, 5 aa, Cryptosporidium hominis
VKTTQ

SEQ ID NO: 2166609 - protein, 8 aa, Cryptosporidium hominis
VKTVPGNV

SEQ ID NO: 2166610 - protein, 8 aa, Cryptosporidium hominis
VKVDEQDI

SEQ ID NO: 2166611 - protein, 24 aa, Cryptosporidium hominis
VLAPTASLGTENEITEAGVGSETV

SEQ ID NO: 2166612 - protein, 5 aa, Cryptosporidium hominis
VLDNG

SEQ ID NO: 2166613 - protein, 8 aa, Cryptosporidium hominis
VLGGGSKE

SEQ ID NO: 2166614 - protein, 24 aa, Cryptosporidium hominis
VLGSSGGGSTSSSSSSSSSSSSVT

SEQ ID NO: 2166615 - protein, 9 aa, Cryptosporidium hominis
VLKSGQKNF

SEQ ID NO: 2166616 - protein, 11 aa, Cryptosporidium hominis
VLPNKDKNEIK

SEQ ID NO: 2166617 - protein, 8 aa, Cryptosporidium hominis
VLPPNSKP

SEQ ID NO: 2166618 - protein, 4 aa, Cryptosporidium hominis
VLPQ

SEQ ID NO: 2166619 - protein, 11 aa, Cryptosporidium hominis
VLSGSTSITNT

SEQ ID NO: 2166620 - protein, 4 aa, Cryptosporidium hominis
VLSS

SEQ ID NO: 2166621 - protein, 8 aa, Cryptosporidium hominis
VMDEKSRK

SEQ ID NO: 2166622 - protein, 7 aa, Cryptosporidium hominis
VNAGEDC

SEQ ID NO: 2166623 - protein, 7 aa, Cryptosporidium hominis
VNAPSRL

SEQ ID NO: 2166624 - protein, 27 aa, Cryptosporidium hominis
VNASYSDKNNSEKSPKEGKISKTEKFK

SEQ ID NO: 2166625 - protein, 66 aa, Cryptosporidium hominis
VNDNNEQSGSQPEEIDEENNNKNENPIENESKSIEDEKVEEEQDKVAEEDDENKEIVENEKTLSRE

SEQ ID NO: 2166626 - protein, 4 aa, Cryptosporidium hominis
VNDP

SEQ ID NO: 2166627 - protein, 19 aa, Cryptosporidium hominis
VNDPDHEKKIQVRKLRFGL

SEQ ID NO: 2166628 - protein, 5 aa, Cryptosporidium hominis
VNDPE

SEQ ID NO: 2166629 - protein, 8 aa, Cryptosporidium hominis
VNDPSFLP

SEQ ID NO: 2166630 - protein, 13 aa, Cryptosporidium hominis
VNDPTMQRKDKDI

SEQ ID NO: 2166631 - protein, 14 aa, Cryptosporidium hominis
VNDSESGIQSKSIT

SEQ ID NO: 2166632 - protein, 8 aa, Cryptosporidium hominis
VNDTPANS

SEQ ID NO: 2166633 - protein, 12 aa, Cryptosporidium hominis
VNDYESGKAIPN

SEQ ID NO: 2166634 - protein, 9 aa, Cryptosporidium hominis
VNEATNKLS

SEQ ID NO: 2166635 - protein, 9 aa, Cryptosporidium hominis
VNEDNFSSL

SEQ ID NO: 2166636 - protein, 7 aa, Cryptosporidium hominis
VNEEENK

SEQ ID NO: 2166637 - protein, 7 aa, Cryptosporidium hominis
VNEEKDR

SEQ ID NO: 2166638 - protein, 10 aa, Cryptosporidium hominis
VNEENNKSNL

SEQ ID NO: 2166639 - protein, 9 aa, Cryptosporidium hominis
VNEEPTYEY

SEQ ID NO: 2166640 - protein, 8 aa, Cryptosporidium hominis
VNEGESGL

SEQ ID NO: 2166641 - protein, 6 aa, Cryptosporidium hominis
VNEGVR

SEQ ID NO: 2166642 - protein, 5 aa, Cryptosporidium hominis
VNENQ

SEQ ID NO: 2166643 - protein, 10 aa, Cryptosporidium hominis
VNEPPSPRKI

SEQ ID NO: 2166644 - protein, 6 aa, Cryptosporidium hominis
VNEQKL

SEQ ID NO: 2166645 - protein, 4 aa, Cryptosporidium hominis
VNES

SEQ ID NO: 2166646 - protein, 15 aa, Cryptosporidium hominis
VNESKSLKNEIRTPQ

SEQ ID NO: 2166647 - protein, 8 aa, Cryptosporidium hominis
VNETKDNI

SEQ ID NO: 2166648 - protein, 10 aa, Cryptosporidium hominis
VNGDGTGSIS

SEQ ID NO: 2166649 - protein, 21 aa, Cryptosporidium hominis
VNGGESNKGSTTNENTNEAKI

SEQ ID NO: 2166650 - protein, 6 aa, Cryptosporidium hominis
VNGKSA

SEQ ID NO: 2166651 - protein, 16 aa, Cryptosporidium hominis
VNGKSSNIDQINSNNT

SEQ ID NO: 2166652 - protein, 5 aa, Cryptosporidium hominis
VNGNN

SEQ ID NO: 2166653 - protein, 14 aa, Cryptosporidium hominis
VNHNNNNNNNCNGN

SEQ ID NO: 2166654 - protein, 10 aa, Cryptosporidium hominis
VNIPENNVKK

SEQ ID NO: 2166655 - protein, 7 aa, Cryptosporidium hominis
VNIPETE

SEQ ID NO: 2166656 - protein, 11 aa, Cryptosporidium hominis
VNKEEDEKKKV

SEQ ID NO: 2166657 - protein, 20 aa, Cryptosporidium hominis
VNKENIRSMNQSNKKRKAKT

SEQ ID NO: 2166658 - protein, 14 aa, Cryptosporidium hominis
VNKGNNVSNKDGRT

SEQ ID NO: 2166659 - protein, 21 aa, Cryptosporidium hominis
VNKKAKQDLEGNNTGKSQENM

SEQ ID NO: 2166660 - protein, 10 aa, Cryptosporidium hominis
VNKKERREAS

SEQ ID NO: 2166661 - protein, 15 aa, Cryptosporidium hominis
VNKNAERPLLKAKDK

SEQ ID NO: 2166662 - protein, 29 aa, Cryptosporidium hominis
VNKPNNTNTGATTTINTNTNTNNTANTIG

SEQ ID NO: 2166663 - protein, 14 aa, Cryptosporidium hominis
VNKRGLSKTNNTII

SEQ ID NO: 2166664 - protein, 16 aa, Cryptosporidium hominis
VNKRRADETHKEPLAA

SEQ ID NO: 2166665 - protein, 23 aa, Cryptosporidium hominis
VNKSFNTEKNLSSTLSSGKDSVK

SEQ ID NO: 2166666 - protein, 11 aa, Cryptosporidium hominis
VNKSLKEEVQV

SEQ ID NO: 2166667 - protein, 14 aa, Cryptosporidium hominis
VNLSKRAGQLSQEE

SEQ ID NO: 2166668 - protein, 5 aa, Cryptosporidium hominis
VNNED

SEQ ID NO: 2166669 - protein, 16 aa, Cryptosporidium hominis
VNNEDTSLNTRAGTPY

SEQ ID NO: 2166670 - protein, 7 aa, Cryptosporidium hominis
VNNEKLD

SEQ ID NO: 2166671 - protein, 11 aa, Cryptosporidium hominis
VNNFDSGNEIY

SEQ ID NO: 2166672 - protein, 15 aa, Cryptosporidium hominis
VNNGNVSNANGSNNF

SEQ ID NO: 2166673 - protein, 7 aa, Cryptosporidium hominis
VNNGTWG

SEQ ID NO: 2166674 - protein, 6 aa, Cryptosporidium hominis
VNNKES

SEQ ID NO: 2166675 - protein, 11 aa, Cryptosporidium hominis
VNNKKTTTIQT

SEQ ID NO: 2166676 - protein, 4 aa, Cryptosporidium hominis
VNNN

SEQ ID NO: 2166677 - protein, 9 aa, Cryptosporidium hominis
VNNNDDEGK

SEQ ID NO: 2166678 - protein, 7 aa, Cryptosporidium hominis
VNNNING

SEQ ID NO: 2166679 - protein, 5 aa, Cryptosporidium hominis
VNNNL

SEQ ID NO: 2166680 - protein, 19 aa, Cryptosporidium hominis
VNNNSSNNNSNSNSSNTIN

SEQ ID NO: 2166681 - protein, 18 aa, Cryptosporidium hominis
VNNNSTQNESNDYNANSQ

SEQ ID NO: 2166682 - protein, 6 aa, Cryptosporidium hominis
VNNPPV

SEQ ID NO: 2166683 - protein, 4 aa, Cryptosporidium hominis
VNNQ

SEQ ID NO: 2166684 - protein, 15 aa, Cryptosporidium hominis
VNNREKIPDKGSYTG

SEQ ID NO: 2166685 - protein, 6 aa, Cryptosporidium hominis
VNNRGR

SEQ ID NO: 2166686 - protein, 32 aa, Cryptosporidium hominis
VNNSEDIQTEDSKTEDVLPNKDSKEKPEEQSA

SEQ ID NO: 2166687 - protein, 7 aa, Cryptosporidium hominis
VNNSGAE

SEQ ID NO: 2166688 - protein, 23 aa, Cryptosporidium hominis
VNNSSNNIGNNSSNGNNGGVGGG

SEQ ID NO: 2166689 - protein, 38 aa, Cryptosporidium hominis
VNNTTTNSSFDSSQKSEEIQQESEKENEQENVESIPPR

SEQ ID NO: 2166690 - protein, 88 aa, Cryptosporidium hominis
VNNVGSSNKNFSINNGGVKDQYYSTHRDNSDKGQHSNVTNNNSTYITGNDDNSKPSHAKNNKPEKIQPNHHQQQNHQQQRQQQHHQQH

SEQ ID NO: 2166691 - protein, 4 aa, Cryptosporidium hominis
VNPD

SEQ ID NO: 2166692 - protein, 12 aa, Cryptosporidium hominis
VNPEEKRPRKSV

SEQ ID NO: 2166693 - protein, 7 aa, Cryptosporidium hominis
VNPENGN

SEQ ID NO: 2166694 - protein, 6 aa, Cryptosporidium hominis
VNPGTY

SEQ ID NO: 2166695 - protein, 5 aa, Cryptosporidium hominis
VNPHD

SEQ ID NO: 2166696 - protein, 9 aa, Cryptosporidium hominis
VNPKDNRYK

SEQ ID NO: 2166697 - protein, 9 aa, Cryptosporidium hominis
VNPNDNQKE

SEQ ID NO: 2166698 - protein, 21 aa, Cryptosporidium hominis
VNPNSASSLQISTSQPSSQKL

SEQ ID NO: 2166699 - protein, 8 aa, Cryptosporidium hominis
VNPPTVAP

SEQ ID NO: 2166700 - protein, 9 aa, Cryptosporidium hominis
VNPPTVASG

SEQ ID NO: 2166701 - protein, 5 aa, Cryptosporidium hominis
VNPSE

SEQ ID NO: 2166702 - protein, 5 aa, Cryptosporidium hominis
VNPYP

SEQ ID NO: 2166703 - protein, 17 aa, Cryptosporidium hominis
VNQKNYKNDKSVFSSFL

SEQ ID NO: 2166704 - protein, 11 aa, Cryptosporidium hominis
VNQKPNIGRQN

SEQ ID NO: 2166705 - protein, 17 aa, Cryptosporidium hominis
VNQKQISSLEERMKFMK

SEQ ID NO: 2166706 - protein, 5 aa, Cryptosporidium hominis
VNQKY

SEQ ID NO: 2166707 - protein, 12 aa, Cryptosporidium hominis
VNQTQEENNREP

SEQ ID NO: 2166708 - protein, 39 aa, Cryptosporidium hominis
VNQTRSSAKKVRRRRNNDDRQEDAESENQDRSKSDQEQR

SEQ ID NO: 2166709 - protein, 12 aa, Cryptosporidium hominis
VNRGRGGSSNLN

SEQ ID NO: 2166710 - protein, 14 aa, Cryptosporidium hominis
VNSDESKENKSNIS

SEQ ID NO: 2166711 - protein, 5 aa, Cryptosporidium hominis
VNSDR

SEQ ID NO: 2166712 - protein, 13 aa, Cryptosporidium hominis
VNSDSPKKARYEN

SEQ ID NO: 2166713 - protein, 7 aa, Cryptosporidium hominis
VNSETRR

SEQ ID NO: 2166714 - protein, 16 aa, Cryptosporidium hominis
VNSGEVELDDQQTPPN

SEQ ID NO: 2166715 - protein, 14 aa, Cryptosporidium hominis
VNSGSNSNSNSNME

SEQ ID NO: 2166716 - protein, 11 aa, Cryptosporidium hominis
VNSKGEKVTPE

SEQ ID NO: 2166717 - protein, 5 aa, Cryptosporidium hominis
VNSKN

SEQ ID NO: 2166718 - protein, 15 aa, Cryptosporidium hominis
VNSKYKEVLNTLRSQ

SEQ ID NO: 2166719 - protein, 7 aa, Cryptosporidium hominis
VNSNNTV

SEQ ID NO: 2166720 - protein, 7 aa, Cryptosporidium hominis
VNSNSFN

SEQ ID NO: 2166721 - protein, 7 aa, Cryptosporidium hominis
VNSNSLR

SEQ ID NO: 2166722 - protein, 9 aa, Cryptosporidium hominis
VNSNSNNNF

SEQ ID NO: 2166723 - protein, 5 aa, Cryptosporidium hominis
VNSPN

SEQ ID NO: 2166724 - protein, 9 aa, Cryptosporidium hominis
VNSQGRPAL

SEQ ID NO: 2166725 - protein, 5 aa, Cryptosporidium hominis
VNSRI

SEQ ID NO: 2166726 - protein, 8 aa, Cryptosporidium hominis
VNSRNNPS

SEQ ID NO: 2166727 - protein, 12 aa, Cryptosporidium hominis
VNSRNSIQNSNI

SEQ ID NO: 2166728 - protein, 11 aa, Cryptosporidium hominis
VNSRSYTNIPY

SEQ ID NO: 2166729 - protein, 23 aa, Cryptosporidium hominis
VNSSLNSEELSANSDSSNTDCAG

SEQ ID NO: 2166730 - protein, 7 aa, Cryptosporidium hominis
VNSSTEV

SEQ ID NO: 2166731 - protein, 9 aa, Cryptosporidium hominis
VNTASSTGI

SEQ ID NO: 2166732 - protein, 13 aa, Cryptosporidium hominis
VNTETGNNSDNVN

SEQ ID NO: 2166733 - protein, 7 aa, Cryptosporidium hominis
VNTNANN

SEQ ID NO: 2166734 - protein, 10 aa, Cryptosporidium hominis
VNTQEYGRRP

SEQ ID NO: 2166735 - protein, 29 aa, Cryptosporidium hominis
VNYSMKNSSKSNNNNNNNTNNNKGGDQKV

SEQ ID NO: 2166736 - protein, 4 aa, Cryptosporidium hominis
VPAE

SEQ ID NO: 2166737 - protein, 15 aa, Cryptosporidium hominis
VPAPDEKTYKETTEA

SEQ ID NO: 2166738 - protein, 10 aa, Cryptosporidium hominis
VPATASNNLA

SEQ ID NO: 2166739 - protein, 8 aa, Cryptosporidium hominis
VPDASNGV

SEQ ID NO: 2166740 - protein, 7 aa, Cryptosporidium hominis
VPDDNGR

SEQ ID NO: 2166741 - protein, 15 aa, Cryptosporidium hominis
VPDKKSLPNNLEASN

SEQ ID NO: 2166742 - protein, 8 aa, Cryptosporidium hominis
VPDKPQHS

SEQ ID NO: 2166743 - protein, 7 aa, Cryptosporidium hominis
VPDMKKT

SEQ ID NO: 2166744 - protein, 10 aa, Cryptosporidium hominis
VPDPSENAAK

SEQ ID NO: 2166745 - protein, 8 aa, Cryptosporidium hominis
VPDTPFKE

SEQ ID NO: 2166746 - protein, 12 aa, Cryptosporidium hominis
VPDYDPNNVNNN

SEQ ID NO: 2166747 - protein, 13 aa, Cryptosporidium hominis
VPEDLRKTSPTGH

SEQ ID NO: 2166748 - protein, 9 aa, Cryptosporidium hominis
VPEGESNDL

SEQ ID NO: 2166749 - protein, 5 aa, Cryptosporidium hominis
VPEIG

SEQ ID NO: 2166750 - protein, 16 aa, Cryptosporidium hominis
VPENENKNNTSLNVTK

SEQ ID NO: 2166751 - protein, 17 aa, Cryptosporidium hominis
VPENTTPLGSSPTTDSA

SEQ ID NO: 2166752 - protein, 6 aa, Cryptosporidium hominis
VPEPDY

SEQ ID NO: 2166753 - protein, 6 aa, Cryptosporidium hominis
VPEPKI

SEQ ID NO: 2166754 - protein, 6 aa, Cryptosporidium hominis
VPGENG

SEQ ID NO: 2166755 - protein, 8 aa, Cryptosporidium hominis
VPGGGACE

SEQ ID NO: 2166756 - protein, 6 aa, Cryptosporidium hominis
VPGGGS

SEQ ID NO: 2166757 - protein, 8 aa, Cryptosporidium hominis
VPGGSIST

SEQ ID NO: 2166758 - protein, 5 aa, Cryptosporidium hominis
VPGPG

SEQ ID NO: 2166759 - protein, 6 aa, Cryptosporidium hominis
VPGPKN

SEQ ID NO: 2166760 - protein, 15 aa, Cryptosporidium hominis
VPGQKQAQRDPLFAN

SEQ ID NO: 2166761 - protein, 17 aa, Cryptosporidium hominis
VPGSAVTTASISGGSQM

SEQ ID NO: 2166762 - protein, 10 aa, Cryptosporidium hominis
VPGSSRGGRI

SEQ ID NO: 2166763 - protein, 5 aa, Cryptosporidium hominis
VPGTL

SEQ ID NO: 2166764 - protein, 8 aa, Cryptosporidium hominis
VPGTSTTG

SEQ ID NO: 2166765 - protein, 4 aa, Cryptosporidium hominis
VPIG

SEQ ID NO: 2166766 - protein, 8 aa, Cryptosporidium hominis
VPIGATPE

SEQ ID NO: 2166767 - protein, 5 aa, Cryptosporidium hominis
VPIPD

SEQ ID NO: 2166768 - protein, 15 aa, Cryptosporidium hominis
VPKDEKSDKYHQTQE

SEQ ID NO: 2166769 - protein, 9 aa, Cryptosporidium hominis
VPKDTNAAV

SEQ ID NO: 2166770 - protein, 5 aa, Cryptosporidium hominis
VPKED

SEQ ID NO: 2166771 - protein, 5 aa, Cryptosporidium hominis
VPKEY

SEQ ID NO: 2166772 - protein, 4 aa, Cryptosporidium hominis
VPKK

SEQ ID NO: 2166773 - protein, 11 aa, Cryptosporidium hominis
VPKKDDSVDGM

SEQ ID NO: 2166774 - protein, 11 aa, Cryptosporidium hominis
VPKPQKNNVPK

SEQ ID NO: 2166775 - protein, 11 aa, Cryptosporidium hominis
VPKRPQQASIR

SEQ ID NO: 2166776 - protein, 9 aa, Cryptosporidium hominis
VPLESSDRT

SEQ ID NO: 2166777 - protein, 5 aa, Cryptosporidium hominis
VPNAL

SEQ ID NO: 2166778 - protein, 6 aa, Cryptosporidium hominis
VPNDSH

SEQ ID NO: 2166779 - protein, 7 aa, Cryptosporidium hominis
VPNDYEP

SEQ ID NO: 2166780 - protein, 4 aa, Cryptosporidium hominis
VPNG

SEQ ID NO: 2166781 - protein, 10 aa, Cryptosporidium hominis
VPNNASPHEL

SEQ ID NO: 2166782 - protein, 6 aa, Cryptosporidium hominis
VPNNGF

SEQ ID NO: 2166783 - protein, 7 aa, Cryptosporidium hominis
VPNNTRE

SEQ ID NO: 2166784 - protein, 6 aa, Cryptosporidium hominis
VPNQPY

SEQ ID NO: 2166785 - protein, 10 aa, Cryptosporidium hominis
VPNQQGQQDK

SEQ ID NO: 2166786 - protein, 6 aa, Cryptosporidium hominis
VPNRTN

SEQ ID NO: 2166787 - protein, 7 aa, Cryptosporidium hominis
VPNTKGI

SEQ ID NO: 2166788 - protein, 5 aa, Cryptosporidium hominis
VPPEI

SEQ ID NO: 2166789 - protein, 8 aa, Cryptosporidium hominis
VPPENASS

SEQ ID NO: 2166790 - protein, 8 aa, Cryptosporidium hominis
VPPEPDVE

SEQ ID NO: 2166791 - protein, 5 aa, Cryptosporidium hominis
VPPET

SEQ ID NO: 2166792 - protein, 9 aa, Cryptosporidium hominis
VPPKTNPRV

SEQ ID NO: 2166793 - protein, 17 aa, Cryptosporidium hominis
VPPQPNSPSDYVFREDQ

SEQ ID NO: 2166794 - protein, 28 aa, Cryptosporidium hominis
VPPRNSTVGTDDSSSPSSSTISRQSRPN

SEQ ID NO: 2166795 - protein, 10 aa, Cryptosporidium hominis
VPPSSSPTIT

SEQ ID NO: 2166796 - protein, 6 aa, Cryptosporidium hominis
VPPTGV

SEQ ID NO: 2166797 - protein, 5 aa, Cryptosporidium hominis
VPQEG

SEQ ID NO: 2166798 - protein, 6 aa, Cryptosporidium hominis
VPQGKA

SEQ ID NO: 2166799 - protein, 10 aa, Cryptosporidium hominis
VPRGSPPELR

SEQ ID NO: 2166800 - protein, 5 aa, Cryptosporidium hominis
VPRPG

SEQ ID NO: 2166801 - protein, 7 aa, Cryptosporidium hominis
VPSDEEL

SEQ ID NO: 2166802 - protein, 5 aa, Cryptosporidium hominis
VPSGV

SEQ ID NO: 2166803 - protein, 8 aa, Cryptosporidium hominis
VPSQNNSN

SEQ ID NO: 2166804 - protein, 7 aa, Cryptosporidium hominis
VPSSEAF

SEQ ID NO: 2166805 - protein, 19 aa, Cryptosporidium hominis
VPSSPMPSPEREQHNSGIG

SEQ ID NO: 2166806 - protein, 8 aa, Cryptosporidium hominis
VPSSQATV

SEQ ID NO: 2166807 - protein, 11 aa, Cryptosporidium hominis
VPSTSELKSNE

SEQ ID NO: 2166808 - protein, 10 aa, Cryptosporidium hominis
VPTDGATGQP

SEQ ID NO: 2166809 - protein, 5 aa, Cryptosporidium hominis
VPTDK

SEQ ID NO: 2166810 - protein, 11 aa, Cryptosporidium hominis
VPTNNNGSKFK

SEQ ID NO: 2166811 - protein, 21 aa, Cryptosporidium hominis
VPTSAASAPTNSSSISPTANV

SEQ ID NO: 2166812 - protein, 7 aa, Cryptosporidium hominis
VPVGDDK

SEQ ID NO: 2166813 - protein, 105 aa, Cryptosporidium hominis
VPVKPSPLLKSKSEKEKEKEEDKDEEKKEKEDKEKKEKLKEKEEEGKEKEEGKEKEKEKDKDEKDKSKSKIKESQKEEKLEETEKDSSKKESKDEEKKEKEDPIA

SEQ ID NO: 2166814 - protein, 110 aa, Cryptosporidium hominis
VPVKPSPLLKSKSEKEKEKEEDKDEKKEKEDKEKKEKLKEKEEEGKEKEEGKEKEKDKDKDEKDKSKSKTKDFEKEKLKETEKGEKEAEKDTSKKESKDEEKKEKEDPIA

SEQ ID NO: 2166815 - protein, 97 aa, Cryptosporidium hominis
VPVKPSPLLKSKSEKEKEKEEDKDEKKEKEDKEKKEKLKEKEEEGKEKEEGKEKEKEKVKAQKKKDEKEEKDNDEKEDDKEKSKESENLEKKPTISE

SEQ ID NO: 2166816 - protein, 4 aa, Cryptosporidium hominis
VPYC

SEQ ID NO: 2166817 - protein, 5 aa, Cryptosporidium hominis
VPYNG

SEQ ID NO: 2166818 - protein, 4 aa, Cryptosporidium hominis
VPYR

SEQ ID NO: 2166819 - protein, 10 aa, Cryptosporidium hominis
VPYSESNNKS

SEQ ID NO: 2166820 - protein, 6 aa, Cryptosporidium hominis
VQADTR

SEQ ID NO: 2166821 - protein, 9 aa, Cryptosporidium hominis
VQDDGPDSS

SEQ ID NO: 2166822 - protein, 15 aa, Cryptosporidium hominis
VQDEEVEGSGAEEIS

SEQ ID NO: 2166823 - protein, 10 aa, Cryptosporidium hominis
VQDGTDDPSQ

SEQ ID NO: 2166824 - protein, 9 aa, Cryptosporidium hominis
VQDTSNNSM

SEQ ID NO: 2166825 - protein, 6 aa, Cryptosporidium hominis
VQEAEE

SEQ ID NO: 2166826 - protein, 6 aa, Cryptosporidium hominis
VQEKNL

SEQ ID NO: 2166827 - protein, 4 aa, Cryptosporidium hominis
VQET

SEQ ID NO: 2166828 - protein, 16 aa, Cryptosporidium hominis
VQGNGQGGRPGSHGHQ

SEQ ID NO: 2166829 - protein, 9 aa, Cryptosporidium hominis
VQGSNKSNN

SEQ ID NO: 2166830 - protein, 6 aa, Cryptosporidium hominis
VQGTEG

SEQ ID NO: 2166831 - protein, 9 aa, Cryptosporidium hominis
VQGTTYPGS

SEQ ID NO: 2166832 - protein, 6 aa, Cryptosporidium hominis
VQIPRY

SEQ ID NO: 2166833 - protein, 11 aa, Cryptosporidium hominis
VQKVSSKLSKI

SEQ ID NO: 2166834 - protein, 4 aa, Cryptosporidium hominis
VQKY

SEQ ID NO: 2166835 - protein, 11 aa, Cryptosporidium hominis
VQNDDSSTEYS

SEQ ID NO: 2166836 - protein, 7 aa, Cryptosporidium hominis
VQNNINQ

SEQ ID NO: 2166837 - protein, 12 aa, Cryptosporidium hominis
VQNNQQAGQDFN

SEQ ID NO: 2166838 - protein, 7 aa, Cryptosporidium hominis
VQNSGGN

SEQ ID NO: 2166839 - protein, 5 aa, Cryptosporidium hominis
VQNSN

SEQ ID NO: 2166840 - protein, 6 aa, Cryptosporidium hominis
VQPFGS

SEQ ID NO: 2166841 - protein, 8 aa, Cryptosporidium hominis
VQPRRSQT

SEQ ID NO: 2166842 - protein, 10 aa, Cryptosporidium hominis
VQPSQNHSMN

SEQ ID NO: 2166843 - protein, 8 aa, Cryptosporidium hominis
VQQAREDA

SEQ ID NO: 2166844 - protein, 14 aa, Cryptosporidium hominis
VQQEDESSSQNDCN

SEQ ID NO: 2166845 - protein, 4 aa, Cryptosporidium hominis
VQQR

SEQ ID NO: 2166846 - protein, 6 aa, Cryptosporidium hominis
VQRQED

SEQ ID NO: 2166847 - protein, 10 aa, Cryptosporidium hominis
VQRTEKGKEV

SEQ ID NO: 2166848 - protein, 7 aa, Cryptosporidium hominis
VQSKGAQ

SEQ ID NO: 2166849 - protein, 16 aa, Cryptosporidium hominis
VQSKGQSRTKLSEKQD

SEQ ID NO: 2166850 - protein, 7 aa, Cryptosporidium hominis
VQSPERL

SEQ ID NO: 2166851 - protein, 6 aa, Cryptosporidium hominis
VQSSGT

SEQ ID NO: 2166852 - protein, 7 aa, Cryptosporidium hominis
VQSTNSA

SEQ ID NO: 2166853 - protein, 19 aa, Cryptosporidium hominis
VQSTTDESLNATSSAIATN

SEQ ID NO: 2166854 - protein, 7 aa, Cryptosporidium hominis
VQSYTSY

SEQ ID NO: 2166855 - protein, 49 aa, Cryptosporidium hominis
VQTAGSAGASNASNLNASNVSNNNSSSAPNYDNQEDYLSEQQGVSDSNV

SEQ ID NO: 2166856 - protein, 6 aa, Cryptosporidium hominis
VQTATH

SEQ ID NO: 2166857 - protein, 23 aa, Cryptosporidium hominis
VQTNDTTSINISPTTSGGDDDNL

SEQ ID NO: 2166858 - protein, 10 aa, Cryptosporidium hominis
VQTSTNTSMV

SEQ ID NO: 2166859 - protein, 11 aa, Cryptosporidium hominis
VQYEPKKGRYI

SEQ ID NO: 2166860 - protein, 8 aa, Cryptosporidium hominis
VQYSNKEN

SEQ ID NO: 2166861 - protein, 4 aa, Cryptosporidium hominis
VRAS

SEQ ID NO: 2166862 - protein, 11 aa, Cryptosporidium hominis
VRDNPTRFATS

SEQ ID NO: 2166863 - protein, 21 aa, Cryptosporidium hominis
VRDNRNIDTNNSSNPKVKSNS

SEQ ID NO: 2166864 - protein, 9 aa, Cryptosporidium hominis
VREKDPTRS

SEQ ID NO: 2166865 - protein, 10 aa, Cryptosporidium hominis
VRENDPNRAL

SEQ ID NO: 2166866 - protein, 11 aa, Cryptosporidium hominis
VRERKVTRGDQ

SEQ ID NO: 2166867 - protein, 4 aa, Cryptosporidium hominis
VRET

SEQ ID NO: 2166868 - protein, 5 aa, Cryptosporidium hominis
VRFPT

SEQ ID NO: 2166869 - protein, 12 aa, Cryptosporidium hominis
VRFSTKGSLGSG

SEQ ID NO: 2166870 - protein, 6 aa, Cryptosporidium hominis
VRGPSR

SEQ ID NO: 2166871 - protein, 12 aa, Cryptosporidium hominis
VRGSSGDKYRQQ

SEQ ID NO: 2166872 - protein, 7 aa, Cryptosporidium hominis
VRKSGVP

SEQ ID NO: 2166873 - protein, 33 aa, Cryptosporidium hominis
VRKTKGVKDESDENDSDSEENDDDNEYEERSNS

SEQ ID NO: 2166874 - protein, 6 aa, Cryptosporidium hominis
VRMDTD

SEQ ID NO: 2166875 - protein, 7 aa, Cryptosporidium hominis
VRNRPNF

SEQ ID NO: 2166876 - protein, 12 aa, Cryptosporidium hominis
VRNTEKITNDNY

SEQ ID NO: 2166877 - protein, 8 aa, Cryptosporidium hominis
VRPDNSQV

SEQ ID NO: 2166878 - protein, 15 aa, Cryptosporidium hominis
VRPDSKYTGRKRKSG

SEQ ID NO: 2166879 - protein, 6 aa, Cryptosporidium hominis
VRPENT

SEQ ID NO: 2166880 - protein, 6 aa, Cryptosporidium hominis
VRPSKN

SEQ ID NO: 2166881 - protein, 20 aa, Cryptosporidium hominis
VRQGKEKELAKANAKGPDIN

SEQ ID NO: 2166882 - protein, 24 aa, Cryptosporidium hominis
VRRDERGVPITSGPVVGSKVGEKA

SEQ ID NO: 2166883 - protein, 7 aa, Cryptosporidium hominis
VRRKQSN

SEQ ID NO: 2166884 - protein, 9 aa, Cryptosporidium hominis
VRSDGTKEI

SEQ ID NO: 2166885 - protein, 7 aa, Cryptosporidium hominis
VRSSGTC

SEQ ID NO: 2166886 - protein, 10 aa, Cryptosporidium hominis
VRSVNESNDF

SEQ ID NO: 2166887 - protein, 6 aa, Cryptosporidium hominis
VRTGSY

SEQ ID NO: 2166888 - protein, 5 aa, Cryptosporidium hominis
VRTPT

SEQ ID NO: 2166889 - protein, 17 aa, Cryptosporidium hominis
VRTRDHQEQQKKCSAIQ

SEQ ID NO: 2166890 - protein, 4 aa, Cryptosporidium hominis
VRTS

SEQ ID NO: 2166891 - protein, 7 aa, Cryptosporidium hominis
VRTTGKT

SEQ ID NO: 2166892 - protein, 22 aa, Cryptosporidium hominis
VSAGDATNSRTTVGKNEEGDLK

SEQ ID NO: 2166893 - protein, 20 aa, Cryptosporidium hominis
VSALNTSSSRISSMENTKLN

SEQ ID NO: 2166894 - protein, 4 aa, Cryptosporidium hominis
VSAN

SEQ ID NO: 2166895 - protein, 8 aa, Cryptosporidium hominis
VSAQQNVR

SEQ ID NO: 2166896 - protein, 9 aa, Cryptosporidium hominis
VSAQRNTED

SEQ ID NO: 2166897 - protein, 10 aa, Cryptosporidium hominis
VSASDACSAY

SEQ ID NO: 2166898 - protein, 17 aa, Cryptosporidium hominis
VSASPHASLPPQSVSDL

SEQ ID NO: 2166899 - protein, 14 aa, Cryptosporidium hominis
VSASRSSYLGTQSI

SEQ ID NO: 2166900 - protein, 17 aa, Cryptosporidium hominis
VSATGANAVQAGHHPPC

SEQ ID NO: 2166901 - protein, 6 aa, Cryptosporidium hominis
VSDDGT

SEQ ID NO: 2166902 - protein, 7 aa, Cryptosporidium hominis
VSDDKAI

SEQ ID NO: 2166903 - protein, 6 aa, Cryptosporidium hominis
VSDDNY

SEQ ID NO: 2166904 - protein, 6 aa, Cryptosporidium hominis
VSDEEV

SEQ ID NO: 2166905 - protein, 15 aa, Cryptosporidium hominis
VSDENCGTNFGTGGM

SEQ ID NO: 2166906 - protein, 37 aa, Cryptosporidium hominis
VSDNNSNNVQNQSSGVSTNSSYTAGGGHTSNIGASNV

SEQ ID NO: 2166907 - protein, 13 aa, Cryptosporidium hominis
VSDPDSNDSKGDA

SEQ ID NO: 2166908 - protein, 6 aa, Cryptosporidium hominis
VSDPKL

SEQ ID NO: 2166909 - protein, 13 aa, Cryptosporidium hominis
VSDQTKVNNTSNE

SEQ ID NO: 2166910 - protein, 10 aa, Cryptosporidium hominis
VSDSISGAQK

SEQ ID NO: 2166911 - protein, 4 aa, Cryptosporidium hominis
VSED

SEQ ID NO: 2166912 - protein, 5 aa, Cryptosporidium hominis
VSEDD

SEQ ID NO: 2166913 - protein, 9 aa, Cryptosporidium hominis
VSEDSSRIE

SEQ ID NO: 2166914 - protein, 4 aa, Cryptosporidium hominis
VSEE

SEQ ID NO: 2166915 - protein, 7 aa, Cryptosporidium hominis
VSEEENS

SEQ ID NO: 2166916 - protein, 12 aa, Cryptosporidium hominis
VSEEKSQDIIQD

SEQ ID NO: 2166917 - protein, 12 aa, Cryptosporidium hominis
VSEERKKTQQAL

SEQ ID NO: 2166918 - protein, 8 aa, Cryptosporidium hominis
VSEETTTG

SEQ ID NO: 2166919 - protein, 6 aa, Cryptosporidium hominis
VSEFRS

SEQ ID NO: 2166920 - protein, 6 aa, Cryptosporidium hominis
VSEGIN

SEQ ID NO: 2166921 - protein, 9 aa, Cryptosporidium hominis
VSEKKRDEI

SEQ ID NO: 2166922 - protein, 32 aa, Cryptosporidium hominis
VSEKRRNDEQQSVPKRVPNKRASSSPNTGVSR

SEQ ID NO: 2166923 - protein, 7 aa, Cryptosporidium hominis
VSEKSDD

SEQ ID NO: 2166924 - protein, 30 aa, Cryptosporidium hominis
VSENATRRSSRINKNGYDSDSLNYEQSSTF

SEQ ID NO: 2166925 - protein, 6 aa, Cryptosporidium hominis
VSENDT

SEQ ID NO: 2166926 - protein, 7 aa, Cryptosporidium hominis
VSENENY

SEQ ID NO: 2166927 - protein, 7 aa, Cryptosporidium hominis
VSENRTA

SEQ ID NO: 2166928 - protein, 8 aa, Cryptosporidium hominis
VSEPDNKK

SEQ ID NO: 2166929 - protein, 6 aa, Cryptosporidium hominis
VSEQAK

SEQ ID NO: 2166930 - protein, 8 aa, Cryptosporidium hominis
VSESLQRK

SEQ ID NO: 2166931 - protein, 6 aa, Cryptosporidium hominis
VSETSI

SEQ ID NO: 2166932 - protein, 10 aa, Cryptosporidium hominis
VSGDYSAATI

SEQ ID NO: 2166933 - protein, 6 aa, Cryptosporidium hominis
VSGEFE

SEQ ID NO: 2166934 - protein, 7 aa, Cryptosporidium hominis
VSGKRSV

SEQ ID NO: 2166935 - protein, 18 aa, Cryptosporidium hominis
VSGRKRRLSSDDEETPIK

SEQ ID NO: 2166936 - protein, 8 aa, Cryptosporidium hominis
VSGTGWDV

SEQ ID NO: 2166937 - protein, 21 aa, Cryptosporidium hominis
VSGTPGKPSVPGTSGVGNSSN

SEQ ID NO: 2166938 - protein, 8 aa, Cryptosporidium hominis
VSGTSEAS

SEQ ID NO: 2166939 - protein, 8 aa, Cryptosporidium hominis
VSHSNTHP

SEQ ID NO: 2166940 - protein, 8 aa, Cryptosporidium hominis
VSHTHGNP

SEQ ID NO: 2166941 - protein, 11 aa, Cryptosporidium hominis
VSIDSSGPTIP

SEQ ID NO: 2166942 - protein, 18 aa, Cryptosporidium hominis
VSIDTSSSDSESEKSATT

SEQ ID NO: 2166943 - protein, 19 aa, Cryptosporidium hominis
VSISNQVGGSLSSKSEESI

SEQ ID NO: 2166944 - protein, 8 aa, Cryptosporidium hominis
VSKDITNK

SEQ ID NO: 2166945 - protein, 4 aa, Cryptosporidium hominis
VSKG

SEQ ID NO: 2166946 - protein, 12 aa, Cryptosporidium hominis
VSKHREGSTGTN

SEQ ID NO: 2166947 - protein, 8 aa, Cryptosporidium hominis
VSKIGRNL

SEQ ID NO: 2166948 - protein, 10 aa, Cryptosporidium hominis
VSKMEEDSQV

SEQ ID NO: 2166949 - protein, 12 aa, Cryptosporidium hominis
VSKNAPSGEYLS

SEQ ID NO: 2166950 - protein, 26 aa, Cryptosporidium hominis
VSKNLSGQAEKDLTENSSEAPNQSRK

SEQ ID NO: 2166951 - protein, 10 aa, Cryptosporidium hominis
VSKPDDSDVI

SEQ ID NO: 2166952 - protein, 6 aa, Cryptosporidium hominis
VSKPGW

SEQ ID NO: 2166953 - protein, 7 aa, Cryptosporidium hominis
VSKPPEV

SEQ ID NO: 2166954 - protein, 19 aa, Cryptosporidium hominis
VSKRSNPDTETSSSSGVEA

SEQ ID NO: 2166955 - protein, 7 aa, Cryptosporidium hominis
VSKSEEE

SEQ ID NO: 2166956 - protein, 15 aa, Cryptosporidium hominis
VSLNSGGNNEKKNRW

SEQ ID NO: 2166957 - protein, 10 aa, Cryptosporidium hominis
VSNDSDKSDR

SEQ ID NO: 2166958 - protein, 9 aa, Cryptosporidium hominis
VSNEGSHGD

SEQ ID NO: 2166959 - protein, 5 aa, Cryptosporidium hominis
VSNES

SEQ ID NO: 2166960 - protein, 10 aa, Cryptosporidium hominis
VSNGSHPSNV

SEQ ID NO: 2166961 - protein, 16 aa, Cryptosporidium hominis
VSNGYDKQYRTNSIAT

SEQ ID NO: 2166962 - protein, 15 aa, Cryptosporidium hominis
VSNHNSNANSPIDPN

SEQ ID NO: 2166963 - protein, 8 aa, Cryptosporidium hominis
VSNKNDEE

SEQ ID NO: 2166964 - protein, 20 aa, Cryptosporidium hominis
VSNNNMNGNSTVSGFSTQSD

SEQ ID NO: 2166965 - protein, 9 aa, Cryptosporidium hominis
VSNNSSRSK

SEQ ID NO: 2166966 - protein, 7 aa, Cryptosporidium hominis
VSNPGSH

SEQ ID NO: 2166967 - protein, 10 aa, Cryptosporidium hominis
VSNQDETTSE

SEQ ID NO: 2166968 - protein, 19 aa, Cryptosporidium hominis
VSNQVDTDSKISLISTNSK

SEQ ID NO: 2166969 - protein, 8 aa, Cryptosporidium hominis
VSNRQGSS

SEQ ID NO: 2166970 - protein, 17 aa, Cryptosporidium hominis
VSNSANKSGNKSKKRNV

SEQ ID NO: 2166971 - protein, 6 aa, Cryptosporidium hominis
VSNSEV

SEQ ID NO: 2166972 - protein, 6 aa, Cryptosporidium hominis
VSNSGW

SEQ ID NO: 2166973 - protein, 14 aa, Cryptosporidium hominis
VSNSSKSQYNGTNI

SEQ ID NO: 2166974 - protein, 8 aa, Cryptosporidium hominis
VSNTSGKC

SEQ ID NO: 2166975 - protein, 10 aa, Cryptosporidium hominis
VSNTTDKTAL

SEQ ID NO: 2166976 - protein, 4 aa, Cryptosporidium hominis
VSNY

SEQ ID NO: 2166977 - protein, 21 aa, Cryptosporidium hominis
VSPDAKRIKDSNDSEDDYASE

SEQ ID NO: 2166978 - protein, 6 aa, Cryptosporidium hominis
VSPDGQ

SEQ ID NO: 2166979 - protein, 4 aa, Cryptosporidium hominis
VSPG

SEQ ID NO: 2166980 - protein, 6 aa, Cryptosporidium hominis
VSPHET

SEQ ID NO: 2166981 - protein, 7 aa, Cryptosporidium hominis
VSPHPEL

SEQ ID NO: 2166982 - protein, 4 aa, Cryptosporidium hominis
VSPN

SEQ ID NO: 2166983 - protein, 15 aa, Cryptosporidium hominis
VSPPGGDFSDPVTTA

SEQ ID NO: 2166984 - protein, 26 aa, Cryptosporidium hominis
VSPPGYGKSGKLTNSKIGNNSETISS

SEQ ID NO: 2166985 - protein, 9 aa, Cryptosporidium hominis
VSPPTVASG

SEQ ID NO: 2166986 - protein, 7 aa, Cryptosporidium hominis
VSPRNNS

SEQ ID NO: 2166987 - protein, 9 aa, Cryptosporidium hominis
VSPRPDKEP

SEQ ID NO: 2166988 - protein, 16 aa, Cryptosporidium hominis
VSPSKTPGTGVNPPPI

SEQ ID NO: 2166989 - protein, 30 aa, Cryptosporidium hominis
VSPSSHSKSIVEPTKDQTVNNYSATPLSDN

SEQ ID NO: 2166990 - protein, 6 aa, Cryptosporidium hominis
VSPSTI

SEQ ID NO: 2166991 - protein, 6 aa, Cryptosporidium hominis
VSPTHY

SEQ ID NO: 2166992 - protein, 16 aa, Cryptosporidium hominis
VSPTNTSRPSKYSPGC

SEQ ID NO: 2166993 - protein, 9 aa, Cryptosporidium hominis
VSPTTGASG

SEQ ID NO: 2166994 - protein, 8 aa, Cryptosporidium hominis
VSQAKDDK

SEQ ID NO: 2166995 - protein, 6 aa, Cryptosporidium hominis
VSQESP

SEQ ID NO: 2166996 - protein, 5 aa, Cryptosporidium hominis
VSQKA

SEQ ID NO: 2166997 - protein, 6 aa, Cryptosporidium hominis
VSQKEK

SEQ ID NO: 2166998 - protein, 16 aa, Cryptosporidium hominis
VSQNEEALSPNTYNIK

SEQ ID NO: 2166999 - protein, 9 aa, Cryptosporidium hominis
VSQNSPGQV

SEQ ID NO: 2167000 - protein, 8 aa, Cryptosporidium hominis
VSQPNNLE

SEQ ID NO: 2167001 - protein, 17 aa, Cryptosporidium hominis
VSQSDPVNDSDINDIPR

SEQ ID NO: 2167002 - protein, 14 aa, Cryptosporidium hominis
VSQTPEVSSSGENY

SEQ ID NO: 2167003 - protein, 13 aa, Cryptosporidium hominis
VSQTQNDTSSEIN

SEQ ID NO: 2167004 - protein, 12 aa, Cryptosporidium hominis
VSQVSNKASYKL

SEQ ID NO: 2167005 - protein, 11 aa, Cryptosporidium hominis
VSRGKDLSSST

SEQ ID NO: 2167006 - protein, 35 aa, Cryptosporidium hominis
VSRNRSTSLNQSSYENPEKGRNNHRKIETPQNEPN

SEQ ID NO: 2167007 - protein, 33 aa, Cryptosporidium hominis
VSRPNDYSQALQSSSSSTAVGGSGTNIQSPYNS

SEQ ID NO: 2167008 - protein, 4 aa, Cryptosporidium hominis
VSRS

SEQ ID NO: 2167009 - protein, 12 aa, Cryptosporidium hominis
VSRTAGGPTRIQ

SEQ ID NO: 2167010 - protein, 4 aa, Cryptosporidium hominis
VSSD

SEQ ID NO: 2167011 - protein, 7 aa, Cryptosporidium hominis
VSSDGSY

SEQ ID NO: 2167012 - protein, 17 aa, Cryptosporidium hominis
VSSEIKETTRDVANEDI

SEQ ID NO: 2167013 - protein, 5 aa, Cryptosporidium hominis
VSSEN

SEQ ID NO: 2167014 - protein, 30 aa, Cryptosporidium hominis
VSSETKSNNASKSNSSYSVTNAARPSNSIR

SEQ ID NO: 2167015 - protein, 19 aa, Cryptosporidium hominis
VSSETVNTNRNGAENMSSP

SEQ ID NO: 2167016 - protein, 4 aa, Cryptosporidium hominis
VSSI

SEQ ID NO: 2167017 - protein, 8 aa, Cryptosporidium hominis
VSSIGNGT

SEQ ID NO: 2167018 - protein, 52 aa, Cryptosporidium hominis
VSSKEETNQIEPTVKNDDKKDQLDKTNTVSTNNSESEKVVEKKDNMETIPEK

SEQ ID NO: 2167019 - protein, 7 aa, Cryptosporidium hominis
VSSLGRV

SEQ ID NO: 2167020 - protein, 7 aa, Cryptosporidium hominis
VSSLPNE

SEQ ID NO: 2167021 - protein, 9 aa, Cryptosporidium hominis
VSSNKEESL

SEQ ID NO: 2167022 - protein, 23 aa, Cryptosporidium hominis
VSSNSNGIKGGASNASNSHDPNN

SEQ ID NO: 2167023 - protein, 10 aa, Cryptosporidium hominis
VSSNSTGKGM

SEQ ID NO: 2167024 - protein, 10 aa, Cryptosporidium hominis
VSSPNKPGKI

SEQ ID NO: 2167025 - protein, 10 aa, Cryptosporidium hominis
VSSPNSIPNM

SEQ ID NO: 2167026 - protein, 7 aa, Cryptosporidium hominis
VSSPNTF

SEQ ID NO: 2167027 - protein, 6 aa, Cryptosporidium hominis
VSSSES

SEQ ID NO: 2167028 - protein, 7 aa, Cryptosporidium hominis
VSSSGEY

SEQ ID NO: 2167029 - protein, 13 aa, Cryptosporidium hominis
VSSSSSEGVPTQE

SEQ ID NO: 2167030 - protein, 26 aa, Cryptosporidium hominis
VSSSSSKKESGGENTNLDDPTQNSLS

SEQ ID NO: 2167031 - protein, 19 aa, Cryptosporidium hominis
VSSSSSSSLQSLSYSDGDL

SEQ ID NO: 2167032 - protein, 8 aa, Cryptosporidium hominis
VSSTGDQI

SEQ ID NO: 2167033 - protein, 11 aa, Cryptosporidium hominis
VSSTGGKKEVK

SEQ ID NO: 2167034 - protein, 6 aa, Cryptosporidium hominis
VSSTPI

SEQ ID NO: 2167035 - protein, 16 aa, Cryptosporidium hominis
VSSVESEGFDPSQLPS

SEQ ID NO: 2167036 - protein, 8 aa, Cryptosporidium hominis
VSTFSPDG

SEQ ID NO: 2167037 - protein, 41 aa, Cryptosporidium hominis
VSTKRKNIPGYNRGRGMGPGGGFRGGMGRGGFRGGYSRGGM

SEQ ID NO: 2167038 - protein, 13 aa, Cryptosporidium hominis
VSTNEDGKGLKGN

SEQ ID NO: 2167039 - protein, 83 aa, Cryptosporidium hominis
VSTNNNNNNNNNNSNNNNNNNNNNNDNDSDNDNDNDNDNDNDNDNDNDNDNDNDNDNDNDNDNDNDNDNDNDNDNDNDSGNNI

SEQ ID NO: 2167040 - protein, 11 aa, Cryptosporidium hominis
VSTPGGSTQAG

SEQ ID NO: 2167041 - protein, 5 aa, Cryptosporidium hominis
VSTQA

SEQ ID NO: 2167042 - protein, 13 aa, Cryptosporidium hominis
VSTQTSKVAATTG

SEQ ID NO: 2167043 - protein, 5 aa, Cryptosporidium hominis
VSTRK

SEQ ID NO: 2167044 - protein, 16 aa, Cryptosporidium hominis
VSTRNSRKGRVSNRGR

SEQ ID NO: 2167045 - protein, 24 aa, Cryptosporidium hominis
VSTSSSSTSASSPTPSSSNPIDTS

SEQ ID NO: 2167046 - protein, 9 aa, Cryptosporidium hominis
VSTTLSAPK

SEQ ID NO: 2167047 - protein, 11 aa, Cryptosporidium hominis
VSTTSSLGSIS

SEQ ID NO: 2167048 - protein, 5 aa, Cryptosporidium hominis
VSVNP

SEQ ID NO: 2167049 - protein, 28 aa, Cryptosporidium hominis
VSVSSASTVVTKNKSGINDEYDNNNNVS

SEQ ID NO: 2167050 - protein, 4 aa, Cryptosporidium hominis
VTAD

SEQ ID NO: 2167051 - protein, 18 aa, Cryptosporidium hominis
VTASNNNAANHSPPSISS

SEQ ID NO: 2167052 - protein, 31 aa, Cryptosporidium hominis
VTATGRKGRKETKNRRKKVRGTEKAKISGGK

SEQ ID NO: 2167053 - protein, 5 aa, Cryptosporidium hominis
VTDDT

SEQ ID NO: 2167054 - protein, 4 aa, Cryptosporidium hominis
VTDG

SEQ ID NO: 2167055 - protein, 10 aa, Cryptosporidium hominis
VTDPENKSIG

SEQ ID NO: 2167056 - protein, 7 aa, Cryptosporidium hominis
VTEDNDK

SEQ ID NO: 2167057 - protein, 8 aa, Cryptosporidium hominis
VTEDPECQ

SEQ ID NO: 2167058 - protein, 5 aa, Cryptosporidium hominis
VTEDQ

SEQ ID NO: 2167059 - protein, 6 aa, Cryptosporidium hominis
VTEEND

SEQ ID NO: 2167060 - protein, 13 aa, Cryptosporidium hominis
VTEGNGSTGSISF

SEQ ID NO: 2167061 - protein, 9 aa, Cryptosporidium hominis
VTEIEDPNS

SEQ ID NO: 2167062 - protein, 6 aa, Cryptosporidium hominis
VTEKNR

SEQ ID NO: 2167063 - protein, 53 aa, Cryptosporidium hominis
VTEPTNNGGEKMDDSKPCAEPGNNGDVQMEGDNNGAQGAGETSEISQESEMKD

SEQ ID NO: 2167064 - protein, 6 aa, Cryptosporidium hominis
VTEQPG

SEQ ID NO: 2167065 - protein, 8 aa, Cryptosporidium hominis
VTESNGYI

SEQ ID NO: 2167066 - protein, 17 aa, Cryptosporidium hominis
VTESSIEASQSKINECN

SEQ ID NO: 2167067 - protein, 4 aa, Cryptosporidium hominis
VTET

SEQ ID NO: 2167068 - protein, 42 aa, Cryptosporidium hominis
VTETATATATVTETATETVTATETATAAATAGNEENNNDKQT

SEQ ID NO: 2167069 - protein, 12 aa, Cryptosporidium hominis
VTGEASSSVRKG

SEQ ID NO: 2167070 - protein, 4 aa, Cryptosporidium hominis
VTGG

SEQ ID NO: 2167071 - protein, 5 aa, Cryptosporidium hominis
VTGHH

SEQ ID NO: 2167072 - protein, 5 aa, Cryptosporidium hominis
VTGKN

SEQ ID NO: 2167073 - protein, 5 aa, Cryptosporidium hominis
VTGPI

SEQ ID NO: 2167074 - protein, 22 aa, Cryptosporidium hominis
VTGSGIGAGTGGIGSNNEGAGG

SEQ ID NO: 2167075 - protein, 7 aa, Cryptosporidium hominis
VTGTEDK

SEQ ID NO: 2167076 - protein, 4 aa, Cryptosporidium hominis
VTIN

SEQ ID NO: 2167077 - protein, 4 aa, Cryptosporidium hominis
VTKE

SEQ ID NO: 2167078 - protein, 10 aa, Cryptosporidium hominis
VTKIKPPPCI

SEQ ID NO: 2167079 - protein, 10 aa, Cryptosporidium hominis
VTKNKDGSLV

SEQ ID NO: 2167080 - protein, 11 aa, Cryptosporidium hominis
VTKNSTIDEGR

SEQ ID NO: 2167081 - protein, 8 aa, Cryptosporidium hominis
VTKSGVNK

SEQ ID NO: 2167082 - protein, 9 aa, Cryptosporidium hominis
VTKSNENFE

SEQ ID NO: 2167083 - protein, 10 aa, Cryptosporidium hominis
VTKTEKEMEA

SEQ ID NO: 2167084 - protein, 4 aa, Cryptosporidium hominis
VTNA

SEQ ID NO: 2167085 - protein, 4 aa, Cryptosporidium hominis
VTNE

SEQ ID NO: 2167086 - protein, 5 aa, Cryptosporidium hominis
VTNET

SEQ ID NO: 2167087 - protein, 18 aa, Cryptosporidium hominis
VTNNDQVGINKEEQSSYL

SEQ ID NO: 2167088 - protein, 9 aa, Cryptosporidium hominis
VTNNKTDKF

SEQ ID NO: 2167089 - protein, 16 aa, Cryptosporidium hominis
VTNNPEIDGCINAVLL

SEQ ID NO: 2167090 - protein, 7 aa, Cryptosporidium hominis
VTNPEEI

SEQ ID NO: 2167091 - protein, 4 aa, Cryptosporidium hominis
VTNS

SEQ ID NO: 2167092 - protein, 6 aa, Cryptosporidium hominis
VTNSEE

SEQ ID NO: 2167093 - protein, 10 aa, Cryptosporidium hominis
VTNSSEKIPS

SEQ ID NO: 2167094 - protein, 8 aa, Cryptosporidium hominis
VTNSSPSF

SEQ ID NO: 2167095 - protein, 67 aa, Cryptosporidium hominis
VTNTKRPISSKNQSTTTTKTTTTTTTTTTTTTTSTTTTSSYSSADVTNSDTSNEETNTEDSESSELE

SEQ ID NO: 2167096 - protein, 25 aa, Cryptosporidium hominis
VTNTSNSNSATPTESEKGSGPKLSL

SEQ ID NO: 2167097 - protein, 5 aa, Cryptosporidium hominis
VTNVS

SEQ ID NO: 2167098 - protein, 13 aa, Cryptosporidium hominis
VTPDGHNFSTRKR

SEQ ID NO: 2167099 - protein, 8 aa, Cryptosporidium hominis
VTPDSRDD

SEQ ID NO: 2167100 - protein, 5 aa, Cryptosporidium hominis
VTPGH

SEQ ID NO: 2167101 - protein, 15 aa, Cryptosporidium hominis
VTPGSDCPKRASSQE

SEQ ID NO: 2167102 - protein, 5 aa, Cryptosporidium hominis
VTPNA

SEQ ID NO: 2167103 - protein, 8 aa, Cryptosporidium hominis
VTPPPPMN

SEQ ID NO: 2167104 - protein, 9 aa, Cryptosporidium hominis
VTPPTAPGI

SEQ ID NO: 2167105 - protein, 5 aa, Cryptosporidium hominis
VTPRP

SEQ ID NO: 2167106 - protein, 5 aa, Cryptosporidium hominis
VTPRT

SEQ ID NO: 2167107 - protein, 5 aa, Cryptosporidium hominis
VTPSD

SEQ ID NO: 2167108 - protein, 7 aa, Cryptosporidium hominis
VTPSGKQ

SEQ ID NO: 2167109 - protein, 7 aa, Cryptosporidium hominis
VTPSKPH

SEQ ID NO: 2167110 - protein, 5 aa, Cryptosporidium hominis
VTQER

SEQ ID NO: 2167111 - protein, 5 aa, Cryptosporidium hominis
VTQES

SEQ ID NO: 2167112 - protein, 5 aa, Cryptosporidium hominis
VTQGQ

SEQ ID NO: 2167113 - protein, 41 aa, Cryptosporidium hominis
VTQKMDDSEFESVSEKDEQFKASKVKRSTKKRKKKGTDSID

SEQ ID NO: 2167114 - protein, 10 aa, Cryptosporidium hominis
VTQKSVNSTV

SEQ ID NO: 2167115 - protein, 8 aa, Cryptosporidium hominis
VTQNISSQ

SEQ ID NO: 2167116 - protein, 8 aa, Cryptosporidium hominis
VTQNKKDT

SEQ ID NO: 2167117 - protein, 5 aa, Cryptosporidium hominis
VTQPI

SEQ ID NO: 2167118 - protein, 7 aa, Cryptosporidium hominis
VTQSNLT

SEQ ID NO: 2167119 - protein, 9 aa, Cryptosporidium hominis
VTRESSQDW

SEQ ID NO: 2167120 - protein, 8 aa, Cryptosporidium hominis
VTRQSYDE

SEQ ID NO: 2167121 - protein, 11 aa, Cryptosporidium hominis
VTSDEGRELAD

SEQ ID NO: 2167122 - protein, 9 aa, Cryptosporidium hominis
VTSEDEGKL

SEQ ID NO: 2167123 - protein, 8 aa, Cryptosporidium hominis
VTSGTEKD

SEQ ID NO: 2167124 - protein, 9 aa, Cryptosporidium hominis
VTSPELTPQ

SEQ ID NO: 2167125 - protein, 14 aa, Cryptosporidium hominis
VTSPENKDKSKHLS

SEQ ID NO: 2167126 - protein, 9 aa, Cryptosporidium hominis
VTSQGPGTS

SEQ ID NO: 2167127 - protein, 16 aa, Cryptosporidium hominis
VTSRSRNQSRPISPVE

SEQ ID NO: 2167128 - protein, 13 aa, Cryptosporidium hominis
VTSSTTASSPSAI

SEQ ID NO: 2167129 - protein, 14 aa, Cryptosporidium hominis
VTSTSTNDQSITSE

SEQ ID NO: 2167130 - protein, 4 aa, Cryptosporidium hominis
VTTK

SEQ ID NO: 2167131 - protein, 7 aa, Cryptosporidium hominis
VTTLSGG

SEQ ID NO: 2167132 - protein, 16 aa, Cryptosporidium hominis
VTTPQAIDNCHTLCSA

SEQ ID NO: 2167133 - protein, 6 aa, Cryptosporidium hominis
VTTPQE

SEQ ID NO: 2167134 - protein, 12 aa, Cryptosporidium hominis
VTTSINTPNTIC

SEQ ID NO: 2167135 - protein, 13 aa, Cryptosporidium hominis
VTTTKGEKTLSPN

SEQ ID NO: 2167136 - protein, 8 aa, Cryptosporidium hominis
VTTTTQIQ

SEQ ID NO: 2167137 - protein, 31 aa, Cryptosporidium hominis
VTYEKSETYTSQRPEPRTPTCQNSSPGVQSS

SEQ ID NO: 2167138 - protein, 11 aa, Cryptosporidium hominis
VVESNSSQSNL

SEQ ID NO: 2167139 - protein, 4 aa, Cryptosporidium hominis
VVGG

SEQ ID NO: 2167140 - protein, 12 aa, Cryptosporidium hominis
VVGGPSNINFPT

SEQ ID NO: 2167141 - protein, 7 aa, Cryptosporidium hominis
VVNGKGS

SEQ ID NO: 2167142 - protein, 4 aa, Cryptosporidium hominis
VVPG

SEQ ID NO: 2167143 - protein, 11 aa, Cryptosporidium hominis
VVPGGGASEIA

SEQ ID NO: 2167144 - protein, 22 aa, Cryptosporidium hominis
VVPQSSSYIRPQSRTKNCESVE

SEQ ID NO: 2167145 - protein, 7 aa, Cryptosporidium hominis
VVPTKKS

SEQ ID NO: 2167146 - protein, 23 aa, Cryptosporidium hominis
VVSPNQSARQHQGKDSSGSSIGE

SEQ ID NO: 2167147 - protein, 7 aa, Cryptosporidium hominis
VVSSQQE

SEQ ID NO: 2167148 - protein, 8 aa, Cryptosporidium hominis
VVSSTQDI

SEQ ID NO: 2167149 - protein, 12 aa, Cryptosporidium hominis
VVTEPESRLSSS

SEQ ID NO: 2167150 - protein, 38 aa, Cryptosporidium hominis
VVTNSNKSSNNSINKAGYNNNNSSINGNNNINNNTNVG

SEQ ID NO: 2167151 - protein, 45 aa, Cryptosporidium hominis
VYDPPRSSSLPEDTISASGHSRSRSNIENQQHQHSSPIDTEKSEC

SEQ ID NO: 2167152 - protein, 12 aa, Cryptosporidium hominis
VYDPPRSSSSLA

SEQ ID NO: 2167153 - protein, 7 aa, Cryptosporidium hominis
VYEPSED

SEQ ID NO: 2167154 - protein, 9 aa, Cryptosporidium hominis
VYGDNSNNI

SEQ ID NO: 2167155 - protein, 16 aa, Cryptosporidium hominis
VYGDSKERSKQEEYKN

SEQ ID NO: 2167156 - protein, 7 aa, Cryptosporidium hominis
VYGNTTN

SEQ ID NO: 2167157 - protein, 6 aa, Cryptosporidium hominis
VYGPKG

SEQ ID NO: 2167158 - protein, 7 aa, Cryptosporidium hominis
VYNPRTR

SEQ ID NO: 2167159 - protein, 6 aa, Cryptosporidium hominis
VYPPSD

SEQ ID NO: 2167160 - protein, 13 aa, Cryptosporidium hominis
VYTSGKSSTAAGL

SEQ ID NO: 2167161 - protein, 4 aa, Cryptosporidium hominis
WAAG

SEQ ID NO: 2167162 - protein, 4 aa, Cryptosporidium hominis
WADE

SEQ ID NO: 2167163 - protein, 11 aa, Cryptosporidium hominis
WAPHQPTCNTG

SEQ ID NO: 2167164 - protein, 25 aa, Cryptosporidium hominis
WASTSSSGESDTEPELTSFYPHFNS

SEQ ID NO: 2167165 - protein, 7 aa, Cryptosporidium hominis
WDDISNN

SEQ ID NO: 2167166 - protein, 6 aa, Cryptosporidium hominis
WDDSRD

SEQ ID NO: 2167167 - protein, 19 aa, Cryptosporidium hominis
WDETQKELHNAKNSLSDVS

SEQ ID NO: 2167168 - protein, 6 aa, Cryptosporidium hominis
WDPNDK

SEQ ID NO: 2167169 - protein, 7 aa, Cryptosporidium hominis
WDQSDKS

SEQ ID NO: 2167170 - protein, 6 aa, Cryptosporidium hominis
WDRTSQ

SEQ ID NO: 2167171 - protein, 15 aa, Cryptosporidium hominis
WDSNSKSDQLNTSQD

SEQ ID NO: 2167172 - protein, 12 aa, Cryptosporidium hominis
WDSRDSYKIRDL

SEQ ID NO: 2167173 - protein, 4 aa, Cryptosporidium hominis
WDTQ

SEQ ID NO: 2167174 - protein, 16 aa, Cryptosporidium hominis
WEEEEEDSGWSSEDEK

SEQ ID NO: 2167175 - protein, 7 aa, Cryptosporidium hominis
WEKPSKY

SEQ ID NO: 2167176 - protein, 13 aa, Cryptosporidium hominis
WEKYTTTPLDSDC

SEQ ID NO: 2167177 - protein, 22 aa, Cryptosporidium hominis
WGAHGGGAFSGKDATKVDRSGA

SEQ ID NO: 2167178 - protein, 15 aa, Cryptosporidium hominis
WGEKKGYSKSNNESF

SEQ ID NO: 2167179 - protein, 16 aa, Cryptosporidium hominis
WGGKSYSCTPTTKESL

SEQ ID NO: 2167180 - protein, 10 aa, Cryptosporidium hominis
WGLPSPDSQG

SEQ ID NO: 2167181 - protein, 25 aa, Cryptosporidium hominis
WGSKQINTQNSQLSSISNNKDFSTS

SEQ ID NO: 2167182 - protein, 11 aa, Cryptosporidium hominis
WGTPRQGKYGL

SEQ ID NO: 2167183 - protein, 43 aa, Cryptosporidium hominis
WGTRTKSVKKKESGKKANRQKQVKKDLQDTTVSGGANNNIPSG

SEQ ID NO: 2167184 - protein, 8 aa, Cryptosporidium hominis
WIGPTTSS

SEQ ID NO: 2167185 - protein, 16 aa, Cryptosporidium hominis
WKDREIDSDKNKRFDE

SEQ ID NO: 2167186 - protein, 8 aa, Cryptosporidium hominis
WKESDESN

SEQ ID NO: 2167187 - protein, 20 aa, Cryptosporidium hominis
WKESNNQKRINDENSSSYTI

SEQ ID NO: 2167188 - protein, 5 aa, Cryptosporidium hominis
WKGNK

SEQ ID NO: 2167189 - protein, 11 aa, Cryptosporidium hominis
WKGRQGQKDKE

SEQ ID NO: 2167190 - protein, 8 aa, Cryptosporidium hominis
WKKEAQDV

SEQ ID NO: 2167191 - protein, 61 aa, Cryptosporidium hominis
WKKPEKEKDRANKDSQKENIPEQESESKTTIKEGEKSKNNTQANPESQDIDEDEDIEPPPW

SEQ ID NO: 2167192 - protein, 15 aa, Cryptosporidium hominis
WKKSPENPMNENPKL

SEQ ID NO: 2167193 - protein, 21 aa, Cryptosporidium hominis
WKNDNVSKKNYNHEETPKVGQ

SEQ ID NO: 2167194 - protein, 7 aa, Cryptosporidium hominis
WKQQKDQ

SEQ ID NO: 2167195 - protein, 11 aa, Cryptosporidium hominis
WKSNIDESDPA

SEQ ID NO: 2167196 - protein, 12 aa, Cryptosporidium hominis
WKSNRQLSEYIF

SEQ ID NO: 2167197 - protein, 4 aa, Cryptosporidium hominis
WKSS

SEQ ID NO: 2167198 - protein, 5 aa, Cryptosporidium hominis
WKTHP

SEQ ID NO: 2167199 - protein, 4 aa, Cryptosporidium hominis
WMRP

SEQ ID NO: 2167200 - protein, 14 aa, Cryptosporidium hominis
WNETSSNLSNSPKI

SEQ ID NO: 2167201 - protein, 5 aa, Cryptosporidium hominis
WNHPT

SEQ ID NO: 2167202 - protein, 4 aa, Cryptosporidium hominis
WNND

SEQ ID NO: 2167203 - protein, 9 aa, Cryptosporidium hominis
WNPANDKQA

SEQ ID NO: 2167204 - protein, 6 aa, Cryptosporidium hominis
WNPQAD

SEQ ID NO: 2167205 - protein, 12 aa, Cryptosporidium hominis
WNPQNDLQAEAR

SEQ ID NO: 2167206 - protein, 7 aa, Cryptosporidium hominis
WNPQNDV

SEQ ID NO: 2167207 - protein, 6 aa, Cryptosporidium hominis
WNPSNE

SEQ ID NO: 2167208 - protein, 42 aa, Cryptosporidium hominis
WNQPNTGSQASSMQTVSQGAQDIRNTDASNQGIPTSTQKSLE

SEQ ID NO: 2167209 - protein, 10 aa, Cryptosporidium hominis
WNSGTTPIYE

SEQ ID NO: 2167210 - protein, 56 aa, Cryptosporidium hominis
WNSSERIQRSKPRPAKIPENTEDFDDYSEYTRPSEAPIRTPFDRRKSVKKLRKSTF

SEQ ID NO: 2167211 - protein, 11 aa, Cryptosporidium hominis
WNSSNLNKSTV

SEQ ID NO: 2167212 - protein, 28 aa, Cryptosporidium hominis
WPFGSQNKENFPQNITSNNSNGKIDGSC

SEQ ID NO: 2167213 - protein, 8 aa, Cryptosporidium hominis
WPGGQTKQ

SEQ ID NO: 2167214 - protein, 7 aa, Cryptosporidium hominis
WPSSDGH

SEQ ID NO: 2167215 - protein, 9 aa, Cryptosporidium hominis
WPTRDGTGV

SEQ ID NO: 2167216 - protein, 13 aa, Cryptosporidium hominis
WPTRIDGSTYSIP

SEQ ID NO: 2167217 - protein, 4 aa, Cryptosporidium hominis
WQEG

SEQ ID NO: 2167218 - protein, 5 aa, Cryptosporidium hominis
WQGKG

SEQ ID NO: 2167219 - protein, 10 aa, Cryptosporidium hominis
WRESSKNQVL

SEQ ID NO: 2167220 - protein, 5 aa, Cryptosporidium hominis
WRKPK

SEQ ID NO: 2167221 - protein, 83 aa, Cryptosporidium hominis
  misc_feature (39)..(39): Xaa can be any naturally occurring amino acid
WRRNRGRAGEKRERAAKNDQGGKTAEEGKKSGRDTRTKXLERRKRRPGGEDESDGSPPAGEGRARSRPTDEGAKPKNTPGRGK

SEQ ID NO: 2167222 - protein, 8 aa, Cryptosporidium hominis
WRSKSKKN

SEQ ID NO: 2167223 - protein, 4 aa, Cryptosporidium hominis
WRSN

SEQ ID NO: 2167224 - protein, 15 aa, Cryptosporidium hominis
WRSNKNNTKNLYNGN

SEQ ID NO: 2167225 - protein, 8 aa, Cryptosporidium hominis
WRSNRTNK

SEQ ID NO: 2167226 - protein, 6 aa, Cryptosporidium hominis
WSDEET

SEQ ID NO: 2167227 - protein, 6 aa, Cryptosporidium hominis
WSEDGD

SEQ ID NO: 2167228 - protein, 8 aa, Cryptosporidium hominis
WSEDKGMN

SEQ ID NO: 2167229 - protein, 5 aa, Cryptosporidium hominis
WSEKG

SEQ ID NO: 2167230 - protein, 22 aa, Cryptosporidium hominis
WSERSGYKEAWKKGENRYGDKW

SEQ ID NO: 2167231 - protein, 4 aa, Cryptosporidium hominis
WSGG

SEQ ID NO: 2167232 - protein, 21 aa, Cryptosporidium hominis
WSGNTTNQNKEENNDQQNEFD

SEQ ID NO: 2167233 - protein, 7 aa, Cryptosporidium hominis
WSGPGEN

SEQ ID NO: 2167234 - protein, 7 aa, Cryptosporidium hominis
WSPEGER

SEQ ID NO: 2167235 - protein, 6 aa, Cryptosporidium hominis
WSPKSN

SEQ ID NO: 2167236 - protein, 4 aa, Cryptosporidium hominis
WSRD

SEQ ID NO: 2167237 - protein, 20 aa, Cryptosporidium hominis
WSSSRSTLSIQNESTRDEFD

SEQ ID NO: 2167238 - protein, 16 aa, Cryptosporidium hominis
WSTDGGSLSLNGDDGT

SEQ ID NO: 2167239 - protein, 5 aa, Cryptosporidium hominis
WSYTT

SEQ ID NO: 2167240 - protein, 16 aa, Cryptosporidium hominis
WTQPGDKNTKIKFIRY

SEQ ID NO: 2167241 - protein, 13 aa, Cryptosporidium hominis
WTSKSDSKEQKEV

SEQ ID NO: 2167242 - protein, 4 aa, Cryptosporidium hominis
YAAN

SEQ ID NO: 2167243 - protein, 6 aa, Cryptosporidium hominis
YADISG

SEQ ID NO: 2167244 - protein, 5 aa, Cryptosporidium hominis
YADPR

SEQ ID NO: 2167245 - protein, 4 aa, Cryptosporidium hominis
YAGK

SEQ ID NO: 2167246 - protein, 13 aa, Cryptosporidium hominis
YAHEINNSDRPYS

SEQ ID NO: 2167247 - protein, 4 aa, Cryptosporidium hominis
YAIR

SEQ ID NO: 2167248 - protein, 11 aa, Cryptosporidium hominis
YAKDEKGEKIQ

SEQ ID NO: 2167249 - protein, 6 aa, Cryptosporidium hominis
YAKNHG

SEQ ID NO: 2167250 - protein, 7 aa, Cryptosporidium hominis
YAKPPFS

SEQ ID NO: 2167251 - protein, 9 aa, Cryptosporidium hominis
YANGASTKY

SEQ ID NO: 2167252 - protein, 10 aa, Cryptosporidium hominis
YANSNANSMN

SEQ ID NO: 2167253 - protein, 4 aa, Cryptosporidium hominis
YAPA

SEQ ID NO: 2167254 - protein, 4 aa, Cryptosporidium hominis
YAPR

SEQ ID NO: 2167255 - protein, 5 aa, Cryptosporidium hominis
YARQQ

SEQ ID NO: 2167256 - protein, 14 aa, Cryptosporidium hominis
YASEPKESKTVRGI

SEQ ID NO: 2167257 - protein, 6 aa, Cryptosporidium hominis
YASNNN

SEQ ID NO: 2167258 - protein, 5 aa, Cryptosporidium hominis
YASNP

SEQ ID NO: 2167259 - protein, 14 aa, Cryptosporidium hominis
YASREANSKTSEKD

SEQ ID NO: 2167260 - protein, 7 aa, Cryptosporidium hominis
YASSGKI

SEQ ID NO: 2167261 - protein, 9 aa, Cryptosporidium hominis
YATGGYGQI

SEQ ID NO: 2167262 - protein, 11 aa, Cryptosporidium hominis
YATNTLRGKDR

SEQ ID NO: 2167263 - protein, 9 aa, Cryptosporidium hominis
YDDASGLNK

SEQ ID NO: 2167264 - protein, 8 aa, Cryptosporidium hominis
YDDDFKGK

SEQ ID NO: 2167265 - protein, 20 aa, Cryptosporidium hominis
YDDDNNNNNNNFSSKSSGIP

SEQ ID NO: 2167266 - protein, 23 aa, Cryptosporidium hominis
YDDDTTNNNNNNNTTSDANTLSH

SEQ ID NO: 2167267 - protein, 8 aa, Cryptosporidium hominis
YDDNEDNR

SEQ ID NO: 2167268 - protein, 6 aa, Cryptosporidium hominis
YDEDLQ

SEQ ID NO: 2167269 - protein, 7 aa, Cryptosporidium hominis
YDEHNRR

SEQ ID NO: 2167270 - protein, 4 aa, Cryptosporidium hominis
YDEK

SEQ ID NO: 2167271 - protein, 7 aa, Cryptosporidium hominis
YDEPTIP

SEQ ID NO: 2167272 - protein, 8 aa, Cryptosporidium hominis
YDESTGEY

SEQ ID NO: 2167273 - protein, 9 aa, Cryptosporidium hominis
YDETSGKMI

SEQ ID NO: 2167274 - protein, 4 aa, Cryptosporidium hominis
YDGG

SEQ ID NO: 2167275 - protein, 4 aa, Cryptosporidium hominis
YDGK

SEQ ID NO: 2167276 - protein, 6 aa, Cryptosporidium hominis
YDGKKS

SEQ ID NO: 2167277 - protein, 8 aa, Cryptosporidium hominis
YDGKTPYG

SEQ ID NO: 2167278 - protein, 7 aa, Cryptosporidium hominis
YDGNSSK

SEQ ID NO: 2167279 - protein, 8 aa, Cryptosporidium hominis
YDKEREQL

SEQ ID NO: 2167280 - protein, 6 aa, Cryptosporidium hominis
YDKNDK

SEQ ID NO: 2167281 - protein, 11 aa, Cryptosporidium hominis
YDKNKDTGDFN

SEQ ID NO: 2167282 - protein, 11 aa, Cryptosporidium hominis
YDKNKVDVKSE

SEQ ID NO: 2167283 - protein, 10 aa, Cryptosporidium hominis
YDKNNDPRIE

SEQ ID NO: 2167284 - protein, 19 aa, Cryptosporidium hominis
YDKSENKCQQNSADVPVPG

SEQ ID NO: 2167285 - protein, 9 aa, Cryptosporidium hominis
YDKTEDDLK

SEQ ID NO: 2167286 - protein, 6 aa, Cryptosporidium hominis
YDLEET

SEQ ID NO: 2167287 - protein, 13 aa, Cryptosporidium hominis
YDLKNSESSQLNS

SEQ ID NO: 2167288 - protein, 8 aa, Cryptosporidium hominis
YDLNPRDS

SEQ ID NO: 2167289 - protein, 8 aa, Cryptosporidium hominis
YDNGGVTD

SEQ ID NO: 2167290 - protein, 7 aa, Cryptosporidium hominis
YDNPHET

SEQ ID NO: 2167291 - protein, 9 aa, Cryptosporidium hominis
YDNQTTVQP

SEQ ID NO: 2167292 - protein, 4 aa, Cryptosporidium hominis
YDNS

SEQ ID NO: 2167293 - protein, 9 aa, Cryptosporidium hominis
YDPDGINTS

SEQ ID NO: 2167294 - protein, 10 aa, Cryptosporidium hominis
YDPDNNDFNN

SEQ ID NO: 2167295 - protein, 7 aa, Cryptosporidium hominis
YDPEKVE

SEQ ID NO: 2167296 - protein, 19 aa, Cryptosporidium hominis
YDPGNLRPSFSPSASDNLN

SEQ ID NO: 2167297 - protein, 12 aa, Cryptosporidium hominis
YDPKSRSMREDP

SEQ ID NO: 2167298 - protein, 7 aa, Cryptosporidium hominis
YDPQEDD

SEQ ID NO: 2167299 - protein, 17 aa, Cryptosporidium hominis
YDPSGTLSGGSIPSNQR

SEQ ID NO: 2167300 - protein, 7 aa, Cryptosporidium hominis
YDPSTGI

SEQ ID NO: 2167301 - protein, 6 aa, Cryptosporidium hominis
YDQGPY

SEQ ID NO: 2167302 - protein, 9 aa, Cryptosporidium hominis
YDQISNKDM

SEQ ID NO: 2167303 - protein, 11 aa, Cryptosporidium hominis
YDQLKEKSSKW

SEQ ID NO: 2167304 - protein, 7 aa, Cryptosporidium hominis
YDQNNPT

SEQ ID NO: 2167305 - protein, 11 aa, Cryptosporidium hominis
YDQNRSTISMD

SEQ ID NO: 2167306 - protein, 9 aa, Cryptosporidium hominis
YDRPITSKP

SEQ ID NO: 2167307 - protein, 4 aa, Cryptosporidium hominis
YDRQ

SEQ ID NO: 2167308 - protein, 9 aa, Cryptosporidium hominis
YDRTKEQLE

SEQ ID NO: 2167309 - protein, 11 aa, Cryptosporidium hominis
YDSEDTSNEYM

SEQ ID NO: 2167310 - protein, 14 aa, Cryptosporidium hominis
YDSEKPCSEDGDEV

SEQ ID NO: 2167311 - protein, 14 aa, Cryptosporidium hominis
YDSENGDNSNRAKN

SEQ ID NO: 2167312 - protein, 11 aa, Cryptosporidium hominis
YDSHEGSSLTG

SEQ ID NO: 2167313 - protein, 7 aa, Cryptosporidium hominis
YDSKENR

SEQ ID NO: 2167314 - protein, 10 aa, Cryptosporidium hominis
YDSNDTEKNI

SEQ ID NO: 2167315 - protein, 9 aa, Cryptosporidium hominis
YDSNGNPQY

SEQ ID NO: 2167316 - protein, 9 aa, Cryptosporidium hominis
YDSNPQESK

SEQ ID NO: 2167317 - protein, 17 aa, Cryptosporidium hominis
YDSTSNDINSNSEGGIN

SEQ ID NO: 2167318 - protein, 13 aa, Cryptosporidium hominis
YDTEKTKLEKKKK

SEQ ID NO: 2167319 - protein, 7 aa, Cryptosporidium hominis
YDTGEEV

SEQ ID NO: 2167320 - protein, 6 aa, Cryptosporidium hominis
YDTNNY

SEQ ID NO: 2167321 - protein, 7 aa, Cryptosporidium hominis
YDTPIEK

SEQ ID NO: 2167322 - protein, 12 aa, Cryptosporidium hominis
YDTSSISNTEDI

SEQ ID NO: 2167323 - protein, 6 aa, Cryptosporidium hominis
YDTTTN

SEQ ID NO: 2167324 - protein, 9 aa, Cryptosporidium hominis
YDVTSYSSN

SEQ ID NO: 2167325 - protein, 6 aa, Cryptosporidium hominis
YDYETG

SEQ ID NO: 2167326 - protein, 9 aa, Cryptosporidium hominis
YEAEGKTEY

SEQ ID NO: 2167327 - protein, 7 aa, Cryptosporidium hominis
YEARKKE

SEQ ID NO: 2167328 - protein, 4 aa, Cryptosporidium hominis
YEDE

SEQ ID NO: 2167329 - protein, 20 aa, Cryptosporidium hominis
YEDKNEKSSLNPTNTYGEYG

SEQ ID NO: 2167330 - protein, 5 aa, Cryptosporidium hominis
YEDNG

SEQ ID NO: 2167331 - protein, 13 aa, Cryptosporidium hominis
YEDPNSWRLSKRR

SEQ ID NO: 2167332 - protein, 4 aa, Cryptosporidium hominis
YEDS

SEQ ID NO: 2167333 - protein, 11 aa, Cryptosporidium hominis
YEEDDDNDAVA

SEQ ID NO: 2167334 - protein, 25 aa, Cryptosporidium hominis
YEEDDTDGDKIENQRNDDKKRRRVK

SEQ ID NO: 2167335 - protein, 8 aa, Cryptosporidium hominis
YEEEQYSN

SEQ ID NO: 2167336 - protein, 14 aa, Cryptosporidium hominis
YEEGYKRKSPTRSY

SEQ ID NO: 2167337 - protein, 5 aa, Cryptosporidium hominis
YEEKQ

SEQ ID NO: 2167338 - protein, 17 aa, Cryptosporidium hominis
YEELGSKERIKYRNSNN

SEQ ID NO: 2167339 - protein, 5 aa, Cryptosporidium hominis
YEENP

SEQ ID NO: 2167340 - protein, 6 aa, Cryptosporidium hominis
YEENRE

SEQ ID NO: 2167341 - protein, 7 aa, Cryptosporidium hominis
YEEQGTS

SEQ ID NO: 2167342 - protein, 6 aa, Cryptosporidium hominis
YEEQRR

SEQ ID NO: 2167343 - protein, 10 aa, Cryptosporidium hominis
YEEQRRNQTL

SEQ ID NO: 2167344 - protein, 11 aa, Cryptosporidium hominis
YEERGKERSDI

SEQ ID NO: 2167345 - protein, 12 aa, Cryptosporidium hominis
YEESENTSNQRL

SEQ ID NO: 2167346 - protein, 8 aa, Cryptosporidium hominis
YEESKEEA

SEQ ID NO: 2167347 - protein, 7 aa, Cryptosporidium hominis
YEETGIS

SEQ ID NO: 2167348 - protein, 6 aa, Cryptosporidium hominis
YEGANE

SEQ ID NO: 2167349 - protein, 7 aa, Cryptosporidium hominis
YEGDSKV

SEQ ID NO: 2167350 - protein, 4 aa, Cryptosporidium hominis
YEGE

SEQ ID NO: 2167351 - protein, 7 aa, Cryptosporidium hominis
YEGEGYD

SEQ ID NO: 2167352 - protein, 16 aa, Cryptosporidium hominis
YEGEQHSNNKRKENAL

SEQ ID NO: 2167353 - protein, 26 aa, Cryptosporidium hominis
YEGNNLSPEKENAQQGADYTNSVPPP

SEQ ID NO: 2167354 - protein, 19 aa, Cryptosporidium hominis
YEGPQDDETAKGIRNCDPD

SEQ ID NO: 2167355 - protein, 4 aa, Cryptosporidium hominis
YEGQ

SEQ ID NO: 2167356 - protein, 16 aa, Cryptosporidium hominis
YEGSECDQEASPDDFD

SEQ ID NO: 2167357 - protein, 5 aa, Cryptosporidium hominis
YEGTD

SEQ ID NO: 2167358 - protein, 8 aa, Cryptosporidium hominis
YEKGDTDF

SEQ ID NO: 2167359 - protein, 8 aa, Cryptosporidium hominis
YEKGINDL

SEQ ID NO: 2167360 - protein, 6 aa, Cryptosporidium hominis
YEKPTP

SEQ ID NO: 2167361 - protein, 9 aa, Cryptosporidium hominis
YEKYKTEDL

SEQ ID NO: 2167362 - protein, 17 aa, Cryptosporidium hominis
YEMGRPASNTKLGASPR

SEQ ID NO: 2167363 - protein, 15 aa, Cryptosporidium hominis
YENESLGQHKKPILN

SEQ ID NO: 2167364 - protein, 13 aa, Cryptosporidium hominis
YENGRPKSGGLND

SEQ ID NO: 2167365 - protein, 5 aa, Cryptosporidium hominis
YENGT

SEQ ID NO: 2167366 - protein, 4 aa, Cryptosporidium hominis
YENK

SEQ ID NO: 2167367 - protein, 14 aa, Cryptosporidium hominis
YENSPENENSDLKE

SEQ ID NO: 2167368 - protein, 7 aa, Cryptosporidium hominis
YEPENPE

SEQ ID NO: 2167369 - protein, 14 aa, Cryptosporidium hominis
YEPSISPNNIADPN

SEQ ID NO: 2167370 - protein, 6 aa, Cryptosporidium hominis
YEPSSS

SEQ ID NO: 2167371 - protein, 8 aa, Cryptosporidium hominis
YEQGKNEN

SEQ ID NO: 2167372 - protein, 8 aa, Cryptosporidium hominis
YEQISSEA

SEQ ID NO: 2167373 - protein, 5 aa, Cryptosporidium hominis
YEQQM

SEQ ID NO: 2167374 - protein, 14 aa, Cryptosporidium hominis
YEQSLDDSNNRQEQ

SEQ ID NO: 2167375 - protein, 6 aa, Cryptosporidium hominis
YERCPN

SEQ ID NO: 2167376 - protein, 7 aa, Cryptosporidium hominis
YERPTPV

SEQ ID NO: 2167377 - protein, 7 aa, Cryptosporidium hominis
YERPVGN

SEQ ID NO: 2167378 - protein, 5 aa, Cryptosporidium hominis
YESEG

SEQ ID NO: 2167379 - protein, 24 aa, Cryptosporidium hominis
YESEPEPENDNDNESEDDEDGYEP

SEQ ID NO: 2167380 - protein, 10 aa, Cryptosporidium hominis
YESEYKAGEF

SEQ ID NO: 2167381 - protein, 5 aa, Cryptosporidium hominis
YESIE

SEQ ID NO: 2167382 - protein, 33 aa, Cryptosporidium hominis
YESRRRSSAQNISSTLESTNQAGTQVGARNGIQ

SEQ ID NO: 2167383 - protein, 15 aa, Cryptosporidium hominis
YESSKNKDLESENAA

SEQ ID NO: 2167384 - protein, 15 aa, Cryptosporidium hominis
YESWKDGRLKMILSE

SEQ ID NO: 2167385 - protein, 5 aa, Cryptosporidium hominis
YETEL

SEQ ID NO: 2167386 - protein, 6 aa, Cryptosporidium hominis
YETLRN

SEQ ID NO: 2167387 - protein, 11 aa, Cryptosporidium hominis
YETNQSGKTQI

SEQ ID NO: 2167388 - protein, 7 aa, Cryptosporidium hominis
YETSEPV

SEQ ID NO: 2167389 - protein, 6 aa, Cryptosporidium hominis
YEYDEP

SEQ ID NO: 2167390 - protein, 17 aa, Cryptosporidium hominis
YEYDSHTESEDEDSSNI

SEQ ID NO: 2167391 - protein, 9 aa, Cryptosporidium hominis
YFKPRGRDI

SEQ ID NO: 2167392 - protein, 5 aa, Cryptosporidium hominis
YFPPG

SEQ ID NO: 2167393 - protein, 10 aa, Cryptosporidium hominis
YFPSNSSSIS

SEQ ID NO: 2167394 - protein, 20 aa, Cryptosporidium hominis
YFRKDSSRSPERYRNRNQIS

SEQ ID NO: 2167395 - protein, 13 aa, Cryptosporidium hominis
YFSPKKKPNADTN

SEQ ID NO: 2167396 - protein, 29 aa, Cryptosporidium hominis
YFSPTASESFAKQSSHVNRDNSNSDLTNL

SEQ ID NO: 2167397 - protein, 5 aa, Cryptosporidium hominis
YGAAD

SEQ ID NO: 2167398 - protein, 9 aa, Cryptosporidium hominis
YGAKELPSN

SEQ ID NO: 2167399 - protein, 11 aa, Cryptosporidium hominis
YGAPNEVESFT

SEQ ID NO: 2167400 - protein, 5 aa, Cryptosporidium hominis
YGARG

SEQ ID NO: 2167401 - protein, 62 aa, Cryptosporidium hominis
YGARNGSISVSNNHRNFGNNSSTKRYKTGTNSGTKKFGTTTTGIASTNQPSNSVSSKIKPED

SEQ ID NO: 2167402 - protein, 9 aa, Cryptosporidium hominis
YGDEADIHD

SEQ ID NO: 2167403 - protein, 7 aa, Cryptosporidium hominis
YGDSKDK

SEQ ID NO: 2167404 - protein, 4 aa, Cryptosporidium hominis
YGDT

SEQ ID NO: 2167405 - protein, 7 aa, Cryptosporidium hominis
YGEEQPV

SEQ ID NO: 2167406 - protein, 7 aa, Cryptosporidium hominis
YGEITRG

SEQ ID NO: 2167407 - protein, 6 aa, Cryptosporidium hominis
YGEPEK

SEQ ID NO: 2167408 - protein, 8 aa, Cryptosporidium hominis
YGGDNGFN

SEQ ID NO: 2167409 - protein, 7 aa, Cryptosporidium hominis
YGGEDCP

SEQ ID NO: 2167410 - protein, 17 aa, Cryptosporidium hominis
YGIPRRNTTVPKTPKFA

SEQ ID NO: 2167411 - protein, 9 aa, Cryptosporidium hominis
YGKEKNNPY

SEQ ID NO: 2167412 - protein, 6 aa, Cryptosporidium hominis
YGNNES

SEQ ID NO: 2167413 - protein, 8 aa, Cryptosporidium hominis
YGNNNNNI

SEQ ID NO: 2167414 - protein, 17 aa, Cryptosporidium hominis
YGNNSEIDQSQEQDEEI

SEQ ID NO: 2167415 - protein, 10 aa, Cryptosporidium hominis
YGNNSNSFRR

SEQ ID NO: 2167416 - protein, 27 aa, Cryptosporidium hominis
YGNPYKSYRGGGGGVGGYSGNRHIVNP

SEQ ID NO: 2167417 - protein, 24 aa, Cryptosporidium hominis
YGNSRNGVKPANFSYQSNPEPRRD

SEQ ID NO: 2167418 - protein, 5 aa, Cryptosporidium hominis
YGNYS

SEQ ID NO: 2167419 - protein, 6 aa, Cryptosporidium hominis
YGPDTG

SEQ ID NO: 2167420 - protein, 17 aa, Cryptosporidium hominis
YGPEGSNHRVRESSVGE

SEQ ID NO: 2167421 - protein, 7 aa, Cryptosporidium hominis
YGPESRG

SEQ ID NO: 2167422 - protein, 8 aa, Cryptosporidium hominis
YGPPPSYP

SEQ ID NO: 2167423 - protein, 11 aa, Cryptosporidium hominis
YGQNEKKYNAE

SEQ ID NO: 2167424 - protein, 6 aa, Cryptosporidium hominis
YGQNPP

SEQ ID NO: 2167425 - protein, 11 aa, Cryptosporidium hominis
YGQQNNSMNDM

SEQ ID NO: 2167426 - protein, 5 aa, Cryptosporidium hominis
YGRHI

SEQ ID NO: 2167427 - protein, 14 aa, Cryptosporidium hominis
YGRITSKNSPMEVS

SEQ ID NO: 2167428 - protein, 5 aa, Cryptosporidium hominis
YGRQI

SEQ ID NO: 2167429 - protein, 4 aa, Cryptosporidium hominis
YGRY

SEQ ID NO: 2167430 - protein, 4 aa, Cryptosporidium hominis
YGSD

SEQ ID NO: 2167431 - protein, 10 aa, Cryptosporidium hominis
YGSDAKTRKM

SEQ ID NO: 2167432 - protein, 20 aa, Cryptosporidium hominis
YGSKNGHSNTHIHSSSNPCP

SEQ ID NO: 2167433 - protein, 4 aa, Cryptosporidium hominis
YGSL

SEQ ID NO: 2167434 - protein, 18 aa, Cryptosporidium hominis
YGSLDGEIEARRKEGQDN

SEQ ID NO: 2167435 - protein, 11 aa, Cryptosporidium hominis
YGSNSQQPRDY

SEQ ID NO: 2167436 - protein, 25 aa, Cryptosporidium hominis
YGSPDIREPSPPPIYDKNGSRINTR

SEQ ID NO: 2167437 - protein, 7 aa, Cryptosporidium hominis
YGSPEIR

SEQ ID NO: 2167438 - protein, 4 aa, Cryptosporidium hominis
YGSQ

SEQ ID NO: 2167439 - protein, 7 aa, Cryptosporidium hominis
YGSRNTE

SEQ ID NO: 2167440 - protein, 11 aa, Cryptosporidium hominis
YGTAGSESKVE

SEQ ID NO: 2167441 - protein, 6 aa, Cryptosporidium hominis
YGTEDV

SEQ ID NO: 2167442 - protein, 11 aa, Cryptosporidium hominis
YGTKNEDENIQ

SEQ ID NO: 2167443 - protein, 12 aa, Cryptosporidium hominis
YGTKSGKQKLTF

SEQ ID NO: 2167444 - protein, 4 aa, Cryptosporidium hominis
YGTP

SEQ ID NO: 2167445 - protein, 7 aa, Cryptosporidium hominis
YGTSGRV

SEQ ID NO: 2167446 - protein, 14 aa, Cryptosporidium hominis
YGTSPELNPIQEKG

SEQ ID NO: 2167447 - protein, 5 aa, Cryptosporidium hominis
YGTTE

SEQ ID NO: 2167448 - protein, 4 aa, Cryptosporidium hominis
YGYG

SEQ ID NO: 2167449 - protein, 8 aa, Cryptosporidium hominis
YHDGTKCG

SEQ ID NO: 2167450 - protein, 15 aa, Cryptosporidium hominis
YHDHGSGKKRRTFSR

SEQ ID NO: 2167451 - protein, 4 aa, Cryptosporidium hominis
YHEK

SEQ ID NO: 2167452 - protein, 5 aa, Cryptosporidium hominis
YHLPS

SEQ ID NO: 2167453 - protein, 9 aa, Cryptosporidium hominis
YHPDGPEGK

SEQ ID NO: 2167454 - protein, 19 aa, Cryptosporidium hominis
YHPDLNPSEEAKNKMAKIV

SEQ ID NO: 2167455 - protein, 4 aa, Cryptosporidium hominis
YHTR

SEQ ID NO: 2167456 - protein, 7 aa, Cryptosporidium hominis
YIATTRD

SEQ ID NO: 2167457 - protein, 12 aa, Cryptosporidium hominis
YIEKQKDNSLTS

SEQ ID NO: 2167458 - protein, 5 aa, Cryptosporidium hominis
YIGPE

SEQ ID NO: 2167459 - protein, 20 aa, Cryptosporidium hominis
YIKPGKDQNKSTLRSSVQDT

SEQ ID NO: 2167460 - protein, 8 aa, Cryptosporidium hominis
YIKPGNNR

SEQ ID NO: 2167461 - protein, 8 aa, Cryptosporidium hominis
YIPSGDTE

SEQ ID NO: 2167462 - protein, 5 aa, Cryptosporidium hominis
YISGS

SEQ ID NO: 2167463 - protein, 8 aa, Cryptosporidium hominis
YISGTNEH

SEQ ID NO: 2167464 - protein, 4 aa, Cryptosporidium hominis
YISS

SEQ ID NO: 2167465 - protein, 33 aa, Cryptosporidium hominis
YISSSPSSSSSSSSSSSSSSSVSFSTPSSSTQL

SEQ ID NO: 2167466 - protein, 16 aa, Cryptosporidium hominis
YITESTPLSGASGGSI

SEQ ID NO: 2167467 - protein, 11 aa, Cryptosporidium hominis
YITPPNGDATR

SEQ ID NO: 2167468 - protein, 8 aa, Cryptosporidium hominis
YKAEEEKE

SEQ ID NO: 2167469 - protein, 6 aa, Cryptosporidium hominis
YKAKQG

SEQ ID NO: 2167470 - protein, 5 aa, Cryptosporidium hominis
YKATK

SEQ ID NO: 2167471 - protein, 4 aa, Cryptosporidium hominis
YKDA

SEQ ID NO: 2167472 - protein, 7 aa, Cryptosporidium hominis
YKDEKEY

SEQ ID NO: 2167473 - protein, 11 aa, Cryptosporidium hominis
YKDEKHSMSTS

SEQ ID NO: 2167474 - protein, 6 aa, Cryptosporidium hominis
YKDENQ

SEQ ID NO: 2167475 - protein, 8 aa, Cryptosporidium hominis
YKDESHAG

SEQ ID NO: 2167476 - protein, 14 aa, Cryptosporidium hominis
YKDHPNYRNNLVQL

SEQ ID NO: 2167477 - protein, 8 aa, Cryptosporidium hominis
YKDPDTNV

SEQ ID NO: 2167478 - protein, 5 aa, Cryptosporidium hominis
YKDPS

SEQ ID NO: 2167479 - protein, 16 aa, Cryptosporidium hominis
YKDRSRSQNEYYNSGI

SEQ ID NO: 2167480 - protein, 12 aa, Cryptosporidium hominis
YKDSDLNEKNEV

SEQ ID NO: 2167481 - protein, 9 aa, Cryptosporidium hominis
YKDSPQFKP

SEQ ID NO: 2167482 - protein, 20 aa, Cryptosporidium hominis
YKEENKIGSIERKKNENNSY

SEQ ID NO: 2167483 - protein, 11 aa, Cryptosporidium hominis
YKEKDQNPNSY

SEQ ID NO: 2167484 - protein, 8 aa, Cryptosporidium hominis
YKEKPEED

SEQ ID NO: 2167485 - protein, 4 aa, Cryptosporidium hominis
YKEL

SEQ ID NO: 2167486 - protein, 7 aa, Cryptosporidium hominis
YKENQKS

SEQ ID NO: 2167487 - protein, 12 aa, Cryptosporidium hominis
YKEQEEEEKEEE

SEQ ID NO: 2167488 - protein, 14 aa, Cryptosporidium hominis
YKEQPHGDASGKSI

SEQ ID NO: 2167489 - protein, 8 aa, Cryptosporidium hominis
YKESDDQQ

SEQ ID NO: 2167490 - protein, 12 aa, Cryptosporidium hominis
YKESHDKYTREQ

SEQ ID NO: 2167491 - protein, 19 aa, Cryptosporidium hominis
YKESLEEKNIERKKAEEEL

SEQ ID NO: 2167492 - protein, 11 aa, Cryptosporidium hominis
YKESPKSCEAT

SEQ ID NO: 2167493 - protein, 4 aa, Cryptosporidium hominis
YKET

SEQ ID NO: 2167494 - protein, 11 aa, Cryptosporidium hominis
YKGGDFKRQGE

SEQ ID NO: 2167495 - protein, 10 aa, Cryptosporidium hominis
YKGGPNNEDQ

SEQ ID NO: 2167496 - protein, 4 aa, Cryptosporidium hominis
YKGN

SEQ ID NO: 2167497 - protein, 12 aa, Cryptosporidium hominis
YKGNTNNSNFRR

SEQ ID NO: 2167498 - protein, 9 aa, Cryptosporidium hominis
YKKDENHRT

SEQ ID NO: 2167499 - protein, 9 aa, Cryptosporidium hominis
YKKDSNPYD

SEQ ID NO: 2167500 - protein, 13 aa, Cryptosporidium hominis
YKKSAEEELGDDP

SEQ ID NO: 2167501 - protein, 6 aa, Cryptosporidium hominis
YKKSNE

SEQ ID NO: 2167502 - protein, 4 aa, Cryptosporidium hominis
YKLP

SEQ ID NO: 2167503 - protein, 5 aa, Cryptosporidium hominis
YKMNS

SEQ ID NO: 2167504 - protein, 13 aa, Cryptosporidium hominis
YKNDEIYKMNNIS

SEQ ID NO: 2167505 - protein, 4 aa, Cryptosporidium hominis
YKNE

SEQ ID NO: 2167506 - protein, 5 aa, Cryptosporidium hominis
YKNEI

SEQ ID NO: 2167507 - protein, 15 aa, Cryptosporidium hominis
YKNGELTSSNDALNS

SEQ ID NO: 2167508 - protein, 9 aa, Cryptosporidium hominis
YKNKESKKM

SEQ ID NO: 2167509 - protein, 6 aa, Cryptosporidium hominis
YKNLNK

SEQ ID NO: 2167510 - protein, 16 aa, Cryptosporidium hominis
YKNPGPIQFDGPNSGI

SEQ ID NO: 2167511 - protein, 8 aa, Cryptosporidium hominis
YKNSLETN

SEQ ID NO: 2167512 - protein, 7 aa, Cryptosporidium hominis
YKNSNEI

SEQ ID NO: 2167513 - protein, 10 aa, Cryptosporidium hominis
YKNTNLPNSQ

SEQ ID NO: 2167514 - protein, 9 aa, Cryptosporidium hominis
YKNTPKSIP

SEQ ID NO: 2167515 - protein, 6 aa, Cryptosporidium hominis
YKNTPN

SEQ ID NO: 2167516 - protein, 15 aa, Cryptosporidium hominis
YKNTYDSIVSDIALR

SEQ ID NO: 2167517 - protein, 10 aa, Cryptosporidium hominis
YKPASRCPEP

SEQ ID NO: 2167518 - protein, 6 aa, Cryptosporidium hominis
YKPDMS

SEQ ID NO: 2167519 - protein, 4 aa, Cryptosporidium hominis
YKPE

SEQ ID NO: 2167520 - protein, 30 aa, Cryptosporidium hominis
YKPETRAEKKARLQEEAKKAAAGETTESKK

SEQ ID NO: 2167521 - protein, 7 aa, Cryptosporidium hominis
YKPGTTN

SEQ ID NO: 2167522 - protein, 6 aa, Cryptosporidium hominis
YKPLKK

SEQ ID NO: 2167523 - protein, 5 aa, Cryptosporidium hominis
YKPME

SEQ ID NO: 2167524 - protein, 19 aa, Cryptosporidium hominis
YKPNIKKGVRRTDKSRIPK

SEQ ID NO: 2167525 - protein, 4 aa, Cryptosporidium hominis
YKPS

SEQ ID NO: 2167526 - protein, 15 aa, Cryptosporidium hominis
YKPSPVKYKGPTSSY

SEQ ID NO: 2167527 - protein, 8 aa, Cryptosporidium hominis
YKPTLRSE

SEQ ID NO: 2167528 - protein, 19 aa, Cryptosporidium hominis
YKQKSSKKKVKREAYSSSV

SEQ ID NO: 2167529 - protein, 14 aa, Cryptosporidium hominis
YKQQKRQHKKEMRG

SEQ ID NO: 2167530 - protein, 9 aa, Cryptosporidium hominis
YKRPPSIGT

SEQ ID NO: 2167531 - protein, 5 aa, Cryptosporidium hominis
YKSDN

SEQ ID NO: 2167532 - protein, 46 aa, Cryptosporidium hominis
YKSDPYRRYPSPRDYREGSRSYGGNSHPPYRSRSRSPPPSRGYERY

SEQ ID NO: 2167533 - protein, 10 aa, Cryptosporidium hominis
YKSKGSELEA

SEQ ID NO: 2167534 - protein, 10 aa, Cryptosporidium hominis
YKSKHRPPWR

SEQ ID NO: 2167535 - protein, 9 aa, Cryptosporidium hominis
YKSKVQRRA

SEQ ID NO: 2167536 - protein, 10 aa, Cryptosporidium hominis
YKSLRKRRTE

SEQ ID NO: 2167537 - protein, 7 aa, Cryptosporidium hominis
YKSNEIE

SEQ ID NO: 2167538 - protein, 8 aa, Cryptosporidium hominis
YKSNENAK

SEQ ID NO: 2167539 - protein, 7 aa, Cryptosporidium hominis
YKSNNLS

SEQ ID NO: 2167540 - protein, 7 aa, Cryptosporidium hominis
YKSNPDL

SEQ ID NO: 2167541 - protein, 17 aa, Cryptosporidium hominis
YKSNTSHKFDENSPIEK

SEQ ID NO: 2167542 - protein, 15 aa, Cryptosporidium hominis
YKSPMVPRKGSNHSY

SEQ ID NO: 2167543 - protein, 6 aa, Cryptosporidium hominis
YKSPSP

SEQ ID NO: 2167544 - protein, 5 aa, Cryptosporidium hominis
YKSQD

SEQ ID NO: 2167545 - protein, 9 aa, Cryptosporidium hominis
YKSSDEVPH

SEQ ID NO: 2167546 - protein, 8 aa, Cryptosporidium hominis
YKSSPTDL

SEQ ID NO: 2167547 - protein, 10 aa, Cryptosporidium hominis
YKSSRRDKIN

SEQ ID NO: 2167548 - protein, 14 aa, Cryptosporidium hominis
YKSSSAEMQIQDIT

SEQ ID NO: 2167549 - protein, 4 aa, Cryptosporidium hominis
YKST

SEQ ID NO: 2167550 - protein, 9 aa, Cryptosporidium hominis
YKSTNRVQD

SEQ ID NO: 2167551 - protein, 9 aa, Cryptosporidium hominis
YKSTQQPPV

SEQ ID NO: 2167552 - protein, 7 aa, Cryptosporidium hominis
YKTATAM

SEQ ID NO: 2167553 - protein, 9 aa, Cryptosporidium hominis
YKTKELSAQ

SEQ ID NO: 2167554 - protein, 7 aa, Cryptosporidium hominis
YKTTGRI

SEQ ID NO: 2167555 - protein, 4 aa, Cryptosporidium hominis
YKWT

SEQ ID NO: 2167556 - protein, 7 aa, Cryptosporidium hominis
YKYTEER

SEQ ID NO: 2167557 - protein, 8 aa, Cryptosporidium hominis
YLASGSDD

SEQ ID NO: 2167558 - protein, 9 aa, Cryptosporidium hominis
YLGSTSYTN

SEQ ID NO: 2167559 - protein, 9 aa, Cryptosporidium hominis
YLKNSNNSL

SEQ ID NO: 2167560 - protein, 8 aa, Cryptosporidium hominis
YLPGADNE

SEQ ID NO: 2167561 - protein, 8 aa, Cryptosporidium hominis
YLSPKYRN

SEQ ID NO: 2167562 - protein, 4 aa, Cryptosporidium hominis
YLTE

SEQ ID NO: 2167563 - protein, 5 aa, Cryptosporidium hominis
YLTEE

SEQ ID NO: 2167564 - protein, 11 aa, Cryptosporidium hominis
YLTEEPNKYGK

SEQ ID NO: 2167565 - protein, 10 aa, Cryptosporidium hominis
YLTPSKQPNF

SEQ ID NO: 2167566 - protein, 10 aa, Cryptosporidium hominis
YLTSGTTGEA

SEQ ID NO: 2167567 - protein, 14 aa, Cryptosporidium hominis
YMGATEKSQDDQSF

SEQ ID NO: 2167568 - protein, 30 aa, Cryptosporidium hominis
YMPRGADPNVGGGTNSSTSNNNNNSGNNGN

SEQ ID NO: 2167569 - protein, 10 aa, Cryptosporidium hominis
YNANFGPSSV

SEQ ID NO: 2167570 - protein, 21 aa, Cryptosporidium hominis
YNDEDSNSQENVNITTSTRPD

SEQ ID NO: 2167571 - protein, 8 aa, Cryptosporidium hominis
YNDGNENE

SEQ ID NO: 2167572 - protein, 5 aa, Cryptosporidium hominis
YNDIT

SEQ ID NO: 2167573 - protein, 13 aa, Cryptosporidium hominis
YNDKQYKNLDPNN

SEQ ID NO: 2167574 - protein, 13 aa, Cryptosporidium hominis
YNDPVDKSVAKNQ

SEQ ID NO: 2167575 - protein, 7 aa, Cryptosporidium hominis
YNDSIQS

SEQ ID NO: 2167576 - protein, 7 aa, Cryptosporidium hominis
YNEENMS

SEQ ID NO: 2167577 - protein, 12 aa, Cryptosporidium hominis
YNEISEDSTEID

SEQ ID NO: 2167578 - protein, 12 aa, Cryptosporidium hominis
YNEISRNMNGNE

SEQ ID NO: 2167579 - protein, 8 aa, Cryptosporidium hominis
YNEKNASG

SEQ ID NO: 2167580 - protein, 10 aa, Cryptosporidium hominis
YNEKNKNTKI

SEQ ID NO: 2167581 - protein, 12 aa, Cryptosporidium hominis
YNEKSKIENEMR

SEQ ID NO: 2167582 - protein, 10 aa, Cryptosporidium hominis
YNENENSGED

SEQ ID NO: 2167583 - protein, 10 aa, Cryptosporidium hominis
YNERHKSEPL

SEQ ID NO: 2167584 - protein, 18 aa, Cryptosporidium hominis
YNESDRDKVDHDESDREE

SEQ ID NO: 2167585 - protein, 12 aa, Cryptosporidium hominis
YNESERNKDYME

SEQ ID NO: 2167586 - protein, 16 aa, Cryptosporidium hominis
YNESKGKLESVVSPLY

SEQ ID NO: 2167587 - protein, 4 aa, Cryptosporidium hominis
YNET

SEQ ID NO: 2167588 - protein, 9 aa, Cryptosporidium hominis
YNGEESSYS

SEQ ID NO: 2167589 - protein, 9 aa, Cryptosporidium hominis
YNHSSKGSF

SEQ ID NO: 2167590 - protein, 7 aa, Cryptosporidium hominis
YNKESSK

SEQ ID NO: 2167591 - protein, 5 aa, Cryptosporidium hominis
YNKGE

SEQ ID NO: 2167592 - protein, 17 aa, Cryptosporidium hominis
YNKGEHKTINRAKTSDF

SEQ ID NO: 2167593 - protein, 9 aa, Cryptosporidium hominis
YNKGSPSTF

SEQ ID NO: 2167594 - protein, 24 aa, Cryptosporidium hominis
YNKHNDSHYNRQKDCHNDSQNGGC

SEQ ID NO: 2167595 - protein, 4 aa, Cryptosporidium hominis
YNKS

SEQ ID NO: 2167596 - protein, 7 aa, Cryptosporidium hominis
YNKSEAI

SEQ ID NO: 2167597 - protein, 5 aa, Cryptosporidium hominis
YNKSL

SEQ ID NO: 2167598 - protein, 8 aa, Cryptosporidium hominis
YNKSMDRI

SEQ ID NO: 2167599 - protein, 11 aa, Cryptosporidium hominis
YNKSSGQTTSN

SEQ ID NO: 2167600 - protein, 4 aa, Cryptosporidium hominis
YNLS

SEQ ID NO: 2167601 - protein, 5 aa, Cryptosporidium hominis
YNMGS

SEQ ID NO: 2167602 - protein, 15 aa, Cryptosporidium hominis
YNMQDSKTESSSPEK

SEQ ID NO: 2167603 - protein, 8 aa, Cryptosporidium hominis
YNNEGISN

SEQ ID NO: 2167604 - protein, 16 aa, Cryptosporidium hominis
YNNENLSENNRNSLSD

SEQ ID NO: 2167605 - protein, 7 aa, Cryptosporidium hominis
YNNEQEQ

SEQ ID NO: 2167606 - protein, 5 aa, Cryptosporidium hominis
YNNEV

SEQ ID NO: 2167607 - protein, 8 aa, Cryptosporidium hominis
YNNGKSCE

SEQ ID NO: 2167608 - protein, 16 aa, Cryptosporidium hominis
YNNGLKETKVSQIPSN

SEQ ID NO: 2167609 - protein, 16 aa, Cryptosporidium hominis
YNNIDSSSSPVSPEVS

SEQ ID NO: 2167610 - protein, 7 aa, Cryptosporidium hominis
YNNKEGN

SEQ ID NO: 2167611 - protein, 11 aa, Cryptosporidium hominis
YNNKSKDLKSV

SEQ ID NO: 2167612 - protein, 9 aa, Cryptosporidium hominis
YNNKTDKAP

SEQ ID NO: 2167613 - protein, 4 aa, Cryptosporidium hominis
YNNN

SEQ ID NO: 2167614 - protein, 19 aa, Cryptosporidium hominis
YNNNDNHKYNSSNSNSGIE

SEQ ID NO: 2167615 - protein, 11 aa, Cryptosporidium hominis
YNNNKVPNIPV

SEQ ID NO: 2167616 - protein, 16 aa, Cryptosporidium hominis
YNNPDVNDDNHSFNSQ

SEQ ID NO: 2167617 - protein, 6 aa, Cryptosporidium hominis
YNNQSS

SEQ ID NO: 2167618 - protein, 19 aa, Cryptosporidium hominis
YNNSKPNFTHSSKYPPPNN

SEQ ID NO: 2167619 - protein, 10 aa, Cryptosporidium hominis
YNNSKYPNIT

SEQ ID NO: 2167620 - protein, 7 aa, Cryptosporidium hominis
YNNSPNH

SEQ ID NO: 2167621 - protein, 9 aa, Cryptosporidium hominis
YNNSSKALD

SEQ ID NO: 2167622 - protein, 6 aa, Cryptosporidium hominis
YNNTEG

SEQ ID NO: 2167623 - protein, 5 aa, Cryptosporidium hominis
YNNYQ

SEQ ID NO: 2167624 - protein, 6 aa, Cryptosporidium hominis
YNPAPT

SEQ ID NO: 2167625 - protein, 11 aa, Cryptosporidium hominis
YNPEKKEFQTP

SEQ ID NO: 2167626 - protein, 5 aa, Cryptosporidium hominis
YNPKQ

SEQ ID NO: 2167627 - protein, 12 aa, Cryptosporidium hominis
YNPLTDNQYSYQ

SEQ ID NO: 2167628 - protein, 5 aa, Cryptosporidium hominis
YNPND

SEQ ID NO: 2167629 - protein, 8 aa, Cryptosporidium hominis
YNPYSTQH

SEQ ID NO: 2167630 - protein, 5 aa, Cryptosporidium hominis
YNQEK

SEQ ID NO: 2167631 - protein, 5 aa, Cryptosporidium hominis
YNQLE

SEQ ID NO: 2167632 - protein, 9 aa, Cryptosporidium hominis
YNQRNGSQI

SEQ ID NO: 2167633 - protein, 11 aa, Cryptosporidium hominis
YNRADNNDPHI

SEQ ID NO: 2167634 - protein, 6 aa, Cryptosporidium hominis
YNRRSN

SEQ ID NO: 2167635 - protein, 9 aa, Cryptosporidium hominis
YNSEFSSNK

SEQ ID NO: 2167636 - protein, 8 aa, Cryptosporidium hominis
YNSENNNT

SEQ ID NO: 2167637 - protein, 11 aa, Cryptosporidium hominis
YNSERSSGLHA

SEQ ID NO: 2167638 - protein, 65 aa, Cryptosporidium hominis
YNSGGGGGGGGGGGSGGYQSQHSSNYSHSRHNHAADNFGSQTGGSHSKSGGGGSQYGSHSHSGGF

SEQ ID NO: 2167639 - protein, 9 aa, Cryptosporidium hominis
YNSGKSGYG

SEQ ID NO: 2167640 - protein, 8 aa, Cryptosporidium hominis
YNSIEATS

SEQ ID NO: 2167641 - protein, 4 aa, Cryptosporidium hominis
YNSK

SEQ ID NO: 2167642 - protein, 8 aa, Cryptosporidium hominis
YNSKTSNN

SEQ ID NO: 2167643 - protein, 5 aa, Cryptosporidium hominis
YNSNE

SEQ ID NO: 2167644 - protein, 45 aa, Cryptosporidium hominis
YNSNGGNDNSNNYNNYNSNRYPPPPSLPYSSTSCDGERSQNHNIQ

SEQ ID NO: 2167645 - protein, 24 aa, Cryptosporidium hominis
YNSNPNSSSLETARSELGAGAGAV

SEQ ID NO: 2167646 - protein, 13 aa, Cryptosporidium hominis
YNSNQSVSRGKKI

SEQ ID NO: 2167647 - protein, 4 aa, Cryptosporidium hominis
YNSQ

SEQ ID NO: 2167648 - protein, 5 aa, Cryptosporidium hominis
YNSRS

SEQ ID NO: 2167649 - protein, 15 aa, Cryptosporidium hominis
YNSRVKNNTNPTQLK

SEQ ID NO: 2167650 - protein, 6 aa, Cryptosporidium hominis
YNSSEV

SEQ ID NO: 2167651 - protein, 10 aa, Cryptosporidium hominis
YNSSKSGKKY

SEQ ID NO: 2167652 - protein, 13 aa, Cryptosporidium hominis
YNSSPKATNSNAD

SEQ ID NO: 2167653 - protein, 13 aa, Cryptosporidium hominis
YNSSYEEGIPENS

SEQ ID NO: 2167654 - protein, 5 aa, Cryptosporidium hominis
YNTAP

SEQ ID NO: 2167655 - protein, 23 aa, Cryptosporidium hominis
YNTETTNNAIEHSSSEYNTSGDY

SEQ ID NO: 2167656 - protein, 10 aa, Cryptosporidium hominis
YNTGESYNYN

SEQ ID NO: 2167657 - protein, 24 aa, Cryptosporidium hominis
YNTHSNGKVTNDKEKSEECGSNSV

SEQ ID NO: 2167658 - protein, 14 aa, Cryptosporidium hominis
YNTNDFPINNSYYH

SEQ ID NO: 2167659 - protein, 10 aa, Cryptosporidium hominis
YNTNTNNKTK

SEQ ID NO: 2167660 - protein, 7 aa, Cryptosporidium hominis
YNTPSNR

SEQ ID NO: 2167661 - protein, 22 aa, Cryptosporidium hominis
YNTTTGQFEKNEDHPNPDEINP

SEQ ID NO: 2167662 - protein, 61 aa, Cryptosporidium hominis
YNTYNNPTNSQTQPVQQTTYPPPPNNNSSISTTGSSYNTAYGSQFPPKHEAKMNNPPMQTS

SEQ ID NO: 2167663 - protein, 32 aa, Cryptosporidium hominis
YNVSDESKSAEKRLESKRSGDTNVVESEHESN

SEQ ID NO: 2167664 - protein, 27 aa, Cryptosporidium hominis
YNYGSKQGNSNYGNSGFGQTYRQREHK

SEQ ID NO: 2167665 - protein, 8 aa, Cryptosporidium hominis
YNYNDTSD

SEQ ID NO: 2167666 - protein, 8 aa, Cryptosporidium hominis
YPAKNGEK

SEQ ID NO: 2167667 - protein, 12 aa, Cryptosporidium hominis
YPDAAKKIEESA

SEQ ID NO: 2167668 - protein, 10 aa, Cryptosporidium hominis
YPDKPSGEDS

SEQ ID NO: 2167669 - protein, 16 aa, Cryptosporidium hominis
YPEEKTNEVPKGNKEK

SEQ ID NO: 2167670 - protein, 6 aa, Cryptosporidium hominis
YPESDQ

SEQ ID NO: 2167671 - protein, 5 aa, Cryptosporidium hominis
YPESI

SEQ ID NO: 2167672 - protein, 11 aa, Cryptosporidium hominis
YPESSIESEST

SEQ ID NO: 2167673 - protein, 6 aa, Cryptosporidium hominis
YPFKPP

SEQ ID NO: 2167674 - protein, 12 aa, Cryptosporidium hominis
YPFSGTSNLSKD

SEQ ID NO: 2167675 - protein, 14 aa, Cryptosporidium hominis
YPGAPFPQTGPTHP

SEQ ID NO: 2167676 - protein, 6 aa, Cryptosporidium hominis
YPGDSE

SEQ ID NO: 2167677 - protein, 4 aa, Cryptosporidium hominis
YPGR

SEQ ID NO: 2167678 - protein, 6 aa, Cryptosporidium hominis
YPGSNI

SEQ ID NO: 2167679 - protein, 5 aa, Cryptosporidium hominis
YPKEV

SEQ ID NO: 2167680 - protein, 6 aa, Cryptosporidium hominis
YPKQGD

SEQ ID NO: 2167681 - protein, 5 aa, Cryptosporidium hominis
YPLGS

SEQ ID NO: 2167682 - protein, 13 aa, Cryptosporidium hominis
YPMANANNSMNNR

SEQ ID NO: 2167683 - protein, 6 aa, Cryptosporidium hominis
YPNEST

SEQ ID NO: 2167684 - protein, 11 aa, Cryptosporidium hominis
YPNPVNGVDSN

SEQ ID NO: 2167685 - protein, 5 aa, Cryptosporidium hominis
YPNSS

SEQ ID NO: 2167686 - protein, 8 aa, Cryptosporidium hominis
YPNSSNES

SEQ ID NO: 2167687 - protein, 4 aa, Cryptosporidium hominis
YPPE

SEQ ID NO: 2167688 - protein, 12 aa, Cryptosporidium hominis
YPPIKNKSPEYV

SEQ ID NO: 2167689 - protein, 8 aa, Cryptosporidium hominis
YPPPTQKT

SEQ ID NO: 2167690 - protein, 7 aa, Cryptosporidium hominis
YPPQSQI

SEQ ID NO: 2167691 - protein, 10 aa, Cryptosporidium hominis
YPPSMQNGRD

SEQ ID NO: 2167692 - protein, 5 aa, Cryptosporidium hominis
YPPTI

SEQ ID NO: 2167693 - protein, 13 aa, Cryptosporidium hominis
YPREPKKKLSGLD

SEQ ID NO: 2167694 - protein, 12 aa, Cryptosporidium hominis
YPRTETNSFSDS

SEQ ID NO: 2167695 - protein, 6 aa, Cryptosporidium hominis
YPRTNN

SEQ ID NO: 2167696 - protein, 5 aa, Cryptosporidium hominis
YPSDP

SEQ ID NO: 2167697 - protein, 9 aa, Cryptosporidium hominis
YPSDSNSDL

SEQ ID NO: 2167698 - protein, 13 aa, Cryptosporidium hominis
YPSKYGKKRMEYE

SEQ ID NO: 2167699 - protein, 4 aa, Cryptosporidium hominis
YPSL

SEQ ID NO: 2167700 - protein, 12 aa, Cryptosporidium hominis
YPSPLTAKTPDN

SEQ ID NO: 2167701 - protein, 5 aa, Cryptosporidium hominis
YPSPT

SEQ ID NO: 2167702 - protein, 21 aa, Cryptosporidium hominis
YPSSSRYNRDYPNGSRSSLSQ

SEQ ID NO: 2167703 - protein, 8 aa, Cryptosporidium hominis
YPTEKSDK

SEQ ID NO: 2167704 - protein, 4 aa, Cryptosporidium hominis
YPTG

SEQ ID NO: 2167705 - protein, 7 aa, Cryptosporidium hominis
YPTQSGS

SEQ ID NO: 2167706 - protein, 6 aa, Cryptosporidium hominis
YPVEEA

SEQ ID NO: 2167707 - protein, 6 aa, Cryptosporidium hominis
YPYEPP

SEQ ID NO: 2167708 - protein, 6 aa, Cryptosporidium hominis
YPYTSS

SEQ ID NO: 2167709 - protein, 18 aa, Cryptosporidium hominis
YQDDNGNTALHKSSANGH

SEQ ID NO: 2167710 - protein, 29 aa, Cryptosporidium hominis
YQDEDYKKVNRKDDFGNEGLDDSYDDDDD

SEQ ID NO: 2167711 - protein, 9 aa, Cryptosporidium hominis
YQDENFGGL

SEQ ID NO: 2167712 - protein, 14 aa, Cryptosporidium hominis
YQDKVSKTPLSTPD

SEQ ID NO: 2167713 - protein, 6 aa, Cryptosporidium hominis
YQDNQP

SEQ ID NO: 2167714 - protein, 9 aa, Cryptosporidium hominis
YQENNGSKN

SEQ ID NO: 2167715 - protein, 4 aa, Cryptosporidium hominis
YQER

SEQ ID NO: 2167716 - protein, 4 aa, Cryptosporidium hominis
YQES

SEQ ID NO: 2167717 - protein, 4 aa, Cryptosporidium hominis
YQGE

SEQ ID NO: 2167718 - protein, 10 aa, Cryptosporidium hominis
YQGKGKGSMA

SEQ ID NO: 2167719 - protein, 13 aa, Cryptosporidium hominis
YQGRQGSTLNGRS

SEQ ID NO: 2167720 - protein, 7 aa, Cryptosporidium hominis
YQGVQPP

SEQ ID NO: 2167721 - protein, 8 aa, Cryptosporidium hominis
YQHGQDTS

SEQ ID NO: 2167722 - protein, 19 aa, Cryptosporidium hominis
YQIKTNRKKQLDQTKYENN

SEQ ID NO: 2167723 - protein, 9 aa, Cryptosporidium hominis
YQKDDPNSF

SEQ ID NO: 2167724 - protein, 7 aa, Cryptosporidium hominis
YQKDSNN

SEQ ID NO: 2167725 - protein, 4 aa, Cryptosporidium hominis
YQKN

SEQ ID NO: 2167726 - protein, 4 aa, Cryptosporidium hominis
YQKS

SEQ ID NO: 2167727 - protein, 17 aa, Cryptosporidium hominis
YQLGKKTEEEVSETKIT

SEQ ID NO: 2167728 - protein, 4 aa, Cryptosporidium hominis
YQNE

SEQ ID NO: 2167729 - protein, 8 aa, Cryptosporidium hominis
YQPERGEW

SEQ ID NO: 2167730 - protein, 9 aa, Cryptosporidium hominis
YQPSQSDDE

SEQ ID NO: 2167731 - protein, 17 aa, Cryptosporidium hominis
YQQEKDSKTNTNKQAKE

SEQ ID NO: 2167732 - protein, 7 aa, Cryptosporidium hominis
YQQQSHH

SEQ ID NO: 2167733 - protein, 4 aa, Cryptosporidium hominis
YQQS

SEQ ID NO: 2167734 - protein, 6 aa, Cryptosporidium hominis
YQSEEN

SEQ ID NO: 2167735 - protein, 5 aa, Cryptosporidium hominis
YQSEK

SEQ ID NO: 2167736 - protein, 8 aa, Cryptosporidium hominis
YQSKNDIN

SEQ ID NO: 2167737 - protein, 7 aa, Cryptosporidium hominis
YQSSKSV

SEQ ID NO: 2167738 - protein, 12 aa, Cryptosporidium hominis
YQTNLKRNVGRI

SEQ ID NO: 2167739 - protein, 9 aa, Cryptosporidium hominis
YQTRQTTGA

SEQ ID NO: 2167740 - protein, 5 aa, Cryptosporidium hominis
YQVTP

SEQ ID NO: 2167741 - protein, 8 aa, Cryptosporidium hominis
YRAPSISG

SEQ ID NO: 2167742 - protein, 9 aa, Cryptosporidium hominis
YRASKEKNL

SEQ ID NO: 2167743 - protein, 5 aa, Cryptosporidium hominis
YRDDS

SEQ ID NO: 2167744 - protein, 5 aa, Cryptosporidium hominis
YRDEI

SEQ ID NO: 2167745 - protein, 11 aa, Cryptosporidium hominis
YRDNEYKNVQS

SEQ ID NO: 2167746 - protein, 5 aa, Cryptosporidium hominis
YRDQT

SEQ ID NO: 2167747 - protein, 8 aa, Cryptosporidium hominis
YREERRKI

SEQ ID NO: 2167748 - protein, 17 aa, Cryptosporidium hominis
YREGGIKREELKQNKFG

SEQ ID NO: 2167749 - protein, 13 aa, Cryptosporidium hominis
YRERQQNKLGYIN

SEQ ID NO: 2167750 - protein, 5 aa, Cryptosporidium hominis
YRETF

SEQ ID NO: 2167751 - protein, 6 aa, Cryptosporidium hominis
YRGGRT

SEQ ID NO: 2167752 - protein, 13 aa, Cryptosporidium hominis
YRGKKSNGQFEYT

SEQ ID NO: 2167753 - protein, 4 aa, Cryptosporidium hominis
YRGN

SEQ ID NO: 2167754 - protein, 11 aa, Cryptosporidium hominis
YRKAQGEKEGL

SEQ ID NO: 2167755 - protein, 46 aa, Cryptosporidium hominis
YRKRRSKRKQNEQNSEKDGLNLNGSNNSTSITENDSFGDRYSNDNT

SEQ ID NO: 2167756 - protein, 31 aa, Cryptosporidium hominis
YRKSSSSSSSSSSSISNTHPSTGKNTFGSHQ

SEQ ID NO: 2167757 - protein, 9 aa, Cryptosporidium hominis
YRMSPNNTI

SEQ ID NO: 2167758 - protein, 31 aa, Cryptosporidium hominis
YRNARNGEINPNEALRESSPNMTTISSGHRN

SEQ ID NO: 2167759 - protein, 5 aa, Cryptosporidium hominis
YRNIP

SEQ ID NO: 2167760 - protein, 14 aa, Cryptosporidium hominis
YRNKTDSTDPSNFT

SEQ ID NO: 2167761 - protein, 8 aa, Cryptosporidium hominis
YRNNGIKS

SEQ ID NO: 2167762 - protein, 10 aa, Cryptosporidium hominis
YRNQNTRKGY

SEQ ID NO: 2167763 - protein, 6 aa, Cryptosporidium hominis
YRNTKT

SEQ ID NO: 2167764 - protein, 16 aa, Cryptosporidium hominis
YRPNGNSNKGENSSSM

SEQ ID NO: 2167765 - protein, 4 aa, Cryptosporidium hominis
YRPP

SEQ ID NO: 2167766 - protein, 8 aa, Cryptosporidium hominis
YRPPNNPE

SEQ ID NO: 2167767 - protein, 22 aa, Cryptosporidium hominis
YRQPGSCKNSKSMTNLASNSSV

SEQ ID NO: 2167768 - protein, 14 aa, Cryptosporidium hominis
YRRPRGGGPVPNSQ

SEQ ID NO: 2167769 - protein, 14 aa, Cryptosporidium hominis
YRSGLTSGHKYKND

SEQ ID NO: 2167770 - protein, 9 aa, Cryptosporidium hominis
YRSNSSQLN

SEQ ID NO: 2167771 - protein, 8 aa, Cryptosporidium hominis
YRSTDTLE

SEQ ID NO: 2167772 - protein, 4 aa, Cryptosporidium hominis
YRTD

SEQ ID NO: 2167773 - protein, 18 aa, Cryptosporidium hominis
YRTGEDEDTPNSNNEEIP

SEQ ID NO: 2167774 - protein, 12 aa, Cryptosporidium hominis
YRYGSPAEDYHK

SEQ ID NO: 2167775 - protein, 9 aa, Cryptosporidium hominis
YSAASQAAA

SEQ ID NO: 2167776 - protein, 23 aa, Cryptosporidium hominis
YSAPSFGSNPNNPGAEHEISDIA

SEQ ID NO: 2167777 - protein, 12 aa, Cryptosporidium hominis
YSDDENDRIRKD

SEQ ID NO: 2167778 - protein, 5 aa, Cryptosporidium hominis
YSDEI

SEQ ID NO: 2167779 - protein, 23 aa, Cryptosporidium hominis
YSDENENSYVTKNSANGKVNTNI

SEQ ID NO: 2167780 - protein, 30 aa, Cryptosporidium hominis
YSDHSSNREYSSPRVKNTPSTQCNTDSSPC

SEQ ID NO: 2167781 - protein, 7 aa, Cryptosporidium hominis
YSDKPQA

SEQ ID NO: 2167782 - protein, 4 aa, Cryptosporidium hominis
YSDP

SEQ ID NO: 2167783 - protein, 4 aa, Cryptosporidium hominis
YSDT

SEQ ID NO: 2167784 - protein, 5 aa, Cryptosporidium hominis
YSDTR

SEQ ID NO: 2167785 - protein, 6 aa, Cryptosporidium hominis
YSDWGS

SEQ ID NO: 2167786 - protein, 31 aa, Cryptosporidium hominis
YSEAGGTGRRKGRSQNRKVDHRKNAKPGQNS

SEQ ID NO: 2167787 - protein, 5 aa, Cryptosporidium hominis
YSEED

SEQ ID NO: 2167788 - protein, 5 aa, Cryptosporidium hominis
YSEEK

SEQ ID NO: 2167789 - protein, 15 aa, Cryptosporidium hominis
YSEENSGGETDKGED

SEQ ID NO: 2167790 - protein, 10 aa, Cryptosporidium hominis
YSEGFPGTRY

SEQ ID NO: 2167791 - protein, 5 aa, Cryptosporidium hominis
YSEIG

SEQ ID NO: 2167792 - protein, 18 aa, Cryptosporidium hominis
YSENVDNMTSTSNDDDEE

SEQ ID NO: 2167793 - protein, 4 aa, Cryptosporidium hominis
YSES

SEQ ID NO: 2167794 - protein, 5 aa, Cryptosporidium hominis
YSESY

SEQ ID NO: 2167795 - protein, 5 aa, Cryptosporidium hominis
YSEYN

SEQ ID NO: 2167796 - protein, 18 aa, Cryptosporidium hominis
YSGAKDTLGGKSSELHAP

SEQ ID NO: 2167797 - protein, 4 aa, Cryptosporidium hominis
YSGD

SEQ ID NO: 2167798 - protein, 7 aa, Cryptosporidium hominis
YSGGEGT

SEQ ID NO: 2167799 - protein, 13 aa, Cryptosporidium hominis
YSGGKLDKSEKLD

SEQ ID NO: 2167800 - protein, 8 aa, Cryptosporidium hominis
YSGGLTKG

SEQ ID NO: 2167801 - protein, 21 aa, Cryptosporidium hominis
YSGGQSPVSEDLAESQRSYYK

SEQ ID NO: 2167802 - protein, 12 aa, Cryptosporidium hominis
YSGGQYSSEDTS

SEQ ID NO: 2167803 - protein, 12 aa, Cryptosporidium hominis
YSGKISKANSIL

SEQ ID NO: 2167804 - protein, 5 aa, Cryptosporidium hominis
YSGQM

SEQ ID NO: 2167805 - protein, 8 aa, Cryptosporidium hominis
YSGRHENS

SEQ ID NO: 2167806 - protein, 5 aa, Cryptosporidium hominis
YSGRT

SEQ ID NO: 2167807 - protein, 12 aa, Cryptosporidium hominis
YSGSNDKSQGVD

SEQ ID NO: 2167808 - protein, 8 aa, Cryptosporidium hominis
YSGSNGSS

SEQ ID NO: 2167809 - protein, 20 aa, Cryptosporidium hominis
YSGSTMPSQYTNTNNRQLSN

SEQ ID NO: 2167810 - protein, 49 aa, Cryptosporidium hominis
YSHSKSVPGPINSSSSRSRSPSIETNKSENKNDGRNKIRDKVRQRDRDF

SEQ ID NO: 2167811 - protein, 26 aa, Cryptosporidium hominis
YSIGQNDGASTSRISNGINTNNNTAN

SEQ ID NO: 2167812 - protein, 6 aa, Cryptosporidium hominis
YSISED

SEQ ID NO: 2167813 - protein, 6 aa, Cryptosporidium hominis
YSKATS

SEQ ID NO: 2167814 - protein, 10 aa, Cryptosporidium hominis
YSKEKDESQL

SEQ ID NO: 2167815 - protein, 6 aa, Cryptosporidium hominis
YSKENQ

SEQ ID NO: 2167816 - protein, 12 aa, Cryptosporidium hominis
YSKKQFNSISNW

SEQ ID NO: 2167817 - protein, 4 aa, Cryptosporidium hominis
YSKN

SEQ ID NO: 2167818 - protein, 8 aa, Cryptosporidium hominis
YSKNSPIE

SEQ ID NO: 2167819 - protein, 5 aa, Cryptosporidium hominis
YSKPI

SEQ ID NO: 2167820 - protein, 6 aa, Cryptosporidium hominis
YSKPVK

SEQ ID NO: 2167821 - protein, 16 aa, Cryptosporidium hominis
YSKSDRSSLPGESQSC

SEQ ID NO: 2167822 - protein, 5 aa, Cryptosporidium hominis
YSKSK

SEQ ID NO: 2167823 - protein, 6 aa, Cryptosporidium hominis
YSKTAY

SEQ ID NO: 2167824 - protein, 10 aa, Cryptosporidium hominis
YSKTESQLTS

SEQ ID NO: 2167825 - protein, 6 aa, Cryptosporidium hominis
YSKYGS

SEQ ID NO: 2167826 - protein, 9 aa, Cryptosporidium hominis
YSLEETNEK

SEQ ID NO: 2167827 - protein, 9 aa, Cryptosporidium hominis
YSLEGKKAR

SEQ ID NO: 2167828 - protein, 11 aa, Cryptosporidium hominis
YSLPSFSEGPS

SEQ ID NO: 2167829 - protein, 11 aa, Cryptosporidium hominis
YSLSTTSNHHH

SEQ ID NO: 2167830 - protein, 19 aa, Cryptosporidium hominis
YSMNTTSSRVVEKEDSGIL

SEQ ID NO: 2167831 - protein, 9 aa, Cryptosporidium hominis
YSNDDNEVF

SEQ ID NO: 2167832 - protein, 7 aa, Cryptosporidium hominis
YSNEEKR

SEQ ID NO: 2167833 - protein, 8 aa, Cryptosporidium hominis
YSNEIEYD

SEQ ID NO: 2167834 - protein, 4 aa, Cryptosporidium hominis
YSNG

SEQ ID NO: 2167835 - protein, 14 aa, Cryptosporidium hominis
YSNGGSVKQFRPSS

SEQ ID NO: 2167836 - protein, 16 aa, Cryptosporidium hominis
YSNGTVSIDKNGDKSS

SEQ ID NO: 2167837 - protein, 16 aa, Cryptosporidium hominis
YSNISSPIQQNNTGDL

SEQ ID NO: 2167838 - protein, 9 aa, Cryptosporidium hominis
YSNLEGQNR

SEQ ID NO: 2167839 - protein, 4 aa, Cryptosporidium hominis
YSNN

SEQ ID NO: 2167840 - protein, 11 aa, Cryptosporidium hominis
YSNNTSGIQQI

SEQ ID NO: 2167841 - protein, 8 aa, Cryptosporidium hominis
YSNPNSIT

SEQ ID NO: 2167842 - protein, 4 aa, Cryptosporidium hominis
YSNS

SEQ ID NO: 2167843 - protein, 13 aa, Cryptosporidium hominis
YSNSELEEEIVER

SEQ ID NO: 2167844 - protein, 19 aa, Cryptosporidium hominis
YSNSGGNKSLQSSSSNPTN

SEQ ID NO: 2167845 - protein, 5 aa, Cryptosporidium hominis
YSNSR

SEQ ID NO: 2167846 - protein, 5 aa, Cryptosporidium hominis
YSNTN

SEQ ID NO: 2167847 - protein, 13 aa, Cryptosporidium hominis
YSNTNETNGSQTQ

SEQ ID NO: 2167848 - protein, 9 aa, Cryptosporidium hominis
YSPDSKNGK

SEQ ID NO: 2167849 - protein, 13 aa, Cryptosporidium hominis
YSPEDQEKKEPVY

SEQ ID NO: 2167850 - protein, 28 aa, Cryptosporidium hominis
YSPENPSKHELSQQESQKAETPHQQDIQ

SEQ ID NO: 2167851 - protein, 9 aa, Cryptosporidium hominis
YSPETRSWT

SEQ ID NO: 2167852 - protein, 9 aa, Cryptosporidium hominis
YSPMSPSSP

SEQ ID NO: 2167853 - protein, 4 aa, Cryptosporidium hominis
YSPN

SEQ ID NO: 2167854 - protein, 45 aa, Cryptosporidium hominis
YSPNSYHQSSPYYSNSPSSSPRSLSPSLTSRQSPQLGSEQSRAES

SEQ ID NO: 2167855 - protein, 18 aa, Cryptosporidium hominis
YSPRESKEVCGGKKRSEI

SEQ ID NO: 2167856 - protein, 15 aa, Cryptosporidium hominis
YSPSENEDSNEEIDE

SEQ ID NO: 2167857 - protein, 7 aa, Cryptosporidium hominis
YSPSNGY

SEQ ID NO: 2167858 - protein, 14 aa, Cryptosporidium hominis
YSPSNVKSNIKNPK

SEQ ID NO: 2167859 - protein, 5 aa, Cryptosporidium hominis
YSPSV

SEQ ID NO: 2167860 - protein, 6 aa, Cryptosporidium hominis
YSPTEI

SEQ ID NO: 2167861 - protein, 7 aa, Cryptosporidium hominis
YSPTNGT

SEQ ID NO: 2167862 - protein, 5 aa, Cryptosporidium hominis
YSPYT

SEQ ID NO: 2167863 - protein, 5 aa, Cryptosporidium hominis
YSQEK

SEQ ID NO: 2167864 - protein, 9 aa, Cryptosporidium hominis
YSQEYEVPP

SEQ ID NO: 2167865 - protein, 12 aa, Cryptosporidium hominis
YSQGPNPSQHGL

SEQ ID NO: 2167866 - protein, 9 aa, Cryptosporidium hominis
YSQNGNSLP

SEQ ID NO: 2167867 - protein, 8 aa, Cryptosporidium hominis
YSQNNGEI

SEQ ID NO: 2167868 - protein, 4 aa, Cryptosporidium hominis
YSQP

SEQ ID NO: 2167869 - protein, 23 aa, Cryptosporidium hominis
YSQSIEANGYGYNNENITSNNGS

SEQ ID NO: 2167870 - protein, 11 aa, Cryptosporidium hominis
YSQSSMNEESS

SEQ ID NO: 2167871 - protein, 11 aa, Cryptosporidium hominis
YSREQKSELDK

SEQ ID NO: 2167872 - protein, 7 aa, Cryptosporidium hominis
YSRERND

SEQ ID NO: 2167873 - protein, 17 aa, Cryptosporidium hominis
YSRGRDSRLSRDTNTGT

SEQ ID NO: 2167874 - protein, 10 aa, Cryptosporidium hominis
YSRKNSENKY

SEQ ID NO: 2167875 - protein, 6 aa, Cryptosporidium hominis
YSRNGN

SEQ ID NO: 2167876 - protein, 17 aa, Cryptosporidium hominis
YSRQSETPRASFTNTYN

SEQ ID NO: 2167877 - protein, 9 aa, Cryptosporidium hominis
YSSAEQRER

SEQ ID NO: 2167878 - protein, 6 aa, Cryptosporidium hominis
YSSAGT

SEQ ID NO: 2167879 - protein, 11 aa, Cryptosporidium hominis
YSSASGHGTGT

SEQ ID NO: 2167880 - protein, 6 aa, Cryptosporidium hominis
YSSDPY

SEQ ID NO: 2167881 - protein, 8 aa, Cryptosporidium hominis
YSSDTENI

SEQ ID NO: 2167882 - protein, 5 aa, Cryptosporidium hominis
YSSEH

SEQ ID NO: 2167883 - protein, 21 aa, Cryptosporidium hominis
YSSENKRATPQQTISNRAPNI

SEQ ID NO: 2167884 - protein, 9 aa, Cryptosporidium hominis
YSSGAEWNP

SEQ ID NO: 2167885 - protein, 9 aa, Cryptosporidium hominis
YSSGENGDY

SEQ ID NO: 2167886 - protein, 11 aa, Cryptosporidium hominis
YSSKEKPANSA

SEQ ID NO: 2167887 - protein, 9 aa, Cryptosporidium hominis
YSSKNTSYH

SEQ ID NO: 2167888 - protein, 4 aa, Cryptosporidium hominis
YSSL

SEQ ID NO: 2167889 - protein, 15 aa, Cryptosporidium hominis
YSSNDRKSPRSAEIT

SEQ ID NO: 2167890 - protein, 10 aa, Cryptosporidium hominis
YSSNKDEHSI

SEQ ID NO: 2167891 - protein, 8 aa, Cryptosporidium hominis
YSSNPSDD

SEQ ID NO: 2167892 - protein, 8 aa, Cryptosporidium hominis
YSSNSNLD

SEQ ID NO: 2167893 - protein, 8 aa, Cryptosporidium hominis
YSSPVGDL

SEQ ID NO: 2167894 - protein, 11 aa, Cryptosporidium hominis
YSSQGRSQGRV

SEQ ID NO: 2167895 - protein, 8 aa, Cryptosporidium hominis
YSSRAPPE

SEQ ID NO: 2167896 - protein, 16 aa, Cryptosporidium hominis
YSSSKTSLNNQKQKKY

SEQ ID NO: 2167897 - protein, 46 aa, Cryptosporidium hominis
YSSSRGGNSQRGANAVGTSSMTGNMGSAAASSSKGRSISDSRREGL

SEQ ID NO: 2167898 - protein, 9 aa, Cryptosporidium hominis
YSSSTTTTM

SEQ ID NO: 2167899 - protein, 10 aa, Cryptosporidium hominis
YSSTSLSSHH

SEQ ID NO: 2167900 - protein, 5 aa, Cryptosporidium hominis
YSTAA

SEQ ID NO: 2167901 - protein, 16 aa, Cryptosporidium hominis
YSTAPKDMKGKKPQEL

SEQ ID NO: 2167902 - protein, 13 aa, Cryptosporidium hominis
YSTDSNNRRVYDN

SEQ ID NO: 2167903 - protein, 10 aa, Cryptosporidium hominis
YSTGEPERLG

SEQ ID NO: 2167904 - protein, 5 aa, Cryptosporidium hominis
YSTPG

SEQ ID NO: 2167905 - protein, 10 aa, Cryptosporidium hominis
YSTPRRVTKN

SEQ ID NO: 2167906 - protein, 9 aa, Cryptosporidium hominis
YSTPTTKNG

SEQ ID NO: 2167907 - protein, 12 aa, Cryptosporidium hominis
YSTSKSKLPDLN

SEQ ID NO: 2167908 - protein, 4 aa, Cryptosporidium hominis
YSVD

SEQ ID NO: 2167909 - protein, 11 aa, Cryptosporidium hominis
YSVDDSSEHKS

SEQ ID NO: 2167910 - protein, 6 aa, Cryptosporidium hominis
YSVDGA

SEQ ID NO: 2167911 - protein, 6 aa, Cryptosporidium hominis
YSYGKN

SEQ ID NO: 2167912 - protein, 11 aa, Cryptosporidium hominis
YSYNSNDQSYK

SEQ ID NO: 2167913 - protein, 6 aa, Cryptosporidium hominis
YTAENR

SEQ ID NO: 2167914 - protein, 12 aa, Cryptosporidium hominis
YTASKKNEENLN

SEQ ID NO: 2167915 - protein, 4 aa, Cryptosporidium hominis
YTDH

SEQ ID NO: 2167916 - protein, 15 aa, Cryptosporidium hominis
YTDSEYSGLNTDDLR

SEQ ID NO: 2167917 - protein, 10 aa, Cryptosporidium hominis
YTDSQFSSSI

SEQ ID NO: 2167918 - protein, 4 aa, Cryptosporidium hominis
YTED

SEQ ID NO: 2167919 - protein, 11 aa, Cryptosporidium hominis
YTENDVTSELT

SEQ ID NO: 2167920 - protein, 6 aa, Cryptosporidium hominis
YTEQNG

SEQ ID NO: 2167921 - protein, 6 aa, Cryptosporidium hominis
YTESKG

SEQ ID NO: 2167922 - protein, 13 aa, Cryptosporidium hominis
YTGGSTGELIVCS

SEQ ID NO: 2167923 - protein, 4 aa, Cryptosporidium hominis
YTGK

SEQ ID NO: 2167924 - protein, 11 aa, Cryptosporidium hominis
YTGKDDPESIY

SEQ ID NO: 2167925 - protein, 21 aa, Cryptosporidium hominis
YTGNSHSHQLEPPNEDLVEDQ

SEQ ID NO: 2167926 - protein, 6 aa, Cryptosporidium hominis
YTGPLT

SEQ ID NO: 2167927 - protein, 6 aa, Cryptosporidium hominis
YTGSDV

SEQ ID NO: 2167928 - protein, 7 aa, Cryptosporidium hominis
YTGSGKT

SEQ ID NO: 2167929 - protein, 11 aa, Cryptosporidium hominis
YTISGTKQGSI

SEQ ID NO: 2167930 - protein, 7 aa, Cryptosporidium hominis
YTKEEGA

SEQ ID NO: 2167931 - protein, 9 aa, Cryptosporidium hominis
YTKQSISDK

SEQ ID NO: 2167932 - protein, 5 aa, Cryptosporidium hominis
YTMEG

SEQ ID NO: 2167933 - protein, 6 aa, Cryptosporidium hominis
YTMPQA

SEQ ID NO: 2167934 - protein, 8 aa, Cryptosporidium hominis
YTNGTPHM

SEQ ID NO: 2167935 - protein, 6 aa, Cryptosporidium hominis
YTPDGI

SEQ ID NO: 2167936 - protein, 9 aa, Cryptosporidium hominis
YTPGKLKND

SEQ ID NO: 2167937 - protein, 6 aa, Cryptosporidium hominis
YTPNPH

SEQ ID NO: 2167938 - protein, 20 aa, Cryptosporidium hominis
YTPSTASSIRDKMNLHNLEV

SEQ ID NO: 2167939 - protein, 15 aa, Cryptosporidium hominis
YTQNLDQADSQRNDD

SEQ ID NO: 2167940 - protein, 5 aa, Cryptosporidium hominis
YTRDS

SEQ ID NO: 2167941 - protein, 8 aa, Cryptosporidium hominis
YTRETSNR

SEQ ID NO: 2167942 - protein, 11 aa, Cryptosporidium hominis
YTRKKNQKGKW

SEQ ID NO: 2167943 - protein, 11 aa, Cryptosporidium hominis
YTRKKSAETQK

SEQ ID NO: 2167944 - protein, 4 aa, Cryptosporidium hominis
YTRQ

SEQ ID NO: 2167945 - protein, 5 aa, Cryptosporidium hominis
YTSAA

SEQ ID NO: 2167946 - protein, 7 aa, Cryptosporidium hominis
YTSDLNS

SEQ ID NO: 2167947 - protein, 11 aa, Cryptosporidium hominis
YTSGKGASAVG

SEQ ID NO: 2167948 - protein, 30 aa, Cryptosporidium hominis
YTSGTGHHGGGISTVSSSLEGVNNTGTVIG

SEQ ID NO: 2167949 - protein, 18 aa, Cryptosporidium hominis
YTSKEGKNVEVYSSKSSE

SEQ ID NO: 2167950 - protein, 5 aa, Cryptosporidium hominis
YTSKQ

SEQ ID NO: 2167951 - protein, 13 aa, Cryptosporidium hominis
YTSNGLDSNGRGQ

SEQ ID NO: 2167952 - protein, 7 aa, Cryptosporidium hominis
YTSQADI

SEQ ID NO: 2167953 - protein, 10 aa, Cryptosporidium hominis
YTSSNSSLTD

SEQ ID NO: 2167954 - protein, 6 aa, Cryptosporidium hominis
YTSTPG

SEQ ID NO: 2167955 - protein, 7 aa, Cryptosporidium hominis
YTTDCTT

SEQ ID NO: 2167956 - protein, 9 aa, Cryptosporidium hominis
YTTKTSPQI

SEQ ID NO: 2167957 - protein, 14 aa, Cryptosporidium hominis
YTTNESNMVSFKQS

SEQ ID NO: 2167958 - protein, 7 aa, Cryptosporidium hominis
YTTREQT

SEQ ID NO: 2167959 - protein, 46 aa, Cryptosporidium hominis
YTTRNSYNRRGNDDRRNRGNQRPNNSLQARREAPDVSDTRAFPVLG

SEQ ID NO: 2167960 - protein, 6 aa, Cryptosporidium hominis
YTTSSN

SEQ ID NO: 2167961 - protein, 17 aa, Cryptosporidium hominis
YTTTQQTQKYKDQYSES

SEQ ID NO: 2167962 - protein, 5 aa, Cryptosporidium hominis
YTTVR

SEQ ID NO: 2167963 - protein, 6 aa, Cryptosporidium hominis
YVDEQE

SEQ ID NO: 2167964 - protein, 5 aa, Cryptosporidium hominis
YVDES

SEQ ID NO: 2167965 - protein, 15 aa, Cryptosporidium hominis
YVEEGEEGEEEGKEF

SEQ ID NO: 2167966 - protein, 8 aa, Cryptosporidium hominis
YVGDPSQF

SEQ ID NO: 2167967 - protein, 4 aa, Cryptosporidium hominis
YVGG

SEQ ID NO: 2167968 - protein, 13 aa, Cryptosporidium hominis
YVGSSKAPIGGSS

SEQ ID NO: 2167969 - protein, 9 aa, Cryptosporidium hominis
YVNSGDKLP

SEQ ID NO: 2167970 - protein, 10 aa, Cryptosporidium hominis
YVPEDEDNNP

SEQ ID NO: 2167971 - protein, 5 aa, Cryptosporidium hominis
YVPGE

SEQ ID NO: 2167972 - protein, 10 aa, Cryptosporidium hominis
YVPNNNVEEE

SEQ ID NO: 2167973 - protein, 11 aa, Cryptosporidium hominis
YVPSSNKDLNQ

SEQ ID NO: 2167974 - protein, 12 aa, Cryptosporidium hominis
YVQPKKNLTQEN

SEQ ID NO: 2167975 - protein, 10 aa, Cryptosporidium hominis
YVSPKNDSRN

SEQ ID NO: 2167976 - protein, 14 aa, Cryptosporidium hominis
YVSSEGEDFDSKDK

SEQ ID NO: 2167977 - protein, 24 aa, Cryptosporidium hominis
YVTNDSVKQDNSKKADTLNFDSET

SEQ ID NO: 2167978 - protein, 7 aa, Cryptosporidium hominis
YYADKED

SEQ ID NO: 2167979 - protein, 9 aa, Cryptosporidium hominis
YYDQGYDND

SEQ ID NO: 2167980 - protein, 5 aa, Cryptosporidium hominis
YYEEG

SEQ ID NO: 2167981 - protein, 13 aa, Cryptosporidium hominis
YYGDDYNNNNNSI

SEQ ID NO: 2167982 - protein, 9 aa, Cryptosporidium hominis
YYGENNGLT

SEQ ID NO: 2167983 - protein, 6 aa, Cryptosporidium hominis
YYKDND

SEQ ID NO: 2167984 - protein, 18 aa, Cryptosporidium hominis
YYNEKGNIKYEKNHQDPE

SEQ ID NO: 2167985 - protein, 44 aa, Cryptosporidium hominis
YYNNSNKKVRYSDDSLDYSQDNELSREYRNRNNNNNNNNSNNNN

SEQ ID NO: 2167986 - protein, 20 aa, Cryptosporidium hominis
YYNSPNLNSSVSQPGPSQFQ

SEQ ID NO: 2167987 - protein, 15 aa, Cryptosporidium hominis
YYPQGEENDNGEGIE

SEQ ID NO: 2167988 - protein, 5 aa, Cryptosporidium hominis
YYQNN

SEQ ID NO: 2167989 - protein, 14 aa, Cryptosporidium hominis
YYQQSGRAGRDSKF

SEQ ID NO: 2167990 - protein, 16 aa, Cryptosporidium hominis
YYRSKNTGCCGSSCGG

SEQ ID NO: 2167991 - protein, 22 aa, Cryptosporidium hominis
YYRTRSSSYCTSTCSSSPPTTG

SEQ ID NO: 2167992 - protein, 12 aa, Cryptosporidium hominis
YYSNNSREQIET

SEQ ID NO: 2167993 - protein, 7 aa, Cryptosporidium hominis
YYSPKNY

SEQ ID NO: 2167994 - protein, 4 aa, Cryptosporidium hominis
YYSS

SEQ ID NO: 2167995 - protein, 8 aa, Cryptosporidium hominis
YYTDEDGY

SEQ ID NO: 2167996 - protein, 6 aa, Cryptosporidium hominis
YYTNGN

SEQ ID NO: 2167997 - protein, 17 aa, Cryptosporidium hominis
YYYGEGNETCSSSDDAP

SEQ ID NO: 2167998 - protein, 22 aa, Cryptosporidium hominis
EGIPPDQQRLIFAGKQLEDGRT

SEQ ID NO: 2167999 - protein, 20 aa, Cryptosporidium hominis
LKAKVPVKPSPLLKSKSEKE

SEQ ID NO: 2168000 - protein, 18 aa, Cryptosporidium hominis
ESVYAPKVYGAWNLHECC

SEQ ID NO: 2168001 - protein, 17 aa, Cryptosporidium hominis
ILGPYVPSIIQFIDNIV

SEQ ID NO: 2168002 - protein, 17 aa, Cryptosporidium hominis
IQKESTLHLVLRLRGGM

SEQ ID NO: 2168003 - protein, 29 aa, Cryptosporidium hominis
KESTLHLVLRLRGGMQIFVKTLTGKTITL

SEQ ID NO: 2168004 - protein, 18 aa, Cryptosporidium hominis
LKLGEVVTTIPTIGFNVE

SEQ ID NO: 2168005 - protein, 21 aa, Cryptosporidium hominis
LNKNLKHFVMFSSVASLLGNF

SEQ ID NO: 2168006 - protein, 22 aa, Cryptosporidium hominis
PFQPNHIVDGISECDLYLFSTC

SEQ ID NO: 2168007 - protein, 18 aa, Cryptosporidium hominis
TILYKLKLGEVVTTIPTI

SEQ ID NO: 2168008 - protein, 17 aa, Cryptosporidium hominis
VYGAWNLHECCEKFELN

SEQ ID NO: 2168009 - protein, 30 aa, Cryptosporidium hominis
AAALGRLIQRTRWPIICICNDRMSEKVRNL

SEQ ID NO: 2168010 - protein, 18 aa, Cryptosporidium hominis
AAALNFNGHFNFGHHSIQ

SEQ ID NO: 2168011 - protein, 18 aa, Cryptosporidium hominis
AAANEWGGVSGNWGGSAA

SEQ ID NO: 2168012 - protein, 26 aa, Cryptosporidium hominis
AAANSWKPIEDGFEISNVIKGNTIDS

SEQ ID NO: 2168013 - protein, 21 aa, Cryptosporidium hominis
AAAQSKYSWHILVTNVDGKLI

SEQ ID NO: 2168014 - protein, 18 aa, Cryptosporidium hominis
AAAVYSRYFFDSQPAKLF

SEQ ID NO: 2168015 - protein, 25 aa, Cryptosporidium hominis
AADKQIPCRFHLISVPPNSRVGSSG

SEQ ID NO: 2168016 - protein, 30 aa, Cryptosporidium hominis
AAFNYGCLMAELKEKMVLFRNRLNKGEEEN

SEQ ID NO: 2168017 - protein, 25 aa, Cryptosporidium hominis
AAFRSKGRIPILSWTNPDLKCTLWR

SEQ ID NO: 2168018 - protein, 27 aa, Cryptosporidium hominis
AAGILKRSLPLVFSRYMSSKCEGKKSS

SEQ ID NO: 2168019 - protein, 17 aa, Cryptosporidium hominis
AAGMLSHASIMRYRKKK

SEQ ID NO: 2168020 - protein, 18 aa, Cryptosporidium hominis
AAILSNGELYTWGCSKNG

SEQ ID NO: 2168021 - protein, 18 aa, Cryptosporidium hominis
AAIQAGVLKGEIKDLLLL

SEQ ID NO: 2168022 - protein, 17 aa, Cryptosporidium hominis
AAIVVKKCKNAIQKYLE

SEQ ID NO: 2168023 - protein, 19 aa, Cryptosporidium hominis
AAKGFSWLESNPCQFDINQ

SEQ ID NO: 2168024 - protein, 23 aa, Cryptosporidium hominis
AAKKFAKQFSCGASVVKGTSGKP

SEQ ID NO: 2168025 - protein, 23 aa, Cryptosporidium hominis
AAKLNEERLRIEANKNSEHPESI

SEQ ID NO: 2168026 - protein, 38 aa, Cryptosporidium hominis
AAKVQTMRALNCTRILQELIKACILRRRKHELQDILKL

SEQ ID NO: 2168027 - protein, 19 aa, Cryptosporidium hominis
AALKVAIEFLEHKRAEKSP

SEQ ID NO: 2168028 - protein, 24 aa, Cryptosporidium hominis
AANELKSRVSIVYSSSSKIIYSKS

SEQ ID NO: 2168029 - protein, 33 aa, Cryptosporidium hominis
AAPRVFYKPKFGWRFFPPNVPDFSRLLVLSKAF

SEQ ID NO: 2168030 - protein, 24 aa, Cryptosporidium hominis
AAQDWTFASSIIKNSSINASNSAS

SEQ ID NO: 2168031 - protein, 20 aa, Cryptosporidium hominis
AAQEIVKFVGKYTPLRQFFF

SEQ ID NO: 2168032 - protein, 26 aa, Cryptosporidium hominis
AAQIRSICLMDTFSLVRSISNLRLIG

SEQ ID NO: 2168033 - protein, 26 aa, Cryptosporidium hominis
AAQTGPKLQEWLGLRDWKNNQSKKQN

SEQ ID NO: 2168034 - protein, 20 aa, Cryptosporidium hominis
AARIALKFHNLREAYPQHFK

SEQ ID NO: 2168035 - protein, 25 aa, Cryptosporidium hominis
AASSEIISGLSFAYPNSSNESFINV

SEQ ID NO: 2168036 - protein, 28 aa, Cryptosporidium hominis
AAVLCSKGNIYLPAWARIYNDRTKLEPT

SEQ ID NO: 2168037 - protein, 25 aa, Cryptosporidium hominis
AAYCTGLLCARRVLKQLNMDKIFTG

SEQ ID NO: 2168038 - protein, 22 aa, Cryptosporidium hominis
AAYFGLECEIHMGEVDVKKEYP

SEQ ID NO: 2168039 - protein, 21 aa, Cryptosporidium hominis
ACASRPSFRPAFSPLSPSRVL

SEQ ID NO: 2168040 - protein, 27 aa, Cryptosporidium hominis
ACIDFPLKQYRMQMGIRVELEDPKELA

SEQ ID NO: 2168041 - protein, 18 aa, Cryptosporidium hominis
ACLNSRKVIPPTLILIDH

SEQ ID NO: 2168042 - protein, 20 aa, Cryptosporidium hominis
ACPGEEIIVTGIYRTFRDQK

SEQ ID NO: 2168043 - protein, 22 aa, Cryptosporidium hominis
ACTNECGWGIQTRGRRINANLI

SEQ ID NO: 2168044 - protein, 26 aa, Cryptosporidium hominis
ADADILCTMPWQFVIIDEAHRLKNRG

SEQ ID NO: 2168045 - protein, 18 aa, Cryptosporidium hominis
ADCIPHFGYTIGRTLSER

SEQ ID NO: 2168046 - protein, 21 aa, Cryptosporidium hominis
ADDLLPLLIFCIIQSNPTKIK

SEQ ID NO: 2168047 - protein, 23 aa, Cryptosporidium hominis
ADGSEIRATCFTKAVDKFYDVLK

SEQ ID NO: 2168048 - protein, 24 aa, Cryptosporidium hominis
ADIKAICTEAGLLALRERRMRVTQ

SEQ ID NO: 2168049 - protein, 25 aa, Cryptosporidium hominis
ADIKRKEIMDSLFACQVGDNGNNSE

SEQ ID NO: 2168050 - protein, 25 aa, Cryptosporidium hominis
ADITNRLGTWLLRIQLNNKLVTDKK

SEQ ID NO: 2168051 - protein, 19 aa, Cryptosporidium hominis
ADKACGFGVYTYANGNRYE

SEQ ID NO: 2168052 - protein, 18 aa, Cryptosporidium hominis
ADKILKDFICNEINSFYY

SEQ ID NO: 2168053 - protein, 22 aa, Cryptosporidium hominis
ADKTGGLKLFLLDNEGTLTPDF

SEQ ID NO: 2168054 - protein, 17 aa, Cryptosporidium hominis
ADLKILGITPFNVSFTS

SEQ ID NO: 2168055 - protein, 17 aa, Cryptosporidium hominis
ADLKTLINEAALIRVNK

SEQ ID NO: 2168056 - protein, 20 aa, Cryptosporidium hominis
ADLPSGFEGLKMLKSSSSPE

SEQ ID NO: 2168057 - protein, 18 aa, Cryptosporidium hominis
ADPFSEFTCGPIDCNKQV

SEQ ID NO: 2168058 - protein, 26 aa, Cryptosporidium hominis
ADPPYSPYCLRCIMLCTISPSVTFFQ

SEQ ID NO: 2168059 - protein, 17 aa, Cryptosporidium hominis
ADPRVPFSPDYWQKQIL

SEQ ID NO: 2168060 - protein, 19 aa, Cryptosporidium hominis
ADRGIVCIDEFDKMSFSDR

SEQ ID NO: 2168061 - protein, 26 aa, Cryptosporidium hominis
ADRWQCGKCLKQFKGEEYVHKHLAKK

SEQ ID NO: 2168062 - protein, 22 aa, Cryptosporidium hominis
ADSEWFSILLFHQNRKKGNFGG

SEQ ID NO: 2168063 - protein, 24 aa, Cryptosporidium hominis
ADSRLSKCKMQFNNVELMTKMNVL

SEQ ID NO: 2168064 - protein, 18 aa, Cryptosporidium hominis
ADTLKQFLVLYGHSLPVA

SEQ ID NO: 2168065 - protein, 20 aa, Cryptosporidium hominis
AEAFSLIPLEAEKGAIFENH

SEQ ID NO: 2168066 - protein, 18 aa, Cryptosporidium hominis
AEALRLATEQSIRVNDEG

SEQ ID NO: 2168067 - protein, 21 aa, Cryptosporidium hominis
AEAQAKMRLSPVVSNKDVDGA

SEQ ID NO: 2168068 - protein, 34 aa, Cryptosporidium hominis
AEARVMVFLDSFDPYGSLCLERSFAILSNNDREN

SEQ ID NO: 2168069 - protein, 18 aa, Cryptosporidium hominis
AEEMFKKIAEAYEVLSDP

SEQ ID NO: 2168070 - protein, 19 aa, Cryptosporidium hominis
AEFLVKKCLSNQWKTGIDF

SEQ ID NO: 2168071 - protein, 18 aa, Cryptosporidium hominis
AEGGVYWERIFQLIPCPY

SEQ ID NO: 2168072 - protein, 21 aa, Cryptosporidium hominis
AEGTCSITLRQRCSPTPEQPK

SEQ ID NO: 2168073 - protein, 20 aa, Cryptosporidium hominis
AEGTGLKIGSGVTMGPGVTI

SEQ ID NO: 2168074 - protein, 21 aa, Cryptosporidium hominis
AEHKGKPFLPGLIEKMTGPVL

SEQ ID NO: 2168075 - protein, 19 aa, Cryptosporidium hominis
AEIPLDLTDEYLAKWLDGK

SEQ ID NO: 2168076 - protein, 24 aa, Cryptosporidium hominis
AEIPPKYILNFPIKNPLFITSNIK

SEQ ID NO: 2168077 - protein, 23 aa, Cryptosporidium hominis
AEISPLRSGLMINEESEEKFGFG

SEQ ID NO: 2168078 - protein, 28 aa, Cryptosporidium hominis
AEKKFKTHILKRSKSIGVSKVKRATNTE

SEQ ID NO: 2168079 - protein, 24 aa, Cryptosporidium hominis
AEKLAREAWRRWIQEEGNVVDDIT

SEQ ID NO: 2168080 - protein, 25 aa, Cryptosporidium hominis
AEKREVWTLGCLLHTLVFGYPPYFD

SEQ ID NO: 2168081 - protein, 20 aa, Cryptosporidium hominis
AELCSLNLQKRLRVLPPKHP

SEQ ID NO: 2168082 - protein, 19 aa, Cryptosporidium hominis
AELEKYLSAIELLDEDMNY

SEQ ID NO: 2168083 - protein, 17 aa, Cryptosporidium hominis
AELLEYINRSIIKNSVS

SEQ ID NO: 2168084 - protein, 24 aa, Cryptosporidium hominis
AELLKPFPTGISWYCKKRRFYTSN

SEQ ID NO: 2168085 - protein, 20 aa, Cryptosporidium hominis
AELQCVLCFIFHVERISSSN

SEQ ID NO: 2168086 - protein, 24 aa, Cryptosporidium hominis
AELRRELNIPLAIKADSEYVTKQD

SEQ ID NO: 2168087 - protein, 20 aa, Cryptosporidium hominis
AEMRKYKSLQTKRRLSKRIS

SEQ ID NO: 2168088 - protein, 19 aa, Cryptosporidium hominis
AENFKIYWTPCSQPSNIDH

SEQ ID NO: 2168089 - protein, 25 aa, Cryptosporidium hominis
AENKNKDCLPLFFSSNTPIRKGYEV

SEQ ID NO: 2168090 - protein, 23 aa, Cryptosporidium hominis
AENLCYLAKLFLDHKTLQYDVEP

SEQ ID NO: 2168091 - protein, 20 aa, Cryptosporidium hominis
AENQAICLATLLKCLETEQV

SEQ ID NO: 2168092 - protein, 25 aa, Cryptosporidium hominis
AENRNRLKLLLSWLEERVQEGYQDP

SEQ ID NO: 2168093 - protein, 18 aa, Cryptosporidium hominis
AENWKNILKSVQFENYKE

SEQ ID NO: 2168094 - protein, 19 aa, Cryptosporidium hominis
AENYLKYNKYLGGKFNDKK

SEQ ID NO: 2168095 - protein, 23 aa, Cryptosporidium hominis
AEPLEILLHLPLVCEDKNTPYVF

SEQ ID NO: 2168096 - protein, 17 aa, Cryptosporidium hominis
AESSLVMEPRIEDSFSQ

SEQ ID NO: 2168097 - protein, 19 aa, Cryptosporidium hominis
AETLSSFPLDQDTHNTLSQ

SEQ ID NO: 2168098 - protein, 17 aa, Cryptosporidium hominis
AETVSMCELVFDQQMNY

SEQ ID NO: 2168099 - protein, 26 aa, Cryptosporidium hominis
AEVAFEKLEVASLFTSRRPVLSCFAC

SEQ ID NO: 2168100 - protein, 24 aa, Cryptosporidium hominis
AEVREVFLRILAIGSLSRIVDDIN

SEQ ID NO: 2168101 - protein, 19 aa, Cryptosporidium hominis
AEYYRQPWVPRAIEKYLSC

SEQ ID NO: 2168102 - protein, 18 aa, Cryptosporidium hominis
AFAGFKYDTMSRILIASY

SEQ ID NO: 2168103 - protein, 23 aa, Cryptosporidium hominis
AFELLVSLMFNYGMREMFVSGLP

SEQ ID NO: 2168104 - protein, 25 aa, Cryptosporidium hominis
AFGDWKDLWSPSSILNSNFQYGTDI

SEQ ID NO: 2168105 - protein, 19 aa, Cryptosporidium hominis
AFGELALLYNCPRAASVVA

SEQ ID NO: 2168106 - protein, 18 aa, Cryptosporidium hominis
AFIIKLFGLKNMQITPER

SEQ ID NO: 2168107 - protein, 17 aa, Cryptosporidium hominis
AFIKPNKSVVCLVMEYM

SEQ ID NO: 2168108 - protein, 23 aa, Cryptosporidium hominis
AFIRSCTRYLTIDTNGTVNNSVV

SEQ ID NO: 2168109 - protein, 22 aa, Cryptosporidium hominis
AFITKRPDLFGTIEEAVAGTHG

SEQ ID NO: 2168110 - protein, 24 aa, Cryptosporidium hominis
AFKGRKFLCSELIHGGTDPNVENI

SEQ ID NO: 2168111 - protein, 37 aa, Cryptosporidium hominis
AFKIAECIKPALAKSPAWLRFIDICLNEIFQKIDLKD

SEQ ID NO: 2168112 - protein, 22 aa, Cryptosporidium hominis
AFKRRFSPIRIIMEDISSHYVN

SEQ ID NO: 2168113 - protein, 21 aa, Cryptosporidium hominis
AFKSKCPYCDRSFLKRNLKIH

SEQ ID NO: 2168114 - protein, 21 aa, Cryptosporidium hominis
AFKTWEIYCSAILESRITALD

SEQ ID NO: 2168115 - protein, 24 aa, Cryptosporidium hominis
AFLDNCIFGLVYIKRSNPIIPSLQ

SEQ ID NO: 2168116 - protein, 30 aa, Cryptosporidium hominis
AFLKLESLVSEFLKKILIVVENWSKCINCF

SEQ ID NO: 2168117 - protein, 25 aa, Cryptosporidium hominis
AFLNIKPRVKPLMYCYEKEIVLYAH

SEQ ID NO: 2168118 - protein, 21 aa, Cryptosporidium hominis
AFNIMVYCLRLDRMDLNHEFP

SEQ ID NO: 2168119 - protein, 23 aa, Cryptosporidium hominis
AFNLPFDYRSPVIMACMGTGIAP

SEQ ID NO: 2168120 - protein, 20 aa, Cryptosporidium hominis
AFNQTICGFDILRTVTGKSV

SEQ ID NO: 2168121 - protein, 27 aa, Cryptosporidium hominis
AFNVIPGELSIPVMVIPVEMKKLNCNE

SEQ ID NO: 2168122 - protein, 21 aa, Cryptosporidium hominis
AFPDDKLLPIYSRVVIQRIPW

SEQ ID NO: 2168123 - protein, 23 aa, Cryptosporidium hominis
AFPSGRIILDYIISKFPNTLGTA

SEQ ID NO: 2168124 - protein, 19 aa, Cryptosporidium hominis
AFQAFKLTTQIYYNLSNDF

SEQ ID NO: 2168125 - protein, 17 aa, Cryptosporidium hominis
AFQIYKKFSFNNEAVET

SEQ ID NO: 2168126 - protein, 17 aa, Cryptosporidium hominis
AFRRPEGTFLYFEDNAG

SEQ ID NO: 2168127 - protein, 17 aa, Cryptosporidium hominis
AFTRIRKNFHAWNDEYK

SEQ ID NO: 2168128 - protein, 19 aa, Cryptosporidium hominis
AFTVHGGDLLTLLNVYNQW

SEQ ID NO: 2168129 - protein, 23 aa, Cryptosporidium hominis
AFTYNEIMVVILFSPELDLNSID

SEQ ID NO: 2168130 - protein, 19 aa, Cryptosporidium hominis
AFVEFSIEYLLSRTCNVSL

SEQ ID NO: 2168131 - protein, 26 aa, Cryptosporidium hominis
AFWHFLSLFIQFIFRTIYSFDENGVE

SEQ ID NO: 2168132 - protein, 32 aa, Cryptosporidium hominis
AFYEYYMAELLWRIGTVLGHSSFVNIPLVPLQ

SEQ ID NO: 2168133 - protein, 20 aa, Cryptosporidium hominis
AFYLEKYLSLVNEVYGSGDL

SEQ ID NO: 2168134 - protein, 20 aa, Cryptosporidium hominis
AGADSEFFGKLVVDSIMTVK

SEQ ID NO: 2168135 - protein, 17 aa, Cryptosporidium hominis
AGAFRYVLLMKENVTTT

SEQ ID NO: 2168136 - protein, 24 aa, Cryptosporidium hominis
AGAHGKDTWGIFRIHQFEKVEQFC

SEQ ID NO: 2168137 - protein, 19 aa, Cryptosporidium hominis
AGATVLADRGIVCIDEFDK

SEQ ID NO: 2168138 - protein, 25 aa, Cryptosporidium hominis
AGAYIKTRTTLKCFKNHPQESGAEH

SEQ ID NO: 2168139 - protein, 18 aa, Cryptosporidium hominis
AGCPLTYMMNIELRKGKS

SEQ ID NO: 2168140 - protein, 24 aa, Cryptosporidium hominis
AGDGRFFLPEAIQIISEIAAAHKV

SEQ ID NO: 2168141 - protein, 25 aa, Cryptosporidium hominis
AGFTYQPKFSIRDLFSLPAKYLKYK

SEQ ID NO: 2168142 - protein, 18 aa, Cryptosporidium hominis
AGGIPIDPSISATVAAAT

SEQ ID NO: 2168143 - protein, 21 aa, Cryptosporidium hominis
AGGVTREWYNILAREMFNPDY

SEQ ID NO: 2168144 - protein, 23 aa, Cryptosporidium hominis
AGGYLRVLNSWNKIGRMQNEFFE

SEQ ID NO: 2168145 - protein, 27 aa, Cryptosporidium hominis
AGIELLKLLTWYLSWNKILEYPSASFS

SEQ ID NO: 2168146 - protein, 25 aa, Cryptosporidium hominis
AGIKIKPKKGLAVVWPNIDSQGKLD

SEQ ID NO: 2168147 - protein, 32 aa, Cryptosporidium hominis
AGIKSFSELGVWRCCCEANGKPIEFVSSRSLL

SEQ ID NO: 2168148 - protein, 17 aa, Cryptosporidium hominis
AGINPGSSITFISVKTG

SEQ ID NO: 2168149 - protein, 18 aa, Cryptosporidium hominis
AGKIQCSYLSSTNHGNRK

SEQ ID NO: 2168150 - protein, 19 aa, Cryptosporidium hominis
AGKPYSVALSFISSQATCC

SEQ ID NO: 2168151 - protein, 17 aa, Cryptosporidium hominis
AGLEWMVKLYKRGLNGI

SEQ ID NO: 2168152 - protein, 25 aa, Cryptosporidium hominis
AGLKKHRLVFCEKPESIPNMARQLQ

SEQ ID NO: 2168153 - protein, 25 aa, Cryptosporidium hominis
AGPEADRGWSDFFSLKTLLDPKTGF

SEQ ID NO: 2168154 - protein, 18 aa, Cryptosporidium hominis
AGPIKLAQDFLKEDEPFF

SEQ ID NO: 2168155 - protein, 19 aa, Cryptosporidium hominis
AGPIKVLSFQCPDEKTSVS

SEQ ID NO: 2168156 - protein, 18 aa, Cryptosporidium hominis
AGPYARKLFVDEFGLPES

SEQ ID NO: 2168157 - protein, 23 aa, Cryptosporidium hominis
AGQDFNGAQVYFGAVQTPSQTTY

SEQ ID NO: 2168158 - protein, 28 aa, Cryptosporidium hominis
AGRNLPLNRFKYSPIVAALKHNHKLLPV

SEQ ID NO: 2168159 - protein, 17 aa, Cryptosporidium hominis
AGRNSCPVRGPRENLSY

SEQ ID NO: 2168160 - protein, 24 aa, Cryptosporidium hominis
AGSCGASACRDCVKNYLEQNKAVA

SEQ ID NO: 2168161 - protein, 25 aa, Cryptosporidium hominis
AGSNGEPWFYKLVDSVSNIMGNYYK

SEQ ID NO: 2168162 - protein, 25 aa, Cryptosporidium hominis
AGSNPKLISMMGVRNEGSIRNNLNI

SEQ ID NO: 2168163 - protein, 20 aa, Cryptosporidium hominis
AGSYSECILECQECKKIKFC

SEQ ID NO: 2168164 - protein, 26 aa, Cryptosporidium hominis
AGTNISLCLCENNNLYYWFLNNECGF

SEQ ID NO: 2168165 - protein, 18 aa, Cryptosporidium hominis
AGTTSIECGMSLMEEISD

SEQ ID NO: 2168166 - protein, 19 aa, Cryptosporidium hominis
AGVGNEFGVGNGLFSQTSL

SEQ ID NO: 2168167 - protein, 27 aa, Cryptosporidium hominis
AGVLKGEIKDLLLLDVTPLSLGIETLG

SEQ ID NO: 2168168 - protein, 20 aa, Cryptosporidium hominis
AGVPCVIPPLPEDFVTQKSD

SEQ ID NO: 2168169 - protein, 23 aa, Cryptosporidium hominis
AGVTGSHLLNGWNTSGSSPSKDG

SEQ ID NO: 2168170 - protein, 22 aa, Cryptosporidium hominis
AGYKIPENLLIKSYDTEKTKLE

SEQ ID NO: 2168171 - protein, 18 aa, Cryptosporidium hominis
AHDKLMGHFKIMEHDTQT

SEQ ID NO: 2168172 - protein, 27 aa, Cryptosporidium hominis
AHHIIDGPIIGLEWKCTGTNNVETVSL

SEQ ID NO: 2168173 - protein, 30 aa, Cryptosporidium hominis
AHIKVNCPIFYQFFCFQRYPILILRPLFSN

SEQ ID NO: 2168174 - protein, 28 aa, Cryptosporidium hominis
AHKVPEYRVLLIIPDEFYLTIADVEFLV

SEQ ID NO: 2168175 - protein, 17 aa, Cryptosporidium hominis
AHNECVTQVCFIRDTHY

SEQ ID NO: 2168176 - protein, 22 aa, Cryptosporidium hominis
AHNYYSLPDFKSMNPTSSINFY

SEQ ID NO: 2168177 - protein, 23 aa, Cryptosporidium hominis
AHPHAGPAQILFPHMAINGQHSA

SEQ ID NO: 2168178 - protein, 22 aa, Cryptosporidium hominis
AHSEIKFVPLIGSAEVDGNQLL

SEQ ID NO: 2168179 - protein, 28 aa, Cryptosporidium hominis
AHVPGCTSEFCLACELVHLTFMLYSCKF

SEQ ID NO: 2168180 - protein, 20 aa, Cryptosporidium hominis
AHYDGVFGFNAFYNSVKNNI

SEQ ID NO: 2168181 - protein, 24 aa, Cryptosporidium hominis
AIDEINKMLSWRLSDENIEPDEIE

SEQ ID NO: 2168182 - protein, 26 aa, Cryptosporidium hominis
AIDLTKIRIRSCKRVVLIEYCKDSEL

SEQ ID NO: 2168183 - protein, 18 aa, Cryptosporidium hominis
AIDQDGLRDALRHASNML

SEQ ID NO: 2168184 - protein, 20 aa, Cryptosporidium hominis
AIDSCAAISKKLIQNNYEKK

SEQ ID NO: 2168185 - protein, 20 aa, Cryptosporidium hominis
AIEALKRFINSVGYSENVDN

SEQ ID NO: 2168186 - protein, 20 aa, Cryptosporidium hominis
AIEELYRLAVKKVSKNFICS

SEQ ID NO: 2168187 - protein, 27 aa, Cryptosporidium hominis
AIFALRVRHRLCNSKGYWPRIKIEIPE

SEQ ID NO: 2168188 - protein, 18 aa, Cryptosporidium hominis
AIFFDWKEFKILNKSTKN

SEQ ID NO: 2168189 - protein, 23 aa, Cryptosporidium hominis
AIFKKLADDISFFKKSKIVNYVN

SEQ ID NO: 2168190 - protein, 19 aa, Cryptosporidium hominis
AIGAMGFSGMEEINSLNGD

SEQ ID NO: 2168191 - protein, 17 aa, Cryptosporidium hominis
AIGDLIRTPVHLVSSAL

SEQ ID NO: 2168192 - protein, 23 aa, Cryptosporidium hominis
AIGKGTRAYQNFLKLKPRKEDRE

SEQ ID NO: 2168193 - protein, 25 aa, Cryptosporidium hominis
AIGNAPWPMGVTMVGIHERAGRTKI

SEQ ID NO: 2168194 - protein, 26 aa, Cryptosporidium hominis
AIGQPLLMRVYEDFFSMRGAKVAQLL

SEQ ID NO: 2168195 - protein, 21 aa, Cryptosporidium hominis
AIGTWIAVCYLFSKYKKKDNC

SEQ ID NO: 2168196 - protein, 23 aa, Cryptosporidium hominis
AIHRVIKDFVIQGGDFVNGDGTG

SEQ ID NO: 2168197 - protein, 23 aa, Cryptosporidium hominis
AIIELCRPFINFSFFKKTPVPLS

SEQ ID NO: 2168198 - protein, 19 aa, Cryptosporidium hominis
AIIRFKSKETIYCSCEFLD

SEQ ID NO: 2168199 - protein, 18 aa, Cryptosporidium hominis
AIISCLNSLEIIHPKEPI

SEQ ID NO: 2168200 - protein, 17 aa, Cryptosporidium hominis
AIKEYEIILLLLKDLIS

SEQ ID NO: 2168201 - protein, 21 aa, Cryptosporidium hominis
AIKIFPITFLPSIKILEIGLS

SEQ ID NO: 2168202 - protein, 29 aa, Cryptosporidium hominis
AIKKGSSRISLQWGCLAEEYPKFDVSVEE

SEQ ID NO: 2168203 - protein, 19 aa, Cryptosporidium hominis
AIKLAFHRGSCSSGDLQEN

SEQ ID NO: 2168204 - protein, 26 aa, Cryptosporidium hominis
AIKLKAEQFLVFLIKLIIKLREDEDQ

SEQ ID NO: 2168205 - protein, 24 aa, Cryptosporidium hominis
AIKLLAIVRDIKRQIKLIKNQHNK

SEQ ID NO: 2168206 - protein, 19 aa, Cryptosporidium hominis
AIKSITLLQQWWRVTSTLK

SEQ ID NO: 2168207 - protein, 19 aa, Cryptosporidium hominis
AILHILNKIVLIFPQSIYF

SEQ ID NO: 2168208 - protein, 19 aa, Cryptosporidium hominis
AILKFPKLVDEIITMIASC

SEQ ID NO: 2168209 - protein, 21 aa, Cryptosporidium hominis
AIMLEKNFIFSIVDPQVLQIE

SEQ ID NO: 2168210 - protein, 18 aa, Cryptosporidium hominis
AINHLWLNDYCSRWFIST

SEQ ID NO: 2168211 - protein, 19 aa, Cryptosporidium hominis
AINMYQKYTHLSRILTNTF

SEQ ID NO: 2168212 - protein, 28 aa, Cryptosporidium hominis
AINSLKNPLLFWFKGLFRQNEPTHIRPA

SEQ ID NO: 2168213 - protein, 25 aa, Cryptosporidium hominis
AIRDTRFNYILGIVLYSVRTRSKFK

SEQ ID NO: 2168214 - protein, 22 aa, Cryptosporidium hominis
AIREFCKKFKTEYGNISHLNTS

SEQ ID NO: 2168215 - protein, 19 aa, Cryptosporidium hominis
AISFLRLYEKWSNTRSNHV

SEQ ID NO: 2168216 - protein, 24 aa, Cryptosporidium hominis
AISKIESLEELWINDNDICDINQL

SEQ ID NO: 2168217 - protein, 19 aa, Cryptosporidium hominis
AITALACSFSIIFDYDNLP

SEQ ID NO: 2168218 - protein, 17 aa, Cryptosporidium hominis
AITGGFPFTKLQSPLQF

SEQ ID NO: 2168219 - protein, 26 aa, Cryptosporidium hominis
AIVGRNWIRRMVYQISSSFVTIPIPR

SEQ ID NO: 2168220 - protein, 24 aa, Cryptosporidium hominis
AIWPGITSKGAFNPKVLIGLINAN

SEQ ID NO: 2168221 - protein, 19 aa, Cryptosporidium hominis
AIWRHQLLCHCIPFNRFCY

SEQ ID NO: 2168222 - protein, 26 aa, Cryptosporidium hominis
AIYAFSNRYADMILTIYGMSCLRSVL

SEQ ID NO: 2168223 - protein, 23 aa, Cryptosporidium hominis
AIYPEAVRMLLLFIYGHTTSLRG

SEQ ID NO: 2168224 - protein, 18 aa, Cryptosporidium hominis
AIYSYLFKEGAIVVHKNP

SEQ ID NO: 2168225 - protein, 20 aa, Cryptosporidium hominis
AKALLQYELRQWFLSNPPSN

SEQ ID NO: 2168226 - protein, 19 aa, Cryptosporidium hominis
AKDGFIFAQSMYIGLVLNN

SEQ ID NO: 2168227 - protein, 34 aa, Cryptosporidium hominis
AKECARILYPTLLRLGYTVSQSRVGKVCVAIGID

SEQ ID NO: 2168228 - protein, 23 aa, Cryptosporidium hominis
AKELFSSGFVLPRCNFKEALADL

SEQ ID NO: 2168229 - protein, 17 aa, Cryptosporidium hominis
AKERLFISVPLNVGKPS

SEQ ID NO: 2168230 - protein, 22 aa, Cryptosporidium hominis
AKFKAMLVEDAYGFETTYVDFL

SEQ ID NO: 2168231 - protein, 18 aa, Cryptosporidium hominis
AKFPELFQGKLKPWKGIL

SEQ ID NO: 2168232 - protein, 21 aa, Cryptosporidium hominis
AKFYIAELLLALDYLNNIQGH

SEQ ID NO: 2168233 - protein, 21 aa, Cryptosporidium hominis
AKFYLGKRCAYIYKAKTIKNG

SEQ ID NO: 2168234 - protein, 20 aa, Cryptosporidium hominis
AKGLTSLRCPICSKSLGDNS

SEQ ID NO: 2168235 - protein, 21 aa, Cryptosporidium hominis
AKHHGFPGIFFNGAVLIGPNG

SEQ ID NO: 2168236 - protein, 25 aa, Cryptosporidium hominis
AKHVYGIECSEIVHVARNIIKDNNL

SEQ ID NO: 2168237 - protein, 18 aa, Cryptosporidium hominis
AKHVYLHHLKAYRSFNNG

SEQ ID NO: 2168238 - protein, 17 aa, Cryptosporidium hominis
AKIASAFTFAFTASELH

SEQ ID NO: 2168239 - protein, 22 aa, Cryptosporidium hominis
AKIKVLYCGICHSDVHQVKNEW

SEQ ID NO: 2168240 - protein, 20 aa, Cryptosporidium hominis
AKILFLSSLTQISWLLNLRG

SEQ ID NO: 2168241 - protein, 20 aa, Cryptosporidium hominis
AKILPNRKFKESKYDISCIS

SEQ ID NO: 2168242 - protein, 17 aa, Cryptosporidium hominis
AKISSIFSRFLSSNLFS

SEQ ID NO: 2168243 - protein, 24 aa, Cryptosporidium hominis
AKKDFRYICEFDYFSRDAKLQSRK

SEQ ID NO: 2168244 - protein, 22 aa, Cryptosporidium hominis
AKKIKSGCWTTDMINESIQNLE

SEQ ID NO: 2168245 - protein, 19 aa, Cryptosporidium hominis
AKKIWLKYLPEDRILSCGS

SEQ ID NO: 2168246 - protein, 17 aa, Cryptosporidium hominis
AKKRLWRNSNFQLVDSD

SEQ ID NO: 2168247 - protein, 18 aa, Cryptosporidium hominis
AKKSEVANQFVVTDNDQI

SEQ ID NO: 2168248 - protein, 28 aa, Cryptosporidium hominis
AKKSSECMGRISRFVSRYLANKGMTIGI

SEQ ID NO: 2168249 - protein, 17 aa, Cryptosporidium hominis
AKLDLFRMRFLGRNIKI

SEQ ID NO: 2168250 - protein, 18 aa, Cryptosporidium hominis
AKLELPDFLKLKDCSSKS

SEQ ID NO: 2168251 - protein, 17 aa, Cryptosporidium hominis
AKLGIGCNVLGKTKSNV

SEQ ID NO: 2168252 - protein, 26 aa, Cryptosporidium hominis
AKLIPFGYNCLTLHSGQDHYDRHSNL

SEQ ID NO: 2168253 - protein, 17 aa, Cryptosporidium hominis
AKLRTDNEWSLLSEIAV

SEQ ID NO: 2168254 - protein, 24 aa, Cryptosporidium hominis
AKMSKKLSGRSIRHVCLEAEREWA

SEQ ID NO: 2168255 - protein, 17 aa, Cryptosporidium hominis
AKMVRDAFEIAREKAPS

SEQ ID NO: 2168256 - protein, 21 aa, Cryptosporidium hominis
AKNYSLICRKILEKFQSDLQE

SEQ ID NO: 2168257 - protein, 24 aa, Cryptosporidium hominis
AKQLPLYILGVLKCPAFRDYKEVS

SEQ ID NO: 2168258 - protein, 22 aa, Cryptosporidium hominis
AKQRTTGSILRKSIDASDDNYS

SEQ ID NO: 2168259 - protein, 24 aa, Cryptosporidium hominis
AKRILSKNQSCFIINKKLIDERTL

SEQ ID NO: 2168260 - protein, 22 aa, Cryptosporidium hominis
AKRRLREKLLRKEISDMKKQKN

SEQ ID NO: 2168261 - protein, 28 aa, Cryptosporidium hominis
AKSLWPSYLQDMPWTMIKFASIARKSHR

SEQ ID NO: 2168262 - protein, 18 aa, Cryptosporidium hominis
AKTDCLLWALDRETFNHI

SEQ ID NO: 2168263 - protein, 18 aa, Cryptosporidium hominis
AKTIKEWLHKALKSETAV

SEQ ID NO: 2168264 - protein, 20 aa, Cryptosporidium hominis
AKVLRINWDYKNKFTQRLNN

SEQ ID NO: 2168265 - protein, 18 aa, Cryptosporidium hominis
AKWDLGWMNDTLSYLYTP

SEQ ID NO: 2168266 - protein, 22 aa, Cryptosporidium hominis
AKYFTKTKFRCCSRQTNKYLVE

SEQ ID NO: 2168267 - protein, 18 aa, Cryptosporidium hominis
AKYHLSLNSKTRKGSTNH

SEQ ID NO: 2168268 - protein, 24 aa, Cryptosporidium hominis
ALAALRLAAIGLENNWKLLWHRNS

SEQ ID NO: 2168269 - protein, 19 aa, Cryptosporidium hominis
ALADLRLMFNDGRAWDMNI

SEQ ID NO: 2168270 - protein, 20 aa, Cryptosporidium hominis
ALAKATWAAGDFKDRIIESC

SEQ ID NO: 2168271 - protein, 17 aa, Cryptosporidium hominis
ALAQFGVVLTDEGYNNI

SEQ ID NO: 2168272 - protein, 17 aa, Cryptosporidium hominis
ALCKEGKGLVHFNGKPL

SEQ ID NO: 2168273 - protein, 19 aa, Cryptosporidium hominis
ALCKFPAHVQQLLMESNGK

SEQ ID NO: 2168274 - protein, 22 aa, Cryptosporidium hominis
ALCNCLKDDIQWTIDNLYTDIP

SEQ ID NO: 2168275 - protein, 24 aa, Cryptosporidium hominis
ALDADSFIPVFYQFVTIYMQETSA

SEQ ID NO: 2168276 - protein, 23 aa, Cryptosporidium hominis
ALDPNVLASLGLNVQKPTLQPIQ

SEQ ID NO: 2168277 - protein, 22 aa, Cryptosporidium hominis
ALDPRGSRLLLLFAPTFLPTTP

SEQ ID NO: 2168278 - protein, 28 aa, Cryptosporidium hominis
ALDRANVFLRWNLAPTKQQIAEFLEMAQ

SEQ ID NO: 2168279 - protein, 19 aa, Cryptosporidium hominis
ALDVFPRLLAENSGLNSTD

SEQ ID NO: 2168280 - protein, 20 aa, Cryptosporidium hominis
ALDVSEPCQLVFSLRYLNNF

SEQ ID NO: 2168281 - protein, 23 aa, Cryptosporidium hominis
ALDYCAKAKILVVKDIERDEIEF

SEQ ID NO: 2168282 - protein, 19 aa, Cryptosporidium hominis
ALDYKEFRNLLTQLLILPE

SEQ ID NO: 2168283 - protein, 31 aa, Cryptosporidium hominis
ALEHGLPPTGGWGLGIDRLIMFLADKNNIKE

SEQ ID NO: 2168284 - protein, 40 aa, Cryptosporidium hominis
ALEKGRFSMAIACYREVQDLDSLLLIYSCIGDIQGLKYVA

SEQ ID NO: 2168285 - protein, 26 aa, Cryptosporidium hominis
ALELKDLKTSIGNRVVGDTMLTMSQK

SEQ ID NO: 2168286 - protein, 22 aa, Cryptosporidium hominis
ALELYPLPFPKIGGVKSPKLAL

SEQ ID NO: 2168287 - protein, 26 aa, Cryptosporidium hominis
ALETFCSGGFRGGPRMVALANFREGK

SEQ ID NO: 2168288 - protein, 21 aa, Cryptosporidium hominis
ALFDKLYGEWALLSRQTQEDL

SEQ ID NO: 2168289 - protein, 27 aa, Cryptosporidium hominis
ALGGHPFGGAMAYRGGEFGRHPPYPGG

SEQ ID NO: 2168290 - protein, 24 aa, Cryptosporidium hominis
ALGLRPVEIYEFSRLNFVNTVLSK

SEQ ID NO: 2168291 - protein, 26 aa, Cryptosporidium hominis
ALGPITRGALKFIFKAPSPDFTKIPP

SEQ ID NO: 2168292 - protein, 19 aa, Cryptosporidium hominis
ALHELLRPHLLRRVKEDVM

SEQ ID NO: 2168293 - protein, 17 aa, Cryptosporidium hominis
ALHESRKALQKKNKPKN

SEQ ID NO: 2168294 - protein, 23 aa, Cryptosporidium hominis
ALHPEPFGVLGYQKFGDDGQYEY

SEQ ID NO: 2168295 - protein, 23 aa, Cryptosporidium hominis
ALHQFRPSPLYFMDEVDAALDFR

SEQ ID NO: 2168296 - protein, 22 aa, Cryptosporidium hominis
ALIPKLLPSLLISESTYATYIR

SEQ ID NO: 2168297 - protein, 18 aa, Cryptosporidium hominis
ALIPMFKILPKRFSSKPK

SEQ ID NO: 2168298 - protein, 18 aa, Cryptosporidium hominis
ALIRVNKLYKRFKLDNNA

SEQ ID NO: 2168299 - protein, 17 aa, Cryptosporidium hominis
ALISLCKLTSLTTKLLN

SEQ ID NO: 2168300 - protein, 33 aa, Cryptosporidium hominis
ALISYYIQHGILFKRLGIIVVDELHLLGDEQRG

SEQ ID NO: 2168301 - protein, 22 aa, Cryptosporidium hominis
ALKLADFGLARAFGIPVRSYTH

SEQ ID NO: 2168302 - protein, 21 aa, Cryptosporidium hominis
ALKSSFYEIEFILITENEKNI

SEQ ID NO: 2168303 - protein, 17 aa, Cryptosporidium hominis
ALLASVHIIRVLEDAEI

SEQ ID NO: 2168304 - protein, 20 aa, Cryptosporidium hominis
ALLATRFNKEVPNFQSNNNH

SEQ ID NO: 2168305 - protein, 25 aa, Cryptosporidium hominis
ALLELLFKSTIPISGLYNSKPKNIY

SEQ ID NO: 2168306 - protein, 24 aa, Cryptosporidium hominis
ALLIMKNFLNNIILNNKNGLNLSK

SEQ ID NO: 2168307 - protein, 22 aa, Cryptosporidium hominis
ALLKYKSCENGKEYQWEILSEM

SEQ ID NO: 2168308 - protein, 19 aa, Cryptosporidium hominis
ALLQLYFTNLFQGNHGFMP

SEQ ID NO: 2168309 - protein, 21 aa, Cryptosporidium hominis
ALLYNCPRAASVVAKTDCLLW

SEQ ID NO: 2168310 - protein, 21 aa, Cryptosporidium hominis
ALMDFRFSVKMNEETLGIGED

SEQ ID NO: 2168311 - protein, 24 aa, Cryptosporidium hominis
ALNISKALVERAVQQRIYLLEPKL

SEQ ID NO: 2168312 - protein, 18 aa, Cryptosporidium hominis
ALNNRWFGGNQVFCSLYN

SEQ ID NO: 2168313 - protein, 18 aa, Cryptosporidium hominis
ALNPKTGILNNIIVNGAG

SEQ ID NO: 2168314 - protein, 18 aa, Cryptosporidium hominis
ALNYMFKVNSIVIHPYVL

SEQ ID NO: 2168315 - protein, 22 aa, Cryptosporidium hominis
ALPKICCILFLVNPGVCSDMIS

SEQ ID NO: 2168316 - protein, 25 aa, Cryptosporidium hominis
ALPNVGYCQGMNYLVGIFLYALDFN

SEQ ID NO: 2168317 - protein, 20 aa, Cryptosporidium hominis
ALQRFCSFILPMLDEKGTHT

SEQ ID NO: 2168318 - protein, 17 aa, Cryptosporidium hominis
ALSLAIEFENKCKEIKE

SEQ ID NO: 2168319 - protein, 29 aa, Cryptosporidium hominis
ALSPLNGTEVAPLFSKFVPNEDTSDSVKF

SEQ ID NO: 2168320 - protein, 20 aa, Cryptosporidium hominis
ALSTLNELLPIWKISINSQA

SEQ ID NO: 2168321 - protein, 22 aa, Cryptosporidium hominis
ALSVCKILGEFGIKEPKIKWVN

SEQ ID NO: 2168322 - protein, 18 aa, Cryptosporidium hominis
ALTALILNKLQLNLKVCA

SEQ ID NO: 2168323 - protein, 17 aa, Cryptosporidium hominis
ALTAMFSKISFVMSKKV

SEQ ID NO: 2168324 - protein, 18 aa, Cryptosporidium hominis
ALTDFKAKIPRGARTGTV

SEQ ID NO: 2168325 - protein, 18 aa, Cryptosporidium hominis
ALTGFKFIITHLDGRKLL

SEQ ID NO: 2168326 - protein, 17 aa, Cryptosporidium hominis
ALTLISNKIPFLFEYIS

SEQ ID NO: 2168327 - protein, 17 aa, Cryptosporidium hominis
ALTQAMKNHKRWIMSLP

SEQ ID NO: 2168328 - protein, 18 aa, Cryptosporidium hominis
ALVEKAAKCDLGAIEGEI

SEQ ID NO: 2168329 - protein, 26 aa, Cryptosporidium hominis
ALVLSDRGICCIDEFDKMDDSSRSIL

SEQ ID NO: 2168330 - protein, 20 aa, Cryptosporidium hominis
ALYLEVLQFIISQYDPRIKI

SEQ ID NO: 2168331 - protein, 19 aa, Cryptosporidium hominis
ALYLRRSGKKLILPLNIVS

SEQ ID NO: 2168332 - protein, 21 aa, Cryptosporidium hominis
AMAMPPLNLKSINDLEGSSEF

SEQ ID NO: 2168333 - protein, 30 aa, Cryptosporidium hominis
AMELFPCGKWPDLLPFLFRLISNLQNYTGA

SEQ ID NO: 2168334 - protein, 28 aa, Cryptosporidium hominis
AMENALRFVCRGCRIGKVLLNNSSENEF

SEQ ID NO: 2168335 - protein, 23 aa, Cryptosporidium hominis
AMIHIRAQPLLRYGDGPICLVLA

SEQ ID NO: 2168336 - protein, 27 aa, Cryptosporidium hominis
AMIHRRGSLIKKLVCIPTTCGSGSEVT

SEQ ID NO: 2168337 - protein, 19 aa, Cryptosporidium hominis
AMKWFPLVKYNGFTGVGSV

SEQ ID NO: 2168338 - protein, 28 aa, Cryptosporidium hominis
AMLNDLKLLIGFLIKYPLNCLRSAESDS

SEQ ID NO: 2168339 - protein, 25 aa, Cryptosporidium hominis
AMLPGCPVKPLGGGEFSSFNIYSKE

SEQ ID NO: 2168340 - protein, 23 aa, Cryptosporidium hominis
AMLRKKDIFDIFSKIPGNPLFKK

SEQ ID NO: 2168341 - protein, 25 aa, Cryptosporidium hominis
AMTFLGGSIFKIGLSKCLQKKLIKL

SEQ ID NO: 2168342 - protein, 17 aa, Cryptosporidium hominis
ANALIQILSNCKFLEII

SEQ ID NO: 2168343 - protein, 26 aa, Cryptosporidium hominis
ANALLRLNNLLSFKGNLLRIGKPKVS

SEQ ID NO: 2168344 - protein, 20 aa, Cryptosporidium hominis
ANDAKLMALTLMSHFDFNAS

SEQ ID NO: 2168345 - protein, 24 aa, Cryptosporidium hominis
ANDLRKDRCTGLIANLHRMGINNS

SEQ ID NO: 2168346 - protein, 24 aa, Cryptosporidium hominis
ANEEMGYPYGMDFVFSSRSINNSY

SEQ ID NO: 2168347 - protein, 22 aa, Cryptosporidium hominis
ANEIRTKVLALRNENSNINIKN

SEQ ID NO: 2168348 - protein, 22 aa, Cryptosporidium hominis
ANELNLKCRIGEGGYGKVYKAI

SEQ ID NO: 2168349 - protein, 20 aa, Cryptosporidium hominis
ANELSSWTCPSCSLRFSTSI

SEQ ID NO: 2168350 - protein, 28 aa, Cryptosporidium hominis
ANEVFKPMVYETIVFPPGYFEYKKQLEE

SEQ ID NO: 2168351 - protein, 20 aa, Cryptosporidium hominis
ANFDYKFGIKSFVLACLAND

SEQ ID NO: 2168352 - protein, 19 aa, Cryptosporidium hominis
ANFEIWKTDGIYRNENDRS

SEQ ID NO: 2168353 - protein, 17 aa, Cryptosporidium hominis
ANFISIRGPELLNKYVG

SEQ ID NO: 2168354 - protein, 24 aa, Cryptosporidium hominis
ANHCNIELNWRDELISKVRQFILY

SEQ ID NO: 2168355 - protein, 19 aa, Cryptosporidium hominis
ANHRCYLLSIKICEYCNIS

SEQ ID NO: 2168356 - protein, 20 aa, Cryptosporidium hominis
ANIASYCPAEHTLTDKMPET

SEQ ID NO: 2168357 - protein, 22 aa, Cryptosporidium hominis
ANIHSLRSSFYRKLSDRLSLAS

SEQ ID NO: 2168358 - protein, 18 aa, Cryptosporidium hominis
ANIKDVIQRMDYYTQKAY

SEQ ID NO: 2168359 - protein, 19 aa, Cryptosporidium hominis
ANISQFIRLNNRLRANGFL

SEQ ID NO: 2168360 - protein, 36 aa, Cryptosporidium hominis
ANKDGMCKYGPHACNYRIVKEVVFENIFFKNKKYSH

SEQ ID NO: 2168361 - protein, 28 aa, Cryptosporidium hominis
ANKVCGMSGVLDSARFRCNLSRALGVKP

SEQ ID NO: 2168362 - protein, 18 aa, Cryptosporidium hominis
ANLERFLPIYNEIIDSIA

SEQ ID NO: 2168363 - protein, 17 aa, Cryptosporidium hominis
ANLFRLIIHHNPSDLID

SEQ ID NO: 2168364 - protein, 19 aa, Cryptosporidium hominis
ANLICQLNIVSAKFIDGDD

SEQ ID NO: 2168365 - protein, 31 aa, Cryptosporidium hominis
ANLIKCCIDKSAWRCLHTLLTDSEYQQHPIS

SEQ ID NO: 2168366 - protein, 19 aa, Cryptosporidium hominis
ANLILPLLIIQSHSIQNII

SEQ ID NO: 2168367 - protein, 18 aa, Cryptosporidium hominis
ANLLKRYSRFILDKFDIC

SEQ ID NO: 2168368 - protein, 19 aa, Cryptosporidium hominis
ANLVRYSRHYELPTISTII

SEQ ID NO: 2168369 - protein, 24 aa, Cryptosporidium hominis
ANNAIKYIVCEQIKKNKLKKLSLE

SEQ ID NO: 2168370 - protein, 25 aa, Cryptosporidium hominis
ANNIPEWRIHFRQILGGTEPFRITH

SEQ ID NO: 2168371 - protein, 26 aa, Cryptosporidium hominis
ANRPDILCLEGLVIALGCFIGNSNIP

SEQ ID NO: 2168372 - protein, 25 aa, Cryptosporidium hominis
ANSELLKHIFIEGSPDHIPNSVDID

SEQ ID NO: 2168373 - protein, 22 aa, Cryptosporidium hominis
ANSFPLGLACNVSNRRYDLNPR

SEQ ID NO: 2168374 - protein, 24 aa, Cryptosporidium hominis
ANSIIKLQLHPCIILEVYSDLIKS

SEQ ID NO: 2168375 - protein, 19 aa, Cryptosporidium hominis
ANSLGLCGSVFVDFGDSFN

SEQ ID NO: 2168376 - protein, 20 aa, Cryptosporidium hominis
ANSQKCIRAGGKHNDLDDVG

SEQ ID NO: 2168377 - protein, 20 aa, Cryptosporidium hominis
ANSSPGCNIVNERDDAYSNL

SEQ ID NO: 2168378 - protein, 21 aa, Cryptosporidium hominis
ANSYIKGSIISGSMALSKRSS

SEQ ID NO: 2168379 - protein, 19 aa, Cryptosporidium hominis
ANTIPFNFQSRQQLNRNPI

SEQ ID NO: 2168380 - protein, 26 aa, Cryptosporidium hominis
ANVILRLVPRLDVPALIRKSQNSQDV

SEQ ID NO: 2168381 - protein, 20 aa, Cryptosporidium hominis
ANYKPVWILSLLHLSSTEHF

SEQ ID NO: 2168382 - protein, 23 aa, Cryptosporidium hominis
APAGRPSYIVQNFQGQKGGIMNS

SEQ ID NO: 2168383 - protein, 17 aa, Cryptosporidium hominis
APAYIANIIGHKGEGGI

SEQ ID NO: 2168384 - protein, 24 aa, Cryptosporidium hominis
APEKSGSFFSAFSMKDQAKSKSWA

SEQ ID NO: 2168385 - protein, 17 aa, Cryptosporidium hominis
APESGRYYFSIEADCGA

SEQ ID NO: 2168386 - protein, 19 aa, Cryptosporidium hominis
APFLTWSIFLIEFLSNRST

SEQ ID NO: 2168387 - protein, 29 aa, Cryptosporidium hominis
APHNLRILRWTIFKSNRLPIGKYVCVIFD

SEQ ID NO: 2168388 - protein, 25 aa, Cryptosporidium hominis
APIKNGLPWCVSLTWSNDGKTLFAG

SEQ ID NO: 2168389 - protein, 23 aa, Cryptosporidium hominis
APIPLELSSSFWIYKDSGKEYTH

SEQ ID NO: 2168390 - protein, 31 aa, Cryptosporidium hominis
APKAFCWLLCDSCNQLLMLLNGFIKLVELES

SEQ ID NO: 2168391 - protein, 30 aa, Cryptosporidium hominis
APLIRLCLYHCKRLDISVHVCDNTVNVLKN

SEQ ID NO: 2168392 - protein, 21 aa, Cryptosporidium hominis
APLLPYLRRLFNTLNREICLF

SEQ ID NO: 2168393 - protein, 18 aa, Cryptosporidium hominis
APLNKTGWFLDYDLNPLN

SEQ ID NO: 2168394 - protein, 28 aa, Cryptosporidium hominis
APLNSLRVYQFLSYDERISGLGIGVHWE

SEQ ID NO: 2168395 - protein, 19 aa, Cryptosporidium hominis
APLPLFMLELFSLSREERA

SEQ ID NO: 2168396 - protein, 18 aa, Cryptosporidium hominis
APLPSVSWIPKKEFNVTL

SEQ ID NO: 2168397 - protein, 29 aa, Cryptosporidium hominis
APNTLIPPFTEWGGTPGVMLRRLPESQNI

SEQ ID NO: 2168398 - protein, 21 aa, Cryptosporidium hominis
APNYCYRCENQAAILRIDDLG

SEQ ID NO: 2168399 - protein, 21 aa, Cryptosporidium hominis
APNYCYRCGNIATVMELDEQL

SEQ ID NO: 2168400 - protein, 24 aa, Cryptosporidium hominis
APNYCYRCGNQAALMELDENENKR

SEQ ID NO: 2168401 - protein, 25 aa, Cryptosporidium hominis
APPAEESSWFSGWFGTSAPEEPPKE

SEQ ID NO: 2168402 - protein, 25 aa, Cryptosporidium hominis
APPAFSKKIIKFFKMNQRNSLNYPS

SEQ ID NO: 2168403 - protein, 25 aa, Cryptosporidium hominis
APRLKDVPISLGRKSWVRLYIEIIG

SEQ ID NO: 2168404 - protein, 27 aa, Cryptosporidium hominis
APSRVGGRLGVCADRFFLVLTNVRNDQ

SEQ ID NO: 2168405 - protein, 18 aa, Cryptosporidium hominis
APTICAAFLMRELGISSL

SEQ ID NO: 2168406 - protein, 25 aa, Cryptosporidium hominis
APVDGEYQLVSGFPPKEIKFDPSTT

SEQ ID NO: 2168407 - protein, 17 aa, Cryptosporidium hominis
APVSGKLVRWLIQNGGQ

SEQ ID NO: 2168408 - protein, 26 aa, Cryptosporidium hominis
APVVDLRGAILDFVGFIMNWSEVENY

SEQ ID NO: 2168409 - protein, 17 aa, Cryptosporidium hominis
AQDFLKEDEPFFVCNSD

SEQ ID NO: 2168410 - protein, 21 aa, Cryptosporidium hominis
AQDGLLYPLNRSFIFITKPVI

SEQ ID NO: 2168411 - protein, 20 aa, Cryptosporidium hominis
AQDVLRSLIWSMNKRNEELS

SEQ ID NO: 2168412 - protein, 21 aa, Cryptosporidium hominis
AQGLVGPIFGSFIMTNFRIIL

SEQ ID NO: 2168413 - protein, 24 aa, Cryptosporidium hominis
AQIRKRLFEIIKMENIPYVDSGID

SEQ ID NO: 2168414 - protein, 18 aa, Cryptosporidium hominis
AQKKGNYGFIEFRTVEET

SEQ ID NO: 2168415 - protein, 19 aa, Cryptosporidium hominis
AQLIFQWIKNPNIGDQEIY

SEQ ID NO: 2168416 - protein, 18 aa, Cryptosporidium hominis
AQLIMIRYLLEIEDKHSD

SEQ ID NO: 2168417 - protein, 23 aa, Cryptosporidium hominis
AQLKAVCVEAGMTALRRGATILC

SEQ ID NO: 2168418 - protein, 25 aa, Cryptosporidium hominis
AQLLRKLYHFCIENNLPPTEETFKK

SEQ ID NO: 2168419 - protein, 22 aa, Cryptosporidium hominis
AQLQIAMGIPLKKIRDIEEYRK

SEQ ID NO: 2168420 - protein, 17 aa, Cryptosporidium hominis
AQMGLKEENAWGIVRAL

SEQ ID NO: 2168421 - protein, 23 aa, Cryptosporidium hominis
AQPGPSPAFCRIAIPNYIQSIYK

SEQ ID NO: 2168422 - protein, 25 aa, Cryptosporidium hominis
AQQHVCEGWAFPMVPDYCSISGQNV

SEQ ID NO: 2168423 - protein, 20 aa, Cryptosporidium hominis
AQRIIPGIFLGGSTIANDLK

SEQ ID NO: 2168424 - protein, 24 aa, Cryptosporidium hominis
AQRVFLMAVQRSFTIGRNNMHVAS

SEQ ID NO: 2168425 - protein, 22 aa, Cryptosporidium hominis
AQSLGLECLGLVFTHNERDEVL

SEQ ID NO: 2168426 - protein, 23 aa, Cryptosporidium hominis
AQVCGYEPGELAIFIGDAHIYEN

SEQ ID NO: 2168427 - protein, 32 aa, Cryptosporidium hominis
ARACHSLTRIFGRLYLFGGFDGIQCFNDLWVY

SEQ ID NO: 2168428 - protein, 26 aa, Cryptosporidium hominis
ARAFCIKLKGDLMRYRAEIFKDDEKN

SEQ ID NO: 2168429 - protein, 21 aa, Cryptosporidium hominis
ARELGPLGIRVVTIGPGVFDT

SEQ ID NO: 2168430 - protein, 23 aa, Cryptosporidium hominis
ARFCPSIKAVKFLGNGQERSDLI

SEQ ID NO: 2168431 - protein, 20 aa, Cryptosporidium hominis
ARFHTVPMVFLEKNKVDQRS

SEQ ID NO: 2168432 - protein, 30 aa, Cryptosporidium hominis
ARGCIKGLSPFLPRVLSYLVKLTSNSKPLI

SEQ ID NO: 2168433 - protein, 21 aa, Cryptosporidium hominis
ARGPKHLQIKLSRAKYEELVD

SEQ ID NO: 2168434 - protein, 18 aa, Cryptosporidium hominis
ARIKERFLHEIGLLDSGI

SEQ ID NO: 2168435 - protein, 17 aa, Cryptosporidium hominis
ARIYGYRVDSTFDNAYR

SEQ ID NO: 2168436 - protein, 18 aa, Cryptosporidium hominis
ARKELTSTKLIWNSIQEN

SEQ ID NO: 2168437 - protein, 18 aa, Cryptosporidium hominis
ARMAERKAAAAAAAAAAA

SEQ ID NO: 2168438 - protein, 19 aa, Cryptosporidium hominis
ARMNKMRLMGLLNNNNTPM

SEQ ID NO: 2168439 - protein, 19 aa, Cryptosporidium hominis
ARNAPILPRGRARQASAGE

SEQ ID NO: 2168440 - protein, 18 aa, Cryptosporidium hominis
ARNASFIRSSRRGCEPEV

SEQ ID NO: 2168441 - protein, 25 aa, Cryptosporidium hominis
ARNNSPVCVPPIYNSFWNPSEFNAI

SEQ ID NO: 2168442 - protein, 24 aa, Cryptosporidium hominis
ARNSVFKLKWKFATMPDKNKIKIA

SEQ ID NO: 2168443 - protein, 18 aa, Cryptosporidium hominis
ARQILVFELKSLQKLFIE

SEQ ID NO: 2168444 - protein, 24 aa, Cryptosporidium hominis
ARQKWAKMALRFGGNELQKNISDQ

SEQ ID NO: 2168445 - protein, 17 aa, Cryptosporidium hominis
ARRAILLSGTPALNNPT

SEQ ID NO: 2168446 - protein, 18 aa, Cryptosporidium hominis
ARRDNKWYLRSQPLRAVN

SEQ ID NO: 2168447 - protein, 18 aa, Cryptosporidium hominis
ARRIAMLQKRRELKAAGM

SEQ ID NO: 2168448 - protein, 23 aa, Cryptosporidium hominis
ARRKYSYFCCNFAQLDYTNSARN

SEQ ID NO: 2168449 - protein, 22 aa, Cryptosporidium hominis
ARRRPYSSLTEMAAYFSNIEPQ

SEQ ID NO: 2168450 - protein, 22 aa, Cryptosporidium hominis
ARSILLDNPQFCYALLHSQFIL

SEQ ID NO: 2168451 - protein, 26 aa, Cryptosporidium hominis
ARSLKRPPAYPTKFFGCELGALSKWE

SEQ ID NO: 2168452 - protein, 19 aa, Cryptosporidium hominis
ARSLLLTPLSIKWNDSNTR

SEQ ID NO: 2168453 - protein, 25 aa, Cryptosporidium hominis
ARTDEIGIPFGITIDFQSVKDDTVT

SEQ ID NO: 2168454 - protein, 22 aa, Cryptosporidium hominis
ARTGKMWKPRILLQQKSKRSIR

SEQ ID NO: 2168455 - protein, 18 aa, Cryptosporidium hominis
ARTLTIKLLDTISLKDEM

SEQ ID NO: 2168456 - protein, 26 aa, Cryptosporidium hominis
ARTPIKSFKCWEGYEQNWDCSDLKSL

SEQ ID NO: 2168457 - protein, 24 aa, Cryptosporidium hominis
ARVRPFILCAILRDLSFNEDIYRS

SEQ ID NO: 2168458 - protein, 17 aa, Cryptosporidium hominis
ASCLNKWYEKYSSVNNE

SEQ ID NO: 2168459 - protein, 26 aa, Cryptosporidium hominis
ASDSRCLRDTWGLRQHRDGRWDWIEA

SEQ ID NO: 2168460 - protein, 24 aa, Cryptosporidium hominis
ASEDELRQSLGLFEHLTYGRGEKR

SEQ ID NO: 2168461 - protein, 23 aa, Cryptosporidium hominis
ASEKLTKGMLGYVSKHTLNNFKN

SEQ ID NO: 2168462 - protein, 25 aa, Cryptosporidium hominis
ASENYELLDYITIQLFGYASFSNEL

SEQ ID NO: 2168463 - protein, 23 aa, Cryptosporidium hominis
ASESIQLAAIVSCFHEVRMEMEK

SEQ ID NO: 2168464 - protein, 24 aa, Cryptosporidium hominis
ASFRPNLDYAKWVIEKGADVNAKD

SEQ ID NO: 2168465 - protein, 17 aa, Cryptosporidium hominis
ASGFCYINDIVLGILEL

SEQ ID NO: 2168466 - protein, 18 aa, Cryptosporidium hominis
ASGHLLATRKARLMNNVI

SEQ ID NO: 2168467 - protein, 22 aa, Cryptosporidium hominis
ASGKTSVCTRIFSELGDKRVTV

SEQ ID NO: 2168468 - protein, 26 aa, Cryptosporidium hominis
ASHDFFLKRLKGIGRHQVKINIYNSL

SEQ ID NO: 2168469 - protein, 31 aa, Cryptosporidium hominis
ASHISKWIRDEYRFNNPMFLIPKKVKKNFKN

SEQ ID NO: 2168470 - protein, 20 aa, Cryptosporidium hominis
ASHKGNVSSLNWINDSNDNL

SEQ ID NO: 2168471 - protein, 25 aa, Cryptosporidium hominis
ASIISRYWLNHSIACSGERILSDGI

SEQ ID NO: 2168472 - protein, 18 aa, Cryptosporidium hominis
ASILNFKFFNSIFELYEE

SEQ ID NO: 2168473 - protein, 18 aa, Cryptosporidium hominis
ASKFGEDQVKIWRRSFDV

SEQ ID NO: 2168474 - protein, 19 aa, Cryptosporidium hominis
ASKFKQALESTGLACQEIQ

SEQ ID NO: 2168475 - protein, 23 aa, Cryptosporidium hominis
ASKKKVGAALECFSGNSSTKNAY

SEQ ID NO: 2168476 - protein, 18 aa, Cryptosporidium hominis
ASKPLREVYVGNLPQGIT

SEQ ID NO: 2168477 - protein, 21 aa, Cryptosporidium hominis
ASKSVSFVRRDRVVFLGSPPE

SEQ ID NO: 2168478 - protein, 21 aa, Cryptosporidium hominis
ASLKLIKSHIVSGVKELNFGN

SEQ ID NO: 2168479 - protein, 17 aa, Cryptosporidium hominis
ASLRKNLKIKYDKEREQ

SEQ ID NO: 2168480 - protein, 19 aa, Cryptosporidium hominis
ASLRKRGKVNNMVSGLGGV

SEQ ID NO: 2168481 - protein, 18 aa, Cryptosporidium hominis
ASLSAQCEMAYIDIISQT

SEQ ID NO: 2168482 - protein, 18 aa, Cryptosporidium hominis
ASLTILLCDSQFPGQPLT

SEQ ID NO: 2168483 - protein, 18 aa, Cryptosporidium hominis
ASLVRLGHEVHLFTRATT

SEQ ID NO: 2168484 - protein, 18 aa, Cryptosporidium hominis
ASNAKTYNGFSHFLYYSA

SEQ ID NO: 2168485 - protein, 19 aa, Cryptosporidium hominis
ASNPVRVLMRYFKEKLALG

SEQ ID NO: 2168486 - protein, 23 aa, Cryptosporidium hominis
ASNRTCNCLALLQCVASHSETRA

SEQ ID NO: 2168487 - protein, 17 aa, Cryptosporidium hominis
ASNSVWGITDFKRILID

SEQ ID NO: 2168488 - protein, 24 aa, Cryptosporidium hominis
ASQLKEIYQMITLGGDAELELIDS

SEQ ID NO: 2168489 - protein, 18 aa, Cryptosporidium hominis
ASRGSKCRVFSRMLESFK

SEQ ID NO: 2168490 - protein, 19 aa, Cryptosporidium hominis
ASRPLTSYVSTRWYRAPEL

SEQ ID NO: 2168491 - protein, 20 aa, Cryptosporidium hominis
ASRTCRRCGQVGHIASNPMC

SEQ ID NO: 2168492 - protein, 20 aa, Cryptosporidium hominis
ASSDETWRIWDIETLNQVQV

SEQ ID NO: 2168493 - protein, 19 aa, Cryptosporidium hominis
ASSESVIFFHFVSKDDKYS

SEQ ID NO: 2168494 - protein, 23 aa, Cryptosporidium hominis
ASSGAIIEYVGNFAFIHGDLSER

SEQ ID NO: 2168495 - protein, 20 aa, Cryptosporidium hominis
ASSNGSIFWVTPTQFNPQTG

SEQ ID NO: 2168496 - protein, 18 aa, Cryptosporidium hominis
ASSSISRTVLVSKTKNED

SEQ ID NO: 2168497 - protein, 22 aa, Cryptosporidium hominis
ASSSRIFIKILFQELSYNMGIK

SEQ ID NO: 2168498 - protein, 18 aa, Cryptosporidium hominis
ASTMVILQRHGCCTMLLY

SEQ ID NO: 2168499 - protein, 19 aa, Cryptosporidium hominis
ASVAMIRGTRRFLFDFSVT

SEQ ID NO: 2168500 - protein, 19 aa, Cryptosporidium hominis
ASVDRGFARCFVMKRQTIE

SEQ ID NO: 2168501 - protein, 20 aa, Cryptosporidium hominis
ASVGKSCLVVRFSKDEFHEY

SEQ ID NO: 2168502 - protein, 31 aa, Cryptosporidium hominis
ASVSHGCLMCLTCSGVHRGLGVHISFIRSIT

SEQ ID NO: 2168503 - protein, 25 aa, Cryptosporidium hominis
ATALTGWRGRLLVGINKTLRVYSLG

SEQ ID NO: 2168504 - protein, 24 aa, Cryptosporidium hominis
ATAVELQLLFPLVRVNFELGVIMV

SEQ ID NO: 2168505 - protein, 18 aa, Cryptosporidium hominis
ATDIGSMLPWFVNLSLKL

SEQ ID NO: 2168506 - protein, 24 aa, Cryptosporidium hominis
ATESNSLYIWIFSHENIKSNELNQ

SEQ ID NO: 2168507 - protein, 25 aa, Cryptosporidium hominis
ATFIKEAFCAPSFAPPKSDIFSINN

SEQ ID NO: 2168508 - protein, 17 aa, Cryptosporidium hominis
ATFPGRTRNGNSYFFHR

SEQ ID NO: 2168509 - protein, 22 aa, Cryptosporidium hominis
ATGHPPLVMSMSFTNQVLAQMD

SEQ ID NO: 2168510 - protein, 31 aa, Cryptosporidium hominis
ATGQPFIPFALSFLMNVGDSYGISFFTTSIQ

SEQ ID NO: 2168511 - protein, 23 aa, Cryptosporidium hominis
ATIPNYIEFANWIGRIKQNTVYC

SEQ ID NO: 2168512 - protein, 17 aa, Cryptosporidium hominis
ATIQTINSINEFQASNN

SEQ ID NO: 2168513 - protein, 21 aa, Cryptosporidium hominis
ATIWLFRCLLSIDSPSFHQLM

SEQ ID NO: 2168514 - protein, 17 aa, Cryptosporidium hominis
ATKRIATVYPRDIVNIR

SEQ ID NO: 2168515 - protein, 17 aa, Cryptosporidium hominis
ATKRKQISMSIEEFLEK

SEQ ID NO: 2168516 - protein, 25 aa, Cryptosporidium hominis
ATLAKRLMERMGLQPQPPHSPPKST

SEQ ID NO: 2168517 - protein, 25 aa, Cryptosporidium hominis
ATLCCLSALGLRGKVVSSFSFFPPK

SEQ ID NO: 2168518 - protein, 20 aa, Cryptosporidium hominis
ATLEKRCKNLIEEKETIQNF

SEQ ID NO: 2168519 - protein, 23 aa, Cryptosporidium hominis
ATLLWGKCSFLLDSDYWKDINSI

SEQ ID NO: 2168520 - protein, 23 aa, Cryptosporidium hominis
ATLQKRILELFVERRALMDENKS

SEQ ID NO: 2168521 - protein, 19 aa, Cryptosporidium hominis
ATLSKPVEDLARYSLKNNP

SEQ ID NO: 2168522 - protein, 23 aa, Cryptosporidium hominis
ATLSRSVTDLALLALNNPCKVST

SEQ ID NO: 2168523 - protein, 26 aa, Cryptosporidium hominis
ATLVDNCLGILAAQLYKFPVTKTLNL

SEQ ID NO: 2168524 - protein, 18 aa, Cryptosporidium hominis
ATMCRLLLPEMIDKRIDK

SEQ ID NO: 2168525 - protein, 26 aa, Cryptosporidium hominis
ATNEKGFSSLHWASLKGHSQVVEELL

SEQ ID NO: 2168526 - protein, 17 aa, Cryptosporidium hominis
ATNIFKRAFVSILKKHD

SEQ ID NO: 2168527 - protein, 18 aa, Cryptosporidium hominis
ATNVNELNQAIKMAYSVG

SEQ ID NO: 2168528 - protein, 19 aa, Cryptosporidium hominis
ATPPFIYNVDHLMECVEIP

SEQ ID NO: 2168529 - protein, 29 aa, Cryptosporidium hominis
ATQCPLCKREFDHINAFNVIPGELSIPVM

SEQ ID NO: 2168530 - protein, 31 aa, Cryptosporidium hominis
ATQRGSFGVVFKGRIRSGIWSNKEVAVKRWK

SEQ ID NO: 2168531 - protein, 22 aa, Cryptosporidium hominis
ATRRIKTEFLVQMDGVNSNSNN

SEQ ID NO: 2168532 - protein, 20 aa, Cryptosporidium hominis
ATSHFKGVVSSNSYDRSSIL

SEQ ID NO: 2168533 - protein, 23 aa, Cryptosporidium hominis
ATTGKPKGFGFVLFNDRKFVISS

SEQ ID NO: 2168534 - protein, 31 aa, Cryptosporidium hominis
ATTKQLWQIAAMCGLEERFINLHAQSLAQSK

SEQ ID NO: 2168535 - protein, 27 aa, Cryptosporidium hominis
ATTLRCFCGVGCYKQGFAQLRRFYEVR

SEQ ID NO: 2168536 - protein, 17 aa, Cryptosporidium hominis
ATTMIHGITPFYYGISG

SEQ ID NO: 2168537 - protein, 31 aa, Cryptosporidium hominis
ATVKARGRCKVAYLDRKAFKRVLGPIEDILK

SEQ ID NO: 2168538 - protein, 25 aa, Cryptosporidium hominis
AVALKKPFVCGSVDTLERIKILQQF

SEQ ID NO: 2168539 - protein, 24 aa, Cryptosporidium hominis
AVAQRLSKIFSRYKALSSGFVDVL

SEQ ID NO: 2168540 - protein, 18 aa, Cryptosporidium hominis
AVDLCAAPGSWSQVLSTK

SEQ ID NO: 2168541 - protein, 17 aa, Cryptosporidium hominis
AVFNRLASRIEEGIQDL

SEQ ID NO: 2168542 - protein, 23 aa, Cryptosporidium hominis
AVGTPGRLSALIFGEYENETLFG

SEQ ID NO: 2168543 - protein, 18 aa, Cryptosporidium hominis
AVHLFDPLFYEGFLEEVP

SEQ ID NO: 2168544 - protein, 18 aa, Cryptosporidium hominis
AVHLSFKCITLYAQYHLF

SEQ ID NO: 2168545 - protein, 18 aa, Cryptosporidium hominis
AVITKVRICKLNVEIVEK

SEQ ID NO: 2168546 - protein, 22 aa, Cryptosporidium hominis
AVLEYLCAELLELAGNAARDAK

SEQ ID NO: 2168547 - protein, 19 aa, Cryptosporidium hominis
AVLGDRPIYVGKFQKKAER

SEQ ID NO: 2168548 - protein, 17 aa, Cryptosporidium hominis
AVLGEFDLPASVKEALI

SEQ ID NO: 2168549 - protein, 21 aa, Cryptosporidium hominis
AVRQFGFKIDIEYIKEFINNY

SEQ ID NO: 2168550 - protein, 19 aa, Cryptosporidium hominis
AVSLYRSKLSNSYKILDKY

SEQ ID NO: 2168551 - protein, 17 aa, Cryptosporidium hominis
AVSRAFGNWDMYSGMKL

SEQ ID NO: 2168552 - protein, 18 aa, Cryptosporidium hominis
AVSRGRMATNTANINNTN

SEQ ID NO: 2168553 - protein, 20 aa, Cryptosporidium hominis
AVTSQACYFDTTDNTMTFVY

SEQ ID NO: 2168554 - protein, 21 aa, Cryptosporidium hominis
AVVHPCAKMLVELSKAQDVEV

SEQ ID NO: 2168555 - protein, 18 aa, Cryptosporidium hominis
AVVPNAKCRLRLLKYERI

SEQ ID NO: 2168556 - protein, 23 aa, Cryptosporidium hominis
AVYPRKGIAFVEYFDIRKAEGAR

SEQ ID NO: 2168557 - protein, 23 aa, Cryptosporidium hominis
AVYSGWYSPYGYTMPFMGSYTPI

SEQ ID NO: 2168558 - protein, 33 aa, Cryptosporidium hominis
AWEACIRFRVSRGWKISNWYGNFYFSGVDLLLA

SEQ ID NO: 2168559 - protein, 20 aa, Cryptosporidium hominis
AWLLEGITLILYKNGVLKAL

SEQ ID NO: 2168560 - protein, 19 aa, Cryptosporidium hominis
AYCAIAISADWLILATDVD

SEQ ID NO: 2168561 - protein, 19 aa, Cryptosporidium hominis
AYFEIREWFDNAVRFEREY

SEQ ID NO: 2168562 - protein, 19 aa, Cryptosporidium hominis
AYFKESIWIPNALIPLVRQ

SEQ ID NO: 2168563 - protein, 18 aa, Cryptosporidium hominis
AYFKKSQFELALDAYTKA

SEQ ID NO: 2168564 - protein, 18 aa, Cryptosporidium hominis
AYFPKWDASIVMINGKMV

SEQ ID NO: 2168565 - protein, 28 aa, Cryptosporidium hominis
AYGIVWKSIDRRTGEVVAVKKIFDAFQN

SEQ ID NO: 2168566 - protein, 18 aa, Cryptosporidium hominis
AYIDILRDQMMGMGELEH

SEQ ID NO: 2168567 - protein, 17 aa, Cryptosporidium hominis
AYIPDGSEMIGFTQNIQ

SEQ ID NO: 2168568 - protein, 25 aa, Cryptosporidium hominis
AYKQRARLAAMVSRRRVTLQHVRAQ

SEQ ID NO: 2168569 - protein, 18 aa, Cryptosporidium hominis
AYKTAFWNGIDWTASSFA

SEQ ID NO: 2168570 - protein, 27 aa, Cryptosporidium hominis
AYLARMKKLYVCLGRHSIYLLKRNLRK

SEQ ID NO: 2168571 - protein, 24 aa, Cryptosporidium hominis
AYLELCGFEQVMINSEFKGQGKKS

SEQ ID NO: 2168572 - protein, 17 aa, Cryptosporidium hominis
AYLGRQIKNAVVTVPAY

SEQ ID NO: 2168573 - protein, 34 aa, Cryptosporidium hominis
AYNNMNFTIGIGLSRLGLYLMNSKLQSLIQIQPQ

SEQ ID NO: 2168574 - protein, 17 aa, Cryptosporidium hominis
AYNSVIIFFFLYHCAFK

SEQ ID NO: 2168575 - protein, 25 aa, Cryptosporidium hominis
AYPKFSEKLRVLFSLDEENGNCKLF

SEQ ID NO: 2168576 - protein, 17 aa, Cryptosporidium hominis
AYPKPQMIGQRFQGGSS

SEQ ID NO: 2168577 - protein, 23 aa, Cryptosporidium hominis
AYQPRFTSIFSKIIIQLSETETI

SEQ ID NO: 2168578 - protein, 20 aa, Cryptosporidium hominis
AYRLIFRSFVELSLNNISQE

SEQ ID NO: 2168579 - protein, 24 aa, Cryptosporidium hominis
AYRLTVIKIVPWITQLDAIPINRS

SEQ ID NO: 2168580 - protein, 21 aa, Cryptosporidium hominis
AYSELVPILILAYDLSTFLRS

SEQ ID NO: 2168581 - protein, 18 aa, Cryptosporidium hominis
AYTDLGIIYYELGKEEKA

SEQ ID NO: 2168582 - protein, 24 aa, Cryptosporidium hominis
AYTGKRWKKSFVTSKYEGLCPSDS

SEQ ID NO: 2168583 - protein, 19 aa, Cryptosporidium hominis
AYYCYKTRLEDNIADENSS

SEQ ID NO: 2168584 - protein, 19 aa, Cryptosporidium hominis
AYYRGMLKDLCEGNTPGPK

SEQ ID NO: 2168585 - protein, 33 aa, Cryptosporidium hominis
CADCGAKTPRWASINLGILICIDCSGVHRHLGV

SEQ ID NO: 2168586 - protein, 20 aa, Cryptosporidium hominis
CADIDGFLVGGASLKPTFAK

SEQ ID NO: 2168587 - protein, 21 aa, Cryptosporidium hominis
CADIIMCSDIFTWSDAYTSDL

SEQ ID NO: 2168588 - protein, 22 aa, Cryptosporidium hominis
CADINAQVPILFGVSNSIIENV

SEQ ID NO: 2168589 - protein, 17 aa, Cryptosporidium hominis
CAIFKRILDPKTMDVPE

SEQ ID NO: 2168590 - protein, 17 aa, Cryptosporidium hominis
CALKILINLSQKSEIGE

SEQ ID NO: 2168591 - protein, 17 aa, Cryptosporidium hominis
CAPYEMKHLKKRERTVA

SEQ ID NO: 2168592 - protein, 20 aa, Cryptosporidium hominis
CAQALFKGPHLALGPDVLLK

SEQ ID NO: 2168593 - protein, 21 aa, Cryptosporidium hominis
CAQGLSGVGARVIVTEIDPIC

SEQ ID NO: 2168594 - protein, 19 aa, Cryptosporidium hominis
CAQKVIQHLHLRRHFKNAP

SEQ ID NO: 2168595 - protein, 21 aa, Cryptosporidium hominis
CAQYFLGFCKYGPKCKRRHEP

SEQ ID NO: 2168596 - protein, 30 aa, Cryptosporidium hominis
CARAGTGGNGFFRRCRSRSSKQTRKRYRFD

SEQ ID NO: 2168597 - protein, 20 aa, Cryptosporidium hominis
CARIGAVHMVVFAGFAAQNL

SEQ ID NO: 2168598 - protein, 21 aa, Cryptosporidium hominis
CATEMKGTFLSISSADLTSKW

SEQ ID NO: 2168599 - protein, 29 aa, Cryptosporidium hominis
CATLHPLLHKLCVIAGRIRDILTLLDLPT

SEQ ID NO: 2168600 - protein, 26 aa, Cryptosporidium hominis
CCAPEKSGIMTPEFPGSHDSNYSFSN

SEQ ID NO: 2168601 - protein, 25 aa, Cryptosporidium hominis
CCDYYRYIRRKSWLISNVLLLMVDS

SEQ ID NO: 2168602 - protein, 21 aa, Cryptosporidium hominis
CCIKTEIFHLVYVSIAKNSYI

SEQ ID NO: 2168603 - protein, 26 aa, Cryptosporidium hominis
CCKDNELLRLLVLLNRIQLLNDVRPY

SEQ ID NO: 2168604 - protein, 17 aa, Cryptosporidium hominis
CCMSGLVADAKTMIDHA

SEQ ID NO: 2168605 - protein, 18 aa, Cryptosporidium hominis
CCNRGGYCNFMHIKHVPR

SEQ ID NO: 2168606 - protein, 17 aa, Cryptosporidium hominis
CCRDHCKINKSDPNSGV

SEQ ID NO: 2168607 - protein, 17 aa, Cryptosporidium hominis
CCRDRAIWFFSLDIGEN

SEQ ID NO: 2168608 - protein, 20 aa, Cryptosporidium hominis
CCSLCRCIETAQWRYLRNTL

SEQ ID NO: 2168609 - protein, 19 aa, Cryptosporidium hominis
CDAVWPGWGHASENPELPK

SEQ ID NO: 2168610 - protein, 24 aa, Cryptosporidium hominis
CDEEASVFIEIDFGTSREEFRVQL

SEQ ID NO: 2168611 - protein, 20 aa, Cryptosporidium hominis
CDFPGKMVPNKNLLRLSRNH

SEQ ID NO: 2168612 - protein, 21 aa, Cryptosporidium hominis
CDGQLKRWIIRPADKDVMTTE

SEQ ID NO: 2168613 - protein, 25 aa, Cryptosporidium hominis
CDICSKSIHKSCLKKCNQFIASSSF

SEQ ID NO: 2168614 - protein, 18 aa, Cryptosporidium hominis
CDKFSGGTTRLIIDNNRI

SEQ ID NO: 2168615 - protein, 21 aa, Cryptosporidium hominis
CDLDIRKDLYANIVLSGGTTM

SEQ ID NO: 2168616 - protein, 27 aa, Cryptosporidium hominis
CDPRHGKYMACCLMYRGDVVPKDTNAA

SEQ ID NO: 2168617 - protein, 28 aa, Cryptosporidium hominis
CDQIQLPPIFYILSKRILIQEAKYHLSL

SEQ ID NO: 2168618 - protein, 17 aa, Cryptosporidium hominis
CDSHRNLWDSLGGYQDV

SEQ ID NO: 2168619 - protein, 25 aa, Cryptosporidium hominis
CDSKLGYYCWFGGKCSCGYWQTPSF

SEQ ID NO: 2168620 - protein, 28 aa, Cryptosporidium hominis
CDSLSLNNCCLKRNCDFRIRLDDERLLL

SEQ ID NO: 2168621 - protein, 18 aa, Cryptosporidium hominis
CDSNPKFVPPLAHNLLKL

SEQ ID NO: 2168622 - protein, 20 aa, Cryptosporidium hominis
CDSSGIFVLFNFKLKLNKEI

SEQ ID NO: 2168623 - protein, 22 aa, Cryptosporidium hominis
CDSSVLCSLVLTVSDLCSMYRD

SEQ ID NO: 2168624 - protein, 17 aa, Cryptosporidium hominis
CDTLRKLSPISITSKII

SEQ ID NO: 2168625 - protein, 28 aa, Cryptosporidium hominis
CDVARCSGRKLLRFNYAKKLQFSSNYAR

SEQ ID NO: 2168626 - protein, 19 aa, Cryptosporidium hominis
CEDNRYPTAHFYTVSAMLN

SEQ ID NO: 2168627 - protein, 23 aa, Cryptosporidium hominis
CEECSRWYHQDCVGYSSKSNNFP

SEQ ID NO: 2168628 - protein, 24 aa, Cryptosporidium hominis
CEEKALLIKAGFSACIRAFTFEGF

SEQ ID NO: 2168629 - protein, 18 aa, Cryptosporidium hominis
CEELRKLFISVYLSQTLQ

SEQ ID NO: 2168630 - protein, 23 aa, Cryptosporidium hominis
CEENKSDCVFIKSQTFNILNSPC

SEQ ID NO: 2168631 - protein, 25 aa, Cryptosporidium hominis
CEEPFSIFKRHECWCRPLEQIGSNT

SEQ ID NO: 2168632 - protein, 27 aa, Cryptosporidium hominis
CEEYLKTKLLFKLIIKSVIKNDPEPLI

SEQ ID NO: 2168633 - protein, 25 aa, Cryptosporidium hominis
CEFRLKKTLLHECCHVAQFLLDSCI

SEQ ID NO: 2168634 - protein, 25 aa, Cryptosporidium hominis
CEFSPRSPLNFKDIFPNASEMAIDL

SEQ ID NO: 2168635 - protein, 24 aa, Cryptosporidium hominis
CEGRVKLGDFGWCGDLCRRCNSMA

SEQ ID NO: 2168636 - protein, 17 aa, Cryptosporidium hominis
CEIGYSLSRLCFEIDDN

SEQ ID NO: 2168637 - protein, 17 aa, Cryptosporidium hominis
CEIHPSLILGVCASIIP

SEQ ID NO: 2168638 - protein, 29 aa, Cryptosporidium hominis
CEIKGNLFPEVKFILNTMLQDGIFLVNLY

SEQ ID NO: 2168639 - protein, 19 aa, Cryptosporidium hominis
CEKEFRNLRRIVISGLRCP

SEQ ID NO: 2168640 - protein, 20 aa, Cryptosporidium hominis
CEKGWRVGQIKRVIINDIGG

SEQ ID NO: 2168641 - protein, 17 aa, Cryptosporidium hominis
CEKIPLFSTSPITNNVN

SEQ ID NO: 2168642 - protein, 17 aa, Cryptosporidium hominis
CEKPESIPNMARQLQAN

SEQ ID NO: 2168643 - protein, 23 aa, Cryptosporidium hominis
CELYETALWGRYEFPNDDSNKGI

SEQ ID NO: 2168644 - protein, 18 aa, Cryptosporidium hominis
CENFSVHCFNGYYNNCIF

SEQ ID NO: 2168645 - protein, 28 aa, Cryptosporidium hominis
CENKKILKRKCLRLLGDKCKTCETTEWS

SEQ ID NO: 2168646 - protein, 18 aa, Cryptosporidium hominis
CENMAKKCKGIEEIISNL

SEQ ID NO: 2168647 - protein, 18 aa, Cryptosporidium hominis
CEPFGDLKKVAVYPRKGI

SEQ ID NO: 2168648 - protein, 23 aa, Cryptosporidium hominis
CESEDKWAIVVASDGIWDSISEE

SEQ ID NO: 2168649 - protein, 19 aa, Cryptosporidium hominis
CESMEGFVLCHSIAGGTGS

SEQ ID NO: 2168650 - protein, 17 aa, Cryptosporidium hominis
CETTIFYAGCTLEEKTG

SEQ ID NO: 2168651 - protein, 21 aa, Cryptosporidium hominis
CFDYPIKEIDSLNVVDKISVR

SEQ ID NO: 2168652 - protein, 19 aa, Cryptosporidium hominis
CFEHSYSSIVGNFIEETPE

SEQ ID NO: 2168653 - protein, 20 aa, Cryptosporidium hominis
CFELKSLFIAPTREICIQIN

SEQ ID NO: 2168654 - protein, 17 aa, Cryptosporidium hominis
CFFGLLDGHGHYGKTAS

SEQ ID NO: 2168655 - protein, 25 aa, Cryptosporidium hominis
CFKQIRLKIIFPNGEEVIRSDLIAW

SEQ ID NO: 2168656 - protein, 27 aa, Cryptosporidium hominis
CFLETARLHNEVCKLLTGTDLILIKSV

SEQ ID NO: 2168657 - protein, 21 aa, Cryptosporidium hominis
CFLLSTKAGGLGINLTTADTV

SEQ ID NO: 2168658 - protein, 17 aa, Cryptosporidium hominis
CFMMLRMPYESEGAKKL

SEQ ID NO: 2168659 - protein, 17 aa, Cryptosporidium hominis
CFNAWPLEYRRVKLYEV

SEQ ID NO: 2168660 - protein, 19 aa, Cryptosporidium hominis
CFNFKSRKIEIIKIKCTST

SEQ ID NO: 2168661 - protein, 29 aa, Cryptosporidium hominis
CFNGYYNNCIFHRVIKGFMIQTGDPTGQG

SEQ ID NO: 2168662 - protein, 20 aa, Cryptosporidium hominis
CFNLKGCYPIYNQDERGELM

SEQ ID NO: 2168663 - protein, 27 aa, Cryptosporidium hominis
CFRFSFLGLRSNEQWLGELFSLSSEDQ

SEQ ID NO: 2168664 - protein, 27 aa, Cryptosporidium hominis
CFSLKVPPVFCNNGNLLLIPKGRDNEI

SEQ ID NO: 2168665 - protein, 27 aa, Cryptosporidium hominis
CFSQDVFKKKCKRRPKMANPNYGTPLS

SEQ ID NO: 2168666 - protein, 18 aa, Cryptosporidium hominis
CFTEFAVSEYRLAREESN

SEQ ID NO: 2168667 - protein, 25 aa, Cryptosporidium hominis
CFTKSFPVCFFCLYSIRKLKEWKKS

SEQ ID NO: 2168668 - protein, 20 aa, Cryptosporidium hominis
CGAKSVVLASHLGRPDGQRK

SEQ ID NO: 2168669 - protein, 22 aa, Cryptosporidium hominis
CGASCCWHYGVDNTFVLRAKTR

SEQ ID NO: 2168670 - protein, 21 aa, Cryptosporidium hominis
CGDIDEIYCTSTINTEVTPFY

SEQ ID NO: 2168671 - protein, 25 aa, Cryptosporidium hominis
CGDTIELFLDFPIDLQKLVLKELHS

SEQ ID NO: 2168672 - protein, 20 aa, Cryptosporidium hominis
CGETYCQECIINFIRNHMDA

SEQ ID NO: 2168673 - protein, 23 aa, Cryptosporidium hominis
  misc_feature (19)..(19): Xaa can be any naturally occurring amino acid
CGFGDTCKFLHDRSDLKVXGNLI

SEQ ID NO: 2168674 - protein, 17 aa, Cryptosporidium hominis
CGHLLIGAYRAHPNIPI

SEQ ID NO: 2168675 - protein, 25 aa, Cryptosporidium hominis
CGHVFHKQCIDAWLSKCDSNKNSNI

SEQ ID NO: 2168676 - protein, 19 aa, Cryptosporidium hominis
CGLTGELRKGEQYLKELRF

SEQ ID NO: 2168677 - protein, 17 aa, Cryptosporidium hominis
CGMFLRGNIIYIYGGLF

SEQ ID NO: 2168678 - protein, 18 aa, Cryptosporidium hominis
CGNFSPLPAESLKLKNGD

SEQ ID NO: 2168679 - protein, 18 aa, Cryptosporidium hominis
CGNQIGMEFWKQLCTEHG

SEQ ID NO: 2168680 - protein, 24 aa, Cryptosporidium hominis
CGPHAEYHIKWCSKVSSIKFLSQN

SEQ ID NO: 2168681 - protein, 19 aa, Cryptosporidium hominis
CGQLGFGNLEDCLVPRVNL

SEQ ID NO: 2168682 - protein, 17 aa, Cryptosporidium hominis
CGQRFRGSVPNKSLANM

SEQ ID NO: 2168683 - protein, 24 aa, Cryptosporidium hominis
CGRAGRTGYAITFFTLKDIPKIKS

SEQ ID NO: 2168684 - protein, 20 aa, Cryptosporidium hominis
CGSFLESRRLIFISQTVMCI

SEQ ID NO: 2168685 - protein, 18 aa, Cryptosporidium hominis
CGSLKDAGLDLKVMRDVE

SEQ ID NO: 2168686 - protein, 21 aa, Cryptosporidium hominis
CGSPNYAAPEVVSGKAYTGPE

SEQ ID NO: 2168687 - protein, 19 aa, Cryptosporidium hominis
CGTRMRFLLQVYAPQDDRE

SEQ ID NO: 2168688 - protein, 18 aa, Cryptosporidium hominis
CGVLPYLVKCMSSEIDGL

SEQ ID NO: 2168689 - protein, 17 aa, Cryptosporidium hominis
CGVNRMFGNLNLSFTGV

SEQ ID NO: 2168690 - protein, 19 aa, Cryptosporidium hominis
CHAFYLSIIREIFCVLTDT

SEQ ID NO: 2168691 - protein, 21 aa, Cryptosporidium hominis
CHDRKHCPGLPPLHRFVQSSG

SEQ ID NO: 2168692 - protein, 27 aa, Cryptosporidium hominis
CHHIFHANCLLPWLNQHNSCPVCRFEL

SEQ ID NO: 2168693 - protein, 20 aa, Cryptosporidium hominis
CHLFYKFKVYMNDLVNSFTS

SEQ ID NO: 2168694 - protein, 20 aa, Cryptosporidium hominis
CHRMSDAHLRQMEVFEQNSK

SEQ ID NO: 2168695 - protein, 23 aa, Cryptosporidium hominis
CHVQYRLGNIDAFQLADGLQYIF

SEQ ID NO: 2168696 - protein, 18 aa, Cryptosporidium hominis
CICADARKLLSLSTPSLI

SEQ ID NO: 2168697 - protein, 19 aa, Cryptosporidium hominis
CIDCNFTFEGFDYKSHNSC

SEQ ID NO: 2168698 - protein, 37 aa, Cryptosporidium hominis
CIDFYYKYKYTLGFKRILRLVYYFKGSHNKNQINMNH

SEQ ID NO: 2168699 - protein, 26 aa, Cryptosporidium hominis
CIDNPLCKICDPFFIGYSDLLNLQVS

SEQ ID NO: 2168700 - protein, 25 aa, Cryptosporidium hominis
CIDSRGRWLSGLCDKDSFKEVMSDW

SEQ ID NO: 2168701 - protein, 26 aa, Cryptosporidium hominis
CIDYTIPDHVPFNISLLRTGQDKQNF

SEQ ID NO: 2168702 - protein, 28 aa, Cryptosporidium hominis
CIELEKKKFKWSFLHTEKFWLENVMNFE

SEQ ID NO: 2168703 - protein, 23 aa, Cryptosporidium hominis
CIFGLTCCGNILVWKVDLMENFV

SEQ ID NO: 2168704 - protein, 18 aa, Cryptosporidium hominis
CIINELRNVFSVYGINVD

SEQ ID NO: 2168705 - protein, 18 aa, Cryptosporidium hominis
CIISEWPSSELISNSKKV

SEQ ID NO: 2168706 - protein, 19 aa, Cryptosporidium hominis
CIKSLLGIIKEQFFLEVKI

SEQ ID NO: 2168707 - protein, 17 aa, Cryptosporidium hominis
CILFRSSPNSDIQNDSE

SEQ ID NO: 2168708 - protein, 20 aa, Cryptosporidium hominis
CILLSSRLGRCIPANPIALV

SEQ ID NO: 2168709 - protein, 20 aa, Cryptosporidium hominis
CIMAIKSLNGYELRGRSIRV

SEQ ID NO: 2168710 - protein, 18 aa, Cryptosporidium hominis
CINCRRGDLLAKELGFNS

SEQ ID NO: 2168711 - protein, 26 aa, Cryptosporidium hominis
CINDEPKKGFGWEICVYNEDMGKSQT

SEQ ID NO: 2168712 - protein, 22 aa, Cryptosporidium hominis
CINGLRPALFEADFDNWNEVNA

SEQ ID NO: 2168713 - protein, 18 aa, Cryptosporidium hominis
CIPFSGAIRDILRQFHPP

SEQ ID NO: 2168714 - protein, 31 aa, Cryptosporidium hominis
CIPPIAVCRVCKSPCRIITLPYIFRYLSNEL

SEQ ID NO: 2168715 - protein, 24 aa, Cryptosporidium hominis
CIPSDFDSTLGLMYGMLASKIINS

SEQ ID NO: 2168716 - protein, 20 aa, Cryptosporidium hominis
CIPYCPIKLISFVLALSSDI

SEQ ID NO: 2168717 - protein, 27 aa, Cryptosporidium hominis
CIQSPVCLDISLNMSRYQIFLDLFELI

SEQ ID NO: 2168718 - protein, 18 aa, Cryptosporidium hominis
CIRDRFYSSLSYGQLKCK

SEQ ID NO: 2168719 - protein, 21 aa, Cryptosporidium hominis
CISCISFCQNMNWSNMQIVFQ

SEQ ID NO: 2168720 - protein, 26 aa, Cryptosporidium hominis
CISGLYEIIKGLKFLHNDGKLLHGNI

SEQ ID NO: 2168721 - protein, 28 aa, Cryptosporidium hominis
CISVGLRVGAILEEKCKLLGEDCTVLSK

SEQ ID NO: 2168722 - protein, 23 aa, Cryptosporidium hominis
CITEIPLDRWPFDLYYDPDPDNR

SEQ ID NO: 2168723 - protein, 24 aa, Cryptosporidium hominis
CITIKSTGISLFFEHDLEDGKGKQ

SEQ ID NO: 2168724 - protein, 19 aa, Cryptosporidium hominis
CITNPLDAMVYYFKEKSGI

SEQ ID NO: 2168725 - protein, 17 aa, Cryptosporidium hominis
CITQHFVKLCNSGRDEH

SEQ ID NO: 2168726 - protein, 21 aa, Cryptosporidium hominis
CKCSSEWSTIIIYTCSKDCNT

SEQ ID NO: 2168727 - protein, 17 aa, Cryptosporidium hominis
CKDEHPESIIFNQNAIK

SEQ ID NO: 2168728 - protein, 23 aa, Cryptosporidium hominis
CKDIIATGCNVVFTEKGVSDLAQ

SEQ ID NO: 2168729 - protein, 21 aa, Cryptosporidium hominis
CKEGRIYVLVNIAAKSSSRTS

SEQ ID NO: 2168730 - protein, 19 aa, Cryptosporidium hominis
CKEIESWKNRFHDLESTAG

SEQ ID NO: 2168731 - protein, 17 aa, Cryptosporidium hominis
CKEIEYYGFLGEFYSPS

SEQ ID NO: 2168732 - protein, 25 aa, Cryptosporidium hominis
CKELCIACESLGWKTPTEIQKKTIP

SEQ ID NO: 2168733 - protein, 20 aa, Cryptosporidium hominis
CKENLFSSGEEGFIENLNLL

SEQ ID NO: 2168734 - protein, 26 aa, Cryptosporidium hominis
CKFTTSICSYGNYFILIDFKEKQQDF

SEQ ID NO: 2168735 - protein, 20 aa, Cryptosporidium hominis
CKGRTNWRSLFLEFQSTQDR

SEQ ID NO: 2168736 - protein, 21 aa, Cryptosporidium hominis
CKHGFHIKCIKEYIEQAPQED

SEQ ID NO: 2168737 - protein, 17 aa, Cryptosporidium hominis
CKHTNCIELVPTEGKMQ

SEQ ID NO: 2168738 - protein, 26 aa, Cryptosporidium hominis
CKICNRPCTMFRWKLHNSKKYNQTTI

SEQ ID NO: 2168739 - protein, 20 aa, Cryptosporidium hominis
CKIEDCYNCKIRNKFHDKLG

SEQ ID NO: 2168740 - protein, 20 aa, Cryptosporidium hominis
CKIFRDCFFEVDSISKRHTG

SEQ ID NO: 2168741 - protein, 21 aa, Cryptosporidium hominis
CKIGDGVRLKDCVIFDNTNIN

SEQ ID NO: 2168742 - protein, 24 aa, Cryptosporidium hominis
CKIMKRSIFLSVDMAHSIHPNYPE

SEQ ID NO: 2168743 - protein, 19 aa, Cryptosporidium hominis
CKIYVWSFQTGKLVDKLSG

SEQ ID NO: 2168744 - protein, 22 aa, Cryptosporidium hominis
CKKALKNTLKIAADANEISMYS

SEQ ID NO: 2168745 - protein, 20 aa, Cryptosporidium hominis
CKKCGSTLFTTDHIIKHGKL

SEQ ID NO: 2168746 - protein, 21 aa, Cryptosporidium hominis
CKKCIICREYIHDKCGYYYKN

SEQ ID NO: 2168747 - protein, 20 aa, Cryptosporidium hominis
CKKGKLFLESFSLLPKISGE

SEQ ID NO: 2168748 - protein, 22 aa, Cryptosporidium hominis
CKLENPEAFEILKNVCNIIEYE

SEQ ID NO: 2168749 - protein, 17 aa, Cryptosporidium hominis
CKLHGQMCQKSREKSYE

SEQ ID NO: 2168750 - protein, 19 aa, Cryptosporidium hominis
CKLIEGFGMSECIGTLGTR

SEQ ID NO: 2168751 - protein, 19 aa, Cryptosporidium hominis
CKLREEFPNVPIIALTATA

SEQ ID NO: 2168752 - protein, 18 aa, Cryptosporidium hominis
CKMHKILIFTQFQLILDE

SEQ ID NO: 2168753 - protein, 19 aa, Cryptosporidium hominis
CKMKGYTDFTIECPKGYKL

SEQ ID NO: 2168754 - protein, 19 aa, Cryptosporidium hominis
CKNFNYLGEIVYSLRSNLS

SEQ ID NO: 2168755 - protein, 17 aa, Cryptosporidium hominis
CKNHHLVSDKLGWFEDN

SEQ ID NO: 2168756 - protein, 22 aa, Cryptosporidium hominis
CKPRVVEAISILERCNKINNSA

SEQ ID NO: 2168757 - protein, 17 aa, Cryptosporidium hominis
CKQEIRQQTQWKILQES

SEQ ID NO: 2168758 - protein, 37 aa, Cryptosporidium hominis
CKSASVSIISPVEWKPDVSFLRYGFISPISSNYPISF

SEQ ID NO: 2168759 - protein, 19 aa, Cryptosporidium hominis
CKSIGWLELAEIILNINDH

SEQ ID NO: 2168760 - protein, 19 aa, Cryptosporidium hominis
CKSSKCEIFNVIIGKHTSL

SEQ ID NO: 2168761 - protein, 19 aa, Cryptosporidium hominis
CKSTENCSKNASSSSSVLN

SEQ ID NO: 2168762 - protein, 18 aa, Cryptosporidium hominis
CKVLPDWIANNTNLNIAK

SEQ ID NO: 2168763 - protein, 17 aa, Cryptosporidium hominis
CKVLPINSSIFGFVDYI

SEQ ID NO: 2168764 - protein, 17 aa, Cryptosporidium hominis
CKVYFPTQLRLIDNYAS

SEQ ID NO: 2168765 - protein, 18 aa, Cryptosporidium hominis
CLAEKLLPFQEGDYVMFR

SEQ ID NO: 2168766 - protein, 22 aa, Cryptosporidium hominis
CLALSYYFIEWLHEYMRNEFSK

SEQ ID NO: 2168767 - protein, 18 aa, Cryptosporidium hominis
CLDSFSGDTSHVIHNFLQ

SEQ ID NO: 2168768 - protein, 17 aa, Cryptosporidium hominis
CLELKVSNFDAYNFNPR

SEQ ID NO: 2168769 - protein, 19 aa, Cryptosporidium hominis
CLFAQRAVERWDKVFNDIG

SEQ ID NO: 2168770 - protein, 19 aa, Cryptosporidium hominis
CLGPHPKSSGLIFSPIKRS

SEQ ID NO: 2168771 - protein, 19 aa, Cryptosporidium hominis
CLIILSKGLGIFNIVYKYL

SEQ ID NO: 2168772 - protein, 17 aa, Cryptosporidium hominis
CLIKDRYIQSGVPSEDG

SEQ ID NO: 2168773 - protein, 23 aa, Cryptosporidium hominis
CLIKEIRKSKDFFLNLLQNKNLI

SEQ ID NO: 2168774 - protein, 23 aa, Cryptosporidium hominis
CLISQCVFIKNSLKYYLNTEYLE

SEQ ID NO: 2168775 - protein, 25 aa, Cryptosporidium hominis
CLKQVGRMGITSSMGLGMTPPGSIL

SEQ ID NO: 2168776 - protein, 26 aa, Cryptosporidium hominis
CLLDMKSKFGSLVEFTRPIKLGKENL

SEQ ID NO: 2168777 - protein, 17 aa, Cryptosporidium hominis
CLLFGGYDGNCWKSDTY

SEQ ID NO: 2168778 - protein, 18 aa, Cryptosporidium hominis
CLMNSKIPNSSCLKYNVE

SEQ ID NO: 2168779 - protein, 25 aa, Cryptosporidium hominis
CLNFTPCQRLTLAQVEYELRRINDD

SEQ ID NO: 2168780 - protein, 29 aa, Cryptosporidium hominis
CLNPAKTLMYCFGEYGALEAEKHIRQNYS

SEQ ID NO: 2168781 - protein, 17 aa, Cryptosporidium hominis
CLQSCPLETPKLDFHEQ

SEQ ID NO: 2168782 - protein, 23 aa, Cryptosporidium hominis
CLSLKRLRNVLDMNNNWTCEEIE

SEQ ID NO: 2168783 - protein, 18 aa, Cryptosporidium hominis
CLTILKIINRFILSTNRQ

SEQ ID NO: 2168784 - protein, 21 aa, Cryptosporidium hominis
CLTQFKWINTQGMLQIIKNYT

SEQ ID NO: 2168785 - protein, 17 aa, Cryptosporidium hominis
CLVMEYMEFGTLSDILY

SEQ ID NO: 2168786 - protein, 20 aa, Cryptosporidium hominis
CLVTEFCKRQRVSKDALIIN

SEQ ID NO: 2168787 - protein, 19 aa, Cryptosporidium hominis
CLYDTLTFTLVSTVQLTNS

SEQ ID NO: 2168788 - protein, 18 aa, Cryptosporidium hominis
CLYTESNISIPLEYGQII

SEQ ID NO: 2168789 - protein, 19 aa, Cryptosporidium hominis
CMLQEPYFAFSAVDEPLII

SEQ ID NO: 2168790 - protein, 22 aa, Cryptosporidium hominis
CMNNAICEYVNLNIDKNINSQK

SEQ ID NO: 2168791 - protein, 17 aa, Cryptosporidium hominis
CNAAKWLNPDKILKRQL

SEQ ID NO: 2168792 - protein, 36 aa, Cryptosporidium hominis
CNATSTKFMPDGTIFKQGWTLFVMINTGVPDYDPNN

SEQ ID NO: 2168793 - protein, 25 aa, Cryptosporidium hominis
CNAYKPLLKLISSWERFCNYTLLKR

SEQ ID NO: 2168794 - protein, 20 aa, Cryptosporidium hominis
CNCERCLRNQQIRKIKNYLK

SEQ ID NO: 2168795 - protein, 19 aa, Cryptosporidium hominis
CNCNCFELNSPLKLIDFGL

SEQ ID NO: 2168796 - protein, 19 aa, Cryptosporidium hominis
CNDLDLWLRYNAYLRKSRL

SEQ ID NO: 2168797 - protein, 25 aa, Cryptosporidium hominis
CNELKKRYNQLVLRFEEAIEQKESF

SEQ ID NO: 2168798 - protein, 24 aa, Cryptosporidium hominis
CNFCSYNDCQKCYENSIKLKNLEN

SEQ ID NO: 2168799 - protein, 19 aa, Cryptosporidium hominis
CNFKEALADLRLMFNDGRA

SEQ ID NO: 2168800 - protein, 22 aa, Cryptosporidium hominis
CNGAKFSKSPFVGGLSAARRRP

SEQ ID NO: 2168801 - protein, 33 aa, Cryptosporidium hominis
CNHPGCTRTAHPLCLKLYGCYMETIAEIDEPIQ

SEQ ID NO: 2168802 - protein, 19 aa, Cryptosporidium hominis
CNILNYLIDGVWRQQQYRL

SEQ ID NO: 2168803 - protein, 18 aa, Cryptosporidium hominis
CNKSLINYMILRKNAEIS

SEQ ID NO: 2168804 - protein, 25 aa, Cryptosporidium hominis
CNLKFKCIGIAPLEVLSDSTIKQDK

SEQ ID NO: 2168805 - protein, 18 aa, Cryptosporidium hominis
CNNFKTLIFKQLISTSIY

SEQ ID NO: 2168806 - protein, 17 aa, Cryptosporidium hominis
CNNIILLEARRHEELYM

SEQ ID NO: 2168807 - protein, 19 aa, Cryptosporidium hominis
CNRGGYCPYSHSMEEVIYH

SEQ ID NO: 2168808 - protein, 24 aa, Cryptosporidium hominis
CNSKGRGKGAFENKGKEMALIMPF

SEQ ID NO: 2168809 - protein, 20 aa, Cryptosporidium hominis
CNSLYKLIFDPTSPRNYFKN

SEQ ID NO: 2168810 - protein, 28 aa, Cryptosporidium hominis
CNSQVLTGICSTLSPGLNLEFETEIKST

SEQ ID NO: 2168811 - protein, 21 aa, Cryptosporidium hominis
CNTEFKLLLNETAPATYQESE

SEQ ID NO: 2168812 - protein, 17 aa, Cryptosporidium hominis
CNTYYCHLIHGLAERRE

SEQ ID NO: 2168813 - protein, 20 aa, Cryptosporidium hominis
CNVIPSLCCLVYPNESHRNL

SEQ ID NO: 2168814 - protein, 20 aa, Cryptosporidium hominis
CNVPAYLRSNFEVYIKASKR

SEQ ID NO: 2168815 - protein, 19 aa, Cryptosporidium hominis
CNVVSSCRELLRICKILQE

SEQ ID NO: 2168816 - protein, 17 aa, Cryptosporidium hominis
CNYGDFESFNKLPYFRE

SEQ ID NO: 2168817 - protein, 21 aa, Cryptosporidium hominis
CNYLKEKLRSLSQVLNTSDTG

SEQ ID NO: 2168818 - protein, 20 aa, Cryptosporidium hominis
CPAKDIFWSKTLSKRPIFSH

SEQ ID NO: 2168819 - protein, 21 aa, Cryptosporidium hominis
CPCDCKGSMQFVHLQCLRTWL

SEQ ID NO: 2168820 - protein, 18 aa, Cryptosporidium hominis
CPDEKAIVAFGGESTILW

SEQ ID NO: 2168821 - protein, 24 aa, Cryptosporidium hominis
CPELKIYNVFHPYDPVAFRLEPLL

SEQ ID NO: 2168822 - protein, 26 aa, Cryptosporidium hominis
CPEPYYPKIFGFRVSDKLSIIERKGI

SEQ ID NO: 2168823 - protein, 17 aa, Cryptosporidium hominis
CPGKIPIISSQSPKNKS

SEQ ID NO: 2168824 - protein, 18 aa, Cryptosporidium hominis
CPIINHWRLNERHYGALQ

SEQ ID NO: 2168825 - protein, 21 aa, Cryptosporidium hominis
CPKLVPIACNNLFRATSFLEV

SEQ ID NO: 2168826 - protein, 19 aa, Cryptosporidium hominis
CPKTSPPYPCRRSTTNFSD

SEQ ID NO: 2168827 - protein, 25 aa, Cryptosporidium hominis
CPLLHRSAFRLALLVVGISHSVLGK

SEQ ID NO: 2168828 - protein, 20 aa, Cryptosporidium hominis
CPLMRAHFMVFKWQEDPKKA

SEQ ID NO: 2168829 - protein, 21 aa, Cryptosporidium hominis
CPPKLGKRPPMKNELLAMNGQ

SEQ ID NO: 2168830 - protein, 26 aa, Cryptosporidium hominis
CPSCSLRFSTSIGRSNSIINLLKNSN

SEQ ID NO: 2168831 - protein, 21 aa, Cryptosporidium hominis
CPSDSSLSMLISFVELENKGN

SEQ ID NO: 2168832 - protein, 25 aa, Cryptosporidium hominis
CPTIEWCRKSLKIISMEISEILLNK

SEQ ID NO: 2168833 - protein, 26 aa, Cryptosporidium hominis
CPVDYLRLLLKNIIFIGGSSINSLLS

SEQ ID NO: 2168834 - protein, 17 aa, Cryptosporidium hominis
CPVGKELLGRVVDALGN

SEQ ID NO: 2168835 - protein, 19 aa, Cryptosporidium hominis
CPVVKKFKAQLLFVELLEQ

SEQ ID NO: 2168836 - protein, 27 aa, Cryptosporidium hominis
CQFHYDCYKALYFLLIAKRLIGESIER

SEQ ID NO: 2168837 - protein, 17 aa, Cryptosporidium hominis
CQFIGELIILFTSNGYY

SEQ ID NO: 2168838 - protein, 18 aa, Cryptosporidium hominis
CQFMKRSLGNLNIEKILN

SEQ ID NO: 2168839 - protein, 17 aa, Cryptosporidium hominis
CQGSWLYYENPVAHFTK

SEQ ID NO: 2168840 - protein, 24 aa, Cryptosporidium hominis
CQHVRCITKLPQLLVLSCNIQSLK

SEQ ID NO: 2168841 - protein, 17 aa, Cryptosporidium hominis
CQIDLKSIYVYLGSQNQ

SEQ ID NO: 2168842 - protein, 23 aa, Cryptosporidium hominis
CQIDPKGRFVICVDSNKEIHPKT

SEQ ID NO: 2168843 - protein, 17 aa, Cryptosporidium hominis
CQILREFEVQARSLQII

SEQ ID NO: 2168844 - protein, 25 aa, Cryptosporidium hominis
CQKILKISDFCHSFGDFLELPIYSS

SEQ ID NO: 2168845 - protein, 25 aa, Cryptosporidium hominis
CQLAFSCTPEIPKYQVLIIALKIQC

SEQ ID NO: 2168846 - protein, 28 aa, Cryptosporidium hominis
CQLESRELLALCLKKIKGLNTVRLVDAS

SEQ ID NO: 2168847 - protein, 17 aa, Cryptosporidium hominis
CQLHHFYGPGCKARSSA

SEQ ID NO: 2168848 - protein, 18 aa, Cryptosporidium hominis
CQLLFIECELWRLHPAEK

SEQ ID NO: 2168849 - protein, 17 aa, Cryptosporidium hominis
CQPISSFGLGIPIQVKT

SEQ ID NO: 2168850 - protein, 27 aa, Cryptosporidium hominis
CQSCVSDLNFGLSLYARDDYIKSKKEQ

SEQ ID NO: 2168851 - protein, 17 aa, Cryptosporidium hominis
CQSDWDLRNLIQKEGQF

SEQ ID NO: 2168852 - protein, 18 aa, Cryptosporidium hominis
CQSYKGTFDPVYGDTLSE

SEQ ID NO: 2168853 - protein, 18 aa, Cryptosporidium hominis
CQVVSFRAKIKINGELEF

SEQ ID NO: 2168854 - protein, 17 aa, Cryptosporidium hominis
CQYCIGMRLELARIDLL

SEQ ID NO: 2168855 - protein, 22 aa, Cryptosporidium hominis
CRDALTRRSLGYAYVNYNSVAD

SEQ ID NO: 2168856 - protein, 20 aa, Cryptosporidium hominis
CREDLEIPSSIELLIQRSLQ

SEQ ID NO: 2168857 - protein, 22 aa, Cryptosporidium hominis
CREFSIKYILKLLQTIEKPTEN

SEQ ID NO: 2168858 - protein, 23 aa, Cryptosporidium hominis
CRHIFPLQHVFIRKVKVLSKPSF

SEQ ID NO: 2168859 - protein, 17 aa, Cryptosporidium hominis
CRHSLKIEDMMTKSFKE

SEQ ID NO: 2168860 - protein, 30 aa, Cryptosporidium hominis
CRILSAAEMKKVFCKSKKPIGSLKDFVHTI

SEQ ID NO: 2168861 - protein, 19 aa, Cryptosporidium hominis
CRKFMQNPVEIFVDDETKL

SEQ ID NO: 2168862 - protein, 19 aa, Cryptosporidium hominis
CRKSLNLIVVNPGMVIGPS

SEQ ID NO: 2168863 - protein, 18 aa, Cryptosporidium hominis
CRLKREMERLIRSNTRYR

SEQ ID NO: 2168864 - protein, 18 aa, Cryptosporidium hominis
CRLLCIHGAGGSDQIFVK

SEQ ID NO: 2168865 - protein, 19 aa, Cryptosporidium hominis
CRLYLSIKGTRKYHSENID

SEQ ID NO: 2168866 - protein, 18 aa, Cryptosporidium hominis
CRPSVMWETKRNKPNTRQ

SEQ ID NO: 2168867 - protein, 19 aa, Cryptosporidium hominis
CRTRFKKYRGLESLRTSNW

SEQ ID NO: 2168868 - protein, 19 aa, Cryptosporidium hominis
CSEAAPIDIADVYRDMEEL

SEQ ID NO: 2168869 - protein, 19 aa, Cryptosporidium hominis
CSEIPKGRYILQVESSDTV

SEQ ID NO: 2168870 - protein, 19 aa, Cryptosporidium hominis
CSEKSLLGIIAFSISKSFK

SEQ ID NO: 2168871 - protein, 20 aa, Cryptosporidium hominis
CSENEIFNDKLVREFSESGE

SEQ ID NO: 2168872 - protein, 23 aa, Cryptosporidium hominis
CSESHAAYTYCCVVSLALLNSLD

SEQ ID NO: 2168873 - protein, 20 aa, Cryptosporidium hominis
CSFCGHARSCHYSYFNKLII

SEQ ID NO: 2168874 - protein, 17 aa, Cryptosporidium hominis
CSFMNKKIRDMTFALPL

SEQ ID NO: 2168875 - protein, 28 aa, Cryptosporidium hominis
CSHIKRRNRYGITRGRKHLAYSGDYSTC

SEQ ID NO: 2168876 - protein, 20 aa, Cryptosporidium hominis
CSKMTTTTTVPSTFTTQTTA

SEQ ID NO: 2168877 - protein, 19 aa, Cryptosporidium hominis
CSKPRLAKLYVNSPLADFG

SEQ ID NO: 2168878 - protein, 21 aa, Cryptosporidium hominis
CSKRMKYGIMGDGVNLASRIE

SEQ ID NO: 2168879 - protein, 21 aa, Cryptosporidium hominis
CSLCQSIELNERLIVKATLII

SEQ ID NO: 2168880 - protein, 18 aa, Cryptosporidium hominis
CSLIEYMRKIFKEMNSRF

SEQ ID NO: 2168881 - protein, 17 aa, Cryptosporidium hominis
CSLNARVAILASANPIS

SEQ ID NO: 2168882 - protein, 19 aa, Cryptosporidium hominis
CSLYPYTSIIWKELSRISA

SEQ ID NO: 2168883 - protein, 19 aa, Cryptosporidium hominis
CSNDREFEEAIKLNLGGYY

SEQ ID NO: 2168884 - protein, 19 aa, Cryptosporidium hominis
CSNECFVLAIIYVGRIIKF

SEQ ID NO: 2168885 - protein, 18 aa, Cryptosporidium hominis
CSNFPISHTNTGAVSSII

SEQ ID NO: 2168886 - protein, 18 aa, Cryptosporidium hominis
CSNFYIFEFQACFDSFLD

SEQ ID NO: 2168887 - protein, 20 aa, Cryptosporidium hominis
CSNISLPLTKIVLQVHPEIQ

SEQ ID NO: 2168888 - protein, 18 aa, Cryptosporidium hominis
CSNLKWEKWYLTHHCTIY

SEQ ID NO: 2168889 - protein, 18 aa, Cryptosporidium hominis
CSPFTMLTEDYVKCLSCG

SEQ ID NO: 2168890 - protein, 21 aa, Cryptosporidium hominis
CSPQLLKTFCETFDFTDLFND

SEQ ID NO: 2168891 - protein, 17 aa, Cryptosporidium hominis
CSSLPVSLIKSETCVLR

SEQ ID NO: 2168892 - protein, 19 aa, Cryptosporidium hominis
CSSNIYPGHGVTFVRNDAK

SEQ ID NO: 2168893 - protein, 25 aa, Cryptosporidium hominis
CSSRREALPYIPLLLPIGITVMAVD

SEQ ID NO: 2168894 - protein, 18 aa, Cryptosporidium hominis
CSTFKTFLNSEGLQEIGQ

SEQ ID NO: 2168895 - protein, 26 aa, Cryptosporidium hominis
CSTSIKSEQGFKIFSPNSEPSNINSI

SEQ ID NO: 2168896 - protein, 19 aa, Cryptosporidium hominis
CSVFGRFNAIIPEGMLSQN

SEQ ID NO: 2168897 - protein, 19 aa, Cryptosporidium hominis
CSVFTLCDLVNITIDETLV

SEQ ID NO: 2168898 - protein, 20 aa, Cryptosporidium hominis
CSVKNSFLNMVTLWNSFTEA

SEQ ID NO: 2168899 - protein, 23 aa, Cryptosporidium hominis
CSVSCCKKLIPLLESMKSVKFLI

SEQ ID NO: 2168900 - protein, 24 aa, Cryptosporidium hominis
CSYIGVCLEPGFYAIITEYLTNGN

SEQ ID NO: 2168901 - protein, 25 aa, Cryptosporidium hominis
CSYPLPLVICPQVFDYRESLSPGLE

SEQ ID NO: 2168902 - protein, 24 aa, Cryptosporidium hominis
CSYSEYRIYPGRGRKFVARDGRVS

SEQ ID NO: 2168903 - protein, 22 aa, Cryptosporidium hominis
CTAGIRPNCEVLVFIDVVNCVT

SEQ ID NO: 2168904 - protein, 27 aa, Cryptosporidium hominis
CTDACLLRYLRGYNLKVIKSFEALAKT

SEQ ID NO: 2168905 - protein, 17 aa, Cryptosporidium hominis
CTDKGKLQFIKESDGNK

SEQ ID NO: 2168906 - protein, 19 aa, Cryptosporidium hominis
CTEFLPRLHQNLGPDYDEK

SEQ ID NO: 2168907 - protein, 23 aa, Cryptosporidium hominis
CTFHLSCRIFDTFLIETHVQYNN

SEQ ID NO: 2168908 - protein, 18 aa, Cryptosporidium hominis
CTGGELFDRIIKRGHFSE

SEQ ID NO: 2168909 - protein, 17 aa, Cryptosporidium hominis
CTHEDKDRIGINVSAQK

SEQ ID NO: 2168910 - protein, 22 aa, Cryptosporidium hominis
CTIAPCKSIQGGDPIPNAFAVS

SEQ ID NO: 2168911 - protein, 29 aa, Cryptosporidium hominis
CTLKTTPRPYLVWLLHDFNFLLYDTANNM

SEQ ID NO: 2168912 - protein, 28 aa, Cryptosporidium hominis
CTLPVNTLMPLVKWRPSSHFQNNQIELP

SEQ ID NO: 2168913 - protein, 23 aa, Cryptosporidium hominis
CTNNKYLTGTRFGPSIRQKTMMQ

SEQ ID NO: 2168914 - protein, 30 aa, Cryptosporidium hominis
CTQEEGRKSFILRINFLLPTGISLEQLPST

SEQ ID NO: 2168915 - protein, 18 aa, Cryptosporidium hominis
CTQPHPFMLPGKFQNSIH

SEQ ID NO: 2168916 - protein, 18 aa, Cryptosporidium hominis
CTRGNLCAFAHSVQELRP

SEQ ID NO: 2168917 - protein, 25 aa, Cryptosporidium hominis
CTSISGCGPGYFSNIAHHFIQSGIK

SEQ ID NO: 2168918 - protein, 20 aa, Cryptosporidium hominis
CTTQCRVIHPNLVHSVNQRW

SEQ ID NO: 2168919 - protein, 29 aa, Cryptosporidium hominis
CTVLSKYSLSYNWFIYWNDNFPKSTGISN

SEQ ID NO: 2168920 - protein, 25 aa, Cryptosporidium hominis
CTVYKVRHNECVAAVKCPQKRIHDS

SEQ ID NO: 2168921 - protein, 20 aa, Cryptosporidium hominis
CTYFPLRKLLIKSLLEKGEI

SEQ ID NO: 2168922 - protein, 23 aa, Cryptosporidium hominis
CVASETYDEFIFYEPTERFYEKL

SEQ ID NO: 2168923 - protein, 18 aa, Cryptosporidium hominis
CVASRAGRSVVLRRKEDD

SEQ ID NO: 2168924 - protein, 20 aa, Cryptosporidium hominis
CVAYLGRLLVSASLSRIPNP

SEQ ID NO: 2168925 - protein, 18 aa, Cryptosporidium hominis
CVELKKKLEDSLLDIYSF

SEQ ID NO: 2168926 - protein, 19 aa, Cryptosporidium hominis
CVIMGKPIKIGTGSFDILY

SEQ ID NO: 2168927 - protein, 18 aa, Cryptosporidium hominis
CVINRLFDGKIFQVLEYS

SEQ ID NO: 2168928 - protein, 17 aa, Cryptosporidium hominis
CVIYRKEEKEVIFESEI

SEQ ID NO: 2168929 - protein, 20 aa, Cryptosporidium hominis
CVLEGVSTIPVLKISGDDNI

SEQ ID NO: 2168930 - protein, 26 aa, Cryptosporidium hominis
CVRPEEITRLYGLKPIRTLTLGTTKK

SEQ ID NO: 2168931 - protein, 34 aa, Cryptosporidium hominis
CVSITYADSVAFCPLSYSHSKLWGSHRGGGGCHV

SEQ ID NO: 2168932 - protein, 20 aa, Cryptosporidium hominis
CVSLLSWLSNIIISPSKSAH

SEQ ID NO: 2168933 - protein, 22 aa, Cryptosporidium hominis
CVSTGTSLFGSSLFQINKTSEN

SEQ ID NO: 2168934 - protein, 17 aa, Cryptosporidium hominis
CVTENDVIFCFRNPSVR

SEQ ID NO: 2168935 - protein, 18 aa, Cryptosporidium hominis
CVTHLLFASSKEKFREIE

SEQ ID NO: 2168936 - protein, 25 aa, Cryptosporidium hominis
CVTLSKPVYICLCADLVNEYIKRPE

SEQ ID NO: 2168937 - protein, 28 aa, Cryptosporidium hominis
CWDSPWGKGRPGWHIECSVMASNTLGFP

SEQ ID NO: 2168938 - protein, 18 aa, Cryptosporidium hominis
CYECTMGLNVQDTNFPLC

SEQ ID NO: 2168939 - protein, 23 aa, Cryptosporidium hominis
CYHPPGTCQRAQIAHFYKKVIED

SEQ ID NO: 2168940 - protein, 24 aa, Cryptosporidium hominis
CYKEKKFDEALGFYLKALGILELE

SEQ ID NO: 2168941 - protein, 19 aa, Cryptosporidium hominis
CYLLSIKICEYCNISYFHI

SEQ ID NO: 2168942 - protein, 19 aa, Cryptosporidium hominis
CYPMAAGSIKKNGYCMLKG

SEQ ID NO: 2168943 - protein, 17 aa, Cryptosporidium hominis
CYSCAPRDTVRFTQLKI

SEQ ID NO: 2168944 - protein, 17 aa, Cryptosporidium hominis
CYSNLGLVYRLLGDCRQ

SEQ ID NO: 2168945 - protein, 17 aa, Cryptosporidium hominis
CYTWKEAKQLISKLKSS

SEQ ID NO: 2168946 - protein, 29 aa, Cryptosporidium hominis
CYVCQKGGKLLGCDFCTYSYHPKCIETEV

SEQ ID NO: 2168947 - protein, 24 aa, Cryptosporidium hominis
DAASMPKYWHFIRLMGRQPSNEVL

SEQ ID NO: 2168948 - protein, 21 aa, Cryptosporidium hominis
DAEAGDILVFYFAGHGVQVDV

SEQ ID NO: 2168949 - protein, 23 aa, Cryptosporidium hominis
DAEWKIIFEKLDLIANSGVNVVL

SEQ ID NO: 2168950 - protein, 17 aa, Cryptosporidium hominis
DAFKRGEAILHSYQRKH

SEQ ID NO: 2168951 - protein, 19 aa, Cryptosporidium hominis
DAGAIAGLNVMRIINEPTA

SEQ ID NO: 2168952 - protein, 22 aa, Cryptosporidium hominis
DAGVIPRLVHFLSDYDHPNLQF

SEQ ID NO: 2168953 - protein, 24 aa, Cryptosporidium hominis
DAIIKQLQIFTGIENLNIDNINTH

SEQ ID NO: 2168954 - protein, 20 aa, Cryptosporidium hominis
DAIIYIWSFKHRKLINKLVG

SEQ ID NO: 2168955 - protein, 23 aa, Cryptosporidium hominis
DAIKKYFCNLGCSYLATRYKDTF

SEQ ID NO: 2168956 - protein, 28 aa, Cryptosporidium hominis
DAISNILGWRIEIIYVEGGLTVYKLSNI

SEQ ID NO: 2168957 - protein, 19 aa, Cryptosporidium hominis
DAKLGYALGHFASIVVESG

SEQ ID NO: 2168958 - protein, 25 aa, Cryptosporidium hominis
DAKYGLCIPTLYSVLLLTICHVHKL

SEQ ID NO: 2168959 - protein, 19 aa, Cryptosporidium hominis
DALKAVVHIIDLYRSRRGI

SEQ ID NO: 2168960 - protein, 24 aa, Cryptosporidium hominis
DALNEIKAELSLRNVNFNQNKYDF

SEQ ID NO: 2168961 - protein, 20 aa, Cryptosporidium hominis
DAMSEWLNKSELGINKMEPK

SEQ ID NO: 2168962 - protein, 19 aa, Cryptosporidium hominis
DAPRCVFPSIVGRPKMPGV

SEQ ID NO: 2168963 - protein, 17 aa, Cryptosporidium hominis
DAQEIMLVFLQLLGSGL

SEQ ID NO: 2168964 - protein, 23 aa, Cryptosporidium hominis
DARTLKYRCDVDCRNRRGKSSKG

SEQ ID NO: 2168965 - protein, 18 aa, Cryptosporidium hominis
DATMPFFIQSLRDMTNRI

SEQ ID NO: 2168966 - protein, 24 aa, Cryptosporidium hominis
DAVIYKLVGSVMVKQSLDDAKSTV

SEQ ID NO: 2168967 - protein, 19 aa, Cryptosporidium hominis
DAVSPFIPSVHDPETQVNS

SEQ ID NO: 2168968 - protein, 21 aa, Cryptosporidium hominis
DAVVYQSNFRPVPLREHIIIK

SEQ ID NO: 2168969 - protein, 19 aa, Cryptosporidium hominis
DAWSPALTLRTVMLSIQAL

SEQ ID NO: 2168970 - protein, 20 aa, Cryptosporidium hominis
DCDRNMILGKGFFVTPSDSV

SEQ ID NO: 2168971 - protein, 18 aa, Cryptosporidium hominis
DCESRNPTWLSLSFAVFI

SEQ ID NO: 2168972 - protein, 19 aa, Cryptosporidium hominis
DCFEYRKVISSNFFHENSN

SEQ ID NO: 2168973 - protein, 19 aa, Cryptosporidium hominis
DCFGEFKRIHVMPFSDTLP

SEQ ID NO: 2168974 - protein, 27 aa, Cryptosporidium hominis
DCFTVTFEFLRRFYIATNVQIQIMDND

SEQ ID NO: 2168975 - protein, 17 aa, Cryptosporidium hominis
DCLCEWNSCGDFVPFIG

SEQ ID NO: 2168976 - protein, 20 aa, Cryptosporidium hominis
DCNEFCFLQLFNLPGNILTL

SEQ ID NO: 2168977 - protein, 22 aa, Cryptosporidium hominis
DCNRSGLPLGGIIIQSGIASGL

SEQ ID NO: 2168978 - protein, 20 aa, Cryptosporidium hominis
DCPIAFQAIIRYMYGHTSEV

SEQ ID NO: 2168979 - protein, 19 aa, Cryptosporidium hominis
DCQPFKQIFKMIALSSTYS

SEQ ID NO: 2168980 - protein, 20 aa, Cryptosporidium hominis
DCRGSLLGRLASVIAKELLN

SEQ ID NO: 2168981 - protein, 24 aa, Cryptosporidium hominis
DCSDLKSLIFASAVEKQSKTRTLK

SEQ ID NO: 2168982 - protein, 59 aa, Cryptosporidium hominis
DCTDVFRSLYPMKAAEIGRNEWYIYCLKIIDALVCFDRKGVKYGIPFLRPVDPNMDGAS

SEQ ID NO: 2168983 - protein, 27 aa, Cryptosporidium hominis
DDDIQYIWRRNCPYLYDTMLSYTLEWP

SEQ ID NO: 2168984 - protein, 22 aa, Cryptosporidium hominis
DDDWQYIEWESANTIHPKPQEN

SEQ ID NO: 2168985 - protein, 22 aa, Cryptosporidium hominis
DDEFKLGIQLTKSGMNLYSSFD

SEQ ID NO: 2168986 - protein, 24 aa, Cryptosporidium hominis
DDEIPRFFKDIGYPITINKTTIIA

SEQ ID NO: 2168987 - protein, 21 aa, Cryptosporidium hominis
DDEKKKLLILGQRQLATMELS

SEQ ID NO: 2168988 - protein, 25 aa, Cryptosporidium hominis
DDELDWKVVCIRVCDPHASQLNDIT

SEQ ID NO: 2168989 - protein, 18 aa, Cryptosporidium hominis
DDELIINGSCKLRKMNEI

SEQ ID NO: 2168990 - protein, 17 aa, Cryptosporidium hominis
DDEMVIINCIYKCHCDI

SEQ ID NO: 2168991 - protein, 18 aa, Cryptosporidium hominis
DDFLSNWWTQASVESCDF

SEQ ID NO: 2168992 - protein, 37 aa, Cryptosporidium hominis
DDFLSSINGVCWCPWDFGLQFACAISDGSVAVCSYSP

SEQ ID NO: 2168993 - protein, 26 aa, Cryptosporidium hominis
DDFSIKLICNFGYRPNCITWNEVNKY

SEQ ID NO: 2168994 - protein, 22 aa, Cryptosporidium hominis
DDGAIFGMEGIFIVKSDPSTIM

SEQ ID NO: 2168995 - protein, 27 aa, Cryptosporidium hominis
DDGCVIPGAGAFEFRAYNTLKETRKSA

SEQ ID NO: 2168996 - protein, 21 aa, Cryptosporidium hominis
DDHKGMRGLYSFFQKENNWQC

SEQ ID NO: 2168997 - protein, 18 aa, Cryptosporidium hominis
DDICILHFNDVYNIEEDV

SEQ ID NO: 2168998 - protein, 20 aa, Cryptosporidium hominis
DDIDFNRYLNLNFYFNQIQN

SEQ ID NO: 2168999 - protein, 33 aa, Cryptosporidium hominis
DDIKLSKYVKFCISFCIYGQGIIDWNNPLNIEN

SEQ ID NO: 2169000 - protein, 17 aa, Cryptosporidium hominis
DDIPFAIYPNSIKKKGN

SEQ ID NO: 2169001 - protein, 21 aa, Cryptosporidium hominis
DDITRVVLIDAYYSKNSKSAI

SEQ ID NO: 2169002 - protein, 26 aa, Cryptosporidium hominis
DDKYGENSYPFFPPGVQPAPIDGDEN

SEQ ID NO: 2169003 - protein, 23 aa, Cryptosporidium hominis
DDLCSKCFYIVRKSPDGIEEFED

SEQ ID NO: 2169004 - protein, 23 aa, Cryptosporidium hominis
DDLEAIGYVLMYFCRNGTLPWQG

SEQ ID NO: 2169005 - protein, 19 aa, Cryptosporidium hominis
DDLISLCLGVSLVGVATSK

SEQ ID NO: 2169006 - protein, 24 aa, Cryptosporidium hominis
DDLKRKYIPAILDWGMVKIFDKSK

SEQ ID NO: 2169007 - protein, 17 aa, Cryptosporidium hominis
DDLLVSFYNSAKASTSV

SEQ ID NO: 2169008 - protein, 22 aa, Cryptosporidium hominis
DDLPKAYSLLLEKHLKLKSEFD

SEQ ID NO: 2169009 - protein, 27 aa, Cryptosporidium hominis
DDLQLYLYLCRLLSGAISLRSQNIQDT

SEQ ID NO: 2169010 - protein, 23 aa, Cryptosporidium hominis
DDLRDLFKLYGRVVNVSVIREKS

SEQ ID NO: 2169011 - protein, 21 aa, Cryptosporidium hominis
DDLRHAHVLLHIIDISGNTNE

SEQ ID NO: 2169012 - protein, 18 aa, Cryptosporidium hominis
DDLTLKLQQIIKLNENLK

SEQ ID NO: 2169013 - protein, 17 aa, Cryptosporidium hominis
DDNFILLIIDLIRELVQ

SEQ ID NO: 2169014 - protein, 42 aa, Cryptosporidium hominis
DDNSLSCSAQAFGDLCNRRKTNISWDIEFKVTETYVNNGTWG

SEQ ID NO: 2169015 - protein, 23 aa, Cryptosporidium hominis
DDPDSCWNWFNRVFEYLPVGAII

SEQ ID NO: 2169016 - protein, 24 aa, Cryptosporidium hominis
DDPDVIEIWNLVFMQYYREVDSTL

SEQ ID NO: 2169017 - protein, 17 aa, Cryptosporidium hominis
DDPRMPTLSAVRRKGYP

SEQ ID NO: 2169018 - protein, 35 aa, Cryptosporidium hominis
DDRNFHCWRHRSFVLCCLRYISVIISWDTFLEEMQ

SEQ ID NO: 2169019 - protein, 17 aa, Cryptosporidium hominis
DDSDCLIFGAKKIFRNF

SEQ ID NO: 2169020 - protein, 21 aa, Cryptosporidium hominis
DDSFCCPDCKNNEDFCYICRD

SEQ ID NO: 2169021 - protein, 32 aa, Cryptosporidium hominis
DDSIHWMIIIALRFIALSSLQLGNYAQCIVVG

SEQ ID NO: 2169022 - protein, 18 aa, Cryptosporidium hominis
DDSLCIWKPTTEKQQVAF

SEQ ID NO: 2169023 - protein, 18 aa, Cryptosporidium hominis
DDSSICLAAMHANTLNRS

SEQ ID NO: 2169024 - protein, 18 aa, Cryptosporidium hominis
DDVLRALTLISNKIPFLF

SEQ ID NO: 2169025 - protein, 17 aa, Cryptosporidium hominis
DDYCSRLSMKTLMRNSS

SEQ ID NO: 2169026 - protein, 23 aa, Cryptosporidium hominis
DDYKELFCAYGEVKKVSSNRKRE

SEQ ID NO: 2169027 - protein, 24 aa, Cryptosporidium hominis
DEADRLLDMGFRQECLEILKYSSR

SEQ ID NO: 2169028 - protein, 18 aa, Cryptosporidium hominis
DEALTYRIESAITAEREI

SEQ ID NO: 2169029 - protein, 22 aa, Cryptosporidium hominis
DECFVKGTLILPNRLRYLQKRK

SEQ ID NO: 2169030 - protein, 17 aa, Cryptosporidium hominis
DECLRKEDNIWGVIVDS

SEQ ID NO: 2169031 - protein, 27 aa, Cryptosporidium hominis
DECSPPCSLPAPPGSDPFTISGFGPES

SEQ ID NO: 2169032 - protein, 19 aa, Cryptosporidium hominis
DEDFIASGMAEYLAITLLR

SEQ ID NO: 2169033 - protein, 18 aa, Cryptosporidium hominis
DEDLDCLKNIESDKSLNE

SEQ ID NO: 2169034 - protein, 26 aa, Cryptosporidium hominis
DEEGNNGFCFLQFSSPLTSYRALKWE

SEQ ID NO: 2169035 - protein, 18 aa, Cryptosporidium hominis
DEELIPYGVFVWASGASP

SEQ ID NO: 2169036 - protein, 24 aa, Cryptosporidium hominis
DEEPECSDVIIGHFEKVIRPYTRK

SEQ ID NO: 2169037 - protein, 24 aa, Cryptosporidium hominis
DEESRLSDQLELFHGDLINLQETI

SEQ ID NO: 2169038 - protein, 23 aa, Cryptosporidium hominis
DEEYRALWSHIFQREALKKSIEA

SEQ ID NO: 2169039 - protein, 25 aa, Cryptosporidium hominis
DEFKNPSSFLKIYGDPLCGKQPSNG

SEQ ID NO: 2169040 - protein, 20 aa, Cryptosporidium hominis
DEFLNPIHMELEIENSKTTV

SEQ ID NO: 2169041 - protein, 27 aa, Cryptosporidium hominis
DEFSTWLDKYVCCDSIEILHVNLYVTS

SEQ ID NO: 2169042 - protein, 18 aa, Cryptosporidium hominis
DEFYLTIADVEFLVLNGP

SEQ ID NO: 2169043 - protein, 19 aa, Cryptosporidium hominis
DEGIGLLMEEMKHLKEDVE

SEQ ID NO: 2169044 - protein, 24 aa, Cryptosporidium hominis
DEHKWKIKSFKAVAQCAIRYLQTK

SEQ ID NO: 2169045 - protein, 23 aa, Cryptosporidium hominis
DEIEEIRKTFNLFDTDGSGTIDP

SEQ ID NO: 2169046 - protein, 23 aa, Cryptosporidium hominis
DEIEHFQWYVGQYLTSRYRILDI

SEQ ID NO: 2169047 - protein, 21 aa, Cryptosporidium hominis
DEIKISIVYLLSKMVNNNPEL

SEQ ID NO: 2169048 - protein, 20 aa, Cryptosporidium hominis
DEINKIILCKNAPNYNAGSL

SEQ ID NO: 2169049 - protein, 25 aa, Cryptosporidium hominis
DEIPIEIPSSLPITLLDDKNYKLIM

SEQ ID NO: 2169050 - protein, 23 aa, Cryptosporidium hominis
DEIPRSILYYETPQYCYSLLRCL

SEQ ID NO: 2169051 - protein, 18 aa, Cryptosporidium hominis
DEISEKFINCINKASDAL

SEQ ID NO: 2169052 - protein, 18 aa, Cryptosporidium hominis
DEIVCLGKGGVYRLRGMT

SEQ ID NO: 2169053 - protein, 19 aa, Cryptosporidium hominis
DEIVECFEALNLEGDLLRG

SEQ ID NO: 2169054 - protein, 24 aa, Cryptosporidium hominis
DEIYKAECLYNLGRAFHQINLKSN

SEQ ID NO: 2169055 - protein, 22 aa, Cryptosporidium hominis
DEIYLRWQHFKTIDQLKQEIVA

SEQ ID NO: 2169056 - protein, 30 aa, Cryptosporidium hominis
DEKPEVVGLLEWLASIVIYRQNRYMEALEF

SEQ ID NO: 2169057 - protein, 22 aa, Cryptosporidium hominis
DEKRKKLTFIVAGGGPTGVEVS

SEQ ID NO: 2169058 - protein, 18 aa, Cryptosporidium hominis
DELEEEYSNWVIRLQGEN

SEQ ID NO: 2169059 - protein, 26 aa, Cryptosporidium hominis
DELENYCLWRGWQYMRLDGSTNKLIR

SEQ ID NO: 2169060 - protein, 26 aa, Cryptosporidium hominis
DELGDLFKLLVHIIGKPIVEPQTMSR

SEQ ID NO: 2169061 - protein, 17 aa, Cryptosporidium hominis
DELKKAFLKAAEGLDES

SEQ ID NO: 2169062 - protein, 19 aa, Cryptosporidium hominis
DELKRIVLVGNEAIKSLES

SEQ ID NO: 2169063 - protein, 25 aa, Cryptosporidium hominis
DELNSGICMGAKQPALLSSKQLFDE

SEQ ID NO: 2169064 - protein, 25 aa, Cryptosporidium hominis
DELPAISGRKLWKLKHKKRVKKYKD

SEQ ID NO: 2169065 - protein, 17 aa, Cryptosporidium hominis
DELQGTPILKGQDSHHV

SEQ ID NO: 2169066 - protein, 25 aa, Cryptosporidium hominis
DELQLEVSKVWKGIESPFSPKKISY

SEQ ID NO: 2169067 - protein, 20 aa, Cryptosporidium hominis
DELRRFVTMSLNEDCVHSVR

SEQ ID NO: 2169068 - protein, 22 aa, Cryptosporidium hominis
DEMKRELVFANHRFKEVSWYPI

SEQ ID NO: 2169069 - protein, 25 aa, Cryptosporidium hominis
DENHIWKIFFDIIFGLQHLHHRGIL

SEQ ID NO: 2169070 - protein, 22 aa, Cryptosporidium hominis
DENKELREEITILLNKKQEITM

SEQ ID NO: 2169071 - protein, 26 aa, Cryptosporidium hominis
DENRYPYRRMIISNIYTLLGELASQA

SEQ ID NO: 2169072 - protein, 20 aa, Cryptosporidium hominis
DEQRESLAFEFSNKKKTESL

SEQ ID NO: 2169073 - protein, 21 aa, Cryptosporidium hominis
DERDLHSFLKPISRFQTEEEQ

SEQ ID NO: 2169074 - protein, 25 aa, Cryptosporidium hominis
DERFKEFKELFISSIKSSYGPKNKH

SEQ ID NO: 2169075 - protein, 18 aa, Cryptosporidium hominis
DERYGWGVSHRGAGYTFG

SEQ ID NO: 2169076 - protein, 20 aa, Cryptosporidium hominis
DESMLSLLERFYSIKISKLP

SEQ ID NO: 2169077 - protein, 20 aa, Cryptosporidium hominis
DETKYNFSFIKSIKVSNVGM

SEQ ID NO: 2169078 - protein, 25 aa, Cryptosporidium hominis
DETSKFCFCKQPVLDNMIRCESGNQ

SEQ ID NO: 2169079 - protein, 35 aa, Cryptosporidium hominis
DEVGLIWKYRFYLFKFKAGIPMLFHFINLNDKEIM

SEQ ID NO: 2169080 - protein, 18 aa, Cryptosporidium hominis
DEVPSLYSNATFQVTKSE

SEQ ID NO: 2169081 - protein, 17 aa, Cryptosporidium hominis
DEVSNIWKVYQRHPRDS

SEQ ID NO: 2169082 - protein, 17 aa, Cryptosporidium hominis
DEYEEFLLSNGRYDILA

SEQ ID NO: 2169083 - protein, 17 aa, Cryptosporidium hominis
DEYSFSEGLSFDSFILV

SEQ ID NO: 2169084 - protein, 22 aa, Cryptosporidium hominis
DFDAICKLCDGFNGADMRNVCS

SEQ ID NO: 2169085 - protein, 18 aa, Cryptosporidium hominis
DFDCLVFVRKDSVYDVEQ

SEQ ID NO: 2169086 - protein, 18 aa, Cryptosporidium hominis
DFDEEMHLFVTRDSFLES

SEQ ID NO: 2169087 - protein, 38 aa, Cryptosporidium hominis
DFDKPGALPHLFRSFRATKFCKRCGAGNSIVVYDSKSG

SEQ ID NO: 2169088 - protein, 20 aa, Cryptosporidium hominis
DFDQRIAKYELFKFNHSQRL

SEQ ID NO: 2169089 - protein, 24 aa, Cryptosporidium hominis
DFEECAAVHLAVVDKAVRYSKIIR

SEQ ID NO: 2169090 - protein, 23 aa, Cryptosporidium hominis
DFFLWRRIGQMSAEIQDWNRAIY

SEQ ID NO: 2169091 - protein, 20 aa, Cryptosporidium hominis
DFFSKIDLNLIVSARNNSPV

SEQ ID NO: 2169092 - protein, 25 aa, Cryptosporidium hominis
DFGARPNWICLGNYHISIHTNNASL

SEQ ID NO: 2169093 - protein, 20 aa, Cryptosporidium hominis
DFGDWQKLRIQEHATEIPPG

SEQ ID NO: 2169094 - protein, 19 aa, Cryptosporidium hominis
DFGLSSFIYDGDFLNTSCG

SEQ ID NO: 2169095 - protein, 17 aa, Cryptosporidium hominis
DFGTTCVVVGIFDQYLV

SEQ ID NO: 2169096 - protein, 26 aa, Cryptosporidium hominis
DFIGKFKCILCPKKIIINESDLDKHI

SEQ ID NO: 2169097 - protein, 17 aa, Cryptosporidium hominis
DFIKRKRLFTDENVKEM

SEQ ID NO: 2169098 - protein, 23 aa, Cryptosporidium hominis
DFILPKIKSVLFVDVDLVAYNNK

SEQ ID NO: 2169099 - protein, 19 aa, Cryptosporidium hominis
DFIPYAISVLQLFQQASIT

SEQ ID NO: 2169100 - protein, 21 aa, Cryptosporidium hominis
DFKLKGPGFRVENVYIPIRNE

SEQ ID NO: 2169101 - protein, 25 aa, Cryptosporidium hominis
DFLKPGHALFGYFADLVEAYSLCLI

SEQ ID NO: 2169102 - protein, 18 aa, Cryptosporidium hominis
DFLLLDGILNYGIAIHNS

SEQ ID NO: 2169103 - protein, 32 aa, Cryptosporidium hominis
DFLQFSFRWMNCLLTREFPTKCVVRLWDTYIA

SEQ ID NO: 2169104 - protein, 18 aa, Cryptosporidium hominis
DFLSHGGNDFGSRISNSI

SEQ ID NO: 2169105 - protein, 25 aa, Cryptosporidium hominis
DFNYKLDEEHGWYVGDNSVWLYNKD

SEQ ID NO: 2169106 - protein, 23 aa, Cryptosporidium hominis
DFPSCIKSALAKQIHSTLHRVHW

SEQ ID NO: 2169107 - protein, 19 aa, Cryptosporidium hominis
DFQRWNLNYEEIMDGELDE

SEQ ID NO: 2169108 - protein, 28 aa, Cryptosporidium hominis
DFQVSYLIFIHGWKLAFLTVSPMSKLFE

SEQ ID NO: 2169109 - protein, 18 aa, Cryptosporidium hominis
DFRLISATLDPLIINEYI

SEQ ID NO: 2169110 - protein, 23 aa, Cryptosporidium hominis
DFRSESISSIAGYMGPGNRRKYY

SEQ ID NO: 2169111 - protein, 24 aa, Cryptosporidium hominis
DFSCFKALQLESIYSTPIPESNNV

SEQ ID NO: 2169112 - protein, 23 aa, Cryptosporidium hominis
DFSEADLQCCINIVNQWTITNIS

SEQ ID NO: 2169113 - protein, 18 aa, Cryptosporidium hominis
DFSGYWCYDNFLQVKSLK

SEQ ID NO: 2169114 - protein, 23 aa, Cryptosporidium hominis
DFSHIDGIILFNAESLNVRNWND

SEQ ID NO: 2169115 - protein, 30 aa, Cryptosporidium hominis
DFSNFRLVCRTHCCRTIFNSYVQNLTLFES

SEQ ID NO: 2169116 - protein, 20 aa, Cryptosporidium hominis
DFTAEYILPALISLFNDVQK

SEQ ID NO: 2169117 - protein, 20 aa, Cryptosporidium hominis
DFTAPELLKGETFSYSLDVW

SEQ ID NO: 2169118 - protein, 24 aa, Cryptosporidium hominis
DFTKISPPCWLFSHENIRTYNQWN

SEQ ID NO: 2169119 - protein, 26 aa, Cryptosporidium hominis
DFVFNSYCLIHLKECINLLTNEINSQ

SEQ ID NO: 2169120 - protein, 18 aa, Cryptosporidium hominis
DFWSCGKLLYLMLTGKYL

SEQ ID NO: 2169121 - protein, 29 aa, Cryptosporidium hominis
DFYRGEHLLEIVVSILSKIFNMYLEKANQ

SEQ ID NO: 2169122 - protein, 23 aa, Cryptosporidium hominis
DFYSNPFYPIFVNEYNKRLFMDH

SEQ ID NO: 2169123 - protein, 29 aa, Cryptosporidium hominis
DGAVEFEWLYCILKYLAFFNSKFGFYNEN

SEQ ID NO: 2169124 - protein, 19 aa, Cryptosporidium hominis
DGAVIYHRFVRKSKDEIKE

SEQ ID NO: 2169125 - protein, 24 aa, Cryptosporidium hominis
DGDKWKCPVCRGEDPLKNMRHKRM

SEQ ID NO: 2169126 - protein, 27 aa, Cryptosporidium hominis
DGEELPQRFVLTPIVEKFLKRRPQMKH

SEQ ID NO: 2169127 - protein, 22 aa, Cryptosporidium hominis
DGETRQHLPININRIIQMAQQK

SEQ ID NO: 2169128 - protein, 20 aa, Cryptosporidium hominis
DGFKSYQKRTVIGRFNPKFN

SEQ ID NO: 2169129 - protein, 21 aa, Cryptosporidium hominis
DGGSLGMLSAHDFIGMRTSLV

SEQ ID NO: 2169130 - protein, 33 aa, Cryptosporidium hominis
DGIDISRLKAIEWRVKLINEKKLRDNVVEYVNN

SEQ ID NO: 2169131 - protein, 18 aa, Cryptosporidium hominis
DGIIPLSINEIFNPEYTN

SEQ ID NO: 2169132 - protein, 24 aa, Cryptosporidium hominis
DGIKRSYHSLARYFSRNVQDTSNN

SEQ ID NO: 2169133 - protein, 29 aa, Cryptosporidium hominis
DGINSLLYEFWIKKFYSITNVEISRSLEP

SEQ ID NO: 2169134 - protein, 48 aa, Cryptosporidium hominis
DGISECDLYLFSTCNATSAKIMPEDTIFKQDWTLFVIISTGIPEYEDN

SEQ ID NO: 2169135 - protein, 32 aa, Cryptosporidium hominis
DGISECDLYLFSTCNATSAKIMPEDTTFNEDW

SEQ ID NO: 2169136 - protein, 28 aa, Cryptosporidium hominis
DGISECDLYLFSTCNATSTKFMPDGTIF

SEQ ID NO: 2169137 - protein, 24 aa, Cryptosporidium hominis
DGKEVKCFHDLYKWNIDKDEWKQV

SEQ ID NO: 2169138 - protein, 33 aa, Cryptosporidium hominis
DGKKFKANLINFICPFCRFFVIDPYNKIIKPLF

SEQ ID NO: 2169139 - protein, 18 aa, Cryptosporidium hominis
DGKVYSEIDWNEDCNPLI

SEQ ID NO: 2169140 - protein, 24 aa, Cryptosporidium hominis
DGLFYSFRISMGIFDSLISKDEEE

SEQ ID NO: 2169141 - protein, 25 aa, Cryptosporidium hominis
DGLIDWKEFCTFIVDYFNTSRESLR

SEQ ID NO: 2169142 - protein, 24 aa, Cryptosporidium hominis
DGLYDRNSLNASRKVTEKSEVDVM

SEQ ID NO: 2169143 - protein, 23 aa, Cryptosporidium hominis
DGMIPEQLERPFIIETSQDLIAK

SEQ ID NO: 2169144 - protein, 18 aa, Cryptosporidium hominis
DGNILWNKPFTTVQGGWI

SEQ ID NO: 2169145 - protein, 25 aa, Cryptosporidium hominis
DGPILPVCINAAVLALIDSGIPMEF

SEQ ID NO: 2169146 - protein, 25 aa, Cryptosporidium hominis
DGQKKNCYIYRLFSTGTIEEKIYQR

SEQ ID NO: 2169147 - protein, 19 aa, Cryptosporidium hominis
DGQPLKFSQVFNLMPSGNG

SEQ ID NO: 2169148 - protein, 23 aa, Cryptosporidium hominis
DGRGPPRKHFRVCVFNLDDNASW

SEQ ID NO: 2169149 - protein, 25 aa, Cryptosporidium hominis
DGRKPEVCRNFKLELNELSSSNYGA

SEQ ID NO: 2169150 - protein, 19 aa, Cryptosporidium hominis
DGSGCGFVQPTYSKEGYNL

SEQ ID NO: 2169151 - protein, 19 aa, Cryptosporidium hominis
DGSLSFWKVIYDLNSKSKI

SEQ ID NO: 2169152 - protein, 22 aa, Cryptosporidium hominis
DGTHCSLCGKSMRVKTHTNSNN

SEQ ID NO: 2169153 - protein, 19 aa, Cryptosporidium hominis
DGVQKFFFKILRRKVHSKH

SEQ ID NO: 2169154 - protein, 17 aa, Cryptosporidium hominis
DGYKCSKNSILPSTSVS

SEQ ID NO: 2169155 - protein, 19 aa, Cryptosporidium hominis
DGYVLRLFCIAFTRRMADQ

SEQ ID NO: 2169156 - protein, 25 aa, Cryptosporidium hominis
DGYYIKGQCAIIMFDVTSRITYKNV

SEQ ID NO: 2169157 - protein, 23 aa, Cryptosporidium hominis
DHGKGFKWKCIKGTNEVYSVNSF

SEQ ID NO: 2169158 - protein, 23 aa, Cryptosporidium hominis
DHGRIPLARRLLMQLLKKANKQT

SEQ ID NO: 2169159 - protein, 25 aa, Cryptosporidium hominis
DHIEMARSIFSSCIEKNFKPRSMKM

SEQ ID NO: 2169160 - protein, 18 aa, Cryptosporidium hominis
DHIKEIYDKPVAGYESNE

SEQ ID NO: 2169161 - protein, 17 aa, Cryptosporidium hominis
DHISTFFSQCLIKSITV

SEQ ID NO: 2169162 - protein, 24 aa, Cryptosporidium hominis
DHKNAKLIYSWKINSEEELILNGI

SEQ ID NO: 2169163 - protein, 23 aa, Cryptosporidium hominis
DHLILPITWKQISSIFNGILKEL

SEQ ID NO: 2169164 - protein, 19 aa, Cryptosporidium hominis
DHLTLLNIFIQWKRHGSNL

SEQ ID NO: 2169165 - protein, 23 aa, Cryptosporidium hominis
DHPFIIKLVRTFKDSENIYLLTE

SEQ ID NO: 2169166 - protein, 26 aa, Cryptosporidium hominis
DHQNILSIYFFQSYLALRDLENQNIC

SEQ ID NO: 2169167 - protein, 18 aa, Cryptosporidium hominis
DHYLRLLDSMEIMKTDQY

SEQ ID NO: 2169168 - protein, 36 aa, Cryptosporidium hominis
DHYPERLHRAFIIQPGWFFKAVWGLISPCIPGNTAE

SEQ ID NO: 2169169 - protein, 18 aa, Cryptosporidium hominis
DHYYKIQPLQGIEQNIGE

SEQ ID NO: 2169170 - protein, 33 aa, Cryptosporidium hominis
DIATKISYNGKQRWRVVTVNGELIDSSGTMTGG

SEQ ID NO: 2169171 - protein, 25 aa, Cryptosporidium hominis
DIDILKGIYIYGFSNWTMMSMDENL

SEQ ID NO: 2169172 - protein, 24 aa, Cryptosporidium hominis
DIDKIIRFSICSSSLQMDLINKTL

SEQ ID NO: 2169173 - protein, 17 aa, Cryptosporidium hominis
DIDKSRVGISSWNSKGT

SEQ ID NO: 2169174 - protein, 18 aa, Cryptosporidium hominis
DIDYKPPFFPKIRSSLQL

SEQ ID NO: 2169175 - protein, 20 aa, Cryptosporidium hominis
DIEFRTCPMFNNKYIVEKIS

SEQ ID NO: 2169176 - protein, 29 aa, Cryptosporidium hominis
DIEISHPLNLRIVGYSIIDIISRNRDLQD

SEQ ID NO: 2169177 - protein, 25 aa, Cryptosporidium hominis
DIESGKRFALKKVLQDPRYKNRELD

SEQ ID NO: 2169178 - protein, 20 aa, Cryptosporidium hominis
DIFSKWKNLLLKINPKADCN

SEQ ID NO: 2169179 - protein, 22 aa, Cryptosporidium hominis
DIGCGNGLFLIDLIRNINFSSA

SEQ ID NO: 2169180 - protein, 25 aa, Cryptosporidium hominis
DIGEWQKLCSYNFHDQEEYKLEWWL

SEQ ID NO: 2169181 - protein, 17 aa, Cryptosporidium hominis
DIGTFAFTCPKGHVITH

SEQ ID NO: 2169182 - protein, 27 aa, Cryptosporidium hominis
DIGTFGLKMMFDWNFEFNWYEDFTDVI

SEQ ID NO: 2169183 - protein, 27 aa, Cryptosporidium hominis
DIIKLRCMSRVFSISVMNCEKYREVRN

SEQ ID NO: 2169184 - protein, 29 aa, Cryptosporidium hominis
DIIKRSNIDYARAFIGYDFKNGSKPKYDG

SEQ ID NO: 2169185 - protein, 22 aa, Cryptosporidium hominis
DIISSALFRDVFLIENSEDVFI

SEQ ID NO: 2169186 - protein, 24 aa, Cryptosporidium hominis
DIIVLRPSNDYIYSLRNVRQNTFA

SEQ ID NO: 2169187 - protein, 25 aa, Cryptosporidium hominis
DIIWLQRDFSVYIVNMFDTGQAARI

SEQ ID NO: 2169188 - protein, 24 aa, Cryptosporidium hominis
DIIYNPGPCVVMAAPGMLQNGTSR

SEQ ID NO: 2169189 - protein, 21 aa, Cryptosporidium hominis
DIKFHQCVRLARFESDRTISF

SEQ ID NO: 2169190 - protein, 21 aa, Cryptosporidium hominis
DIKSSGFINYFGLQRFGTSEI

SEQ ID NO: 2169191 - protein, 21 aa, Cryptosporidium hominis
DILAIRIFIQNALKLCNQLPP

SEQ ID NO: 2169192 - protein, 20 aa, Cryptosporidium hominis
DILEIRKLRFKDFKNTDLVD

SEQ ID NO: 2169193 - protein, 20 aa, Cryptosporidium hominis
DILESARFINYIGKNNNVDN

SEQ ID NO: 2169194 - protein, 20 aa, Cryptosporidium hominis
DILKKLELINSIIDNTILIK

SEQ ID NO: 2169195 - protein, 36 aa, Cryptosporidium hominis
DILKMLKNLSIVWTIWKPIKYCAVENIIPRDNLVEF

SEQ ID NO: 2169196 - protein, 19 aa, Cryptosporidium hominis
DILSDWRNSTLLKSHSDMV

SEQ ID NO: 2169197 - protein, 19 aa, Cryptosporidium hominis
DILSWFGLSNKSAKILFLG

SEQ ID NO: 2169198 - protein, 22 aa, Cryptosporidium hominis
DILWGGGKLKSSLKDDIQRLNS

SEQ ID NO: 2169199 - protein, 17 aa, Cryptosporidium hominis
DIMFKGRTNNDMIKLIM

SEQ ID NO: 2169200 - protein, 19 aa, Cryptosporidium hominis
DIPALLKEEMIEDDKSLSL

SEQ ID NO: 2169201 - protein, 17 aa, Cryptosporidium hominis
DIPFEWQNTGVYIKHRS

SEQ ID NO: 2169202 - protein, 30 aa, Cryptosporidium hominis
DIPGFRRCLIMAFVCNFCGIKTNELKPSGA

SEQ ID NO: 2169203 - protein, 25 aa, Cryptosporidium hominis
DIPKKECKKKLKATKLKNSTELNGA

SEQ ID NO: 2169204 - protein, 18 aa, Cryptosporidium hominis
DIQCCGILANISITTELP

SEQ ID NO: 2169205 - protein, 34 aa, Cryptosporidium hominis
DIQDFFKNNRIEDVKIKLPMRNGNNEGVAIVEFE

SEQ ID NO: 2169206 - protein, 20 aa, Cryptosporidium hominis
DIRFGKLILEQYKIRKELGL

SEQ ID NO: 2169207 - protein, 28 aa, Cryptosporidium hominis
DISEVKYAIGPLFDFSKTFQFIRNYLEL

SEQ ID NO: 2169208 - protein, 17 aa, Cryptosporidium hominis
DISFHILELLKVIEDEI

SEQ ID NO: 2169209 - protein, 18 aa, Cryptosporidium hominis
DISKEIIPGIHYFNPKSC

SEQ ID NO: 2169210 - protein, 23 aa, Cryptosporidium hominis
DISMLTCFLIILVNVINYNQFHT

SEQ ID NO: 2169211 - protein, 19 aa, Cryptosporidium hominis
DISSRFSIISSNLKESPTN

SEQ ID NO: 2169212 - protein, 20 aa, Cryptosporidium hominis
DISSSYGWINTCLRIMELSQ

SEQ ID NO: 2169213 - protein, 17 aa, Cryptosporidium hominis
DITCAQWHPIKGLIATG

SEQ ID NO: 2169214 - protein, 18 aa, Cryptosporidium hominis
DIVAFLLFNADEILVDLK

SEQ ID NO: 2169215 - protein, 23 aa, Cryptosporidium hominis
DIVELFLIPQWWMNCKPFAEKAC

SEQ ID NO: 2169216 - protein, 17 aa, Cryptosporidium hominis
DIVKGRIMLEKKSRFSL

SEQ ID NO: 2169217 - protein, 23 aa, Cryptosporidium hominis
DIVQRLKRVSSMFSSTLPINIYL

SEQ ID NO: 2169218 - protein, 17 aa, Cryptosporidium hominis
DIVVIAWGLSLERPTMI

SEQ ID NO: 2169219 - protein, 28 aa, Cryptosporidium hominis
DIWLIRMRYPRCEGSTMRYFFVDTRSDG

SEQ ID NO: 2169220 - protein, 31 aa, Cryptosporidium hominis
DIWSIGVLCYVCLCGGLPFHDNRAFDLYHKI

SEQ ID NO: 2169221 - protein, 24 aa, Cryptosporidium hominis
DIWSVGCIFIELLIGRPIFSGDSE

SEQ ID NO: 2169222 - protein, 23 aa, Cryptosporidium hominis
DIYELKESILLVYSEFKQKGWCQ

SEQ ID NO: 2169223 - protein, 18 aa, Cryptosporidium hominis
DIYHAPLLYYREDDSISD

SEQ ID NO: 2169224 - protein, 25 aa, Cryptosporidium hominis
DIYKYLPPRIQTVLVSATLPDDILV

SEQ ID NO: 2169225 - protein, 24 aa, Cryptosporidium hominis
DIYNFLRDRLRAVWQDLTVQHATR

SEQ ID NO: 2169226 - protein, 22 aa, Cryptosporidium hominis
DIYPSIPTRLIFSVQNYQGYPF

SEQ ID NO: 2169227 - protein, 28 aa, Cryptosporidium hominis
DKARHFLWKAMVTGVPYSQAKLMKESQV

SEQ ID NO: 2169228 - protein, 27 aa, Cryptosporidium hominis
DKCLPNLKKGLFSRLVSNYSNLQNTKL

SEQ ID NO: 2169229 - protein, 19 aa, Cryptosporidium hominis
DKCSIRIKSLDSIYNQRNG

SEQ ID NO: 2169230 - protein, 21 aa, Cryptosporidium hominis
DKDINLFKLVGFVRNVEHDDY

SEQ ID NO: 2169231 - protein, 18 aa, Cryptosporidium hominis
DKDRIGINVSAQKEMVIL

SEQ ID NO: 2169232 - protein, 24 aa, Cryptosporidium hominis
DKEPILFKRIYLWREEAKIQVSKN

SEQ ID NO: 2169233 - protein, 23 aa, Cryptosporidium hominis
DKEPLKPLYLLYRHLKDSTYQAK

SEQ ID NO: 2169234 - protein, 20 aa, Cryptosporidium hominis
DKEWGGSCEDVFDPNEYWQK

SEQ ID NO: 2169235 - protein, 23 aa, Cryptosporidium hominis
DKFEFPDLPFVIMEEIYTYINQN

SEQ ID NO: 2169236 - protein, 17 aa, Cryptosporidium hominis
DKFGGLHNFMRWNRNIL

SEQ ID NO: 2169237 - protein, 26 aa, Cryptosporidium hominis
DKFGIRNLLPAFGHIRDYFNVNKNGS

SEQ ID NO: 2169238 - protein, 20 aa, Cryptosporidium hominis
DKFIESFSVTLVFIASTLIN

SEQ ID NO: 2169239 - protein, 24 aa, Cryptosporidium hominis
DKFINYLIGFYFKHLQYLYNPDVR

SEQ ID NO: 2169240 - protein, 27 aa, Cryptosporidium hominis
DKFNVFFIKSIINTACICPNFEVNTNI

SEQ ID NO: 2169241 - protein, 24 aa, Cryptosporidium hominis
DKFSKIILSLGCKLNIDNLSKPDC

SEQ ID NO: 2169242 - protein, 18 aa, Cryptosporidium hominis
DKICEPVIIQGNYDIHPI

SEQ ID NO: 2169243 - protein, 20 aa, Cryptosporidium hominis
DKIFSVLSHNGTVFNINSKN

SEQ ID NO: 2169244 - protein, 25 aa, Cryptosporidium hominis
DKIIRDIWLPLSPSGWQWYKRLLDV

SEQ ID NO: 2169245 - protein, 24 aa, Cryptosporidium hominis
DKIIRFRHSEYILSLTLSEDQQFV

SEQ ID NO: 2169246 - protein, 17 aa, Cryptosporidium hominis
DKIKTGAIFFGEPGTNA

SEQ ID NO: 2169247 - protein, 18 aa, Cryptosporidium hominis
DKIRKSFVSQYDKHHSSK

SEQ ID NO: 2169248 - protein, 21 aa, Cryptosporidium hominis
DKIVAEYAKHVYLHHLKAYRS

SEQ ID NO: 2169249 - protein, 20 aa, Cryptosporidium hominis
DKIVDTCSSLPVSLIKSETC

SEQ ID NO: 2169250 - protein, 17 aa, Cryptosporidium hominis
DKIYWTYKIKGLAMGKK

SEQ ID NO: 2169251 - protein, 19 aa, Cryptosporidium hominis
DKKALTWGLGLQGRLGHGD

SEQ ID NO: 2169252 - protein, 34 aa, Cryptosporidium hominis
DKKFYPCKCRYQICLWCFYHVRDQLDNKCPACRQ

SEQ ID NO: 2169253 - protein, 24 aa, Cryptosporidium hominis
DKKIGDTWIHYIAFELLNGDFQSQ

SEQ ID NO: 2169254 - protein, 19 aa, Cryptosporidium hominis
DKKMCLICLDEFKDQQEIL

SEQ ID NO: 2169255 - protein, 17 aa, Cryptosporidium hominis
DKKRGLLKVSKSTGGSS

SEQ ID NO: 2169256 - protein, 20 aa, Cryptosporidium hominis
DKKTAMHFFDIIKNKYALLI

SEQ ID NO: 2169257 - protein, 25 aa, Cryptosporidium hominis
DKLAISRRVDKHWRLIGFGDIISGD

SEQ ID NO: 2169258 - protein, 18 aa, Cryptosporidium hominis
DKLFQLSKMRIYEKPDEN

SEQ ID NO: 2169259 - protein, 23 aa, Cryptosporidium hominis
DKLSEFLPALLLRLKEQGKHIKF

SEQ ID NO: 2169260 - protein, 18 aa, Cryptosporidium hominis
DKLSILIIDVQPLLHASP

SEQ ID NO: 2169261 - protein, 24 aa, Cryptosporidium hominis
DKNSALLVLRRKKLVTQEREKLLS

SEQ ID NO: 2169262 - protein, 18 aa, Cryptosporidium hominis
DKPLKPGRTYKIPSRNYT

SEQ ID NO: 2169263 - protein, 21 aa, Cryptosporidium hominis
DKPMIKECIKNIVTNPFAQKD

SEQ ID NO: 2169264 - protein, 22 aa, Cryptosporidium hominis
DKRILIKKCVPICQRLFYSDTV

SEQ ID NO: 2169265 - protein, 18 aa, Cryptosporidium hominis
DKRISMSSILDVSGAPPI

SEQ ID NO: 2169266 - protein, 18 aa, Cryptosporidium hominis
DKRRPSFERDLSLSEDTA

SEQ ID NO: 2169267 - protein, 19 aa, Cryptosporidium hominis
DKSDWLLKYCEHLSEKINS

SEQ ID NO: 2169268 - protein, 18 aa, Cryptosporidium hominis
DKSIRIHGKFCGDDLLEI

SEQ ID NO: 2169269 - protein, 17 aa, Cryptosporidium hominis
DKSLKLFRIDSDFCSYK

SEQ ID NO: 2169270 - protein, 20 aa, Cryptosporidium hominis
DKSLSLELILDSEIRKTEVL

SEQ ID NO: 2169271 - protein, 26 aa, Cryptosporidium hominis
DKSRIPKFRNPWDVYGELQPRRSKDL

SEQ ID NO: 2169272 - protein, 25 aa, Cryptosporidium hominis
DKTCSDIVFFIAKFIQHYPRLDEGL

SEQ ID NO: 2169273 - protein, 18 aa, Cryptosporidium hominis
DKTLWISAEEEVDDSTSN

SEQ ID NO: 2169274 - protein, 20 aa, Cryptosporidium hominis
DKTMKCWDLEQNRIVRNYAR

SEQ ID NO: 2169275 - protein, 26 aa, Cryptosporidium hominis
DKTNSCKHLFSWIEYEMALLGNSIHG

SEQ ID NO: 2169276 - protein, 18 aa, Cryptosporidium hominis
DKVPVILGNEASNVIETE

SEQ ID NO: 2169277 - protein, 21 aa, Cryptosporidium hominis
DKWDVMVDVFFWRDPEEYENS

SEQ ID NO: 2169278 - protein, 21 aa, Cryptosporidium hominis
DKWKIPRPECITINHSELSEE

SEQ ID NO: 2169279 - protein, 18 aa, Cryptosporidium hominis
DKWMDAIILWTLKSRKYR

SEQ ID NO: 2169280 - protein, 26 aa, Cryptosporidium hominis
DKWPLNKWAPSPFRVQHASPYKQMHA

SEQ ID NO: 2169281 - protein, 35 aa, Cryptosporidium hominis
DKYGVRFGVSGMQGWRVSMEDAHIALPRLDKHPEL

SEQ ID NO: 2169282 - protein, 27 aa, Cryptosporidium hominis
DKYNPVLDNTFEWCIDVCDEWKKNTQI

SEQ ID NO: 2169283 - protein, 23 aa, Cryptosporidium hominis
DKYWSSRLYDLYRRMKGESSQRD

SEQ ID NO: 2169284 - protein, 27 aa, Cryptosporidium hominis
DLAKEYWRFLVGYNYELLISLLHSAPS

SEQ ID NO: 2169285 - protein, 25 aa, Cryptosporidium hominis
DLAYRLCFLACHIEVVNAIASADDG

SEQ ID NO: 2169286 - protein, 23 aa, Cryptosporidium hominis
DLCKEIPIHINVGSVDALKASHN

SEQ ID NO: 2169287 - protein, 18 aa, Cryptosporidium hominis
DLDFPILLHRKLINISLR

SEQ ID NO: 2169288 - protein, 24 aa, Cryptosporidium hominis
DLDGKYLVCNLEFDEKKNIEFDSK

SEQ ID NO: 2169289 - protein, 24 aa, Cryptosporidium hominis
DLEAKKWGFRCCKQTCRFSKCTNI

SEQ ID NO: 2169290 - protein, 28 aa, Cryptosporidium hominis
DLELNFDFNVYRILNEFMEECRKNSNKQ

SEQ ID NO: 2169291 - protein, 28 aa, Cryptosporidium hominis
DLELPLPKKEYRGIPELELSDKSEDKHE

SEQ ID NO: 2169292 - protein, 23 aa, Cryptosporidium hominis
DLESSDLFGIMAPVELKPRTIEN

SEQ ID NO: 2169293 - protein, 32 aa, Cryptosporidium hominis
DLFHRSIFLFICTNCTCSVQAFRCQLPRMNDY

SEQ ID NO: 2169294 - protein, 17 aa, Cryptosporidium hominis
DLFLMKIRDSFMDVQFT

SEQ ID NO: 2169295 - protein, 22 aa, Cryptosporidium hominis
DLFPDCFAGIPSCTSDDWRKGV

SEQ ID NO: 2169296 - protein, 25 aa, Cryptosporidium hominis
DLGALRSPLPWDLGRHSKSTIQVSH

SEQ ID NO: 2169297 - protein, 18 aa, Cryptosporidium hominis
DLGHLLKAPFCIHHSTGR

SEQ ID NO: 2169298 - protein, 18 aa, Cryptosporidium hominis
DLGNACWMNKHFSQDIQT

SEQ ID NO: 2169299 - protein, 19 aa, Cryptosporidium hominis
DLGPIYGFQWRHYNGEYKT

SEQ ID NO: 2169300 - protein, 20 aa, Cryptosporidium hominis
DLGPMRFAIGKSIFKRSDFT

SEQ ID NO: 2169301 - protein, 17 aa, Cryptosporidium hominis
DLGRTSPSLGDLIQESL

SEQ ID NO: 2169302 - protein, 24 aa, Cryptosporidium hominis
DLHREAGELYGLIHARYITTPRGL

SEQ ID NO: 2169303 - protein, 24 aa, Cryptosporidium hominis
DLIDGSIVWTGRNIKVFSSGPPII

SEQ ID NO: 2169304 - protein, 17 aa, Cryptosporidium hominis
DLIFVFQLMEYFNNPEF

SEQ ID NO: 2169305 - protein, 31 aa, Cryptosporidium hominis
DLIIDFPLFIKLVEYRIIKGTSQILRIELPG

SEQ ID NO: 2169306 - protein, 17 aa, Cryptosporidium hominis
DLIKKVLKNSIQILQSD

SEQ ID NO: 2169307 - protein, 25 aa, Cryptosporidium hominis
DLINEFKHALVWGTSVKHNPQCVGL

SEQ ID NO: 2169308 - protein, 17 aa, Cryptosporidium hominis
DLIPRWITQKNKYRRIG

SEQ ID NO: 2169309 - protein, 24 aa, Cryptosporidium hominis
DLIRRRYLGELKKTLVSDSQILNR

SEQ ID NO: 2169310 - protein, 21 aa, Cryptosporidium hominis
DLISEAFCFLPLAHVINDKVF

SEQ ID NO: 2169311 - protein, 19 aa, Cryptosporidium hominis
DLIYKFLFRKHDDSHLNTN

SEQ ID NO: 2169312 - protein, 27 aa, Cryptosporidium hominis
DLKCRQCFLNEYIPDWSMDESISVFLK

SEQ ID NO: 2169313 - protein, 24 aa, Cryptosporidium hominis
DLKEVSELHILRLKQIETAQRLKE

SEQ ID NO: 2169314 - protein, 25 aa, Cryptosporidium hominis
DLKILLFELFIQFGLIDKITIRGGS

SEQ ID NO: 2169315 - protein, 20 aa, Cryptosporidium hominis
DLKPICAFCQNRSSHGPYKH

SEQ ID NO: 2169316 - protein, 23 aa, Cryptosporidium hominis
DLKPPKLSVEKLLTFDDPDYEYL

SEQ ID NO: 2169317 - protein, 19 aa, Cryptosporidium hominis
DLKPRWVSGETLSYSNSFD

SEQ ID NO: 2169318 - protein, 24 aa, Cryptosporidium hominis
DLKSVLELPPFYKYENKMQLQLTT

SEQ ID NO: 2169319 - protein, 18 aa, Cryptosporidium hominis
DLLDRLLIIRTIPYNIEE

SEQ ID NO: 2169320 - protein, 19 aa, Cryptosporidium hominis
DLLFTPKATEDFSGDDDHL

SEQ ID NO: 2169321 - protein, 24 aa, Cryptosporidium hominis
DLLHKGGNCNSFIEKFGRNHLNDS

SEQ ID NO: 2169322 - protein, 17 aa, Cryptosporidium hominis
DLLKKGLILPGMKEAEG

SEQ ID NO: 2169323 - protein, 28 aa, Cryptosporidium hominis
DLLRIMLKFRRHLICPNHIIVEEIKATW

SEQ ID NO: 2169324 - protein, 24 aa, Cryptosporidium hominis
DLLRWRSAMELVQMISSISDALTE

SEQ ID NO: 2169325 - protein, 24 aa, Cryptosporidium hominis
DLLSKLCTLSCSRIHETILGDKNN

SEQ ID NO: 2169326 - protein, 17 aa, Cryptosporidium hominis
DLLSLPIVRGPPCFEKN

SEQ ID NO: 2169327 - protein, 19 aa, Cryptosporidium hominis
DLLSSCKFQLSKLRIKNFQ

SEQ ID NO: 2169328 - protein, 23 aa, Cryptosporidium hominis
DLLSTLEYFNWYLNLSGDIEPFP

SEQ ID NO: 2169329 - protein, 20 aa, Cryptosporidium hominis
DLMRSVGLWEFDRYTGKFHE

SEQ ID NO: 2169330 - protein, 22 aa, Cryptosporidium hominis
DLMYSHSLWTNSFYVAFIELRR

SEQ ID NO: 2169331 - protein, 23 aa, Cryptosporidium hominis
DLNHEFPRVLFIKANGKVIQNIE

SEQ ID NO: 2169332 - protein, 31 aa, Cryptosporidium hominis
DLNIFLQRVIPGICLNHKIDAIFIDSITNLY

SEQ ID NO: 2169333 - protein, 26 aa, Cryptosporidium hominis
DLNIRKELFDNLSFPISLSDGIVGKV

SEQ ID NO: 2169334 - protein, 30 aa, Cryptosporidium hominis
DLNKIPIRFPWILEELPIAQSFKNQFLLFN

SEQ ID NO: 2169335 - protein, 24 aa, Cryptosporidium hominis
DLNLEKRKTYVIGVVPDPGIDSEW

SEQ ID NO: 2169336 - protein, 24 aa, Cryptosporidium hominis
DLNQGMGFADLFYNFLNSEVEESM

SEQ ID NO: 2169337 - protein, 18 aa, Cryptosporidium hominis
DLNRKHMLVPDVGDEKEE

SEQ ID NO: 2169338 - protein, 42 aa, Cryptosporidium hominis
DLNSVKYYEGFKLPLGDLGRKMLLKKLREIHTQNPTKMEKAL

SEQ ID NO: 2169339 - protein, 24 aa, Cryptosporidium hominis
DLNTRKRRALALIELGSIFQSVAN

SEQ ID NO: 2169340 - protein, 18 aa, Cryptosporidium hominis
DLPARVSVLQAILRKSPL

SEQ ID NO: 2169341 - protein, 22 aa, Cryptosporidium hominis
DLPRSVVPTCIGIPNKEVDLID

SEQ ID NO: 2169342 - protein, 17 aa, Cryptosporidium hominis
DLQFEIDENISLNPTLP

SEQ ID NO: 2169343 - protein, 25 aa, Cryptosporidium hominis
DLQFKQDLSYFIHGKWASIKKLVDD

SEQ ID NO: 2169344 - protein, 24 aa, Cryptosporidium hominis
DLQSREFLDLNLDYSFESNNVSME

SEQ ID NO: 2169345 - protein, 30 aa, Cryptosporidium hominis
DLRAKYGKGFDIIRKMGFKGGGLGVDGSGI

SEQ ID NO: 2169346 - protein, 20 aa, Cryptosporidium hominis
DLREPEAIYAFSNRYADMIL

SEQ ID NO: 2169347 - protein, 17 aa, Cryptosporidium hominis
DLRRLFEDYGEVTDCHL

SEQ ID NO: 2169348 - protein, 17 aa, Cryptosporidium hominis
DLRRMIDDILNLMESHY

SEQ ID NO: 2169349 - protein, 17 aa, Cryptosporidium hominis
DLSGVIFQNGFILEQNI

SEQ ID NO: 2169350 - protein, 33 aa, Cryptosporidium hominis
DLSIGLSPKRSKCMLNDDLELETAIATNGNGVA

SEQ ID NO: 2169351 - protein, 24 aa, Cryptosporidium hominis
DLSKKRIYFFLGLGPNISNNILKS

SEQ ID NO: 2169352 - protein, 20 aa, Cryptosporidium hominis
DLSKRITIYEDFVSKHYKKW

SEQ ID NO: 2169353 - protein, 20 aa, Cryptosporidium hominis
DLSLLFSAPIKYRSTDTLEG

SEQ ID NO: 2169354 - protein, 19 aa, Cryptosporidium hominis
DLSLLRFSLVTNNFYESVI

SEQ ID NO: 2169355 - protein, 21 aa, Cryptosporidium hominis
DLSSLLELHAAFLAFTLTLYP

SEQ ID NO: 2169356 - protein, 23 aa, Cryptosporidium hominis
DLSTISFSWRFGAFSNFKEMLSI

SEQ ID NO: 2169357 - protein, 19 aa, Cryptosporidium hominis
DLTNYLSIYRKWIYHSSSV

SEQ ID NO: 2169358 - protein, 25 aa, Cryptosporidium hominis
DLTQKEMKHWGATIDRINRQEIISY

SEQ ID NO: 2169359 - protein, 17 aa, Cryptosporidium hominis
DLTRCIIDHLSKLSSII

SEQ ID NO: 2169360 - protein, 30 aa, Cryptosporidium hominis
DLVAAEGLKCGWGFPTGCSLNHCAAHYTPN

SEQ ID NO: 2169361 - protein, 24 aa, Cryptosporidium hominis
DLVIPRGSGELVHMIKKNTCIPVL

SEQ ID NO: 2169362 - protein, 22 aa, Cryptosporidium hominis
DLWLKLLPILLYSLDIWLSDLI

SEQ ID NO: 2169363 - protein, 18 aa, Cryptosporidium hominis
DLYESFMLTNLNTFNPSF

SEQ ID NO: 2169364 - protein, 18 aa, Cryptosporidium hominis
DLYHYIYICTVVNKNVPE

SEQ ID NO: 2169365 - protein, 29 aa, Cryptosporidium hominis
DLYKCKKEDLEFVSPFYLKAARKDFVHAF

SEQ ID NO: 2169366 - protein, 24 aa, Cryptosporidium hominis
DMDTLQLFCQVLYDCCNNPPPITE

SEQ ID NO: 2169367 - protein, 20 aa, Cryptosporidium hominis
DMEVCPNCNQVFKTIVPPEL

SEQ ID NO: 2169368 - protein, 24 aa, Cryptosporidium hominis
DMFHACRLACECCMDIHRTLHNFP

SEQ ID NO: 2169369 - protein, 18 aa, Cryptosporidium hominis
DMGGGFDGRMGGRMSREV

SEQ ID NO: 2169370 - protein, 24 aa, Cryptosporidium hominis
DMHPEKRQKAAWLAYVDNNLPILK

SEQ ID NO: 2169371 - protein, 26 aa, Cryptosporidium hominis
DMIKQKLKFILKHAISKSTSNKSNSR

SEQ ID NO: 2169372 - protein, 24 aa, Cryptosporidium hominis
DMKGSNKINCILFRSSPNSDIQND

SEQ ID NO: 2169373 - protein, 20 aa, Cryptosporidium hominis
DMKLDFYNRLISGFEYDLSS

SEQ ID NO: 2169374 - protein, 20 aa, Cryptosporidium hominis
DMNRMDAMYNRDINYIRDLL

SEQ ID NO: 2169375 - protein, 27 aa, Cryptosporidium hominis
DMNSLKSKCIWKSVRMINIPKEANFQD

SEQ ID NO: 2169376 - protein, 26 aa, Cryptosporidium hominis
DMPKELKNCFILTLNVSLEYENSEVT

SEQ ID NO: 2169377 - protein, 23 aa, Cryptosporidium hominis
DMPNKMCPAGFELIDDDQCSQTV

SEQ ID NO: 2169378 - protein, 30 aa, Cryptosporidium hominis
DMWSLGCILGEILCGKPIFPGSSTMNQLER

SEQ ID NO: 2169379 - protein, 22 aa, Cryptosporidium hominis
DNATLWSIVIKTAYRKRRSKRK

SEQ ID NO: 2169380 - protein, 17 aa, Cryptosporidium hominis
DNCKNHHLVSDKLGWFE

SEQ ID NO: 2169381 - protein, 19 aa, Cryptosporidium hominis
DNCTLSLRKEGPIWILLIR

SEQ ID NO: 2169382 - protein, 37 aa, Cryptosporidium hominis
DNDVCKFYLCGLCPHELFENTKLYMGPCKNIHSEVLR

SEQ ID NO: 2169383 - protein, 25 aa, Cryptosporidium hominis
DNDWTRKVPPSWTLKILGSIIQGDA

SEQ ID NO: 2169384 - protein, 28 aa, Cryptosporidium hominis
DNFNPRSGIRWLCFILGEYGKLISSKVS

SEQ ID NO: 2169385 - protein, 19 aa, Cryptosporidium hominis
DNFSLCFSISNHIIQQYHP

SEQ ID NO: 2169386 - protein, 23 aa, Cryptosporidium hominis
DNGGRFLSLHAYNLSKLNSNIPS

SEQ ID NO: 2169387 - protein, 25 aa, Cryptosporidium hominis
DNIEIYSYLNACPKSLLEVYWENEV

SEQ ID NO: 2169388 - protein, 18 aa, Cryptosporidium hominis
DNIFCVTFTSSLFSLICL

SEQ ID NO: 2169389 - protein, 20 aa, Cryptosporidium hominis
DNIKKGFTIENDWETRMKIR

SEQ ID NO: 2169390 - protein, 25 aa, Cryptosporidium hominis
DNIRSQKLPSFGFENRFQDNIKGKG

SEQ ID NO: 2169391 - protein, 25 aa, Cryptosporidium hominis
DNISKAALLLPFAIQKELKLFNNCS

SEQ ID NO: 2169392 - protein, 19 aa, Cryptosporidium hominis
DNISRCLVLIQFNDSNDKP

SEQ ID NO: 2169393 - protein, 26 aa, Cryptosporidium hominis
DNIVRIKMCGPCVVCQDEYSIGDEVM

SEQ ID NO: 2169394 - protein, 31 aa, Cryptosporidium hominis
DNKKYWLKYSIEIIRQIRWILGNSSIHSNTP

SEQ ID NO: 2169395 - protein, 23 aa, Cryptosporidium hominis
DNKSELLAAAAAFAASNTMNISN

SEQ ID NO: 2169396 - protein, 25 aa, Cryptosporidium hominis
DNLEDAWPCAELIGYYLDKKNPGNS

SEQ ID NO: 2169397 - protein, 21 aa, Cryptosporidium hominis
DNLENGMICYYGEDEVIGGYP

SEQ ID NO: 2169398 - protein, 18 aa, Cryptosporidium hominis
DNLIMEYLGPIDSIRAAN

SEQ ID NO: 2169399 - protein, 18 aa, Cryptosporidium hominis
DNLKFILVQTQLKSLCIS

SEQ ID NO: 2169400 - protein, 17 aa, Cryptosporidium hominis
DNNCIYCNSSLERTSNT

SEQ ID NO: 2169401 - protein, 24 aa, Cryptosporidium hominis
DNPSMWPASLTMYIKQQVDEMHET

SEQ ID NO: 2169402 - protein, 23 aa, Cryptosporidium hominis
DNSEVAFQWKCSCWSTNDEFLLE

SEQ ID NO: 2169403 - protein, 19 aa, Cryptosporidium hominis
DNSIAWVVEGIFLSKDMYL

SEQ ID NO: 2169404 - protein, 23 aa, Cryptosporidium hominis
DNSWILRYLVLRLEKEHLKIKNI

SEQ ID NO: 2169405 - protein, 20 aa, Cryptosporidium hominis
DNTHSKIILFVGNYKNGTNN

SEQ ID NO: 2169406 - protein, 20 aa, Cryptosporidium hominis
DNTRCILGMMSMENTAILSV

SEQ ID NO: 2169407 - protein, 19 aa, Cryptosporidium hominis
DNTRLMLENLRLRDSGGVQ

SEQ ID NO: 2169408 - protein, 24 aa, Cryptosporidium hominis
DPALLRPGRLDRKIEFPLPDRRQR

SEQ ID NO: 2169409 - protein, 24 aa, Cryptosporidium hominis
DPAPYWWYNELRKYGSVPHSGFGL

SEQ ID NO: 2169410 - protein, 25 aa, Cryptosporidium hominis
DPCYSRGETLVGYIQGWRNVQDEAL

SEQ ID NO: 2169411 - protein, 26 aa, Cryptosporidium hominis
DPEFLKWLVQVCSPINRYISKIDFPK

SEQ ID NO: 2169412 - protein, 20 aa, Cryptosporidium hominis
DPELERYSAIIMDEAHERSL

SEQ ID NO: 2169413 - protein, 17 aa, Cryptosporidium hominis
DPFCGTGGILISASHFG

SEQ ID NO: 2169414 - protein, 21 aa, Cryptosporidium hominis
DPGALILKLLHNGRNIETASV

SEQ ID NO: 2169415 - protein, 19 aa, Cryptosporidium hominis
DPGDSLGIPSFLTITRQQK

SEQ ID NO: 2169416 - protein, 17 aa, Cryptosporidium hominis
DPIEIIEGISLDDLNKK

SEQ ID NO: 2169417 - protein, 33 aa, Cryptosporidium hominis
DPIEIVCFLPALCRRKDVAFCIIGGKARLGKLI

SEQ ID NO: 2169418 - protein, 26 aa, Cryptosporidium hominis
DPINWKRSWSSLIRMLYTDYLMSNPK

SEQ ID NO: 2169419 - protein, 22 aa, Cryptosporidium hominis
DPKEEIIKAFKLFDDDETGKIT

SEQ ID NO: 2169420 - protein, 25 aa, Cryptosporidium hominis
DPKVRIKYLRYIQRLEQRGVEGIDA

SEQ ID NO: 2169421 - protein, 23 aa, Cryptosporidium hominis
DPKVTGCLLVCLNRATRLVKSQQ

SEQ ID NO: 2169422 - protein, 21 aa, Cryptosporidium hominis
DPLEKRFLEIEGVIDSTESNN

SEQ ID NO: 2169423 - protein, 26 aa, Cryptosporidium hominis
DPLIDSWRVGPSMLIGRRNLASITLE

SEQ ID NO: 2169424 - protein, 24 aa, Cryptosporidium hominis
DPLRAVFAGLRILDSIRFMGLSSS

SEQ ID NO: 2169425 - protein, 19 aa, Cryptosporidium hominis
DPNEIFARFFASDRAGSFG

SEQ ID NO: 2169426 - protein, 19 aa, Cryptosporidium hominis
DPNSFPFVVLGNKLDLDQK

SEQ ID NO: 2169427 - protein, 23 aa, Cryptosporidium hominis
DPQKKLQVVFSISQLEKALEEGN

SEQ ID NO: 2169428 - protein, 22 aa, Cryptosporidium hominis
DPQRCIMWYGQVSAIDGCPVIR

SEQ ID NO: 2169429 - protein, 21 aa, Cryptosporidium hominis
DPRTANAIGTIFGHRHTVVRI

SEQ ID NO: 2169430 - protein, 23 aa, Cryptosporidium hominis
DPRVIKKLYSMTGNINLKSLQDE

SEQ ID NO: 2169431 - protein, 23 aa, Cryptosporidium hominis
DPRVIWQKEFLNIPYEVTADLIR

SEQ ID NO: 2169432 - protein, 32 aa, Cryptosporidium hominis
DPSQIPRPVFGNIIDKDCCIYESDKYLLPPNS

SEQ ID NO: 2169433 - protein, 24 aa, Cryptosporidium hominis
DPTDIFKLHGIKTFKPAYSRVDKQ

SEQ ID NO: 2169434 - protein, 17 aa, Cryptosporidium hominis
DPTHWLWDRIIFSNTRQ

SEQ ID NO: 2169435 - protein, 21 aa, Cryptosporidium hominis
DPVRMLKYNFELEDFLERYTF

SEQ ID NO: 2169436 - protein, 23 aa, Cryptosporidium hominis
DPYTLLPEQPWDVMKEDGDKPLA

SEQ ID NO: 2169437 - protein, 18 aa, Cryptosporidium hominis
DPYVLVAIAISFWKENDF

SEQ ID NO: 2169438 - protein, 22 aa, Cryptosporidium hominis
DQCIYHDYRTGLIDLKTDVTPR

SEQ ID NO: 2169439 - protein, 17 aa, Cryptosporidium hominis
DQEDRWAVWLPTVKREQ

SEQ ID NO: 2169440 - protein, 23 aa, Cryptosporidium hominis
DQFEENLNKFGIQGTFDENLYTT

SEQ ID NO: 2169441 - protein, 33 aa, Cryptosporidium hominis
DQFLRLLQLLGEWAEFGLIVIFCNRQTDVDELF

SEQ ID NO: 2169442 - protein, 22 aa, Cryptosporidium hominis
DQFPRVRYACCQTIGQISLDHS

SEQ ID NO: 2169443 - protein, 32 aa, Cryptosporidium hominis
DQGFNRCRVLILCPFKGVAKKLVDTLVTILPH

SEQ ID NO: 2169444 - protein, 17 aa, Cryptosporidium hominis
DQGRALLKSELSAYLRS

SEQ ID NO: 2169445 - protein, 23 aa, Cryptosporidium hominis
DQIFRKRLEDLEIERNNLIEKIN

SEQ ID NO: 2169446 - protein, 22 aa, Cryptosporidium hominis
DQIKIPFLLKNNMREYQVAGLE

SEQ ID NO: 2169447 - protein, 32 aa, Cryptosporidium hominis
DQIKKIRCVSFWVKEWGILFVGSTVFSQMVVF

SEQ ID NO: 2169448 - protein, 22 aa, Cryptosporidium hominis
DQIPELRLDEMETNIIEPTLEE

SEQ ID NO: 2169449 - protein, 18 aa, Cryptosporidium hominis
DQIRKIQTEFGWNTYKSS

SEQ ID NO: 2169450 - protein, 23 aa, Cryptosporidium hominis
DQLGCFAKFCLRVDGSAKLTFIQ

SEQ ID NO: 2169451 - protein, 22 aa, Cryptosporidium hominis
DQLYEWAKKLILAGKAYVDHQT

SEQ ID NO: 2169452 - protein, 24 aa, Cryptosporidium hominis
DQNIPICSAFGSPFDSSLIISSSL

SEQ ID NO: 2169453 - protein, 26 aa, Cryptosporidium hominis
DQNIRLSTGVSEIFGFFETSEDKQMP

SEQ ID NO: 2169454 - protein, 23 aa, Cryptosporidium hominis
DQNKEFIVQIGLLEENKSKCEFV

SEQ ID NO: 2169455 - protein, 28 aa, Cryptosporidium hominis
DQRENNRELLLFDLAINMYQKYTHLSRI

SEQ ID NO: 2169456 - protein, 26 aa, Cryptosporidium hominis
DQRIRPNTQLQWLFIDKWPHLVVLTI

SEQ ID NO: 2169457 - protein, 24 aa, Cryptosporidium hominis
DQSGSWEYSEFIAASMEPEMYLNN

SEQ ID NO: 2169458 - protein, 23 aa, Cryptosporidium hominis
DQVKSEFGLVELFELSEYENVLD

SEQ ID NO: 2169459 - protein, 24 aa, Cryptosporidium hominis
DQWRGSCYGTLYKGVEYLKSNNYD

SEQ ID NO: 2169460 - protein, 23 aa, Cryptosporidium hominis
DQYKKEILSLLLESRPAIVESAE

SEQ ID NO: 2169461 - protein, 35 aa, Cryptosporidium hominis
DQYKSGYKGVSWNKRMQSWLAFWTEGQRRRSKTFN

SEQ ID NO: 2169462 - protein, 48 aa, Cryptosporidium hominis
DRANRMLMKGRRECSSIPGFFQNKLGWFNCVENFFSVCNDEQIVEDNE

SEQ ID NO: 2169463 - protein, 26 aa, Cryptosporidium hominis
DRDDWVRKLSRLMIPYVQKGVLDLGE

SEQ ID NO: 2169464 - protein, 18 aa, Cryptosporidium hominis
DRDLKLCQETIKRNNGND

SEQ ID NO: 2169465 - protein, 21 aa, Cryptosporidium hominis
DREDLEYNDFISLLANDIKNN

SEQ ID NO: 2169466 - protein, 18 aa, Cryptosporidium hominis
DRFIDALNATKCAIEQGI

SEQ ID NO: 2169467 - protein, 17 aa, Cryptosporidium hominis
DRFLLDIGLRVQDQKMV

SEQ ID NO: 2169468 - protein, 20 aa, Cryptosporidium hominis
DRFSSFFTEPLFCKDMTEKE

SEQ ID NO: 2169469 - protein, 25 aa, Cryptosporidium hominis
DRFSVNCYMPVVIVSPVSQNIEAKF

SEQ ID NO: 2169470 - protein, 21 aa, Cryptosporidium hominis
DRHEKSLGICINFILNKSNLT

SEQ ID NO: 2169471 - protein, 17 aa, Cryptosporidium hominis
DRICRIVLEHALNLLPY

SEQ ID NO: 2169472 - protein, 29 aa, Cryptosporidium hominis
DRIICGFLDRTIRVWFRTDQQLFLEEERE

SEQ ID NO: 2169473 - protein, 18 aa, Cryptosporidium hominis
DRIIKRGHFSERYAAVIM

SEQ ID NO: 2169474 - protein, 22 aa, Cryptosporidium hominis
DRIRTLKTLFGYQVGMPGRPLL

SEQ ID NO: 2169475 - protein, 26 aa, Cryptosporidium hominis
DRISDDWRWLALKSEKRLNNMKKMNS

SEQ ID NO: 2169476 - protein, 26 aa, Cryptosporidium hominis
DRKATPFLCLLVKLLQIRPSTEIVLE

SEQ ID NO: 2169477 - protein, 23 aa, Cryptosporidium hominis
DRKKEIMDNLPLITDQFSTSRNS

SEQ ID NO: 2169478 - protein, 19 aa, Cryptosporidium hominis
DRKYQCILLSATLNKEVDS

SEQ ID NO: 2169479 - protein, 24 aa, Cryptosporidium hominis
DRLKGNEELNGFVGISRVFNGNIK

SEQ ID NO: 2169480 - protein, 19 aa, Cryptosporidium hominis
DRLLDLNIWCLALRQKVPD

SEQ ID NO: 2169481 - protein, 23 aa, Cryptosporidium hominis
DRLLNEILTLCFFSEGELLHSLY

SEQ ID NO: 2169482 - protein, 26 aa, Cryptosporidium hominis
DRLPNCVFPKSFYSWLLNENNNKYFS

SEQ ID NO: 2169483 - protein, 22 aa, Cryptosporidium hominis
DRMRFKVINLFKKWASRFSNSN

SEQ ID NO: 2169484 - protein, 24 aa, Cryptosporidium hominis
DRNKSNSYIKTWGKEKWTNDLIHK

SEQ ID NO: 2169485 - protein, 22 aa, Cryptosporidium hominis
DRNRRIALIESFNDRNTRKNAK

SEQ ID NO: 2169486 - protein, 18 aa, Cryptosporidium hominis
DRNTRFVHRSRLLAHKEV

SEQ ID NO: 2169487 - protein, 20 aa, Cryptosporidium hominis
DRPFPFVLVAGVEKAPLKVH

SEQ ID NO: 2169488 - protein, 23 aa, Cryptosporidium hominis
DRQRWSRRRNLSKIISGKNVNNN

SEQ ID NO: 2169489 - protein, 18 aa, Cryptosporidium hominis
DRRNVIVVLFLIREYPLA

SEQ ID NO: 2169490 - protein, 24 aa, Cryptosporidium hominis
DRSIPTKMPMHLFSGKRGMGKTDR

SEQ ID NO: 2169491 - protein, 23 aa, Cryptosporidium hominis
DRSPLFPGSSCFPLSPDNKQQTE

SEQ ID NO: 2169492 - protein, 18 aa, Cryptosporidium hominis
DRTFLSLDVLNGELTQIK

SEQ ID NO: 2169493 - protein, 24 aa, Cryptosporidium hominis
DRVAALRFEWAWQHPNICKVTREN

SEQ ID NO: 2169494 - protein, 19 aa, Cryptosporidium hominis
DRVKRSWTNKRIGKENNSS

SEQ ID NO: 2169495 - protein, 17 aa, Cryptosporidium hominis
DRVRIFVVFESPSMAQI

SEQ ID NO: 2169496 - protein, 20 aa, Cryptosporidium hominis
DRYGNIIAIMNLFKDYKFDN

SEQ ID NO: 2169497 - protein, 21 aa, Cryptosporidium hominis
DRYVFECLWSEMIDQTSFDDS

SEQ ID NO: 2169498 - protein, 24 aa, Cryptosporidium hominis
DRYYRLLYSQLLYRPIYISKNKKL

SEQ ID NO: 2169499 - protein, 17 aa, Cryptosporidium hominis
DSACVFHNCSSRFSDGY

SEQ ID NO: 2169500 - protein, 25 aa, Cryptosporidium hominis
DSAFSKLIELCFELKHSLATKYIGR

SEQ ID NO: 2169501 - protein, 19 aa, Cryptosporidium hominis
DSAWHLRRIMSNNKIDQKD

SEQ ID NO: 2169502 - protein, 18 aa, Cryptosporidium hominis
DSCCVGASYICVADGVGG

SEQ ID NO: 2169503 - protein, 19 aa, Cryptosporidium hominis
DSDHAPVIIPETGSGSDHA

SEQ ID NO: 2169504 - protein, 35 aa, Cryptosporidium hominis
DSDPLMSRYRCYTEWKLLYRCNRHPNILNLIGGIR

SEQ ID NO: 2169505 - protein, 22 aa, Cryptosporidium hominis
DSEFPLVIYLNYTFQKEETFSY

SEQ ID NO: 2169506 - protein, 21 aa, Cryptosporidium hominis
DSETRMFLVLKDYFGHSKKVF

SEQ ID NO: 2169507 - protein, 22 aa, Cryptosporidium hominis
DSFEVSFRFLLFSEEYLCNLKE

SEQ ID NO: 2169508 - protein, 24 aa, Cryptosporidium hominis
DSFGVVELCWTLNFNQIGDFYPSN

SEQ ID NO: 2169509 - protein, 21 aa, Cryptosporidium hominis
DSFKLKGNEDIIKKNDQISQD

SEQ ID NO: 2169510 - protein, 19 aa, Cryptosporidium hominis
DSFSDCLYMLHDVQNERPP

SEQ ID NO: 2169511 - protein, 18 aa, Cryptosporidium hominis
DSGGRLCQCEYILNEILE

SEQ ID NO: 2169512 - protein, 24 aa, Cryptosporidium hominis
DSGKFRRGAPCWYIVHGQSNAIND

SEQ ID NO: 2169513 - protein, 19 aa, Cryptosporidium hominis
DSGKRIDFSLLMNNNKCSI

SEQ ID NO: 2169514 - protein, 23 aa, Cryptosporidium hominis
DSIAKYNVCEHIKFKNYNKGSPS

SEQ ID NO: 2169515 - protein, 19 aa, Cryptosporidium hominis
DSIFSESSCVSGYTMMKSS

SEQ ID NO: 2169516 - protein, 25 aa, Cryptosporidium hominis
DSIKKYLCCFLFHYIAEFQGVWVCF

SEQ ID NO: 2169517 - protein, 19 aa, Cryptosporidium hominis
DSILIKNLICFDHPTTEIN

SEQ ID NO: 2169518 - protein, 28 aa, Cryptosporidium hominis
DSIPESFLPDFLDLIIWGHEHECIVNPV

SEQ ID NO: 2169519 - protein, 19 aa, Cryptosporidium hominis
DSIPIEYLDLIKRWLNEME

SEQ ID NO: 2169520 - protein, 26 aa, Cryptosporidium hominis
DSKISWRYEKDGSFNGMCLGIETING

SEQ ID NO: 2169521 - protein, 19 aa, Cryptosporidium hominis
DSKLEVISQSYSIFSSSSS

SEQ ID NO: 2169522 - protein, 26 aa, Cryptosporidium hominis
DSKLIRLIWEGLNICVPINNKKKQFN

SEQ ID NO: 2169523 - protein, 28 aa, Cryptosporidium hominis
DSKLRISIQRLLAGMTFELNSEQEQTST

SEQ ID NO: 2169524 - protein, 25 aa, Cryptosporidium hominis
DSKRFKELHEFGTMYRLLLSGTPLH

SEQ ID NO: 2169525 - protein, 26 aa, Cryptosporidium hominis
DSKVFPYPICFVSKSLPTPPKDYNLR

SEQ ID NO: 2169526 - protein, 22 aa, Cryptosporidium hominis
DSLATKNYAGWGYGIRYTYGIF

SEQ ID NO: 2169527 - protein, 24 aa, Cryptosporidium hominis
DSLEGKIPLGFSFSVSAMLIPYHL

SEQ ID NO: 2169528 - protein, 22 aa, Cryptosporidium hominis
DSLELSLLLNFRSLSTKLQTEI

SEQ ID NO: 2169529 - protein, 18 aa, Cryptosporidium hominis
DSLFYRKEHQTPIINKDI

SEQ ID NO: 2169530 - protein, 17 aa, Cryptosporidium hominis
DSLKFALVKFKDFTDSF

SEQ ID NO: 2169531 - protein, 17 aa, Cryptosporidium hominis
DSLKRLFLDDEFNREYS

SEQ ID NO: 2169532 - protein, 19 aa, Cryptosporidium hominis
DSLLSRFDLQFLLLDIPDK

SEQ ID NO: 2169533 - protein, 18 aa, Cryptosporidium hominis
DSLMDFIFFIWGADDEFW

SEQ ID NO: 2169534 - protein, 24 aa, Cryptosporidium hominis
DSLNLAWRLAFVLKNKYEVDIKKQ

SEQ ID NO: 2169535 - protein, 24 aa, Cryptosporidium hominis
DSLSGDRLGCFNLSLKGHGHAVSF

SEQ ID NO: 2169536 - protein, 20 aa, Cryptosporidium hominis
DSLVCKAGIIASKAAGDARF

SEQ ID NO: 2169537 - protein, 18 aa, Cryptosporidium hominis
DSLVEFVRYILSSRSSSF

SEQ ID NO: 2169538 - protein, 30 aa, Cryptosporidium hominis
DSLYNLITMCLRPNPDLRASSKEVFDYLVN

SEQ ID NO: 2169539 - protein, 25 aa, Cryptosporidium hominis
DSNGLNKYPFCLTILSSGKLINTLS

SEQ ID NO: 2169540 - protein, 19 aa, Cryptosporidium hominis
DSNTAIAFLLRHEENLEQR

SEQ ID NO: 2169541 - protein, 19 aa, Cryptosporidium hominis
DSPHAENCVQLFSPDNYDG

SEQ ID NO: 2169542 - protein, 24 aa, Cryptosporidium hominis
DSPLPERHEIVLFKSMEDANNTTF

SEQ ID NO: 2169543 - protein, 18 aa, Cryptosporidium hominis
DSQLFISLLESWVGIKYE

SEQ ID NO: 2169544 - protein, 23 aa, Cryptosporidium hominis
DSQMIRDVINWMKERQGEAIHWL

SEQ ID NO: 2169545 - protein, 24 aa, Cryptosporidium hominis
DSRLDSEWFMKILRHDPNVYRIAS

SEQ ID NO: 2169546 - protein, 20 aa, Cryptosporidium hominis
DSRTRCMRIWTLLRNSVPNA

SEQ ID NO: 2169547 - protein, 19 aa, Cryptosporidium hominis
DSSFKDFLNSLGLNESLYA

SEQ ID NO: 2169548 - protein, 18 aa, Cryptosporidium hominis
DSSIKLRALKVLFSVINE

SEQ ID NO: 2169549 - protein, 25 aa, Cryptosporidium hominis
DSSLICFHEQLALPVQEDFSPAQFE

SEQ ID NO: 2169550 - protein, 21 aa, Cryptosporidium hominis
DSSNLPLYSLGSFRDANYYPN

SEQ ID NO: 2169551 - protein, 20 aa, Cryptosporidium hominis
DSSRKAFLRDLRKLIEESDV

SEQ ID NO: 2169552 - protein, 21 aa, Cryptosporidium hominis
DSSYFNRMLNMLLNAGAEIDD

SEQ ID NO: 2169553 - protein, 22 aa, Cryptosporidium hominis
DSTDFPSKRKVPLDTNNGIVRI

SEQ ID NO: 2169554 - protein, 23 aa, Cryptosporidium hominis
DSTECYRAHQSYIQRRFANGDFG

SEQ ID NO: 2169555 - protein, 17 aa, Cryptosporidium hominis
DSTFYFEIIINIFGPLY

SEQ ID NO: 2169556 - protein, 20 aa, Cryptosporidium hominis
DSTVFLSKYIEGMKPEQKSI

SEQ ID NO: 2169557 - protein, 18 aa, Cryptosporidium hominis
DSVPKIIGHFLVRQIMDK

SEQ ID NO: 2169558 - protein, 26 aa, Cryptosporidium hominis
DTDLRCSQCGKVFHFDCLRNCNLIGS

SEQ ID NO: 2169559 - protein, 24 aa, Cryptosporidium hominis
DTDQRIQGLIGRYNSMCMDDQILK

SEQ ID NO: 2169560 - protein, 20 aa, Cryptosporidium hominis
DTEHFWSLCNDKFMLIAYKW

SEQ ID NO: 2169561 - protein, 21 aa, Cryptosporidium hominis
DTEILCILSGVCVWSVKCEIH

SEQ ID NO: 2169562 - protein, 22 aa, Cryptosporidium hominis
DTENKGILGFSDFGNACRLVSF

SEQ ID NO: 2169563 - protein, 19 aa, Cryptosporidium hominis
DTFMRRYNTIPTFLSEVDY

SEQ ID NO: 2169564 - protein, 20 aa, Cryptosporidium hominis
DTFNSFIWEPAVNKLSAYSS

SEQ ID NO: 2169565 - protein, 18 aa, Cryptosporidium hominis
DTGEYFCEECGIQQQENR

SEQ ID NO: 2169566 - protein, 22 aa, Cryptosporidium hominis
DTICADCEGIGGPKDAIQYCEL

SEQ ID NO: 2169567 - protein, 18 aa, Cryptosporidium hominis
DTIIPFHNLYYLKSKISK

SEQ ID NO: 2169568 - protein, 25 aa, Cryptosporidium hominis
DTKKKSKVCGINWTCDGNKLVYSAR

SEQ ID NO: 2169569 - protein, 20 aa, Cryptosporidium hominis
DTLDARLLKTGLTPVNNKEL

SEQ ID NO: 2169570 - protein, 23 aa, Cryptosporidium hominis
DTLLCIIQRVSLLWENKDFEFFE

SEQ ID NO: 2169571 - protein, 18 aa, Cryptosporidium hominis
DTLQESYHNFKFISSSNK

SEQ ID NO: 2169572 - protein, 25 aa, Cryptosporidium hominis
DTLRALIGLKCIRISFCRKDDHSTS

SEQ ID NO: 2169573 - protein, 23 aa, Cryptosporidium hominis
DTLRKLVVLVWTFLQETSFGSSP

SEQ ID NO: 2169574 - protein, 31 aa, Cryptosporidium hominis
DTPMSPRTAKWVRELTPVLEPYNFNLNEISD

SEQ ID NO: 2169575 - protein, 31 aa, Cryptosporidium hominis
DTPYIHQFCSIKSPMLAPTFFSLHPCFVSEP

SEQ ID NO: 2169576 - protein, 19 aa, Cryptosporidium hominis
DTQKWNVILGRRLILNRRV

SEQ ID NO: 2169577 - protein, 23 aa, Cryptosporidium hominis
DTRKFRPRKNISFSPGPINIAWS

SEQ ID NO: 2169578 - protein, 20 aa, Cryptosporidium hominis
DTSELFKLVGNRNKIFKNTL

SEQ ID NO: 2169579 - protein, 19 aa, Cryptosporidium hominis
DTTDNTMTFVYQAPTKTET

SEQ ID NO: 2169580 - protein, 28 aa, Cryptosporidium hominis
DTVINRCGHLFCRDCIDRNLSSRNRKCP

SEQ ID NO: 2169581 - protein, 18 aa, Cryptosporidium hominis
DVAFKCLPLYSSKTQLNN

SEQ ID NO: 2169582 - protein, 26 aa, Cryptosporidium hominis
DVAHSEWVRDVAWRPSVDLLAETIAS

SEQ ID NO: 2169583 - protein, 23 aa, Cryptosporidium hominis
DVDEIHEYLLLKGVNAVAIHGGL

SEQ ID NO: 2169584 - protein, 18 aa, Cryptosporidium hominis
DVDFDFPEMQAIKNALAN

SEQ ID NO: 2169585 - protein, 19 aa, Cryptosporidium hominis
DVDFNMCFNYNVGIDPMQI

SEQ ID NO: 2169586 - protein, 17 aa, Cryptosporidium hominis
DVDMKIAPLSRVAIYTW

SEQ ID NO: 2169587 - protein, 26 aa, Cryptosporidium hominis
DVDVLEYFKAKLLNIANANERSLAPM

SEQ ID NO: 2169588 - protein, 20 aa, Cryptosporidium hominis
DVEIRFEAIGLISSIVESND

SEQ ID NO: 2169589 - protein, 18 aa, Cryptosporidium hominis
DVFNFSFDFKHFLKDEEL

SEQ ID NO: 2169590 - protein, 17 aa, Cryptosporidium hominis
DVFWSMLARKLSCFDWF

SEQ ID NO: 2169591 - protein, 22 aa, Cryptosporidium hominis
DVKELPSILLFTCQSLKPYKVI

SEQ ID NO: 2169592 - protein, 62 aa, Cryptosporidium hominis
DVKKSRTSLALPEFLVEDIPLPKVCVFQIEAKLELLLLYRGCSSKRPHTKRGRSTANTSNSS

SEQ ID NO: 2169593 - protein, 25 aa, Cryptosporidium hominis
DVKLIPELFWDKDFILNLNAGATQK

SEQ ID NO: 2169594 - protein, 20 aa, Cryptosporidium hominis
DVLDPALLRPGRLDRKVEIP

SEQ ID NO: 2169595 - protein, 24 aa, Cryptosporidium hominis
DVLFKTELINGISTVSRIENFING

SEQ ID NO: 2169596 - protein, 24 aa, Cryptosporidium hominis
DVLKEEIGPVILYFGCRYYDNDYL

SEQ ID NO: 2169597 - protein, 18 aa, Cryptosporidium hominis
DVLNVMGLYPGDPGPPGG

SEQ ID NO: 2169598 - protein, 19 aa, Cryptosporidium hominis
DVLSSLALVSLDTSDGPFC

SEQ ID NO: 2169599 - protein, 21 aa, Cryptosporidium hominis
DVNDPDFWKKVLGDSSVSSFL

SEQ ID NO: 2169600 - protein, 26 aa, Cryptosporidium hominis
DVNQCVGHAFAFAFLQQVVVEPSVKY

SEQ ID NO: 2169601 - protein, 33 aa, Cryptosporidium hominis
DVNSCNALLASCCGKGQLLLTLVYGNDWVPMAI

SEQ ID NO: 2169602 - protein, 23 aa, Cryptosporidium hominis
DVPCLACPVFETCSWSFESQILP

SEQ ID NO: 2169603 - protein, 21 aa, Cryptosporidium hominis
DVPQFKEIVLTEFITDAISKY

SEQ ID NO: 2169604 - protein, 25 aa, Cryptosporidium hominis
DVRINWRKVIIRSRMNHVNILDDLN

SEQ ID NO: 2169605 - protein, 26 aa, Cryptosporidium hominis
DVSEGCSLLVRNLRFETSPGRVRHHF

SEQ ID NO: 2169606 - protein, 20 aa, Cryptosporidium hominis
DVSKSEVIRLFKAVNTDSID

SEQ ID NO: 2169607 - protein, 29 aa, Cryptosporidium hominis
DVSLFYDKRLRSWIFGDLENIGYNTEESI

SEQ ID NO: 2169608 - protein, 23 aa, Cryptosporidium hominis
DVTFYRFSFFKSPVVQNAIDQTK

SEQ ID NO: 2169609 - protein, 25 aa, Cryptosporidium hominis
DVVASLKVLLPVVGDEINEILKLAT

SEQ ID NO: 2169610 - protein, 19 aa, Cryptosporidium hominis
DVYCNCLDLLQAKQLVKNK

SEQ ID NO: 2169611 - protein, 25 aa, Cryptosporidium hominis
DVYELALLSVEWGNYLGGAFIRYWK

SEQ ID NO: 2169612 - protein, 22 aa, Cryptosporidium hominis
DVYHGLGIPISMVYSRNLLGGA

SEQ ID NO: 2169613 - protein, 18 aa, Cryptosporidium hominis
DVYKCLNYSIYHSVKSIL

SEQ ID NO: 2169614 - protein, 28 aa, Cryptosporidium hominis
DWAQCELCKKWRKLPLGMNPNTLPEEWV

SEQ ID NO: 2169615 - protein, 24 aa, Cryptosporidium hominis
DWCISRQLWWGHRIPAYKIISSKL

SEQ ID NO: 2169616 - protein, 20 aa, Cryptosporidium hominis
DWEKKPLIVDFDFQINEDSE

SEQ ID NO: 2169617 - protein, 20 aa, Cryptosporidium hominis
DWGPVYIIKKVESLLDKLLL

SEQ ID NO: 2169618 - protein, 23 aa, Cryptosporidium hominis
DWIFKINKLPLWLHPYEILVIGS

SEQ ID NO: 2169619 - protein, 19 aa, Cryptosporidium hominis
DWNSLFCILSHLPKLECLM

SEQ ID NO: 2169620 - protein, 20 aa, Cryptosporidium hominis
DWQYECITQPGVLQGRNLVY

SEQ ID NO: 2169621 - protein, 21 aa, Cryptosporidium hominis
DWTLFVILSTGVPVYGDNSNN

SEQ ID NO: 2169622 - protein, 29 aa, Cryptosporidium hominis
DWVCYYLSAGIALRFISNIKNLYADNNNK

SEQ ID NO: 2169623 - protein, 25 aa, Cryptosporidium hominis
DWVSSLRITDKLAISEEVLKKTLET

SEQ ID NO: 2169624 - protein, 26 aa, Cryptosporidium hominis
DYCNFKGGFQKLDLSKIIQLQESAKS

SEQ ID NO: 2169625 - protein, 20 aa, Cryptosporidium hominis
DYDFTCPIRKTLGMMKTIGN

SEQ ID NO: 2169626 - protein, 22 aa, Cryptosporidium hominis
DYELRNKHLISFADKQDPSFES

SEQ ID NO: 2169627 - protein, 26 aa, Cryptosporidium hominis
DYFKEEAIEWAFKLLTQVYGIPKDRL

SEQ ID NO: 2169628 - protein, 22 aa, Cryptosporidium hominis
DYFRVLWNFISSVDLVRKTKLD

SEQ ID NO: 2169629 - protein, 18 aa, Cryptosporidium hominis
DYIIEILNSFNISSLTLE

SEQ ID NO: 2169630 - protein, 18 aa, Cryptosporidium hominis
DYILYPSSCCGYIINSSE

SEQ ID NO: 2169631 - protein, 17 aa, Cryptosporidium hominis
DYINYVGLNISEKRNDT

SEQ ID NO: 2169632 - protein, 28 aa, Cryptosporidium hominis
DYITQVEFLTGMLIFRPYNIKEKNSPNF

SEQ ID NO: 2169633 - protein, 21 aa, Cryptosporidium hominis
DYLSTWPELCFVCEAPDHSIA

SEQ ID NO: 2169634 - protein, 24 aa, Cryptosporidium hominis
DYNEKKEDLSLCEILENNDEGLNE

SEQ ID NO: 2169635 - protein, 17 aa, Cryptosporidium hominis
DYNEWKSEALIFEIDGY

SEQ ID NO: 2169636 - protein, 20 aa, Cryptosporidium hominis
DYNLRHFNEYGGLEGLTKLK

SEQ ID NO: 2169637 - protein, 26 aa, Cryptosporidium hominis
DYPKLLACSDLGISMHYSSSGLDLPM

SEQ ID NO: 2169638 - protein, 25 aa, Cryptosporidium hominis
DYPSKLSDFDFEWNNSLSVINKEQF

SEQ ID NO: 2169639 - protein, 21 aa, Cryptosporidium hominis
DYPSMRVPSLIVFGQSQSQSQ

SEQ ID NO: 2169640 - protein, 34 aa, Cryptosporidium hominis
DYQKEFKKVPGALWVQESMLFKIFNDECVHIPSL

SEQ ID NO: 2169641 - protein, 24 aa, Cryptosporidium hominis
DYRIFRVSGEFSRALQQARVAKKL

SEQ ID NO: 2169642 - protein, 21 aa, Cryptosporidium hominis
DYSELYLLPLVLKVLEIGSYE

SEQ ID NO: 2169643 - protein, 34 aa, Cryptosporidium hominis
DYSINCRDSIAPNLPGAFLSVVMQNLSSVNFPEE

SEQ ID NO: 2169644 - protein, 21 aa, Cryptosporidium hominis
DYSLLSASLRKRGKVNNMVSG

SEQ ID NO: 2169645 - protein, 18 aa, Cryptosporidium hominis
DYTYLRKLFRDLMQREGY

SEQ ID NO: 2169646 - protein, 20 aa, Cryptosporidium hominis
DYVATRWYRAPEILLGSTKY

SEQ ID NO: 2169647 - protein, 25 aa, Cryptosporidium hominis
DYVPGKGRGAIGFASGVSRDDQTIT

SEQ ID NO: 2169648 - protein, 21 aa, Cryptosporidium hominis
DYWKRVAVITKVRICKLNVEI

SEQ ID NO: 2169649 - protein, 18 aa, Cryptosporidium hominis
DYYGRRLATASSDHTIRI

SEQ ID NO: 2169650 - protein, 24 aa, Cryptosporidium hominis
DYYKKLCSQVIFPTPLVSTEKVVV

SEQ ID NO: 2169651 - protein, 25 aa, Cryptosporidium hominis
DYYPNIGREWYIKRWNDIKSIKFQK

SEQ ID NO: 2169652 - protein, 24 aa, Cryptosporidium hominis
EAAAKKLQSAWIHYKKKRLVILLR

SEQ ID NO: 2169653 - protein, 23 aa, Cryptosporidium hominis
EAALCCIREKMDVIDMEDETIDA

SEQ ID NO: 2169654 - protein, 20 aa, Cryptosporidium hominis
EAANNLKLFNSMKELITNNY

SEQ ID NO: 2169655 - protein, 18 aa, Cryptosporidium hominis
EACSMNNERLEVITKTAI

SEQ ID NO: 2169656 - protein, 27 aa, Cryptosporidium hominis
EADLWSLGVLFYVMLGGAFPFDERKGN

SEQ ID NO: 2169657 - protein, 32 aa, Cryptosporidium hominis
EAESVERLQALGFPRNAVIEAYLICEKNEELA

SEQ ID NO: 2169658 - protein, 24 aa, Cryptosporidium hominis
EAEVIRKLSLAGGRMQIKPFLDAM

SEQ ID NO: 2169659 - protein, 23 aa, Cryptosporidium hominis
EAFCSKWFVGLNVHVLPFPSLCK

SEQ ID NO: 2169660 - protein, 22 aa, Cryptosporidium hominis
EAFIHDPLIEWMRPGKTTQISN

SEQ ID NO: 2169661 - protein, 22 aa, Cryptosporidium hominis
EAFLKVAEKIYKNILDGIYDLS

SEQ ID NO: 2169662 - protein, 21 aa, Cryptosporidium hominis
EAFLPTIDLLMALKATYGNEL

SEQ ID NO: 2169663 - protein, 21 aa, Cryptosporidium hominis
EAFTSSFLRQIWPEVWASNRN

SEQ ID NO: 2169664 - protein, 27 aa, Cryptosporidium hominis
EAGDNSISTIGYWSIIDGFSSSLIKHA

SEQ ID NO: 2169665 - protein, 24 aa, Cryptosporidium hominis
EAGNKFKILKAWMDGCECFSRAAE

SEQ ID NO: 2169666 - protein, 19 aa, Cryptosporidium hominis
EAIFKLKEYIIQNLSNSLN

SEQ ID NO: 2169667 - protein, 21 aa, Cryptosporidium hominis
EAIKNIISICCCSRDIAEKAF

SEQ ID NO: 2169668 - protein, 19 aa, Cryptosporidium hominis
EAIRTVIEYVSTKYGPEEE

SEQ ID NO: 2169669 - protein, 19 aa, Cryptosporidium hominis
EAISTLALDYCAKAKILVV

SEQ ID NO: 2169670 - protein, 21 aa, Cryptosporidium hominis
EAITYLKECVLIFRRKESTKS

SEQ ID NO: 2169671 - protein, 22 aa, Cryptosporidium hominis
EAIWKEKIAVFDFCSPGQSGDL

SEQ ID NO: 2169672 - protein, 23 aa, Cryptosporidium hominis
EAKAFGIKSPWRIVRSRFYVTSA

SEQ ID NO: 2169673 - protein, 19 aa, Cryptosporidium hominis
EAKMDAVLEKLPYKNGEDK

SEQ ID NO: 2169674 - protein, 22 aa, Cryptosporidium hominis
EAKNKRKIFVHSLPTNISDDQI

SEQ ID NO: 2169675 - protein, 24 aa, Cryptosporidium hominis
EAKPGSKIKLEFRVVPLTNGLLKL

SEQ ID NO: 2169676 - protein, 23 aa, Cryptosporidium hominis
EAKRCIYDALCVVRNLIRDSRVV

SEQ ID NO: 2169677 - protein, 18 aa, Cryptosporidium hominis
EALDIAASMIKPGVTTDA

SEQ ID NO: 2169678 - protein, 26 aa, Cryptosporidium hominis
EALDLLKNLLCHPSKRFDGEQIKKHP

SEQ ID NO: 2169679 - protein, 21 aa, Cryptosporidium hominis
EALEIPKIVNFDRVCTEIQSF

SEQ ID NO: 2169680 - protein, 24 aa, Cryptosporidium hominis
EALFNLLNALACFGSSLKKRPAVM

SEQ ID NO: 2169681 - protein, 18 aa, Cryptosporidium hominis
EALFVGEMLCLVRFAGDF

SEQ ID NO: 2169682 - protein, 19 aa, Cryptosporidium hominis
EALGAYVFIADNCKELLDV

SEQ ID NO: 2169683 - protein, 19 aa, Cryptosporidium hominis
EALIQSICMIFFQSSPESK

SEQ ID NO: 2169684 - protein, 27 aa, Cryptosporidium hominis
EALKILKSRCSIPFIANGGISNYEDIQ

SEQ ID NO: 2169685 - protein, 19 aa, Cryptosporidium hominis
EALLCDLKALLIEAKQEIP

SEQ ID NO: 2169686 - protein, 18 aa, Cryptosporidium hominis
EALLRPGRFEVQIEIGLP

SEQ ID NO: 2169687 - protein, 19 aa, Cryptosporidium hominis
EALNPLQIGWSFKNMPGNS

SEQ ID NO: 2169688 - protein, 17 aa, Cryptosporidium hominis
EALQALIVLPSRELAIQ

SEQ ID NO: 2169689 - protein, 25 aa, Cryptosporidium hominis
EALRTYLFTYGHLYSSYSVNNLIEM

SEQ ID NO: 2169690 - protein, 17 aa, Cryptosporidium hominis
EALSHPYFNGININSGY

SEQ ID NO: 2169691 - protein, 24 aa, Cryptosporidium hominis
EANESTLIRLGELVTLRESNDRLR

SEQ ID NO: 2169692 - protein, 28 aa, Cryptosporidium hominis
EANTIECAICLMTLQDLLNCKNKGEEQE

SEQ ID NO: 2169693 - protein, 19 aa, Cryptosporidium hominis
EAPDRLTGLASYYEILELF

SEQ ID NO: 2169694 - protein, 19 aa, Cryptosporidium hominis
EAPGILRKLLQIISRMNTC

SEQ ID NO: 2169695 - protein, 32 aa, Cryptosporidium hominis
EAPKQFKDWRAHDIGIGFLLYGESACFALARM

SEQ ID NO: 2169696 - protein, 24 aa, Cryptosporidium hominis
EARAVPKVRRKRTLIPQESVDERN

SEQ ID NO: 2169697 - protein, 18 aa, Cryptosporidium hominis
EARDLGVSDLQNVKKEYD

SEQ ID NO: 2169698 - protein, 21 aa, Cryptosporidium hominis
EARKSPCLDGKVQRTEKGKEV

SEQ ID NO: 2169699 - protein, 18 aa, Cryptosporidium hominis
EASGKMVLLHKLLPKLFS

SEQ ID NO: 2169700 - protein, 23 aa, Cryptosporidium hominis
EASKAKMVFHGRFFAGRKLNVSF

SEQ ID NO: 2169701 - protein, 35 aa, Cryptosporidium hominis
EASLLAFEICQSIIPRLAYEIAEEIVVNLDNGSKQ

SEQ ID NO: 2169702 - protein, 18 aa, Cryptosporidium hominis
EASMGRRLRFLANVDPID

SEQ ID NO: 2169703 - protein, 21 aa, Cryptosporidium hominis
EASYWKNYWAEREKYVVQYIR

SEQ ID NO: 2169704 - protein, 24 aa, Cryptosporidium hominis
EATRAKVCRKIEFSQNLDLYEFCS

SEQ ID NO: 2169705 - protein, 30 aa, Cryptosporidium hominis
EATRIVKIKFKIRDICIWSILYERIKRTTT

SEQ ID NO: 2169706 - protein, 30 aa, Cryptosporidium hominis
EAVELPLVCPELYQQIGIDPPTGVLLYGPP

SEQ ID NO: 2169707 - protein, 17 aa, Cryptosporidium hominis
EAVKRLNSDFGDSPLCF

SEQ ID NO: 2169708 - protein, 18 aa, Cryptosporidium hominis
EAVTENFLSSSLSSSPPL

SEQ ID NO: 2169709 - protein, 20 aa, Cryptosporidium hominis
EAVYLRYKLRREFRKNQLKP

SEQ ID NO: 2169710 - protein, 17 aa, Cryptosporidium hominis
EAWFPGYNSYRELVSCS

SEQ ID NO: 2169711 - protein, 27 aa, Cryptosporidium hominis
EAYFILIKTRIENMWNEKINVFSQKRK

SEQ ID NO: 2169712 - protein, 21 aa, Cryptosporidium hominis
EAYLEICNYISDILEVRLNSD

SEQ ID NO: 2169713 - protein, 21 aa, Cryptosporidium hominis
ECDLHLKWAPFVTSSECLAYI

SEQ ID NO: 2169714 - protein, 21 aa, Cryptosporidium hominis
ECDRHKCKMIAGRIIPAIATT

SEQ ID NO: 2169715 - protein, 21 aa, Cryptosporidium hominis
ECEELKMGAFLAVAQGSKSPA

SEQ ID NO: 2169716 - protein, 19 aa, Cryptosporidium hominis
ECGILKLDILQMISNKVGV

SEQ ID NO: 2169717 - protein, 20 aa, Cryptosporidium hominis
ECGYIKYTTSEFMCVASRAG

SEQ ID NO: 2169718 - protein, 25 aa, Cryptosporidium hominis
ECIDVCKRIGFPVMIKASSGGGGKG

SEQ ID NO: 2169719 - protein, 18 aa, Cryptosporidium hominis
ECILKSVKLRASIAPIEA

SEQ ID NO: 2169720 - protein, 17 aa, Cryptosporidium hominis
ECINVCKCINYETNYNL

SEQ ID NO: 2169721 - protein, 26 aa, Cryptosporidium hominis
ECISILTGDWYIQWYLNNYKDDIKDN

SEQ ID NO: 2169722 - protein, 19 aa, Cryptosporidium hominis
ECKRRYNVKLWKTFTDCFN

SEQ ID NO: 2169723 - protein, 25 aa, Cryptosporidium hominis
ECNFKEELCRTCQYSSLKNIDLYIE

SEQ ID NO: 2169724 - protein, 22 aa, Cryptosporidium hominis
ECNRRGRSPSLSYTVTTLQAQR

SEQ ID NO: 2169725 - protein, 25 aa, Cryptosporidium hominis
ECNSCEYGLCNDCFYKFREINDKKK

SEQ ID NO: 2169726 - protein, 20 aa, Cryptosporidium hominis
ECNYLSTLFSSFSNTVKGFI

SEQ ID NO: 2169727 - protein, 24 aa, Cryptosporidium hominis
ECREKRVRCMFMIVGDNSRYQICN

SEQ ID NO: 2169728 - protein, 24 aa, Cryptosporidium hominis
ECRNLKFQGLMTMGDSDVNLTSEC

SEQ ID NO: 2169729 - protein, 25 aa, Cryptosporidium hominis
ECVCSEGYTGDGFTCHDIDECKVGN

SEQ ID NO: 2169730 - protein, 22 aa, Cryptosporidium hominis
ECVRKLYYELLVEYNGDDSGKV

SEQ ID NO: 2169731 - protein, 24 aa, Cryptosporidium hominis
EDAWEIYYSITLIQLSFREIFIIF

SEQ ID NO: 2169732 - protein, 22 aa, Cryptosporidium hominis
EDCIRMAINLFHDYFYCQIKQL

SEQ ID NO: 2169733 - protein, 17 aa, Cryptosporidium hominis
EDCYYSADEDFQLENEE

SEQ ID NO: 2169734 - protein, 24 aa, Cryptosporidium hominis
EDDDKFCICVQSIIGEIFELRTQL

SEQ ID NO: 2169735 - protein, 22 aa, Cryptosporidium hominis
EDDFDGLPSEEEELDDIDDEED

SEQ ID NO: 2169736 - protein, 23 aa, Cryptosporidium hominis
EDDLKGKLIHHFSPSTITCPGIS

SEQ ID NO: 2169737 - protein, 18 aa, Cryptosporidium hominis
EDEFIRFSGCAKNQACTI

SEQ ID NO: 2169738 - protein, 24 aa, Cryptosporidium hominis
EDEFIVLACDGIWDVVDNQLCVDI

SEQ ID NO: 2169739 - protein, 23 aa, Cryptosporidium hominis
EDEFLLIACDGIFESFRDQEAIS

SEQ ID NO: 2169740 - protein, 26 aa, Cryptosporidium hominis
EDFFCSHSPFPVIWFSNYNDIQSFDI

SEQ ID NO: 2169741 - protein, 24 aa, Cryptosporidium hominis
EDFSKRNSISFNFILNTNNSNSNL

SEQ ID NO: 2169742 - protein, 18 aa, Cryptosporidium hominis
EDGAPVIRILKPGETDEC

SEQ ID NO: 2169743 - protein, 24 aa, Cryptosporidium hominis
EDGKLSAAEFIIFNTLVKVSIERN

SEQ ID NO: 2169744 - protein, 18 aa, Cryptosporidium hominis
EDGLYVFSCVCNVCNSKI

SEQ ID NO: 2169745 - protein, 24 aa, Cryptosporidium hominis
EDGNYPPICSVYGVPAKYLDPLTN

SEQ ID NO: 2169746 - protein, 22 aa, Cryptosporidium hominis
EDHCKFPLTFLLNINSKSPKQG

SEQ ID NO: 2169747 - protein, 20 aa, Cryptosporidium hominis
EDHIDYMVSYFRKYDLRGNG

SEQ ID NO: 2169748 - protein, 27 aa, Cryptosporidium hominis
EDIEINGCKASHIYKSLIQQNMSHMSI

SEQ ID NO: 2169749 - protein, 18 aa, Cryptosporidium hominis
EDIINALSTFGFGDYTDT

SEQ ID NO: 2169750 - protein, 24 aa, Cryptosporidium hominis
EDIKRWIYHSIEFTCNSIPKIDDN

SEQ ID NO: 2169751 - protein, 18 aa, Cryptosporidium hominis
EDILRYTLSRHLPQVKLN

SEQ ID NO: 2169752 - protein, 17 aa, Cryptosporidium hominis
EDIQVLDLWKLSILIGG

SEQ ID NO: 2169753 - protein, 18 aa, Cryptosporidium hominis
EDKEWAVEHGKLLTESGS

SEQ ID NO: 2169754 - protein, 26 aa, Cryptosporidium hominis
EDLARYSLKNNPEWLVLDQYREIGHK

SEQ ID NO: 2169755 - protein, 27 aa, Cryptosporidium hominis
EDLKRKRKVAIKVIRDVQRYTSAAKIE

SEQ ID NO: 2169756 - protein, 21 aa, Cryptosporidium hominis
EDLNQLLTFWKHESNMGDHPL

SEQ ID NO: 2169757 - protein, 24 aa, Cryptosporidium hominis
EDLPFNKMQFIWSSELDEHKRVKL

SEQ ID NO: 2169758 - protein, 20 aa, Cryptosporidium hominis
EDLQWSDWNSFVAAETTITN

SEQ ID NO: 2169759 - protein, 19 aa, Cryptosporidium hominis
EDLSSIQWFSIEDVGKIIY

SEQ ID NO: 2169760 - protein, 27 aa, Cryptosporidium hominis
EDLVDCKRILREIAILSRLNHDHIVKI

SEQ ID NO: 2169761 - protein, 27 aa, Cryptosporidium hominis
EDLYSGSIISRFIPRFILSLSSCNNCV

SEQ ID NO: 2169762 - protein, 23 aa, Cryptosporidium hominis
EDNEWYKAQFLEMKNELEKAISQ

SEQ ID NO: 2169763 - protein, 25 aa, Cryptosporidium hominis
EDNILNWERTVLKYFIFGGAIRVKI

SEQ ID NO: 2169764 - protein, 30 aa, Cryptosporidium hominis
EDNPMKLLELSNWISVLLEGIARQVVAFKG

SEQ ID NO: 2169765 - protein, 21 aa, Cryptosporidium hominis
EDPAWFGGMLKRIKNLVEEGI

SEQ ID NO: 2169766 - protein, 17 aa, Cryptosporidium hominis
EDPIEFIDSYSYIRDLP

SEQ ID NO: 2169767 - protein, 20 aa, Cryptosporidium hominis
EDQLRYEIQLSQPLSREERE

SEQ ID NO: 2169768 - protein, 19 aa, Cryptosporidium hominis
EDQVKIWRRSFDVPPPVLE

SEQ ID NO: 2169769 - protein, 18 aa, Cryptosporidium hominis
EDRLIPILNELKDMKMES

SEQ ID NO: 2169770 - protein, 24 aa, Cryptosporidium hominis
EDRTQLYYFVKWLSCPYDQCTWES

SEQ ID NO: 2169771 - protein, 18 aa, Cryptosporidium hominis
EDRWPGVENTFYFDKEIN

SEQ ID NO: 2169772 - protein, 22 aa, Cryptosporidium hominis
EDSFEWQLKYKNKMKGNMIFMA

SEQ ID NO: 2169773 - protein, 27 aa, Cryptosporidium hominis
EDSQKRLPDWAKRFHRILKVISQQEAF

SEQ ID NO: 2169774 - protein, 17 aa, Cryptosporidium hominis
EDSRCLASWMLNGLAEY

SEQ ID NO: 2169775 - protein, 34 aa, Cryptosporidium hominis
EDSSFRLPVELEMVKCPEFPVLDFHHWYENFQNS

SEQ ID NO: 2169776 - protein, 20 aa, Cryptosporidium hominis
EDTPTCGIGENFDKSNEVEV

SEQ ID NO: 2169777 - protein, 24 aa, Cryptosporidium hominis
EDVACKTSMEFTCAPATQKVAQVL

SEQ ID NO: 2169778 - protein, 23 aa, Cryptosporidium hominis
EDVFQRPWYISTIARDNRIKSWQ

SEQ ID NO: 2169779 - protein, 23 aa, Cryptosporidium hominis
EDVIRACKDYAFQISPYPIILSL

SEQ ID NO: 2169780 - protein, 19 aa, Cryptosporidium hominis
EDVLIAFELLSYAMFGEVI

SEQ ID NO: 2169781 - protein, 23 aa, Cryptosporidium hominis
EDWKHVSFLAIDLIRKLLTYNPA

SEQ ID NO: 2169782 - protein, 18 aa, Cryptosporidium hominis
EDYFGYDVYLVMNITDID

SEQ ID NO: 2169783 - protein, 29 aa, Cryptosporidium hominis
EDYLKSVCAINCWGLFASNLISFQNLMNV

SEQ ID NO: 2169784 - protein, 26 aa, Cryptosporidium hominis
EEAIAWKQFLDQQMQVIARKLERRIS

SEQ ID NO: 2169785 - protein, 26 aa, Cryptosporidium hominis
EEDFKTSFSYFYEAFEAFNIANDERA

SEQ ID NO: 2169786 - protein, 36 aa, Cryptosporidium hominis
EEDHKPRLLVKLLLEQGEGLTVVFVEMKRRADQIED

SEQ ID NO: 2169787 - protein, 30 aa, Cryptosporidium hominis
EEDLQELFKTAGRVVKVFLAKNKNNSKNTK

SEQ ID NO: 2169788 - protein, 17 aa, Cryptosporidium hominis
EEDLSTISFSWRFGAFS

SEQ ID NO: 2169789 - protein, 23 aa, Cryptosporidium hominis
EEDSLCAIREAYEELGIDVTKHL

SEQ ID NO: 2169790 - protein, 44 aa, Cryptosporidium hominis
EEDVVGSPQCGPYCSTYPKGYFAFWLTYDSKYNYFIISVNSNND

SEQ ID NO: 2169791 - protein, 25 aa, Cryptosporidium hominis
EEDWQIWYLLSWCSLVSEDVSGAIE

SEQ ID NO: 2169792 - protein, 21 aa, Cryptosporidium hominis
EEEAIPLFVVFDESMITENNL

SEQ ID NO: 2169793 - protein, 23 aa, Cryptosporidium hominis
EEEASSLLFEFMVTLQERFYSWL

SEQ ID NO: 2169794 - protein, 17 aa, Cryptosporidium hominis
EEEEFVYFLSRIPNLSK

SEQ ID NO: 2169795 - protein, 31 aa, Cryptosporidium hominis
EEEFWKHRAKLYRFVNGEWKERGVGNAKLLQ

SEQ ID NO: 2169796 - protein, 23 aa, Cryptosporidium hominis
EEEGRLKPWLPNSEYNVIYRDGE

SEQ ID NO: 2169797 - protein, 25 aa, Cryptosporidium hominis
EEELDWKLQNIIKFLNSVENKLDSY

SEQ ID NO: 2169798 - protein, 19 aa, Cryptosporidium hominis
EEEREGALFYILNKIFTKR

SEQ ID NO: 2169799 - protein, 25 aa, Cryptosporidium hominis
EEERRKWDYSWQIGKTQVFVKDSLQ

SEQ ID NO: 2169800 - protein, 20 aa, Cryptosporidium hominis
EEFFTCRKLYNESKLAACEY

SEQ ID NO: 2169801 - protein, 17 aa, Cryptosporidium hominis
EEFKVFLYVTNNLSIDQ

SEQ ID NO: 2169802 - protein, 22 aa, Cryptosporidium hominis
EEFPDRILQTFSVFPSPKVSDT

SEQ ID NO: 2169803 - protein, 27 aa, Cryptosporidium hominis
EEFVHFLFREGFLVKGSRMESYDFHSI

SEQ ID NO: 2169804 - protein, 18 aa, Cryptosporidium hominis
EEHKFLSFIDSFYAQMEL

SEQ ID NO: 2169805 - protein, 25 aa, Cryptosporidium hominis
EEHVLSFPMSYIFFSTYGRKFADKI

SEQ ID NO: 2169806 - protein, 25 aa, Cryptosporidium hominis
EEIEKWLICRKMKFPRSVCSKNHLI

SEQ ID NO: 2169807 - protein, 17 aa, Cryptosporidium hominis
EEIENIKSLQFRAQDSI

SEQ ID NO: 2169808 - protein, 34 aa, Cryptosporidium hominis
EEILGAFNLLNWLKGRVSICLGRNLENNIEEISV

SEQ ID NO: 2169809 - protein, 21 aa, Cryptosporidium hominis
EEILRLTSRVFANAYEVIGIP

SEQ ID NO: 2169810 - protein, 20 aa, Cryptosporidium hominis
EEINRIVAIVANPLQFNIPS

SEQ ID NO: 2169811 - protein, 23 aa, Cryptosporidium hominis
EEIPQQCPIGFVFVESVRKCIKK

SEQ ID NO: 2169812 - protein, 17 aa, Cryptosporidium hominis
EEIQEIIKKVADTHTEY

SEQ ID NO: 2169813 - protein, 17 aa, Cryptosporidium hominis
EEIRQNLTLAINFLVSL

SEQ ID NO: 2169814 - protein, 25 aa, Cryptosporidium hominis
EEKEFKMNLCLISLNRMDFELNMEC

SEQ ID NO: 2169815 - protein, 17 aa, Cryptosporidium hominis
EEKFGFGAINNRGSASL

SEQ ID NO: 2169816 - protein, 33 aa, Cryptosporidium hominis
EEKKRGICRLVRRSDYYISYFIDFSDLEKKLIN

SEQ ID NO: 2169817 - protein, 25 aa, Cryptosporidium hominis
EEKLSWLPNIEILDMPEKVDLTLPC

SEQ ID NO: 2169818 - protein, 19 aa, Cryptosporidium hominis
EELAMPMHIHITAESQYKL

SEQ ID NO: 2169819 - protein, 27 aa, Cryptosporidium hominis
EELCACVSIIPSVRSIYKFKGQVHDEN

SEQ ID NO: 2169820 - protein, 20 aa, Cryptosporidium hominis
EELDLYLLVLRVVSKKADIV

SEQ ID NO: 2169821 - protein, 26 aa, Cryptosporidium hominis
EELEILDRISFIWGYNNDNMYKINII

SEQ ID NO: 2169822 - protein, 21 aa, Cryptosporidium hominis
EELICFVCCRAFGSIWEKVNH

SEQ ID NO: 2169823 - protein, 21 aa, Cryptosporidium hominis
EELKSNWSYTTGVKNLSSVSC

SEQ ID NO: 2169824 - protein, 22 aa, Cryptosporidium hominis
EELKVFRSALGLDKPTRGRYKQ

SEQ ID NO: 2169825 - protein, 17 aa, Cryptosporidium hominis
EELLKYLFSKRDLNEET

SEQ ID NO: 2169826 - protein, 17 aa, Cryptosporidium hominis
EELNGIGSFHIMEDSSN

SEQ ID NO: 2169827 - protein, 18 aa, Cryptosporidium hominis
EELSEKYLSGVFEQQTMS

SEQ ID NO: 2169828 - protein, 20 aa, Cryptosporidium hominis
EELTKLNGIGVWSAEMAMIF

SEQ ID NO: 2169829 - protein, 17 aa, Cryptosporidium hominis
EELVSLSHILPHYCFGN

SEQ ID NO: 2169830 - protein, 24 aa, Cryptosporidium hominis
EENARLLIFEIYCRIHKSIDLNVI

SEQ ID NO: 2169831 - protein, 26 aa, Cryptosporidium hominis
EENNFELLLCHPFNLSLNKYNAINKL

SEQ ID NO: 2169832 - protein, 22 aa, Cryptosporidium hominis
EENRKLNIFAYIGRLEDEIANL

SEQ ID NO: 2169833 - protein, 29 aa, Cryptosporidium hominis
EEPFMQLFCGLFFQLSYFITFAQILSDKS

SEQ ID NO: 2169834 - protein, 26 aa, Cryptosporidium hominis
EEPKELKRSLGLIMLRGENIVTFVAE

SEQ ID NO: 2169835 - protein, 18 aa, Cryptosporidium hominis
EEPTGISNYNSFPINEPN

SEQ ID NO: 2169836 - protein, 23 aa, Cryptosporidium hominis
EEQFNLWKMAFKSEMIEKKIWKD

SEQ ID NO: 2169837 - protein, 19 aa, Cryptosporidium hominis
EEQIFKWIYDRNIDYSRYQ

SEQ ID NO: 2169838 - protein, 18 aa, Cryptosporidium hominis
EEQNLGRLRMPKTVNKFG

SEQ ID NO: 2169839 - protein, 26 aa, Cryptosporidium hominis
EERKKFVPRCCFFGGKAAPGYATAKT

SEQ ID NO: 2169840 - protein, 21 aa, Cryptosporidium hominis
EERLRGILLDHFLIQISQIRI

SEQ ID NO: 2169841 - protein, 24 aa, Cryptosporidium hominis
EERNFKSFLTRNIEEGGDPIESLN

SEQ ID NO: 2169842 - protein, 25 aa, Cryptosporidium hominis
EERSRHPYIRYSYNFEQDRNRRIAL

SEQ ID NO: 2169843 - protein, 28 aa, Cryptosporidium hominis
EESAALFYSRWFDFELLRSANLKEVIIS

SEQ ID NO: 2169844 - protein, 18 aa, Cryptosporidium hominis
EESIVVVLFKIRNLMRNL

SEQ ID NO: 2169845 - protein, 24 aa, Cryptosporidium hominis
EESKRIIKDICNYLLFNEEMSIRM

SEQ ID NO: 2169846 - protein, 24 aa, Cryptosporidium hominis
EESPDVLKAIGYCHTSSFYTVKSL

SEQ ID NO: 2169847 - protein, 20 aa, Cryptosporidium hominis
EESRCIASIDYLTHVVKKNN

SEQ ID NO: 2169848 - protein, 20 aa, Cryptosporidium hominis
EESRKFCFGTGIRTNVLYGG

SEQ ID NO: 2169849 - protein, 29 aa, Cryptosporidium hominis
EESYMLLSCLHRYHYSCVLNNISAVTPSG

SEQ ID NO: 2169850 - protein, 17 aa, Cryptosporidium hominis
EETEKALQLDGFACMGS

SEQ ID NO: 2169851 - protein, 38 aa, Cryptosporidium hominis
EETIEYRDGMKLSLGVDGRKLLLKRIRETRSSRENEIN

SEQ ID NO: 2169852 - protein, 34 aa, Cryptosporidium hominis
EETKSQRFLLIFIRISLLDFKRIILEIMEEIQKK

SEQ ID NO: 2169853 - protein, 25 aa, Cryptosporidium hominis
EEVFKALDFLFFIYGQLGFTFDLFL

SEQ ID NO: 2169854 - protein, 17 aa, Cryptosporidium hominis
EEVLLLCDRCDRGYHTY

SEQ ID NO: 2169855 - protein, 27 aa, Cryptosporidium hominis
EEVQYRIPLLNCHVGDWQPVDSDRVVF

SEQ ID NO: 2169856 - protein, 20 aa, Cryptosporidium hominis
EEVSRYYNVFLKRYKELPGG

SEQ ID NO: 2169857 - protein, 29 aa, Cryptosporidium hominis
EEVTNGFSKWQVCRSFLATLMLSNNREID

SEQ ID NO: 2169858 - protein, 19 aa, Cryptosporidium hominis
EEYFKESNFITNITQNSTQ

SEQ ID NO: 2169859 - protein, 21 aa, Cryptosporidium hominis
EEYLELPIAYISRLTDCHHLL

SEQ ID NO: 2169860 - protein, 25 aa, Cryptosporidium hominis
EEYMKILLSRRGLKFSGKKDTKFIE

SEQ ID NO: 2169861 - protein, 32 aa, Cryptosporidium hominis
EEYPEFKGIFDLPGSIIIKLDLGKFGGNKPIF

SEQ ID NO: 2169862 - protein, 23 aa, Cryptosporidium hominis
EFAQYYLHMAFVFDDSSLFTHIA

SEQ ID NO: 2169863 - protein, 17 aa, Cryptosporidium hominis
EFCFTELNNIIPISLEE

SEQ ID NO: 2169864 - protein, 19 aa, Cryptosporidium hominis
EFCNGAWRVLVKKQQRYSF

SEQ ID NO: 2169865 - protein, 25 aa, Cryptosporidium hominis
EFCTLCHVPMCRLCRPSHTHADEKT

SEQ ID NO: 2169866 - protein, 33 aa, Cryptosporidium hominis
EFCTRSWRDAKAWRYSLLVARKSKMADNSYEEA

SEQ ID NO: 2169867 - protein, 24 aa, Cryptosporidium hominis
EFCYEIPKKMGIFCNTTILKKEEI

SEQ ID NO: 2169868 - protein, 26 aa, Cryptosporidium hominis
EFDQRLPGELGRRLRIDDSDFNDIDQ

SEQ ID NO: 2169869 - protein, 19 aa, Cryptosporidium hominis
EFDRARLAGNTGITTLTTN

SEQ ID NO: 2169870 - protein, 20 aa, Cryptosporidium hominis
EFEEAIKLNLGGYYYIYQRT

SEQ ID NO: 2169871 - protein, 17 aa, Cryptosporidium hominis
EFEEKFPNIAVWSKESP

SEQ ID NO: 2169872 - protein, 18 aa, Cryptosporidium hominis
EFEFPVRVFRNITPDYDS

SEQ ID NO: 2169873 - protein, 26 aa, Cryptosporidium hominis
EFEKLNKLKSALSELGDFNKKLLEEN

SEQ ID NO: 2169874 - protein, 24 aa, Cryptosporidium hominis
EFEKQLRCDFTMFDSFEMNLVDKI

SEQ ID NO: 2169875 - protein, 22 aa, Cryptosporidium hominis
EFEQLKLLFRHFSTIHHGMHAL

SEQ ID NO: 2169876 - protein, 23 aa, Cryptosporidium hominis
EFEYCKRENFFLLEERCKESIYY

SEQ ID NO: 2169877 - protein, 17 aa, Cryptosporidium hominis
EFFQLLVQEIFNIDFGM

SEQ ID NO: 2169878 - protein, 25 aa, Cryptosporidium hominis
EFGDFSTPYSSWFEGLGSCYSEIED

SEQ ID NO: 2169879 - protein, 25 aa, Cryptosporidium hominis
EFGIKEPKIKWVNDIYVNGKKIGGI

SEQ ID NO: 2169880 - protein, 25 aa, Cryptosporidium hominis
EFGKETSCASWACYYNSRYSGSDIK

SEQ ID NO: 2169881 - protein, 19 aa, Cryptosporidium hominis
EFHVRNLLCSLLRDDLHAF

SEQ ID NO: 2169882 - protein, 21 aa, Cryptosporidium hominis
EFIFSCLKTIYPLNSKLLEAI

SEQ ID NO: 2169883 - protein, 18 aa, Cryptosporidium hominis
EFIQEHFIFWQRSSNTPE

SEQ ID NO: 2169884 - protein, 20 aa, Cryptosporidium hominis
EFIQRIIIHGTYLDKWKNIK

SEQ ID NO: 2169885 - protein, 20 aa, Cryptosporidium hominis
EFLEQIRPQIPLIEAASPGA

SEQ ID NO: 2169886 - protein, 19 aa, Cryptosporidium hominis
EFLGIDWRKEQNIVNPKSN

SEQ ID NO: 2169887 - protein, 26 aa, Cryptosporidium hominis
EFLVDWRFWFCPDSNMLETGEDLYFR

SEQ ID NO: 2169888 - protein, 24 aa, Cryptosporidium hominis
EFMERLKIPLLWVPGTSAGIFKAG

SEQ ID NO: 2169889 - protein, 26 aa, Cryptosporidium hominis
EFNGPSYFCSYSFASVFSRMGPSSWP

SEQ ID NO: 2169890 - protein, 26 aa, Cryptosporidium hominis
EFPNPCPSREVLFFTSGFKNVQTQMI

SEQ ID NO: 2169891 - protein, 20 aa, Cryptosporidium hominis
EFPTGSTLYCKGSGVVDCIA

SEQ ID NO: 2169892 - protein, 23 aa, Cryptosporidium hominis
EFQIISSIIYEWENLFGEKDIFC

SEQ ID NO: 2169893 - protein, 24 aa, Cryptosporidium hominis
EFREYRFGQILPVSIHQFFKEKSL

SEQ ID NO: 2169894 - protein, 19 aa, Cryptosporidium hominis
EFSEFGLTLSHITLTEGTQ

SEQ ID NO: 2169895 - protein, 22 aa, Cryptosporidium hominis
EFSPFYSCLLVSASQDKTIKLW

SEQ ID NO: 2169896 - protein, 19 aa, Cryptosporidium hominis
EFSRYIRRFYSVIIPDSDN

SEQ ID NO: 2169897 - protein, 19 aa, Cryptosporidium hominis
EFTCPGMLHSPRAQLLFSK

SEQ ID NO: 2169898 - protein, 18 aa, Cryptosporidium hominis
EFVGIGLNTGENVPFEMK

SEQ ID NO: 2169899 - protein, 17 aa, Cryptosporidium hominis
EFVRMSEAWKCKFCNVI

SEQ ID NO: 2169900 - protein, 24 aa, Cryptosporidium hominis
EFYDLRAPSTFKVRNFGTTIASKN

SEQ ID NO: 2169901 - protein, 20 aa, Cryptosporidium hominis
EFYSELSIISRIRHPNVTLF

SEQ ID NO: 2169902 - protein, 21 aa, Cryptosporidium hominis
EGASLSGIGAVIGNNETNEGL

SEQ ID NO: 2169903 - protein, 23 aa, Cryptosporidium hominis
EGAYKYSTETGFIVWSFQGRQLY

SEQ ID NO: 2169904 - protein, 22 aa, Cryptosporidium hominis
EGCAPYRFIHRDIKTINMLINR

SEQ ID NO: 2169905 - protein, 26 aa, Cryptosporidium hominis
EGCIEFSRNPTIRNWLGSGLYLNKSH

SEQ ID NO: 2169906 - protein, 26 aa, Cryptosporidium hominis
EGCVEILKWLSYVPECVGGRLPIMVD

SEQ ID NO: 2169907 - protein, 19 aa, Cryptosporidium hominis
EGDCVLKATKVINTSDENI

SEQ ID NO: 2169908 - protein, 20 aa, Cryptosporidium hominis
EGEFRFRRGYLKSKNPRKMV

SEQ ID NO: 2169909 - protein, 28 aa, Cryptosporidium hominis
EGEIEFKSLLFIPSHPPFDMFDTYMGKS

SEQ ID NO: 2169910 - protein, 21 aa, Cryptosporidium hominis
EGFLTRLGRKMAELPMEPKLS

SEQ ID NO: 2169911 - protein, 19 aa, Cryptosporidium hominis
EGFTTIPDISWENVGALNE

SEQ ID NO: 2169912 - protein, 19 aa, Cryptosporidium hominis
EGGIPLVKLVETVVPDVEV

SEQ ID NO: 2169913 - protein, 23 aa, Cryptosporidium hominis
EGGKDASAARYIFTKLSKWTRYI

SEQ ID NO: 2169914 - protein, 18 aa, Cryptosporidium hominis
EGGLLFCVTFKMISFRPY

SEQ ID NO: 2169915 - protein, 23 aa, Cryptosporidium hominis
EGHSRPIFGLDVHPDGALVVSGD

SEQ ID NO: 2169916 - protein, 26 aa, Cryptosporidium hominis
EGIFWHPINKVWIGVWLDSITHETCT

SEQ ID NO: 2169917 - protein, 17 aa, Cryptosporidium hominis
EGIKHKKNEIFLDVIEK

SEQ ID NO: 2169918 - protein, 19 aa, Cryptosporidium hominis
EGIPDGWMGLDIGPESSNS

SEQ ID NO: 2169919 - protein, 29 aa, Cryptosporidium hominis
EGKKLLILKRRCINYFSFGEESRVGITFD

SEQ ID NO: 2169920 - protein, 17 aa, Cryptosporidium hominis
EGKMIFHRFHKRKWKMY

SEQ ID NO: 2169921 - protein, 21 aa, Cryptosporidium hominis
EGKQMLARVVGWKLYGTQVTH

SEQ ID NO: 2169922 - protein, 22 aa, Cryptosporidium hominis
EGKRIPFGFRDRSLPHFLKYDY

SEQ ID NO: 2169923 - protein, 18 aa, Cryptosporidium hominis
EGKSECFSNICDETKKNN

SEQ ID NO: 2169924 - protein, 17 aa, Cryptosporidium hominis
EGLHILVRYNEPRELEI

SEQ ID NO: 2169925 - protein, 19 aa, Cryptosporidium hominis
EGLIICNIPSFSGGVNLWK

SEQ ID NO: 2169926 - protein, 17 aa, Cryptosporidium hominis
EGLKRGIGIHHDGLSLR

SEQ ID NO: 2169927 - protein, 20 aa, Cryptosporidium hominis
EGLLRKLLAFKEVNLDFIPY

SEQ ID NO: 2169928 - protein, 17 aa, Cryptosporidium hominis
EGLNCDIYWKNDDFRGN

SEQ ID NO: 2169929 - protein, 19 aa, Cryptosporidium hominis
EGLNWPRINISEISSENIR

SEQ ID NO: 2169930 - protein, 28 aa, Cryptosporidium hominis
EGLYDRFSRWSVLLGFSLPNLVEESEEL

SEQ ID NO: 2169931 - protein, 26 aa, Cryptosporidium hominis
EGLYGPECDEWSAGVMMYVLLCGYPP

SEQ ID NO: 2169932 - protein, 18 aa, Cryptosporidium hominis
EGMWYKDQAIGLYILQAN

SEQ ID NO: 2169933 - protein, 23 aa, Cryptosporidium hominis
EGNQLIFPPGYKIPALSKSKKED

SEQ ID NO: 2169934 - protein, 42 aa, Cryptosporidium hominis
EGNSRGELYLTLDELRWVQLHVRPEFGFILSPTAPKTQKQKK

SEQ ID NO: 2169935 - protein, 22 aa, Cryptosporidium hominis
EGPRNVGGYGYIGSNELNSIIK

SEQ ID NO: 2169936 - protein, 28 aa, Cryptosporidium hominis
EGRKRRWEFVIEWRNVFLKSEQYNSKSA

SEQ ID NO: 2169937 - protein, 21 aa, Cryptosporidium hominis
EGRNNLFLKRDEIIIRKISHM

SEQ ID NO: 2169938 - protein, 22 aa, Cryptosporidium hominis
EGRRISMEPLDIGELNTSSTSN

SEQ ID NO: 2169939 - protein, 28 aa, Cryptosporidium hominis
EGRVKLFPPELLSALAECISKENSLLRD

SEQ ID NO: 2169940 - protein, 20 aa, Cryptosporidium hominis
EGSGSGHLRFYLARKITEDD

SEQ ID NO: 2169941 - protein, 28 aa, Cryptosporidium hominis
EGSKTWDRYEMRIYKRVIDLYSSSDVVK

SEQ ID NO: 2169942 - protein, 24 aa, Cryptosporidium hominis
EGSLRSNAIISIFESYCVEKNPST

SEQ ID NO: 2169943 - protein, 22 aa, Cryptosporidium hominis
EGSYKIKLIFDEAVSEFMEPNI

SEQ ID NO: 2169944 - protein, 25 aa, Cryptosporidium hominis
EGTDRRLDCWLTWESLRVIPNEYLP

SEQ ID NO: 2169945 - protein, 28 aa, Cryptosporidium hominis
EGTFRPERIVKIAERFGVQGDVALDNIM

SEQ ID NO: 2169946 - protein, 20 aa, Cryptosporidium hominis
EGTLGYPSNYSIEWDFVNYQ

SEQ ID NO: 2169947 - protein, 19 aa, Cryptosporidium hominis
EGVEESWAPAVEYYTGYTR

SEQ ID NO: 2169948 - protein, 19 aa, Cryptosporidium hominis
EGYFHGRLAINFEAIVNDQ

SEQ ID NO: 2169949 - protein, 18 aa, Cryptosporidium hominis
EGYSSSYVPAPKVGINVN

SEQ ID NO: 2169950 - protein, 22 aa, Cryptosporidium hominis
EHAESVLRKYSGIKSVNGGRGI

SEQ ID NO: 2169951 - protein, 25 aa, Cryptosporidium hominis
EHALDLFSAFFICPLFDTKYVDREV

SEQ ID NO: 2169952 - protein, 19 aa, Cryptosporidium hominis
EHDKFLLNWKRYCKTIPLR

SEQ ID NO: 2169953 - protein, 23 aa, Cryptosporidium hominis
EHFKEVFPISFRTNIPLLCESFV

SEQ ID NO: 2169954 - protein, 22 aa, Cryptosporidium hominis
EHGLKCCVRAKIDMQCKNKCMR

SEQ ID NO: 2169955 - protein, 19 aa, Cryptosporidium hominis
EHIEFQLKVSICEVYMERI

SEQ ID NO: 2169956 - protein, 20 aa, Cryptosporidium hominis
EHISRLLSVLLEEFKSMGKE

SEQ ID NO: 2169957 - protein, 24 aa, Cryptosporidium hominis
EHIYCCLVCGINYQGKGKGSMAYK

SEQ ID NO: 2169958 - protein, 24 aa, Cryptosporidium hominis
EHKLPSGFQRPSWSSQQHSIVEQW

SEQ ID NO: 2169959 - protein, 20 aa, Cryptosporidium hominis
EHKQWGTAVFNFRRNEVRSF

SEQ ID NO: 2169960 - protein, 20 aa, Cryptosporidium hominis
EHLVKLIALKNVFARQLPKM

SEQ ID NO: 2169961 - protein, 18 aa, Cryptosporidium hominis
EHMDMVWINDYHLLLLCQ

SEQ ID NO: 2169962 - protein, 19 aa, Cryptosporidium hominis
EHMRTCKEILSGKSLDEIT

SEQ ID NO: 2169963 - protein, 18 aa, Cryptosporidium hominis
EHQGVMFAPPYKVHNVPL

SEQ ID NO: 2169964 - protein, 25 aa, Cryptosporidium hominis
EHTGGKLPFWLSPRQAIVLSISEKT

SEQ ID NO: 2169965 - protein, 18 aa, Cryptosporidium hominis
EHVRFCIICNYVNKITPA

SEQ ID NO: 2169966 - protein, 27 aa, Cryptosporidium hominis
EHYQRSPTCWRLVMRHIGILDFDSNQN

SEQ ID NO: 2169967 - protein, 24 aa, Cryptosporidium hominis
EIAEVCIQLGIPCKVESKRYSRDC

SEQ ID NO: 2169968 - protein, 20 aa, Cryptosporidium hominis
EIAISYFIECFLRKNRENSA

SEQ ID NO: 2169969 - protein, 18 aa, Cryptosporidium hominis
EIALKALQLFDSSNELDL

SEQ ID NO: 2169970 - protein, 19 aa, Cryptosporidium hominis
EIANKLGLIEILEKENEEI

SEQ ID NO: 2169971 - protein, 23 aa, Cryptosporidium hominis
EIAPRNGLLRVREFQMAEIEHFI

SEQ ID NO: 2169972 - protein, 25 aa, Cryptosporidium hominis
EIARLKLRYQEAYGHFMSEKRKRDS

SEQ ID NO: 2169973 - protein, 21 aa, Cryptosporidium hominis
EIDEKFLFYLFSNFGKILSLK

SEQ ID NO: 2169974 - protein, 18 aa, Cryptosporidium hominis
EIDLPDVMSIRLDRKLSA

SEQ ID NO: 2169975 - protein, 17 aa, Cryptosporidium hominis
EIDLSSFGHIINYFHRT

SEQ ID NO: 2169976 - protein, 20 aa, Cryptosporidium hominis
EIDMSSDLLIRVYTKDESHS

SEQ ID NO: 2169977 - protein, 20 aa, Cryptosporidium hominis
EIDMVWRIFRYFGTPTEESW

SEQ ID NO: 2169978 - protein, 20 aa, Cryptosporidium hominis
EIECNRKAEVERMQKLRNTL

SEQ ID NO: 2169979 - protein, 24 aa, Cryptosporidium hominis
EIEDFWYKNIEGINNIQGFDYSSM

SEQ ID NO: 2169980 - protein, 20 aa, Cryptosporidium hominis
EIEDLLKHGAYYLLEGSEAS

SEQ ID NO: 2169981 - protein, 24 aa, Cryptosporidium hominis
EIEKRIPDPLLFSIIESIQKIYNP

SEQ ID NO: 2169982 - protein, 22 aa, Cryptosporidium hominis
EIEKVWKPKVEEINSKCEDYLF

SEQ ID NO: 2169983 - protein, 22 aa, Cryptosporidium hominis
EIELQIGDIFGFLKERGLYKPN

SEQ ID NO: 2169984 - protein, 29 aa, Cryptosporidium hominis
EIEPISKDEGFNWCGNTVSRITNNESNKL

SEQ ID NO: 2169985 - protein, 21 aa, Cryptosporidium hominis
EIERLKVRMAKECEEEQMESV

SEQ ID NO: 2169986 - protein, 19 aa, Cryptosporidium hominis
EIFCQRLSNTIGRNVTKEE

SEQ ID NO: 2169987 - protein, 25 aa, Cryptosporidium hominis
EIFDSIYIPYRLVKSNSLEEISTYL

SEQ ID NO: 2169988 - protein, 25 aa, Cryptosporidium hominis
EIFGMLDVKKGLLLQLIGGVTNQVN

SEQ ID NO: 2169989 - protein, 32 aa, Cryptosporidium hominis
EIFIGTIHSFCWKLLKEYGSFIGLPKDIAIID

SEQ ID NO: 2169990 - protein, 20 aa, Cryptosporidium hominis
EIFLKSFLIENFSVYIDEIS

SEQ ID NO: 2169991 - protein, 18 aa, Cryptosporidium hominis
EIFLKYSKLMNNYYDEDI

SEQ ID NO: 2169992 - protein, 17 aa, Cryptosporidium hominis
EIFRVMLESNPQLKALR

SEQ ID NO: 2169993 - protein, 19 aa, Cryptosporidium hominis
EIFWNSYFLTRLCRNTRLR

SEQ ID NO: 2169994 - protein, 18 aa, Cryptosporidium hominis
EIGEGVTIFCITELYIVS

SEQ ID NO: 2169995 - protein, 22 aa, Cryptosporidium hominis
EIGGYCCECYYNNNNNNNNNNN

SEQ ID NO: 2169996 - protein, 24 aa, Cryptosporidium hominis
EIGNLDMLLKYSWENETSLLSYYY

SEQ ID NO: 2169997 - protein, 25 aa, Cryptosporidium hominis
EIGRATFEGGGGFISHILPNRKPVS

SEQ ID NO: 2169998 - protein, 18 aa, Cryptosporidium hominis
EIHKELNNRCIIEIEKKE

SEQ ID NO: 2169999 - protein, 23 aa, Cryptosporidium hominis
EIIDELRMKLDLIQGNISMVDEF

SEQ ID NO: 2170000 - protein, 22 aa, Cryptosporidium hominis
EIIDLFRFSDKYGIKSLYNACV

SEQ ID NO: 2170001 - protein, 17 aa, Cryptosporidium hominis
EIIEAYNHCKGYYNEKG

SEQ ID NO: 2170002 - protein, 24 aa, Cryptosporidium hominis
EIIGGCSRIPWVQRAIGAAFNDKE

SEQ ID NO: 2170003 - protein, 18 aa, Cryptosporidium hominis
EIIKLAGFNSLLDVPEAP

SEQ ID NO: 2170004 - protein, 26 aa, Cryptosporidium hominis
EIILKSKKCRFMIHILAINYKGKHKE

SEQ ID NO: 2170005 - protein, 19 aa, Cryptosporidium hominis
EIINRVAACIRMTAVDSDQ

SEQ ID NO: 2170006 - protein, 18 aa, Cryptosporidium hominis
EIIPEIRKTTNLDEKRDR

SEQ ID NO: 2170007 - protein, 18 aa, Cryptosporidium hominis
EIIQWAKECNAFIEVPKL

SEQ ID NO: 2170008 - protein, 22 aa, Cryptosporidium hominis
EIIRGGLSLDLFSRIRDALSSL

SEQ ID NO: 2170009 - protein, 19 aa, Cryptosporidium hominis
EIIRLKRNSSLWCSHYYSR

SEQ ID NO: 2170010 - protein, 17 aa, Cryptosporidium hominis
EIIRNSISFRYSFMKSK

SEQ ID NO: 2170011 - protein, 23 aa, Cryptosporidium hominis
EIISDMNGSFIIGNKSNESENNQ

SEQ ID NO: 2170012 - protein, 19 aa, Cryptosporidium hominis
EIITGLGVIKSDQNEEFIV

SEQ ID NO: 2170013 - protein, 26 aa, Cryptosporidium hominis
EIKEIAEFLIYYRFREVIRDKDDYDD

SEQ ID NO: 2170014 - protein, 25 aa, Cryptosporidium hominis
EIKEIRRIAKMLVWLQENNPKTSAS

SEQ ID NO: 2170015 - protein, 22 aa, Cryptosporidium hominis
EIKKAYRRLAIKHHPDKGGDQE

SEQ ID NO: 2170016 - protein, 23 aa, Cryptosporidium hominis
EIKKEYRLRALALHPDKNQNDEK

SEQ ID NO: 2170017 - protein, 20 aa, Cryptosporidium hominis
EIKKRRGLSSASGMLKYKDI

SEQ ID NO: 2170018 - protein, 21 aa, Cryptosporidium hominis
EIKKWNAVALWSWDIVVDNCA

SEQ ID NO: 2170019 - protein, 25 aa, Cryptosporidium hominis
EIKQILKYKFDYYFDVSPRQISKQI

SEQ ID NO: 2170020 - protein, 24 aa, Cryptosporidium hominis
EILARLSQCRVINSKTIKLATNNN

SEQ ID NO: 2170021 - protein, 23 aa, Cryptosporidium hominis
EILDKELVGIIGMENSISLDDSS

SEQ ID NO: 2170022 - protein, 20 aa, Cryptosporidium hominis
EILFKISYALPNVGYCQGMN

SEQ ID NO: 2170023 - protein, 17 aa, Cryptosporidium hominis
EILFLTVHFMDNVLIKD

SEQ ID NO: 2170024 - protein, 19 aa, Cryptosporidium hominis
EILGHCDISPCNKIKDQSE

SEQ ID NO: 2170025 - protein, 23 aa, Cryptosporidium hominis
EILIKRRILLNIKNSSGQLANVI

SEQ ID NO: 2170026 - protein, 23 aa, Cryptosporidium hominis
EILKISLFAYFALKKAESHDFLR

SEQ ID NO: 2170027 - protein, 23 aa, Cryptosporidium hominis
EILKTTPIFVSIRIHTEKPSTQL

SEQ ID NO: 2170028 - protein, 17 aa, Cryptosporidium hominis
EILRLAYNIGTSIWHWS

SEQ ID NO: 2170029 - protein, 21 aa, Cryptosporidium hominis
EILRSRGIERLFPIQAQSFES

SEQ ID NO: 2170030 - protein, 17 aa, Cryptosporidium hominis
EILSSGFLVKKFSQDDV

SEQ ID NO: 2170031 - protein, 19 aa, Cryptosporidium hominis
EIMEISLTLIKNVTNILAP

SEQ ID NO: 2170032 - protein, 24 aa, Cryptosporidium hominis
EIMELPPSLWYVVLPQLLSRCQHP

SEQ ID NO: 2170033 - protein, 22 aa, Cryptosporidium hominis
EIMFIKRKVNLISQIYPINIDY

SEQ ID NO: 2170034 - protein, 21 aa, Cryptosporidium hominis
EIMLAFELITFLLRSGGNFEE

SEQ ID NO: 2170035 - protein, 19 aa, Cryptosporidium hominis
EINCIKSVVEWIKSLQTQE

SEQ ID NO: 2170036 - protein, 25 aa, Cryptosporidium hominis
EINIKLIDWGSCLSIDQASNTRNSY

SEQ ID NO: 2170037 - protein, 25 aa, Cryptosporidium hominis
EINNWKIKIELGIEEEKKTKTRILE

SEQ ID NO: 2170038 - protein, 22 aa, Cryptosporidium hominis
EINTCLIRDYLLKGLNKIEING

SEQ ID NO: 2170039 - protein, 31 aa, Cryptosporidium hominis
EINWPETHGWWLYCCHNGWLTIKRSVLIEVP

SEQ ID NO: 2170040 - protein, 23 aa, Cryptosporidium hominis
EIPELFRNIHFIIVDEVDRLLSQ

SEQ ID NO: 2170041 - protein, 18 aa, Cryptosporidium hominis
EIPFILVPLSSLYMENFS

SEQ ID NO: 2170042 - protein, 19 aa, Cryptosporidium hominis
EIPGEVKISQSIVRPNIFY

SEQ ID NO: 2170043 - protein, 24 aa, Cryptosporidium hominis
EIPNCKGENIVNCHHSFGDGIDKS

SEQ ID NO: 2170044 - protein, 19 aa, Cryptosporidium hominis
EIPNLPFLGKSIRVEEDIG

SEQ ID NO: 2170045 - protein, 25 aa, Cryptosporidium hominis
EIPSVYCCICKSSYGVNLACNHPGC

SEQ ID NO: 2170046 - protein, 20 aa, Cryptosporidium hominis
EIRDTCTYFPLRKLLIKSLL

SEQ ID NO: 2170047 - protein, 18 aa, Cryptosporidium hominis
EIREEIDEDIDISKSFIP

SEQ ID NO: 2170048 - protein, 26 aa, Cryptosporidium hominis
EIREKPSRFSPLLVDSSLVFPNDKSL

SEQ ID NO: 2170049 - protein, 18 aa, Cryptosporidium hominis
EIRICIKSLLGIIKEQFF

SEQ ID NO: 2170050 - protein, 20 aa, Cryptosporidium hominis
EIRKRYRIHFKRIQNEGEDN

SEQ ID NO: 2170051 - protein, 22 aa, Cryptosporidium hominis
EIRKSYRKLALKWHPDKNPDNR

SEQ ID NO: 2170052 - protein, 18 aa, Cryptosporidium hominis
EIRWCSCNIYSTQDHAAA

SEQ ID NO: 2170053 - protein, 19 aa, Cryptosporidium hominis
EISDLEFIGLIKTKVQEEF

SEQ ID NO: 2170054 - protein, 25 aa, Cryptosporidium hominis
EISHVKRKKLGIGDFQQISKAENFD

SEQ ID NO: 2170055 - protein, 20 aa, Cryptosporidium hominis
EISIIHPMYIDGHTSQGHGH

SEQ ID NO: 2170056 - protein, 27 aa, Cryptosporidium hominis
EISIPFSWSQPILKLKILEENDFKADI

SEQ ID NO: 2170057 - protein, 23 aa, Cryptosporidium hominis
EISKMDPCVYCLTINNNEENLEK

SEQ ID NO: 2170058 - protein, 20 aa, Cryptosporidium hominis
EISKSLLPIHLDIVKLSQIP

SEQ ID NO: 2170059 - protein, 27 aa, Cryptosporidium hominis
EISMLQKRHEMCVVQKNAIKDLINLHK

SEQ ID NO: 2170060 - protein, 20 aa, Cryptosporidium hominis
EISNRFGGVNNIHNYHHREN

SEQ ID NO: 2170061 - protein, 22 aa, Cryptosporidium hominis
EISPELKSLMSVDYSRRNLIKK

SEQ ID NO: 2170062 - protein, 19 aa, Cryptosporidium hominis
EISQLIWYQHIQPLSTEIV

SEQ ID NO: 2170063 - protein, 24 aa, Cryptosporidium hominis
EISREIYKGYGIKNETDGSVTETK

SEQ ID NO: 2170064 - protein, 20 aa, Cryptosporidium hominis
EISRIQGILKNFARESDKMD

SEQ ID NO: 2170065 - protein, 21 aa, Cryptosporidium hominis
EISTSIPLYCPLAIGYFWIDK

SEQ ID NO: 2170066 - protein, 20 aa, Cryptosporidium hominis
EISYAMLLGSNFALNYMFKV

SEQ ID NO: 2170067 - protein, 25 aa, Cryptosporidium hominis
EITDICFDLNMTLFLAWSPKEAGHI

SEQ ID NO: 2170068 - protein, 25 aa, Cryptosporidium hominis
EIVCHTRTAWKEVADNLKTGTAYFA

SEQ ID NO: 2170069 - protein, 23 aa, Cryptosporidium hominis
EIVKDIKETACFVSSNIQKDEND

SEQ ID NO: 2170070 - protein, 17 aa, Cryptosporidium hominis
EIVSSFFEVYFAYHEYY

SEQ ID NO: 2170071 - protein, 25 aa, Cryptosporidium hominis
EIYCVPEYARYGAIHSGYSPSPQVV

SEQ ID NO: 2170072 - protein, 20 aa, Cryptosporidium hominis
EIYNQLLFLYKFRLSNSYGT

SEQ ID NO: 2170073 - protein, 23 aa, Cryptosporidium hominis
EIYRDGLNFQNLMNLKNRLQGYL

SEQ ID NO: 2170074 - protein, 21 aa, Cryptosporidium hominis
EIYSNELKKKIGLNNNNSNNN

SEQ ID NO: 2170075 - protein, 37 aa, Cryptosporidium hominis
EKAAIRFLLINSPLHRRSHLKHFRFSESDEEGEEPYV

SEQ ID NO: 2170076 - protein, 17 aa, Cryptosporidium hominis
EKAETLSSFPLDQDTHN

SEQ ID NO: 2170077 - protein, 18 aa, Cryptosporidium hominis
EKAIKEAEFIAASESIKL

SEQ ID NO: 2170078 - protein, 22 aa, Cryptosporidium hominis
EKALKLGLILPKPNQFVSTDFS

SEQ ID NO: 2170079 - protein, 19 aa, Cryptosporidium hominis
EKANLLFDLFGYDDANRLS

SEQ ID NO: 2170080 - protein, 19 aa, Cryptosporidium hominis
EKARIIGTRALQISMNAPV

SEQ ID NO: 2170081 - protein, 24 aa, Cryptosporidium hominis
EKARNFFGRFGITGSLALEPLYVL

SEQ ID NO: 2170082 - protein, 24 aa, Cryptosporidium hominis
EKATEVVKFLKFVNKGNLAMALDI

SEQ ID NO: 2170083 - protein, 22 aa, Cryptosporidium hominis
EKAYRICFNLYFQEIYDFQLSL

SEQ ID NO: 2170084 - protein, 21 aa, Cryptosporidium hominis
EKCDFKLISFYKAVKGNIVNV

SEQ ID NO: 2170085 - protein, 23 aa, Cryptosporidium hominis
EKCKALRELIIWMTHGESYNRLL

SEQ ID NO: 2170086 - protein, 19 aa, Cryptosporidium hominis
EKCNKRVAFRYHNRQPEKC

SEQ ID NO: 2170087 - protein, 30 aa, Cryptosporidium hominis
EKCPFEVTECGWGEFDIMAKVYFVDSTEKP

SEQ ID NO: 2170088 - protein, 24 aa, Cryptosporidium hominis
EKCSVCSCHGTLLSCDICSKSIHK

SEQ ID NO: 2170089 - protein, 18 aa, Cryptosporidium hominis
EKCYLKKQPIPDFKDQSF

SEQ ID NO: 2170090 - protein, 25 aa, Cryptosporidium hominis
EKDAFILICSDGVWEFISSQEAVDI

SEQ ID NO: 2170091 - protein, 24 aa, Cryptosporidium hominis
EKDALLKIFRLVDEKALAQESLEE

SEQ ID NO: 2170092 - protein, 24 aa, Cryptosporidium hominis
EKDDIKLYGWKEYYSLKQASEVSL

SEQ ID NO: 2170093 - protein, 25 aa, Cryptosporidium hominis
EKDEKLDELVTIFSHKNNRKFSHDN

SEQ ID NO: 2170094 - protein, 24 aa, Cryptosporidium hominis
EKDGLWAVLAWLSILAHKNPDPTK

SEQ ID NO: 2170095 - protein, 22 aa, Cryptosporidium hominis
EKDLYRPLLFTNIVTSICREIP

SEQ ID NO: 2170096 - protein, 23 aa, Cryptosporidium hominis
EKEAKKALSNSLIKYNAKEYLFK

SEQ ID NO: 2170097 - protein, 31 aa, Cryptosporidium hominis
EKEEKTYFLRGLLYRIWKYNRNGKVINNSNQ

SEQ ID NO: 2170098 - protein, 20 aa, Cryptosporidium hominis
EKEFRLSSFDTQDAVVNAIS

SEQ ID NO: 2170099 - protein, 20 aa, Cryptosporidium hominis
EKEGLQRYVRDDGSNTITNK

SEQ ID NO: 2170100 - protein, 18 aa, Cryptosporidium hominis
EKEGWIRTGDICQLLPNG

SEQ ID NO: 2170101 - protein, 24 aa, Cryptosporidium hominis
EKELFPSFRIEVINYLKMRSQEYI

SEQ ID NO: 2170102 - protein, 23 aa, Cryptosporidium hominis
EKELKLQILEIYNSKLDERTYRK

SEQ ID NO: 2170103 - protein, 17 aa, Cryptosporidium hominis
EKELRRQARTCFNNSNV

SEQ ID NO: 2170104 - protein, 22 aa, Cryptosporidium hominis
EKEVGIKILIRLVEIQENKTQF

SEQ ID NO: 2170105 - protein, 18 aa, Cryptosporidium hominis
EKFLEFNRQTLESSSNET

SEQ ID NO: 2170106 - protein, 18 aa, Cryptosporidium hominis
EKFQEIYRQFAPLIDQRS

SEQ ID NO: 2170107 - protein, 20 aa, Cryptosporidium hominis
EKFWQLPLDPEFQEMVKSEI

SEQ ID NO: 2170108 - protein, 24 aa, Cryptosporidium hominis
EKGRLKVVKYQGVRYIQNYLKNRA

SEQ ID NO: 2170109 - protein, 19 aa, Cryptosporidium hominis
EKGVREMFIRFVLIYCRFI

SEQ ID NO: 2170110 - protein, 20 aa, Cryptosporidium hominis
EKHVEMAIKLFKNATIEAIK

SEQ ID NO: 2170111 - protein, 24 aa, Cryptosporidium hominis
EKIAELENALAIGEANKIESLKTY

SEQ ID NO: 2170112 - protein, 20 aa, Cryptosporidium hominis
EKICKKRNKLGCEMNISQSV

SEQ ID NO: 2170113 - protein, 19 aa, Cryptosporidium hominis
EKIDFWKSQFLRLVKKLLI

SEQ ID NO: 2170114 - protein, 18 aa, Cryptosporidium hominis
EKIELCVGIVDWKLESGE

SEQ ID NO: 2170115 - protein, 24 aa, Cryptosporidium hominis
EKIEMKRLLELNIMENENKKKEII

SEQ ID NO: 2170116 - protein, 17 aa, Cryptosporidium hominis
EKIHLCVQDGCESSFQL

SEQ ID NO: 2170117 - protein, 21 aa, Cryptosporidium hominis
EKIISKWRFYRLESKSLQGIK

SEQ ID NO: 2170118 - protein, 25 aa, Cryptosporidium hominis
EKIIWRLAYISVMGYEIDFGWLEIL

SEQ ID NO: 2170119 - protein, 17 aa, Cryptosporidium hominis
EKIKEISTMINVEDEDF

SEQ ID NO: 2170120 - protein, 23 aa, Cryptosporidium hominis
EKIKPFDMLIPFVNESGQIKFVT

SEQ ID NO: 2170121 - protein, 17 aa, Cryptosporidium hominis
EKIKVLIPGAGLGRLLF

SEQ ID NO: 2170122 - protein, 22 aa, Cryptosporidium hominis
EKIPDYCLEMISQVSSEFGLLK

SEQ ID NO: 2170123 - protein, 21 aa, Cryptosporidium hominis
EKIRTMLRMATNVNELNQAIK

SEQ ID NO: 2170124 - protein, 23 aa, Cryptosporidium hominis
EKISESFSQASFEVINKPKKVDI

SEQ ID NO: 2170125 - protein, 24 aa, Cryptosporidium hominis
EKIWLRGRITESRCKGSLGFVLLR

SEQ ID NO: 2170126 - protein, 24 aa, Cryptosporidium hominis
EKIYLKVRTSQFFPSKITESQNKK

SEQ ID NO: 2170127 - protein, 24 aa, Cryptosporidium hominis
EKKDLKLGRGHESDVRISDVSIST

SEQ ID NO: 2170128 - protein, 20 aa, Cryptosporidium hominis
EKKGNIAFIDVTLWDSKTNI

SEQ ID NO: 2170129 - protein, 21 aa, Cryptosporidium hominis
EKKKLIIQEDFVKGIIDGIKQ

SEQ ID NO: 2170130 - protein, 19 aa, Cryptosporidium hominis
EKKSTGLLAKTIAKAKAKS

SEQ ID NO: 2170131 - protein, 24 aa, Cryptosporidium hominis
EKKTKMELESCLKDELNLSNFNNE

SEQ ID NO: 2170132 - protein, 45 aa, Cryptosporidium hominis
EKLGAFLFPESVVFWRWLTPRILAIVGDKGIYHWTIESGNSNSIP

SEQ ID NO: 2170133 - protein, 26 aa, Cryptosporidium hominis
EKLIELVRLNVGLIFCIDEPSEVRKI

SEQ ID NO: 2170134 - protein, 26 aa, Cryptosporidium hominis
EKLIILSSYLAFLVFKVSKKNQTTEN

SEQ ID NO: 2170135 - protein, 22 aa, Cryptosporidium hominis
EKLKLSAWKYHNFRLNTLDAMF

SEQ ID NO: 2170136 - protein, 22 aa, Cryptosporidium hominis
EKLKQVMRQDGKIKDRVLNEEN

SEQ ID NO: 2170137 - protein, 17 aa, Cryptosporidium hominis
EKLKSDYFKNIRAGKIA

SEQ ID NO: 2170138 - protein, 18 aa, Cryptosporidium hominis
EKLLESFMFTSLDDDELK

SEQ ID NO: 2170139 - protein, 24 aa, Cryptosporidium hominis
EKLLKEERWSVCESGLDYITNEYI

SEQ ID NO: 2170140 - protein, 23 aa, Cryptosporidium hominis
EKLLLEFFERLEVIQSQDILCSR

SEQ ID NO: 2170141 - protein, 17 aa, Cryptosporidium hominis
EKLLLFSKECGISAQGL

SEQ ID NO: 2170142 - protein, 20 aa, Cryptosporidium hominis
EKLNELMGIFKKRESSDSQL

SEQ ID NO: 2170143 - protein, 17 aa, Cryptosporidium hominis
EKLNLKIRKKKDSTHES

SEQ ID NO: 2170144 - protein, 19 aa, Cryptosporidium hominis
EKLPSIISVIELGKNIESH

SEQ ID NO: 2170145 - protein, 21 aa, Cryptosporidium hominis
EKLRIAEGLSEREKELNIKQN

SEQ ID NO: 2170146 - protein, 17 aa, Cryptosporidium hominis
EKLRLAIESSSEKVSLQ

SEQ ID NO: 2170147 - protein, 21 aa, Cryptosporidium hominis
EKLSYLKIWVPSAHRPPKHQT

SEQ ID NO: 2170148 - protein, 25 aa, Cryptosporidium hominis
EKLVILFKLIHEFLNFYEINNTCRM

SEQ ID NO: 2170149 - protein, 21 aa, Cryptosporidium hominis
EKLVKRSNILTNLTSCDILSD

SEQ ID NO: 2170150 - protein, 25 aa, Cryptosporidium hominis
EKMDISNDLTFRYLLDTLQESYHNF

SEQ ID NO: 2170151 - protein, 17 aa, Cryptosporidium hominis
EKMMILGVGNIDHSSFK

SEQ ID NO: 2170152 - protein, 28 aa, Cryptosporidium hominis
EKMVRCPAQLYFIKRRIENIKENIENTE

SEQ ID NO: 2170153 - protein, 18 aa, Cryptosporidium hominis
EKNKGFFGTWNCFRRDHK

SEQ ID NO: 2170154 - protein, 29 aa, Cryptosporidium hominis
EKNKKFLEIKVWEETRIEKYQHFISAIDP

SEQ ID NO: 2170155 - protein, 23 aa, Cryptosporidium hominis
EKNLKVGSIIFVRIKKYNFSDNG

SEQ ID NO: 2170156 - protein, 22 aa, Cryptosporidium hominis
EKNSVCFKLNVKCTKDDINHEK

SEQ ID NO: 2170157 - protein, 24 aa, Cryptosporidium hominis
EKNTLLQMCRLISTLLEYFPNSFF

SEQ ID NO: 2170158 - protein, 23 aa, Cryptosporidium hominis
EKNWRAVFRLGIQQIVSICNTKM

SEQ ID NO: 2170159 - protein, 28 aa, Cryptosporidium hominis
EKPLKGGKLFTCKSCPDEKAIVAFGGES

SEQ ID NO: 2170160 - protein, 19 aa, Cryptosporidium hominis
EKPLPSARAKDDYLQYEQY

SEQ ID NO: 2170161 - protein, 18 aa, Cryptosporidium hominis
EKQDCPAFIYYWNGSTCY

SEQ ID NO: 2170162 - protein, 22 aa, Cryptosporidium hominis
EKQKLHCLNTLFSKLQINQAII

SEQ ID NO: 2170163 - protein, 20 aa, Cryptosporidium hominis
EKRDYIEVLHPLQYNIQEKA

SEQ ID NO: 2170164 - protein, 20 aa, Cryptosporidium hominis
EKRGYRIAAMKLTIATPAIL

SEQ ID NO: 2170165 - protein, 22 aa, Cryptosporidium hominis
EKRIFPELFIIMSTFPPNIPEY

SEQ ID NO: 2170166 - protein, 19 aa, Cryptosporidium hominis
EKRIMVATDLFGRGIDIER

SEQ ID NO: 2170167 - protein, 24 aa, Cryptosporidium hominis
EKRIQFKIQVCKIGAGKFPILNRS

SEQ ID NO: 2170168 - protein, 17 aa, Cryptosporidium hominis
EKRLKDHISSIGCNITD

SEQ ID NO: 2170169 - protein, 19 aa, Cryptosporidium hominis
EKRRKRREAFREMADEAAR

SEQ ID NO: 2170170 - protein, 28 aa, Cryptosporidium hominis
EKSDIWAIACCLLEIFGGPIPFYEYSSN

SEQ ID NO: 2170171 - protein, 31 aa, Cryptosporidium hominis
EKSDIWSLGCCIYEILAGRPPFYARSYDELR

SEQ ID NO: 2170172 - protein, 23 aa, Cryptosporidium hominis
EKSFMIFCIPISWLDSTDDYIKL

SEQ ID NO: 2170173 - protein, 21 aa, Cryptosporidium hominis
EKSFRLPIFELTYDFQMPNTT

SEQ ID NO: 2170174 - protein, 18 aa, Cryptosporidium hominis
EKSFSIDDTQVWAYKAFA

SEQ ID NO: 2170175 - protein, 28 aa, Cryptosporidium hominis
EKSGSRMKYWWSKYIRRQKKKKEESKEK

SEQ ID NO: 2170176 - protein, 17 aa, Cryptosporidium hominis
EKSILVYDLGGGTFDVS

SEQ ID NO: 2170177 - protein, 28 aa, Cryptosporidium hominis
EKSKGMKSQFCKLVDNFVEETSKALIDE

SEQ ID NO: 2170178 - protein, 18 aa, Cryptosporidium hominis
EKSLSLTGSFGFGWLSKG

SEQ ID NO: 2170179 - protein, 21 aa, Cryptosporidium hominis
EKSLYSRFLVINDIGNTFELV

SEQ ID NO: 2170180 - protein, 25 aa, Cryptosporidium hominis
EKSRQLRESFEISKEDLFIGCEITC

SEQ ID NO: 2170181 - protein, 25 aa, Cryptosporidium hominis
EKSSKWKAKCYQLNDLNTTSINECN

SEQ ID NO: 2170182 - protein, 17 aa, Cryptosporidium hominis
EKSWRKKEVNIIINVGG

SEQ ID NO: 2170183 - protein, 19 aa, Cryptosporidium hominis
EKTEPLGLHKADMCMETIK

SEQ ID NO: 2170184 - protein, 25 aa, Cryptosporidium hominis
EKTGPYAVFMCYKLYSLFDPEDKGY

SEQ ID NO: 2170185 - protein, 23 aa, Cryptosporidium hominis
EKTHGNGLLCVNVRSEQCIEISS

SEQ ID NO: 2170186 - protein, 17 aa, Cryptosporidium hominis
EKTQFVHIICSLYTPGI

SEQ ID NO: 2170187 - protein, 19 aa, Cryptosporidium hominis
EKVKDFKKDIDVLGELYKI

SEQ ID NO: 2170188 - protein, 19 aa, Cryptosporidium hominis
EKVKLCLSDTTQLRTGLNI

SEQ ID NO: 2170189 - protein, 22 aa, Cryptosporidium hominis
EKVPFRLTRNMEHLMGPFGKNG

SEQ ID NO: 2170190 - protein, 27 aa, Cryptosporidium hominis
EKVSELDCFFHIYGRFDQFNDICNEVH

SEQ ID NO: 2170191 - protein, 17 aa, Cryptosporidium hominis
EKWEMPEPCITPEGKLL

SEQ ID NO: 2170192 - protein, 18 aa, Cryptosporidium hominis
EKYFHAVKLFLSENNIKS

SEQ ID NO: 2170193 - protein, 28 aa, Cryptosporidium hominis
EKYFNYWMLAKKFEFEKIVTRWTSNIDN

SEQ ID NO: 2170194 - protein, 17 aa, Cryptosporidium hominis
EKYKISIYVNRKLLESN

SEQ ID NO: 2170195 - protein, 23 aa, Cryptosporidium hominis
EKYLKALQLLNVYRERSHEIYNL

SEQ ID NO: 2170196 - protein, 23 aa, Cryptosporidium hominis
EKYLSELFIKMNNMEWRAKPKNN

SEQ ID NO: 2170197 - protein, 26 aa, Cryptosporidium hominis
EKYQFPFSRLPPIIDFSFAESRHFDW

SEQ ID NO: 2170198 - protein, 44 aa, Cryptosporidium hominis
EKYSFLRLNYESEYLFRLLWHFSHCCIYHGSLLNSSTLNRDFES

SEQ ID NO: 2170199 - protein, 22 aa, Cryptosporidium hominis
EKYSLWESIKKKYFGEIKAFKF

SEQ ID NO: 2170200 - protein, 22 aa, Cryptosporidium hominis
ELAGLKLTSAFAEETNMNSRLN

SEQ ID NO: 2170201 - protein, 22 aa, Cryptosporidium hominis
ELAKLIEHISIIKVTTNKKNGK

SEQ ID NO: 2170202 - protein, 25 aa, Cryptosporidium hominis
ELALIWCILKTFAISTKYHHRQEFI

SEQ ID NO: 2170203 - protein, 24 aa, Cryptosporidium hominis
ELALNRLHRQFARIESRERIEVEL

SEQ ID NO: 2170204 - protein, 23 aa, Cryptosporidium hominis
ELAMSRYHIAVLLNNGHVYVSLN

SEQ ID NO: 2170205 - protein, 24 aa, Cryptosporidium hominis
ELANSLSSEAWRFRASVENYSDDT

SEQ ID NO: 2170206 - protein, 20 aa, Cryptosporidium hominis
ELCKYLPQTHGLVMGGANRR

SEQ ID NO: 2170207 - protein, 26 aa, Cryptosporidium hominis
ELCLGGYCKIGYPGIIIVEGLEDCCL

SEQ ID NO: 2170208 - protein, 24 aa, Cryptosporidium hominis
ELCLIRYFAYIGFFMINSIENIHQ

SEQ ID NO: 2170209 - protein, 21 aa, Cryptosporidium hominis
ELCSICSNFRRRKHTNNISPL

SEQ ID NO: 2170210 - protein, 17 aa, Cryptosporidium hominis
ELDCYRKKVNLRGTIYS

SEQ ID NO: 2170211 - protein, 20 aa, Cryptosporidium hominis
ELDERCPFSHCLSWHRRNPY

SEQ ID NO: 2170212 - protein, 21 aa, Cryptosporidium hominis
ELDKLAILLIENFLNLNGKQR

SEQ ID NO: 2170213 - protein, 19 aa, Cryptosporidium hominis
ELDKRYSMEGNLLTFSGQR

SEQ ID NO: 2170214 - protein, 18 aa, Cryptosporidium hominis
ELDLRMIAISARNAEYNP

SEQ ID NO: 2170215 - protein, 26 aa, Cryptosporidium hominis
ELDPDFGISAWIAIKALFVNLETSRR

SEQ ID NO: 2170216 - protein, 19 aa, Cryptosporidium hominis
ELDQLLKFSNEEFIESSAL

SEQ ID NO: 2170217 - protein, 23 aa, Cryptosporidium hominis
ELDREMSFVLPLGAIQMLRRFYQ

SEQ ID NO: 2170218 - protein, 24 aa, Cryptosporidium hominis
ELEAKISEMIPIFDKIQDEGKSEE

SEQ ID NO: 2170219 - protein, 19 aa, Cryptosporidium hominis
ELEGWALSWNKIKESYLAS

SEQ ID NO: 2170220 - protein, 19 aa, Cryptosporidium hominis
ELEINRFQNIVAFLNTALN

SEQ ID NO: 2170221 - protein, 23 aa, Cryptosporidium hominis
ELEKKLKCPVVMIGQRSILPRNY

SEQ ID NO: 2170222 - protein, 24 aa, Cryptosporidium hominis
ELELKPSHFIPLLKSYIEDTNNGK

SEQ ID NO: 2170223 - protein, 20 aa, Cryptosporidium hominis
ELENLLLYNINKLRHERIKL

SEQ ID NO: 2170224 - protein, 24 aa, Cryptosporidium hominis
ELENYKSASILSAIDSSRGRKTQN

SEQ ID NO: 2170225 - protein, 25 aa, Cryptosporidium hominis
ELENYKSKVSIFGLDQDEMKSDIEE

SEQ ID NO: 2170226 - protein, 22 aa, Cryptosporidium hominis
ELESLKSKFLIQDVQDAEYEKI

SEQ ID NO: 2170227 - protein, 19 aa, Cryptosporidium hominis
ELFDICYQGTVGDFHDKLQ

SEQ ID NO: 2170228 - protein, 19 aa, Cryptosporidium hominis
ELFEKELLPHVGVTSGSES

SEQ ID NO: 2170229 - protein, 18 aa, Cryptosporidium hominis
ELFFAQKMDLGGSVPLML

SEQ ID NO: 2170230 - protein, 20 aa, Cryptosporidium hominis
ELFFKIQLSKILVVGAGGIG

SEQ ID NO: 2170231 - protein, 24 aa, Cryptosporidium hominis
ELFINKKLRIVNCKHSINSPKRIA

SEQ ID NO: 2170232 - protein, 18 aa, Cryptosporidium hominis
ELFLKFIYCVLRVKIEWI

SEQ ID NO: 2170233 - protein, 24 aa, Cryptosporidium hominis
ELGKRLRGGEVLHRDEWIPTQDNN

SEQ ID NO: 2170234 - protein, 19 aa, Cryptosporidium hominis
ELHFIIWKMDINEIQAPID

SEQ ID NO: 2170235 - protein, 18 aa, Cryptosporidium hominis
ELIHCRSLRDILYNLVKI

SEQ ID NO: 2170236 - protein, 19 aa, Cryptosporidium hominis
ELIKCADIDGFLVGGASLK

SEQ ID NO: 2170237 - protein, 21 aa, Cryptosporidium hominis
ELIMRHPFPGPGLSINVICYD

SEQ ID NO: 2170238 - protein, 17 aa, Cryptosporidium hominis
ELINFHSSNKFALKPLR

SEQ ID NO: 2170239 - protein, 19 aa, Cryptosporidium hominis
ELIRKEMIYRHKVSEVHES

SEQ ID NO: 2170240 - protein, 17 aa, Cryptosporidium hominis
ELIRKYSVLEIKVSDIY

SEQ ID NO: 2170241 - protein, 21 aa, Cryptosporidium hominis
ELKCVSEECTIVLDKLNMSIS

SEQ ID NO: 2170242 - protein, 23 aa, Cryptosporidium hominis
ELKDVCSKLQLEISQRARKSDLI

SEQ ID NO: 2170243 - protein, 21 aa, Cryptosporidium hominis
ELKLRQFRHLQSMIDEERNLL

SEQ ID NO: 2170244 - protein, 21 aa, Cryptosporidium hominis
ELKRMIIHISSIRSLAKKTIS

SEQ ID NO: 2170245 - protein, 25 aa, Cryptosporidium hominis
ELKSIPKCFVLRKGKVVKQLKGLVM

SEQ ID NO: 2170246 - protein, 23 aa, Cryptosporidium hominis
ELKTNLWLERSWIIHFSGSNRLE

SEQ ID NO: 2170247 - protein, 33 aa, Cryptosporidium hominis
ELLDRPFVHLLIWNYIKCCISFYQLDDQEQKND

SEQ ID NO: 2170248 - protein, 20 aa, Cryptosporidium hominis
ELLFNYEIGDIIHRIIETRH

SEQ ID NO: 2170249 - protein, 18 aa, Cryptosporidium hominis
ELLISWDKETIIVSEIDS

SEQ ID NO: 2170250 - protein, 24 aa, Cryptosporidium hominis
ELLKCPKSSWPKIISELPTGIKSE

SEQ ID NO: 2170251 - protein, 20 aa, Cryptosporidium hominis
ELLNRLPFIVKHDDAELLGL

SEQ ID NO: 2170252 - protein, 17 aa, Cryptosporidium hominis
ELLRECCKIGREALDIA

SEQ ID NO: 2170253 - protein, 23 aa, Cryptosporidium hominis
ELLRGIRIHFTRIVKSFDSSIGD

SEQ ID NO: 2170254 - protein, 20 aa, Cryptosporidium hominis
ELLSCIPFELLSSSHNGKNN

SEQ ID NO: 2170255 - protein, 20 aa, Cryptosporidium hominis
ELLSFPHIFNQVFLSLNRFN

SEQ ID NO: 2170256 - protein, 22 aa, Cryptosporidium hominis
ELLSFSELYGSILDRRIIQSLT

SEQ ID NO: 2170257 - protein, 21 aa, Cryptosporidium hominis
ELLVKLKQFWSEYPEKLNKKI

SEQ ID NO: 2170258 - protein, 17 aa, Cryptosporidium hominis
ELMFEMFQTQSLNIALQ

SEQ ID NO: 2170259 - protein, 20 aa, Cryptosporidium hominis
ELMFQLLNGMAYCHSHNIMH

SEQ ID NO: 2170260 - protein, 20 aa, Cryptosporidium hominis
ELMHSFLKFFIQEIFLSLGI

SEQ ID NO: 2170261 - protein, 43 aa, Cryptosporidium hominis
ELNIKEGILGRGSISWLNLKPKIPYFNVRKALILLQDAGFITF

SEQ ID NO: 2170262 - protein, 18 aa, Cryptosporidium hominis
ELNKRISNNILRLQISKK

SEQ ID NO: 2170263 - protein, 19 aa, Cryptosporidium hominis
ELNRSCKLNENHLNFNCNQ

SEQ ID NO: 2170264 - protein, 17 aa, Cryptosporidium hominis
ELNSIKVLDELRGPLKV

SEQ ID NO: 2170265 - protein, 19 aa, Cryptosporidium hominis
ELNSPLKLIDFGLAKRITR

SEQ ID NO: 2170266 - protein, 19 aa, Cryptosporidium hominis
ELNSRISTLDLKLQESSRD

SEQ ID NO: 2170267 - protein, 21 aa, Cryptosporidium hominis
ELNVIPGIGYYPGQIQINSPI

SEQ ID NO: 2170268 - protein, 27 aa, Cryptosporidium hominis
ELPKFKNRILGGVKREEMVPILRPPSK

SEQ ID NO: 2170269 - protein, 25 aa, Cryptosporidium hominis
ELPNRPITCIIWSRFVNNIYLSHGI

SEQ ID NO: 2170270 - protein, 21 aa, Cryptosporidium hominis
ELPPFLKVEKLMFERHERENK

SEQ ID NO: 2170271 - protein, 18 aa, Cryptosporidium hominis
ELPVPYMVPKPFVVPVHV

SEQ ID NO: 2170272 - protein, 23 aa, Cryptosporidium hominis
ELQELRAKQFAILEQEGMLSHIK

SEQ ID NO: 2170273 - protein, 25 aa, Cryptosporidium hominis
ELQHLSVPYWNLFPDIIDDVLNDTN

SEQ ID NO: 2170274 - protein, 28 aa, Cryptosporidium hominis
ELRATFFDVLEIFLLTIYKFREKLSSSS

SEQ ID NO: 2170275 - protein, 19 aa, Cryptosporidium hominis
ELRECKLSLNTNKEHSNIL

SEQ ID NO: 2170276 - protein, 28 aa, Cryptosporidium hominis
ELRILRKEMKNLLLLSKKEAYQFSKNNI

SEQ ID NO: 2170277 - protein, 18 aa, Cryptosporidium hominis
ELRMCVRTQIGPVATPDH

SEQ ID NO: 2170278 - protein, 26 aa, Cryptosporidium hominis
ELRPWSRLLDVSPWFNYGFTEKTFKE

SEQ ID NO: 2170279 - protein, 22 aa, Cryptosporidium hominis
ELRRQNNRCCCNHGGEKLYQRN

SEQ ID NO: 2170280 - protein, 27 aa, Cryptosporidium hominis
ELRSFGGKWPFIFFKSRIEFLETVTQS

SEQ ID NO: 2170281 - protein, 20 aa, Cryptosporidium hominis
ELSDDFFINMPRNVFIGLNS

SEQ ID NO: 2170282 - protein, 22 aa, Cryptosporidium hominis
ELSDFLKYEFISLIKDILFFSK

SEQ ID NO: 2170283 - protein, 18 aa, Cryptosporidium hominis
ELSLLGISESLNWALCKH

SEQ ID NO: 2170284 - protein, 21 aa, Cryptosporidium hominis
ELSLPYKLWIDAKSRDWILEW

SEQ ID NO: 2170285 - protein, 20 aa, Cryptosporidium hominis
ELSNAISIIGLLELLLNSNT

SEQ ID NO: 2170286 - protein, 27 aa, Cryptosporidium hominis
ELSNMWVPYISYSKCFYNFSRVSKLVQ

SEQ ID NO: 2170287 - protein, 20 aa, Cryptosporidium hominis
ELSQNILICGGLASVPGFER

SEQ ID NO: 2170288 - protein, 22 aa, Cryptosporidium hominis
ELSSLKSMNGMYLSNMISGRNL

SEQ ID NO: 2170289 - protein, 22 aa, Cryptosporidium hominis
ELSTLCGVTGYVLYITYQSIID

SEQ ID NO: 2170290 - protein, 25 aa, Cryptosporidium hominis
ELTQINIKYCFPFIVIYDASNTGDQ

SEQ ID NO: 2170291 - protein, 17 aa, Cryptosporidium hominis
ELVFCNKPILEIDHGGD

SEQ ID NO: 2170292 - protein, 18 aa, Cryptosporidium hominis
ELVKICSEYVFSLRKDIK

SEQ ID NO: 2170293 - protein, 23 aa, Cryptosporidium hominis
ELVLSGIKWLTSVVNEIDELEQR

SEQ ID NO: 2170294 - protein, 17 aa, Cryptosporidium hominis
ELVPSRMSESIFWQSYF

SEQ ID NO: 2170295 - protein, 19 aa, Cryptosporidium hominis
ELYKRFKTMLFEKNNNGNE

SEQ ID NO: 2170296 - protein, 18 aa, Cryptosporidium hominis
ELYRCDLVYVSSRKKVPI

SEQ ID NO: 2170297 - protein, 29 aa, Cryptosporidium hominis
EMAIKEKWRLQKISWKYCILDEAHRIKNE

SEQ ID NO: 2170298 - protein, 17 aa, Cryptosporidium hominis
EMALICMNKKHSRYLGC

SEQ ID NO: 2170299 - protein, 18 aa, Cryptosporidium hominis
EMDKCNELLYPILGRSLI

SEQ ID NO: 2170300 - protein, 20 aa, Cryptosporidium hominis
EMDSAKFSTEIDLKANKDNN

SEQ ID NO: 2170301 - protein, 31 aa, Cryptosporidium hominis
EMDSLITMLRLACIHPQLGIMGIHNKNKDGD

SEQ ID NO: 2170302 - protein, 20 aa, Cryptosporidium hominis
EMDSSPWLSADFNIEPNSIF

SEQ ID NO: 2170303 - protein, 18 aa, Cryptosporidium hominis
EMESFKVNLIYSKIYSTI

SEQ ID NO: 2170304 - protein, 20 aa, Cryptosporidium hominis
EMFIRFVLIYCRFIKKKENV

SEQ ID NO: 2170305 - protein, 21 aa, Cryptosporidium hominis
EMGAIELLIVWENLETKRMVV

SEQ ID NO: 2170306 - protein, 26 aa, Cryptosporidium hominis
EMGKGSFKYAWVLDKLKAERERGITI

SEQ ID NO: 2170307 - protein, 22 aa, Cryptosporidium hominis
EMHYKLILKRPILLFWREYFEL

SEQ ID NO: 2170308 - protein, 19 aa, Cryptosporidium hominis
EMIYRHKVSEVHESKNEIL

SEQ ID NO: 2170309 - protein, 20 aa, Cryptosporidium hominis
EMKHLKEDVEYEGIFWHPIN

SEQ ID NO: 2170310 - protein, 21 aa, Cryptosporidium hominis
EMKNSGNLPPIITSNQSPTST

SEQ ID NO: 2170311 - protein, 24 aa, Cryptosporidium hominis
EMLCLVRFAGDFSIYIVSSPSENE

SEQ ID NO: 2170312 - protein, 25 aa, Cryptosporidium hominis
EMLSSRAVFILVEMIGQNFQTKNFK

SEQ ID NO: 2170313 - protein, 25 aa, Cryptosporidium hominis
EMMNKKKSKKCCIFHKKRNFGESSS

SEQ ID NO: 2170314 - protein, 20 aa, Cryptosporidium hominis
EMNDCLKPTLIIPPENADFT

SEQ ID NO: 2170315 - protein, 26 aa, Cryptosporidium hominis
EMNKIKDCPLFLSFSYGRALQASVLK

SEQ ID NO: 2170316 - protein, 17 aa, Cryptosporidium hominis
EMRDYWLKFKDKISKII

SEQ ID NO: 2170317 - protein, 26 aa, Cryptosporidium hominis
EMSELRQSLQLNLAMIYVKIQEWSKA

SEQ ID NO: 2170318 - protein, 19 aa, Cryptosporidium hominis
EMSKWRYNYNWKHESCNLV

SEQ ID NO: 2170319 - protein, 26 aa, Cryptosporidium hominis
EMVSHSLPVLCRLLYFSDLEVMTDAC

SEQ ID NO: 2170320 - protein, 17 aa, Cryptosporidium hominis
ENAFKIAAARELYEETG

SEQ ID NO: 2170321 - protein, 24 aa, Cryptosporidium hominis
ENCECPKWSFCNVLNKLKIEKNCS

SEQ ID NO: 2170322 - protein, 25 aa, Cryptosporidium hominis
ENCIQLFHPICAWLNGVQIEVDCDP

SEQ ID NO: 2170323 - protein, 28 aa, Cryptosporidium hominis
ENDIGSIWLIREIYLSLTPQILKLSMSV

SEQ ID NO: 2170324 - protein, 21 aa, Cryptosporidium hominis
ENEASFFLSYIGYFIYSENKD

SEQ ID NO: 2170325 - protein, 23 aa, Cryptosporidium hominis
ENEAYLKKRENLRDALTNRSNNT

SEQ ID NO: 2170326 - protein, 18 aa, Cryptosporidium hominis
ENELILFDVLNCIYNSLS

SEQ ID NO: 2170327 - protein, 22 aa, Cryptosporidium hominis
ENELKPGDLVGVNKDSYLILDK

SEQ ID NO: 2170328 - protein, 32 aa, Cryptosporidium hominis
ENESLWFDALRHLLKWTLQWDPSNRPNVNQLL

SEQ ID NO: 2170329 - protein, 28 aa, Cryptosporidium hominis
ENEYGISLLSIWVHLIPLEFIKTNLMQT

SEQ ID NO: 2170330 - protein, 22 aa, Cryptosporidium hominis
ENEYWMVVEFPKNSSLYRKHNC

SEQ ID NO: 2170331 - protein, 20 aa, Cryptosporidium hominis
ENFASVSVMSRPTRKTFESL

SEQ ID NO: 2170332 - protein, 20 aa, Cryptosporidium hominis
ENFFIQFPIFPSNMSQYRQR

SEQ ID NO: 2170333 - protein, 19 aa, Cryptosporidium hominis
ENFGSRFKNSMVCNNNNSN

SEQ ID NO: 2170334 - protein, 17 aa, Cryptosporidium hominis
ENFKFYSPIVFVRSIIR

SEQ ID NO: 2170335 - protein, 18 aa, Cryptosporidium hominis
ENFLDVIFGFLLRKTDFF

SEQ ID NO: 2170336 - protein, 20 aa, Cryptosporidium hominis
ENFPFCTIEPHEARMNVPDD

SEQ ID NO: 2170337 - protein, 30 aa, Cryptosporidium hominis
ENFSDFIPHKWVRLAMCEGYDINCTDFDIG

SEQ ID NO: 2170338 - protein, 37 aa, Cryptosporidium hominis
ENFYEEFRDGILLVNLLKQWSSLYGYNNTEGDLLIYK

SEQ ID NO: 2170339 - protein, 21 aa, Cryptosporidium hominis
ENGCKVILFGSLYRVIHESAK

SEQ ID NO: 2170340 - protein, 17 aa, Cryptosporidium hominis
ENGDKSLSIAFSNSKSD

SEQ ID NO: 2170341 - protein, 22 aa, Cryptosporidium hominis
ENGRLKFIFDTHIYSINTNKIL

SEQ ID NO: 2170342 - protein, 21 aa, Cryptosporidium hominis
ENHKAYLLFYYRSDFNKYDLL

SEQ ID NO: 2170343 - protein, 18 aa, Cryptosporidium hominis
ENIIKFLKIKNEFQNKII

SEQ ID NO: 2170344 - protein, 29 aa, Cryptosporidium hominis
ENILKRFFECIKLILKKEATRIVKIKFKI

SEQ ID NO: 2170345 - protein, 22 aa, Cryptosporidium hominis
ENILKYYKSILMSLPNSPKNIV

SEQ ID NO: 2170346 - protein, 25 aa, Cryptosporidium hominis
ENILLRIECCKKYEKKYLEIERYIT

SEQ ID NO: 2170347 - protein, 17 aa, Cryptosporidium hominis
ENILQLYAWFEDKSRIW

SEQ ID NO: 2170348 - protein, 18 aa, Cryptosporidium hominis
ENIPNIYAGEAIWPGITS

SEQ ID NO: 2170349 - protein, 23 aa, Cryptosporidium hominis
ENIQCVIRWSFGGDEVFVTGSFN

SEQ ID NO: 2170350 - protein, 20 aa, Cryptosporidium hominis
ENKISNDWWSDGEEDEEDEE

SEQ ID NO: 2170351 - protein, 26 aa, Cryptosporidium hominis
ENKLCQRFPWLEVLIRSMDMSILNPS

SEQ ID NO: 2170352 - protein, 23 aa, Cryptosporidium hominis
ENLCKRIPSILEKFFDKSITKKI

SEQ ID NO: 2170353 - protein, 18 aa, Cryptosporidium hominis
ENLIPHKLFQGNRSSISL

SEQ ID NO: 2170354 - protein, 28 aa, Cryptosporidium hominis
ENLLFHYMKRFVIGLSIDKISSRNCNEY

SEQ ID NO: 2170355 - protein, 26 aa, Cryptosporidium hominis
ENLLGFDLKDLAARGALSTRARVPYN

SEQ ID NO: 2170356 - protein, 19 aa, Cryptosporidium hominis
ENLLKPCFNHEELFKTLNS

SEQ ID NO: 2170357 - protein, 17 aa, Cryptosporidium hominis
ENLLSLLEWGGIKLPLK

SEQ ID NO: 2170358 - protein, 23 aa, Cryptosporidium hominis
ENLNIKTTDYFSVYYEANVKNDN

SEQ ID NO: 2170359 - protein, 22 aa, Cryptosporidium hominis
ENMKLFLKGMIQYTTYSQLERF

SEQ ID NO: 2170360 - protein, 19 aa, Cryptosporidium hominis
ENMNPNRLFSIIRAYVLTL

SEQ ID NO: 2170361 - protein, 18 aa, Cryptosporidium hominis
ENNFCLSHSSGIAENTSI

SEQ ID NO: 2170362 - protein, 23 aa, Cryptosporidium hominis
ENNMPIDVFLPIFVNHDHLLLEM

SEQ ID NO: 2170363 - protein, 21 aa, Cryptosporidium hominis
ENNNPCKFKDQYPMANANNSM

SEQ ID NO: 2170364 - protein, 25 aa, Cryptosporidium hominis
ENNQHCLPCGRFISPEYLVPGTPGF

SEQ ID NO: 2170365 - protein, 19 aa, Cryptosporidium hominis
ENNVIPGVMRGILDDIYDK

SEQ ID NO: 2170366 - protein, 19 aa, Cryptosporidium hominis
ENNWQCVVEIVPNCPKVIC

SEQ ID NO: 2170367 - protein, 28 aa, Cryptosporidium hominis
ENPDEYAVECLCQLIMTTGYYLDSNEKS

SEQ ID NO: 2170368 - protein, 23 aa, Cryptosporidium hominis
ENPEIMGSFDIILGSDLVYNSDM

SEQ ID NO: 2170369 - protein, 20 aa, Cryptosporidium hominis
ENPLFLSVRAQDIESVTTLL

SEQ ID NO: 2170370 - protein, 17 aa, Cryptosporidium hominis
ENPSCAVNNDFNLFLIP

SEQ ID NO: 2170371 - protein, 32 aa, Cryptosporidium hominis
ENQWIPLRISCGLLTGVVKLFCHKVEYLDNKC

SEQ ID NO: 2170372 - protein, 19 aa, Cryptosporidium hominis
ENRASVILVGLGFTQEMLK

SEQ ID NO: 2170373 - protein, 23 aa, Cryptosporidium hominis
ENREIPQAPELRVEKRPLVELQD

SEQ ID NO: 2170374 - protein, 21 aa, Cryptosporidium hominis
ENRLLVSYLLNCSKIKNLGIT

SEQ ID NO: 2170375 - protein, 22 aa, Cryptosporidium hominis
ENRSSKEWVEFACSKWMEFFVK

SEQ ID NO: 2170376 - protein, 17 aa, Cryptosporidium hominis
ENSEFSERFGIDTLFEK

SEQ ID NO: 2170377 - protein, 17 aa, Cryptosporidium hominis
ENSEGIEGFLFEEIMPE

SEQ ID NO: 2170378 - protein, 22 aa, Cryptosporidium hominis
ENSELRKVIKIQEKKQSEFIDN

SEQ ID NO: 2170379 - protein, 20 aa, Cryptosporidium hominis
ENSGKMVLMDRLIKKLVSGG

SEQ ID NO: 2170380 - protein, 24 aa, Cryptosporidium hominis
ENSGTKFLLLIPVLMNLINVLIKH

SEQ ID NO: 2170381 - protein, 19 aa, Cryptosporidium hominis
ENSHLNFDFSRGMRTLSAP

SEQ ID NO: 2170382 - protein, 23 aa, Cryptosporidium hominis
ENSLRIFSEYIIKNSRNIIEYSE

SEQ ID NO: 2170383 - protein, 19 aa, Cryptosporidium hominis
ENSRGIVNFAMKWESDKRQ

SEQ ID NO: 2170384 - protein, 25 aa, Cryptosporidium hominis
ENTEFFSMGFSPKFTWSAPTDATWI

SEQ ID NO: 2170385 - protein, 18 aa, Cryptosporidium hominis
ENTESWYLSEFEEYSDTW

SEQ ID NO: 2170386 - protein, 26 aa, Cryptosporidium hominis
ENTIDYKIWLAKCIDLSQMDEDDKKR

SEQ ID NO: 2170387 - protein, 21 aa, Cryptosporidium hominis
ENTVIPGFCPNFNYHIIHDEY

SEQ ID NO: 2170388 - protein, 22 aa, Cryptosporidium hominis
ENVLRKRVHEMSTRLSKQGLLC

SEQ ID NO: 2170389 - protein, 26 aa, Cryptosporidium hominis
ENVSFTGIQIWISTLSFQIWTSTKNL

SEQ ID NO: 2170390 - protein, 18 aa, Cryptosporidium hominis
ENVSWILDGFHTMLKSRS

SEQ ID NO: 2170391 - protein, 23 aa, Cryptosporidium hominis
ENWIKIPCIYPSNSYESLEIIKM

SEQ ID NO: 2170392 - protein, 24 aa, Cryptosporidium hominis
ENYFRSPYTYKFYIDPKSKEEYDS

SEQ ID NO: 2170393 - protein, 17 aa, Cryptosporidium hominis
ENYKRRVSSSSFIQGGK

SEQ ID NO: 2170394 - protein, 40 aa, Cryptosporidium hominis
ENYPLSGGVPICLILQYPLECLRRSAAVFYFTSEPKSRGG

SEQ ID NO: 2170395 - protein, 31 aa, Cryptosporidium hominis
EPAKCLLIGSPFKLPCSKGCHLRTDIISFLH

SEQ ID NO: 2170396 - protein, 22 aa, Cryptosporidium hominis
EPDCRRTINLLNEFISKLDPGA

SEQ ID NO: 2170397 - protein, 23 aa, Cryptosporidium hominis
EPECKYPIIALKYVNDIYHLCSP

SEQ ID NO: 2170398 - protein, 20 aa, Cryptosporidium hominis
EPEEIISFISLLEKCKSPAI

SEQ ID NO: 2170399 - protein, 25 aa, Cryptosporidium hominis
EPEFLRRHQRLFASQIMKSILNGLS

SEQ ID NO: 2170400 - protein, 17 aa, Cryptosporidium hominis
EPEILLANTCGPQTFEN

SEQ ID NO: 2170401 - protein, 19 aa, Cryptosporidium hominis
EPFIDRVLKLNGQLSPFLR

SEQ ID NO: 2170402 - protein, 21 aa, Cryptosporidium hominis
EPGAFSFSFFEVYCEKIQDLL

SEQ ID NO: 2170403 - protein, 25 aa, Cryptosporidium hominis
EPGSKRAFCQFIMEPICQLFSSIMN

SEQ ID NO: 2170404 - protein, 19 aa, Cryptosporidium hominis
EPIELDCNTPLPAPPSPRY

SEQ ID NO: 2170405 - protein, 17 aa, Cryptosporidium hominis
EPINYYKASEMERSVII

SEQ ID NO: 2170406 - protein, 20 aa, Cryptosporidium hominis
EPIPPVYIPIFWTSIHRNKV

SEQ ID NO: 2170407 - protein, 20 aa, Cryptosporidium hominis
EPKIRVPIYLTSSAINKFND

SEQ ID NO: 2170408 - protein, 32 aa, Cryptosporidium hominis
EPLCAGYTKYILRTDILYRRVNPILTSEADQR

SEQ ID NO: 2170409 - protein, 32 aa, Cryptosporidium hominis
EPLCIGCGICVKKCPYSAITIINLPKNMSKDT

SEQ ID NO: 2170410 - protein, 19 aa, Cryptosporidium hominis
EPLFKRIVNKEEKTFEELK

SEQ ID NO: 2170411 - protein, 26 aa, Cryptosporidium hominis
EPLKLGYSFCFGRPSKAILCNLAPSE

SEQ ID NO: 2170412 - protein, 22 aa, Cryptosporidium hominis
EPMKMRLLLDESKLKACISSVR

SEQ ID NO: 2170413 - protein, 19 aa, Cryptosporidium hominis
EPNFKMQSEEPINVNSENP

SEQ ID NO: 2170414 - protein, 20 aa, Cryptosporidium hominis
EPNIRFDFINVEIGGNNQQT

SEQ ID NO: 2170415 - protein, 25 aa, Cryptosporidium hominis
EPNIYLLERIVYFIPNELVYKTFNE

SEQ ID NO: 2170416 - protein, 20 aa, Cryptosporidium hominis
EPNNSLKLEISWSDRFALSG

SEQ ID NO: 2170417 - protein, 20 aa, Cryptosporidium hominis
EPPFSHFFNLRIFNGYFSDE

SEQ ID NO: 2170418 - protein, 23 aa, Cryptosporidium hominis
EPPIKEFMCKSGNDYFERVNPAK

SEQ ID NO: 2170419 - protein, 17 aa, Cryptosporidium hominis
EPQKTWYCPGCTRDEEY

SEQ ID NO: 2170420 - protein, 19 aa, Cryptosporidium hominis
EPQMARGRFREFYQCDLDI

SEQ ID NO: 2170421 - protein, 25 aa, Cryptosporidium hominis
EPSCGKSQLLRFVMSIAPLAISTTG

SEQ ID NO: 2170422 - protein, 25 aa, Cryptosporidium hominis
EPSVIFRRFLEDLARNSHLGGESIV

SEQ ID NO: 2170423 - protein, 29 aa, Cryptosporidium hominis
EPTHASGASVLWSLRSILINNVNKYHKEC

SEQ ID NO: 2170424 - protein, 18 aa, Cryptosporidium hominis
EPTNLMMTKNLFKSTNNL

SEQ ID NO: 2170425 - protein, 17 aa, Cryptosporidium hominis
EPVDFSMLSKLVLESSL

SEQ ID NO: 2170426 - protein, 23 aa, Cryptosporidium hominis
EPVHRLEWHSGGNGLLLSSSLDG

SEQ ID NO: 2170427 - protein, 22 aa, Cryptosporidium hominis
EPVKSLRIGIDHPVYDDDEEIN

SEQ ID NO: 2170428 - protein, 23 aa, Cryptosporidium hominis
EPVSSCRDDFCVFSTPEFESRDS

SEQ ID NO: 2170429 - protein, 19 aa, Cryptosporidium hominis
EPVVIHFSKTISRNRRVKY

SEQ ID NO: 2170430 - protein, 24 aa, Cryptosporidium hominis
EPYLSTPFYMGIKVKDMLNQSKDL

SEQ ID NO: 2170431 - protein, 19 aa, Cryptosporidium hominis
EPYPFNLMFRTKIGPKEVE

SEQ ID NO: 2170432 - protein, 19 aa, Cryptosporidium hominis
EQEKHYNSHFGQYEGNNLS

SEQ ID NO: 2170433 - protein, 22 aa, Cryptosporidium hominis
EQEKPRLIIHKIVLENFKSYGG

SEQ ID NO: 2170434 - protein, 32 aa, Cryptosporidium hominis
EQEKSFIFELLYIKRKLSLVLDLDNTLIHASS

SEQ ID NO: 2170435 - protein, 25 aa, Cryptosporidium hominis
EQELRLNILGILGVLMKYYPNVYWE

SEQ ID NO: 2170436 - protein, 21 aa, Cryptosporidium hominis
EQESLCKAAFKVFDLDMDGRI

SEQ ID NO: 2170437 - protein, 24 aa, Cryptosporidium hominis
EQEVPLKFLFPTDRVANISFEAFI

SEQ ID NO: 2170438 - protein, 24 aa, Cryptosporidium hominis
EQFCKAAVLYSDFYQFALGENFVC

SEQ ID NO: 2170439 - protein, 23 aa, Cryptosporidium hominis
EQFMCPICLGAFVDPCTLSCSHS

SEQ ID NO: 2170440 - protein, 18 aa, Cryptosporidium hominis
EQFSESGLEAMLEEELLK

SEQ ID NO: 2170441 - protein, 25 aa, Cryptosporidium hominis
EQGIVPGGGSALLWASRNLGKLYSQ

SEQ ID NO: 2170442 - protein, 24 aa, Cryptosporidium hominis
EQIKKHILSVFGFEELYRMNILER

SEQ ID NO: 2170443 - protein, 20 aa, Cryptosporidium hominis
EQIPDCKSSKCEIFNVIIGK

SEQ ID NO: 2170444 - protein, 17 aa, Cryptosporidium hominis
EQKQIWKHQNMKIELND

SEQ ID NO: 2170445 - protein, 19 aa, Cryptosporidium hominis
EQLNISRTMLASMGSPSDS

SEQ ID NO: 2170446 - protein, 17 aa, Cryptosporidium hominis
EQLPKGDYDEIISRHYS

SEQ ID NO: 2170447 - protein, 17 aa, Cryptosporidium hominis
EQMKLFLKELENHVEEE

SEQ ID NO: 2170448 - protein, 25 aa, Cryptosporidium hominis
EQNKNEIIGGLGLESSVISMNNGFG

SEQ ID NO: 2170449 - protein, 25 aa, Cryptosporidium hominis
EQPCASVFYPCMQCADIFQLKADIC

SEQ ID NO: 2170450 - protein, 23 aa, Cryptosporidium hominis
EQPTGYECLLCFLQDASNGLLQI

SEQ ID NO: 2170451 - protein, 20 aa, Cryptosporidium hominis
EQRSAEGLASPIGFSPLASP

SEQ ID NO: 2170452 - protein, 23 aa, Cryptosporidium hominis
EQSFPWHLEIPFPSEEEDLSTIS

SEQ ID NO: 2170453 - protein, 22 aa, Cryptosporidium hominis
EQSIRFLFEGERLRPEMTAEDA

SEQ ID NO: 2170454 - protein, 20 aa, Cryptosporidium hominis
EQSKIPLLVFPYGSTSTGFA

SEQ ID NO: 2170455 - protein, 24 aa, Cryptosporidium hominis
EQSVKFRLAIQSDKPSFTFNSNIC

SEQ ID NO: 2170456 - protein, 22 aa, Cryptosporidium hominis
EQTCKVPLFIQERICADEISFS

SEQ ID NO: 2170457 - protein, 20 aa, Cryptosporidium hominis
EQTIKLFLIPGIDENTPLEP

SEQ ID NO: 2170458 - protein, 24 aa, Cryptosporidium hominis
EQTKKRPSDVAKEEQSKKVCTETS

SEQ ID NO: 2170459 - protein, 34 aa, Cryptosporidium hominis
EQTKYRVPSFLSFKPKFMYSIPFECNENKYSRSY

SEQ ID NO: 2170460 - protein, 17 aa, Cryptosporidium hominis
EQVKRELSLLGISESLN

SEQ ID NO: 2170461 - protein, 17 aa, Cryptosporidium hominis
EQYKIRKELGLLFNQNF

SEQ ID NO: 2170462 - protein, 18 aa, Cryptosporidium hominis
ERACNNCNCGRADLEKEI

SEQ ID NO: 2170463 - protein, 22 aa, Cryptosporidium hominis
ERAKMMLKLSVDIVNKQNITKK

SEQ ID NO: 2170464 - protein, 24 aa, Cryptosporidium hominis
ERANLKLQLDFAIIQQGRLKGQSS

SEQ ID NO: 2170465 - protein, 25 aa, Cryptosporidium hominis
ERARASAPCIVFFDELDSLCAARSS

SEQ ID NO: 2170466 - protein, 26 aa, Cryptosporidium hominis
ERAVITFKALVKFYRDSLYSVDYNHD

SEQ ID NO: 2170467 - protein, 30 aa, Cryptosporidium hominis
ERCSFKDLNVYFGWETPLVIPIITEPDCCY

SEQ ID NO: 2170468 - protein, 20 aa, Cryptosporidium hominis
EREHYLGHSLHYNRSRGRGR

SEQ ID NO: 2170469 - protein, 24 aa, Cryptosporidium hominis
EREYYKWDYIILLTTRYISPDSNT

SEQ ID NO: 2170470 - protein, 22 aa, Cryptosporidium hominis
ERFDCPWFFSTLLTIILFKDKY

SEQ ID NO: 2170471 - protein, 24 aa, Cryptosporidium hominis
ERFLFFRRYLLKGATKVIFCGPPI

SEQ ID NO: 2170472 - protein, 19 aa, Cryptosporidium hominis
ERFLLKEIFQSCIESILVG

SEQ ID NO: 2170473 - protein, 19 aa, Cryptosporidium hominis
ERFNDWKFLFSNTLGLNVV

SEQ ID NO: 2170474 - protein, 24 aa, Cryptosporidium hominis
ERFQRCLRLTFNETVMKNPQWFKL

SEQ ID NO: 2170475 - protein, 24 aa, Cryptosporidium hominis
ERFRCPEALFQPGLLGKEAVGIGE

SEQ ID NO: 2170476 - protein, 24 aa, Cryptosporidium hominis
ERFTSEFGISRFLNFGFTTTPQLH

SEQ ID NO: 2170477 - protein, 17 aa, Cryptosporidium hominis
ERGEDDLATGFKMIQNL

SEQ ID NO: 2170478 - protein, 19 aa, Cryptosporidium hominis
ERHKLPLSIYPSGSYSTIK

SEQ ID NO: 2170479 - protein, 29 aa, Cryptosporidium hominis
ERIDGNVLWYSSVGISWCYINRYIELLDY

SEQ ID NO: 2170480 - protein, 17 aa, Cryptosporidium hominis
ERIEGIYLSSSSLIQHV

SEQ ID NO: 2170481 - protein, 17 aa, Cryptosporidium hominis
ERIHKFKVIPEVLSTSN

SEQ ID NO: 2170482 - protein, 23 aa, Cryptosporidium hominis
ERINDAFEFFSISALIDDQVLCL

SEQ ID NO: 2170483 - protein, 21 aa, Cryptosporidium hominis
ERKEREKLERQCYWMQEENKT

SEQ ID NO: 2170484 - protein, 21 aa, Cryptosporidium hominis
ERKKLVYYEALFNKLENDVVL

SEQ ID NO: 2170485 - protein, 20 aa, Cryptosporidium hominis
ERLEKLGFSQGVWNFDPIQP

SEQ ID NO: 2170486 - protein, 23 aa, Cryptosporidium hominis
ERLGECINNFFTPLIQIIHYWGG

SEQ ID NO: 2170487 - protein, 17 aa, Cryptosporidium hominis
ERLIPPRMSPLLRSQRQ

SEQ ID NO: 2170488 - protein, 24 aa, Cryptosporidium hominis
ERLKCKPFSWYVDKFRASFDRGGL

SEQ ID NO: 2170489 - protein, 21 aa, Cryptosporidium hominis
ERLKFSASIFHHIQLQKESII

SEQ ID NO: 2170490 - protein, 17 aa, Cryptosporidium hominis
ERLKLIKQFLELNFNCS

SEQ ID NO: 2170491 - protein, 23 aa, Cryptosporidium hominis
ERLKRKLLIRSECLRSMRVSVRW

SEQ ID NO: 2170492 - protein, 23 aa, Cryptosporidium hominis
ERLNEIISMRLSYNQDLISLQST

SEQ ID NO: 2170493 - protein, 19 aa, Cryptosporidium hominis
ERLRYVKSYSESYADCITG

SEQ ID NO: 2170494 - protein, 17 aa, Cryptosporidium hominis
ERMCKAVGYSSAGTVEF

SEQ ID NO: 2170495 - protein, 19 aa, Cryptosporidium hominis
ERMEMAKQLGIDVSKENLK

SEQ ID NO: 2170496 - protein, 19 aa, Cryptosporidium hominis
ERMNSGFLGFGRKPSNSIF

SEQ ID NO: 2170497 - protein, 26 aa, Cryptosporidium hominis
ERMVYEIFSVGGYCCDLMVSSFKNIV

SEQ ID NO: 2170498 - protein, 24 aa, Cryptosporidium hominis
ERNEIRIRLSLPRSVLMEVSDFSL

SEQ ID NO: 2170499 - protein, 23 aa, Cryptosporidium hominis
ERNELRYRLVHGEDRIEIPDSAD

SEQ ID NO: 2170500 - protein, 22 aa, Cryptosporidium hominis
ERNIVCLSQLYLIQHIFDTNLT

SEQ ID NO: 2170501 - protein, 17 aa, Cryptosporidium hominis
ERNLHCFLTDNDCVRLT

SEQ ID NO: 2170502 - protein, 18 aa, Cryptosporidium hominis
ERNPQLGLNNVFSASPVK

SEQ ID NO: 2170503 - protein, 25 aa, Cryptosporidium hominis
ERQIRNCLYNWKYKSQLERELSLQK

SEQ ID NO: 2170504 - protein, 20 aa, Cryptosporidium hominis
ERRFGWYRRCMKEYEQQFGE

SEQ ID NO: 2170505 - protein, 25 aa, Cryptosporidium hominis
ERSTWSRIFSPLSFGFDKRELSYSG

SEQ ID NO: 2170506 - protein, 28 aa, Cryptosporidium hominis
ERSVELLKSLGICRNFRPSVLTKTMIHT

SEQ ID NO: 2170507 - protein, 34 aa, Cryptosporidium hominis
ERTELDDLCFCLSQERLNILGIRKEFDKVYESLT

SEQ ID NO: 2170508 - protein, 21 aa, Cryptosporidium hominis
ERTWFLRRNFHSVIIDEAHRI

SEQ ID NO: 2170509 - protein, 25 aa, Cryptosporidium hominis
ERVPFPRVYHSAALCTEGPAAGMTV

SEQ ID NO: 2170510 - protein, 17 aa, Cryptosporidium hominis
ERVSPCPEDFDVVLDND

SEQ ID NO: 2170511 - protein, 24 aa, Cryptosporidium hominis
ERVSWKLFKTGICKCCDPNKLIKS

SEQ ID NO: 2170512 - protein, 27 aa, Cryptosporidium hominis
ERYEDCMNCLYLLLPFTLTHGTSQNVS

SEQ ID NO: 2170513 - protein, 26 aa, Cryptosporidium hominis
ERYEEKRARIRLMRRQTARQKWAKMA

SEQ ID NO: 2170514 - protein, 20 aa, Cryptosporidium hominis
ERYRIGGIIGTGQFAEVFYC

SEQ ID NO: 2170515 - protein, 26 aa, Cryptosporidium hominis
ERYTGKFLPFKGISWKTIIESLCSPN

SEQ ID NO: 2170516 - protein, 26 aa, Cryptosporidium hominis
ESADLSLWCSLKITLLGELPLSSKLE

SEQ ID NO: 2170517 - protein, 26 aa, Cryptosporidium hominis
ESAEGSRILREFSLGSLAMRRSGSLT

SEQ ID NO: 2170518 - protein, 31 aa, Cryptosporidium hominis
ESAESTKPFGGRFGATGFGSRGGRGGQRGRV

SEQ ID NO: 2170519 - protein, 22 aa, Cryptosporidium hominis
ESAKIFSRDILKLRKQMERLSL

SEQ ID NO: 2170520 - protein, 19 aa, Cryptosporidium hominis
ESCKQEFMNILNFGELDRD

SEQ ID NO: 2170521 - protein, 23 aa, Cryptosporidium hominis
ESCSKMRRKEIINLEDTLKELED

SEQ ID NO: 2170522 - protein, 23 aa, Cryptosporidium hominis
ESCVKVLLNYGADLKLTNDDGLT

SEQ ID NO: 2170523 - protein, 23 aa, Cryptosporidium hominis
ESDAEFPLPISYLVDVNTKALEM

SEQ ID NO: 2170524 - protein, 28 aa, Cryptosporidium hominis
ESDELEMRLVLYLLKYFAPIWDTKVRNQ

SEQ ID NO: 2170525 - protein, 20 aa, Cryptosporidium hominis
ESDLKCPVSCKIRILDHHDL

SEQ ID NO: 2170526 - protein, 23 aa, Cryptosporidium hominis
ESDLYLPILGQLYPLLSKAKSIS

SEQ ID NO: 2170527 - protein, 17 aa, Cryptosporidium hominis
ESDRLQDFVLIGIFVKK

SEQ ID NO: 2170528 - protein, 19 aa, Cryptosporidium hominis
ESDSGCLLSSRYVSRLVPL

SEQ ID NO: 2170529 - protein, 23 aa, Cryptosporidium hominis
ESDSSLSTRGRRKLVKTENGTPV

SEQ ID NO: 2170530 - protein, 25 aa, Cryptosporidium hominis
ESEDDIWELYNLILSGDSVRSVTYR

SEQ ID NO: 2170531 - protein, 17 aa, Cryptosporidium hominis
ESEFKPEPELELEFEPE

SEQ ID NO: 2170532 - protein, 18 aa, Cryptosporidium hominis
ESEISRVDEEWRTRQTHI

SEQ ID NO: 2170533 - protein, 22 aa, Cryptosporidium hominis
ESELTLSIDISRDFSSNEEEDN

SEQ ID NO: 2170534 - protein, 20 aa, Cryptosporidium hominis
ESEMPLTVEIFIEVLDSEAL

SEQ ID NO: 2170535 - protein, 21 aa, Cryptosporidium hominis
ESENGWVHWYCGLREHYFFIV

SEQ ID NO: 2170536 - protein, 18 aa, Cryptosporidium hominis
ESEPRRSSVADVSYNSSL

SEQ ID NO: 2170537 - protein, 17 aa, Cryptosporidium hominis
ESFFWIRDRCLRYTPVN

SEQ ID NO: 2170538 - protein, 17 aa, Cryptosporidium hominis
ESFFYRLILETNQDKGF

SEQ ID NO: 2170539 - protein, 18 aa, Cryptosporidium hominis
ESFKHLNLVIEVYNTHIR

SEQ ID NO: 2170540 - protein, 27 aa, Cryptosporidium hominis
ESFLQLQICGVSSCAHSLIQKIHQLLD

SEQ ID NO: 2170541 - protein, 17 aa, Cryptosporidium hominis
ESFPTPGTESFYITQLS

SEQ ID NO: 2170542 - protein, 19 aa, Cryptosporidium hominis
ESFSGIYPLSPYVERELYH

SEQ ID NO: 2170543 - protein, 25 aa, Cryptosporidium hominis
ESFSIGENCMMDWHIKKSVFENIFP

SEQ ID NO: 2170544 - protein, 19 aa, Cryptosporidium hominis
ESFVSEFFPNSMVPGASHK

SEQ ID NO: 2170545 - protein, 24 aa, Cryptosporidium hominis
ESGEIRYGQCTGFLNRLPMLDSES

SEQ ID NO: 2170546 - protein, 23 aa, Cryptosporidium hominis
ESGLCIKGGIKGEGDSYSNSKLV

SEQ ID NO: 2170547 - protein, 21 aa, Cryptosporidium hominis
ESGLPYDIILVFMDKTRGTKE

SEQ ID NO: 2170548 - protein, 27 aa, Cryptosporidium hominis
ESHCSLPNPIIYKWPSNSVCIEDYKLY

SEQ ID NO: 2170549 - protein, 22 aa, Cryptosporidium hominis
ESHERNIICLTFRGQPKRWVFC

SEQ ID NO: 2170550 - protein, 27 aa, Cryptosporidium hominis
ESHTIDLFPCLVHKPKNSKVVSNYNSD

SEQ ID NO: 2170551 - protein, 18 aa, Cryptosporidium hominis
ESICMVVNAVTRVETLKD

SEQ ID NO: 2170552 - protein, 24 aa, Cryptosporidium hominis
ESIEKIRLAPKFELNRIHEHGVRK

SEQ ID NO: 2170553 - protein, 25 aa, Cryptosporidium hominis
ESIFQRKYWPVFIGTIPICDLEPSN

SEQ ID NO: 2170554 - protein, 18 aa, Cryptosporidium hominis
ESIIFKNQPKIFGKPKNI

SEQ ID NO: 2170555 - protein, 25 aa, Cryptosporidium hominis
ESIIKFNRLPICIWRTISDFEESSH

SEQ ID NO: 2170556 - protein, 23 aa, Cryptosporidium hominis
ESIIPGPAFFSIDGYASSGKIQQ

SEQ ID NO: 2170557 - protein, 19 aa, Cryptosporidium hominis
ESIKHAFFGYVFKINELVN

SEQ ID NO: 2170558 - protein, 32 aa, Cryptosporidium hominis
ESIKSFFNGCGVVKRVSIPRYSDTGKMRGFAM

SEQ ID NO: 2170559 - protein, 24 aa, Cryptosporidium hominis
ESIPKNRQCVLVSATMPTALASFS

SEQ ID NO: 2170560 - protein, 17 aa, Cryptosporidium hominis
ESISVVLNEQMRKLYNL

SEQ ID NO: 2170561 - protein, 17 aa, Cryptosporidium hominis
ESITMQCRICLTEGEQE

SEQ ID NO: 2170562 - protein, 23 aa, Cryptosporidium hominis
ESKCYRYRIFSLPPRAGASSSEN

SEQ ID NO: 2170563 - protein, 22 aa, Cryptosporidium hominis
ESKFCIRKTKLIDLIFPIIHGI

SEQ ID NO: 2170564 - protein, 20 aa, Cryptosporidium hominis
ESKIKRYEGLGFKLESDKIS

SEQ ID NO: 2170565 - protein, 23 aa, Cryptosporidium hominis
ESKLKYKLHIMKTSLQGLVSKTG

SEQ ID NO: 2170566 - protein, 27 aa, Cryptosporidium hominis
ESKNLSATEFDVCHSLLQKIKTRDEDL

SEQ ID NO: 2170567 - protein, 24 aa, Cryptosporidium hominis
ESKNPLRLVVMSATLESTKFQSYF

SEQ ID NO: 2170568 - protein, 20 aa, Cryptosporidium hominis
ESKNRIFAIIKGFSFIMRYS

SEQ ID NO: 2170569 - protein, 22 aa, Cryptosporidium hominis
ESKPYLNKEILDILNSKNLNRE

SEQ ID NO: 2170570 - protein, 23 aa, Cryptosporidium hominis
ESKSHLKSIVGLLKSAWNSSERI

SEQ ID NO: 2170571 - protein, 22 aa, Cryptosporidium hominis
ESLCNLVKISIITGTFNNIESY

SEQ ID NO: 2170572 - protein, 23 aa, Cryptosporidium hominis
ESLKIAEGILRRRKIVDTDRRLK

SEQ ID NO: 2170573 - protein, 23 aa, Cryptosporidium hominis
ESLKRDVENLSIMKKSYDDQSFI

SEQ ID NO: 2170574 - protein, 20 aa, Cryptosporidium hominis
ESLLKPCIEHHNMLQSYKSS

SEQ ID NO: 2170575 - protein, 25 aa, Cryptosporidium hominis
ESLLYLTLHELFIFRTLQTDPNPAN

SEQ ID NO: 2170576 - protein, 19 aa, Cryptosporidium hominis
ESLNDAILQACDMAMKIPE

SEQ ID NO: 2170577 - protein, 21 aa, Cryptosporidium hominis
ESLNGIWKRDESYPKQGETSS

SEQ ID NO: 2170578 - protein, 19 aa, Cryptosporidium hominis
ESLNLVAMINSIFDYIQEN

SEQ ID NO: 2170579 - protein, 21 aa, Cryptosporidium hominis
ESLPLKVFDMRGSDENGIDAF

SEQ ID NO: 2170580 - protein, 19 aa, Cryptosporidium hominis
ESLSVPSFNCISQELLSVD

SEQ ID NO: 2170581 - protein, 23 aa, Cryptosporidium hominis
ESLTEWEKIGWLTASRLLLEIDS

SEQ ID NO: 2170582 - protein, 24 aa, Cryptosporidium hominis
ESLYLKACKFVSVSQTNNKVIKML

SEQ ID NO: 2170583 - protein, 23 aa, Cryptosporidium hominis
ESMGGSPAWRCNPEFAQYYLHMA

SEQ ID NO: 2170584 - protein, 26 aa, Cryptosporidium hominis
ESMGRDFVGGGGISRGGGNRDGSDSK

SEQ ID NO: 2170585 - protein, 28 aa, Cryptosporidium hominis
ESNFKVIYKILCLILSMLETNQNTKKSL

SEQ ID NO: 2170586 - protein, 20 aa, Cryptosporidium hominis
ESNGIFYMHIPKMYENQIQD

SEQ ID NO: 2170587 - protein, 31 aa, Cryptosporidium hominis
ESNKKLLVFLKMRWLSNNVCSIECLSKFAKR

SEQ ID NO: 2170588 - protein, 24 aa, Cryptosporidium hominis
ESNKSKMIWSEIGHIVHSNRKPQY

SEQ ID NO: 2170589 - protein, 32 aa, Cryptosporidium hominis
ESNMYWCDIMQFYLFYCPKCIHLKQSNVPYCP

SEQ ID NO: 2170590 - protein, 18 aa, Cryptosporidium hominis
ESNTCEWAFGAMDKNTTV

SEQ ID NO: 2170591 - protein, 19 aa, Cryptosporidium hominis
ESNTLCNITSFLYKQLNNR

SEQ ID NO: 2170592 - protein, 25 aa, Cryptosporidium hominis
ESNVPFNIKYAYSLHKLNLNEDAAS

SEQ ID NO: 2170593 - protein, 26 aa, Cryptosporidium hominis
ESPYSKLKSWGIKTLLLKSSDDLRQE

SEQ ID NO: 2170594 - protein, 19 aa, Cryptosporidium hominis
ESQRVWLEYSLKRQQAQLQ

SEQ ID NO: 2170595 - protein, 24 aa, Cryptosporidium hominis
ESQYKLDKAVSMIQPLLDPFHPLH

SEQ ID NO: 2170596 - protein, 24 aa, Cryptosporidium hominis
ESRAEIVHGVLFIDEVHMLDVECF

SEQ ID NO: 2170597 - protein, 21 aa, Cryptosporidium hominis
ESRCKGSLGFVLLRQTFYRLQ

SEQ ID NO: 2170598 - protein, 25 aa, Cryptosporidium hominis
ESRDGFSKTAIREIVLLTNLKHENI

SEQ ID NO: 2170599 - protein, 26 aa, Cryptosporidium hominis
ESRFLQKRFEFEVDYMKKLRVWEASF

SEQ ID NO: 2170600 - protein, 21 aa, Cryptosporidium hominis
ESRHFDWPNIVTIHQGMHEVF

SEQ ID NO: 2170601 - protein, 20 aa, Cryptosporidium hominis
ESRLEIPSEWFLHTGREYNT

SEQ ID NO: 2170602 - protein, 21 aa, Cryptosporidium hominis
ESRLFPVGFKKEFCTFLEKPQ

SEQ ID NO: 2170603 - protein, 17 aa, Cryptosporidium hominis
ESRRMVFSKANIKLSEF

SEQ ID NO: 2170604 - protein, 17 aa, Cryptosporidium hominis
ESSIIYYLGHLALAKQC

SEQ ID NO: 2170605 - protein, 23 aa, Cryptosporidium hominis
ESSIPIFQCFAWERGKFSMGGTQ

SEQ ID NO: 2170606 - protein, 20 aa, Cryptosporidium hominis
ESSLRRLDRTLLLIEENFEQ

SEQ ID NO: 2170607 - protein, 21 aa, Cryptosporidium hominis
ESTLHLVLRLRGGVIEPSLAN

SEQ ID NO: 2170608 - protein, 24 aa, Cryptosporidium hominis
ESVDFPFRNDRLIKQCENINSSNA

SEQ ID NO: 2170609 - protein, 18 aa, Cryptosporidium hominis
ESVEITAIENFFIDLIKE

SEQ ID NO: 2170610 - protein, 23 aa, Cryptosporidium hominis
ESVRAMPTFKFFLNGKEVKSVVG

SEQ ID NO: 2170611 - protein, 23 aa, Cryptosporidium hominis
ESVRKCIKKESAIPRCNDGYIHR

SEQ ID NO: 2170612 - protein, 25 aa, Cryptosporidium hominis
ESVSIPARHAFRIIGEIMPVLDDVV

SEQ ID NO: 2170613 - protein, 37 aa, Cryptosporidium hominis
ESVVGSPQCGPYCSTYPKGYFAFWLTYNSVTNKYIIS

SEQ ID NO: 2170614 - protein, 24 aa, Cryptosporidium hominis
ETDKRLKIYFPLPPLDKYYDSCAP

SEQ ID NO: 2170615 - protein, 19 aa, Cryptosporidium hominis
ETELDILKEFIPIRLEMYE

SEQ ID NO: 2170616 - protein, 28 aa, Cryptosporidium hominis
ETFKLILELIRINLEFGIYGINQSNYDL

SEQ ID NO: 2170617 - protein, 34 aa, Cryptosporidium hominis
ETGIFKKEETALISFEFLGLAAMNLSSLDKTKFL

SEQ ID NO: 2170618 - protein, 19 aa, Cryptosporidium hominis
ETGSKIKPGIIVLVNNCDW

SEQ ID NO: 2170619 - protein, 18 aa, Cryptosporidium hominis
ETGWCPDLIMNPHGFPSR

SEQ ID NO: 2170620 - protein, 17 aa, Cryptosporidium hominis
ETIASSCGVGFARVLIE

SEQ ID NO: 2170621 - protein, 22 aa, Cryptosporidium hominis
ETIGSVKLKMQWNSPEDPNENT

SEQ ID NO: 2170622 - protein, 17 aa, Cryptosporidium hominis
ETIKFSLNIKDELSDLS

SEQ ID NO: 2170623 - protein, 21 aa, Cryptosporidium hominis
ETILDWQFKVPPKRGSQLYQL

SEQ ID NO: 2170624 - protein, 24 aa, Cryptosporidium hominis
ETISAYPMALKFVEDGNARDGRSI

SEQ ID NO: 2170625 - protein, 23 aa, Cryptosporidium hominis
ETISKICLGIYNFRRNAKDLRIL

SEQ ID NO: 2170626 - protein, 35 aa, Cryptosporidium hominis
ETISSSSFLYWLVNNCLKFETRKIVIVTHSNSITQ

SEQ ID NO: 2170627 - protein, 18 aa, Cryptosporidium hominis
ETKETFVIISADDKVRTI

SEQ ID NO: 2170628 - protein, 19 aa, Cryptosporidium hominis
ETKIVTSIDNFVIVWDFEA

SEQ ID NO: 2170629 - protein, 27 aa, Cryptosporidium hominis
ETKKISRFLICLVITDRPMECFKKRCY

SEQ ID NO: 2170630 - protein, 24 aa, Cryptosporidium hominis
ETKKRYNLEYKKFIQGIEELSKNS

SEQ ID NO: 2170631 - protein, 21 aa, Cryptosporidium hominis
ETLCCKLAYFKTIDDFEECKK

SEQ ID NO: 2170632 - protein, 44 aa, Cryptosporidium hominis
ETLCKHHPFEFITFLNYCRALRFEDRPDYAYLRRLFKDLFFREG

SEQ ID NO: 2170633 - protein, 28 aa, Cryptosporidium hominis
ETLELFDIPPVRVCIQILSAHQLPDNLS

SEQ ID NO: 2170634 - protein, 25 aa, Cryptosporidium hominis
ETLEYIQVFKLFCLVFSRLDMNQIT

SEQ ID NO: 2170635 - protein, 24 aa, Cryptosporidium hominis
ETLKFLEKVRVIWKHDNEFKHECL

SEQ ID NO: 2170636 - protein, 23 aa, Cryptosporidium hominis
ETLLRYSNDFDIIVAESCIVGLQ

SEQ ID NO: 2170637 - protein, 20 aa, Cryptosporidium hominis
ETLPRPNIDFNQTHKMLDPF

SEQ ID NO: 2170638 - protein, 19 aa, Cryptosporidium hominis
ETLREIFRLSKLRKQLKEF

SEQ ID NO: 2170639 - protein, 20 aa, Cryptosporidium hominis
ETLRFWQIFPTGRPKGPKNL

SEQ ID NO: 2170640 - protein, 24 aa, Cryptosporidium hominis
ETLRKDPNFELSIYPIGPVRDGCL

SEQ ID NO: 2170641 - protein, 19 aa, Cryptosporidium hominis
ETLSELVIEIRREIESYQI

SEQ ID NO: 2170642 - protein, 17 aa, Cryptosporidium hominis
ETLSWDDIYSLFESSLR

SEQ ID NO: 2170643 - protein, 22 aa, Cryptosporidium hominis
ETLYKVSRSRIFRINNEANNNS

SEQ ID NO: 2170644 - protein, 17 aa, Cryptosporidium hominis
ETMNWRIEKPCINIDFV

SEQ ID NO: 2170645 - protein, 38 aa, Cryptosporidium hominis
ETNKRFIMRKMPLLCWAADIPSAKAFNFDDYPQLLPNN

SEQ ID NO: 2170646 - protein, 23 aa, Cryptosporidium hominis
ETNRLRHVTKFYSYLLSKDAIPW

SEQ ID NO: 2170647 - protein, 22 aa, Cryptosporidium hominis
ETPEFKNELLIKESDKKSLDED

SEQ ID NO: 2170648 - protein, 21 aa, Cryptosporidium hominis
ETPQKCPLCNSNRVFEFQIQP

SEQ ID NO: 2170649 - protein, 17 aa, Cryptosporidium hominis
ETPRLYCSLGDLTQDLS

SEQ ID NO: 2170650 - protein, 21 aa, Cryptosporidium hominis
ETQPFPLCSCRYFEENESVDK

SEQ ID NO: 2170651 - protein, 24 aa, Cryptosporidium hominis
ETQPKRWMIMFSRAQSSSYRDSKD

SEQ ID NO: 2170652 - protein, 19 aa, Cryptosporidium hominis
ETQVECLNLSKSMCLKCVE

SEQ ID NO: 2170653 - protein, 21 aa, Cryptosporidium hominis
ETRICKIYDSPNLPEGDATFS

SEQ ID NO: 2170654 - protein, 17 aa, Cryptosporidium hominis
ETTPLLLRVDGLVGLLA

SEQ ID NO: 2170655 - protein, 23 aa, Cryptosporidium hominis
ETVEKLLSLEQWGTLIQTMNQMN

SEQ ID NO: 2170656 - protein, 19 aa, Cryptosporidium hominis
ETVRRYRDNYSQLRQLFEK

SEQ ID NO: 2170657 - protein, 29 aa, Cryptosporidium hominis
ETVTKTTTRFASGNVDGVTTRTETFVTKA

SEQ ID NO: 2170658 - protein, 17 aa, Cryptosporidium hominis
ETYGEVCPANWKKGQKG

SEQ ID NO: 2170659 - protein, 19 aa, Cryptosporidium hominis
ETYLGRSVKHAVITVPAYF

SEQ ID NO: 2170660 - protein, 19 aa, Cryptosporidium hominis
ETYRIGPFPSSSMSNSKLN

SEQ ID NO: 2170661 - protein, 17 aa, Cryptosporidium hominis
EVAVCNLASIGLPKFVD

SEQ ID NO: 2170662 - protein, 20 aa, Cryptosporidium hominis
EVAYDYSINDITGFDNINEE

SEQ ID NO: 2170663 - protein, 18 aa, Cryptosporidium hominis
EVCPANWKKGQKGMSATH

SEQ ID NO: 2170664 - protein, 25 aa, Cryptosporidium hominis
EVDDELRQALLLSIQDFSGNDSTNN

SEQ ID NO: 2170665 - protein, 25 aa, Cryptosporidium hominis
EVDLRKCDVWNLGVLLHCLLVGVPP

SEQ ID NO: 2170666 - protein, 24 aa, Cryptosporidium hominis
EVDRLGPTAFEWILGEIEHQFYRS

SEQ ID NO: 2170667 - protein, 31 aa, Cryptosporidium hominis
EVDSSIFLIKLCGQIIIKFPKLRVLLDPEGI

SEQ ID NO: 2170668 - protein, 37 aa, Cryptosporidium hominis
EVDTAYSIKLFLERFGMSCGVLTPIIPAATRRMLIQC

SEQ ID NO: 2170669 - protein, 26 aa, Cryptosporidium hominis
EVEIKIKLIDSMPFDRFVCVFKTLDE

SEQ ID NO: 2170670 - protein, 19 aa, Cryptosporidium hominis
EVENTDLLVRLNDYKENQK

SEQ ID NO: 2170671 - protein, 19 aa, Cryptosporidium hominis
EVEVFDCSFSKLDQFNLDS

SEQ ID NO: 2170672 - protein, 20 aa, Cryptosporidium hominis
EVFARAILNGQVFKEFKNQR

SEQ ID NO: 2170673 - protein, 19 aa, Cryptosporidium hominis
EVFPYLSCFFAVKHNSFSQ

SEQ ID NO: 2170674 - protein, 25 aa, Cryptosporidium hominis
EVFSRKKCIWRPCEELAKNNLTEMG

SEQ ID NO: 2170675 - protein, 17 aa, Cryptosporidium hominis
EVFSVFVSKAIERALLP

SEQ ID NO: 2170676 - protein, 19 aa, Cryptosporidium hominis
EVGIKVWILDGGECCSVGV

SEQ ID NO: 2170677 - protein, 18 aa, Cryptosporidium hominis
EVGKSIGKKEQRKNLEAF

SEQ ID NO: 2170678 - protein, 34 aa, Cryptosporidium hominis
EVGNSGLFRPEMLRPLGFPSDIVVIAWGLSLERP

SEQ ID NO: 2170679 - protein, 20 aa, Cryptosporidium hominis
EVGRCHFVMLDGCATPLQLD

SEQ ID NO: 2170680 - protein, 25 aa, Cryptosporidium hominis
EVGSDSCTFVWLCMKLGTSKFNINS

SEQ ID NO: 2170681 - protein, 24 aa, Cryptosporidium hominis
EVHKEVIELISFTIYRQANGPAAG

SEQ ID NO: 2170682 - protein, 21 aa, Cryptosporidium hominis
EVIASIAIKFCAKIPDKDELH

SEQ ID NO: 2170683 - protein, 30 aa, Cryptosporidium hominis
EVIELPIKHPEIFESLGIAQPKGVLLYGPP

SEQ ID NO: 2170684 - protein, 20 aa, Cryptosporidium hominis
EVIFDPKLIMRDVQPVHELI

SEQ ID NO: 2170685 - protein, 18 aa, Cryptosporidium hominis
EVILNYFVCNEFSTDELI

SEQ ID NO: 2170686 - protein, 25 aa, Cryptosporidium hominis
EVINSPWLFFSIRILDGYDTFCSDF

SEQ ID NO: 2170687 - protein, 20 aa, Cryptosporidium hominis
EVINYPPIIKNYYKEVNEIK

SEQ ID NO: 2170688 - protein, 20 aa, Cryptosporidium hominis
EVIRGELLLVIRNVPGKQEV

SEQ ID NO: 2170689 - protein, 19 aa, Cryptosporidium hominis
EVIRLFKAVNTDSIDVVSI

SEQ ID NO: 2170690 - protein, 18 aa, Cryptosporidium hominis
EVKCVDWSPFNNFVAACC

SEQ ID NO: 2170691 - protein, 24 aa, Cryptosporidium hominis
EVKIPRIYFHSVLGSNIPTKNVKL

SEQ ID NO: 2170692 - protein, 18 aa, Cryptosporidium hominis
EVLCCKKGACWANKIGLS

SEQ ID NO: 2170693 - protein, 21 aa, Cryptosporidium hominis
EVLFLQQIIAPFVLRRSKQDV

SEQ ID NO: 2170694 - protein, 24 aa, Cryptosporidium hominis
EVLLGFNCTIFAYGQTGTGKTYTM

SEQ ID NO: 2170695 - protein, 27 aa, Cryptosporidium hominis
EVLMLTSFSGGFGFMGGAVMEPEEPRK

SEQ ID NO: 2170696 - protein, 27 aa, Cryptosporidium hominis
EVNLLKKLRGCPHVIQLIDSEIALSCG

SEQ ID NO: 2170697 - protein, 28 aa, Cryptosporidium hominis
EVNLLTKWMGCPPLPFKLDDKETDNLEK

SEQ ID NO: 2170698 - protein, 21 aa, Cryptosporidium hominis
EVPDIPRNIAIADYVEQILFV

SEQ ID NO: 2170699 - protein, 21 aa, Cryptosporidium hominis
EVPQLSAVVVLAAAKAAEAAQ

SEQ ID NO: 2170700 - protein, 19 aa, Cryptosporidium hominis
EVPTGWKYFGNLMDAKMID

SEQ ID NO: 2170701 - protein, 25 aa, Cryptosporidium hominis
EVPTSYFPVMGFLSERRRLDEMPEI

SEQ ID NO: 2170702 - protein, 25 aa, Cryptosporidium hominis
EVQVFKIFLTKNCRYTEDIDNKLSK

SEQ ID NO: 2170703 - protein, 24 aa, Cryptosporidium hominis
EVREDLKDGISLISRELVNKLTNN

SEQ ID NO: 2170704 - protein, 18 aa, Cryptosporidium hominis
EVRSRVILTDGLELKNEI

SEQ ID NO: 2170705 - protein, 18 aa, Cryptosporidium hominis
EVSELIEMVSSIKLWVQL

SEQ ID NO: 2170706 - protein, 27 aa, Cryptosporidium hominis
EVSELWKIRFGIEVDIIQLFKMAGLYE

SEQ ID NO: 2170707 - protein, 23 aa, Cryptosporidium hominis
EVSEYDIGYTYDFKNRNHPSEKK

SEQ ID NO: 2170708 - protein, 26 aa, Cryptosporidium hominis
EVSGNLKRIIKIVLFTLKSSNYEWIF

SEQ ID NO: 2170709 - protein, 31 aa, Cryptosporidium hominis
EVSHMVKARLAVCMTFRLAIETFNQYYSYFD

SEQ ID NO: 2170710 - protein, 27 aa, Cryptosporidium hominis
EVSIRRMAYCIGVALSRLHELGIVHRD

SEQ ID NO: 2170711 - protein, 26 aa, Cryptosporidium hominis
EVSKLRVQLEESRKLQNYWKELVQSV

SEQ ID NO: 2170712 - protein, 19 aa, Cryptosporidium hominis
EVSLVFTLQFENNQEIIFS

SEQ ID NO: 2170713 - protein, 21 aa, Cryptosporidium hominis
EVTHSPILVKIKFLDSAEISS

SEQ ID NO: 2170714 - protein, 17 aa, Cryptosporidium hominis
EVTLRFRKRERLLSAGV

SEQ ID NO: 2170715 - protein, 17 aa, Cryptosporidium hominis
EVTYRGSVSLNNVLLEL

SEQ ID NO: 2170716 - protein, 21 aa, Cryptosporidium hominis
EVVAGSSGFGCNFDGDPEIIE

SEQ ID NO: 2170717 - protein, 21 aa, Cryptosporidium hominis
EVVEISSKITMGASEGEEGGF

SEQ ID NO: 2170718 - protein, 22 aa, Cryptosporidium hominis
EVVFKLPLEVGSNMAGGQLHIR

SEQ ID NO: 2170719 - protein, 19 aa, Cryptosporidium hominis
EVVGPPGANIFIFNVPYEW

SEQ ID NO: 2170720 - protein, 19 aa, Cryptosporidium hominis
EVVTSTQAMNCLKIPPMEA

SEQ ID NO: 2170721 - protein, 21 aa, Cryptosporidium hominis
EVYAYRLLRHPNICSYIGVCL

SEQ ID NO: 2170722 - protein, 33 aa, Cryptosporidium hominis
EVYEDRLNLYFILEFCAGGNLFHSLQDAIQSGF

SEQ ID NO: 2170723 - protein, 29 aa, Cryptosporidium hominis
EVYNGRYLIVSKLGWGHFSTVWLAIDTLS

SEQ ID NO: 2170724 - protein, 20 aa, Cryptosporidium hominis
EVYRYFKAIKSITLLQQWWR

SEQ ID NO: 2170725 - protein, 21 aa, Cryptosporidium hominis
EWLDPRVKKTEWSRAEEEKLL

SEQ ID NO: 2170726 - protein, 21 aa, Cryptosporidium hominis
EWLDVISRQGSKLSRTSFNTA

SEQ ID NO: 2170727 - protein, 19 aa, Cryptosporidium hominis
EWQNLMISQAFILSSSISE

SEQ ID NO: 2170728 - protein, 18 aa, Cryptosporidium hominis
EWSNLRFWESAVVGASDS

SEQ ID NO: 2170729 - protein, 20 aa, Cryptosporidium hominis
EWTKQFVCFVDMCQMCCNTQ

SEQ ID NO: 2170730 - protein, 28 aa, Cryptosporidium hominis
EWVMHYWKEIPLPFSFTSIINRIRNNYY

SEQ ID NO: 2170731 - protein, 17 aa, Cryptosporidium hominis
EWYPERQSWKVVGHTGI

SEQ ID NO: 2170732 - protein, 21 aa, Cryptosporidium hominis
EYACSIALKKLEEISLKNGTV

SEQ ID NO: 2170733 - protein, 23 aa, Cryptosporidium hominis
EYCKFCIPHGSYLINLGNPDEEK

SEQ ID NO: 2170734 - protein, 21 aa, Cryptosporidium hominis
EYCKKISILSLERMSIVTCAC

SEQ ID NO: 2170735 - protein, 20 aa, Cryptosporidium hominis
EYDREMKLFMEYQSKLRALR

SEQ ID NO: 2170736 - protein, 22 aa, Cryptosporidium hominis
EYDRRGMYGIINRWNHINPCSQ

SEQ ID NO: 2170737 - protein, 21 aa, Cryptosporidium hominis
EYEIPCQWRKIDNIISKNVGS

SEQ ID NO: 2170738 - protein, 17 aa, Cryptosporidium hominis
EYEIWLVTEYIRTGDLF

SEQ ID NO: 2170739 - protein, 22 aa, Cryptosporidium hominis
EYFEKPLDVWSLCYGVRTKISK

SEQ ID NO: 2170740 - protein, 24 aa, Cryptosporidium hominis
EYFREIFSSLLLKPFNKTEETTLL

SEQ ID NO: 2170741 - protein, 17 aa, Cryptosporidium hominis
EYGDGLIQLKSDKKYEF

SEQ ID NO: 2170742 - protein, 23 aa, Cryptosporidium hominis
EYGMIPRALNLIFDNIDRNCEKG

SEQ ID NO: 2170743 - protein, 25 aa, Cryptosporidium hominis
EYGNLYKYKVDYEILSKQNETLMIE

SEQ ID NO: 2170744 - protein, 19 aa, Cryptosporidium hominis
EYIFNSREVFGLKLIADDK

SEQ ID NO: 2170745 - protein, 17 aa, Cryptosporidium hominis
EYIKKGLLLGILGGAEH

SEQ ID NO: 2170746 - protein, 19 aa, Cryptosporidium hominis
EYILPKFMESYLKCDEHKL

SEQ ID NO: 2170747 - protein, 24 aa, Cryptosporidium hominis
EYISRVIKCRCLFSTHLHLLCDEF

SEQ ID NO: 2170748 - protein, 24 aa, Cryptosporidium hominis
EYKAGEFSRGYFLGRYEIPKIDEN

SEQ ID NO: 2170749 - protein, 18 aa, Cryptosporidium hominis
EYKKRVTVGSSIRNSNRT

SEQ ID NO: 2170750 - protein, 21 aa, Cryptosporidium hominis
EYKNSLFILETFKLPEDTTES

SEQ ID NO: 2170751 - protein, 19 aa, Cryptosporidium hominis
EYKRLKREHFDYMVNCKCN

SEQ ID NO: 2170752 - protein, 25 aa, Cryptosporidium hominis
EYLGTWWRTEFNYSPLPYLPPHSTR

SEQ ID NO: 2170753 - protein, 19 aa, Cryptosporidium hominis
EYLICGESKIDLVILKNHT

SEQ ID NO: 2170754 - protein, 25 aa, Cryptosporidium hominis
EYLIEIFQGLEIVLRLLERRQKPFF

SEQ ID NO: 2170755 - protein, 23 aa, Cryptosporidium hominis
EYNACKLPSLGIKQHNKEEDLNH

SEQ ID NO: 2170756 - protein, 22 aa, Cryptosporidium hominis
EYNLCEIKRVISIAESAISMPE

SEQ ID NO: 2170757 - protein, 25 aa, Cryptosporidium hominis
EYNLFLKLLHRFSQFKFRSIGATED

SEQ ID NO: 2170758 - protein, 24 aa, Cryptosporidium hominis
EYNLRMKALELFKGKNQAKNFRSE

SEQ ID NO: 2170759 - protein, 22 aa, Cryptosporidium hominis
EYNRNCNLLKGPFESKIDSNKA

SEQ ID NO: 2170760 - protein, 23 aa, Cryptosporidium hominis
EYPERRISTRNSIHSSSDNKIDL

SEQ ID NO: 2170761 - protein, 23 aa, Cryptosporidium hominis
EYPETAEAISFLIGALAKDTRLE

SEQ ID NO: 2170762 - protein, 17 aa, Cryptosporidium hominis
EYQIVGVSWLLALHQNS

SEQ ID NO: 2170763 - protein, 19 aa, Cryptosporidium hominis
EYRLLKTVHPRDNPWYKGC

SEQ ID NO: 2170764 - protein, 19 aa, Cryptosporidium hominis
EYRWLHFLHLALIVHLISS

SEQ ID NO: 2170765 - protein, 23 aa, Cryptosporidium hominis
EYSCPDCGKSILENFLMDILEAF

SEQ ID NO: 2170766 - protein, 22 aa, Cryptosporidium hominis
EYSDCSPLSFLTGGGGATNFGM

SEQ ID NO: 2170767 - protein, 19 aa, Cryptosporidium hominis
EYSEKCLLANHRFEQELYR

SEQ ID NO: 2170768 - protein, 24 aa, Cryptosporidium hominis
EYTRDAFNLYGLRQYFPKNYDSLI

SEQ ID NO: 2170769 - protein, 25 aa, Cryptosporidium hominis
EYTRHQRCCIMFYPPGNELIRQDGL

SEQ ID NO: 2170770 - protein, 20 aa, Cryptosporidium hominis
FAARAKFYFENTFLGEATFD

SEQ ID NO: 2170771 - protein, 18 aa, Cryptosporidium hominis
FADLRTNQQLAYVVRATQ

SEQ ID NO: 2170772 - protein, 20 aa, Cryptosporidium hominis
FADRFANVINEFIIDIKRIN

SEQ ID NO: 2170773 - protein, 21 aa, Cryptosporidium hominis
FADRFCLRRLIDFSLGSLSSE

SEQ ID NO: 2170774 - protein, 25 aa, Cryptosporidium hominis
FADVEPRLSVLYKLLVKISSTHNQV

SEQ ID NO: 2170775 - protein, 17 aa, Cryptosporidium hominis
FAENAWILEILVSLHEG

SEQ ID NO: 2170776 - protein, 23 aa, Cryptosporidium hominis
FAFLKHCRLPFPFDDQRIRPNTQ

SEQ ID NO: 2170777 - protein, 19 aa, Cryptosporidium hominis
FAFTCPKGHVITHIHAKSN

SEQ ID NO: 2170778 - protein, 25 aa, Cryptosporidium hominis
FAGAYKYAVSNGIKTDNVYGLPVDE

SEQ ID NO: 2170779 - protein, 24 aa, Cryptosporidium hominis
FAIDEAHCISEWGHDFRTAYRRLN

SEQ ID NO: 2170780 - protein, 27 aa, Cryptosporidium hominis
FAIDEAHCVCQWGFDFRPDYIQLCKLR

SEQ ID NO: 2170781 - protein, 17 aa, Cryptosporidium hominis
FAKDSSMSLAKFHQDHL

SEQ ID NO: 2170782 - protein, 21 aa, Cryptosporidium hominis
FAKESLSIFYSYDLSSNSCSV

SEQ ID NO: 2170783 - protein, 25 aa, Cryptosporidium hominis
FAKLSSMHFYGWKKGLKTGIYYLRT

SEQ ID NO: 2170784 - protein, 18 aa, Cryptosporidium hominis
FALARMIELTYGRVANNG

SEQ ID NO: 2170785 - protein, 25 aa, Cryptosporidium hominis
FALKQLKLLILTTMAFAKNGVFQSM

SEQ ID NO: 2170786 - protein, 19 aa, Cryptosporidium hominis
FALLEMVGILYRRFPNIKE

SEQ ID NO: 2170787 - protein, 17 aa, Cryptosporidium hominis
FALNLGRKPDLMYSHSL

SEQ ID NO: 2170788 - protein, 32 aa, Cryptosporidium hominis
FAMLREKNFRPSINTLQEWLSITWNTTYNNGL

SEQ ID NO: 2170789 - protein, 24 aa, Cryptosporidium hominis
FANTCFNLFSLLSLLKDSLISITS

SEQ ID NO: 2170790 - protein, 17 aa, Cryptosporidium hominis
FANTRFLLDQSNFCNDI

SEQ ID NO: 2170791 - protein, 18 aa, Cryptosporidium hominis
FAQQPFLYMNSNLTDWEF

SEQ ID NO: 2170792 - protein, 18 aa, Cryptosporidium hominis
FAQRFLKPSGTMIPQRYT

SEQ ID NO: 2170793 - protein, 18 aa, Cryptosporidium hominis
FARDALRQIKQKKLSRFI

SEQ ID NO: 2170794 - protein, 20 aa, Cryptosporidium hominis
FASCFRCGKSGHIVAFCPNN

SEQ ID NO: 2170795 - protein, 17 aa, Cryptosporidium hominis
FASIEAFTQEFGELQTS

SEQ ID NO: 2170796 - protein, 27 aa, Cryptosporidium hominis
FASILKEWRLCTGIELILTAKVPIIKY

SEQ ID NO: 2170797 - protein, 27 aa, Cryptosporidium hominis
FASIMGARCVVVWIGIRDCLSQESLFS

SEQ ID NO: 2170798 - protein, 22 aa, Cryptosporidium hominis
FASLIKRICTRLRIKNLPNPSI

SEQ ID NO: 2170799 - protein, 19 aa, Cryptosporidium hominis
FAVFICLNCSSDHRKMGVH

SEQ ID NO: 2170800 - protein, 22 aa, Cryptosporidium hominis
FCDISKYHATIMVLNIAANIHK

SEQ ID NO: 2170801 - protein, 24 aa, Cryptosporidium hominis
FCDREMRAGISLLEYLLSQGFLDE

SEQ ID NO: 2170802 - protein, 21 aa, Cryptosporidium hominis
FCEFQLKLKLKSAFNGKEFEH

SEQ ID NO: 2170803 - protein, 25 aa, Cryptosporidium hominis
FCEIKKARISLIEWAFNDIQSDLTR

SEQ ID NO: 2170804 - protein, 19 aa, Cryptosporidium hominis
FCELKRWCPSLRVVKLHGD

SEQ ID NO: 2170805 - protein, 17 aa, Cryptosporidium hominis
FCFSCILSDLGGKKQRL

SEQ ID NO: 2170806 - protein, 17 aa, Cryptosporidium hominis
FCGISIVCNYHKYCKFN

SEQ ID NO: 2170807 - protein, 18 aa, Cryptosporidium hominis
FCGTLVIIFDLWTRVTRD

SEQ ID NO: 2170808 - protein, 18 aa, Cryptosporidium hominis
FCHILSCKVFENGQLGVI

SEQ ID NO: 2170809 - protein, 19 aa, Cryptosporidium hominis
FCHVMRRVPSKFLLGEASD

SEQ ID NO: 2170810 - protein, 17 aa, Cryptosporidium hominis
FCITELYIVSQSSSGMI

SEQ ID NO: 2170811 - protein, 22 aa, Cryptosporidium hominis
FCNCGYMFKVIVVSDCFVGKRI

SEQ ID NO: 2170812 - protein, 24 aa, Cryptosporidium hominis
FCNNNCLIIMKWIDSLLYITQKIR

SEQ ID NO: 2170813 - protein, 17 aa, Cryptosporidium hominis
FCNYDMVSRIMRLNSSN

SEQ ID NO: 2170814 - protein, 18 aa, Cryptosporidium hominis
FCQEGIDLLSNMLCFDPN

SEQ ID NO: 2170815 - protein, 17 aa, Cryptosporidium hominis
FCQISFKSSNGVTKSIG

SEQ ID NO: 2170816 - protein, 19 aa, Cryptosporidium hominis
FCQNMNWSNMQIVFQSYLR

SEQ ID NO: 2170817 - protein, 19 aa, Cryptosporidium hominis
FCSLFGNKDPFIWQESLCL

SEQ ID NO: 2170818 - protein, 17 aa, Cryptosporidium hominis
FCSRYSLTKELKEKTLF

SEQ ID NO: 2170819 - protein, 22 aa, Cryptosporidium hominis
FCSSIEVCLVFGADIIFMQNWD

SEQ ID NO: 2170820 - protein, 18 aa, Cryptosporidium hominis
FCVTFKMISFRPYVGEVI

SEQ ID NO: 2170821 - protein, 19 aa, Cryptosporidium hominis
FCYVKRPISDFDLTELRIH

SEQ ID NO: 2170822 - protein, 24 aa, Cryptosporidium hominis
FDAKTAKGSTVWCDSAPSVLNDPD

SEQ ID NO: 2170823 - protein, 17 aa, Cryptosporidium hominis
FDAKWDLGWMNDTLSYL

SEQ ID NO: 2170824 - protein, 26 aa, Cryptosporidium hominis
FDCVKRIPDGILLFFGSYSLMDQAVK

SEQ ID NO: 2170825 - protein, 18 aa, Cryptosporidium hominis
FDDESVLSLIYFKTKTEL

SEQ ID NO: 2170826 - protein, 27 aa, Cryptosporidium hominis
FDDFPSFPYKYGMAITSLLADGQSNSI

SEQ ID NO: 2170827 - protein, 25 aa, Cryptosporidium hominis
FDEFMRFSVLLTVLFGLKDPIDPKV

SEQ ID NO: 2170828 - protein, 20 aa, Cryptosporidium hominis
FDENMADISFQVNDSNNNQL

SEQ ID NO: 2170829 - protein, 20 aa, Cryptosporidium hominis
FDFDSYISFVIFIINYGNYF

SEQ ID NO: 2170830 - protein, 26 aa, Cryptosporidium hominis
FDFLDGNCSRGFFLADIQNISEQFLL

SEQ ID NO: 2170831 - protein, 19 aa, Cryptosporidium hominis
FDFSEMIYSVLIHDKNQIS

SEQ ID NO: 2170832 - protein, 24 aa, Cryptosporidium hominis
FDFSYKNCHPLIIFKYKDKLLSYR

SEQ ID NO: 2170833 - protein, 17 aa, Cryptosporidium hominis
FDGEIYAGINVRKAAVT

SEQ ID NO: 2170834 - protein, 19 aa, Cryptosporidium hominis
FDGPLSFDTIMALKKKKSN

SEQ ID NO: 2170835 - protein, 20 aa, Cryptosporidium hominis
FDGTCVFTLNSRSKINYSVI

SEQ ID NO: 2170836 - protein, 17 aa, Cryptosporidium hominis
FDHNFNAGMSRSYSKSY

SEQ ID NO: 2170837 - protein, 30 aa, Cryptosporidium hominis
FDHSRWMGSRGRVKAAYSFSWDSIAQATSF

SEQ ID NO: 2170838 - protein, 21 aa, Cryptosporidium hominis
FDILGQTLQHFGSLSQSRTLV

SEQ ID NO: 2170839 - protein, 17 aa, Cryptosporidium hominis
FDILKEYNRQGVPISSG

SEQ ID NO: 2170840 - protein, 17 aa, Cryptosporidium hominis
FDILKKRIPDQIERAKM

SEQ ID NO: 2170841 - protein, 19 aa, Cryptosporidium hominis
FDINRLWIRNLGRDCRLAL

SEQ ID NO: 2170842 - protein, 20 aa, Cryptosporidium hominis
FDITIAEFILKIYPNIEPSN

SEQ ID NO: 2170843 - protein, 26 aa, Cryptosporidium hominis
FDKARAAAPCVLFFDELDSIGTQRGS

SEQ ID NO: 2170844 - protein, 28 aa, Cryptosporidium hominis
FDKELEPAIKFCFGHTIICEDENIAKMI

SEQ ID NO: 2170845 - protein, 19 aa, Cryptosporidium hominis
FDKKYKVCIKRVDNKLTVR

SEQ ID NO: 2170846 - protein, 17 aa, Cryptosporidium hominis
FDKVMGYFRKYAGLEEG

SEQ ID NO: 2170847 - protein, 17 aa, Cryptosporidium hominis
FDLAKIVRHPHLGVVGN

SEQ ID NO: 2170848 - protein, 21 aa, Cryptosporidium hominis
FDLALGLGILELCISILQEIQ

SEQ ID NO: 2170849 - protein, 18 aa, Cryptosporidium hominis
FDLDNYLIMYNITSSEDG

SEQ ID NO: 2170850 - protein, 17 aa, Cryptosporidium hominis
FDLEKFCLSKICEINEI

SEQ ID NO: 2170851 - protein, 17 aa, Cryptosporidium hominis
FDLKYNGFYILYAKSNK

SEQ ID NO: 2170852 - protein, 25 aa, Cryptosporidium hominis
FDLLAQICLKGGFVNDAIFYYNESL

SEQ ID NO: 2170853 - protein, 25 aa, Cryptosporidium hominis
FDLMYSKRAFVHWYVGEGMEEGEFS

SEQ ID NO: 2170854 - protein, 21 aa, Cryptosporidium hominis
FDLWTRVTRDFFWPYTTVASG

SEQ ID NO: 2170855 - protein, 17 aa, Cryptosporidium hominis
FDMFGGMDGMMGGMGGM

SEQ ID NO: 2170856 - protein, 24 aa, Cryptosporidium hominis
FDMRKLNIARFIYKGFVHAVLDVD

SEQ ID NO: 2170857 - protein, 22 aa, Cryptosporidium hominis
FDNDIVRYFKMISGIASDINSE

SEQ ID NO: 2170858 - protein, 25 aa, Cryptosporidium hominis
FDNITKCKIEFPRQPTLSNECINAI

SEQ ID NO: 2170859 - protein, 17 aa, Cryptosporidium hominis
FDNSCILITARGFSDLP

SEQ ID NO: 2170860 - protein, 20 aa, Cryptosporidium hominis
FDPEFAKGLFDVYRRCLFVE

SEQ ID NO: 2170861 - protein, 20 aa, Cryptosporidium hominis
FDPKNMFILLSIPENKALIE

SEQ ID NO: 2170862 - protein, 20 aa, Cryptosporidium hominis
FDPQNGIGILIGNSSSSPNY

SEQ ID NO: 2170863 - protein, 17 aa, Cryptosporidium hominis
FDQVLKFGSYVVDELVN

SEQ ID NO: 2170864 - protein, 18 aa, Cryptosporidium hominis
FDRFVCVFKTLDENGHVC

SEQ ID NO: 2170865 - protein, 20 aa, Cryptosporidium hominis
FDSILLAWDFFKDIKEEVFG

SEQ ID NO: 2170866 - protein, 23 aa, Cryptosporidium hominis
FDSNDAKSLFVLNPDGSGILKDI

SEQ ID NO: 2170867 - protein, 23 aa, Cryptosporidium hominis
FDSSNSIFSRFDWHKDSIRYSLK

SEQ ID NO: 2170868 - protein, 19 aa, Cryptosporidium hominis
FDVIFPADIARILVGVTSF

SEQ ID NO: 2170869 - protein, 22 aa, Cryptosporidium hominis
FDYEICSICSGAISPYEAIRLL

SEQ ID NO: 2170870 - protein, 19 aa, Cryptosporidium hominis
FDYKYSFNMILAAQELNLE

SEQ ID NO: 2170871 - protein, 17 aa, Cryptosporidium hominis
FDYRKEFDACLDTLVIS

SEQ ID NO: 2170872 - protein, 22 aa, Cryptosporidium hominis
FECGVCKYGKEFDKIQRIIKTK

SEQ ID NO: 2170873 - protein, 25 aa, Cryptosporidium hominis
FEDCFKEWLNNGLFTGEFGSICVNE

SEQ ID NO: 2170874 - protein, 24 aa, Cryptosporidium hominis
FEDINSLLFRHSPPQMNGDELANL

SEQ ID NO: 2170875 - protein, 23 aa, Cryptosporidium hominis
FEDLKLVLFNLSGKIIKDEDLIF

SEQ ID NO: 2170876 - protein, 18 aa, Cryptosporidium hominis
FEDPMACIHEMLSQISGV

SEQ ID NO: 2170877 - protein, 23 aa, Cryptosporidium hominis
FEDSESPPICTIMTDCSGVIKTG

SEQ ID NO: 2170878 - protein, 17 aa, Cryptosporidium hominis
FEDYGEVTDCHLVTNPL

SEQ ID NO: 2170879 - protein, 24 aa, Cryptosporidium hominis
FEEAQRRAIEFLRRKREEVRMKTQ

SEQ ID NO: 2170880 - protein, 22 aa, Cryptosporidium hominis
FEEIINFLLCRVIGECKSNTVV

SEQ ID NO: 2170881 - protein, 20 aa, Cryptosporidium hominis
FEFFGEATVNLIQCGINILE

SEQ ID NO: 2170882 - protein, 22 aa, Cryptosporidium hominis
FEFHGLDPLISFSIFQELEDAK

SEQ ID NO: 2170883 - protein, 17 aa, Cryptosporidium hominis
FEFLNILQVHGFPRVLG

SEQ ID NO: 2170884 - protein, 21 aa, Cryptosporidium hominis
FEFPSAIQRRAIVPIIQGRDT

SEQ ID NO: 2170885 - protein, 25 aa, Cryptosporidium hominis
FEGGIWRVLLGLLREEFNKKSNKKS

SEQ ID NO: 2170886 - protein, 21 aa, Cryptosporidium hominis
FEGIHCKICYLDFAQRWVYQQ

SEQ ID NO: 2170887 - protein, 18 aa, Cryptosporidium hominis
FEHPADCIYMNGVDNRHF

SEQ ID NO: 2170888 - protein, 17 aa, Cryptosporidium hominis
FEICHTTFPSVYHKYKK

SEQ ID NO: 2170889 - protein, 17 aa, Cryptosporidium hominis
FEIGGLLADKSCQRNEY

SEQ ID NO: 2170890 - protein, 26 aa, Cryptosporidium hominis
FEIGQKLLEKMGWKQGEGLGKNNQGI

SEQ ID NO: 2170891 - protein, 19 aa, Cryptosporidium hominis
FEIGSTFRISMLEYAIPAN

SEQ ID NO: 2170892 - protein, 19 aa, Cryptosporidium hominis
FEIHGCGHKLNEFSESAKS

SEQ ID NO: 2170893 - protein, 18 aa, Cryptosporidium hominis
FEIIPYTLAENAGLNPIE

SEQ ID NO: 2170894 - protein, 20 aa, Cryptosporidium hominis
FEIISIQLSMHYMLINEETS

SEQ ID NO: 2170895 - protein, 18 aa, Cryptosporidium hominis
FEIKELLTALKGVAEELI

SEQ ID NO: 2170896 - protein, 20 aa, Cryptosporidium hominis
FEILDSPLILPQIVTCLNCT

SEQ ID NO: 2170897 - protein, 17 aa, Cryptosporidium hominis
FEILKNVCNIIEYEVEP

SEQ ID NO: 2170898 - protein, 17 aa, Cryptosporidium hominis
FEILRTTLIQSLLKTIA

SEQ ID NO: 2170899 - protein, 43 aa, Cryptosporidium hominis
FEIQYAKDFEFFFGVPYRPYIRLSRYRFGKNMKYPRDLKQEEA

SEQ ID NO: 2170900 - protein, 17 aa, Cryptosporidium hominis
FEISSCISASPKLKAVI

SEQ ID NO: 2170901 - protein, 25 aa, Cryptosporidium hominis
FEITFHPYCLISNSDGIGFVVIGLN

SEQ ID NO: 2170902 - protein, 17 aa, Cryptosporidium hominis
FEKELFAFLTGETPREN

SEQ ID NO: 2170903 - protein, 23 aa, Cryptosporidium hominis
FEKGNLFLFQFGLSIVDVCREDI

SEQ ID NO: 2170904 - protein, 18 aa, Cryptosporidium hominis
FEKKLPYVFKDSSNVPEW

SEQ ID NO: 2170905 - protein, 20 aa, Cryptosporidium hominis
FEKKLQLKRCRESRESIIKD

SEQ ID NO: 2170906 - protein, 18 aa, Cryptosporidium hominis
FEKLILLYYVIGQREYME

SEQ ID NO: 2170907 - protein, 23 aa, Cryptosporidium hominis
FEKNCNRLPILHSNCKLRTMNDS

SEQ ID NO: 2170908 - protein, 21 aa, Cryptosporidium hominis
FEKTLKCEIINLEKQISKMEC

SEQ ID NO: 2170909 - protein, 29 aa, Cryptosporidium hominis
FEKVFKIIKLMKIKKFLNKSECTIDDVNG

SEQ ID NO: 2170910 - protein, 18 aa, Cryptosporidium hominis
FEKVWIDPFFDRKTLHVA

SEQ ID NO: 2170911 - protein, 22 aa, Cryptosporidium hominis
FELCSSYPRIIVVPENISDSQL

SEQ ID NO: 2170912 - protein, 17 aa, Cryptosporidium hominis
FELFPFQVLSTEKNERF

SEQ ID NO: 2170913 - protein, 19 aa, Cryptosporidium hominis
FELLASELFDVPRDSGVAY

SEQ ID NO: 2170914 - protein, 17 aa, Cryptosporidium hominis
FELLKTYYHPLIVELVY

SEQ ID NO: 2170915 - protein, 18 aa, Cryptosporidium hominis
FELPKFQIEVGFWKAAST

SEQ ID NO: 2170916 - protein, 17 aa, Cryptosporidium hominis
FEMGNRGIVVANNTHSS

SEQ ID NO: 2170917 - protein, 22 aa, Cryptosporidium hominis
FENKCKEIKEVNPYYYTILQDK

SEQ ID NO: 2170918 - protein, 22 aa, Cryptosporidium hominis
FENKRCYFRYRLKQLRKESGSY

SEQ ID NO: 2170919 - protein, 21 aa, Cryptosporidium hominis
FENKWKWARKSGENNVGDLWK

SEQ ID NO: 2170920 - protein, 20 aa, Cryptosporidium hominis
FENLSRPYAPLRDITGSIFG

SEQ ID NO: 2170921 - protein, 26 aa, Cryptosporidium hominis
FENNCFPCPIFKTGWMETNSKGDLNI

SEQ ID NO: 2170922 - protein, 18 aa, Cryptosporidium hominis
FEPIRKCSESNWFKKVVI

SEQ ID NO: 2170923 - protein, 18 aa, Cryptosporidium hominis
FEPLLPYLVYYFNYNTRI

SEQ ID NO: 2170924 - protein, 26 aa, Cryptosporidium hominis
FEQEEGAKSAIQWNQTEYKGRMLRIN

SEQ ID NO: 2170925 - protein, 25 aa, Cryptosporidium hominis
FEQFSWPHFHRGDILSMKYVFLGDY

SEQ ID NO: 2170926 - protein, 20 aa, Cryptosporidium hominis
FEQPCAKNKCVLNDDKTTAP

SEQ ID NO: 2170927 - protein, 18 aa, Cryptosporidium hominis
FERFGMSPSRGVLFYGPP

SEQ ID NO: 2170928 - protein, 27 aa, Cryptosporidium hominis
FERKPFKRPSSYEVLMILNGINSEDIK

SEQ ID NO: 2170929 - protein, 18 aa, Cryptosporidium hominis
FERNLLFSGFIKVKKLKG

SEQ ID NO: 2170930 - protein, 26 aa, Cryptosporidium hominis
FERRFLYLRLLDRLIIGNATYLQLAY

SEQ ID NO: 2170931 - protein, 24 aa, Cryptosporidium hominis
FESLPWKGQTMFSNFRELQISLQS

SEQ ID NO: 2170932 - protein, 17 aa, Cryptosporidium hominis
FESNFIFDLWSFLNGGG

SEQ ID NO: 2170933 - protein, 18 aa, Cryptosporidium hominis
FESNIAFSEHDLREIDNY

SEQ ID NO: 2170934 - protein, 32 aa, Cryptosporidium hominis
FESTLRFGYEYLFKTARIQGMIDTCGKISLQC

SEQ ID NO: 2170935 - protein, 25 aa, Cryptosporidium hominis
FETEMKLFYCKYNDPAYIKIEKLNL

SEQ ID NO: 2170936 - protein, 18 aa, Cryptosporidium hominis
FETFMEWKKKKEKEEEEK

SEQ ID NO: 2170937 - protein, 25 aa, Cryptosporidium hominis
FETLMTELGCGYECEDSQITYFENL

SEQ ID NO: 2170938 - protein, 28 aa, Cryptosporidium hominis
FETNLNWKGRELVALSVLQAYLGGGSSF

SEQ ID NO: 2170939 - protein, 19 aa, Cryptosporidium hominis
FETSMKFLTEACLRGALDN

SEQ ID NO: 2170940 - protein, 18 aa, Cryptosporidium hominis
FETSVMFAPPLAMPEIKV

SEQ ID NO: 2170941 - protein, 17 aa, Cryptosporidium hominis
FEVEGSDIFTAKLKFEG

SEQ ID NO: 2170942 - protein, 28 aa, Cryptosporidium hominis
FEVIISPLLRRPCSNYGKELESELIRQS

SEQ ID NO: 2170943 - protein, 17 aa, Cryptosporidium hominis
FEVIMSYFVLKIEKKPT

SEQ ID NO: 2170944 - protein, 21 aa, Cryptosporidium hominis
FEVLYKPWGIVRGSSKKFPTK

SEQ ID NO: 2170945 - protein, 23 aa, Cryptosporidium hominis
FEVPEGVEAISLMGYSFSVEDSD

SEQ ID NO: 2170946 - protein, 23 aa, Cryptosporidium hominis
FEWAKQMICGFCSREQGFSENCK

SEQ ID NO: 2170947 - protein, 17 aa, Cryptosporidium hominis
FEWCKLDDNCLSVVGSS

SEQ ID NO: 2170948 - protein, 18 aa, Cryptosporidium hominis
FEWQNTGVYIKHRSFLKA

SEQ ID NO: 2170949 - protein, 26 aa, Cryptosporidium hominis
FEYFEDFLKFIGFHLSIRKDQKVILA

SEQ ID NO: 2170950 - protein, 19 aa, Cryptosporidium hominis
FEYIICKDDSLSLLNSNSL

SEQ ID NO: 2170951 - protein, 24 aa, Cryptosporidium hominis
FEYIIPIFVIYRIFEVHSEDCKSI

SEQ ID NO: 2170952 - protein, 17 aa, Cryptosporidium hominis
FEYLPYDLSGYIEGLKL

SEQ ID NO: 2170953 - protein, 20 aa, Cryptosporidium hominis
FEYMRIKYSFIIPDKEYLVD

SEQ ID NO: 2170954 - protein, 18 aa, Cryptosporidium hominis
FFAFFPFQTAEMALENMK

SEQ ID NO: 2170955 - protein, 19 aa, Cryptosporidium hominis
FFCQLKLNRIQVLKVSLFK

SEQ ID NO: 2170956 - protein, 19 aa, Cryptosporidium hominis
FFCVHGGLSPELRSVDQIL

SEQ ID NO: 2170957 - protein, 24 aa, Cryptosporidium hominis
FFDLKEIFRIGGVPPETNFLFLGD

SEQ ID NO: 2170958 - protein, 25 aa, Cryptosporidium hominis
FFDNYKGEESFDFVPIKENLDDFSI

SEQ ID NO: 2170959 - protein, 22 aa, Cryptosporidium hominis
FFGCSEYFLSHIIKNLNLKTPI

SEQ ID NO: 2170960 - protein, 18 aa, Cryptosporidium hominis
FFGKLVVDSIMTVKATDP

SEQ ID NO: 2170961 - protein, 19 aa, Cryptosporidium hominis
FFHGRGGSIGRGGGPQHLA

SEQ ID NO: 2170962 - protein, 22 aa, Cryptosporidium hominis
FFKGMGAGLVAAVALPVTAVGV

SEQ ID NO: 2170963 - protein, 17 aa, Cryptosporidium hominis
FFKMGKFYELFYIDAYI

SEQ ID NO: 2170964 - protein, 28 aa, Cryptosporidium hominis
FFKSYWKSQEIHITLKRIEVIRQNSQDS

SEQ ID NO: 2170965 - protein, 24 aa, Cryptosporidium hominis
FFLDRPDVMCKFRVRIEGDKTKSP

SEQ ID NO: 2170966 - protein, 23 aa, Cryptosporidium hominis
FFLEELYRQINIRSGISRLQYSV

SEQ ID NO: 2170967 - protein, 18 aa, Cryptosporidium hominis
FFLHENRYYLSLEYFPQT

SEQ ID NO: 2170968 - protein, 17 aa, Cryptosporidium hominis
FFLVFLVSIGYTVLAPN

SEQ ID NO: 2170969 - protein, 19 aa, Cryptosporidium hominis
FFMKLSIRVHFDMISHPNN

SEQ ID NO: 2170970 - protein, 24 aa, Cryptosporidium hominis
FFMPHCDRCVFGMIINYFNNGEGK

SEQ ID NO: 2170971 - protein, 18 aa, Cryptosporidium hominis
FFNFKIVGQRGYSINYLK

SEQ ID NO: 2170972 - protein, 17 aa, Cryptosporidium hominis
FFNSRPVIIKNINHNLI

SEQ ID NO: 2170973 - protein, 23 aa, Cryptosporidium hominis
FFPYDLKRYLSMFPDKVPPVKFI

SEQ ID NO: 2170974 - protein, 18 aa, Cryptosporidium hominis
FFQLDFINHLLIQSVPNH

SEQ ID NO: 2170975 - protein, 17 aa, Cryptosporidium hominis
FFQLRRLSIVFDNPDCV

SEQ ID NO: 2170976 - protein, 23 aa, Cryptosporidium hominis
FFQRAHLFDYSWKHLAEEQRRIE

SEQ ID NO: 2170977 - protein, 24 aa, Cryptosporidium hominis
FFRDKFRLLPGWAQLVLFSSSVLK

SEQ ID NO: 2170978 - protein, 17 aa, Cryptosporidium hominis
FFRRKHVGMNKSTVVAL

SEQ ID NO: 2170979 - protein, 28 aa, Cryptosporidium hominis
FFSGLIKLPFLSSEPEYINFPISQANIQ

SEQ ID NO: 2170980 - protein, 18 aa, Cryptosporidium hominis
FFSISALIDDQVLCLHSG

SEQ ID NO: 2170981 - protein, 18 aa, Cryptosporidium hominis
FFSQCLIKSITVGNLNKE

SEQ ID NO: 2170982 - protein, 18 aa, Cryptosporidium hominis
FFTAKISSIFSRFLSSNL

SEQ ID NO: 2170983 - protein, 17 aa, Cryptosporidium hominis
FFTHFYSAITFLEKLDG

SEQ ID NO: 2170984 - protein, 27 aa, Cryptosporidium hominis
FFTPCNVPNPNRFSNKPKNSNSKVQIQ

SEQ ID NO: 2170985 - protein, 24 aa, Cryptosporidium hominis
FFTSHLFLDVFFKFLVSDKSSKDF

SEQ ID NO: 2170986 - protein, 18 aa, Cryptosporidium hominis
FFVLKGVHLLRGDELSIN

SEQ ID NO: 2170987 - protein, 19 aa, Cryptosporidium hominis
FFYCTIKTNLFSSTFETIR

SEQ ID NO: 2170988 - protein, 18 aa, Cryptosporidium hominis
FFYIKCSTISKLNKFLNY

SEQ ID NO: 2170989 - protein, 18 aa, Cryptosporidium hominis
FGAAIGGALGLTFGNMIK

SEQ ID NO: 2170990 - protein, 19 aa, Cryptosporidium hominis
FGAKGEWLAVGAAKTGQLI

SEQ ID NO: 2170991 - protein, 25 aa, Cryptosporidium hominis
FGALPLHYRHFIGILCSSLYDNDYM

SEQ ID NO: 2170992 - protein, 20 aa, Cryptosporidium hominis
FGCECGRSSSGRSGRKLRNF

SEQ ID NO: 2170993 - protein, 26 aa, Cryptosporidium hominis
FGCILMELYTGVLLFKTHEHMEHLAM

SEQ ID NO: 2170994 - protein, 17 aa, Cryptosporidium hominis
FGCTVFQVICGYPPFNA

SEQ ID NO: 2170995 - protein, 18 aa, Cryptosporidium hominis
FGDFGVEIGERIEFPLLV

SEQ ID NO: 2170996 - protein, 21 aa, Cryptosporidium hominis
FGDGIIRLLAIKTRSMEIYEI

SEQ ID NO: 2170997 - protein, 17 aa, Cryptosporidium hominis
FGDIIVFIHDICILSDF

SEQ ID NO: 2170998 - protein, 25 aa, Cryptosporidium hominis
FGDSKIVSLLLEYGALANISDLNND

SEQ ID NO: 2170999 - protein, 24 aa, Cryptosporidium hominis
FGEDFKGKCKVKCDNCMRSELEKP

SEQ ID NO: 2171000 - protein, 17 aa, Cryptosporidium hominis
FGEDQVKIWRRSFDVPP

SEQ ID NO: 2171001 - protein, 23 aa, Cryptosporidium hominis
FGEESRVGITFDTYRKRNVLLNR

SEQ ID NO: 2171002 - protein, 31 aa, Cryptosporidium hominis
FGEVESLTLVLACKLNVFKFNCDVSQIRPTI

SEQ ID NO: 2171003 - protein, 25 aa, Cryptosporidium hominis
FGFNRAREKAIKYLDARRKGIILTT

SEQ ID NO: 2171004 - protein, 18 aa, Cryptosporidium hominis
FGGDEVFVTGSFNFWRKQ

SEQ ID NO: 2171005 - protein, 17 aa, Cryptosporidium hominis
FGGESHGGYTYCVVSGL

SEQ ID NO: 2171006 - protein, 24 aa, Cryptosporidium hominis
FGGFSSCFQFNFDGRLFDKFETGD

SEQ ID NO: 2171007 - protein, 21 aa, Cryptosporidium hominis
FGGNHYFDFNNFWELKYQGHM

SEQ ID NO: 2171008 - protein, 17 aa, Cryptosporidium hominis
FGGPFGGGGSGAIGVGN

SEQ ID NO: 2171009 - protein, 27 aa, Cryptosporidium hominis
FGGSCFKKDVLCLAYLFDHFNLKDEAE

SEQ ID NO: 2171010 - protein, 28 aa, Cryptosporidium hominis
FGGVLLEVPLKFVLDVAFSDFSNYKKTL

SEQ ID NO: 2171011 - protein, 25 aa, Cryptosporidium hominis
FGISRIMLSVTMPFTLTSIGTPQYM

SEQ ID NO: 2171012 - protein, 21 aa, Cryptosporidium hominis
FGKIFESWDTPGLVNGVGNWR

SEQ ID NO: 2171013 - protein, 19 aa, Cryptosporidium hominis
FGKIWKSCHPNLIDSNAIK

SEQ ID NO: 2171014 - protein, 22 aa, Cryptosporidium hominis
FGLGKWRIILATSKLTNRDEVG

SEQ ID NO: 2171015 - protein, 18 aa, Cryptosporidium hominis
FGMGKSIGGKGLGMKLTL

SEQ ID NO: 2171016 - protein, 17 aa, Cryptosporidium hominis
FGMSPSRGVLFYGPPGC

SEQ ID NO: 2171017 - protein, 24 aa, Cryptosporidium hominis
FGMVNIPIVFAIDGAGIPVMDDTF

SEQ ID NO: 2171018 - protein, 17 aa, Cryptosporidium hominis
FGNCNYSIIAMAEEDNL

SEQ ID NO: 2171019 - protein, 17 aa, Cryptosporidium hominis
FGNLANLGFLNPNISQN

SEQ ID NO: 2171020 - protein, 21 aa, Cryptosporidium hominis
FGNNCPLLLEGSYNGNNTLVG

SEQ ID NO: 2171021 - protein, 17 aa, Cryptosporidium hominis
FGNSCLMLANEKSSLGK

SEQ ID NO: 2171022 - protein, 20 aa, Cryptosporidium hominis
FGPGNWSLIKNFVIGRTDAD

SEQ ID NO: 2171023 - protein, 17 aa, Cryptosporidium hominis
FGQCFRKMMKDVRRLLQ

SEQ ID NO: 2171024 - protein, 20 aa, Cryptosporidium hominis
FGSNEEFNLLSIFKDDNANI

SEQ ID NO: 2171025 - protein, 18 aa, Cryptosporidium hominis
FGSSTAFVACFDPKTNKL

SEQ ID NO: 2171026 - protein, 26 aa, Cryptosporidium hominis
FGTAIMFCNMSDYPFLSSIEKASKIS

SEQ ID NO: 2171027 - protein, 19 aa, Cryptosporidium hominis
FGTFCPKGSHFFNPDVPAL

SEQ ID NO: 2171028 - protein, 19 aa, Cryptosporidium hominis
FGTGNDWAKSFGWSSYGNM

SEQ ID NO: 2171029 - protein, 18 aa, Cryptosporidium hominis
FGTLYSREGVGHVITGDI

SEQ ID NO: 2171030 - protein, 20 aa, Cryptosporidium hominis
FGVASLRSMNSNALSSYRST

SEQ ID NO: 2171031 - protein, 21 aa, Cryptosporidium hominis
FGVGFYASYLVSDRVTVISKN

SEQ ID NO: 2171032 - protein, 19 aa, Cryptosporidium hominis
FGVGGIKVQQILDLKNGEY

SEQ ID NO: 2171033 - protein, 26 aa, Cryptosporidium hominis
FGVGPSQITSFCWITNQIFLVGFSNG

SEQ ID NO: 2171034 - protein, 19 aa, Cryptosporidium hominis
FGWLSKGMMNIKCQEDLKL

SEQ ID NO: 2171035 - protein, 20 aa, Cryptosporidium hominis
FGYESGIWSKFVGLMKNSLN

SEQ ID NO: 2171036 - protein, 19 aa, Cryptosporidium hominis
FHFLCLKIINEPQKTWYCP

SEQ ID NO: 2171037 - protein, 34 aa, Cryptosporidium hominis
FHKELVRPVVWCRMVVRRLLVYFIEADRIFLNYL

SEQ ID NO: 2171038 - protein, 20 aa, Cryptosporidium hominis
FHKNIKGFIIQGGDPTGTGK

SEQ ID NO: 2171039 - protein, 24 aa, Cryptosporidium hominis
FHKSDFRMGIFESFSSRTNLIYTY

SEQ ID NO: 2171040 - protein, 42 aa, Cryptosporidium hominis
FHKWIGWIESKLRFLVRKLETFKGLQVRPWPKAIQEQDEAKD

SEQ ID NO: 2171041 - protein, 27 aa, Cryptosporidium hominis
FHLCREILRLTKLVVDCHVQYRLGNID

SEQ ID NO: 2171042 - protein, 18 aa, Cryptosporidium hominis
FHPYRIPRHHLKEEEYPE

SEQ ID NO: 2171043 - protein, 17 aa, Cryptosporidium hominis
FHRFHKRKWKMYIDSSK

SEQ ID NO: 2171044 - protein, 18 aa, Cryptosporidium hominis
FHSCCKLKKNQKNDEYIF

SEQ ID NO: 2171045 - protein, 23 aa, Cryptosporidium hominis
FHSGNGFKLLFAIDEEIIGKCKN

SEQ ID NO: 2171046 - protein, 32 aa, Cryptosporidium hominis
FHSKKPIICMEWSKWTPNILMTGGVDNKVVVW

SEQ ID NO: 2171047 - protein, 24 aa, Cryptosporidium hominis
FHTIFSLPGAHIFRDEINNSHQVH

SEQ ID NO: 2171048 - protein, 18 aa, Cryptosporidium hominis
FHWENWKTIFKIYPIYSI

SEQ ID NO: 2171049 - protein, 17 aa, Cryptosporidium hominis
FHYIYKYEKSLSLTGSF

SEQ ID NO: 2171050 - protein, 26 aa, Cryptosporidium hominis
FIAVLRGHVGPVYMVSWSVDSRLIAS

SEQ ID NO: 2171051 - protein, 20 aa, Cryptosporidium hominis
FICHCERCTTSFLNCNDSYI

SEQ ID NO: 2171052 - protein, 18 aa, Cryptosporidium hominis
FIDELRLIKKEYTEYLQK

SEQ ID NO: 2171053 - protein, 25 aa, Cryptosporidium hominis
FIDISNSILQWLKEYLNNFSQTSIC

SEQ ID NO: 2171054 - protein, 19 aa, Cryptosporidium hominis
FIDTCRINVQYAFPPGSDL

SEQ ID NO: 2171055 - protein, 20 aa, Cryptosporidium hominis
FIEEHKRFFLSKFSISHFSD

SEQ ID NO: 2171056 - protein, 27 aa, Cryptosporidium hominis
FIEFRRRYLEEFLRRIFNRGYLISSNL

SEQ ID NO: 2171057 - protein, 23 aa, Cryptosporidium hominis
FIESLKLPYMNGDVLTIENDLIP

SEQ ID NO: 2171058 - protein, 24 aa, Cryptosporidium hominis
FIFNTCKYGFVRVIHSSISMDLER

SEQ ID NO: 2171059 - protein, 17 aa, Cryptosporidium hominis
FIFPSPVQYHILSQGVI

SEQ ID NO: 2171060 - protein, 22 aa, Cryptosporidium hominis
FIGCKYSSIFDKNACIALNDSF

SEQ ID NO: 2171061 - protein, 18 aa, Cryptosporidium hominis
FIGEIPMTASHAEMRKYK

SEQ ID NO: 2171062 - protein, 17 aa, Cryptosporidium hominis
FIGKRIVNGQFVQDDQQ

SEQ ID NO: 2171063 - protein, 27 aa, Cryptosporidium hominis
FIGSYRNPISFNYQCYNSLVYPILGTK

SEQ ID NO: 2171064 - protein, 21 aa, Cryptosporidium hominis
FIHDICILSDFFKKPTSENNK

SEQ ID NO: 2171065 - protein, 17 aa, Cryptosporidium hominis
FIHKNGIIHRDLKPENI

SEQ ID NO: 2171066 - protein, 17 aa, Cryptosporidium hominis
FIHRDIKTINMLINRKD

SEQ ID NO: 2171067 - protein, 17 aa, Cryptosporidium hominis
FIIEGLEKLVTTKLYNV

SEQ ID NO: 2171068 - protein, 24 aa, Cryptosporidium hominis
FIIHARKAWLNGINPSKNRTIPKL

SEQ ID NO: 2171069 - protein, 18 aa, Cryptosporidium hominis
FIILSCTGIGFSNFARKA

SEQ ID NO: 2171070 - protein, 31 aa, Cryptosporidium hominis
FIKCAQKLIWKRFRIGMMHDAQEFLRYFLEA

SEQ ID NO: 2171071 - protein, 26 aa, Cryptosporidium hominis
FIKDWKLSRVWSKELIEYTWLSKLSE

SEQ ID NO: 2171072 - protein, 26 aa, Cryptosporidium hominis
FIKLLFSFIELCKFNKNNIVGTENLI

SEQ ID NO: 2171073 - protein, 18 aa, Cryptosporidium hominis
FIKNLFFVYYCKSPLVMN

SEQ ID NO: 2171074 - protein, 22 aa, Cryptosporidium hominis
FILFLMCIHRLGAFQKNDLPDL

SEQ ID NO: 2171075 - protein, 21 aa, Cryptosporidium hominis
FILTSRVGGVGLNITGANRVI

SEQ ID NO: 2171076 - protein, 24 aa, Cryptosporidium hominis
FIMTNFRIILAPLFQKNINNKALT

SEQ ID NO: 2171077 - protein, 24 aa, Cryptosporidium hominis
FINFWKQRFYRIWQRSLEGGIKFA

SEQ ID NO: 2171078 - protein, 29 aa, Cryptosporidium hominis
FINLLVPFYLPSFVNLEIMFRIIKTKIKT

SEQ ID NO: 2171079 - protein, 25 aa, Cryptosporidium hominis
FINLPESIWLSGFLDQVNLKDVMLN

SEQ ID NO: 2171080 - protein, 20 aa, Cryptosporidium hominis
FINRRLSLFKTLYEKQCALL

SEQ ID NO: 2171081 - protein, 17 aa, Cryptosporidium hominis
FINSVGYSENVDNMTST

SEQ ID NO: 2171082 - protein, 17 aa, Cryptosporidium hominis
FIPLISMLLHPKFDESR

SEQ ID NO: 2171083 - protein, 20 aa, Cryptosporidium hominis
FIPLKPIGWRKRSFSKENST

SEQ ID NO: 2171084 - protein, 20 aa, Cryptosporidium hominis
FIPPPSKHIAEFLMGDSSIK

SEQ ID NO: 2171085 - protein, 20 aa, Cryptosporidium hominis
FIQEISPKFQDGGYESTSKP

SEQ ID NO: 2171086 - protein, 17 aa, Cryptosporidium hominis
FIRKHVTENFQWLTNNH

SEQ ID NO: 2171087 - protein, 19 aa, Cryptosporidium hominis
FIRLWKPLEKIIGYMEKNL

SEQ ID NO: 2171088 - protein, 21 aa, Cryptosporidium hominis
FIRNYLELHLNRLEQYPNCII

SEQ ID NO: 2171089 - protein, 21 aa, Cryptosporidium hominis
FIRYYCIKEKIQIRNLRASLL

SEQ ID NO: 2171090 - protein, 18 aa, Cryptosporidium hominis
FISEWRNGYFQLYKESCY

SEQ ID NO: 2171091 - protein, 17 aa, Cryptosporidium hominis
FISFSVSIGTRIFLFFN

SEQ ID NO: 2171092 - protein, 18 aa, Cryptosporidium hominis
FISIKGFYFQAKILGETI

SEQ ID NO: 2171093 - protein, 20 aa, Cryptosporidium hominis
FISLLESWVGIKYEKVKYIQ

SEQ ID NO: 2171094 - protein, 24 aa, Cryptosporidium hominis
FITKLQNILIYWTNLIHEYETEKK

SEQ ID NO: 2171095 - protein, 17 aa, Cryptosporidium hominis
FIVAYNVALNVNRNERR

SEQ ID NO: 2171096 - protein, 21 aa, Cryptosporidium hominis
FKAAEMNKNFQLIVVDSKNNL

SEQ ID NO: 2171097 - protein, 24 aa, Cryptosporidium hominis
FKAIVSKIPSLRCNHSYSGNSKIL

SEQ ID NO: 2171098 - protein, 23 aa, Cryptosporidium hominis
FKAKREVVNFQDILREEEITSKE

SEQ ID NO: 2171099 - protein, 26 aa, Cryptosporidium hominis
FKALVFKPKIGELLICRISHVSPSHV

SEQ ID NO: 2171100 - protein, 26 aa, Cryptosporidium hominis
FKCEICGNCSYWGRRAFERHFSETRH

SEQ ID NO: 2171101 - protein, 17 aa, Cryptosporidium hominis
FKCGINYQPPTVVPGGD

SEQ ID NO: 2171102 - protein, 30 aa, Cryptosporidium hominis
FKDEHCYNIFILKGIGWRKLSNYENEENED

SEQ ID NO: 2171103 - protein, 22 aa, Cryptosporidium hominis
FKDFLLEICVEIETNPNLKQNV

SEQ ID NO: 2171104 - protein, 19 aa, Cryptosporidium hominis
FKDVNGISVIGIVRPFDQG

SEQ ID NO: 2171105 - protein, 17 aa, Cryptosporidium hominis
FKEIKDLISDYMNETSR

SEQ ID NO: 2171106 - protein, 24 aa, Cryptosporidium hominis
FKEKRKMHYREFITAKSKLPKAND

SEQ ID NO: 2171107 - protein, 24 aa, Cryptosporidium hominis
FKFQLSLNNLEIWFHRDNKKENMS

SEQ ID NO: 2171108 - protein, 21 aa, Cryptosporidium hominis
FKFYSNLPFRNFYSSVYFINI

SEQ ID NO: 2171109 - protein, 19 aa, Cryptosporidium hominis
FKFYSPIVFVRSIIRTKLS

SEQ ID NO: 2171110 - protein, 24 aa, Cryptosporidium hominis
FKGDLKLSPELNVNRLKIVTFNIL

SEQ ID NO: 2171111 - protein, 19 aa, Cryptosporidium hominis
FKGLIKRKKLVNLNFINKY

SEQ ID NO: 2171112 - protein, 20 aa, Cryptosporidium hominis
FKGMIDIRPHIFSMQSNQCP

SEQ ID NO: 2171113 - protein, 21 aa, Cryptosporidium hominis
FKGSTCYELLTAEKNNLGIQS

SEQ ID NO: 2171114 - protein, 20 aa, Cryptosporidium hominis
FKHTPDVISPLFAYNKSYSR

SEQ ID NO: 2171115 - protein, 22 aa, Cryptosporidium hominis
FKHTSCFECIAEPKGLPYGAFI

SEQ ID NO: 2171116 - protein, 20 aa, Cryptosporidium hominis
FKIDQIRSALKHFNLSNRFQ

SEQ ID NO: 2171117 - protein, 18 aa, Cryptosporidium hominis
FKIEGFPIESEKICYNLT

SEQ ID NO: 2171118 - protein, 26 aa, Cryptosporidium hominis
FKIITNNVFRFKVIIAKNLEEAMITG

SEQ ID NO: 2171119 - protein, 20 aa, Cryptosporidium hominis
FKISMSLPAYALKYGNVENG

SEQ ID NO: 2171120 - protein, 17 aa, Cryptosporidium hominis
FKIYFQRFGNIKDAVLI

SEQ ID NO: 2171121 - protein, 19 aa, Cryptosporidium hominis
FKKDIDVLGELYKISNIIT

SEQ ID NO: 2171122 - protein, 18 aa, Cryptosporidium hominis
FKKEKEFKVFKWCHISSS

SEQ ID NO: 2171123 - protein, 28 aa, Cryptosporidium hominis
FKKGVLKCLLLKIIRPDRIVTLFNKLIS

SEQ ID NO: 2171124 - protein, 17 aa, Cryptosporidium hominis
FKKTQGIDLSRDKLALQ

SEQ ID NO: 2171125 - protein, 20 aa, Cryptosporidium hominis
FKKWCAEYGPELVLEACAIR

SEQ ID NO: 2171126 - protein, 21 aa, Cryptosporidium hominis
FKLDIPFNLKKVFLNESDTEN

SEQ ID NO: 2171127 - protein, 18 aa, Cryptosporidium hominis
FKLEMFVSKGVKNKIGHI

SEQ ID NO: 2171128 - protein, 19 aa, Cryptosporidium hominis
FKLLKQVRDIWKFQDLYRA

SEQ ID NO: 2171129 - protein, 17 aa, Cryptosporidium hominis
FKLLMNHIEKWEVDNTY

SEQ ID NO: 2171130 - protein, 17 aa, Cryptosporidium hominis
FKLLTQVYGIPKDRLYA

SEQ ID NO: 2171131 - protein, 18 aa, Cryptosporidium hominis
FKLMLNIIKEFNNRYNQV

SEQ ID NO: 2171132 - protein, 17 aa, Cryptosporidium hominis
FKLSRWIDDNSRVLSTE

SEQ ID NO: 2171133 - protein, 24 aa, Cryptosporidium hominis
FKNIEIPSSMELYDKLELEEFCGI

SEQ ID NO: 2171134 - protein, 17 aa, Cryptosporidium hominis
FKNIHYFHSNKQGEFII

SEQ ID NO: 2171135 - protein, 26 aa, Cryptosporidium hominis
FKNILSCYKLACIVQHNHISAIKKFL

SEQ ID NO: 2171136 - protein, 18 aa, Cryptosporidium hominis
FKNKIKGLNKWVLLPCEM

SEQ ID NO: 2171137 - protein, 18 aa, Cryptosporidium hominis
FKNLLHAKIVNACPHENI

SEQ ID NO: 2171138 - protein, 18 aa, Cryptosporidium hominis
FKNNSYLQEVLKLNEEKK

SEQ ID NO: 2171139 - protein, 20 aa, Cryptosporidium hominis
FKNYITICSIKYKSANQSKS

SEQ ID NO: 2171140 - protein, 19 aa, Cryptosporidium hominis
FKPIEGCVQIKKNSLSQKV

SEQ ID NO: 2171141 - protein, 17 aa, Cryptosporidium hominis
FKPKYDYIFNGNKDHSF

SEQ ID NO: 2171142 - protein, 23 aa, Cryptosporidium hominis
FKQCGYIAASLIYRGNLELLRLL

SEQ ID NO: 2171143 - protein, 28 aa, Cryptosporidium hominis
FKQIITRIPRVDCSIGIHDRNKKFEFVL

SEQ ID NO: 2171144 - protein, 20 aa, Cryptosporidium hominis
FKRLTESKLKVFVNAITDSS

SEQ ID NO: 2171145 - protein, 28 aa, Cryptosporidium hominis
FKSKETIYCSCEFLDLESLYETERDQAE

SEQ ID NO: 2171146 - protein, 22 aa, Cryptosporidium hominis
FKSKEYFWIKWANFEEKYGNFE

SEQ ID NO: 2171147 - protein, 17 aa, Cryptosporidium hominis
FKSLMVFMKGIKEEPYC

SEQ ID NO: 2171148 - protein, 17 aa, Cryptosporidium hominis
FKSSIVVNSGQLQSEKS

SEQ ID NO: 2171149 - protein, 17 aa, Cryptosporidium hominis
FKTFGCGSAIASTSYAT

SEQ ID NO: 2171150 - protein, 17 aa, Cryptosporidium hominis
FKTHCPRSQSADFKLKV

SEQ ID NO: 2171151 - protein, 25 aa, Cryptosporidium hominis
FKTNSAKVLSTWPPYRWSNNEIFVF

SEQ ID NO: 2171152 - protein, 30 aa, Cryptosporidium hominis
FKTQDFINGLKCISCPSLHNLVIVITIRMA

SEQ ID NO: 2171153 - protein, 26 aa, Cryptosporidium hominis
FKTTPIPLLSPRVFIHDHIVLDKDLV

SEQ ID NO: 2171154 - protein, 20 aa, Cryptosporidium hominis
FKVTETYVNNGTWGNEFELP

SEQ ID NO: 2171155 - protein, 27 aa, Cryptosporidium hominis
FKVYTLRFPNSFFGYPIQIFTKYIYKH

SEQ ID NO: 2171156 - protein, 17 aa, Cryptosporidium hominis
FKYIFLIMGQLKVPRNR

SEQ ID NO: 2171157 - protein, 19 aa, Cryptosporidium hominis
FKYKIGDLVYSLWKGQLWK

SEQ ID NO: 2171158 - protein, 22 aa, Cryptosporidium hominis
FKYNDVRESFRLAFLDLVESRG

SEQ ID NO: 2171159 - protein, 17 aa, Cryptosporidium hominis
FLACLKALGITGPHLIV

SEQ ID NO: 2171160 - protein, 18 aa, Cryptosporidium hominis
FLADKGLVLIEDFINKLE

SEQ ID NO: 2171161 - protein, 20 aa, Cryptosporidium hominis
FLAQRISSINSFSRLCEATG

SEQ ID NO: 2171162 - protein, 27 aa, Cryptosporidium hominis
FLASSYTLPIIWLLKSMNLSDGISIND

SEQ ID NO: 2171163 - protein, 20 aa, Cryptosporidium hominis
FLCDHSFHRYCLLQQDQCPI

SEQ ID NO: 2171164 - protein, 21 aa, Cryptosporidium hominis
FLCFGEYMYGSGLVLNPKVKW

SEQ ID NO: 2171165 - protein, 20 aa, Cryptosporidium hominis
FLCVCSDGFTGPSCETGKFI

SEQ ID NO: 2171166 - protein, 19 aa, Cryptosporidium hominis
FLDIKRWIINISKTKENNN

SEQ ID NO: 2171167 - protein, 20 aa, Cryptosporidium hominis
FLDLPSPWIAIKHADQVLQK

SEQ ID NO: 2171168 - protein, 19 aa, Cryptosporidium hominis
FLDMFSRGISIISECIIDK

SEQ ID NO: 2171169 - protein, 27 aa, Cryptosporidium hominis
FLDPKRFLSLLKRPSFASIDLNLILPY

SEQ ID NO: 2171170 - protein, 18 aa, Cryptosporidium hominis
FLDYDLNPLNGFIALGTN

SEQ ID NO: 2171171 - protein, 17 aa, Cryptosporidium hominis
FLEESMNNFMIETMDLF

SEQ ID NO: 2171172 - protein, 29 aa, Cryptosporidium hominis
FLEGIRCPFCIIGFLVPSPIFKKSEVVES

SEQ ID NO: 2171173 - protein, 19 aa, Cryptosporidium hominis
FLEKCRIKLKSEFKEFSRL

SEQ ID NO: 2171174 - protein, 19 aa, Cryptosporidium hominis
FLEKEISVEYLLKLIDDKK

SEQ ID NO: 2171175 - protein, 19 aa, Cryptosporidium hominis
FLEKVKKIFGGVLIIGIYD

SEQ ID NO: 2171176 - protein, 21 aa, Cryptosporidium hominis
FLELSEFLFGIIEKRIGIGNS

SEQ ID NO: 2171177 - protein, 19 aa, Cryptosporidium hominis
FLEPVNWKKLGLDDYPDIV

SEQ ID NO: 2171178 - protein, 18 aa, Cryptosporidium hominis
FLEVVKLLIQFLGISSNG

SEQ ID NO: 2171179 - protein, 17 aa, Cryptosporidium hominis
FLFPFSLVGSSGTAVSG

SEQ ID NO: 2171180 - protein, 17 aa, Cryptosporidium hominis
FLGEGSYFRAYRGRKLF

SEQ ID NO: 2171181 - protein, 17 aa, Cryptosporidium hominis
FLGLNRETFEFVAVKSE

SEQ ID NO: 2171182 - protein, 25 aa, Cryptosporidium hominis
FLGSPSRFHGICMANKKGLVLHITL

SEQ ID NO: 2171183 - protein, 27 aa, Cryptosporidium hominis
FLHLKSEQRLLVDFQEFPVMLVDLLNR

SEQ ID NO: 2171184 - protein, 20 aa, Cryptosporidium hominis
FLINFGKKFVKFELKEFSNL

SEQ ID NO: 2171185 - protein, 26 aa, Cryptosporidium hominis
FLINIWQSICCLMNILNSSEDKFINY

SEQ ID NO: 2171186 - protein, 17 aa, Cryptosporidium hominis
FLINKARYIQAYFINAF

SEQ ID NO: 2171187 - protein, 17 aa, Cryptosporidium hominis
FLISENFLKPENEFKFV

SEQ ID NO: 2171188 - protein, 18 aa, Cryptosporidium hominis
FLISIGINPDGIRFRQHL

SEQ ID NO: 2171189 - protein, 25 aa, Cryptosporidium hominis
FLIVLDSSLPWTLNDDLVIWIQQIQ

SEQ ID NO: 2171190 - protein, 26 aa, Cryptosporidium hominis
FLKEGFLSKGGGFWGALNRNSKVDPD

SEQ ID NO: 2171191 - protein, 17 aa, Cryptosporidium hominis
FLKEMKNRNNGVIGKMT

SEQ ID NO: 2171192 - protein, 23 aa, Cryptosporidium hominis
FLKGVSKERLKILLDLYPTPDEI

SEQ ID NO: 2171193 - protein, 21 aa, Cryptosporidium hominis
FLKRDCVNVTLFFNKVLQSRK

SEQ ID NO: 2171194 - protein, 20 aa, Cryptosporidium hominis
FLKRQLTGHVVTRWYRAPEL

SEQ ID NO: 2171195 - protein, 17 aa, Cryptosporidium hominis
FLLDIGLRVQDQKMVGS

SEQ ID NO: 2171196 - protein, 18 aa, Cryptosporidium hominis
FLLGKIVFLDSIYYKLKL

SEQ ID NO: 2171197 - protein, 25 aa, Cryptosporidium hominis
FLLSTRAGGIGINLATADVVILFDS

SEQ ID NO: 2171198 - protein, 24 aa, Cryptosporidium hominis
FLLSTRAGGLGINLATADIVILYD

SEQ ID NO: 2171199 - protein, 24 aa, Cryptosporidium hominis
FLLSTRAGGLGINLTSADTVIIFD

SEQ ID NO: 2171200 - protein, 18 aa, Cryptosporidium hominis
FLLWMNGLNDLVCNLSLI

SEQ ID NO: 2171201 - protein, 18 aa, Cryptosporidium hominis
FLMAKNCFLVALELDPNH

SEQ ID NO: 2171202 - protein, 22 aa, Cryptosporidium hominis
FLNIEHLFKYHSCEDSITNEYI

SEQ ID NO: 2171203 - protein, 25 aa, Cryptosporidium hominis
FLNKNETAFDCYFSSDLYIQEESEN

SEQ ID NO: 2171204 - protein, 17 aa, Cryptosporidium hominis
FLNKSECTIDDVNGNHE

SEQ ID NO: 2171205 - protein, 18 aa, Cryptosporidium hominis
FLNNLIIDSSMLKIFCEL

SEQ ID NO: 2171206 - protein, 17 aa, Cryptosporidium hominis
FLNNTLCMMDLMIIPLK

SEQ ID NO: 2171207 - protein, 26 aa, Cryptosporidium hominis
FLPKDSRLVIYGKFKDNPLVSLIGEV

SEQ ID NO: 2171208 - protein, 18 aa, Cryptosporidium hominis
FLQIYKFLLAKRLLQYHL

SEQ ID NO: 2171209 - protein, 17 aa, Cryptosporidium hominis
FLQMSFETSMKFLTEAC

SEQ ID NO: 2171210 - protein, 22 aa, Cryptosporidium hominis
FLRDCFLSCNLHKIITPSGTAY

SEQ ID NO: 2171211 - protein, 18 aa, Cryptosporidium hominis
FLRFMPRSFSIKKISLAP

SEQ ID NO: 2171212 - protein, 26 aa, Cryptosporidium hominis
FLRKGEGKIKAFKLANLEKFDSKLSS

SEQ ID NO: 2171213 - protein, 21 aa, Cryptosporidium hominis
FLRLLEICDILNITSLDELSD

SEQ ID NO: 2171214 - protein, 22 aa, Cryptosporidium hominis
FLRNCELNREVGWREVENTDLL

SEQ ID NO: 2171215 - protein, 17 aa, Cryptosporidium hominis
FLRNKVRTIESKVRDYE

SEQ ID NO: 2171216 - protein, 17 aa, Cryptosporidium hominis
FLSFRFELEDEFDSCNK

SEQ ID NO: 2171217 - protein, 24 aa, Cryptosporidium hominis
FLSQLLSFFNMRAIAIVGNNEAAT

SEQ ID NO: 2171218 - protein, 23 aa, Cryptosporidium hominis
FLSSAPRPDRFVFEDEDNDNSDI

SEQ ID NO: 2171219 - protein, 17 aa, Cryptosporidium hominis
FLSSCKFFNDIITLFNN

SEQ ID NO: 2171220 - protein, 18 aa, Cryptosporidium hominis
FLSYLDHLLNFMSHTIKD

SEQ ID NO: 2171221 - protein, 18 aa, Cryptosporidium hominis
FLTKKGWILKMEAVTNSH

SEQ ID NO: 2171222 - protein, 22 aa, Cryptosporidium hominis
FLTLELRKQWIQYFKDNAPNLK

SEQ ID NO: 2171223 - protein, 17 aa, Cryptosporidium hominis
FLVDSALSFIKSTINDK

SEQ ID NO: 2171224 - protein, 17 aa, Cryptosporidium hominis
FLVGKRQFSVLIYTHIN

SEQ ID NO: 2171225 - protein, 24 aa, Cryptosporidium hominis
FLVRELVMLFILLRPTIHKERLDS

SEQ ID NO: 2171226 - protein, 17 aa, Cryptosporidium hominis
FLVTKTFMRMDSACVQS

SEQ ID NO: 2171227 - protein, 18 aa, Cryptosporidium hominis
FLYRIIKANSLSQVSSAP

SEQ ID NO: 2171228 - protein, 17 aa, Cryptosporidium hominis
FLYSNCDAYAGEFQMSK

SEQ ID NO: 2171229 - protein, 25 aa, Cryptosporidium hominis
FMASCGYFAATFCPQQNYSSHKVFV

SEQ ID NO: 2171230 - protein, 24 aa, Cryptosporidium hominis
FMCSASVPEVLVERDAVLSSFGTV

SEQ ID NO: 2171231 - protein, 17 aa, Cryptosporidium hominis
FMDPWNMQGHPYPAYAP

SEQ ID NO: 2171232 - protein, 25 aa, Cryptosporidium hominis
FMEGCSMIEKILRGMSIKVDLTDKN

SEQ ID NO: 2171233 - protein, 20 aa, Cryptosporidium hominis
FMEPRLKINKGFTGDSEENL

SEQ ID NO: 2171234 - protein, 34 aa, Cryptosporidium hominis
FMINKRLLFTLVRLKLWIVEEILYDEQILDGSQL

SEQ ID NO: 2171235 - protein, 19 aa, Cryptosporidium hominis
FMKFYSLKLPMKLANEFSR

SEQ ID NO: 2171236 - protein, 23 aa, Cryptosporidium hominis
FMKKSRPEWFVLQTPRTPECKAR

SEQ ID NO: 2171237 - protein, 18 aa, Cryptosporidium hominis
FMLCDGCILAVSIEKGPF

SEQ ID NO: 2171238 - protein, 29 aa, Cryptosporidium hominis
FMNGFSPKSQWKFICRFRSCFNKGDTAML

SEQ ID NO: 2171239 - protein, 19 aa, Cryptosporidium hominis
FMNKKIRDMTFALPLTDHI

SEQ ID NO: 2171240 - protein, 18 aa, Cryptosporidium hominis
FMQILAPADLHLCNSYDV

SEQ ID NO: 2171241 - protein, 19 aa, Cryptosporidium hominis
FMSRCFSDGLMFARSNLSQ

SEQ ID NO: 2171242 - protein, 18 aa, Cryptosporidium hominis
FMSRRALGGHPFGGAMAY

SEQ ID NO: 2171243 - protein, 19 aa, Cryptosporidium hominis
FMSTPRKKQVMMFSATMTK

SEQ ID NO: 2171244 - protein, 27 aa, Cryptosporidium hominis
FNAEEWKPISLNAICELLSSKDFKDTI

SEQ ID NO: 2171245 - protein, 17 aa, Cryptosporidium hominis
FNAFSYIGINSFKIMCV

SEQ ID NO: 2171246 - protein, 25 aa, Cryptosporidium hominis
FNAHEGVSIGCQWHPVFPSRIASCG

SEQ ID NO: 2171247 - protein, 17 aa, Cryptosporidium hominis
FNCFAARAKFYFENTFL

SEQ ID NO: 2171248 - protein, 21 aa, Cryptosporidium hominis
FNCKALSVTLEHLFEQQSSTL

SEQ ID NO: 2171249 - protein, 19 aa, Cryptosporidium hominis
FNCSSCLDSILSKLDGNTD

SEQ ID NO: 2171250 - protein, 18 aa, Cryptosporidium hominis
FNDGFSLSTGNLHRTRSH

SEQ ID NO: 2171251 - protein, 20 aa, Cryptosporidium hominis
FNDKLVREFSESGEFTEYHT

SEQ ID NO: 2171252 - protein, 25 aa, Cryptosporidium hominis
FNDYQWDFLSKFYRVYISDQYKFVS

SEQ ID NO: 2171253 - protein, 17 aa, Cryptosporidium hominis
FNEGCRVYCRFVDAKPT

SEQ ID NO: 2171254 - protein, 25 aa, Cryptosporidium hominis
FNEPRKTCVIETFAPGFPGCAEGSV

SEQ ID NO: 2171255 - protein, 17 aa, Cryptosporidium hominis
FNFKEMIKKLSLNSIKL

SEQ ID NO: 2171256 - protein, 27 aa, Cryptosporidium hominis
FNGDFLLNLLIKFGILRSDASDLHSLI

SEQ ID NO: 2171257 - protein, 19 aa, Cryptosporidium hominis
FNGILLKASFLGKTDIIKS

SEQ ID NO: 2171258 - protein, 17 aa, Cryptosporidium hominis
FNGMSIVVTGTFNSNSR

SEQ ID NO: 2171259 - protein, 20 aa, Cryptosporidium hominis
FNGNCKLLLEYIPFSEPEDI

SEQ ID NO: 2171260 - protein, 17 aa, Cryptosporidium hominis
FNGRCLFYGALFNLSNR

SEQ ID NO: 2171261 - protein, 24 aa, Cryptosporidium hominis
FNIHPGDIFGCAGDIGWITGHSYL

SEQ ID NO: 2171262 - protein, 21 aa, Cryptosporidium hominis
FNIICTQNLFIWGRNDKGQLG

SEQ ID NO: 2171263 - protein, 18 aa, Cryptosporidium hominis
FNIMYLWGNFTVHEQTGG

SEQ ID NO: 2171264 - protein, 19 aa, Cryptosporidium hominis
FNIPTLRDSQSYRRSVYNS

SEQ ID NO: 2171265 - protein, 22 aa, Cryptosporidium hominis
FNIQLDCLYLFSPDYDGSPPLY

SEQ ID NO: 2171266 - protein, 19 aa, Cryptosporidium hominis
FNITRIKRCCQIMGRQEND

SEQ ID NO: 2171267 - protein, 26 aa, Cryptosporidium hominis
FNKEICMDCCKNLCKYNTIPVRCHFC

SEQ ID NO: 2171268 - protein, 17 aa, Cryptosporidium hominis
FNKEYLLPCSTSFNNLS

SEQ ID NO: 2171269 - protein, 17 aa, Cryptosporidium hominis
FNKFPIKNLNVGNNKRI

SEQ ID NO: 2171270 - protein, 19 aa, Cryptosporidium hominis
FNKKISFDPSKRISLGFSN

SEQ ID NO: 2171271 - protein, 24 aa, Cryptosporidium hominis
FNKLREQLFMMGFELQDQNIEKDQ

SEQ ID NO: 2171272 - protein, 18 aa, Cryptosporidium hominis
FNKNSCIISTKIYLSKQA

SEQ ID NO: 2171273 - protein, 23 aa, Cryptosporidium hominis
FNKRCEYCKVLSTSLSKMNFSKI

SEQ ID NO: 2171274 - protein, 24 aa, Cryptosporidium hominis
FNKSEIHLRCLLLSNMFTEQSIKE

SEQ ID NO: 2171275 - protein, 23 aa, Cryptosporidium hominis
FNKYPCLEFQLDLAQSDLDLLVR

SEQ ID NO: 2171276 - protein, 17 aa, Cryptosporidium hominis
FNLDLIKLHALTPRTNN

SEQ ID NO: 2171277 - protein, 26 aa, Cryptosporidium hominis
FNLEFKPKCVLPLLIGDFTLYRVLQK

SEQ ID NO: 2171278 - protein, 19 aa, Cryptosporidium hominis
FNLQSCIHSGQLILPDNSE

SEQ ID NO: 2171279 - protein, 22 aa, Cryptosporidium hominis
FNLSRYWQYDVEVLQKVSEKSD

SEQ ID NO: 2171280 - protein, 17 aa, Cryptosporidium hominis
FNLSSALALSAGVLPQH

SEQ ID NO: 2171281 - protein, 17 aa, Cryptosporidium hominis
FNMEIFRNERRKELDQL

SEQ ID NO: 2171282 - protein, 17 aa, Cryptosporidium hominis
FNNAFCSESEFGKETSC

SEQ ID NO: 2171283 - protein, 24 aa, Cryptosporidium hominis
FNNICNTCGLPLSTESKCQQSNTH

SEQ ID NO: 2171284 - protein, 25 aa, Cryptosporidium hominis
FNNNFNFRINVQWHSVYVDGWPHII

SEQ ID NO: 2171285 - protein, 24 aa, Cryptosporidium hominis
FNNSLSRLGQAYVELNETKQSLKD

SEQ ID NO: 2171286 - protein, 22 aa, Cryptosporidium hominis
FNPKPGFFQKLIHSRDSKTLKE

SEQ ID NO: 2171287 - protein, 24 aa, Cryptosporidium hominis
FNPKWENLSPFTFNVLCPEISIIN

SEQ ID NO: 2171288 - protein, 25 aa, Cryptosporidium hominis
FNPLYNYGKNYAFYPPGIKPAPIIG

SEQ ID NO: 2171289 - protein, 22 aa, Cryptosporidium hominis
FNQFLRCDSVLYLLVYPQKPLC

SEQ ID NO: 2171290 - protein, 28 aa, Cryptosporidium hominis
FNQIRKTEIFWKFFLENLKGDMMNKTNF

SEQ ID NO: 2171291 - protein, 19 aa, Cryptosporidium hominis
FNQLILKYRGLRNGEISKV

SEQ ID NO: 2171292 - protein, 24 aa, Cryptosporidium hominis
FNRLKEMINEFLSLDVDFLQKIGS

SEQ ID NO: 2171293 - protein, 20 aa, Cryptosporidium hominis
FNRLRRCINPITNNEITKTK

SEQ ID NO: 2171294 - protein, 18 aa, Cryptosporidium hominis
FNSFFSTAHWKEVNSGEV

SEQ ID NO: 2171295 - protein, 24 aa, Cryptosporidium hominis
FNSHPWIWLKSIFEICKDTKQVEN

SEQ ID NO: 2171296 - protein, 18 aa, Cryptosporidium hominis
FNSPCKVAPNPKDCNLFE

SEQ ID NO: 2171297 - protein, 17 aa, Cryptosporidium hominis
FNSPFEELQKLHSPNTS

SEQ ID NO: 2171298 - protein, 25 aa, Cryptosporidium hominis
FNSREFKIAIALAENCQLPVFITLR

SEQ ID NO: 2171299 - protein, 25 aa, Cryptosporidium hominis
FNSRTDPRFKPLIRKEHKVKIDKRF

SEQ ID NO: 2171300 - protein, 25 aa, Cryptosporidium hominis
FNSSAFPPLTSALIKQIPSSKDSTK

SEQ ID NO: 2171301 - protein, 17 aa, Cryptosporidium hominis
FNSTFHLPYSFKEVPEP

SEQ ID NO: 2171302 - protein, 17 aa, Cryptosporidium hominis
FNSTLSFKRNDPDLKIS

SEQ ID NO: 2171303 - protein, 17 aa, Cryptosporidium hominis
FNSYFRKGQAWITFSNA

SEQ ID NO: 2171304 - protein, 30 aa, Cryptosporidium hominis
FNTEFFSPTGLCMTNLKVLNIQGCSQIIDL

SEQ ID NO: 2171305 - protein, 26 aa, Cryptosporidium hominis
FNTRWKCPLCYQIIRPSMLKLDSFVK

SEQ ID NO: 2171306 - protein, 21 aa, Cryptosporidium hominis
FNVECNDVYFGVPTVIVKFLL

SEQ ID NO: 2171307 - protein, 20 aa, Cryptosporidium hominis
FNVHHFPLSISIGYINGKEG

SEQ ID NO: 2171308 - protein, 23 aa, Cryptosporidium hominis
FNYKVKYSWIAVHGIHTKQLLLK

SEQ ID NO: 2171309 - protein, 17 aa, Cryptosporidium hominis
FNYKYNFVKSDSTSSDD

SEQ ID NO: 2171310 - protein, 18 aa, Cryptosporidium hominis
FPAFFAVFTREFENAVVK

SEQ ID NO: 2171311 - protein, 17 aa, Cryptosporidium hominis
FPAGFTPSLSCKGFHDL

SEQ ID NO: 2171312 - protein, 23 aa, Cryptosporidium hominis
FPASEAFQLYSTYGFPMDLTELM

SEQ ID NO: 2171313 - protein, 21 aa, Cryptosporidium hominis
FPCENCAISQIALYDHNIRQY

SEQ ID NO: 2171314 - protein, 26 aa, Cryptosporidium hominis
FPCNVPKWIAQQVWFKCSFLSNETDK

SEQ ID NO: 2171315 - protein, 30 aa, Cryptosporidium hominis
FPDGTPSWFPPLYVEALKHLKDLIPPSRLQ

SEQ ID NO: 2171316 - protein, 21 aa, Cryptosporidium hominis
FPDLAPLMWHSFGCITALLQE

SEQ ID NO: 2171317 - protein, 20 aa, Cryptosporidium hominis
FPDSRLVGRVDILSESALKH

SEQ ID NO: 2171318 - protein, 22 aa, Cryptosporidium hominis
FPESLLPINGVPIINYIIEMLL

SEQ ID NO: 2171319 - protein, 21 aa, Cryptosporidium hominis
FPEVVELLLSSGADLSSGLPH

SEQ ID NO: 2171320 - protein, 21 aa, Cryptosporidium hominis
FPGCAEGSVYYDLQTCIMAYQ

SEQ ID NO: 2171321 - protein, 25 aa, Cryptosporidium hominis
FPGTIDRIRRWFGLYKAVENKDVAK

SEQ ID NO: 2171322 - protein, 17 aa, Cryptosporidium hominis
FPHTCYVVAGTQANMED

SEQ ID NO: 2171323 - protein, 20 aa, Cryptosporidium hominis
FPILLHRKLINISLRKLNNI

SEQ ID NO: 2171324 - protein, 19 aa, Cryptosporidium hominis
FPKFSASCEKFRFMNKKNK

SEQ ID NO: 2171325 - protein, 18 aa, Cryptosporidium hominis
FPKISEFCFTELNNIIPI

SEQ ID NO: 2171326 - protein, 37 aa, Cryptosporidium hominis
FPKKDECHCCFWKKNPYKYRMTLPFLQQKPRFNLWAS

SEQ ID NO: 2171327 - protein, 20 aa, Cryptosporidium hominis
FPKLQSVSFDNLFKLNTPLQ

SEQ ID NO: 2171328 - protein, 17 aa, Cryptosporidium hominis
FPKVVKKRFTYYLDSSL

SEQ ID NO: 2171329 - protein, 26 aa, Cryptosporidium hominis
FPLDESIPIVLALPVTACLDDIVRPW

SEQ ID NO: 2171330 - protein, 17 aa, Cryptosporidium hominis
FPLDYGQIVFFDELLFL

SEQ ID NO: 2171331 - protein, 17 aa, Cryptosporidium hominis
FPLLNEIKQLYIDAYSG

SEQ ID NO: 2171332 - protein, 17 aa, Cryptosporidium hominis
FPLPNIVQQFLPSIVQL

SEQ ID NO: 2171333 - protein, 20 aa, Cryptosporidium hominis
FPLSPKLFVHRTGRTARAGQ

SEQ ID NO: 2171334 - protein, 17 aa, Cryptosporidium hominis
FPNEFLYLNIPIYDTPF

SEQ ID NO: 2171335 - protein, 18 aa, Cryptosporidium hominis
FPNIKEFIENHLMLSNQV

SEQ ID NO: 2171336 - protein, 21 aa, Cryptosporidium hominis
FPNIKEMCGSINFVDNIGIFG

SEQ ID NO: 2171337 - protein, 21 aa, Cryptosporidium hominis
FPNIKLIWSCNSSFSSLVILR

SEQ ID NO: 2171338 - protein, 22 aa, Cryptosporidium hominis
FPNLNLLKTLVFKKGAFTHQNV

SEQ ID NO: 2171339 - protein, 17 aa, Cryptosporidium hominis
FPNVPSFICKTEGEFYK

SEQ ID NO: 2171340 - protein, 17 aa, Cryptosporidium hominis
FPPNGSAPMSMGSGAFA

SEQ ID NO: 2171341 - protein, 20 aa, Cryptosporidium hominis
FPQNVCERLRLLFNSQSGKL

SEQ ID NO: 2171342 - protein, 17 aa, Cryptosporidium hominis
FPQVKWQFVRRNVSSEN

SEQ ID NO: 2171343 - protein, 22 aa, Cryptosporidium hominis
FPSNNLGEYGFRLNDEDRNLNN

SEQ ID NO: 2171344 - protein, 17 aa, Cryptosporidium hominis
FPTELKPIISNKSKLVG

SEQ ID NO: 2171345 - protein, 18 aa, Cryptosporidium hominis
FPTKCVVRLWDTYIAENT

SEQ ID NO: 2171346 - protein, 23 aa, Cryptosporidium hominis
FPTLTPRFGLGKHQSRWFNCKDS

SEQ ID NO: 2171347 - protein, 28 aa, Cryptosporidium hominis
FPTNLRLKYMQIYIMGGYAKKHFYNKEQ

SEQ ID NO: 2171348 - protein, 18 aa, Cryptosporidium hominis
FPTPGTESFYITQLSILT

SEQ ID NO: 2171349 - protein, 17 aa, Cryptosporidium hominis
FPTPVNRSISNGSNPIL

SEQ ID NO: 2171350 - protein, 17 aa, Cryptosporidium hominis
FPTQIFWISCKSIKCFM

SEQ ID NO: 2171351 - protein, 20 aa, Cryptosporidium hominis
FPVMGEQSVTMMINEEAQIV

SEQ ID NO: 2171352 - protein, 26 aa, Cryptosporidium hominis
FPVPFDMKSIRSLQTFSNQHSISHSF

SEQ ID NO: 2171353 - protein, 22 aa, Cryptosporidium hominis
FPVPMKKFGTLYSREGVGHVIT

SEQ ID NO: 2171354 - protein, 21 aa, Cryptosporidium hominis
FPVYEIPNSVTSEICQEVGTK

SEQ ID NO: 2171355 - protein, 25 aa, Cryptosporidium hominis
FQAFISWERIEIFKVSPTYSKNFGL

SEQ ID NO: 2171356 - protein, 27 aa, Cryptosporidium hominis
FQALKILSNAFIKLSSRYDQLKEKSSK

SEQ ID NO: 2171357 - protein, 17 aa, Cryptosporidium hominis
FQASPAYFIIPNYNYAF

SEQ ID NO: 2171358 - protein, 17 aa, Cryptosporidium hominis
FQCSISSCVIQNELSWY

SEQ ID NO: 2171359 - protein, 17 aa, Cryptosporidium hominis
FQDCSKMTTTTTVPSTF

SEQ ID NO: 2171360 - protein, 17 aa, Cryptosporidium hominis
FQDHSWKQLKCYIEEAK

SEQ ID NO: 2171361 - protein, 18 aa, Cryptosporidium hominis
FQDLYRATGPLQFEGPCS

SEQ ID NO: 2171362 - protein, 23 aa, Cryptosporidium hominis
FQDYEIRGILNLNPFLSSNVDEV

SEQ ID NO: 2171363 - protein, 17 aa, Cryptosporidium hominis
FQEAFVLCDLVKSRLEI

SEQ ID NO: 2171364 - protein, 24 aa, Cryptosporidium hominis
FQEFPVMLVDLLNRSKGNGCSDNY

SEQ ID NO: 2171365 - protein, 17 aa, Cryptosporidium hominis
FQERCRVLNASGEAMDQ

SEQ ID NO: 2171366 - protein, 17 aa, Cryptosporidium hominis
FQFCHAFYLSIIREIFC

SEQ ID NO: 2171367 - protein, 20 aa, Cryptosporidium hominis
FQGKELHWLIDIKVVCLSYD

SEQ ID NO: 2171368 - protein, 24 aa, Cryptosporidium hominis
FQGRKSRTGYNRFFNDDEVENVVH

SEQ ID NO: 2171369 - protein, 21 aa, Cryptosporidium hominis
FQGTISFLILHWDDLFFELFE

SEQ ID NO: 2171370 - protein, 22 aa, Cryptosporidium hominis
FQHTHLYGRHLIIEVAENDDDS

SEQ ID NO: 2171371 - protein, 18 aa, Cryptosporidium hominis
FQIELACTNFDFCNQETN

SEQ ID NO: 2171372 - protein, 20 aa, Cryptosporidium hominis
FQIQAAYWWYEDMWYDKYSH

SEQ ID NO: 2171373 - protein, 17 aa, Cryptosporidium hominis
FQIRFILVLLQGNILEH

SEQ ID NO: 2171374 - protein, 18 aa, Cryptosporidium hominis
FQKRFFKLNLTDNALLYW

SEQ ID NO: 2171375 - protein, 17 aa, Cryptosporidium hominis
FQLGVGFGRLKQIFGSF

SEQ ID NO: 2171376 - protein, 19 aa, Cryptosporidium hominis
FQLKVSICEVYMERIRDLL

SEQ ID NO: 2171377 - protein, 18 aa, Cryptosporidium hominis
FQLLEDILFQYALSRSRY

SEQ ID NO: 2171378 - protein, 22 aa, Cryptosporidium hominis
FQLLIRQMELVQAKLQYQQEAW

SEQ ID NO: 2171379 - protein, 21 aa, Cryptosporidium hominis
FQLSKLRIKNFQGFSNDYFKK

SEQ ID NO: 2171380 - protein, 19 aa, Cryptosporidium hominis
FQLTALINVPHWLKPASNK

SEQ ID NO: 2171381 - protein, 23 aa, Cryptosporidium hominis
FQMEYCLCFDPAIVKGMQVCQVS

SEQ ID NO: 2171382 - protein, 20 aa, Cryptosporidium hominis
FQNGLPLVAGGGLLGQNGGI

SEQ ID NO: 2171383 - protein, 20 aa, Cryptosporidium hominis
FQPNHIVDGISECDLYLFST

SEQ ID NO: 2171384 - protein, 22 aa, Cryptosporidium hominis
FQRKCPYCSFREHSKCQNKCCK

SEQ ID NO: 2171385 - protein, 26 aa, Cryptosporidium hominis
FQRKSGSAYPFWDLKIINVISSSERK

SEQ ID NO: 2171386 - protein, 25 aa, Cryptosporidium hominis
FQRPEHYIRFPVHKEFVSGIRLEDG

SEQ ID NO: 2171387 - protein, 18 aa, Cryptosporidium hominis
FQTTSKWIAKHSKGKERL

SEQ ID NO: 2171388 - protein, 17 aa, Cryptosporidium hominis
FQVCVFAPNLLLGCVMT

SEQ ID NO: 2171389 - protein, 17 aa, Cryptosporidium hominis
FQVNDIYKRVCYFYSPK

SEQ ID NO: 2171390 - protein, 19 aa, Cryptosporidium hominis
FQVSKCNYYRGLLSREFPN

SEQ ID NO: 2171391 - protein, 24 aa, Cryptosporidium hominis
FQYALSRSRYESCMNLGNDNSQSF

SEQ ID NO: 2171392 - protein, 18 aa, Cryptosporidium hominis
FQYKALRYLQIHDIPNMT

SEQ ID NO: 2171393 - protein, 17 aa, Cryptosporidium hominis
FQYLRFTISVILLGNLL

SEQ ID NO: 2171394 - protein, 25 aa, Cryptosporidium hominis
FQYVECCEFYKKAADMFDMDEYSKT

SEQ ID NO: 2171395 - protein, 17 aa, Cryptosporidium hominis
FRARRTLCEMLEDRGYI

SEQ ID NO: 2171396 - protein, 17 aa, Cryptosporidium hominis
FRATYILPTSPHFSDSD

SEQ ID NO: 2171397 - protein, 17 aa, Cryptosporidium hominis
FRCNLSRALGVKPSDVS

SEQ ID NO: 2171398 - protein, 18 aa, Cryptosporidium hominis
FRDGYMIATGQPFRDFVD

SEQ ID NO: 2171399 - protein, 21 aa, Cryptosporidium hominis
FRDRVDLRKKLVFSVDPPGCK

SEQ ID NO: 2171400 - protein, 32 aa, Cryptosporidium hominis
FRDVIKRNQLYAFRLLQYQARIELKGKIGSEI

SEQ ID NO: 2171401 - protein, 21 aa, Cryptosporidium hominis
FREETGILKRMVKNKQMKETR

SEQ ID NO: 2171402 - protein, 30 aa, Cryptosporidium hominis
FREIIFKVQCLWPVFLLPLVSGELFFTINE

SEQ ID NO: 2171403 - protein, 20 aa, Cryptosporidium hominis
FREQDVFKLSFAYHPSSIIY

SEQ ID NO: 2171404 - protein, 26 aa, Cryptosporidium hominis
FRESVEYRYKVMYQLADSIRFLHSLS

SEQ ID NO: 2171405 - protein, 20 aa, Cryptosporidium hominis
FRFDLRVENLHIFLHEQCEI

SEQ ID NO: 2171406 - protein, 25 aa, Cryptosporidium hominis
FRFNYSKEFLRWALCVPGQKKNWLV

SEQ ID NO: 2171407 - protein, 17 aa, Cryptosporidium hominis
FRFRQEMQLLSILDHPN

SEQ ID NO: 2171408 - protein, 17 aa, Cryptosporidium hominis
FRHGEGILTVNGKQKRV

SEQ ID NO: 2171409 - protein, 17 aa, Cryptosporidium hominis
FRHVLRNISTQVLRTKK

SEQ ID NO: 2171410 - protein, 18 aa, Cryptosporidium hominis
FRIVVRPLPPLPFTICDW

SEQ ID NO: 2171411 - protein, 27 aa, Cryptosporidium hominis
FRKARQNSPCIIFFDEIDAIGVNRESM

SEQ ID NO: 2171412 - protein, 19 aa, Cryptosporidium hominis
FRKGYLEPIVMKKGYCGSY

SEQ ID NO: 2171413 - protein, 19 aa, Cryptosporidium hominis
FRKNLKYKIKPNCKYELIP

SEQ ID NO: 2171414 - protein, 22 aa, Cryptosporidium hominis
FRKQMKSCCYCVELIGDDFRTE

SEQ ID NO: 2171415 - protein, 17 aa, Cryptosporidium hominis
FRKRRCYSTFNSYFNKF

SEQ ID NO: 2171416 - protein, 20 aa, Cryptosporidium hominis
FRLICKKYGCDLGYSPMYHS

SEQ ID NO: 2171417 - protein, 20 aa, Cryptosporidium hominis
FRLIDEFYPILICKKNDYNL

SEQ ID NO: 2171418 - protein, 17 aa, Cryptosporidium hominis
FRLLIDRSIEIRNWRRG

SEQ ID NO: 2171419 - protein, 18 aa, Cryptosporidium hominis
FRLPIKKESGHISSDNLK

SEQ ID NO: 2171420 - protein, 21 aa, Cryptosporidium hominis
FRLVKYEFNEFQAIEKKKKER

SEQ ID NO: 2171421 - protein, 26 aa, Cryptosporidium hominis
FRLYMKSTKILPRSSVSTMDRRNACD

SEQ ID NO: 2171422 - protein, 17 aa, Cryptosporidium hominis
FRMQTITILSSMYEVIN

SEQ ID NO: 2171423 - protein, 20 aa, Cryptosporidium hominis
FRNCVALGLDVDFDFPEMQA

SEQ ID NO: 2171424 - protein, 18 aa, Cryptosporidium hominis
FRNEIYKILDNTRLVKKV

SEQ ID NO: 2171425 - protein, 17 aa, Cryptosporidium hominis
FRNFYSSVYFINIAELY

SEQ ID NO: 2171426 - protein, 35 aa, Cryptosporidium hominis
FRNKIKRFLLPKLLQFRPNIIFISAGFDGHVIDIV

SEQ ID NO: 2171427 - protein, 18 aa, Cryptosporidium hominis
FRNKISSILLLNNISRDF

SEQ ID NO: 2171428 - protein, 32 aa, Cryptosporidium hominis
FRNVCKMANVLKRFGIKKGDSVGIYMPMIPET

SEQ ID NO: 2171429 - protein, 18 aa, Cryptosporidium hominis
FRPPEAYETGSLYDPTKV

SEQ ID NO: 2171430 - protein, 19 aa, Cryptosporidium hominis
FRPSEYFDYNLRHFNEYGG

SEQ ID NO: 2171431 - protein, 18 aa, Cryptosporidium hominis
FRQPMIPGVSCWNGSDGI

SEQ ID NO: 2171432 - protein, 19 aa, Cryptosporidium hominis
FRQTIMISACRIEDINSLF

SEQ ID NO: 2171433 - protein, 18 aa, Cryptosporidium hominis
FRRAIGLRIRDVKEVYEG

SEQ ID NO: 2171434 - protein, 21 aa, Cryptosporidium hominis
FRRFMNFDWFTSMFSSRRRGT

SEQ ID NO: 2171435 - protein, 20 aa, Cryptosporidium hominis
FRRISPLVGVLSDSYHNINF

SEQ ID NO: 2171436 - protein, 21 aa, Cryptosporidium hominis
FRRLARMKILRLSRDDEIQLG

SEQ ID NO: 2171437 - protein, 19 aa, Cryptosporidium hominis
FRSEPYKKLGAIGTGPLNT

SEQ ID NO: 2171438 - protein, 24 aa, Cryptosporidium hominis
FRSHICLSILCSQNIDKIIETNLV

SEQ ID NO: 2171439 - protein, 25 aa, Cryptosporidium hominis
FRSKIPQLIRHLGWDESIPLRNSLI

SEQ ID NO: 2171440 - protein, 21 aa, Cryptosporidium hominis
FRSRTMGLVSMETYKRHISDI

SEQ ID NO: 2171441 - protein, 17 aa, Cryptosporidium hominis
FRTDIDIIKDVDNLQDG

SEQ ID NO: 2171442 - protein, 18 aa, Cryptosporidium hominis
FRTLSIDYSKLIDEEGIK

SEQ ID NO: 2171443 - protein, 19 aa, Cryptosporidium hominis
FRTNIPLLCESFVDNQENS

SEQ ID NO: 2171444 - protein, 27 aa, Cryptosporidium hominis
FRVEELRLRLCSQLAALLNPIILSRFE

SEQ ID NO: 2171445 - protein, 17 aa, Cryptosporidium hominis
FRVIPDYVMESMPESKF

SEQ ID NO: 2171446 - protein, 18 aa, Cryptosporidium hominis
FRVIQGLIRRSYGNSGAV

SEQ ID NO: 2171447 - protein, 17 aa, Cryptosporidium hominis
FSAAAALSSLVSAGVRS

SEQ ID NO: 2171448 - protein, 20 aa, Cryptosporidium hominis
FSAPVNLRFKTPRSDEELAF

SEQ ID NO: 2171449 - protein, 19 aa, Cryptosporidium hominis
FSATFPREIQQLAKDFLHN

SEQ ID NO: 2171450 - protein, 18 aa, Cryptosporidium hominis
FSCGNSFNALVSHDDEVV

SEQ ID NO: 2171451 - protein, 17 aa, Cryptosporidium hominis
FSCRECSWNPTSACSIQ

SEQ ID NO: 2171452 - protein, 17 aa, Cryptosporidium hominis
FSDGCIVSITDFSCGEF

SEQ ID NO: 2171453 - protein, 17 aa, Cryptosporidium hominis
FSDGWILDSNTIPNQIK

SEQ ID NO: 2171454 - protein, 17 aa, Cryptosporidium hominis
FSDIDFDSYILGREGEQ

SEQ ID NO: 2171455 - protein, 18 aa, Cryptosporidium hominis
FSDKYGIKSLYNACVPAI

SEQ ID NO: 2171456 - protein, 19 aa, Cryptosporidium hominis
FSDMNVFKSSPLLTSILVK

SEQ ID NO: 2171457 - protein, 20 aa, Cryptosporidium hominis
FSEAHLNSKKCCTVLTKVLN

SEQ ID NO: 2171458 - protein, 25 aa, Cryptosporidium hominis
FSEALNVLKSVGFVIVKLKPSQIHR

SEQ ID NO: 2171459 - protein, 19 aa, Cryptosporidium hominis
FSEICDFSILNEMKRKLLS

SEQ ID NO: 2171460 - protein, 24 aa, Cryptosporidium hominis
FSEIFISWIHVKAMRCFVEAVLRY

SEQ ID NO: 2171461 - protein, 18 aa, Cryptosporidium hominis
FSELCKVENKDVILGLHK

SEQ ID NO: 2171462 - protein, 19 aa, Cryptosporidium hominis
FSERNGISMYESWAESNRQ

SEQ ID NO: 2171463 - protein, 18 aa, Cryptosporidium hominis
FSETEVRAEIREFIQLMK

SEQ ID NO: 2171464 - protein, 17 aa, Cryptosporidium hominis
FSFEICDADGSEIRATC

SEQ ID NO: 2171465 - protein, 25 aa, Cryptosporidium hominis
FSFFPPKLSGLVLRDRDGSEIEFKK

SEQ ID NO: 2171466 - protein, 17 aa, Cryptosporidium hominis
FSFKDVNGISVIGIVRP

SEQ ID NO: 2171467 - protein, 24 aa, Cryptosporidium hominis
FSFRETHSVFSLRLLPNEMAMVVN

SEQ ID NO: 2171468 - protein, 19 aa, Cryptosporidium hominis
FSGADLAELCQRAAKAAIR

SEQ ID NO: 2171469 - protein, 18 aa, Cryptosporidium hominis
FSGASARFTTPSISGYNR

SEQ ID NO: 2171470 - protein, 19 aa, Cryptosporidium hominis
FSGIILAGNILRLTPASKG

SEQ ID NO: 2171471 - protein, 17 aa, Cryptosporidium hominis
FSGILAAHSIHLKILQD

SEQ ID NO: 2171472 - protein, 21 aa, Cryptosporidium hominis
FSGKIPQIGFWYIRHRHDKLD

SEQ ID NO: 2171473 - protein, 17 aa, Cryptosporidium hominis
FSGLNAFNGGVGINSNL

SEQ ID NO: 2171474 - protein, 20 aa, Cryptosporidium hominis
FSGNFGELIVDDFVHSPASI

SEQ ID NO: 2171475 - protein, 17 aa, Cryptosporidium hominis
FSGPIVRGSKLFLKGFD

SEQ ID NO: 2171476 - protein, 17 aa, Cryptosporidium hominis
FSGRMGKFPSLSEDILT

SEQ ID NO: 2171477 - protein, 20 aa, Cryptosporidium hominis
FSGRNLRKLPFVSLLSSYHH

SEQ ID NO: 2171478 - protein, 17 aa, Cryptosporidium hominis
FSICKGVNKNGTLCTNP

SEQ ID NO: 2171479 - protein, 21 aa, Cryptosporidium hominis
FSIDDTQVWAYKAFAQALEII

SEQ ID NO: 2171480 - protein, 17 aa, Cryptosporidium hominis
FSIKDILIRLLVFTFTL

SEQ ID NO: 2171481 - protein, 18 aa, Cryptosporidium hominis
FSIKEVVCRRCNKRQPAS

SEQ ID NO: 2171482 - protein, 17 aa, Cryptosporidium hominis
FSIMVLQECLQRHGYSC

SEQ ID NO: 2171483 - protein, 22 aa, Cryptosporidium hominis
FSINDLRFLLKQMSTNIFNKNI

SEQ ID NO: 2171484 - protein, 22 aa, Cryptosporidium hominis
FSIWDPKVTFFGRSIGLSKDDP

SEQ ID NO: 2171485 - protein, 20 aa, Cryptosporidium hominis
FSKGALDFSLKVRNQCDGSK

SEQ ID NO: 2171486 - protein, 25 aa, Cryptosporidium hominis
FSKRTGIDLQTRFPGASSQSIDLLK

SEQ ID NO: 2171487 - protein, 26 aa, Cryptosporidium hominis
FSLECISESLSPFFFNRQEKLNVLES

SEQ ID NO: 2171488 - protein, 32 aa, Cryptosporidium hominis
FSLEVISILFSLKIMFPDKIFLLRGNHEDASV

SEQ ID NO: 2171489 - protein, 18 aa, Cryptosporidium hominis
FSLFSSALTAMFSKISFV

SEQ ID NO: 2171490 - protein, 19 aa, Cryptosporidium hominis
FSLLLSIFNNHKWNIDIPD

SEQ ID NO: 2171491 - protein, 17 aa, Cryptosporidium hominis
FSLQLSDYFRLLIDRSI

SEQ ID NO: 2171492 - protein, 17 aa, Cryptosporidium hominis
FSLTVDIEPSFNLENSL

SEQ ID NO: 2171493 - protein, 24 aa, Cryptosporidium hominis
FSLYEFPEIFLFELDSQVNFDTWR

SEQ ID NO: 2171494 - protein, 24 aa, Cryptosporidium hominis
FSMFLKPSRGWNAPPLKQQTIDLF

SEQ ID NO: 2171495 - protein, 23 aa, Cryptosporidium hominis
FSMLKVLELRNLYIPLDTFDHLI

SEQ ID NO: 2171496 - protein, 20 aa, Cryptosporidium hominis
FSMQYPIIWEDFKNHLNSNN

SEQ ID NO: 2171497 - protein, 17 aa, Cryptosporidium hominis
FSMSSNWWDIAKFNEDI

SEQ ID NO: 2171498 - protein, 19 aa, Cryptosporidium hominis
FSNEEFIESSALRTAKNDS

SEQ ID NO: 2171499 - protein, 22 aa, Cryptosporidium hominis
FSNEELLDLYGFYKQATVGDAP

SEQ ID NO: 2171500 - protein, 19 aa, Cryptosporidium hominis
FSNHKAIIILFELKETKIV

SEQ ID NO: 2171501 - protein, 26 aa, Cryptosporidium hominis
FSNIPIDRQRIIAIVNFSSGFFPVSI

SEQ ID NO: 2171502 - protein, 32 aa, Cryptosporidium hominis
FSNLAFKPRNSYIYRYDGRFSGNGCKYMEVKG

SEQ ID NO: 2171503 - protein, 28 aa, Cryptosporidium hominis
FSNLCKMVEFSLLWMALVINKFPNFIKV

SEQ ID NO: 2171504 - protein, 24 aa, Cryptosporidium hominis
FSNLKDKYKVFSMNNAKHRIFSRK

SEQ ID NO: 2171505 - protein, 23 aa, Cryptosporidium hominis
FSNLKSYLNFISIYNQISKQGSI

SEQ ID NO: 2171506 - protein, 17 aa, Cryptosporidium hominis
FSNMIASFGQDQTISLL

SEQ ID NO: 2171507 - protein, 18 aa, Cryptosporidium hominis
FSNWIGQFMIKINHRQLL

SEQ ID NO: 2171508 - protein, 39 aa, Cryptosporidium hominis
FSNWQRLRWSIRMIPQKLPLDLIIALECVLQLHSTPIDE

SEQ ID NO: 2171509 - protein, 18 aa, Cryptosporidium hominis
FSPEIQGFIVTKFDPLLS

SEQ ID NO: 2171510 - protein, 21 aa, Cryptosporidium hominis
FSPKLLESIKIIGYSLPTPIQ

SEQ ID NO: 2171511 - protein, 21 aa, Cryptosporidium hominis
FSQGYLKNLFLLSLDKNKDKI

SEQ ID NO: 2171512 - protein, 28 aa, Cryptosporidium hominis
FSQKILAHYGFVFPIMIRLKILHHHLLF

SEQ ID NO: 2171513 - protein, 17 aa, Cryptosporidium hominis
FSQNSYNGFGGIPNNNN

SEQ ID NO: 2171514 - protein, 19 aa, Cryptosporidium hominis
FSQVSGLKFRFNGDLPPGQ

SEQ ID NO: 2171515 - protein, 24 aa, Cryptosporidium hominis
FSRDELAKILKFGAQKLWSKGTNN

SEQ ID NO: 2171516 - protein, 21 aa, Cryptosporidium hominis
FSRNDTIHFAIGIDTNSFSTV

SEQ ID NO: 2171517 - protein, 24 aa, Cryptosporidium hominis
FSRPICSPLSQFLVGSDGSNSKNV

SEQ ID NO: 2171518 - protein, 21 aa, Cryptosporidium hominis
FSSELKRMFDNCRFYNAKNTI

SEQ ID NO: 2171519 - protein, 17 aa, Cryptosporidium hominis
FSSKEFRELIQVREKLH

SEQ ID NO: 2171520 - protein, 26 aa, Cryptosporidium hominis
FSSKIKLKKRMLYFTLTTGKMKLPSS

SEQ ID NO: 2171521 - protein, 28 aa, Cryptosporidium hominis
FSSKPKQARLAFPLLIQRFKDLREEAIA

SEQ ID NO: 2171522 - protein, 17 aa, Cryptosporidium hominis
FSSLMVNLLVKRKITAV

SEQ ID NO: 2171523 - protein, 25 aa, Cryptosporidium hominis
FSSNGFPWWRGIISFFKEYLTSNKQ

SEQ ID NO: 2171524 - protein, 17 aa, Cryptosporidium hominis
FSSRTNLIYTYSSNWFA

SEQ ID NO: 2171525 - protein, 23 aa, Cryptosporidium hominis
FSSSCVICTLPIGVLKKSVQSSE

SEQ ID NO: 2171526 - protein, 30 aa, Cryptosporidium hominis
FSSTYDCRGGLKYIWNDNCKVNWHSNNLSP

SEQ ID NO: 2171527 - protein, 18 aa, Cryptosporidium hominis
FSTAAPLFYFGLPEETLM

SEQ ID NO: 2171528 - protein, 26 aa, Cryptosporidium hominis
FSTGSVGWYYGGKVPLPVGDDLEVLC

SEQ ID NO: 2171529 - protein, 18 aa, Cryptosporidium hominis
FSTHLHLLCDEFSNDTKV

SEQ ID NO: 2171530 - protein, 23 aa, Cryptosporidium hominis
FSTREAFHGRPLYITPSMHLLSL

SEQ ID NO: 2171531 - protein, 30 aa, Cryptosporidium hominis
FSVDLALRLSQRTGTQWRPRILNHNKHLKR

SEQ ID NO: 2171532 - protein, 30 aa, Cryptosporidium hominis
FSVEGQLEFKAILFIPRRAPFDLFETRKKR

SEQ ID NO: 2171533 - protein, 17 aa, Cryptosporidium hominis
FSVEYHVGNLLSRTTYS

SEQ ID NO: 2171534 - protein, 20 aa, Cryptosporidium hominis
FSVIFRRAFASRVIPPKLLK

SEQ ID NO: 2171535 - protein, 17 aa, Cryptosporidium hominis
FSYAIKNTTLWLSKYFF

SEQ ID NO: 2171536 - protein, 19 aa, Cryptosporidium hominis
FSYNGHLDEGFSMDWNPNQ

SEQ ID NO: 2171537 - protein, 18 aa, Cryptosporidium hominis
FTAGIIIVLSSVFDKIAL

SEQ ID NO: 2171538 - protein, 19 aa, Cryptosporidium hominis
FTCPVCLDYYMLPVTIPCG

SEQ ID NO: 2171539 - protein, 22 aa, Cryptosporidium hominis
FTDYPPLGRFAVRDMKQTVAVG

SEQ ID NO: 2171540 - protein, 25 aa, Cryptosporidium hominis
FTEHVKRFSIIYDQGIGMNGIQTNE

SEQ ID NO: 2171541 - protein, 18 aa, Cryptosporidium hominis
FTEKNVFTRGFENLYKIN

SEQ ID NO: 2171542 - protein, 32 aa, Cryptosporidium hominis
FTEKTFKEYIIRQLGIRWERIKKQNIETSDDL

SEQ ID NO: 2171543 - protein, 24 aa, Cryptosporidium hominis
FTFDKCFTSEYVRAMETAAMLGLP

SEQ ID NO: 2171544 - protein, 23 aa, Cryptosporidium hominis
FTFPEKLDLSSFVNHNNKGETDT

SEQ ID NO: 2171545 - protein, 30 aa, Cryptosporidium hominis
FTGVVGVLCGKDYLPLRWELNSTKESYNFE

SEQ ID NO: 2171546 - protein, 21 aa, Cryptosporidium hominis
FTKHDIFKYIFLIMGQLKVPR

SEQ ID NO: 2171547 - protein, 18 aa, Cryptosporidium hominis
FTKLGDACYSPFSMINNT

SEQ ID NO: 2171548 - protein, 17 aa, Cryptosporidium hominis
FTLKENFNFFIDEISSV

SEQ ID NO: 2171549 - protein, 19 aa, Cryptosporidium hominis
FTLSIGRLNTDPLMNTGNQ

SEQ ID NO: 2171550 - protein, 20 aa, Cryptosporidium hominis
FTMPTSCKKFISTINNKFTE

SEQ ID NO: 2171551 - protein, 22 aa, Cryptosporidium hominis
FTNPCLFSINNIRVTGVSGQCI

SEQ ID NO: 2171552 - protein, 26 aa, Cryptosporidium hominis
FTNREYPIVLIIGWCEKIDMLIKLTF

SEQ ID NO: 2171553 - protein, 18 aa, Cryptosporidium hominis
FTNSPSYPVYMRSLSEEK

SEQ ID NO: 2171554 - protein, 23 aa, Cryptosporidium hominis
FTPSTLRAIFKLSIQADQEAVSV

SEQ ID NO: 2171555 - protein, 20 aa, Cryptosporidium hominis
FTQLLPVPKAHFVSDFNSKD

SEQ ID NO: 2171556 - protein, 20 aa, Cryptosporidium hominis
FTQYWQVIGILAKQESRQIR

SEQ ID NO: 2171557 - protein, 25 aa, Cryptosporidium hominis
FTRKHAYMRNELVFCNKPILEIDHG

SEQ ID NO: 2171558 - protein, 17 aa, Cryptosporidium hominis
FTRNCLSKEDLDVIDKI

SEQ ID NO: 2171559 - protein, 21 aa, Cryptosporidium hominis
FTRNDLCVIMTGIPYIDKKNF

SEQ ID NO: 2171560 - protein, 18 aa, Cryptosporidium hominis
FTSEIKIIRSRSENSLKL

SEQ ID NO: 2171561 - protein, 24 aa, Cryptosporidium hominis
FTSEKRPIVEFAIEDKRALFIQKK

SEQ ID NO: 2171562 - protein, 17 aa, Cryptosporidium hominis
FTSFKNNEMNASKHNLR

SEQ ID NO: 2171563 - protein, 25 aa, Cryptosporidium hominis
FTSILKRKKHIFIITKTSSVFQSSI

SEQ ID NO: 2171564 - protein, 27 aa, Cryptosporidium hominis
FTSKEYIRDCCTIKPHWLVDFAPNLFQ

SEQ ID NO: 2171565 - protein, 18 aa, Cryptosporidium hominis
FTSMITYLCRSCFLPEIF

SEQ ID NO: 2171566 - protein, 20 aa, Cryptosporidium hominis
FTSPISSEFDILGQTLQHFG

SEQ ID NO: 2171567 - protein, 31 aa, Cryptosporidium hominis
FTSSRWKNISSSVKDLIKWMMTKDPESRCTA

SEQ ID NO: 2171568 - protein, 21 aa, Cryptosporidium hominis
FTYGSKFPPPIPNIGSFVDLL

SEQ ID NO: 2171569 - protein, 29 aa, Cryptosporidium hominis
FVAWNKCSVCLWNRSSYEYHILQECSNSN

SEQ ID NO: 2171570 - protein, 20 aa, Cryptosporidium hominis
FVCASTRIALTASAKWGLPS

SEQ ID NO: 2171571 - protein, 25 aa, Cryptosporidium hominis
FVCPCCRKPDSCFCGIEKDFNISQE

SEQ ID NO: 2171572 - protein, 17 aa, Cryptosporidium hominis
FVDCFRIEEDYSQEELD

SEQ ID NO: 2171573 - protein, 17 aa, Cryptosporidium hominis
FVDNFRWQCIVLDEAHR

SEQ ID NO: 2171574 - protein, 17 aa, Cryptosporidium hominis
FVDSGILFYEFRLPIIY

SEQ ID NO: 2171575 - protein, 23 aa, Cryptosporidium hominis
FVEEKVRLFTGLNFDHDGLSEGI

SEQ ID NO: 2171576 - protein, 19 aa, Cryptosporidium hominis
FVEMCMWEDAVDCLIVADR

SEQ ID NO: 2171577 - protein, 18 aa, Cryptosporidium hominis
FVFGKRAKHMRLNKVSEL

SEQ ID NO: 2171578 - protein, 26 aa, Cryptosporidium hominis
FVFHPKIPFVCKIEMKSETKIGVITS

SEQ ID NO: 2171579 - protein, 20 aa, Cryptosporidium hominis
FVGAEPYNTIGIRIPNIELI

SEQ ID NO: 2171580 - protein, 17 aa, Cryptosporidium hominis
FVGEMLCLVRFAGDFSI

SEQ ID NO: 2171581 - protein, 17 aa, Cryptosporidium hominis
FVGILGHRVFQLKELEN

SEQ ID NO: 2171582 - protein, 17 aa, Cryptosporidium hominis
FVGPSCSLIEYMRKIFK

SEQ ID NO: 2171583 - protein, 30 aa, Cryptosporidium hominis
FVGTISKFKIPIELFPLNKNQIIIDIDLVQ

SEQ ID NO: 2171584 - protein, 18 aa, Cryptosporidium hominis
FVGVSSFLGTGMKSFLEK

SEQ ID NO: 2171585 - protein, 23 aa, Cryptosporidium hominis
FVHKNIRLAVAHKVGHRTVASPQ

SEQ ID NO: 2171586 - protein, 18 aa, Cryptosporidium hominis
FVIKDWTYFLPILLSSSV

SEQ ID NO: 2171587 - protein, 19 aa, Cryptosporidium hominis
FVIYPNLLFEKELCDLSVI

SEQ ID NO: 2171588 - protein, 18 aa, Cryptosporidium hominis
FVKCEYCSNNMHITCSWS

SEQ ID NO: 2171589 - protein, 19 aa, Cryptosporidium hominis
FVKELNLVIPNSFRINRGG

SEQ ID NO: 2171590 - protein, 18 aa, Cryptosporidium hominis
FVKLISWYDNESGYSNRL

SEQ ID NO: 2171591 - protein, 22 aa, Cryptosporidium hominis
FVKSFFDLVSMILLKADVHIFE

SEQ ID NO: 2171592 - protein, 18 aa, Cryptosporidium hominis
FVLAIIYVGRIIKFNKNF

SEQ ID NO: 2171593 - protein, 19 aa, Cryptosporidium hominis
FVLGGLTAVALEWKQESKL

SEQ ID NO: 2171594 - protein, 19 aa, Cryptosporidium hominis
FVLKIFPVSIDVFLSNRLI

SEQ ID NO: 2171595 - protein, 27 aa, Cryptosporidium hominis
FVLSLAYKFDPCVWLDDPLPISHPVIL

SEQ ID NO: 2171596 - protein, 17 aa, Cryptosporidium hominis
FVMEICTGGELFDRIIK

SEQ ID NO: 2171597 - protein, 19 aa, Cryptosporidium hominis
FVMQDVQEHFKRASQTILS

SEQ ID NO: 2171598 - protein, 24 aa, Cryptosporidium hominis
FVNFKRLYEYNGKKLPFSVAQIGL

SEQ ID NO: 2171599 - protein, 19 aa, Cryptosporidium hominis
FVNKQDCESFEFFFSFIYG

SEQ ID NO: 2171600 - protein, 21 aa, Cryptosporidium hominis
FVPAHFCKDAWGLVYYDGTPT

SEQ ID NO: 2171601 - protein, 23 aa, Cryptosporidium hominis
FVPAKSWLPMMNLIGNEENNEEK

SEQ ID NO: 2171602 - protein, 20 aa, Cryptosporidium hominis
FVPQRYLRRGIFSSVDLSSS

SEQ ID NO: 2171603 - protein, 32 aa, Cryptosporidium hominis
FVPSQCFKLDLIMYSAIGWARHGEINQNHSTN

SEQ ID NO: 2171604 - protein, 27 aa, Cryptosporidium hominis
FVRDLTSFSWNFTRRAKRRTVQVQDIK

SEQ ID NO: 2171605 - protein, 22 aa, Cryptosporidium hominis
FVRLLLNRKKYRIILLDEPTIE

SEQ ID NO: 2171606 - protein, 18 aa, Cryptosporidium hominis
FVRSLSFGDYSPYESQVE

SEQ ID NO: 2171607 - protein, 18 aa, Cryptosporidium hominis
FVSCGWDKIVKVWSHEFK

SEQ ID NO: 2171608 - protein, 19 aa, Cryptosporidium hominis
FVSHGLCETTIFYAGCTLE

SEQ ID NO: 2171609 - protein, 17 aa, Cryptosporidium hominis
FVSLTPVDFCVMVILIR

SEQ ID NO: 2171610 - protein, 23 aa, Cryptosporidium hominis
FVSPLKFKFIIEELNEWRESSKN

SEQ ID NO: 2171611 - protein, 18 aa, Cryptosporidium hominis
FVSREFRGIEKSRQLRES

SEQ ID NO: 2171612 - protein, 18 aa, Cryptosporidium hominis
FVSSEAFADLRTNQQLAY

SEQ ID NO: 2171613 - protein, 31 aa, Cryptosporidium hominis
FVTRKAILLRFSWLAPCHLVQIECINRRRKI

SEQ ID NO: 2171614 - protein, 17 aa, Cryptosporidium hominis
FVVLSIWLVELNSFVSF

SEQ ID NO: 2171615 - protein, 19 aa, Cryptosporidium hominis
FVVPRYVEKLVEIPFHPGM

SEQ ID NO: 2171616 - protein, 25 aa, Cryptosporidium hominis
FVVPVHVPVLEFRDHFVPIPVRKRV

SEQ ID NO: 2171617 - protein, 18 aa, Cryptosporidium hominis
FVYFLSRIPNLSKRLECM

SEQ ID NO: 2171618 - protein, 17 aa, Cryptosporidium hominis
FWCKYREHVEKNGDSNQ

SEQ ID NO: 2171619 - protein, 18 aa, Cryptosporidium hominis
FWDESCDFYGLNRIGHEH

SEQ ID NO: 2171620 - protein, 19 aa, Cryptosporidium hominis
FWDTYRFEGNSQWIPIKNN

SEQ ID NO: 2171621 - protein, 26 aa, Cryptosporidium hominis
FWEPSWRIWIFFLRGIIPILERWIGN

SEQ ID NO: 2171622 - protein, 21 aa, Cryptosporidium hominis
FWIDIQLRWGDYDSHDIERYC

SEQ ID NO: 2171623 - protein, 19 aa, Cryptosporidium hominis
FWKSERYSIDYSLSTYLSW

SEQ ID NO: 2171624 - protein, 26 aa, Cryptosporidium hominis
FWPEIPEYNLSFGIHTQSAIKIAKGI

SEQ ID NO: 2171625 - protein, 18 aa, Cryptosporidium hominis
FWSKTMRPHLKFDHDKSI

SEQ ID NO: 2171626 - protein, 25 aa, Cryptosporidium hominis
FWSQMARKELRWLRDFTKVRSSGTC

SEQ ID NO: 2171627 - protein, 26 aa, Cryptosporidium hominis
FYAGKGEHPVQCMIFSGPFTTDKENL

SEQ ID NO: 2171628 - protein, 29 aa, Cryptosporidium hominis
FYCPGINKVRYWAMCFIGSERSTEPEFDL

SEQ ID NO: 2171629 - protein, 21 aa, Cryptosporidium hominis
FYFNKLRAIEILYEELNEKKI

SEQ ID NO: 2171630 - protein, 22 aa, Cryptosporidium hominis
FYFSCFNEIFKLEFPQGDKERI

SEQ ID NO: 2171631 - protein, 19 aa, Cryptosporidium hominis
FYFSSIFDHIVFKQAQEMI

SEQ ID NO: 2171632 - protein, 20 aa, Cryptosporidium hominis
FYGNCVGGLIASATSVALRE

SEQ ID NO: 2171633 - protein, 20 aa, Cryptosporidium hominis
FYIYQILKALDFCHSQGIMH

SEQ ID NO: 2171634 - protein, 26 aa, Cryptosporidium hominis
FYKKLKLKVILIDGTWSQAKSINKSL

SEQ ID NO: 2171635 - protein, 18 aa, Cryptosporidium hominis
FYKLNGFGEKHTRSYLSI

SEQ ID NO: 2171636 - protein, 24 aa, Cryptosporidium hominis
FYKNIIFLLRLIALYSEKSEQKYN

SEQ ID NO: 2171637 - protein, 17 aa, Cryptosporidium hominis
FYKSLKFALENPENACI

SEQ ID NO: 2171638 - protein, 26 aa, Cryptosporidium hominis
FYLDDGSGLILIDWLVDNTGTKYKQD

SEQ ID NO: 2171639 - protein, 17 aa, Cryptosporidium hominis
FYLFNVWVNDFYRILKW

SEQ ID NO: 2171640 - protein, 19 aa, Cryptosporidium hominis
FYLIFEFFVAGNIILTDCN

SEQ ID NO: 2171641 - protein, 21 aa, Cryptosporidium hominis
FYLLESLCSILSNKLLEQSME

SEQ ID NO: 2171642 - protein, 18 aa, Cryptosporidium hominis
FYLQRYGVELGRRKNADE

SEQ ID NO: 2171643 - protein, 21 aa, Cryptosporidium hominis
FYLRGSCRFGDNCRDYHPNGS

SEQ ID NO: 2171644 - protein, 17 aa, Cryptosporidium hominis
FYLSTLLAMTVKLVQNN

SEQ ID NO: 2171645 - protein, 25 aa, Cryptosporidium hominis
FYMMVRAKASLHLVAHRGASYFVPE

SEQ ID NO: 2171646 - protein, 17 aa, Cryptosporidium hominis
FYNDYIFRYKRKPISDS

SEQ ID NO: 2171647 - protein, 18 aa, Cryptosporidium hominis
FYNNPVMLQSFITKMDYQ

SEQ ID NO: 2171648 - protein, 17 aa, Cryptosporidium hominis
FYNRYKILYPSFESHDF

SEQ ID NO: 2171649 - protein, 17 aa, Cryptosporidium hominis
FYPALTMVGTPSPNITS

SEQ ID NO: 2171650 - protein, 17 aa, Cryptosporidium hominis
FYPFRFYPMNELDQKFP

SEQ ID NO: 2171651 - protein, 18 aa, Cryptosporidium hominis
FYPHKFKISMSLPAYALK

SEQ ID NO: 2171652 - protein, 24 aa, Cryptosporidium hominis
FYPPGIKPAPIIGNYHTTPPNYHY

SEQ ID NO: 2171653 - protein, 25 aa, Cryptosporidium hominis
FYQHLKELLVVASLYENYRNFQNQC

SEQ ID NO: 2171654 - protein, 17 aa, Cryptosporidium hominis
FYSCNKTVLNIEEQLTS

SEQ ID NO: 2171655 - protein, 23 aa, Cryptosporidium hominis
FYSGRLGGTFSNGRLNGNNNINH

SEQ ID NO: 2171656 - protein, 23 aa, Cryptosporidium hominis
FYSKAMIRKAIRGELFHDDHVEL

SEQ ID NO: 2171657 - protein, 24 aa, Cryptosporidium hominis
FYSSELNSVLKLMFERDPHKRPSA

SEQ ID NO: 2171658 - protein, 18 aa, Cryptosporidium hominis
FYSSIDIVKESKFATQEH

SEQ ID NO: 2171659 - protein, 17 aa, Cryptosporidium hominis
FYSYSIFLFKQFERTNG

SEQ ID NO: 2171660 - protein, 27 aa, Cryptosporidium hominis
FYTDERLRLGGVLELLDEEALIREAAA

SEQ ID NO: 2171661 - protein, 18 aa, Cryptosporidium hominis
FYTKLTFLNDEHWVNISH

SEQ ID NO: 2171662 - protein, 18 aa, Cryptosporidium hominis
FYTSPRCMCVSFHKYGDY

SEQ ID NO: 2171663 - protein, 24 aa, Cryptosporidium hominis
FYWERLPRFVGFEELPWREYWCYP

SEQ ID NO: 2171664 - protein, 22 aa, Cryptosporidium hominis
FYWTGIKWICTRNDSSNTILGY

SEQ ID NO: 2171665 - protein, 18 aa, Cryptosporidium hominis
FYYFRILTVESELDLNRD

SEQ ID NO: 2171666 - protein, 18 aa, Cryptosporidium hominis
FYYLKGHIKRSSTRDRPR

SEQ ID NO: 2171667 - protein, 18 aa, Cryptosporidium hominis
FYYSYFLPNNHMMSVPQI

SEQ ID NO: 2171668 - protein, 18 aa, Cryptosporidium hominis
GAAAPVYLAAVLEYLCAE

SEQ ID NO: 2171669 - protein, 20 aa, Cryptosporidium hominis
GAAFVDFMATVALNYTKSQF

SEQ ID NO: 2171670 - protein, 19 aa, Cryptosporidium hominis
GAEQFNWDSLRSISRKERE

SEQ ID NO: 2171671 - protein, 19 aa, Cryptosporidium hominis
GAFEVLARIQIKKLLRPSL

SEQ ID NO: 2171672 - protein, 21 aa, Cryptosporidium hominis
GAFGKCMRCGNGAAGNSSSCG

SEQ ID NO: 2171673 - protein, 18 aa, Cryptosporidium hominis
GAFGVVFKCMDLVTNEIV

SEQ ID NO: 2171674 - protein, 27 aa, Cryptosporidium hominis
GAFSNFKEMLSITVLLHYLCIGNDSPL

SEQ ID NO: 2171675 - protein, 23 aa, Cryptosporidium hominis
GAGNAILSYWFIKECGKPQNKIK

SEQ ID NO: 2171676 - protein, 18 aa, Cryptosporidium hominis
GAHINRSLLALANCINSL

SEQ ID NO: 2171677 - protein, 25 aa, Cryptosporidium hominis
GAHKRKKPGVLTFNLYSGQFEKSNP

SEQ ID NO: 2171678 - protein, 36 aa, Cryptosporidium hominis
GAHPPRPAIPPPHMYAPNMARPGPYAQGRYAPSGAL

SEQ ID NO: 2171679 - protein, 22 aa, Cryptosporidium hominis
GAIMFCDASGFTALTAALDKQL

SEQ ID NO: 2171680 - protein, 19 aa, Cryptosporidium hominis
GAINNRGSASLGLNNGFSE

SEQ ID NO: 2171681 - protein, 18 aa, Cryptosporidium hominis
GAIPDWSKAGRMILRDYW

SEQ ID NO: 2171682 - protein, 24 aa, Cryptosporidium hominis
GAKFARQGTNPGLIHISHKERQSS

SEQ ID NO: 2171683 - protein, 20 aa, Cryptosporidium hominis
GALAIDCPFMGKFVDGIQGD

SEQ ID NO: 2171684 - protein, 27 aa, Cryptosporidium hominis
GALGCEFLKSMALLGVGCGPNGTVTIT

SEQ ID NO: 2171685 - protein, 24 aa, Cryptosporidium hominis
GALNELRVDLELRIISPIKNSHIY

SEQ ID NO: 2171686 - protein, 18 aa, Cryptosporidium hominis
GALNSMIQKGNFSFGGGG

SEQ ID NO: 2171687 - protein, 21 aa, Cryptosporidium hominis
GAMRTRGGIKLSQLSQNLSQA

SEQ ID NO: 2171688 - protein, 19 aa, Cryptosporidium hominis
GANFRYAVLESDEIQDEML

SEQ ID NO: 2171689 - protein, 37 aa, Cryptosporidium hominis
GANIFIFNVPYEWDKKSLVGLFCRFGNILSAHLMVDK

SEQ ID NO: 2171690 - protein, 20 aa, Cryptosporidium hominis
GANLMQEFLDGCWDMDQHYE

SEQ ID NO: 2171691 - protein, 23 aa, Cryptosporidium hominis
GAQPIRCPTNFLKKVSQDVVVTS

SEQ ID NO: 2171692 - protein, 19 aa, Cryptosporidium hominis
GASHCYPMAAGSIKKNGYC

SEQ ID NO: 2171693 - protein, 17 aa, Cryptosporidium hominis
GASIVIFSPCIEQVSKN

SEQ ID NO: 2171694 - protein, 17 aa, Cryptosporidium hominis
GASMFSNIHQFSAESAL

SEQ ID NO: 2171695 - protein, 17 aa, Cryptosporidium hominis
GATILKSLESLFISESI

SEQ ID NO: 2171696 - protein, 25 aa, Cryptosporidium hominis
GATKVIFCGPPIYPSIYLDCIQSIN

SEQ ID NO: 2171697 - protein, 23 aa, Cryptosporidium hominis
GAVRKSGVPGVYWSQKPQGWRVV

SEQ ID NO: 2171698 - protein, 19 aa, Cryptosporidium hominis
GAYSRINGVVTLRELKIAA

SEQ ID NO: 2171699 - protein, 28 aa, Cryptosporidium hominis
GCEKDIYIKPIFKAERTTLILRDLENDV

SEQ ID NO: 2171700 - protein, 18 aa, Cryptosporidium hominis
GCFDKMFEALKSLIYLSE

SEQ ID NO: 2171701 - protein, 19 aa, Cryptosporidium hominis
GCFFKEFVKESSITSSSLP

SEQ ID NO: 2171702 - protein, 19 aa, Cryptosporidium hominis
GCFKDKIGRFLSERYIISK

SEQ ID NO: 2171703 - protein, 17 aa, Cryptosporidium hominis
GCFVKIFGELTLMVSEP

SEQ ID NO: 2171704 - protein, 43 aa, Cryptosporidium hominis
GCIELSRHPLCHYCRRSCKRLNYSRCPSKLKPLNLGINPSGLN

SEQ ID NO: 2171705 - protein, 17 aa, Cryptosporidium hominis
GCIGRRVTISDSQEFKI

SEQ ID NO: 2171706 - protein, 20 aa, Cryptosporidium hominis
GCIGTHHWMAPEILRGEGFT

SEQ ID NO: 2171707 - protein, 22 aa, Cryptosporidium hominis
GCINLSSVIAIHIEDALNFVIR

SEQ ID NO: 2171708 - protein, 19 aa, Cryptosporidium hominis
GCKNYRFGGCGSVLDYRYL

SEQ ID NO: 2171709 - protein, 25 aa, Cryptosporidium hominis
GCLDGTIRLWDFRTGENVKILKGHK

SEQ ID NO: 2171710 - protein, 19 aa, Cryptosporidium hominis
GCSLSCIFNLSSAIEELYR

SEQ ID NO: 2171711 - protein, 24 aa, Cryptosporidium hominis
GCSVARNLIGWGIRNFKFIDHSKV

SEQ ID NO: 2171712 - protein, 18 aa, Cryptosporidium hominis
GCTLKLPIVNEDDDMMDF

SEQ ID NO: 2171713 - protein, 21 aa, Cryptosporidium hominis
GCTLPYIGFEELKEMGITEIT

SEQ ID NO: 2171714 - protein, 24 aa, Cryptosporidium hominis
GCTSISRPSLMGMEKQRQEESNLS

SEQ ID NO: 2171715 - protein, 22 aa, Cryptosporidium hominis
GCTSVKTCPGIVSLKKDIDIYF

SEQ ID NO: 2171716 - protein, 20 aa, Cryptosporidium hominis
GDAYGRLTYWFIPPSSSKEG

SEQ ID NO: 2171717 - protein, 17 aa, Cryptosporidium hominis
GDCRVGSTASVYAAAIL

SEQ ID NO: 2171718 - protein, 23 aa, Cryptosporidium hominis
GDDLYLSISLIRFSEYVDGYVLF

SEQ ID NO: 2171719 - protein, 27 aa, Cryptosporidium hominis
GDEIIECVSFPSAVAIGLEIAIKGMGR

SEQ ID NO: 2171720 - protein, 26 aa, Cryptosporidium hominis
GDELAADFGENWFSRIRRISENNIKN

SEQ ID NO: 2171721 - protein, 30 aa, Cryptosporidium hominis
GDFRSASMYHCIRCSYKAQDGLLYPLNRSF

SEQ ID NO: 2171722 - protein, 24 aa, Cryptosporidium hominis
GDFRSTKKKIHWLANLPSVLTKCI

SEQ ID NO: 2171723 - protein, 17 aa, Cryptosporidium hominis
GDGDGDGDEDVKLYNNN

SEQ ID NO: 2171724 - protein, 25 aa, Cryptosporidium hominis
GDGFKLVYCTLCYESCNSKAFCQGG

SEQ ID NO: 2171725 - protein, 25 aa, Cryptosporidium hominis
GDGFLKGIVIDSSFCSLRQLCHELV

SEQ ID NO: 2171726 - protein, 19 aa, Cryptosporidium hominis
GDGSAIWNSELEAWATIGS

SEQ ID NO: 2171727 - protein, 20 aa, Cryptosporidium hominis
GDGSRLGYNGPKGMYPIGKI

SEQ ID NO: 2171728 - protein, 22 aa, Cryptosporidium hominis
GDHLTLLYAFESFREVLYKDEN

SEQ ID NO: 2171729 - protein, 27 aa, Cryptosporidium hominis
GDIIHWLFLSICTFEERKCFSLTDLSK

SEQ ID NO: 2171730 - protein, 19 aa, Cryptosporidium hominis
GDIPRNISLHMTRGLIDKV

SEQ ID NO: 2171731 - protein, 18 aa, Cryptosporidium hominis
GDIYKLETFFSGSETQFK

SEQ ID NO: 2171732 - protein, 22 aa, Cryptosporidium hominis
GDKSSFCELNLGEVVVYKPKSK

SEQ ID NO: 2171733 - protein, 21 aa, Cryptosporidium hominis
GDKYEVFGVGGIKVQQILDLK

SEQ ID NO: 2171734 - protein, 24 aa, Cryptosporidium hominis
GDLFAYRLRILFKQSNISIYMEPL

SEQ ID NO: 2171735 - protein, 18 aa, Cryptosporidium hominis
GDLKFSVEEINDLNMKYI

SEQ ID NO: 2171736 - protein, 18 aa, Cryptosporidium hominis
GDLKHRLRTPIVHSLLKD

SEQ ID NO: 2171737 - protein, 22 aa, Cryptosporidium hominis
GDLKVWKFFIGYEQINIEDDKS

SEQ ID NO: 2171738 - protein, 24 aa, Cryptosporidium hominis
GDLLRGIFAYGFEKPSAIQQRGIK

SEQ ID NO: 2171739 - protein, 17 aa, Cryptosporidium hominis
GDLRLPNGKEVVHRNLA

SEQ ID NO: 2171740 - protein, 18 aa, Cryptosporidium hominis
GDMIFGYKNTKYFDTEIQ

SEQ ID NO: 2171741 - protein, 22 aa, Cryptosporidium hominis
GDNHIKVALTLQDEVPSLDLTP

SEQ ID NO: 2171742 - protein, 17 aa, Cryptosporidium hominis
GDNKHGYGIQKWPDGAV

SEQ ID NO: 2171743 - protein, 18 aa, Cryptosporidium hominis
GDNLASFSDYRLAKNENK

SEQ ID NO: 2171744 - protein, 22 aa, Cryptosporidium hominis
GDNSNNIAFNYKYNFVKSDSTS

SEQ ID NO: 2171745 - protein, 18 aa, Cryptosporidium hominis
GDNTFYLIFEFFVAGNII

SEQ ID NO: 2171746 - protein, 34 aa, Cryptosporidium hominis
GDPEFLVYLKSCLGSVRIPHHWNSKRRYLQGKKG

SEQ ID NO: 2171747 - protein, 24 aa, Cryptosporidium hominis
GDQESPFVYALVDWIKEKVGNFRI

SEQ ID NO: 2171748 - protein, 20 aa, Cryptosporidium hominis
GDRFPTLNLSPPVTGGVTIK

SEQ ID NO: 2171749 - protein, 29 aa, Cryptosporidium hominis
GDRLFDMGFAPQLLSIISIIRPDRQIAIF

SEQ ID NO: 2171750 - protein, 24 aa, Cryptosporidium hominis
GDSQCLENYPFLNMLGQQPLNNVI

SEQ ID NO: 2171751 - protein, 24 aa, Cryptosporidium hominis
GDVIVWTLPFLVRSCENSINIPLN

SEQ ID NO: 2171752 - protein, 18 aa, Cryptosporidium hominis
GDVSFLLKLHAYLEFWGL

SEQ ID NO: 2171753 - protein, 24 aa, Cryptosporidium hominis
GDYCELRCHACVGGTSVRDDMNKL

SEQ ID NO: 2171754 - protein, 18 aa, Cryptosporidium hominis
GDYDEIISRHYSVNGNAN

SEQ ID NO: 2171755 - protein, 21 aa, Cryptosporidium hominis
GEASLEWSLNFLTRNCDFLNE

SEQ ID NO: 2171756 - protein, 19 aa, Cryptosporidium hominis
GECSKCIKDELDILLYNCN

SEQ ID NO: 2171757 - protein, 24 aa, Cryptosporidium hominis
GEDCPRQVWPSVVGVKESGDKRFP

SEQ ID NO: 2171758 - protein, 19 aa, Cryptosporidium hominis
GEDELRDATLLVLANKQDL

SEQ ID NO: 2171759 - protein, 31 aa, Cryptosporidium hominis
GEDPRIGGPSSIFEMRLSPSMNELKNEEIDK

SEQ ID NO: 2171760 - protein, 20 aa, Cryptosporidium hominis
GEEFPLFMGEDVLDPNNPHI

SEQ ID NO: 2171761 - protein, 22 aa, Cryptosporidium hominis
GEEFRVPFLVNYRTSCQPNKFE

SEQ ID NO: 2171762 - protein, 24 aa, Cryptosporidium hominis
GEEIDEVGCLLIFDETYKSVIDSF

SEQ ID NO: 2171763 - protein, 26 aa, Cryptosporidium hominis
GEENAWNMARDAFKFINNNNKLPFDF

SEQ ID NO: 2171764 - protein, 17 aa, Cryptosporidium hominis
GEFARLYPMGKQILGKL

SEQ ID NO: 2171765 - protein, 17 aa, Cryptosporidium hominis
GEFFIHYQIDLLAFRLL

SEQ ID NO: 2171766 - protein, 25 aa, Cryptosporidium hominis
GEFLRNHLMCYSRNNLLTSELTFPT

SEQ ID NO: 2171767 - protein, 18 aa, Cryptosporidium hominis
GEGGKIAFIDHFTNNEHY

SEQ ID NO: 2171768 - protein, 18 aa, Cryptosporidium hominis
GEGIDWTRIDFIDNKVII

SEQ ID NO: 2171769 - protein, 18 aa, Cryptosporidium hominis
GEGRGGFGGGGRDGFGGG

SEQ ID NO: 2171770 - protein, 19 aa, Cryptosporidium hominis
GEHICGVLTKKIAGSSSGS

SEQ ID NO: 2171771 - protein, 24 aa, Cryptosporidium hominis
GEHRFLQEWTKLRFFDKSTNKRLD

SEQ ID NO: 2171772 - protein, 30 aa, Cryptosporidium hominis
GEIAAICKKQMRLLFEPQRLTIHDVYSDLY

SEQ ID NO: 2171773 - protein, 19 aa, Cryptosporidium hominis
GEIILEMFLEQSILSIKER

SEQ ID NO: 2171774 - protein, 21 aa, Cryptosporidium hominis
GEIKAFKFILMEIGFESIIAD

SEQ ID NO: 2171775 - protein, 27 aa, Cryptosporidium hominis
GEIKKAYHKLAIKWHPDKNMGNDRQMC

SEQ ID NO: 2171776 - protein, 20 aa, Cryptosporidium hominis
GEIQIKWKCSNCGEFSNEIN

SEQ ID NO: 2171777 - protein, 21 aa, Cryptosporidium hominis
GEISDSILIYDIFSHNLKLNG

SEQ ID NO: 2171778 - protein, 25 aa, Cryptosporidium hominis
GEISRFNIEGGILMKSYLIGQPELT

SEQ ID NO: 2171779 - protein, 18 aa, Cryptosporidium hominis
GEIYRWGLYDLKSPIVFK

SEQ ID NO: 2171780 - protein, 21 aa, Cryptosporidium hominis
GEKDLKINFLSSQINQLKDEN

SEQ ID NO: 2171781 - protein, 20 aa, Cryptosporidium hominis
GEKKFGFSLKNSICKAQNNI

SEQ ID NO: 2171782 - protein, 22 aa, Cryptosporidium hominis
GEKLRSLLFNSFNLKSESQGYG

SEQ ID NO: 2171783 - protein, 19 aa, Cryptosporidium hominis
GEKTLSSLALVFALHQFRP

SEQ ID NO: 2171784 - protein, 18 aa, Cryptosporidium hominis
GEKTMAALALLFAMQSYH

SEQ ID NO: 2171785 - protein, 19 aa, Cryptosporidium hominis
GELIIECIGEMLTDSDVRD

SEQ ID NO: 2171786 - protein, 18 aa, Cryptosporidium hominis
GELIKFSSFNKIGHFEVI

SEQ ID NO: 2171787 - protein, 23 aa, Cryptosporidium hominis
GELILAEKPLCWITTKIGNHFKD

SEQ ID NO: 2171788 - protein, 20 aa, Cryptosporidium hominis
GELNCIFRKIKFDIPTECEE

SEQ ID NO: 2171789 - protein, 19 aa, Cryptosporidium hominis
GELRGIVNCERINIDEEHV

SEQ ID NO: 2171790 - protein, 21 aa, Cryptosporidium hominis
GELYSLVRFIGFHPYAYNFCN

SEQ ID NO: 2171791 - protein, 17 aa, Cryptosporidium hominis
GEMVRRRLTLYRYNEFR

SEQ ID NO: 2171792 - protein, 24 aa, Cryptosporidium hominis
GEMYECLGRLMGICVTTKSAMNIN

SEQ ID NO: 2171793 - protein, 23 aa, Cryptosporidium hominis
GENLKIPPLPALSDVAEKCGLNI

SEQ ID NO: 2171794 - protein, 26 aa, Cryptosporidium hominis
GENRNAFCAIRPPGHHLGTWGAAQTV

SEQ ID NO: 2171795 - protein, 23 aa, Cryptosporidium hominis
GENRSSLMFGTLVYTFREGSVSQ

SEQ ID NO: 2171796 - protein, 22 aa, Cryptosporidium hominis
GENSLGRLLELERSFDYIVGID

SEQ ID NO: 2171797 - protein, 19 aa, Cryptosporidium hominis
GEPCGLLLHLSQDCIPVTQ

SEQ ID NO: 2171798 - protein, 24 aa, Cryptosporidium hominis
GEPSKRWYERIAVISPYNEQVKII

SEQ ID NO: 2171799 - protein, 24 aa, Cryptosporidium hominis
GERKRLSLQNSFPYNYNYPAVYNS

SEQ ID NO: 2171800 - protein, 30 aa, Cryptosporidium hominis
GERVYKPGGKKEWRVVFWTHESTKPSRRQC

SEQ ID NO: 2171801 - protein, 17 aa, Cryptosporidium hominis
GESCSFGSSSNISEDLN

SEQ ID NO: 2171802 - protein, 20 aa, Cryptosporidium hominis
GESDLQWQLDYSRNCALISL

SEQ ID NO: 2171803 - protein, 22 aa, Cryptosporidium hominis
GESFPACRIHKMKAADFSKIPS

SEQ ID NO: 2171804 - protein, 21 aa, Cryptosporidium hominis
GESHGGYTYCVVSGLCILGKS

SEQ ID NO: 2171805 - protein, 26 aa, Cryptosporidium hominis
GESIKCCPSFSKAYYRRGIAYFNLLK

SEQ ID NO: 2171806 - protein, 17 aa, Cryptosporidium hominis
GETRICSDYIPPFKKKN

SEQ ID NO: 2171807 - protein, 25 aa, Cryptosporidium hominis
GETTKLHFSKFFSLGQLQCVDPETR

SEQ ID NO: 2171808 - protein, 17 aa, Cryptosporidium hominis
GEVKRQYGIGPLEPTFL

SEQ ID NO: 2171809 - protein, 18 aa, Cryptosporidium hominis
GEVKSCNIIRDYKTGDSL

SEQ ID NO: 2171810 - protein, 22 aa, Cryptosporidium hominis
GEVSLQFIRCFIPNSHMRSDVW

SEQ ID NO: 2171811 - protein, 24 aa, Cryptosporidium hominis
GEYFRIILCSSILKIIDSYTFQKT

SEQ ID NO: 2171812 - protein, 25 aa, Cryptosporidium hominis
GFAALRFLIRSSLNACNEFLKLGVF

SEQ ID NO: 2171813 - protein, 19 aa, Cryptosporidium hominis
GFCYTFSGNLLIFILPRVE

SEQ ID NO: 2171814 - protein, 23 aa, Cryptosporidium hominis
GFDPTEWCNLGSGINTMVQVETS

SEQ ID NO: 2171815 - protein, 22 aa, Cryptosporidium hominis
GFERLFPPLLYKLQQEYIQENA

SEQ ID NO: 2171816 - protein, 22 aa, Cryptosporidium hominis
GFERRVSSELGELISNEKILKP

SEQ ID NO: 2171817 - protein, 24 aa, Cryptosporidium hominis
GFFEQLKGLFLMKPIDEAVEDLLQ

SEQ ID NO: 2171818 - protein, 19 aa, Cryptosporidium hominis
GFFKTQIVNVPPRLDSSSG

SEQ ID NO: 2171819 - protein, 17 aa, Cryptosporidium hominis
GFFSKAMYIRKSQALSR

SEQ ID NO: 2171820 - protein, 18 aa, Cryptosporidium hominis
GFFSKLGSMLSFGKKSSS

SEQ ID NO: 2171821 - protein, 22 aa, Cryptosporidium hominis
GFGEKHTRSYLSIPNYLKYTKC

SEQ ID NO: 2171822 - protein, 18 aa, Cryptosporidium hominis
GFGGETPVSFAIVDDKQF

SEQ ID NO: 2171823 - protein, 26 aa, Cryptosporidium hominis
GFGRIGRLVLRACMERNDITVVAIND

SEQ ID NO: 2171824 - protein, 18 aa, Cryptosporidium hominis
GFGVYKLATGRIYEGQYS

SEQ ID NO: 2171825 - protein, 21 aa, Cryptosporidium hominis
GFICAEVYKFTDLMELGSEAA

SEQ ID NO: 2171826 - protein, 22 aa, Cryptosporidium hominis
GFKEERWKKLIPVQVLSKTGNK

SEQ ID NO: 2171827 - protein, 22 aa, Cryptosporidium hominis
GFKKEFPNGLKYEVLSISKNVK

SEQ ID NO: 2171828 - protein, 31 aa, Cryptosporidium hominis
GFKSWLEYHKKFWLESFHAFNEKQLELEKKL

SEQ ID NO: 2171829 - protein, 24 aa, Cryptosporidium hominis
GFLAIPNDWWMCYVHGDDLEKILC

SEQ ID NO: 2171830 - protein, 23 aa, Cryptosporidium hominis
GFLKGGGITTYLLESSRCVKHSH

SEQ ID NO: 2171831 - protein, 18 aa, Cryptosporidium hominis
GFLKVAFQFPPKERLPVT

SEQ ID NO: 2171832 - protein, 26 aa, Cryptosporidium hominis
GFLLEIPEIVPFRLTPNIVIAMGSCG

SEQ ID NO: 2171833 - protein, 25 aa, Cryptosporidium hominis
GFLRSLWLISRFDWEKKPLIVDFDF

SEQ ID NO: 2171834 - protein, 28 aa, Cryptosporidium hominis
GFLSSFRFPHCSRYTAFPVGIADSANGG

SEQ ID NO: 2171835 - protein, 21 aa, Cryptosporidium hominis
GFLTKSFISIKGFYFQAKILG

SEQ ID NO: 2171836 - protein, 18 aa, Cryptosporidium hominis
GFPSVGFQFETYLTRSEI

SEQ ID NO: 2171837 - protein, 25 aa, Cryptosporidium hominis
GFRDFFLKPELIRAIGDAGFEHPSE

SEQ ID NO: 2171838 - protein, 31 aa, Cryptosporidium hominis
GFRRLIYSLIEWRSVFGLVCSFKSFIESDNF

SEQ ID NO: 2171839 - protein, 25 aa, Cryptosporidium hominis
GFRRSCLFELLSLSVSRGYIVSNPS

SEQ ID NO: 2171840 - protein, 19 aa, Cryptosporidium hominis
GFRSLSLKGIYYDRRNHGW

SEQ ID NO: 2171841 - protein, 21 aa, Cryptosporidium hominis
GFRVGNRAIRGWNQPNTGSQA

SEQ ID NO: 2171842 - protein, 19 aa, Cryptosporidium hominis
GFSESQVINALRATNGNTE

SEQ ID NO: 2171843 - protein, 24 aa, Cryptosporidium hominis
GFTECPKSYVFRGTKDVTSQQLQL

SEQ ID NO: 2171844 - protein, 19 aa, Cryptosporidium hominis
GFTGAPYMDRIRTLKTLFG

SEQ ID NO: 2171845 - protein, 22 aa, Cryptosporidium hominis
GFTNRTLPHFKMNCVDGRSRGF

SEQ ID NO: 2171846 - protein, 18 aa, Cryptosporidium hominis
GFVGNSFFSGLQPDEFFF

SEQ ID NO: 2171847 - protein, 24 aa, Cryptosporidium hominis
GFVPSHWSPTAIKLFPLASPVGRN

SEQ ID NO: 2171848 - protein, 23 aa, Cryptosporidium hominis
GFWNEMPSKMKIESPKSQEISGV

SEQ ID NO: 2171849 - protein, 25 aa, Cryptosporidium hominis
GGAFRIWDIRTGRSILSQLAHSKKI

SEQ ID NO: 2171850 - protein, 27 aa, Cryptosporidium hominis
GGAGGNRRWNFGASKEKGRYKQSGNES

SEQ ID NO: 2171851 - protein, 17 aa, Cryptosporidium hominis
GGALSRSNSLRYSSSSG

SEQ ID NO: 2171852 - protein, 17 aa, Cryptosporidium hominis
GGALVLADEGICLIDEF

SEQ ID NO: 2171853 - protein, 18 aa, Cryptosporidium hominis
GGDAYRAETFLATLEKVK

SEQ ID NO: 2171854 - protein, 18 aa, Cryptosporidium hominis
GGDFKRQGEIEVVGGDDE

SEQ ID NO: 2171855 - protein, 21 aa, Cryptosporidium hominis
GGDGTLLWLSHLFQTSVPPVI

SEQ ID NO: 2171856 - protein, 25 aa, Cryptosporidium hominis
GGDKRYNITGSFCSTSIKSEQGFKI

SEQ ID NO: 2171857 - protein, 23 aa, Cryptosporidium hominis
GGDYYKSELLDTIYHPNYPDYSN

SEQ ID NO: 2171858 - protein, 20 aa, Cryptosporidium hominis
GGEGKCLWIDTEGTFRPERI

SEQ ID NO: 2171859 - protein, 19 aa, Cryptosporidium hominis
GGEGLNLQVANYVFLLDPW

SEQ ID NO: 2171860 - protein, 17 aa, Cryptosporidium hominis
GGEKCNSEKTILYEERQ

SEQ ID NO: 2171861 - protein, 20 aa, Cryptosporidium hominis
GGELIFVIRPAPSMGGEGGI

SEQ ID NO: 2171862 - protein, 22 aa, Cryptosporidium hominis
GGELQRVALILALGKKADIYLI

SEQ ID NO: 2171863 - protein, 21 aa, Cryptosporidium hominis
GGETLKYIRKLVVTRYELLSF

SEQ ID NO: 2171864 - protein, 24 aa, Cryptosporidium hominis
GGEVCGLRISEFHYGSKSPLFEEF

SEQ ID NO: 2171865 - protein, 23 aa, Cryptosporidium hominis
GGEYIGGLLPGALAAAGVNIGGG

SEQ ID NO: 2171866 - protein, 27 aa, Cryptosporidium hominis
GGFGIPKYAGEIIIVRFERSQIFPEET

SEQ ID NO: 2171867 - protein, 18 aa, Cryptosporidium hominis
GGFYGHPCKCLFINWHKL

SEQ ID NO: 2171868 - protein, 21 aa, Cryptosporidium hominis
GGGGSSMGIGGRMERNENKIS

SEQ ID NO: 2171869 - protein, 23 aa, Cryptosporidium hominis
GGGHCMDIAKVLRVLYEDPNTTL

SEQ ID NO: 2171870 - protein, 28 aa, Cryptosporidium hominis
GGGLTPLSMCLLIKYNCETLVDLELEGL

SEQ ID NO: 2171871 - protein, 20 aa, Cryptosporidium hominis
GGGMSGLGIIGGGTNAAAAA

SEQ ID NO: 2171872 - protein, 17 aa, Cryptosporidium hominis
GGGPCGVLASLNGFIIS

SEQ ID NO: 2171873 - protein, 25 aa, Cryptosporidium hominis
GGGPHLGPHPHIFIHGNPQFHYHHQ

SEQ ID NO: 2171874 - protein, 22 aa, Cryptosporidium hominis
GGGVTCLNASSASLGFQNGLPL

SEQ ID NO: 2171875 - protein, 22 aa, Cryptosporidium hominis
GGGYRRVYGMGLHSNRRGGPDD

SEQ ID NO: 2171876 - protein, 20 aa, Cryptosporidium hominis
GGHEFIDISLLPGVNLITGG

SEQ ID NO: 2171877 - protein, 19 aa, Cryptosporidium hominis
GGHFHSWVMSWHFSEVDNS

SEQ ID NO: 2171878 - protein, 26 aa, Cryptosporidium hominis
GGHGRFTFLLLRALERYSPVWEDLGY

SEQ ID NO: 2171879 - protein, 19 aa, Cryptosporidium hominis
GGIIAPIIVVPGATIPGGV

SEQ ID NO: 2171880 - protein, 18 aa, Cryptosporidium hominis
GGIKGMRIAKYGTAEYEK

SEQ ID NO: 2171881 - protein, 22 aa, Cryptosporidium hominis
GGILRKVFEAITNLVSDVNLEC

SEQ ID NO: 2171882 - protein, 22 aa, Cryptosporidium hominis
GGILRYKVDFQDYAVVEDDLDE

SEQ ID NO: 2171883 - protein, 18 aa, Cryptosporidium hominis
GGINNYSICTNNHMGGPI

SEQ ID NO: 2171884 - protein, 17 aa, Cryptosporidium hominis
GGIPFLLNLRHFYQFNF

SEQ ID NO: 2171885 - protein, 22 aa, Cryptosporidium hominis
GGISLPFVLKVVLSESLDMILL

SEQ ID NO: 2171886 - protein, 22 aa, Cryptosporidium hominis
GGKDICNSCIDLKELLVSVCGE

SEQ ID NO: 2171887 - protein, 20 aa, Cryptosporidium hominis
GGKKDRHWPIIGESLPNRSL

SEQ ID NO: 2171888 - protein, 24 aa, Cryptosporidium hominis
GGKRKRDSFELSSDFAKCANSDHF

SEQ ID NO: 2171889 - protein, 19 aa, Cryptosporidium hominis
GGLALNEFGSFMGNMNEEP

SEQ ID NO: 2171890 - protein, 31 aa, Cryptosporidium hominis
GGLGGIGRIIIKWMLEEGVRKIAILSRSANN

SEQ ID NO: 2171891 - protein, 18 aa, Cryptosporidium hominis
GGLGRLLVHMKLINKSEE

SEQ ID NO: 2171892 - protein, 19 aa, Cryptosporidium hominis
GGLIKSAFNAFSYIGINSF

SEQ ID NO: 2171893 - protein, 23 aa, Cryptosporidium hominis
GGMGMMDKCYFTGKSDLLNWLNS

SEQ ID NO: 2171894 - protein, 21 aa, Cryptosporidium hominis
GGNIILPLALIDKCIGNRIYV

SEQ ID NO: 2171895 - protein, 23 aa, Cryptosporidium hominis
GGNRKIIKIPYLANITDFSTIQN

SEQ ID NO: 2171896 - protein, 23 aa, Cryptosporidium hominis
GGPKPRCSHQAVIFNECLYIHGG

SEQ ID NO: 2171897 - protein, 25 aa, Cryptosporidium hominis
GGQKTLVALAFLFALHRADPAPMYL

SEQ ID NO: 2171898 - protein, 25 aa, Cryptosporidium hominis
GGSCNICGSVKHLARNCDQQISKTN

SEQ ID NO: 2171899 - protein, 30 aa, Cryptosporidium hominis
GGSDPLSRLVMKWRNLSVSDIQDFTYITEN

SEQ ID NO: 2171900 - protein, 18 aa, Cryptosporidium hominis
GGSGISRHLGISKLGTPN

SEQ ID NO: 2171901 - protein, 18 aa, Cryptosporidium hominis
GGSKKEWGIESISNNIFT

SEQ ID NO: 2171902 - protein, 19 aa, Cryptosporidium hominis
GGSVFEFKLTSGIPSAVPT

SEQ ID NO: 2171903 - protein, 28 aa, Cryptosporidium hominis
GGTRLVKVCSKYTMVPYFGSRSIVKIND

SEQ ID NO: 2171904 - protein, 29 aa, Cryptosporidium hominis
GGVIDYKSHGIGVFLPEGRTIDPNANDGL

SEQ ID NO: 2171905 - protein, 25 aa, Cryptosporidium hominis
GGVRGCAYCGGLGHRIGQCTKLLEL

SEQ ID NO: 2171906 - protein, 18 aa, Cryptosporidium hominis
GGYNCLLLTGLLEHYQSF

SEQ ID NO: 2171907 - protein, 20 aa, Cryptosporidium hominis
GHAKAHIVGLDIFTNKKYED

SEQ ID NO: 2171908 - protein, 22 aa, Cryptosporidium hominis
GHCAGALVYKGMNGYLAVIRGL

SEQ ID NO: 2171909 - protein, 23 aa, Cryptosporidium hominis
GHDIWPGACYVYKSNGSKSSLRY

SEQ ID NO: 2171910 - protein, 18 aa, Cryptosporidium hominis
GHEYEVWDYLGNPESDIP

SEQ ID NO: 2171911 - protein, 17 aa, Cryptosporidium hominis
GHFSERYAAVIMRQVFS

SEQ ID NO: 2171912 - protein, 17 aa, Cryptosporidium hominis
GHGDAISSLCEIKIAEE

SEQ ID NO: 2171913 - protein, 18 aa, Cryptosporidium hominis
GHGQRHGHGHGHTQTQNQ

SEQ ID NO: 2171914 - protein, 18 aa, Cryptosporidium hominis
GHHTAILLVTGKLYMFGG

SEQ ID NO: 2171915 - protein, 24 aa, Cryptosporidium hominis
GHITSIAVLRTHRGFGLAKKLLTQ

SEQ ID NO: 2171916 - protein, 25 aa, Cryptosporidium hominis
GHLFFEIFPFLSGIENMILKQIIMQ

SEQ ID NO: 2171917 - protein, 29 aa, Cryptosporidium hominis
GHNLFLPYIFELHSGGLFPAPILINEMKD

SEQ ID NO: 2171918 - protein, 23 aa, Cryptosporidium hominis
GHPLEGVMVVELIIIAKCCGLTG

SEQ ID NO: 2171919 - protein, 17 aa, Cryptosporidium hominis
GHSKEGYAMDWGNSTSN

SEQ ID NO: 2171920 - protein, 20 aa, Cryptosporidium hominis
GHSMRLRSAYSMAKAMVEGH

SEQ ID NO: 2171921 - protein, 19 aa, Cryptosporidium hominis
GIAPGCLKTYVTTDSNLLC

SEQ ID NO: 2171922 - protein, 27 aa, Cryptosporidium hominis
GIARLWDLRMGRELVKYSSGLRSSCHS

SEQ ID NO: 2171923 - protein, 27 aa, Cryptosporidium hominis
GIATGCLYLKQRGIFHLNLKPTNILIE

SEQ ID NO: 2171924 - protein, 20 aa, Cryptosporidium hominis
GIATICRIHRLHIAPDYDEF

SEQ ID NO: 2171925 - protein, 17 aa, Cryptosporidium hominis
GICGMRLNAERISTIAR

SEQ ID NO: 2171926 - protein, 24 aa, Cryptosporidium hominis
GIDFDRHYGRCVVMVGIPYQYTLS

SEQ ID NO: 2171927 - protein, 19 aa, Cryptosporidium hominis
GIDIPDIEWIIQFDAPQDP

SEQ ID NO: 2171928 - protein, 20 aa, Cryptosporidium hominis
GIEGFHQFFPGLNMGGEYIG

SEQ ID NO: 2171929 - protein, 18 aa, Cryptosporidium hominis
GIELSVPILEQINDIVRL

SEQ ID NO: 2171930 - protein, 18 aa, Cryptosporidium hominis
GIETLGGVFTRLINRNTT

SEQ ID NO: 2171931 - protein, 34 aa, Cryptosporidium hominis
GIETLRAIPWVFAWTQIRSHLPVWLGLSAALEEM

SEQ ID NO: 2171932 - protein, 22 aa, Cryptosporidium hominis
GIFNGRPSYRHFVNGVRNESNN

SEQ ID NO: 2171933 - protein, 27 aa, Cryptosporidium hominis
GIGNLFPQEAIEYGSLMNSMECMGGLT

SEQ ID NO: 2171934 - protein, 27 aa, Cryptosporidium hominis
GIGTEILRCLIFSGFRRIDIVDYDYVE

SEQ ID NO: 2171935 - protein, 19 aa, Cryptosporidium hominis
GIIESYKFVIGNLQIDNQY

SEQ ID NO: 2171936 - protein, 17 aa, Cryptosporidium hominis
GIILSPRAKKKVSMEDL

SEQ ID NO: 2171937 - protein, 19 aa, Cryptosporidium hominis
GIINFKEWVVNGAEEHLLN

SEQ ID NO: 2171938 - protein, 17 aa, Cryptosporidium hominis
GIIPEYLTNLFSSNELN

SEQ ID NO: 2171939 - protein, 24 aa, Cryptosporidium hominis
GIIPRAVQLIFERLESQYTEYGVR

SEQ ID NO: 2171940 - protein, 21 aa, Cryptosporidium hominis
GIIRYCLIQLQSLGLVEFNPN

SEQ ID NO: 2171941 - protein, 18 aa, Cryptosporidium hominis
GIISKGYFNSRCPRSQSM

SEQ ID NO: 2171942 - protein, 23 aa, Cryptosporidium hominis
GIKEEPYCRFAKGLVSLLDSIKV

SEQ ID NO: 2171943 - protein, 23 aa, Cryptosporidium hominis
GIKERKNKVYGFAAGQDDGIEGE

SEQ ID NO: 2171944 - protein, 25 aa, Cryptosporidium hominis
GIKILKILFLILINYNIFPGVNGKS

SEQ ID NO: 2171945 - protein, 24 aa, Cryptosporidium hominis
GIKNFPFAPSMKIDRLGAVCDFSY

SEQ ID NO: 2171946 - protein, 24 aa, Cryptosporidium hominis
GIKPLFPVKPLLSISSPDFEQIWK

SEQ ID NO: 2171947 - protein, 25 aa, Cryptosporidium hominis
GIKTRISGQISPWNALEMAMKEFKD

SEQ ID NO: 2171948 - protein, 19 aa, Cryptosporidium hominis
GILEGRYSFNFNSSKGKIK

SEQ ID NO: 2171949 - protein, 17 aa, Cryptosporidium hominis
GILFGMVNIPIVFAIDG

SEQ ID NO: 2171950 - protein, 17 aa, Cryptosporidium hominis
GILKCFFNSRPVIIKNI

SEQ ID NO: 2171951 - protein, 20 aa, Cryptosporidium hominis
GILNMNAFQLFGLENKFSIN

SEQ ID NO: 2171952 - protein, 17 aa, Cryptosporidium hominis
GILPIIADSLHEILEDF

SEQ ID NO: 2171953 - protein, 20 aa, Cryptosporidium hominis
GILQKKARDLNNFQYGDDDI

SEQ ID NO: 2171954 - protein, 19 aa, Cryptosporidium hominis
GILSRFGYTYLPKFKLGED

SEQ ID NO: 2171955 - protein, 20 aa, Cryptosporidium hominis
GINCPARSIVFTSIKKYDGR

SEQ ID NO: 2171956 - protein, 20 aa, Cryptosporidium hominis
GINDLCWINPTLTPNIFSTV

SEQ ID NO: 2171957 - protein, 23 aa, Cryptosporidium hominis
GINELNPGFPLILPNQLYQVNNA

SEQ ID NO: 2171958 - protein, 23 aa, Cryptosporidium hominis
GINLNEIRNGLNISKSKNSSINK

SEQ ID NO: 2171959 - protein, 24 aa, Cryptosporidium hominis
GINLPSLRKPISLISRSPRNSYSK

SEQ ID NO: 2171960 - protein, 23 aa, Cryptosporidium hominis
GINNGGYEDIRFGNQSGTHNMVF

SEQ ID NO: 2171961 - protein, 18 aa, Cryptosporidium hominis
GINPSKWGGSVLPKSNGV

SEQ ID NO: 2171962 - protein, 17 aa, Cryptosporidium hominis
GIPEYVSLMPYYTSLCY

SEQ ID NO: 2171963 - protein, 21 aa, Cryptosporidium hominis
GIPNAYALGDCALVRPRKLAE

SEQ ID NO: 2171964 - protein, 27 aa, Cryptosporidium hominis
GIPRIKHKFEIATLFIQYFLQDVLNIL

SEQ ID NO: 2171965 - protein, 17 aa, Cryptosporidium hominis
GIPTPFVVDALSEVGKS

SEQ ID NO: 2171966 - protein, 18 aa, Cryptosporidium hominis
GIQALNFGNKYRKIEQTV

SEQ ID NO: 2171967 - protein, 27 aa, Cryptosporidium hominis
GIQASLNARCSIFAAANPVYGHFDDFM

SEQ ID NO: 2171968 - protein, 23 aa, Cryptosporidium hominis
GIQSIFLGMPFKFEDNSQISDIT

SEQ ID NO: 2171969 - protein, 18 aa, Cryptosporidium hominis
GIRAFGLRIPKFPVPKIT

SEQ ID NO: 2171970 - protein, 22 aa, Cryptosporidium hominis
GIRRRFERRIYIPLPDEESRVL

SEQ ID NO: 2171971 - protein, 18 aa, Cryptosporidium hominis
GISDLKFKPAFNPYTEPS

SEQ ID NO: 2171972 - protein, 23 aa, Cryptosporidium hominis
GISGKLLIYDDWLYFGPLSVQEL

SEQ ID NO: 2171973 - protein, 20 aa, Cryptosporidium hominis
GISQRHICYYYKELSENFKL

SEQ ID NO: 2171974 - protein, 18 aa, Cryptosporidium hominis
GISTWRVPIPRKQLKKNK

SEQ ID NO: 2171975 - protein, 20 aa, Cryptosporidium hominis
GISVIRRVRKSDNNRIARVT

SEQ ID NO: 2171976 - protein, 20 aa, Cryptosporidium hominis
GITDFKRILIDLKFTGKLIQ

SEQ ID NO: 2171977 - protein, 25 aa, Cryptosporidium hominis
GITQLEWKLIEFFKRHNYRINADNG

SEQ ID NO: 2171978 - protein, 19 aa, Cryptosporidium hominis
GITRVPLKGSDQCDNIEQL

SEQ ID NO: 2171979 - protein, 18 aa, Cryptosporidium hominis
GIVNFAMKWESDKRQSTI

SEQ ID NO: 2171980 - protein, 24 aa, Cryptosporidium hominis
GIWNNRKGVCIHFGGRFNKKKVNR

SEQ ID NO: 2171981 - protein, 36 aa, Cryptosporidium hominis
GIYHWNDGRVYTGYWLKNHMFGYGKFDWTDHRCYEG

SEQ ID NO: 2171982 - protein, 19 aa, Cryptosporidium hominis
GIYNKGFNRPSKIQAAALP

SEQ ID NO: 2171983 - protein, 23 aa, Cryptosporidium hominis
GIYTTEIDPECTFQPNLRKTLFE

SEQ ID NO: 2171984 - protein, 19 aa, Cryptosporidium hominis
GKAECKMVICDPSYVLNEN

SEQ ID NO: 2171985 - protein, 20 aa, Cryptosporidium hominis
GKAFEIQNIFGLSNKSSKAS

SEQ ID NO: 2171986 - protein, 20 aa, Cryptosporidium hominis
GKAGGGTGIEIDMLAKELLK

SEQ ID NO: 2171987 - protein, 17 aa, Cryptosporidium hominis
GKALDLNHCMALIGSPA

SEQ ID NO: 2171988 - protein, 18 aa, Cryptosporidium hominis
GKALSGLLDGIGKMDNII

SEQ ID NO: 2171989 - protein, 20 aa, Cryptosporidium hominis
GKARARKLVILYGNLSFPSK

SEQ ID NO: 2171990 - protein, 18 aa, Cryptosporidium hominis
GKCFRLYTKEAFESELAD

SEQ ID NO: 2171991 - protein, 24 aa, Cryptosporidium hominis
GKDGRIRGNLMGKRVDFSARTVIT

SEQ ID NO: 2171992 - protein, 22 aa, Cryptosporidium hominis
GKDIKCRPILIVKLAKLDTFVG

SEQ ID NO: 2171993 - protein, 18 aa, Cryptosporidium hominis
GKEAVSCVNGSIIHPFYQ

SEQ ID NO: 2171994 - protein, 24 aa, Cryptosporidium hominis
GKEDEIFIDYCINQLVYKIRKSAA

SEQ ID NO: 2171995 - protein, 26 aa, Cryptosporidium hominis
GKEVFKCFLCGELGHTLKDCKKPRND

SEQ ID NO: 2171996 - protein, 21 aa, Cryptosporidium hominis
GKEVRYSVMLSYEEKLIAHQI

SEQ ID NO: 2171997 - protein, 24 aa, Cryptosporidium hominis
GKFTWPDGRAYIGQWKNGKQHGIG

SEQ ID NO: 2171998 - protein, 17 aa, Cryptosporidium hominis
GKGDIYLQNGIEKIEGI

SEQ ID NO: 2171999 - protein, 19 aa, Cryptosporidium hominis
GKGILRFAMGHSIQGVWKD

SEQ ID NO: 2172000 - protein, 39 aa, Cryptosporidium hominis
GKGKHGLGVWSFFNIHSSWIPFLCQIRIPPSPLLKQELT

SEQ ID NO: 2172001 - protein, 23 aa, Cryptosporidium hominis
GKHDKWVIAWSFFEKEERTSILK

SEQ ID NO: 2172002 - protein, 18 aa, Cryptosporidium hominis
GKHKALLGSIRGFKGNNV

SEQ ID NO: 2172003 - protein, 19 aa, Cryptosporidium hominis
GKHKLSICIAEYNKIFDTL

SEQ ID NO: 2172004 - protein, 20 aa, Cryptosporidium hominis
GKHNFDYESGYSFERPLTKA

SEQ ID NO: 2172005 - protein, 26 aa, Cryptosporidium hominis
GKIGSEIFAGASIIKHIVLKRIKYGF

SEQ ID NO: 2172006 - protein, 20 aa, Cryptosporidium hominis
GKIRLNDLIIALRRAFDNGT

SEQ ID NO: 2172007 - protein, 24 aa, Cryptosporidium hominis
GKKLRCCTKEGLTLEETAEEKEAF

SEQ ID NO: 2172008 - protein, 19 aa, Cryptosporidium hominis
GKKQRLWSFGGQDKLLSLD

SEQ ID NO: 2172009 - protein, 32 aa, Cryptosporidium hominis
GKKSNLLQFLWIRFYGFRVIFRKFNDLLLTSV

SEQ ID NO: 2172010 - protein, 20 aa, Cryptosporidium hominis
GKLFDLSYEEVFIVKMTSTN

SEQ ID NO: 2172011 - protein, 20 aa, Cryptosporidium hominis
GKLFLCGQLFSNSKNNKKIG

SEQ ID NO: 2172012 - protein, 22 aa, Cryptosporidium hominis
GKLIKLRVLIVGLRGLGVEIAK

SEQ ID NO: 2172013 - protein, 23 aa, Cryptosporidium hominis
GKLKPRHVPDFVLISPEDVDRLL

SEQ ID NO: 2172014 - protein, 39 aa, Cryptosporidium hominis
GKLSQRLKDALGMQPNWPPPWLVRMQKYGPPPSYPYLRV

SEQ ID NO: 2172015 - protein, 22 aa, Cryptosporidium hominis
GKLTGLRIVRIATHPSAQRMGY

SEQ ID NO: 2172016 - protein, 19 aa, Cryptosporidium hominis
GKLVEIFSYIHFQDYFLQI

SEQ ID NO: 2172017 - protein, 20 aa, Cryptosporidium hominis
GKLYLIFDFFPIGPTMAPDT

SEQ ID NO: 2172018 - protein, 24 aa, Cryptosporidium hominis
GKLYRLVRSSFPFNLSSGPPNWGL

SEQ ID NO: 2172019 - protein, 18 aa, Cryptosporidium hominis
GKMYPGLAMSRAIGDTLG

SEQ ID NO: 2172020 - protein, 25 aa, Cryptosporidium hominis
GKNHNRGSFGWCSGITLYGEGAILS

SEQ ID NO: 2172021 - protein, 24 aa, Cryptosporidium hominis
GKNRFMKLYYKFQVEEAAIKKYGS

SEQ ID NO: 2172022 - protein, 22 aa, Cryptosporidium hominis
GKNSLSDSFVWKDYHRGYISTE

SEQ ID NO: 2172023 - protein, 17 aa, Cryptosporidium hominis
GKPAVTITPKFAASPPK

SEQ ID NO: 2172024 - protein, 18 aa, Cryptosporidium hominis
GKPFLPVGIHPVPYFGTS

SEQ ID NO: 2172025 - protein, 24 aa, Cryptosporidium hominis
GKPSLKTSQGFKGCKLFLSNIEIV

SEQ ID NO: 2172026 - protein, 17 aa, Cryptosporidium hominis
GKPSNRFSVPTVDISPI

SEQ ID NO: 2172027 - protein, 28 aa, Cryptosporidium hominis
GKQILEWKRSGVNLLFGLQITFNVPDEV

SEQ ID NO: 2172028 - protein, 18 aa, Cryptosporidium hominis
GKQKLTFNSSNLVKTYSK

SEQ ID NO: 2172029 - protein, 17 aa, Cryptosporidium hominis
GKQLWLKGLKNNGENCN

SEQ ID NO: 2172030 - protein, 25 aa, Cryptosporidium hominis
GKRFKSQDIMNVFALSPNGKLVSFV

SEQ ID NO: 2172031 - protein, 21 aa, Cryptosporidium hominis
GKRILAEGMLTVFSPKNIPLM

SEQ ID NO: 2172032 - protein, 26 aa, Cryptosporidium hominis
GKRLTFPSFFPIKQFFFCFFIEESLE

SEQ ID NO: 2172033 - protein, 19 aa, Cryptosporidium hominis
GKRPFGSTFEDHAKEKDYI

SEQ ID NO: 2172034 - protein, 21 aa, Cryptosporidium hominis
GKRQFSVLIYTHINWIEDEIR

SEQ ID NO: 2172035 - protein, 25 aa, Cryptosporidium hominis
GKSCGFRFHSIELLKNIKSNNSKSN

SEQ ID NO: 2172036 - protein, 27 aa, Cryptosporidium hominis
GKSIGGKGLGMKLTLSGNVSSVKPIMI

SEQ ID NO: 2172037 - protein, 20 aa, Cryptosporidium hominis
GKSKRKGRSITRKKANNLVP

SEQ ID NO: 2172038 - protein, 18 aa, Cryptosporidium hominis
GKSKWKDFIFWDKTKNSW

SEQ ID NO: 2172039 - protein, 18 aa, Cryptosporidium hominis
GKSMCYLLPCIQFAIQNQ

SEQ ID NO: 2172040 - protein, 19 aa, Cryptosporidium hominis
GKSRGYGFVSFTNPNDMLS

SEQ ID NO: 2172041 - protein, 27 aa, Cryptosporidium hominis
GKSTGRCNCGYPIFIINGEVVAGSSGF

SEQ ID NO: 2172042 - protein, 23 aa, Cryptosporidium hominis
GKSYLFERYSRFGMSDSIIQRNF

SEQ ID NO: 2172043 - protein, 22 aa, Cryptosporidium hominis
GKSYLSKILLIYSLMDIDVGYV

SEQ ID NO: 2172044 - protein, 21 aa, Cryptosporidium hominis
GKTATFALAMLGKVDTRIIHP

SEQ ID NO: 2172045 - protein, 24 aa, Cryptosporidium hominis
GKTLCYCLPMLQILAEDPFSVFGL

SEQ ID NO: 2172046 - protein, 19 aa, Cryptosporidium hominis
GKTLCYILPILGRLKNDKV

SEQ ID NO: 2172047 - protein, 26 aa, Cryptosporidium hominis
GKVEHIWKSTCFIKLQSKLDDGGYFT

SEQ ID NO: 2172048 - protein, 17 aa, Cryptosporidium hominis
GKVGDFGIAISIDSKLG

SEQ ID NO: 2172049 - protein, 24 aa, Cryptosporidium hominis
GKVKIEHIEWVLSIRTEPKNFISE

SEQ ID NO: 2172050 - protein, 21 aa, Cryptosporidium hominis
GKVLRCICILNSPINDTNDVS

SEQ ID NO: 2172051 - protein, 20 aa, Cryptosporidium hominis
GKVNGFSICKGVNKNGTLCT

SEQ ID NO: 2172052 - protein, 25 aa, Cryptosporidium hominis
GKYDVIHFILKFVVDIDRQIQDKML

SEQ ID NO: 2172053 - protein, 20 aa, Cryptosporidium hominis
GKYELIGVICHLGKSVHSGH

SEQ ID NO: 2172054 - protein, 17 aa, Cryptosporidium hominis
GKYISTIYCKLNPLFEK

SEQ ID NO: 2172055 - protein, 27 aa, Cryptosporidium hominis
GKYNLRASLKLPEFTSYLINNNYQLYV

SEQ ID NO: 2172056 - protein, 20 aa, Cryptosporidium hominis
GKYTIPGWRTMQMAYESFDF

SEQ ID NO: 2172057 - protein, 18 aa, Cryptosporidium hominis
GLCGPIKAIYLGLNHQTM

SEQ ID NO: 2172058 - protein, 17 aa, Cryptosporidium hominis
GLDAWREEFLIQATPKD

SEQ ID NO: 2172059 - protein, 26 aa, Cryptosporidium hominis
GLDLPMKVVDMLGAGIPIISFSYPTI

SEQ ID NO: 2172060 - protein, 26 aa, Cryptosporidium hominis
GLDYWEFKEILLYCGEASSCGNDPIS

SEQ ID NO: 2172061 - protein, 27 aa, Cryptosporidium hominis
GLELKNEISSLLPLLNCSNPKTIILVS

SEQ ID NO: 2172062 - protein, 26 aa, Cryptosporidium hominis
GLENGLKIVLCIGESLSERETGKTND

SEQ ID NO: 2172063 - protein, 21 aa, Cryptosporidium hominis
GLERISSKFFPSATESTSMSF

SEQ ID NO: 2172064 - protein, 23 aa, Cryptosporidium hominis
GLETLPSVVLSFIVDKCNEQLLQ

SEQ ID NO: 2172065 - protein, 18 aa, Cryptosporidium hominis
GLFLKELIILILREENEA

SEQ ID NO: 2172066 - protein, 27 aa, Cryptosporidium hominis
GLFQRCVAQFDRLMKRGAFLDNYKKQS

SEQ ID NO: 2172067 - protein, 18 aa, Cryptosporidium hominis
GLFQSCLEKVEDYFTLDL

SEQ ID NO: 2172068 - protein, 51 aa, Cryptosporidium hominis
GLFQSRWAWTTGDSRLISEMTFAFKVLKSFRGKLRLGVCCTGKPVITETQN

SEQ ID NO: 2172069 - protein, 18 aa, Cryptosporidium hominis
GLGKEYMKLFDLKVFDND

SEQ ID NO: 2172070 - protein, 18 aa, Cryptosporidium hominis
GLIGSPPPREIWSGANNE

SEQ ID NO: 2172071 - protein, 18 aa, Cryptosporidium hominis
GLIKTLRIIISGKRSKHE

SEQ ID NO: 2172072 - protein, 35 aa, Cryptosporidium hominis
GLINFTIKKSDFRNIPMLVSNLFGTTNLKKQILLW

SEQ ID NO: 2172073 - protein, 22 aa, Cryptosporidium hominis
GLLFEFRLSWSNHLIYTHWMER

SEQ ID NO: 2172074 - protein, 24 aa, Cryptosporidium hominis
GLLINLYYSFGFEVDSNNSPQTLP

SEQ ID NO: 2172075 - protein, 18 aa, Cryptosporidium hominis
GLLKNSYGLSGINLDLES

SEQ ID NO: 2172076 - protein, 25 aa, Cryptosporidium hominis
GLLLRFNRLCGVKNIPCQISIQKLS

SEQ ID NO: 2172077 - protein, 22 aa, Cryptosporidium hominis
GLLSNFDWRSSYLPHIYSATLG

SEQ ID NO: 2172078 - protein, 17 aa, Cryptosporidium hominis
GLMLAGGFNREYTSFLL

SEQ ID NO: 2172079 - protein, 25 aa, Cryptosporidium hominis
GLNNWSRVASLLIMKSAKQCKSRWY

SEQ ID NO: 2172080 - protein, 20 aa, Cryptosporidium hominis
GLNSCFRSFLSQCPNQDKSY

SEQ ID NO: 2172081 - protein, 17 aa, Cryptosporidium hominis
GLNTAVFHKGAFREENN

SEQ ID NO: 2172082 - protein, 25 aa, Cryptosporidium hominis
GLNVREIYGGLSLYKRNKKRITGII

SEQ ID NO: 2172083 - protein, 23 aa, Cryptosporidium hominis
GLPSLKQLIVFKSLSDFLEGKAL

SEQ ID NO: 2172084 - protein, 26 aa, Cryptosporidium hominis
GLQDPRANLFWDPAVMTAASSVSPFY

SEQ ID NO: 2172085 - protein, 26 aa, Cryptosporidium hominis
GLQKLRWYCQLCEKQCRDENGFKCHR

SEQ ID NO: 2172086 - protein, 18 aa, Cryptosporidium hominis
GLQLKLKAFDNFLQNYPY

SEQ ID NO: 2172087 - protein, 24 aa, Cryptosporidium hominis
GLQPRCIFNTVASRVLERILRKYF

SEQ ID NO: 2172088 - protein, 17 aa, Cryptosporidium hominis
GLRDAASIASLMTTTQV

SEQ ID NO: 2172089 - protein, 17 aa, Cryptosporidium hominis
GLRIGVLLMSRQAPGIA

SEQ ID NO: 2172090 - protein, 19 aa, Cryptosporidium hominis
GLRVYLSVVGNEYFNTVIN

SEQ ID NO: 2172091 - protein, 24 aa, Cryptosporidium hominis
GLSISFPTIVAYVVDTVRSQKPVT

SEQ ID NO: 2172092 - protein, 18 aa, Cryptosporidium hominis
GLSRGFSFCEYRDIETCI

SEQ ID NO: 2172093 - protein, 19 aa, Cryptosporidium hominis
GLSSSFKNPFVSLAANTEN

SEQ ID NO: 2172094 - protein, 21 aa, Cryptosporidium hominis
GLSTTCIKNQISFGNKFENDR

SEQ ID NO: 2172095 - protein, 25 aa, Cryptosporidium hominis
GLSVCKHIFCFVCIKQWSDVATQCP

SEQ ID NO: 2172096 - protein, 19 aa, Cryptosporidium hominis
GLTKILFKNFISYYSNEYI

SEQ ID NO: 2172097 - protein, 18 aa, Cryptosporidium hominis
GLTKVSCKLEFEFDTILM

SEQ ID NO: 2172098 - protein, 20 aa, Cryptosporidium hominis
GLTMKWTEGSFWTANVKIIP

SEQ ID NO: 2172099 - protein, 18 aa, Cryptosporidium hominis
GLTYICATPERFFTVCQV

SEQ ID NO: 2172100 - protein, 19 aa, Cryptosporidium hominis
GLVCGGAAGLILGPIGVSF

SEQ ID NO: 2172101 - protein, 18 aa, Cryptosporidium hominis
GLVLCGSAFGMTQGAILA

SEQ ID NO: 2172102 - protein, 18 aa, Cryptosporidium hominis
GLVLEIHGSLKIPYHPDG

SEQ ID NO: 2172103 - protein, 17 aa, Cryptosporidium hominis
GLVRSATSFAFQRHIDM

SEQ ID NO: 2172104 - protein, 26 aa, Cryptosporidium hominis
GLYDLFCKFNILLQYFQYKALRYLQI

SEQ ID NO: 2172105 - protein, 22 aa, Cryptosporidium hominis
GLYSLTCQLFFTSNEARLTQKK

SEQ ID NO: 2172106 - protein, 18 aa, Cryptosporidium hominis
GMFSSVVKCVDMETQNEV

SEQ ID NO: 2172107 - protein, 18 aa, Cryptosporidium hominis
GMGAKVKCIYDNDLYKKQ

SEQ ID NO: 2172108 - protein, 21 aa, Cryptosporidium hominis
GMGPFGNFGGPFGGGGSGAIG

SEQ ID NO: 2172109 - protein, 40 aa, Cryptosporidium hominis
GMIEKYRLISIYRFYYACFLKDLCNPMMTFELIVAKYSLE

SEQ ID NO: 2172110 - protein, 20 aa, Cryptosporidium hominis
GMIKDEWKKDLDKFVLDCDL

SEQ ID NO: 2172111 - protein, 21 aa, Cryptosporidium hominis
GMNEYRGGRTFEDWIKSKENS

SEQ ID NO: 2172112 - protein, 21 aa, Cryptosporidium hominis
GMNLLLFLTGRFICRQKGLDV

SEQ ID NO: 2172113 - protein, 17 aa, Cryptosporidium hominis
GMNPVCFSFTDQVRACI

SEQ ID NO: 2172114 - protein, 21 aa, Cryptosporidium hominis
GMRECHIYDSLALTKFLYYLY

SEQ ID NO: 2172115 - protein, 20 aa, Cryptosporidium hominis
GMTACYCCAPPLVNFESNFS

SEQ ID NO: 2172116 - protein, 26 aa, Cryptosporidium hominis
GMWYIKGIVTKGIWPFLSATNKVKRA

SEQ ID NO: 2172117 - protein, 20 aa, Cryptosporidium hominis
GNAGKFCHILSCKVFENGQL

SEQ ID NO: 2172118 - protein, 23 aa, Cryptosporidium hominis
GNCLQIASLYGIVCGIRSLGDFS

SEQ ID NO: 2172119 - protein, 18 aa, Cryptosporidium hominis
GNDRMCALHCLNSILQGP

SEQ ID NO: 2172120 - protein, 19 aa, Cryptosporidium hominis
GNDSYWLGTIDKVLQGISK

SEQ ID NO: 2172121 - protein, 19 aa, Cryptosporidium hominis
GNFDFARYSLVGTGLNNSN

SEQ ID NO: 2172122 - protein, 18 aa, Cryptosporidium hominis
GNFHKFALFFIYKSNNSL

SEQ ID NO: 2172123 - protein, 20 aa, Cryptosporidium hominis
GNFLFYSLFEALKVNLNVDQ

SEQ ID NO: 2172124 - protein, 25 aa, Cryptosporidium hominis
GNFVRVGTNFAFAFLGESYVEEAAT

SEQ ID NO: 2172125 - protein, 18 aa, Cryptosporidium hominis
GNGKISRQQFIWLTSIGG

SEQ ID NO: 2172126 - protein, 19 aa, Cryptosporidium hominis
GNGKVCFIDTEGTFRPERI

SEQ ID NO: 2172127 - protein, 25 aa, Cryptosporidium hominis
GNGKYCGDETCFLTSLRPIFSIIGQ

SEQ ID NO: 2172128 - protein, 26 aa, Cryptosporidium hominis
GNGMIPVLCIKLGSTILNKEFSGRLY

SEQ ID NO: 2172129 - protein, 19 aa, Cryptosporidium hominis
GNGSKEYLERIGLGHREEN

SEQ ID NO: 2172130 - protein, 20 aa, Cryptosporidium hominis
GNGVEYLNELSLKFRETIGK

SEQ ID NO: 2172131 - protein, 20 aa, Cryptosporidium hominis
GNHLCEWAGFTCNWEYLPND

SEQ ID NO: 2172132 - protein, 17 aa, Cryptosporidium hominis
GNIKFYVRRVLITDHIE

SEQ ID NO: 2172133 - protein, 29 aa, Cryptosporidium hominis
GNILPLNFCIPPLFGSCNPPFYGIGMNNS

SEQ ID NO: 2172134 - protein, 28 aa, Cryptosporidium hominis
GNILTRFPSSWKKYKWEKYLKSVLDHVD

SEQ ID NO: 2172135 - protein, 21 aa, Cryptosporidium hominis
GNINRLYFRGFQMKFDTQQNI

SEQ ID NO: 2172136 - protein, 22 aa, Cryptosporidium hominis
GNIRVEIWFSDFSNQSAHQALL

SEQ ID NO: 2172137 - protein, 26 aa, Cryptosporidium hominis
GNKFPRKSSKFVLSFKKSSDDIVRKT

SEQ ID NO: 2172138 - protein, 29 aa, Cryptosporidium hominis
GNKGKCCAFWKKWCCCCLSDKGPTKSGNY

SEQ ID NO: 2172139 - protein, 26 aa, Cryptosporidium hominis
GNKGYWNMYDWELLMRDIQYPAKNGE

SEQ ID NO: 2172140 - protein, 26 aa, Cryptosporidium hominis
GNKIKDFSELIVLKELPKLETLSLLL

SEQ ID NO: 2172141 - protein, 26 aa, Cryptosporidium hominis
GNLFKEFFELPNGCVCCTVKDELLKA

SEQ ID NO: 2172142 - protein, 20 aa, Cryptosporidium hominis
GNLHGFGGLMAQDPDAPIPD

SEQ ID NO: 2172143 - protein, 19 aa, Cryptosporidium hominis
GNLIFSPKIFLPCNPDKGY

SEQ ID NO: 2172144 - protein, 17 aa, Cryptosporidium hominis
GNLPILYNENNMLRCES

SEQ ID NO: 2172145 - protein, 20 aa, Cryptosporidium hominis
GNLPSINWAISNNFREKMKS

SEQ ID NO: 2172146 - protein, 25 aa, Cryptosporidium hominis
GNLSKSFPSCWPLEYQNLNNIPLFR

SEQ ID NO: 2172147 - protein, 18 aa, Cryptosporidium hominis
GNLYCFAIDEAHCISEWG

SEQ ID NO: 2172148 - protein, 19 aa, Cryptosporidium hominis
GNMPLSILRYLSSIVPSIQ

SEQ ID NO: 2172149 - protein, 22 aa, Cryptosporidium hominis
GNNEGVAIVEFENFDDLSNSVN

SEQ ID NO: 2172150 - protein, 24 aa, Cryptosporidium hominis
GNNQRCYCSSIIGFQGISLTNTIT

SEQ ID NO: 2172151 - protein, 23 aa, Cryptosporidium hominis
GNPDCLYPILNICKNNRYLSPEI

SEQ ID NO: 2172152 - protein, 19 aa, Cryptosporidium hominis
GNPEWRSLWDYSCKNNSQF

SEQ ID NO: 2172153 - protein, 17 aa, Cryptosporidium hominis
GNPHICFNFSFENKMTE

SEQ ID NO: 2172154 - protein, 23 aa, Cryptosporidium hominis
GNPKECLDLSFSENDTVRDKILK

SEQ ID NO: 2172155 - protein, 17 aa, Cryptosporidium hominis
GNPNCKFFIHLILILQA

SEQ ID NO: 2172156 - protein, 19 aa, Cryptosporidium hominis
GNPTFKMLVQRHANQIRVC

SEQ ID NO: 2172157 - protein, 18 aa, Cryptosporidium hominis
GNQAIWRNLIPRIWSIFI

SEQ ID NO: 2172158 - protein, 23 aa, Cryptosporidium hominis
GNQCIYGVWFHFLCLKIINEPQK

SEQ ID NO: 2172159 - protein, 35 aa, Cryptosporidium hominis
GNQIPYDRQFWSYAYKTGRLHPAEEQVQRQLNEGV

SEQ ID NO: 2172160 - protein, 26 aa, Cryptosporidium hominis
GNRGMGVRKRARFTLYDDNQELNQTI

SEQ ID NO: 2172161 - protein, 22 aa, Cryptosporidium hominis
GNRMITEILLKYGADINDVDED

SEQ ID NO: 2172162 - protein, 19 aa, Cryptosporidium hominis
GNRSKGFCFIEYTSQESAE

SEQ ID NO: 2172163 - protein, 19 aa, Cryptosporidium hominis
GNRVGVCISGGKDSSVLLN

SEQ ID NO: 2172164 - protein, 19 aa, Cryptosporidium hominis
GNSGLKIGRNSDCDFPGKM

SEQ ID NO: 2172165 - protein, 17 aa, Cryptosporidium hominis
GNSIVFNQPWIPIMRIS

SEQ ID NO: 2172166 - protein, 19 aa, Cryptosporidium hominis
GNSPLHWATTNKKKEVIIK

SEQ ID NO: 2172167 - protein, 32 aa, Cryptosporidium hominis
GNSQNCKKCGLKHSIHFSPLICHSNDIKIGKI

SEQ ID NO: 2172168 - protein, 17 aa, Cryptosporidium hominis
GNSSCKIVLNQDSSVEN

SEQ ID NO: 2172169 - protein, 22 aa, Cryptosporidium hominis
GNSSMFLPGRAQNTAGQAGQVG

SEQ ID NO: 2172170 - protein, 18 aa, Cryptosporidium hominis
GNSYKFTNIKSFSNIMKD

SEQ ID NO: 2172171 - protein, 26 aa, Cryptosporidium hominis
GNTIKIKCYLIWSIKFEIIKKKKRLR

SEQ ID NO: 2172172 - protein, 26 aa, Cryptosporidium hominis
GNTRLTEIFSEYGLNGCDIKKKYNSQ

SEQ ID NO: 2172173 - protein, 33 aa, Cryptosporidium hominis
GNTYLSLSSVERFFYIKQCESGYNSIINYKSQE

SEQ ID NO: 2172174 - protein, 20 aa, Cryptosporidium hominis
GNVAYWLYMPAISHIIDCNG

SEQ ID NO: 2172175 - protein, 25 aa, Cryptosporidium hominis
GNVIKWLKKQICKINPSLPPNEIIN

SEQ ID NO: 2172176 - protein, 25 aa, Cryptosporidium hominis
GNVNNICPCDRAIDSCAAISKKLIQ

SEQ ID NO: 2172177 - protein, 25 aa, Cryptosporidium hominis
GNVSGTVGGLSARLNFGSMSYVPPI

SEQ ID NO: 2172178 - protein, 24 aa, Cryptosporidium hominis
GNYIGEQAMNIWILTTKRNELEYA

SEQ ID NO: 2172179 - protein, 18 aa, Cryptosporidium hominis
GPCALTLSMYFIKTCGRA

SEQ ID NO: 2172180 - protein, 17 aa, Cryptosporidium hominis
GPCGVLASLNGFIISQL

SEQ ID NO: 2172181 - protein, 26 aa, Cryptosporidium hominis
GPDGRPMPYWLYKLNGLGIEFKCEIC

SEQ ID NO: 2172182 - protein, 18 aa, Cryptosporidium hominis
GPDINNLLSYSSFNKDNP

SEQ ID NO: 2172183 - protein, 24 aa, Cryptosporidium hominis
GPGCKARSSATWYPQNYQILKIKS

SEQ ID NO: 2172184 - protein, 24 aa, Cryptosporidium hominis
GPGFFKDDFFKYLFDSDNQKNKEF

SEQ ID NO: 2172185 - protein, 20 aa, Cryptosporidium hominis
GPGKCYRLYTEAAFNTEMLP

SEQ ID NO: 2172186 - protein, 24 aa, Cryptosporidium hominis
GPGNVPKALFISSIEEFVGDRPVY

SEQ ID NO: 2172187 - protein, 26 aa, Cryptosporidium hominis
GPIISLRAYYPERFASSKPKYIPGND

SEQ ID NO: 2172188 - protein, 27 aa, Cryptosporidium hominis
GPKDAIQYCELCQGQGVRVQIRQIGPM

SEQ ID NO: 2172189 - protein, 22 aa, Cryptosporidium hominis
GPKMSLSETVMKYFSANKKSGV

SEQ ID NO: 2172190 - protein, 18 aa, Cryptosporidium hominis
GPKWPYSEFEDVKNANHK

SEQ ID NO: 2172191 - protein, 22 aa, Cryptosporidium hominis
GPLPNGLCFTHFQNNIVSSANI

SEQ ID NO: 2172192 - protein, 24 aa, Cryptosporidium hominis
GPNGQHVCMVFEVLGPNILQLISL

SEQ ID NO: 2172193 - protein, 25 aa, Cryptosporidium hominis
GPNRKTLKVPFCNGVKASSFNYFFF

SEQ ID NO: 2172194 - protein, 23 aa, Cryptosporidium hominis
GPPGCGKTLLADMVSWLNGLNVF

SEQ ID NO: 2172195 - protein, 22 aa, Cryptosporidium hominis
GPPGCGKTLLAKAVASECSANF

SEQ ID NO: 2172196 - protein, 21 aa, Cryptosporidium hominis
GPPGCSKTLMAKAVATESKMN

SEQ ID NO: 2172197 - protein, 24 aa, Cryptosporidium hominis
GPQKWEYSLIPSLKSLIQDNNNLD

SEQ ID NO: 2172198 - protein, 21 aa, Cryptosporidium hominis
GPRMVRDVFRLARENSPAIVF

SEQ ID NO: 2172199 - protein, 30 aa, Cryptosporidium hominis
GPSSFRINPYLPAVVEWQYNTIIREIDQEI

SEQ ID NO: 2172200 - protein, 25 aa, Cryptosporidium hominis
GPSSWPEFSKLLAHLVESPHYSVRL

SEQ ID NO: 2172201 - protein, 18 aa, Cryptosporidium hominis
GPTAYFAISDVVLRHDLS

SEQ ID NO: 2172202 - protein, 22 aa, Cryptosporidium hominis
GPTFVCPLCLMNSKIPNSSCLK

SEQ ID NO: 2172203 - protein, 19 aa, Cryptosporidium hominis
GPVKACICSKDKIFSSAND

SEQ ID NO: 2172204 - protein, 23 aa, Cryptosporidium hominis
GPYNMAIEFFTLEREIYIAKLLL

SEQ ID NO: 2172205 - protein, 23 aa, Cryptosporidium hominis
GPYNSIVMMSWIVKGYFGENSKL

SEQ ID NO: 2172206 - protein, 27 aa, Cryptosporidium hominis
GPYPVFLVYSIICLKCSLQENSAIKLS

SEQ ID NO: 2172207 - protein, 19 aa, Cryptosporidium hominis
GQAMGLSFSVPKGVPVPPS

SEQ ID NO: 2172208 - protein, 21 aa, Cryptosporidium hominis
GQCKMEILPYMIGALYSGQTN

SEQ ID NO: 2172209 - protein, 23 aa, Cryptosporidium hominis
GQDGVNFIGVFSLIDTEIRMPTV

SEQ ID NO: 2172210 - protein, 19 aa, Cryptosporidium hominis
GQFEECERLYSIMEPIIAK

SEQ ID NO: 2172211 - protein, 17 aa, Cryptosporidium hominis
GQFGVGFYASYLVSDRV

SEQ ID NO: 2172212 - protein, 22 aa, Cryptosporidium hominis
GQFGVGFYSAYLVADKVTVITK

SEQ ID NO: 2172213 - protein, 21 aa, Cryptosporidium hominis
GQFIKTPAFYPVSKVLLDEKT

SEQ ID NO: 2172214 - protein, 19 aa, Cryptosporidium hominis
GQFIPYFGQPLLFPNNNQN

SEQ ID NO: 2172215 - protein, 18 aa, Cryptosporidium hominis
GQGGRPFAKLDKDFNTQK

SEQ ID NO: 2172216 - protein, 17 aa, Cryptosporidium hominis
GQGIIDWNNPLNIENKL

SEQ ID NO: 2172217 - protein, 18 aa, Cryptosporidium hominis
GQGLLDDSSKVLGKLETD

SEQ ID NO: 2172218 - protein, 17 aa, Cryptosporidium hominis
GQGLWQDILRSFMNGLQ

SEQ ID NO: 2172219 - protein, 18 aa, Cryptosporidium hominis
GQGSRPGSGTGIGIGIGI

SEQ ID NO: 2172220 - protein, 18 aa, Cryptosporidium hominis
GQIKEMFQQMSISLNNSE

SEQ ID NO: 2172221 - protein, 26 aa, Cryptosporidium hominis
GQINLPLCGLLIYFISSLIHRSPIFN

SEQ ID NO: 2172222 - protein, 21 aa, Cryptosporidium hominis
GQIPDYAAPVILKRDKSTIAD

SEQ ID NO: 2172223 - protein, 20 aa, Cryptosporidium hominis
GQIPLAIALAHTYGYNQVKE

SEQ ID NO: 2172224 - protein, 21 aa, Cryptosporidium hominis
GQIRKFFRQNLQILLFSATYH

SEQ ID NO: 2172225 - protein, 26 aa, Cryptosporidium hominis
GQKGDLILEFDICFPKSLTPEQKKLI

SEQ ID NO: 2172226 - protein, 26 aa, Cryptosporidium hominis
GQKLARRAAGIIVRMVKQGKIAGRAI

SEQ ID NO: 2172227 - protein, 20 aa, Cryptosporidium hominis
GQKLEIKYNALVVAEKAKLR

SEQ ID NO: 2172228 - protein, 17 aa, Cryptosporidium hominis
GQKRLSQLAKWKTAEEV

SEQ ID NO: 2172229 - protein, 24 aa, Cryptosporidium hominis
GQKTLLPCCLVIANSKDSNISCIY

SEQ ID NO: 2172230 - protein, 24 aa, Cryptosporidium hominis
GQKVLDIWFPYIVQSLLQAFKREN

SEQ ID NO: 2172231 - protein, 30 aa, Cryptosporidium hominis
GQLFCGFFLSRIVCHNCQYTSNTYDPFMDV

SEQ ID NO: 2172232 - protein, 19 aa, Cryptosporidium hominis
GQLKKSAWFLNGMPTNLFN

SEQ ID NO: 2172233 - protein, 19 aa, Cryptosporidium hominis
GQLMIEYIAVWGIINEDDH

SEQ ID NO: 2172234 - protein, 41 aa, Cryptosporidium hominis
GQNGNWACCKCSNVNFPRRFRCFKCGEYRDEIGDKIVAEYA

SEQ ID NO: 2172235 - protein, 33 aa, Cryptosporidium hominis
GQPKRWVFCPCRSCLFKGKAHDKLMGHFKIMEH

SEQ ID NO: 2172236 - protein, 19 aa, Cryptosporidium hominis
GQSIFGIVISNNYLVTIYG

SEQ ID NO: 2172237 - protein, 25 aa, Cryptosporidium hominis
GQSIHPVENMMIGRGHGIMLENSMD

SEQ ID NO: 2172238 - protein, 21 aa, Cryptosporidium hominis
GQSYCGQVWRIFVASDGCLMG

SEQ ID NO: 2172239 - protein, 19 aa, Cryptosporidium hominis
GQVAQFFAFFPFQTAEMAL

SEQ ID NO: 2172240 - protein, 23 aa, Cryptosporidium hominis
GQVFMKLLRLLRLHVPNIDPSMF

SEQ ID NO: 2172241 - protein, 17 aa, Cryptosporidium hominis
GQVKFDLLDNVIGNLKR

SEQ ID NO: 2172242 - protein, 21 aa, Cryptosporidium hominis
GQVSLKRSIVYDSSLGCCVPL

SEQ ID NO: 2172243 - protein, 19 aa, Cryptosporidium hominis
GRADLKIRIPKSLWEYWEA

SEQ ID NO: 2172244 - protein, 20 aa, Cryptosporidium hominis
GRAGVPMEVMGLLLGEFIDD

SEQ ID NO: 2172245 - protein, 17 aa, Cryptosporidium hominis
GRALLKSELSAYLRSHP

SEQ ID NO: 2172246 - protein, 22 aa, Cryptosporidium hominis
GRCALPSNFDASYCFALGHTAA

SEQ ID NO: 2172247 - protein, 20 aa, Cryptosporidium hominis
GRCAMPSNFDSNYCYALGHC

SEQ ID NO: 2172248 - protein, 27 aa, Cryptosporidium hominis
GRCGNEVWLTLPLFFPSATLHNVTHQR

SEQ ID NO: 2172249 - protein, 18 aa, Cryptosporidium hominis
GRDLFVYDPSLFVDDEDA

SEQ ID NO: 2172250 - protein, 22 aa, Cryptosporidium hominis
GRDSKFSKAMLFFSKRDITCLK

SEQ ID NO: 2172251 - protein, 23 aa, Cryptosporidium hominis
GRFERYDTISGYKIRRNYKYWLV

SEQ ID NO: 2172252 - protein, 22 aa, Cryptosporidium hominis
GRFKFLDDYKHEFGALNEEILI

SEQ ID NO: 2172253 - protein, 17 aa, Cryptosporidium hominis
GRFKHISNFIGAESPNL

SEQ ID NO: 2172254 - protein, 19 aa, Cryptosporidium hominis
GRFSRCFGNNIEGRISINS

SEQ ID NO: 2172255 - protein, 25 aa, Cryptosporidium hominis
GRGGQSALRFARLRMEKRHNYLRKV

SEQ ID NO: 2172256 - protein, 21 aa, Cryptosporidium hominis
GRGRPRINREALAAAAAAAAA

SEQ ID NO: 2172257 - protein, 18 aa, Cryptosporidium hominis
GRHSVVCRHWIRNMCMKG

SEQ ID NO: 2172258 - protein, 20 aa, Cryptosporidium hominis
GRIGNGMAMTMIPNNDKDVT

SEQ ID NO: 2172259 - protein, 19 aa, Cryptosporidium hominis
GRIRGPLIIQGYEIGFCER

SEQ ID NO: 2172260 - protein, 17 aa, Cryptosporidium hominis
GRISPIFIEGLKRGIGI

SEQ ID NO: 2172261 - protein, 23 aa, Cryptosporidium hominis
GRITTEIQSFVPVILGENQKLDT

SEQ ID NO: 2172262 - protein, 18 aa, Cryptosporidium hominis
GRKERVSSPLSVQKMISD

SEQ ID NO: 2172263 - protein, 18 aa, Cryptosporidium hominis
GRKRLRVTTVSYRYSEPN

SEQ ID NO: 2172264 - protein, 29 aa, Cryptosporidium hominis
GRKRSTNLLKSWFSKAFKQGISLSPKLNN

SEQ ID NO: 2172265 - protein, 17 aa, Cryptosporidium hominis
GRLCEHYNQLVISQDQQ

SEQ ID NO: 2172266 - protein, 18 aa, Cryptosporidium hominis
GRLIRRLEHTFPCTKPKE

SEQ ID NO: 2172267 - protein, 24 aa, Cryptosporidium hominis
GRLKGHCCTCFATAPEVYLNNDYD

SEQ ID NO: 2172268 - protein, 20 aa, Cryptosporidium hominis
GRLSKRAFKFQRKCETRDSI

SEQ ID NO: 2172269 - protein, 20 aa, Cryptosporidium hominis
GRLTGRGGLGLGTAGSLSRG

SEQ ID NO: 2172270 - protein, 17 aa, Cryptosporidium hominis
GRLTLADALVYACNLKV

SEQ ID NO: 2172271 - protein, 17 aa, Cryptosporidium hominis
GRLWSVEKYLSEPFIDR

SEQ ID NO: 2172272 - protein, 19 aa, Cryptosporidium hominis
GRMAREFLDLQWATQFKEY

SEQ ID NO: 2172273 - protein, 22 aa, Cryptosporidium hominis
GRMFPVELIYNIKPEKDYLEAS

SEQ ID NO: 2172274 - protein, 17 aa, Cryptosporidium hominis
GRMHLAILLLQHEPNLQ

SEQ ID NO: 2172275 - protein, 26 aa, Cryptosporidium hominis
GRMLLEKGFKFDVVYTSVLKRAIMTT

SEQ ID NO: 2172276 - protein, 18 aa, Cryptosporidium hominis
GRMSKDRLFEIMDTFLRQ

SEQ ID NO: 2172277 - protein, 19 aa, Cryptosporidium hominis
GRNAFMCSASVPEVLVERD

SEQ ID NO: 2172278 - protein, 19 aa, Cryptosporidium hominis
GRPALGIKARNGVVIATEK

SEQ ID NO: 2172279 - protein, 26 aa, Cryptosporidium hominis
GRPEKAPDVCYSWWIFSLLYFLGRAN

SEQ ID NO: 2172280 - protein, 54 aa, Cryptosporidium hominis
GRPSHALLICKRICHFDSRLSKLYRSMYIQNYRVGLKILKKRAALNNEEKMNQL

SEQ ID NO: 2172281 - protein, 18 aa, Cryptosporidium hominis
GRPSIDMECYNSMDGPKK

SEQ ID NO: 2172282 - protein, 23 aa, Cryptosporidium hominis
GRQFEHPDYWLVQSNPWEIERQD

SEQ ID NO: 2172283 - protein, 21 aa, Cryptosporidium hominis
GRRAIGGSVCSSGSSSCSTGV

SEQ ID NO: 2172284 - protein, 17 aa, Cryptosporidium hominis
GRREFKYFVGTPQFMAP

SEQ ID NO: 2172285 - protein, 17 aa, Cryptosporidium hominis
GRRFNHYSLDNINLNDE

SEQ ID NO: 2172286 - protein, 17 aa, Cryptosporidium hominis
GRSELVVGWYHSHPGFG

SEQ ID NO: 2172287 - protein, 28 aa, Cryptosporidium hominis
GRSFTAEILHEWSPSINLLTTVDSIIKF

SEQ ID NO: 2172288 - protein, 18 aa, Cryptosporidium hominis
GRSRGFVGNSFFSGLQPD

SEQ ID NO: 2172289 - protein, 17 aa, Cryptosporidium hominis
GRSRGYGFVTYKSSESI

SEQ ID NO: 2172290 - protein, 24 aa, Cryptosporidium hominis
GRSTSILLCDWLFTILDYLDKKKS

SEQ ID NO: 2172291 - protein, 19 aa, Cryptosporidium hominis
GRTKTCIIATITASSIYLE

SEQ ID NO: 2172292 - protein, 18 aa, Cryptosporidium hominis
GRVFDMLDKGYLRVDNLK

SEQ ID NO: 2172293 - protein, 24 aa, Cryptosporidium hominis
GRVFSGQIGGTGRRSIIRQPNENL

SEQ ID NO: 2172294 - protein, 28 aa, Cryptosporidium hominis
GRVGPGHCYRLYSSPIYENIFPKFAPID

SEQ ID NO: 2172295 - protein, 18 aa, Cryptosporidium hominis
GRVLDFIERGILNVSKIS

SEQ ID NO: 2172296 - protein, 22 aa, Cryptosporidium hominis
GRVSSGICYRMYTEQTFLADML

SEQ ID NO: 2172297 - protein, 24 aa, Cryptosporidium hominis
GRVTRIIRLLTFINRSIEGSGILR

SEQ ID NO: 2172298 - protein, 20 aa, Cryptosporidium hominis
GRYDFIWIQWALQYLSDDEF

SEQ ID NO: 2172299 - protein, 21 aa, Cryptosporidium hominis
GRYRKLFLNLIEECIQNIDSL

SEQ ID NO: 2172300 - protein, 17 aa, Cryptosporidium hominis
GRYSSPIFFPIYNSLLD

SEQ ID NO: 2172301 - protein, 23 aa, Cryptosporidium hominis
GSAEVRAQIRLIFREYQNKKKIQ

SEQ ID NO: 2172302 - protein, 19 aa, Cryptosporidium hominis
GSANTDYMCRSGIDTSPSI

SEQ ID NO: 2172303 - protein, 27 aa, Cryptosporidium hominis
GSARTRLSNWIISFSCLDDDIKGEVPF

SEQ ID NO: 2172304 - protein, 18 aa, Cryptosporidium hominis
GSCAICFQKQANLCQNAS

SEQ ID NO: 2172305 - protein, 23 aa, Cryptosporidium hominis
GSDAPSHLGMRFIGGRYVPKTVA

SEQ ID NO: 2172306 - protein, 23 aa, Cryptosporidium hominis
GSDDNVICLWDIQSKPNNYERKL

SEQ ID NO: 2172307 - protein, 17 aa, Cryptosporidium hominis
GSDHGSCSEGYIYEESH

SEQ ID NO: 2172308 - protein, 20 aa, Cryptosporidium hominis
GSDPFTISGFGPESTSTDPI

SEQ ID NO: 2172309 - protein, 18 aa, Cryptosporidium hominis
GSDSDFWRSKKCTKKEYI

SEQ ID NO: 2172310 - protein, 22 aa, Cryptosporidium hominis
GSEGRNGFVSSLRNKPPSRKLR

SEQ ID NO: 2172311 - protein, 24 aa, Cryptosporidium hominis
GSEHAGICNQRFRKSAVLGNSNGC

SEQ ID NO: 2172312 - protein, 32 aa, Cryptosporidium hominis
GSENGYICLWDLQPDFGRSIFGIQYNKNNLHG

SEQ ID NO: 2172313 - protein, 26 aa, Cryptosporidium hominis
GSESRKAYFIGYMVHKLCLGALGRVP

SEQ ID NO: 2172314 - protein, 17 aa, Cryptosporidium hominis
GSFGLTFRMQNFERYYL

SEQ ID NO: 2172315 - protein, 25 aa, Cryptosporidium hominis
GSFLCEIKTQIGLPPLKIYGKGSNM

SEQ ID NO: 2172316 - protein, 17 aa, Cryptosporidium hominis
GSFLTKEILRLENSINT

SEQ ID NO: 2172317 - protein, 24 aa, Cryptosporidium hominis
GSFNKECRTIFVGDLYINRSKSNY

SEQ ID NO: 2172318 - protein, 46 aa, Cryptosporidium hominis
GSGILKDISTEFEIKFELGLINGSWLGGDIFILNREHALEAVNYSI

SEQ ID NO: 2172319 - protein, 24 aa, Cryptosporidium hominis
GSGKILARLDTRWDKVGNNEILRF

SEQ ID NO: 2172320 - protein, 26 aa, Cryptosporidium hominis
GSGNVLKCLICIGGGNINKTFDYIKQ

SEQ ID NO: 2172321 - protein, 18 aa, Cryptosporidium hominis
GSGRMLGPLAKNISKAMI

SEQ ID NO: 2172322 - protein, 23 aa, Cryptosporidium hominis
GSGSGRNGMVSNIQSSFSEGLQP

SEQ ID NO: 2172323 - protein, 18 aa, Cryptosporidium hominis
GSHALVFCTDWNTFKDIN

SEQ ID NO: 2172324 - protein, 24 aa, Cryptosporidium hominis
GSIKRYGIPALMNYSYRYTNKALS

SEQ ID NO: 2172325 - protein, 41 aa, Cryptosporidium hominis
GSIPKAPCSTCQFRTSTVYCIDCCEGFCSKCVREFHNSVST

SEQ ID NO: 2172326 - protein, 25 aa, Cryptosporidium hominis
GSIQFKCIFCKILVQMIIYSQQLFE

SEQ ID NO: 2172327 - protein, 17 aa, Cryptosporidium hominis
GSISSLWTKHNSSPPKA

SEQ ID NO: 2172328 - protein, 24 aa, Cryptosporidium hominis
GSITSRQIDIEVSKETTDTSVANN

SEQ ID NO: 2172329 - protein, 23 aa, Cryptosporidium hominis
GSKFHRLKHLTIFIEENQDLKEK

SEQ ID NO: 2172330 - protein, 26 aa, Cryptosporidium hominis
GSKFLDPFLFWEGRVKLFPPELLSAL

SEQ ID NO: 2172331 - protein, 17 aa, Cryptosporidium hominis
GSKVCSVAPIAGETKIW

SEQ ID NO: 2172332 - protein, 26 aa, Cryptosporidium hominis
GSKVGRLGRLCCEKQNKFVMQIHEKL

SEQ ID NO: 2172333 - protein, 24 aa, Cryptosporidium hominis
GSKYKIDSVFGFLREFHVKKENQV

SEQ ID NO: 2172334 - protein, 24 aa, Cryptosporidium hominis
GSLDFKSFVIDTLFDISNEIPDIL

SEQ ID NO: 2172335 - protein, 23 aa, Cryptosporidium hominis
GSLFSGTQNGIFFIKKNNGGSGV

SEQ ID NO: 2172336 - protein, 24 aa, Cryptosporidium hominis
GSLISLKIATLVGGLDMVMQSLSL

SEQ ID NO: 2172337 - protein, 19 aa, Cryptosporidium hominis
GSLMLGRISSHFYLSPETI

SEQ ID NO: 2172338 - protein, 22 aa, Cryptosporidium hominis
GSLPAPIMNRFDQEFRMYVNSD

SEQ ID NO: 2172339 - protein, 18 aa, Cryptosporidium hominis
GSLSRTTSNLSPAQQNIV

SEQ ID NO: 2172340 - protein, 24 aa, Cryptosporidium hominis
GSLVHKIELFPEVLPDTTMQSADY

SEQ ID NO: 2172341 - protein, 17 aa, Cryptosporidium hominis
GSMAYKHSLELKHHLFI

SEQ ID NO: 2172342 - protein, 17 aa, Cryptosporidium hominis
GSMGYNFGGIDDSNSIA

SEQ ID NO: 2172343 - protein, 24 aa, Cryptosporidium hominis
GSMSQLFILCKFDFDLFSKIIASI

SEQ ID NO: 2172344 - protein, 31 aa, Cryptosporidium hominis
GSNYNYFIDRGWRDCFECFKHENRYSTSASS

SEQ ID NO: 2172345 - protein, 23 aa, Cryptosporidium hominis
GSPIRGNLPISFSTGNGKKVSIT

SEQ ID NO: 2172346 - protein, 23 aa, Cryptosporidium hominis
GSPQFLDEIDFCLEKEEDSYFDS

SEQ ID NO: 2172347 - protein, 19 aa, Cryptosporidium hominis
GSQGFCLLNNVAIGAAYCR

SEQ ID NO: 2172348 - protein, 20 aa, Cryptosporidium hominis
GSRGGRGGQRGRVFSGQIGG

SEQ ID NO: 2172349 - protein, 24 aa, Cryptosporidium hominis
GSRLRLLLDRSRFILSTKGDINQY

SEQ ID NO: 2172350 - protein, 22 aa, Cryptosporidium hominis
GSSCPFVKSVLGRIFVNPTGNK

SEQ ID NO: 2172351 - protein, 23 aa, Cryptosporidium hominis
GSSDFKSATLFSLGSDLNVLKNS

SEQ ID NO: 2172352 - protein, 19 aa, Cryptosporidium hominis
GSSGGGRGNESMGRDFVGG

SEQ ID NO: 2172353 - protein, 17 aa, Cryptosporidium hominis
GSSGGGYDLNRKQPPPS

SEQ ID NO: 2172354 - protein, 29 aa, Cryptosporidium hominis
GSSKEMIKWLGCLPIESMIDVYGTIVVPE

SEQ ID NO: 2172355 - protein, 27 aa, Cryptosporidium hominis
GSSNNLKSKWALDKRSGNIIERSILSL

SEQ ID NO: 2172356 - protein, 19 aa, Cryptosporidium hominis
GSSPRWAPVSNREFTNDEK

SEQ ID NO: 2172357 - protein, 18 aa, Cryptosporidium hominis
GSSQEFNDGFSLSTGNLH

SEQ ID NO: 2172358 - protein, 24 aa, Cryptosporidium hominis
GSSREVLLRFNVDLPKKHGRGGQS

SEQ ID NO: 2172359 - protein, 17 aa, Cryptosporidium hominis
GSSRGGSGIGRLTGRGE

SEQ ID NO: 2172360 - protein, 28 aa, Cryptosporidium hominis
GSSRMAKIGWSRFDSFFRKIPMGAKKDI

SEQ ID NO: 2172361 - protein, 19 aa, Cryptosporidium hominis
GSSSWKKFPARRIGVVLSG

SEQ ID NO: 2172362 - protein, 19 aa, Cryptosporidium hominis
GSVIDCSRNGHINHRFSNR

SEQ ID NO: 2172363 - protein, 17 aa, Cryptosporidium hominis
GSVIPPFLRGSQGAGVS

SEQ ID NO: 2172364 - protein, 20 aa, Cryptosporidium hominis
GSYKRKNKSLAEYSESCDSI

SEQ ID NO: 2172365 - protein, 25 aa, Cryptosporidium hominis
GSYRFPNNGPLCFTIPEFSNNPTLV

SEQ ID NO: 2172366 - protein, 28 aa, Cryptosporidium hominis
GTAPSNGIQLCFLPDKFSIHLAPSQGLL

SEQ ID NO: 2172367 - protein, 21 aa, Cryptosporidium hominis
GTCYMPYWMMQNLELQEGDIT

SEQ ID NO: 2172368 - protein, 33 aa, Cryptosporidium hominis
GTEEDRVNCPFYWKIGACRHGDQCSRNHYKPTS

SEQ ID NO: 2172369 - protein, 19 aa, Cryptosporidium hominis
GTEHFKKYASLMLLLSDIL

SEQ ID NO: 2172370 - protein, 20 aa, Cryptosporidium hominis
GTEIPYIICKEVNSQSSEEV

SEQ ID NO: 2172371 - protein, 25 aa, Cryptosporidium hominis
GTEPFRITHEMSKIEVRSRVILTDG

SEQ ID NO: 2172372 - protein, 19 aa, Cryptosporidium hominis
GTEYFDAKLGQYIDYPITD

SEQ ID NO: 2172373 - protein, 18 aa, Cryptosporidium hominis
GTFDGIICIAVLHHLSTP

SEQ ID NO: 2172374 - protein, 17 aa, Cryptosporidium hominis
GTFPRVGIFTSDVEYLL

SEQ ID NO: 2172375 - protein, 17 aa, Cryptosporidium hominis
GTGGILISASHFGATCF

SEQ ID NO: 2172376 - protein, 18 aa, Cryptosporidium hominis
GTGGMRTKIFAARIAAAA

SEQ ID NO: 2172377 - protein, 17 aa, Cryptosporidium hominis
GTGILSMLAAKCGAKAV

SEQ ID NO: 2172378 - protein, 29 aa, Cryptosporidium hominis
GTGKSYLSMCIAGELGLPFFKLSGPNIIN

SEQ ID NO: 2172379 - protein, 20 aa, Cryptosporidium hominis
GTGWDVRDGRSLYRDDEDKI

SEQ ID NO: 2172380 - protein, 22 aa, Cryptosporidium hominis
GTHFCMYVKHKLLFNEMNNTQD

SEQ ID NO: 2172381 - protein, 18 aa, Cryptosporidium hominis
GTILNCIQVFGLDAKMVI

SEQ ID NO: 2172382 - protein, 18 aa, Cryptosporidium hominis
GTILWKYWNKPSEASTRN

SEQ ID NO: 2172383 - protein, 18 aa, Cryptosporidium hominis
GTINFDEFCHVMRRVPSK

SEQ ID NO: 2172384 - protein, 23 aa, Cryptosporidium hominis
GTKLLNSFIPWMGTCGTQPSAGQ

SEQ ID NO: 2172385 - protein, 24 aa, Cryptosporidium hominis
GTKTLRLAPQLSDVFQKEKVKVGD

SEQ ID NO: 2172386 - protein, 20 aa, Cryptosporidium hominis
GTLIPFEYILNYEKEKTNIL

SEQ ID NO: 2172387 - protein, 22 aa, Cryptosporidium hominis
GTLKTCGGHWGYIDLQQPVFHV

SEQ ID NO: 2172388 - protein, 20 aa, Cryptosporidium hominis
GTLRKLRPPIVTLLTTSPPE

SEQ ID NO: 2172389 - protein, 17 aa, Cryptosporidium hominis
GTMLAFAHCLQKYEFHV

SEQ ID NO: 2172390 - protein, 27 aa, Cryptosporidium hominis
GTMVYRMGLILEETWDKSLEGSRARYE

SEQ ID NO: 2172391 - protein, 23 aa, Cryptosporidium hominis
GTNCVYCKFYFQEILEDHVPGYR

SEQ ID NO: 2172392 - protein, 31 aa, Cryptosporidium hominis
GTNKGYCFIEFLGKLEAISALEQFQHTHLYG

SEQ ID NO: 2172393 - protein, 26 aa, Cryptosporidium hominis
GTNWPVWENLGSIYLRGTIADLENCF

SEQ ID NO: 2172394 - protein, 30 aa, Cryptosporidium hominis
GTPNGPFLYPLSVRGRKPFSLLTDDESSDD

SEQ ID NO: 2172395 - protein, 21 aa, Cryptosporidium hominis
GTQCPDLTLIDLPGITRVPLK

SEQ ID NO: 2172396 - protein, 25 aa, Cryptosporidium hominis
GTRILRFIFELIQLSTFGVSERAQR

SEQ ID NO: 2172397 - protein, 17 aa, Cryptosporidium hominis
GTRLKAPVDAVVNTTNK

SEQ ID NO: 2172398 - protein, 22 aa, Cryptosporidium hominis
GTRLLKRWITYPLVNTDRINER

SEQ ID NO: 2172399 - protein, 21 aa, Cryptosporidium hominis
GTSKCIIRYDLLDIGLAICSP

SEQ ID NO: 2172400 - protein, 22 aa, Cryptosporidium hominis
GTSVLFGLKLVEMLCGVEKSKL

SEQ ID NO: 2172401 - protein, 18 aa, Cryptosporidium hominis
GTTALVCIIFGPDPIDNK

SEQ ID NO: 2172402 - protein, 26 aa, Cryptosporidium hominis
GTTNLKKQILLWLNDNEISLFDNDST

SEQ ID NO: 2172403 - protein, 26 aa, Cryptosporidium hominis
GTTTGCFNPLLRQMYLGWQGNNSALT

SEQ ID NO: 2172404 - protein, 21 aa, Cryptosporidium hominis
GTVDYTLKVSRFKNVNLLAMH

SEQ ID NO: 2172405 - protein, 17 aa, Cryptosporidium hominis
GTVGYNNGVGFVNHQNY

SEQ ID NO: 2172406 - protein, 25 aa, Cryptosporidium hominis
GTVNLLRCRNDIFLQKKNQSSSFSP

SEQ ID NO: 2172407 - protein, 21 aa, Cryptosporidium hominis
GTVRWVIDRCREIYGVNSNNL

SEQ ID NO: 2172408 - protein, 17 aa, Cryptosporidium hominis
GTVVVWDLITYTAINTF

SEQ ID NO: 2172409 - protein, 20 aa, Cryptosporidium hominis
GTYFTCVWIQISKQRDSLFT

SEQ ID NO: 2172410 - protein, 19 aa, Cryptosporidium hominis
GVAIDEFFSAIKSRGPESP

SEQ ID NO: 2172411 - protein, 18 aa, Cryptosporidium hominis
GVAMPWLYQNFDASGYSF

SEQ ID NO: 2172412 - protein, 23 aa, Cryptosporidium hominis
GVCKFLFKTEHYALFSKLKSLLD

SEQ ID NO: 2172413 - protein, 26 aa, Cryptosporidium hominis
GVDLLLSYILHRLFDTPFTDEDGKIL

SEQ ID NO: 2172414 - protein, 24 aa, Cryptosporidium hominis
GVELNGWSRYPLKISKFEEENVKN

SEQ ID NO: 2172415 - protein, 23 aa, Cryptosporidium hominis
GVELRWFYSEHDLLDLGKIIDKS

SEQ ID NO: 2172416 - protein, 18 aa, Cryptosporidium hominis
GVENTFYFDKEINQWCQR

SEQ ID NO: 2172417 - protein, 23 aa, Cryptosporidium hominis
GVFPCGVLSDAIRSETQNPNGSI

SEQ ID NO: 2172418 - protein, 18 aa, Cryptosporidium hominis
GVFPVLCDPVSCGKSSFD

SEQ ID NO: 2172419 - protein, 17 aa, Cryptosporidium hominis
GVFRRCGYLSNSSFNSN

SEQ ID NO: 2172420 - protein, 25 aa, Cryptosporidium hominis
GVFSAIKYLLSKGVLQRKIIVLSLI

SEQ ID NO: 2172421 - protein, 19 aa, Cryptosporidium hominis
GVFVRVFVLLTDFMDTLMI

SEQ ID NO: 2172422 - protein, 36 aa, Cryptosporidium hominis
GVGGGHGIGMGMGNRIIPGISPGVIHPKSTVGGGGS

SEQ ID NO: 2172423 - protein, 18 aa, Cryptosporidium hominis
GVGGKRLLEKDCDQDNGN

SEQ ID NO: 2172424 - protein, 19 aa, Cryptosporidium hominis
GVGKSCLLLRFADDTYTDS

SEQ ID NO: 2172425 - protein, 22 aa, Cryptosporidium hominis
GVGLSAGFDRYSQSNGFNSGGG

SEQ ID NO: 2172426 - protein, 17 aa, Cryptosporidium hominis
GVGNWRILYEPIGGGGR

SEQ ID NO: 2172427 - protein, 27 aa, Cryptosporidium hominis
GVGYIGIEWKGPFPLHNSIIQHVKRVQ

SEQ ID NO: 2172428 - protein, 23 aa, Cryptosporidium hominis
GVGYPSGLLFGGLGSNLGQHNVA

SEQ ID NO: 2172429 - protein, 27 aa, Cryptosporidium hominis
GVIDHCLLHVSLLLKQKIQAFVCIGTV

SEQ ID NO: 2172430 - protein, 28 aa, Cryptosporidium hominis
GVIEPSFGIGRIIYCLLEHSFKIREDLS

SEQ ID NO: 2172431 - protein, 20 aa, Cryptosporidium hominis
GVIGCPVCYVPLTIDLNKIS

SEQ ID NO: 2172432 - protein, 19 aa, Cryptosporidium hominis
GVIKFWRLRSEKEISREKE

SEQ ID NO: 2172433 - protein, 22 aa, Cryptosporidium hominis
GVINFKIAEWNLQISDSDEKTF

SEQ ID NO: 2172434 - protein, 18 aa, Cryptosporidium hominis
GVKFFSFIISGNKPSSVN

SEQ ID NO: 2172435 - protein, 25 aa, Cryptosporidium hominis
GVKNQEIDCGFDFAPVDEYSNIGIW

SEQ ID NO: 2172436 - protein, 23 aa, Cryptosporidium hominis
GVLCIKNSWPGMFRGIFGAHYLH

SEQ ID NO: 2172437 - protein, 18 aa, Cryptosporidium hominis
GVLEFWNDWFSPDSNKIT

SEQ ID NO: 2172438 - protein, 17 aa, Cryptosporidium hominis
GVLGRGAYSSVFKIRSK

SEQ ID NO: 2172439 - protein, 19 aa, Cryptosporidium hominis
GVLLLIIFGLPPVYHLDDP

SEQ ID NO: 2172440 - protein, 20 aa, Cryptosporidium hominis
GVLMKYYPNVYWERVGNITI

SEQ ID NO: 2172441 - protein, 25 aa, Cryptosporidium hominis
GVPLDLRGSVPIQIHQPPQIPLSQS

SEQ ID NO: 2172442 - protein, 18 aa, Cryptosporidium hominis
GVPLYKYIAELAGNDTNN

SEQ ID NO: 2172443 - protein, 17 aa, Cryptosporidium hominis
GVPPGKPSYVYRPPNNP

SEQ ID NO: 2172444 - protein, 22 aa, Cryptosporidium hominis
GVRILLEFDDSFNLERTMQSIT

SEQ ID NO: 2172445 - protein, 23 aa, Cryptosporidium hominis
GVRQILCGNGFNIICTQNLFIWG

SEQ ID NO: 2172446 - protein, 19 aa, Cryptosporidium hominis
GVSELSFSGASARFTTPSI

SEQ ID NO: 2172447 - protein, 18 aa, Cryptosporidium hominis
GVSKEFHSKLVMMSDGGS

SEQ ID NO: 2172448 - protein, 22 aa, Cryptosporidium hominis
GVSRGFGFVSFLSPDEATKAIT

SEQ ID NO: 2172449 - protein, 21 aa, Cryptosporidium hominis
GVSSFGFGGCNSHVILESASA

SEQ ID NO: 2172450 - protein, 37 aa, Cryptosporidium hominis
GVSVAVLDRCVWCIRCYSEGRYPPILNSGHFIKVDAP

SEQ ID NO: 2172451 - protein, 25 aa, Cryptosporidium hominis
GVSVLEHLIRCFKENSSLSNVLKPF

SEQ ID NO: 2172452 - protein, 19 aa, Cryptosporidium hominis
GVTIFCITELYIVSQSSSG

SEQ ID NO: 2172453 - protein, 17 aa, Cryptosporidium hominis
GVVCGMNSINVGVGTPN

SEQ ID NO: 2172454 - protein, 24 aa, Cryptosporidium hominis
GVVGPWRRSLHGGQTVDSLETVRR

SEQ ID NO: 2172455 - protein, 29 aa, Cryptosporidium hominis
GVVHVKYRKGACTNCGSMTHQARDCLERP

SEQ ID NO: 2172456 - protein, 19 aa, Cryptosporidium hominis
GVVRRSVGVGKNLIWAGLD

SEQ ID NO: 2172457 - protein, 26 aa, Cryptosporidium hominis
GVYEPVSVCCIEFWNTIADLEIELSL

SEQ ID NO: 2172458 - protein, 18 aa, Cryptosporidium hominis
GVYSMVSPLQSFRTPRLE

SEQ ID NO: 2172459 - protein, 18 aa, Cryptosporidium hominis
GWIAAARFEEFVGRISHA

SEQ ID NO: 2172460 - protein, 26 aa, Cryptosporidium hominis
GWKRIPKERSCIFLDSINEQDSSVND

SEQ ID NO: 2172461 - protein, 27 aa, Cryptosporidium hominis
GWLVRKKFCKLFMLKRCILALKRKSLI

SEQ ID NO: 2172462 - protein, 22 aa, Cryptosporidium hominis
GWNFTGCSTVPFVTYPEKNTPS

SEQ ID NO: 2172463 - protein, 20 aa, Cryptosporidium hominis
GWTCETCGASTNLWLNLSDG

SEQ ID NO: 2172464 - protein, 18 aa, Cryptosporidium hominis
GWVYYSLENSAVIEKSWR

SEQ ID NO: 2172465 - protein, 17 aa, Cryptosporidium hominis
GYADPRSLVLTLQELST

SEQ ID NO: 2172466 - protein, 25 aa, Cryptosporidium hominis
GYDINCTDFDIGIFDSCLCTCNSGS

SEQ ID NO: 2172467 - protein, 24 aa, Cryptosporidium hominis
GYDSLKEALNYVWGPSVELIPSMQ

SEQ ID NO: 2172468 - protein, 20 aa, Cryptosporidium hominis
GYFASYRACAVGTKEREGNN

SEQ ID NO: 2172469 - protein, 18 aa, Cryptosporidium hominis
GYFIARGMIEYFQEQELF

SEQ ID NO: 2172470 - protein, 21 aa, Cryptosporidium hominis
GYFTCEGRQLLTLKTAESSRM

SEQ ID NO: 2172471 - protein, 18 aa, Cryptosporidium hominis
GYGIQKWPDGAVFEGNFV

SEQ ID NO: 2172472 - protein, 23 aa, Cryptosporidium hominis
GYGKVYKAIWTTRGITVAVKAFR

SEQ ID NO: 2172473 - protein, 17 aa, Cryptosporidium hominis
GYGRLLIDLLRFICNEL

SEQ ID NO: 2172474 - protein, 23 aa, Cryptosporidium hominis
GYILPKDMDALISPFYNINIQNK

SEQ ID NO: 2172475 - protein, 25 aa, Cryptosporidium hominis
GYISREHCIFYYSSIRNREYEGLDY

SEQ ID NO: 2172476 - protein, 26 aa, Cryptosporidium hominis
GYITSIEWIFHTKLLVFTIYRILDTF

SEQ ID NO: 2172477 - protein, 17 aa, Cryptosporidium hominis
GYLAWVGNRSEVMDGSF

SEQ ID NO: 2172478 - protein, 19 aa, Cryptosporidium hominis
GYLIHLTQDISWIYNKMDM

SEQ ID NO: 2172479 - protein, 19 aa, Cryptosporidium hominis
GYLKFPRKSMLEYVPSNSG

SEQ ID NO: 2172480 - protein, 17 aa, Cryptosporidium hominis
GYLRLSFNFKEKKISHI

SEQ ID NO: 2172481 - protein, 18 aa, Cryptosporidium hominis
GYNGPKGMYPIGKISKDS

SEQ ID NO: 2172482 - protein, 26 aa, Cryptosporidium hominis
GYNHRRLEAESGTQISIRGKGTTKEG

SEQ ID NO: 2172483 - protein, 24 aa, Cryptosporidium hominis
GYNIGIRLVDEFLAKSGISKCDSF

SEQ ID NO: 2172484 - protein, 35 aa, Cryptosporidium hominis
GYNLSCDAWAIGICLYEFLCGCLPFGNDAVDYLEI

SEQ ID NO: 2172485 - protein, 19 aa, Cryptosporidium hominis
GYRNFGPDLDRMMLPLNKK

SEQ ID NO: 2172486 - protein, 23 aa, Cryptosporidium hominis
GYSMLERICHRFSEFWSSKSPII

SEQ ID NO: 2172487 - protein, 25 aa, Cryptosporidium hominis
GYSMLLRKGIGIGYISLFSFDESCL

SEQ ID NO: 2172488 - protein, 22 aa, Cryptosporidium hominis
GYSQLKKGILLLLVGGVEKRTK

SEQ ID NO: 2172489 - protein, 22 aa, Cryptosporidium hominis
GYWDYGRSKIIFTRRNKSGQTT

SEQ ID NO: 2172490 - protein, 18 aa, Cryptosporidium hominis
GYYRSCGNDVNIPETELN

SEQ ID NO: 2172491 - protein, 25 aa, Cryptosporidium hominis
GYYYHGVPSWDWYYPYHYAPYVMDI

SEQ ID NO: 2172492 - protein, 21 aa, Cryptosporidium hominis
HACNAFGICLAPLYDTLGEDN

SEQ ID NO: 2172493 - protein, 25 aa, Cryptosporidium hominis
HACSYNLKPAIGIYICVQSSDFSNS

SEQ ID NO: 2172494 - protein, 17 aa, Cryptosporidium hominis
HAIEHTIEWARDAFQGI

SEQ ID NO: 2172495 - protein, 32 aa, Cryptosporidium hominis
HAIIPPEYISGISIEIPPRFDLTKLPWLNQIP

SEQ ID NO: 2172496 - protein, 17 aa, Cryptosporidium hominis
HAIKGYLSNQVPIFSKK

SEQ ID NO: 2172497 - protein, 21 aa, Cryptosporidium hominis
HAKSICLNYGIAKIYDGRFHL

SEQ ID NO: 2172498 - protein, 19 aa, Cryptosporidium hominis
HALAREFYSELSIISRIRH

SEQ ID NO: 2172499 - protein, 18 aa, Cryptosporidium hominis
HAPSLIFMDEIDSIGSQR

SEQ ID NO: 2172500 - protein, 24 aa, Cryptosporidium hominis
HASHVRLSLRKGKGEQRVCKVYGS

SEQ ID NO: 2172501 - protein, 18 aa, Cryptosporidium hominis
HATHLGVLCECLKEESLI

SEQ ID NO: 2172502 - protein, 21 aa, Cryptosporidium hominis
HCFGEKTFGLFWGKNHNRGSF

SEQ ID NO: 2172503 - protein, 21 aa, Cryptosporidium hominis
HCGEAGKISHLATMYLLADSI

SEQ ID NO: 2172504 - protein, 24 aa, Cryptosporidium hominis
HCGSSLDLGKLLDICLEKILKRTN

SEQ ID NO: 2172505 - protein, 18 aa, Cryptosporidium hominis
HCIGIEFRDPSLIISPRS

SEQ ID NO: 2172506 - protein, 21 aa, Cryptosporidium hominis
HCIKMLRLLQIEDFRKNLSKE

SEQ ID NO: 2172507 - protein, 17 aa, Cryptosporidium hominis
HCISRWLKTRNVCPLDN

SEQ ID NO: 2172508 - protein, 20 aa, Cryptosporidium hominis
HCLYMEKIVAPFLVVVPQST

SEQ ID NO: 2172509 - protein, 19 aa, Cryptosporidium hominis
HCNSAFQWATKEGILCEED

SEQ ID NO: 2172510 - protein, 27 aa, Cryptosporidium hominis
HCSYIQVFRYLKSNIFEKLKLYQNSLN

SEQ ID NO: 2172511 - protein, 17 aa, Cryptosporidium hominis
HCTPVFLSYLIVEILDD

SEQ ID NO: 2172512 - protein, 18 aa, Cryptosporidium hominis
HDACLNSHAFKCINPKPL

SEQ ID NO: 2172513 - protein, 17 aa, Cryptosporidium hominis
HDAERGTRMEINEPDTP

SEQ ID NO: 2172514 - protein, 17 aa, Cryptosporidium hominis
HDELRMIIRRVNNHVKV

SEQ ID NO: 2172515 - protein, 24 aa, Cryptosporidium hominis
HDGLSEGIIPLWGTAFSNGLVRKY

SEQ ID NO: 2172516 - protein, 17 aa, Cryptosporidium hominis
HDIKFNRTHVLGCEARS

SEQ ID NO: 2172517 - protein, 36 aa, Cryptosporidium hominis
HDIVQWKNARVFFIHRIKRQLLLFSLRSEISQKLGI

SEQ ID NO: 2172518 - protein, 18 aa, Cryptosporidium hominis
HDLHKGFIPQASPVVNYR

SEQ ID NO: 2172519 - protein, 21 aa, Cryptosporidium hominis
HDLRILVGANLVRISHLEGLT

SEQ ID NO: 2172520 - protein, 24 aa, Cryptosporidium hominis
HDMALRYHQCKSIIKQLDEELSSL

SEQ ID NO: 2172521 - protein, 25 aa, Cryptosporidium hominis
HDPYKRLLVFFKWLFNSLNRGSRAV

SEQ ID NO: 2172522 - protein, 18 aa, Cryptosporidium hominis
HDTFLFEIGSTFRISMLE

SEQ ID NO: 2172523 - protein, 27 aa, Cryptosporidium hominis
HDTPSGSIGKLIFRRDGNMDLYLNSSK

SEQ ID NO: 2172524 - protein, 24 aa, Cryptosporidium hominis
HDVSGCPYPLEVVKVSVPSGVTQI

SEQ ID NO: 2172525 - protein, 17 aa, Cryptosporidium hominis
HEEELKEKVGMKINCDR

SEQ ID NO: 2172526 - protein, 20 aa, Cryptosporidium hominis
HEFFYSQWIEQIGYLSSLTK

SEQ ID NO: 2172527 - protein, 19 aa, Cryptosporidium hominis
HEFQAGANGAGFANANPMK

SEQ ID NO: 2172528 - protein, 32 aa, Cryptosporidium hominis
HEGDSMPGFPSPDMFEYLILPHLRKIQAPVME

SEQ ID NO: 2172529 - protein, 28 aa, Cryptosporidium hominis
HEIEPQLIFLRWIRLLFSREFSDLNNSI

SEQ ID NO: 2172530 - protein, 25 aa, Cryptosporidium hominis
HEIKCLKNELVYPILILLDEPMLCE

SEQ ID NO: 2172531 - protein, 17 aa, Cryptosporidium hominis
HEIKSCVSITYADSVAF

SEQ ID NO: 2172532 - protein, 27 aa, Cryptosporidium hominis
HEIRKLRRGCNLSKLLVEVAKNRCTHR

SEQ ID NO: 2172533 - protein, 24 aa, Cryptosporidium hominis
HEIRSDCFVLGWYQLIRLDDFQDY

SEQ ID NO: 2172534 - protein, 25 aa, Cryptosporidium hominis
HEITGNLLPSWKIVILDEAEMMTAD

SEQ ID NO: 2172535 - protein, 19 aa, Cryptosporidium hominis
HEKALKASQAIQRSLLDLE

SEQ ID NO: 2172536 - protein, 21 aa, Cryptosporidium hominis
HEKEVNCIRFSSSGELLASGG

SEQ ID NO: 2172537 - protein, 35 aa, Cryptosporidium hominis
HEKVSVKFSQYFSMFKKKMLKSFNSINELYHEMKP

SEQ ID NO: 2172538 - protein, 25 aa, Cryptosporidium hominis
HELGEHGIIVWMSRDPIGIKEKILN

SEQ ID NO: 2172539 - protein, 20 aa, Cryptosporidium hominis
HELIDFQERCRVLNASGEAM

SEQ ID NO: 2172540 - protein, 23 aa, Cryptosporidium hominis
HELKRIRTLSIVGGRNIDQQAFS

SEQ ID NO: 2172541 - protein, 23 aa, Cryptosporidium hominis
HEMSLRLLLNTIITTAAKYQKSI

SEQ ID NO: 2172542 - protein, 18 aa, Cryptosporidium hominis
HERKFNRGLFLSEFIMDY

SEQ ID NO: 2172543 - protein, 33 aa, Cryptosporidium hominis
HERVEDVIKSWESRLAKQVKLFNKASSDVLEVD

SEQ ID NO: 2172544 - protein, 18 aa, Cryptosporidium hominis
HEVLYVLGQMGLKSPLTR

SEQ ID NO: 2172545 - protein, 24 aa, Cryptosporidium hominis
HFENRLKDLVLRISSDQDFTLNDD

SEQ ID NO: 2172546 - protein, 18 aa, Cryptosporidium hominis
HFEPKYINPLQCDITSNG

SEQ ID NO: 2172547 - protein, 19 aa, Cryptosporidium hominis
HFGRRECRPSVMWETKRNK

SEQ ID NO: 2172548 - protein, 28 aa, Cryptosporidium hominis
HFGTLAFCRRWLDQLGFNKHALALKSLV

SEQ ID NO: 2172549 - protein, 27 aa, Cryptosporidium hominis
HFINCFSVILGFRYANFMLLIDSVDER

SEQ ID NO: 2172550 - protein, 23 aa, Cryptosporidium hominis
HFIPMYVELCDKLRDHLKDVTTI

SEQ ID NO: 2172551 - protein, 26 aa, Cryptosporidium hominis
HFITLKKSLNCLLNLSKSEKLFVSYF

SEQ ID NO: 2172552 - protein, 23 aa, Cryptosporidium hominis
HFKSRLGNQLVYGEVGFRDFFNK

SEQ ID NO: 2172553 - protein, 23 aa, Cryptosporidium hominis
HFLKEGDFLRGLILALAMNNFNI

SEQ ID NO: 2172554 - protein, 21 aa, Cryptosporidium hominis
HFTCTCRLCKKEERSNHTDSG

SEQ ID NO: 2172555 - protein, 23 aa, Cryptosporidium hominis
HFVKDRLYLMIKIIKVDNIITFE

SEQ ID NO: 2172556 - protein, 25 aa, Cryptosporidium hominis
HGDIPKRWLNEISECIQGRDGMVQY

SEQ ID NO: 2172557 - protein, 21 aa, Cryptosporidium hominis
HGDLRFRVLLGDRKFYSMPLY

SEQ ID NO: 2172558 - protein, 19 aa, Cryptosporidium hominis
HGFPSRMTIGMLLESMGGK

SEQ ID NO: 2172559 - protein, 26 aa, Cryptosporidium hominis
HGGDSFSMPSYIRIPSNNFPNSNNRN

SEQ ID NO: 2172560 - protein, 17 aa, Cryptosporidium hominis
HGGHLLDKLNVFIDDST

SEQ ID NO: 2172561 - protein, 17 aa, Cryptosporidium hominis
HGGHPKHIKEWFLSNSI

SEQ ID NO: 2172562 - protein, 17 aa, Cryptosporidium hominis
HGGIGGSIHKVEQIKEI

SEQ ID NO: 2172563 - protein, 24 aa, Cryptosporidium hominis
HGGRVGWDYCLWIDIPEFSCMYLK

SEQ ID NO: 2172564 - protein, 17 aa, Cryptosporidium hominis
HGGTIRQLLRFKYKNGL

SEQ ID NO: 2172565 - protein, 17 aa, Cryptosporidium hominis
HGIPGSCERLEKILLQD

SEQ ID NO: 2172566 - protein, 23 aa, Cryptosporidium hominis
HGKKKRAPILKKIFGKKDSSNID

SEQ ID NO: 2172567 - protein, 20 aa, Cryptosporidium hominis
HGKKYRCRYISGKIDKAQES

SEQ ID NO: 2172568 - protein, 19 aa, Cryptosporidium hominis
HGLPKFLINKARYIQAYFI

SEQ ID NO: 2172569 - protein, 28 aa, Cryptosporidium hominis
HGLRMGAVIKRFYIDSIYTQDNLINLDT

SEQ ID NO: 2172570 - protein, 20 aa, Cryptosporidium hominis
HGLSLFEFNKRYNIDVSGLA

SEQ ID NO: 2172571 - protein, 19 aa, Cryptosporidium hominis
HGLSRANMNNMIMQDRYNK

SEQ ID NO: 2172572 - protein, 24 aa, Cryptosporidium hominis
HGNPNLRDPILYRILKQSHPHTGD

SEQ ID NO: 2172573 - protein, 20 aa, Cryptosporidium hominis
HGSLSDFDCLVFVRKDSVYD

SEQ ID NO: 2172574 - protein, 20 aa, Cryptosporidium hominis
HGTKGGCEREILSLNRVNSI

SEQ ID NO: 2172575 - protein, 20 aa, Cryptosporidium hominis
HGTTELRVTNDFYKTSVCRY

SEQ ID NO: 2172576 - protein, 27 aa, Cryptosporidium hominis
HGYKFPHSIWIQALRFLASSRFHVQTA

SEQ ID NO: 2172577 - protein, 22 aa, Cryptosporidium hominis
HHDFFILHLRKCVIGILDNWIK

SEQ ID NO: 2172578 - protein, 26 aa, Cryptosporidium hominis
HHDIPKFGMITARFLKTSGIPKDVLH

SEQ ID NO: 2172579 - protein, 28 aa, Cryptosporidium hominis
HHIFRLRIIQKFDWPLPLLFTKKNMEHY

SEQ ID NO: 2172580 - protein, 17 aa, Cryptosporidium hominis
HHLKEWVFGSLDLLKTK

SEQ ID NO: 2172581 - protein, 23 aa, Cryptosporidium hominis
HHPPCGRAITLFDHNGMAVATTT

SEQ ID NO: 2172582 - protein, 18 aa, Cryptosporidium hominis
HHPSLDWVSSLRITDKLA

SEQ ID NO: 2172583 - protein, 25 aa, Cryptosporidium hominis
HHRVSSAMPSEWTIPHVILDSLLSC

SEQ ID NO: 2172584 - protein, 19 aa, Cryptosporidium hominis
HHSGFGFIEFEFVSDVEYA

SEQ ID NO: 2172585 - protein, 24 aa, Cryptosporidium hominis
HHTFFEMLGSWSFGDYFKEEAIEW

SEQ ID NO: 2172586 - protein, 21 aa, Cryptosporidium hominis
HHYITILLTWKVKEETKTMDY

SEQ ID NO: 2172587 - protein, 25 aa, Cryptosporidium hominis
HIALPRLDKHPELSLFGVFDGHGGS

SEQ ID NO: 2172588 - protein, 24 aa, Cryptosporidium hominis
HIELSGKRQGCWRRRKDGKRKHFS

SEQ ID NO: 2172589 - protein, 18 aa, Cryptosporidium hominis
HIFNQVFLSLNRFNDYID

SEQ ID NO: 2172590 - protein, 21 aa, Cryptosporidium hominis
HIGQACYDQAMAFCNAVDVGS

SEQ ID NO: 2172591 - protein, 26 aa, Cryptosporidium hominis
HIIGPNWGEYFAIQIFNQLIVCSVGE

SEQ ID NO: 2172592 - protein, 20 aa, Cryptosporidium hominis
HIIWDHIIRQGGTIDMLATD

SEQ ID NO: 2172593 - protein, 17 aa, Cryptosporidium hominis
HIKALKIDDLIKNLMNP

SEQ ID NO: 2172594 - protein, 24 aa, Cryptosporidium hominis
HIKHYGMLLGSFILRKNDPEKQFE

SEQ ID NO: 2172595 - protein, 19 aa, Cryptosporidium hominis
HILEKLRIIQTYYQICDEL

SEQ ID NO: 2172596 - protein, 18 aa, Cryptosporidium hominis
HILLCGVPPFAGNTDTEI

SEQ ID NO: 2172597 - protein, 21 aa, Cryptosporidium hominis
HILRDWAVFVLQADPDSGSNL

SEQ ID NO: 2172598 - protein, 17 aa, Cryptosporidium hominis
HILYMLLLRSKIGKASL

SEQ ID NO: 2172599 - protein, 24 aa, Cryptosporidium hominis
HINDRLLWCNEWLPETPLEKFDGN

SEQ ID NO: 2172600 - protein, 25 aa, Cryptosporidium hominis
HINGLSIRYIPSLKRMRFEYDCIQD

SEQ ID NO: 2172601 - protein, 18 aa, Cryptosporidium hominis
HINLGSDILMDFFDGGFL

SEQ ID NO: 2172602 - protein, 17 aa, Cryptosporidium hominis
HIPFLISTFNYLVDEIK

SEQ ID NO: 2172603 - protein, 17 aa, Cryptosporidium hominis
HIPHTGIVKAFKVTKNS

SEQ ID NO: 2172604 - protein, 23 aa, Cryptosporidium hominis
HIRGKMRKKVWVNPGDIVLVSLR

SEQ ID NO: 2172605 - protein, 22 aa, Cryptosporidium hominis
HISGECFPVFKGIASKLNNLFS

SEQ ID NO: 2172606 - protein, 22 aa, Cryptosporidium hominis
HISLKKLAPYRVDKKRKYSPPV

SEQ ID NO: 2172607 - protein, 24 aa, Cryptosporidium hominis
HISWFKVPPSIYFNRGCLEEALQD

SEQ ID NO: 2172608 - protein, 20 aa, Cryptosporidium hominis
HIYFSCNWFDVYVEVDLTPI

SEQ ID NO: 2172609 - protein, 24 aa, Cryptosporidium hominis
HKALKFLVKDEIFKELYIETIISR

SEQ ID NO: 2172610 - protein, 19 aa, Cryptosporidium hominis
HKCILCTNKHIFIIYITEN

SEQ ID NO: 2172611 - protein, 20 aa, Cryptosporidium hominis
HKDGGLGFDAKWDLGWMNDT

SEQ ID NO: 2172612 - protein, 37 aa, Cryptosporidium hominis
HKDILFSGMFIKLAKSFRNIFLGNKWLSPPELFSRMF

SEQ ID NO: 2172613 - protein, 32 aa, Cryptosporidium hominis
HKDRILLHETIFWKRRHGLRISSGLLKDIFGY

SEQ ID NO: 2172614 - protein, 23 aa, Cryptosporidium hominis
HKEEVKIYLDEIAVLRSQILQMS

SEQ ID NO: 2172615 - protein, 28 aa, Cryptosporidium hominis
HKEKKIVIEIEIGRCIIDLKVAKNNIYL

SEQ ID NO: 2172616 - protein, 28 aa, Cryptosporidium hominis
HKERLGHLSCRVCGVEYTSRIGKFDEAV

SEQ ID NO: 2172617 - protein, 17 aa, Cryptosporidium hominis
HKFTIKLLMMATRCKII

SEQ ID NO: 2172618 - protein, 30 aa, Cryptosporidium hominis
HKGTINRIRVCPQLPNLVSTWSELGKVCMW

SEQ ID NO: 2172619 - protein, 17 aa, Cryptosporidium hominis
HKILGYEKIRAFKCIST

SEQ ID NO: 2172620 - protein, 26 aa, Cryptosporidium hominis
HKIWLYLDHWLFWLSLTNENNNSSNQ

SEQ ID NO: 2172621 - protein, 23 aa, Cryptosporidium hominis
HKKRRKRANSGWDAQSNNSCNSP

SEQ ID NO: 2172622 - protein, 21 aa, Cryptosporidium hominis
HKLRCRPKSSFSLTSTNSTDE

SEQ ID NO: 2172623 - protein, 28 aa, Cryptosporidium hominis
HKLVSFYVRDILKFILNEESISNEKLNG

SEQ ID NO: 2172624 - protein, 19 aa, Cryptosporidium hominis
HKLYRRAGTVINGNNSSII

SEQ ID NO: 2172625 - protein, 18 aa, Cryptosporidium hominis
HKQELELMEKFSREQDEH

SEQ ID NO: 2172626 - protein, 23 aa, Cryptosporidium hominis
HKQIEFRASLTHRQRVSKFNEKL

SEQ ID NO: 2172627 - protein, 31 aa, Cryptosporidium hominis
HKQILVAAILCRWWHALPDWPPPDTDYQALL

SEQ ID NO: 2172628 - protein, 24 aa, Cryptosporidium hominis
HKQKRIAKRIGIIKEKIVNESKSL

SEQ ID NO: 2172629 - protein, 20 aa, Cryptosporidium hominis
HKQYVVYQLIKVIKYLHSGG

SEQ ID NO: 2172630 - protein, 21 aa, Cryptosporidium hominis
HKRSLSFPKFLGGIELDINQD

SEQ ID NO: 2172631 - protein, 23 aa, Cryptosporidium hominis
HKSPRMRKICQWKDIKEFCLMPP

SEQ ID NO: 2172632 - protein, 27 aa, Cryptosporidium hominis
HKSRIWRGSRWSGVCIGLLNLGGGILK

SEQ ID NO: 2172633 - protein, 27 aa, Cryptosporidium hominis
HKSTGLPIDPMVGLPFDPKSGNLVHPY

SEQ ID NO: 2172634 - protein, 20 aa, Cryptosporidium hominis
HKTPRGAAALARLTTIDGCP

SEQ ID NO: 2172635 - protein, 33 aa, Cryptosporidium hominis
HKVIPFEYGNGYGYLYTRLKWILDNNETSGQFK

SEQ ID NO: 2172636 - protein, 20 aa, Cryptosporidium hominis
HKVRDSWNKLVSVIQKTSSN

SEQ ID NO: 2172637 - protein, 17 aa, Cryptosporidium hominis
HKYCTSISATWRMYKAK

SEQ ID NO: 2172638 - protein, 24 aa, Cryptosporidium hominis
HKYTGLRFIASVILKRPEIYRPLD

SEQ ID NO: 2172639 - protein, 19 aa, Cryptosporidium hominis
HLAAMWVSEIDMLIQKSKN

SEQ ID NO: 2172640 - protein, 27 aa, Cryptosporidium hominis
HLAFSAILCAGIDGILHKIHPAAYLNT

SEQ ID NO: 2172641 - protein, 17 aa, Cryptosporidium hominis
HLCKGREAGQGSENIKS

SEQ ID NO: 2172642 - protein, 28 aa, Cryptosporidium hominis
HLENCWRKDLLSHFLLKLCFINNKEKQE

SEQ ID NO: 2172643 - protein, 20 aa, Cryptosporidium hominis
HLERCISDLQFVFAQIPLSV

SEQ ID NO: 2172644 - protein, 22 aa, Cryptosporidium hominis
HLESLGEIYIDLWVTSDNQNGS

SEQ ID NO: 2172645 - protein, 25 aa, Cryptosporidium hominis
HLEYLAGSCNFQWILSNVYDAYTGE

SEQ ID NO: 2172646 - protein, 18 aa, Cryptosporidium hominis
HLFETCPSGNCFEYYSIA

SEQ ID NO: 2172647 - protein, 20 aa, Cryptosporidium hominis
HLHFFKFIGRIIGKCIYDGQ

SEQ ID NO: 2172648 - protein, 30 aa, Cryptosporidium hominis
HLIKRLFKIPFWPDGFRFIKNRKYFIKDGI

SEQ ID NO: 2172649 - protein, 17 aa, Cryptosporidium hominis
HLIPLEFIKTNLMQTIW

SEQ ID NO: 2172650 - protein, 23 aa, Cryptosporidium hominis
HLKMFTDWIELMSRECFELTILK

SEQ ID NO: 2172651 - protein, 20 aa, Cryptosporidium hominis
HLLDYLSLICIQWKSQYKIC

SEQ ID NO: 2172652 - protein, 23 aa, Cryptosporidium hominis
HLLKAPFCIHHSTGRLCIPIDTS

SEQ ID NO: 2172653 - protein, 21 aa, Cryptosporidium hominis
HLLNGSFFRVNFKAISQGELK

SEQ ID NO: 2172654 - protein, 27 aa, Cryptosporidium hominis
HLLPRIDEFWIKYIQMELILKNYINVR

SEQ ID NO: 2172655 - protein, 22 aa, Cryptosporidium hominis
HLMFKKHLPAPLGKDGKPRKDF

SEQ ID NO: 2172656 - protein, 20 aa, Cryptosporidium hominis
HLNHHLPWIEEYHQRSLKTE

SEQ ID NO: 2172657 - protein, 23 aa, Cryptosporidium hominis
HLNKPCTRNTCIIESKKYFLMEK

SEQ ID NO: 2172658 - protein, 18 aa, Cryptosporidium hominis
HLNSGIDFLCFGEYMYGS

SEQ ID NO: 2172659 - protein, 17 aa, Cryptosporidium hominis
HLQENIIEFEKKSRAAK

SEQ ID NO: 2172660 - protein, 17 aa, Cryptosporidium hominis
HLQTHFIRKHVTENFQW

SEQ ID NO: 2172661 - protein, 19 aa, Cryptosporidium hominis
HLSRLLIVLFSVYHNFEKN

SEQ ID NO: 2172662 - protein, 17 aa, Cryptosporidium hominis
HLVPRLFDGKSYDEIDD

SEQ ID NO: 2172663 - protein, 18 aa, Cryptosporidium hominis
HLWDLRKSAILDSLELST

SEQ ID NO: 2172664 - protein, 18 aa, Cryptosporidium hominis
HLYFQIQAAYWWYEDMWY

SEQ ID NO: 2172665 - protein, 30 aa, Cryptosporidium hominis
HLYGVLCCICKSCGAFLLKGEEKRQHLAKL

SEQ ID NO: 2172666 - protein, 20 aa, Cryptosporidium hominis
HLYNFISLVSGCNINNQNKK

SEQ ID NO: 2172667 - protein, 25 aa, Cryptosporidium hominis
HMIDDYFPRYSIIPNKECIDKWCRL

SEQ ID NO: 2172668 - protein, 22 aa, Cryptosporidium hominis
HMLQRRKSYNFNYREQNSEKQI

SEQ ID NO: 2172669 - protein, 26 aa, Cryptosporidium hominis
HMSILSIILERLFNSPFEELQKLHSP

SEQ ID NO: 2172670 - protein, 17 aa, Cryptosporidium hominis
HNEKSNVITFIKESTSK

SEQ ID NO: 2172671 - protein, 17 aa, Cryptosporidium hominis
HNGYVFLILEYVDTNLF

SEQ ID NO: 2172672 - protein, 17 aa, Cryptosporidium hominis
HNHGGSSGGGYDLNRKQ

SEQ ID NO: 2172673 - protein, 19 aa, Cryptosporidium hominis
HNIDISFWDTYRFEGNSQW

SEQ ID NO: 2172674 - protein, 17 aa, Cryptosporidium hominis
HNIGQLSLRYHELNRSK

SEQ ID NO: 2172675 - protein, 28 aa, Cryptosporidium hominis
HNKVLLKRRKIVYITAGFNGCTSVKTCP

SEQ ID NO: 2172676 - protein, 26 aa, Cryptosporidium hominis
HNQYWKTKLCLMFSKGACKNGDNCRF

SEQ ID NO: 2172677 - protein, 26 aa, Cryptosporidium hominis
HNRLPEEVPIKWTGRLQRTAAQTLFI

SEQ ID NO: 2172678 - protein, 20 aa, Cryptosporidium hominis
HNSDVWGLVKLNRFEKKGNI

SEQ ID NO: 2172679 - protein, 18 aa, Cryptosporidium hominis
HNTPRSATILVIEKGGLW

SEQ ID NO: 2172680 - protein, 20 aa, Cryptosporidium hominis
HNYHAWSLVNWLIYELIPTI

SEQ ID NO: 2172681 - protein, 17 aa, Cryptosporidium hominis
HNYQREWILPLLNNLKN

SEQ ID NO: 2172682 - protein, 21 aa, Cryptosporidium hominis
HPAILRLGMRMKDRKIVGTNM

SEQ ID NO: 2172683 - protein, 28 aa, Cryptosporidium hominis
HPANCSPRLKINIIWPTTLKNYTMYSNM

SEQ ID NO: 2172684 - protein, 20 aa, Cryptosporidium hominis
HPARFRSCQNYEIITHGGES

SEQ ID NO: 2172685 - protein, 25 aa, Cryptosporidium hominis
HPESIISLLSPVSWLQMDEIKINSD

SEQ ID NO: 2172686 - protein, 30 aa, Cryptosporidium hominis
HPFRNKEVIDLWGPHEVILFECGVCKYGKE

SEQ ID NO: 2172687 - protein, 25 aa, Cryptosporidium hominis
HPGFLPEIYDSINITLYRMRRLLGV

SEQ ID NO: 2172688 - protein, 20 aa, Cryptosporidium hominis
HPIELEMLSPIFNNEIIDLR

SEQ ID NO: 2172689 - protein, 23 aa, Cryptosporidium hominis
HPILLRLVTLRTMMEKLKPIDVK

SEQ ID NO: 2172690 - protein, 24 aa, Cryptosporidium hominis
HPINDCFLSSGADWTIKLWMPNPL

SEQ ID NO: 2172691 - protein, 17 aa, Cryptosporidium hominis
HPISPEIQTLIQSPMIA

SEQ ID NO: 2172692 - protein, 21 aa, Cryptosporidium hominis
HPLLFRFQLLIWSLKLKQFLN

SEQ ID NO: 2172693 - protein, 20 aa, Cryptosporidium hominis
HPLNHLLYRCYKLLTFWNVI

SEQ ID NO: 2172694 - protein, 22 aa, Cryptosporidium hominis
HPMKDELLANFVVQSHMNSQEM

SEQ ID NO: 2172695 - protein, 22 aa, Cryptosporidium hominis
HPNLQFEAAWTLTNISSGTTEQ

SEQ ID NO: 2172696 - protein, 22 aa, Cryptosporidium hominis
HPNSYFKNSCHTFNDQVLENEY

SEQ ID NO: 2172697 - protein, 25 aa, Cryptosporidium hominis
HPRFTRDDCHLIMKVTIPLVRALTG

SEQ ID NO: 2172698 - protein, 30 aa, Cryptosporidium hominis
HPRKYSAKLEMLFRKNFIRNLHEVEEIFHK

SEQ ID NO: 2172699 - protein, 25 aa, Cryptosporidium hominis
HPYYLPNFLDIFSWSLPFVSEKVTE

SEQ ID NO: 2172700 - protein, 18 aa, Cryptosporidium hominis
HQDHLCRVYPSGTRISSS

SEQ ID NO: 2172701 - protein, 24 aa, Cryptosporidium hominis
HQERKCIPIALLIEQITKKKLHVT

SEQ ID NO: 2172702 - protein, 38 aa, Cryptosporidium hominis
HQHNSAIFGLCWCNNDSFLLSGCLDRQITVLNIKNNMV

SEQ ID NO: 2172703 - protein, 18 aa, Cryptosporidium hominis
HQIILAIVYQNAYSAVSS

SEQ ID NO: 2172704 - protein, 17 aa, Cryptosporidium hominis
HQKLVLLSRCSRLTNEI

SEQ ID NO: 2172705 - protein, 33 aa, Cryptosporidium hominis
HQKTVSEWSRYIVKCILEGSSMRKEDHSHSFQI

SEQ ID NO: 2172706 - protein, 23 aa, Cryptosporidium hominis
HQMEWYLCHSFLKNIESIPNKIS

SEQ ID NO: 2172707 - protein, 22 aa, Cryptosporidium hominis
HQRITIIDTWSRLNCGALKIAS

SEQ ID NO: 2172708 - protein, 23 aa, Cryptosporidium hominis
HQSKCLFPDSLIYETWGKSKWKD

SEQ ID NO: 2172709 - protein, 23 aa, Cryptosporidium hominis
HQTMQPCGFCFVQYYNHADALTA

SEQ ID NO: 2172710 - protein, 28 aa, Cryptosporidium hominis
HQTQECPKRIILCRYCNNFVQAGTDGHY

SEQ ID NO: 2172711 - protein, 18 aa, Cryptosporidium hominis
HRAGINFDAYDNIPVEMT

SEQ ID NO: 2172712 - protein, 25 aa, Cryptosporidium hominis
HRAYVCPKCGLIISSISKRAMAQSI

SEQ ID NO: 2172713 - protein, 27 aa, Cryptosporidium hominis
HRFPSQILLKRINLLKTYIKTSNLNIP

SEQ ID NO: 2172714 - protein, 23 aa, Cryptosporidium hominis
HRFSNRPRFVSMQDVHNHFRDHL

SEQ ID NO: 2172715 - protein, 19 aa, Cryptosporidium hominis
HRGEPYSLCVDLWSVGIIL

SEQ ID NO: 2172716 - protein, 18 aa, Cryptosporidium hominis
HRGLLKQQLELVIDEYIE

SEQ ID NO: 2172717 - protein, 26 aa, Cryptosporidium hominis
HRGYSCPKCKSIVCYLPTKCPVCLIY

SEQ ID NO: 2172718 - protein, 30 aa, Cryptosporidium hominis
HRLKMVRGRCLGFYGVKGFLQGKHITLTEK

SEQ ID NO: 2172719 - protein, 34 aa, Cryptosporidium hominis
HRLKNRGAKTLQVFKSIACRHILLLSGTPVQNNT

SEQ ID NO: 2172720 - protein, 20 aa, Cryptosporidium hominis
HRLPPSGGFGMNLGIQDSLN

SEQ ID NO: 2172721 - protein, 25 aa, Cryptosporidium hominis
HRLPVPRPGQVLGLVGTNGIGKSTA

SEQ ID NO: 2172722 - protein, 26 aa, Cryptosporidium hominis
HRLRSGLKMKCGRSKFQKSYTECSDY

SEQ ID NO: 2172723 - protein, 25 aa, Cryptosporidium hominis
HRLVRPRYVPCVQIGNTQNLKDPSL

SEQ ID NO: 2172724 - protein, 24 aa, Cryptosporidium hominis
HRSNLKPAPSMNLRKEFGSRMESK

SEQ ID NO: 2172725 - protein, 21 aa, Cryptosporidium hominis
HSAANLSCCVLINYPDDVKIS

SEQ ID NO: 2172726 - protein, 24 aa, Cryptosporidium hominis
HSAFQRRKLLAFITWRLTTNRSSH

SEQ ID NO: 2172727 - protein, 23 aa, Cryptosporidium hominis
HSAKDFTGGTSWYESPEQKMLEY

SEQ ID NO: 2172728 - protein, 20 aa, Cryptosporidium hominis
HSCREFMYYSDIYDLQNFIK

SEQ ID NO: 2172729 - protein, 30 aa, Cryptosporidium hominis
HSDCIIPNCLRQGEFKNVWNILETSGIEHI

SEQ ID NO: 2172730 - protein, 24 aa, Cryptosporidium hominis
HSDWTEFRQMAGLESQLERQRKHG

SEQ ID NO: 2172731 - protein, 24 aa, Cryptosporidium hominis
HSEGIDWISGDGFLENIKDSHFVD

SEQ ID NO: 2172732 - protein, 20 aa, Cryptosporidium hominis
HSGGFRKSFHGYPPSQMEGG

SEQ ID NO: 2172733 - protein, 17 aa, Cryptosporidium hominis
HSGPVKACICSKDKIFS

SEQ ID NO: 2172734 - protein, 31 aa, Cryptosporidium hominis
HSGVGKGCAFVKYAFKEQGLFAIKSLHGALT

SEQ ID NO: 2172735 - protein, 22 aa, Cryptosporidium hominis
HSGYIKCINMLSELSLNKNVLC

SEQ ID NO: 2172736 - protein, 21 aa, Cryptosporidium hominis
HSHPGFGCWFSGTDVSTQQSF

SEQ ID NO: 2172737 - protein, 20 aa, Cryptosporidium hominis
HSIECICLIMALKIRYKDKV

SEQ ID NO: 2172738 - protein, 18 aa, Cryptosporidium hominis
HSILRKKRNNSWMLNKAI

SEQ ID NO: 2172739 - protein, 24 aa, Cryptosporidium hominis
HSINELILEFPIDYQEVLWDSSPS

SEQ ID NO: 2172740 - protein, 20 aa, Cryptosporidium hominis
HSIPLLWRLAMFRIEDIPLF

SEQ ID NO: 2172741 - protein, 36 aa, Cryptosporidium hominis
HSITLKLCSMLPEVRRRIDLGSSLILQNYSDEEIYY

SEQ ID NO: 2172742 - protein, 23 aa, Cryptosporidium hominis
HSKLEGWSVFQLPKYMPESKKNC

SEQ ID NO: 2172743 - protein, 26 aa, Cryptosporidium hominis
HSKRVKISKLLIEGKIKEAISSSYGN

SEQ ID NO: 2172744 - protein, 26 aa, Cryptosporidium hominis
HSLIGLDYLHRICGVIHTDIKPENIV

SEQ ID NO: 2172745 - protein, 23 aa, Cryptosporidium hominis
HSLPKPQTCIDYSHLQNKGRSIG

SEQ ID NO: 2172746 - protein, 20 aa, Cryptosporidium hominis
HSLSYKPNIKKGVRRTDKSR

SEQ ID NO: 2172747 - protein, 17 aa, Cryptosporidium hominis
HSNMKISYITLKSNYRQ

SEQ ID NO: 2172748 - protein, 23 aa, Cryptosporidium hominis
HSNSMKLIWEKIIKVWMSVYQPI

SEQ ID NO: 2172749 - protein, 17 aa, Cryptosporidium hominis
HSPGHMLNSLFNCNTDN

SEQ ID NO: 2172750 - protein, 24 aa, Cryptosporidium hominis
HSPPPLEMILCIGDDRSDEDMFSV

SEQ ID NO: 2172751 - protein, 18 aa, Cryptosporidium hominis
HSPSLCLNNCGFYGNPTT

SEQ ID NO: 2172752 - protein, 24 aa, Cryptosporidium hominis
HSSMDKGGGLSFLVQVVVIHVFPI

SEQ ID NO: 2172753 - protein, 24 aa, Cryptosporidium hominis
HSVFKRKGGDLFIEKDITLVEALT

SEQ ID NO: 2172754 - protein, 23 aa, Cryptosporidium hominis
HSVGIAPRLYAILEHCEDHFNDV

SEQ ID NO: 2172755 - protein, 17 aa, Cryptosporidium hominis
HSVHFIISVANSFPQLN

SEQ ID NO: 2172756 - protein, 26 aa, Cryptosporidium hominis
HSVQELRPLPDLRFTRLCELTKRGDI

SEQ ID NO: 2172757 - protein, 17 aa, Cryptosporidium hominis
HSVSGRNKMDFPFDMPS

SEQ ID NO: 2172758 - protein, 17 aa, Cryptosporidium hominis
HSWRLTSYCPLLVQFFG

SEQ ID NO: 2172759 - protein, 21 aa, Cryptosporidium hominis
HSYEIPEIIATKVIYGNENYI

SEQ ID NO: 2172760 - protein, 25 aa, Cryptosporidium hominis
HSYNCGFCHFSLNVNLEMDAGNEID

SEQ ID NO: 2172761 - protein, 17 aa, Cryptosporidium hominis
HSYPIPVPVPVITPRTR

SEQ ID NO: 2172762 - protein, 17 aa, Cryptosporidium hominis
HTFYRSSPVIPLNDPTI

SEQ ID NO: 2172763 - protein, 20 aa, Cryptosporidium hominis
HTFYWSCLRSPSETNKPTSK

SEQ ID NO: 2172764 - protein, 25 aa, Cryptosporidium hominis
HTHCNKCIKFGLSLDQIQIHDKLYH

SEQ ID NO: 2172765 - protein, 17 aa, Cryptosporidium hominis
HTIPMSALEIFYKEMEK

SEQ ID NO: 2172766 - protein, 17 aa, Cryptosporidium hominis
HTLWNLGEICNDELEKK

SEQ ID NO: 2172767 - protein, 21 aa, Cryptosporidium hominis
HTRIFPSLVISVGSGVSIIRV

SEQ ID NO: 2172768 - protein, 26 aa, Cryptosporidium hominis
HTSIKSSGIGNGYMGHSISGSAINNY

SEQ ID NO: 2172769 - protein, 18 aa, Cryptosporidium hominis
HTSIRFGLGRFTKHEDVD

SEQ ID NO: 2172770 - protein, 20 aa, Cryptosporidium hominis
HTSPRKIGIDMKEIAKVVVK

SEQ ID NO: 2172771 - protein, 29 aa, Cryptosporidium hominis
HTSPYKFSSSQGVIDWKPQHQKLSIFEKN

SEQ ID NO: 2172772 - protein, 20 aa, Cryptosporidium hominis
HTTVIPRTGVNPPIVTSSVG

SEQ ID NO: 2172773 - protein, 19 aa, Cryptosporidium hominis
HTYNIFPRDPWVSDVKGER

SEQ ID NO: 2172774 - protein, 24 aa, Cryptosporidium hominis
HVAQFLLDSCIKPPHGQIFMKWGK

SEQ ID NO: 2172775 - protein, 21 aa, Cryptosporidium hominis
HVASACLYAICRREKTPHMLI

SEQ ID NO: 2172776 - protein, 18 aa, Cryptosporidium hominis
HVCNICTDFESSLNESVS

SEQ ID NO: 2172777 - protein, 25 aa, Cryptosporidium hominis
HVEIFKRKVFLGQWQSAYIILTKDK

SEQ ID NO: 2172778 - protein, 18 aa, Cryptosporidium hominis
HVGDWGTQFGMLIEYLKE

SEQ ID NO: 2172779 - protein, 25 aa, Cryptosporidium hominis
HVISRLRFPLYMAHIEKLLGETCKY

SEQ ID NO: 2172780 - protein, 17 aa, Cryptosporidium hominis
HVKAMRCFVEAVLRYGV

SEQ ID NO: 2172781 - protein, 24 aa, Cryptosporidium hominis
HVKYSVRCPKMFLEDLYPPALESA

SEQ ID NO: 2172782 - protein, 32 aa, Cryptosporidium hominis
HVLSIRINMRQVRLLEVYNIRILESVVIRVHP

SEQ ID NO: 2172783 - protein, 23 aa, Cryptosporidium hominis
HVLSRTFSGGACFDKVSLVYNKP

SEQ ID NO: 2172784 - protein, 34 aa, Cryptosporidium hominis
HVMKMYWKPLMEWDLKCFVKILKQCPRISICLRE

SEQ ID NO: 2172785 - protein, 24 aa, Cryptosporidium hominis
HVPGYRIMSCWEQKVEKPNPKYQY

SEQ ID NO: 2172786 - protein, 18 aa, Cryptosporidium hominis
HVRCEVDSALSIGNNNSF

SEQ ID NO: 2172787 - protein, 33 aa, Cryptosporidium hominis
HVVSRLVPDSGLIELLPFYSFHILSRTPVSKIP

SEQ ID NO: 2172788 - protein, 25 aa, Cryptosporidium hominis
HWMAPEILRGEGFTKYADVYSFGII

SEQ ID NO: 2172789 - protein, 21 aa, Cryptosporidium hominis
HWWYIFKKKFNMSTKGGISEE

SEQ ID NO: 2172790 - protein, 28 aa, Cryptosporidium hominis
HYASDCWDAEVLTSYGWIECAGHADRSC

SEQ ID NO: 2172791 - protein, 25 aa, Cryptosporidium hominis
HYCRVLRFEDRPDYTYLRKLFRDLM

SEQ ID NO: 2172792 - protein, 24 aa, Cryptosporidium hominis
HYEKYWLPENMNLYIDSALDYRLF

SEQ ID NO: 2172793 - protein, 22 aa, Cryptosporidium hominis
HYKKKRLVILLRIYSIKQAKAI

SEQ ID NO: 2172794 - protein, 18 aa, Cryptosporidium hominis
HYLFYPKNIQVMDLKENS

SEQ ID NO: 2172795 - protein, 23 aa, Cryptosporidium hominis
HYNTITCCTAVTWQYAPPEIVGC

SEQ ID NO: 2172796 - protein, 19 aa, Cryptosporidium hominis
HYQFVEWRISVYGKDKSEW

SEQ ID NO: 2172797 - protein, 24 aa, Cryptosporidium hominis
HYRCDRPVVLGLDMQQLSKFMKFC

SEQ ID NO: 2172798 - protein, 27 aa, Cryptosporidium hominis
HYSKFKTVCFPMFCGLSSKNIILNVGD

SEQ ID NO: 2172799 - protein, 21 aa, Cryptosporidium hominis
HYTNCKLEFLNIENIHKVRDS

SEQ ID NO: 2172800 - protein, 25 aa, Cryptosporidium hominis
HYYCPPKFPENVFRPFEYNITKLYS

SEQ ID NO: 2172801 - protein, 18 aa, Cryptosporidium hominis
IAAARELYEETGLDFRNR

SEQ ID NO: 2172802 - protein, 19 aa, Cryptosporidium hominis
IAAASIPVSCLRPGLRWIQ

SEQ ID NO: 2172803 - protein, 22 aa, Cryptosporidium hominis
IAAQYGSVVVVGERSNLVGNSA

SEQ ID NO: 2172804 - protein, 21 aa, Cryptosporidium hominis
IACNNLFRATSFLEVKPNFNN

SEQ ID NO: 2172805 - protein, 20 aa, Cryptosporidium hominis
IADKCFIGPEIEFFVFESVS

SEQ ID NO: 2172806 - protein, 21 aa, Cryptosporidium hominis
IADRRRINVALTRAKYNLWIV

SEQ ID NO: 2172807 - protein, 19 aa, Cryptosporidium hominis
IADTWLKSKVLDEAYKNGF

SEQ ID NO: 2172808 - protein, 18 aa, Cryptosporidium hominis
IAFCPSLSSPGILASASW

SEQ ID NO: 2172809 - protein, 20 aa, Cryptosporidium hominis
IAFDVKWPIIANISDLISSE

SEQ ID NO: 2172810 - protein, 23 aa, Cryptosporidium hominis
IAFFDSVCGIWRNMKEKNINNLL

SEQ ID NO: 2172811 - protein, 25 aa, Cryptosporidium hominis
IAFKRKIELLECTKVVVNKGSSHIK

SEQ ID NO: 2172812 - protein, 26 aa, Cryptosporidium hominis
IAGFGASESLIWSLSIHFRSITLQDP

SEQ ID NO: 2172813 - protein, 20 aa, Cryptosporidium hominis
IAGINRKWITGQIGNSGNNY

SEQ ID NO: 2172814 - protein, 17 aa, Cryptosporidium hominis
IAGSIVFHHFAIWAKFT

SEQ ID NO: 2172815 - protein, 24 aa, Cryptosporidium hominis
IAIFKSKRIHPVLQKDNFKAGLLF

SEQ ID NO: 2172816 - protein, 17 aa, Cryptosporidium hominis
IAIKGMGRRVFQNKGPV

SEQ ID NO: 2172817 - protein, 17 aa, Cryptosporidium hominis
IAINLSNSFGIVDIESI

SEQ ID NO: 2172818 - protein, 24 aa, Cryptosporidium hominis
IAIRRLLNILLDFIAKLDPSLGTK

SEQ ID NO: 2172819 - protein, 18 aa, Cryptosporidium hominis
IAISADWLILATDVDALF

SEQ ID NO: 2172820 - protein, 19 aa, Cryptosporidium hominis
IAISLYFSGLNCIENISTA

SEQ ID NO: 2172821 - protein, 19 aa, Cryptosporidium hominis
IAKEFIYKKIDTITQCVKA

SEQ ID NO: 2172822 - protein, 26 aa, Cryptosporidium hominis
IAKFTIIKPQVWFKRTEESLSQLEEE

SEQ ID NO: 2172823 - protein, 19 aa, Cryptosporidium hominis
IAKYELFKFNHSQRLNSVD

SEQ ID NO: 2172824 - protein, 18 aa, Cryptosporidium hominis
IALLISFDRYGKEKNNPY

SEQ ID NO: 2172825 - protein, 21 aa, Cryptosporidium hominis
IALNLIKFGGNIIISLKTALT

SEQ ID NO: 2172826 - protein, 26 aa, Cryptosporidium hominis
IANSYNWVKSVCPWDLSLSSNTWKHI

SEQ ID NO: 2172827 - protein, 31 aa, Cryptosporidium hominis
IAPSCNKCLLPGFHPITAWLLPPSYFEKGQL

SEQ ID NO: 2172828 - protein, 21 aa, Cryptosporidium hominis
IAQEEFKFWPIEVLSLPNIFK

SEQ ID NO: 2172829 - protein, 26 aa, Cryptosporidium hominis
IAQHFKFNLMRILKRIKQTEEVQVYI

SEQ ID NO: 2172830 - protein, 18 aa, Cryptosporidium hominis
IAQKLALPVDEVTEDPEC

SEQ ID NO: 2172831 - protein, 23 aa, Cryptosporidium hominis
IAQRKKLSLTFPIDHGHIDDWTK

SEQ ID NO: 2172832 - protein, 20 aa, Cryptosporidium hominis
IAQVLGFSMSSNWWDIAKFN

SEQ ID NO: 2172833 - protein, 23 aa, Cryptosporidium hominis
IARFHRILRPFMLRRVKSEVEID

SEQ ID NO: 2172834 - protein, 21 aa, Cryptosporidium hominis
IARGCLNRRTAAFIAKLRKSK

SEQ ID NO: 2172835 - protein, 25 aa, Cryptosporidium hominis
IASKMLRGEIWFHNIGIEEICDETF

SEQ ID NO: 2172836 - protein, 21 aa, Cryptosporidium hominis
IASPLGIRRVMGMSEGGKGSD

SEQ ID NO: 2172837 - protein, 18 aa, Cryptosporidium hominis
IASRIVVLRPMYSRKEAE

SEQ ID NO: 2172838 - protein, 24 aa, Cryptosporidium hominis
IASSLESAMSWVVTIGRYATYIQR

SEQ ID NO: 2172839 - protein, 17 aa, Cryptosporidium hominis
IASSSFYLPNWFSSSKI

SEQ ID NO: 2172840 - protein, 31 aa, Cryptosporidium hominis
IATFGDDTIKIWNMKGFGCVRTMIAENPVCG

SEQ ID NO: 2172841 - protein, 18 aa, Cryptosporidium hominis
IATGFPVVIKVVKKTRIM

SEQ ID NO: 2172842 - protein, 17 aa, Cryptosporidium hominis
IATILLFIKEILLSFSE

SEQ ID NO: 2172843 - protein, 25 aa, Cryptosporidium hominis
IATSILPLKRFEAMDLDEILTDDSI

SEQ ID NO: 2172844 - protein, 19 aa, Cryptosporidium hominis
IAVMMFFIYADRWNMKPLS

SEQ ID NO: 2172845 - protein, 24 aa, Cryptosporidium hominis
IAVVPCGLLYPIVFIGNIPPNVPY

SEQ ID NO: 2172846 - protein, 21 aa, Cryptosporidium hominis
IAWMDHIPVSIGWTLESTLLS

SEQ ID NO: 2172847 - protein, 25 aa, Cryptosporidium hominis
IAYKCPNLKVYVCDKNIKKIQEWNS

SEQ ID NO: 2172848 - protein, 18 aa, Cryptosporidium hominis
IAYLPGNMPLSILRYLSS

SEQ ID NO: 2172849 - protein, 21 aa, Cryptosporidium hominis
ICANLIKLGYIKGYISWEHQV

SEQ ID NO: 2172850 - protein, 20 aa, Cryptosporidium hominis
ICATPERFFTVCQVLGNVIT

SEQ ID NO: 2172851 - protein, 18 aa, Cryptosporidium hominis
ICEVCGNLFPSATSLQRH

SEQ ID NO: 2172852 - protein, 20 aa, Cryptosporidium hominis
ICGHVYKLLVEKKISSAYEW

SEQ ID NO: 2172853 - protein, 19 aa, Cryptosporidium hominis
ICGLLNGIEYCICKCDELD

SEQ ID NO: 2172854 - protein, 17 aa, Cryptosporidium hominis
ICGYPPFNAPSEFLVFC

SEQ ID NO: 2172855 - protein, 17 aa, Cryptosporidium hominis
ICIDLLVCNEGSAYVTI

SEQ ID NO: 2172856 - protein, 18 aa, Cryptosporidium hominis
ICIIPNLDRNGGFQQKPG

SEQ ID NO: 2172857 - protein, 17 aa, Cryptosporidium hominis
ICIKHLHESLKLIHCDI

SEQ ID NO: 2172858 - protein, 21 aa, Cryptosporidium hominis
ICILDGKYSMNECPIDNYHDE

SEQ ID NO: 2172859 - protein, 23 aa, Cryptosporidium hominis
ICIRLISGLKFLEFDDIETGKPS

SEQ ID NO: 2172860 - protein, 17 aa, Cryptosporidium hominis
ICIVCGTTQTSQWRFLN

SEQ ID NO: 2172861 - protein, 23 aa, Cryptosporidium hominis
ICKGIQFHISYFFLNKENPEIYL

SEQ ID NO: 2172862 - protein, 17 aa, Cryptosporidium hominis
ICLKEYFEKPLDVWSLC

SEQ ID NO: 2172863 - protein, 24 aa, Cryptosporidium hominis
ICNIGDSFLEYRFKIASLLWDNHI

SEQ ID NO: 2172864 - protein, 18 aa, Cryptosporidium hominis
ICNKLHSVWKGYKTRSIL

SEQ ID NO: 2172865 - protein, 19 aa, Cryptosporidium hominis
ICNLNLKASRGSKCRVFSR

SEQ ID NO: 2172866 - protein, 24 aa, Cryptosporidium hominis
ICNYIVPICSSFLASLIDSENRMQ

SEQ ID NO: 2172867 - protein, 21 aa, Cryptosporidium hominis
ICQKSGFPKVKFTNFKMENII

SEQ ID NO: 2172868 - protein, 25 aa, Cryptosporidium hominis
ICRAYMRLALEWYPDGNRSDTELKG

SEQ ID NO: 2172869 - protein, 20 aa, Cryptosporidium hominis
ICRDVNCTFAHSINDLRTTE

SEQ ID NO: 2172870 - protein, 19 aa, Cryptosporidium hominis
ICREEELYTLFSHINGFKE

SEQ ID NO: 2172871 - protein, 24 aa, Cryptosporidium hominis
ICRREKTPHMLIDFSDVLQTPVKV

SEQ ID NO: 2172872 - protein, 32 aa, Cryptosporidium hominis
ICSIEWKNRFFFGFALREHYGPIPLNALSSSL

SEQ ID NO: 2172873 - protein, 30 aa, Cryptosporidium hominis
ICSIGRLKPEFIKDLLLIQINSFWSSSSRY

SEQ ID NO: 2172874 - protein, 29 aa, Cryptosporidium hominis
ICSLYTPGIYRLACGQVYGAANYLGMTSL

SEQ ID NO: 2172875 - protein, 18 aa, Cryptosporidium hominis
ICSPRIRASNVINDQLSG

SEQ ID NO: 2172876 - protein, 26 aa, Cryptosporidium hominis
ICSQFRRLGCSLDWSREFFTLDENMS

SEQ ID NO: 2172877 - protein, 17 aa, Cryptosporidium hominis
ICTVLRKNVDAVRFYTK

SEQ ID NO: 2172878 - protein, 22 aa, Cryptosporidium hominis
ICVADGVGGWISQGVSSAMYSR

SEQ ID NO: 2172879 - protein, 24 aa, Cryptosporidium hominis
ICYEFLTQSLVCFEEELAESKRQF

SEQ ID NO: 2172880 - protein, 19 aa, Cryptosporidium hominis
ICYLDFAQRWVYQQDCNKF

SEQ ID NO: 2172881 - protein, 17 aa, Cryptosporidium hominis
IDCKYSHDFVQEIVDKN

SEQ ID NO: 2172882 - protein, 17 aa, Cryptosporidium hominis
IDCPSKYDMLMAMANNV

SEQ ID NO: 2172883 - protein, 24 aa, Cryptosporidium hominis
IDDELRIIHTLGIKPINAEQVNQE

SEQ ID NO: 2172884 - protein, 20 aa, Cryptosporidium hominis
IDDWLCGSIPLSKKQEYQLF

SEQ ID NO: 2172885 - protein, 24 aa, Cryptosporidium hominis
IDDYSVRVVDVFSMPQSGNSVSVE

SEQ ID NO: 2172886 - protein, 18 aa, Cryptosporidium hominis
IDECTQIAMDLSRNVNKF

SEQ ID NO: 2172887 - protein, 20 aa, Cryptosporidium hominis
IDEDDWYAGLGVVPISSEKT

SEQ ID NO: 2172888 - protein, 25 aa, Cryptosporidium hominis
IDEIDKFLLSFGLRKVGMHIIFLFE

SEQ ID NO: 2172889 - protein, 17 aa, Cryptosporidium hominis
IDELEHLNINLKRNEDV

SEQ ID NO: 2172890 - protein, 20 aa, Cryptosporidium hominis
IDFFECFDFSDSTKKKIFES

SEQ ID NO: 2172891 - protein, 22 aa, Cryptosporidium hominis
IDFFKVVFAIVVIDSYVSILCN

SEQ ID NO: 2172892 - protein, 24 aa, Cryptosporidium hominis
IDFFRERYIMFASRLFSQIVKEIE

SEQ ID NO: 2172893 - protein, 19 aa, Cryptosporidium hominis
IDFKEAFVSPVTLKIVKLG

SEQ ID NO: 2172894 - protein, 17 aa, Cryptosporidium hominis
IDFTLSIGRLNTDPLMN

SEQ ID NO: 2172895 - protein, 23 aa, Cryptosporidium hominis
IDGNPSWMFEKAFKTLKEKIPTC

SEQ ID NO: 2172896 - protein, 19 aa, Cryptosporidium hominis
IDGTLDWVFCPSTDKDHDK

SEQ ID NO: 2172897 - protein, 24 aa, Cryptosporidium hominis
IDHASKIESIQCEIVKTFKNLTLS

SEQ ID NO: 2172898 - protein, 26 aa, Cryptosporidium hominis
IDHFMFKICLLFSIQIVPISNDHTER

SEQ ID NO: 2172899 - protein, 18 aa, Cryptosporidium hominis
IDICLPLHTSSCFIHLLR

SEQ ID NO: 2172900 - protein, 29 aa, Cryptosporidium hominis
IDIELGKGWKIFLARSVDLGRWAIIQKLS

SEQ ID NO: 2172901 - protein, 30 aa, Cryptosporidium hominis
IDIERARVSGRHWGIIELDSEFSCKTLLNN

SEQ ID NO: 2172902 - protein, 19 aa, Cryptosporidium hominis
IDIEYIKEFINNYKLPNNS

SEQ ID NO: 2172903 - protein, 27 aa, Cryptosporidium hominis
IDIGVVPQCCWIWSTYVFLKIIKSFTF

SEQ ID NO: 2172904 - protein, 18 aa, Cryptosporidium hominis
IDIHSGGIDLRFPHHDNE

SEQ ID NO: 2172905 - protein, 21 aa, Cryptosporidium hominis
IDIKRSLKLLINNNSSSWTKN

SEQ ID NO: 2172906 - protein, 20 aa, Cryptosporidium hominis
IDILVCVALGADMFDCVYPC

SEQ ID NO: 2172907 - protein, 17 aa, Cryptosporidium hominis
IDIPIILGKIEKPRNSL

SEQ ID NO: 2172908 - protein, 25 aa, Cryptosporidium hominis
IDIRKLCRCAICYDPGKAQFNETYE

SEQ ID NO: 2172909 - protein, 22 aa, Cryptosporidium hominis
IDIYRRCKIYEDSGSFVRHVTI

SEQ ID NO: 2172910 - protein, 29 aa, Cryptosporidium hominis
IDKGTHYEFKFLDGLFVFDPSIKGKNESN

SEQ ID NO: 2172911 - protein, 18 aa, Cryptosporidium hominis
IDLARGIFTSNLINFDTW

SEQ ID NO: 2172912 - protein, 24 aa, Cryptosporidium hominis
IDLDEIKKAYSLFIDVKRSTQYLI

SEQ ID NO: 2172913 - protein, 25 aa, Cryptosporidium hominis
IDLIKWRLIPNFEQIHFKNLKFLIV

SEQ ID NO: 2172914 - protein, 19 aa, Cryptosporidium hominis
IDLKMVKFKNVNFIQIYIS

SEQ ID NO: 2172915 - protein, 23 aa, Cryptosporidium hominis
IDLLRSSSCNLCLHEDDLNSSVI

SEQ ID NO: 2172916 - protein, 19 aa, Cryptosporidium hominis
IDLNLMWQSSIYSLKTKSS

SEQ ID NO: 2172917 - protein, 22 aa, Cryptosporidium hominis
IDLPLPRINCGMFLRGNIIYIY

SEQ ID NO: 2172918 - protein, 17 aa, Cryptosporidium hominis
IDLPTCLNSDNLYRALR

SEQ ID NO: 2172919 - protein, 18 aa, Cryptosporidium hominis
IDLSIPYAGIPISHLVLC

SEQ ID NO: 2172920 - protein, 25 aa, Cryptosporidium hominis
IDLSNSLFISNCANYKLSKRDDSWS

SEQ ID NO: 2172921 - protein, 20 aa, Cryptosporidium hominis
IDLVICDEAHRLKNDKTKTA

SEQ ID NO: 2172922 - protein, 17 aa, Cryptosporidium hominis
IDMKPFLNQGLPIWERV

SEQ ID NO: 2172923 - protein, 18 aa, Cryptosporidium hominis
IDMKRWYLDQQILYPGGT

SEQ ID NO: 2172924 - protein, 18 aa, Cryptosporidium hominis
IDMKSIYLTPDFMDKKNR

SEQ ID NO: 2172925 - protein, 26 aa, Cryptosporidium hominis
IDMLFNRKEYMNALNLSLGQKLQYKT

SEQ ID NO: 2172926 - protein, 24 aa, Cryptosporidium hominis
IDMLNIPIWLYKESGSLTVNGPFS

SEQ ID NO: 2172927 - protein, 21 aa, Cryptosporidium hominis
IDMYTRINSLLTFMNEPAKSE

SEQ ID NO: 2172928 - protein, 24 aa, Cryptosporidium hominis
IDNRRKRGSISFHVKPKVNLSYPR

SEQ ID NO: 2172929 - protein, 30 aa, Cryptosporidium hominis
IDNSSLWNSFELILRPELKKLNFNIENIIK

SEQ ID NO: 2172930 - protein, 17 aa, Cryptosporidium hominis
IDPHPAISKLPLSDTRL

SEQ ID NO: 2172931 - protein, 20 aa, Cryptosporidium hominis
IDQEHFEIFDPVYPSMTEIF

SEQ ID NO: 2172932 - protein, 26 aa, Cryptosporidium hominis
IDQELKSVEKYSCFEHNSNIDRLSSS

SEQ ID NO: 2172933 - protein, 18 aa, Cryptosporidium hominis
IDQLFGIFRLVGTPLGTS

SEQ ID NO: 2172934 - protein, 23 aa, Cryptosporidium hominis
IDQRLHDVFNFIRTGGIMLGDGK

SEQ ID NO: 2172935 - protein, 17 aa, Cryptosporidium hominis
IDRHIIAAVAGLTADAN

SEQ ID NO: 2172936 - protein, 18 aa, Cryptosporidium hominis
IDRILRLESGGVIQPVSF

SEQ ID NO: 2172937 - protein, 21 aa, Cryptosporidium hominis
IDRPSLPSVELLNAHDELINI

SEQ ID NO: 2172938 - protein, 19 aa, Cryptosporidium hominis
IDSAWSGGVNGLFFVSYFL

SEQ ID NO: 2172939 - protein, 31 aa, Cryptosporidium hominis
IDSLLKLSFGYGWNLLHIFSYLEHIETLQLL

SEQ ID NO: 2172940 - protein, 25 aa, Cryptosporidium hominis
IDSLPPYLLVQLVRFEWKKSSEIAR

SEQ ID NO: 2172941 - protein, 27 aa, Cryptosporidium hominis
IDSNKSFKLSICNANELIIECKHADSG

SEQ ID NO: 2172942 - protein, 22 aa, Cryptosporidium hominis
IDSTGWYDLISMILASSNKIVD

SEQ ID NO: 2172943 - protein, 25 aa, Cryptosporidium hominis
IDSTNIFKRQLVKEINEEERNFKMV

SEQ ID NO: 2172944 - protein, 26 aa, Cryptosporidium hominis
IDSVRVSLKFYFKCEFERRLFNQLTI

SEQ ID NO: 2172945 - protein, 29 aa, Cryptosporidium hominis
  misc_feature (25)..(25): Xaa can be any naturally occurring amino acid
IDTNRVGVEVSKTFNIWQLTNIKEXPADT

SEQ ID NO: 2172946 - protein, 25 aa, Cryptosporidium hominis
IDVIWRKIFTQEFVKITLDDVYVIF

SEQ ID NO: 2172947 - protein, 29 aa, Cryptosporidium hominis
IDWKPNPLCWDNLRKAFCSGYFHNSARIR

SEQ ID NO: 2172948 - protein, 17 aa, Cryptosporidium hominis
IDWTRIDFIDNKVIIDS

SEQ ID NO: 2172949 - protein, 21 aa, Cryptosporidium hominis
IDYLEWIHARLEYMTKGSRIN

SEQ ID NO: 2172950 - protein, 17 aa, Cryptosporidium hominis
IDYLLAFINKNSKEFLA

SEQ ID NO: 2172951 - protein, 25 aa, Cryptosporidium hominis
IDYLRNDYKFGFMMQFFPNEKDDKL

SEQ ID NO: 2172952 - protein, 26 aa, Cryptosporidium hominis
IDYQKLRTPFWIWLSVNDEWNYSLEW

SEQ ID NO: 2172953 - protein, 20 aa, Cryptosporidium hominis
IEADRIFLNYLYRKPQGQGY

SEQ ID NO: 2172954 - protein, 18 aa, Cryptosporidium hominis
IEAGRMLLEKGFKFDVVY

SEQ ID NO: 2172955 - protein, 17 aa, Cryptosporidium hominis
IEAVRRALLRELRTVIS

SEQ ID NO: 2172956 - protein, 17 aa, Cryptosporidium hominis
IECFLRKNRENSAMKIE

SEQ ID NO: 2172957 - protein, 23 aa, Cryptosporidium hominis
IECNEMKNFIGPIIQGKVAKDIC

SEQ ID NO: 2172958 - protein, 20 aa, Cryptosporidium hominis
IECPKGYKLDEEALLLLPPE

SEQ ID NO: 2172959 - protein, 17 aa, Cryptosporidium hominis
IEDALNFVIRTFGRDYC

SEQ ID NO: 2172960 - protein, 19 aa, Cryptosporidium hominis
IEDGIPFNGIEIAISSDNL

SEQ ID NO: 2172961 - protein, 32 aa, Cryptosporidium hominis
IEDKEWLSRLEIICGWLGELARVIRHLVKHFP

SEQ ID NO: 2172962 - protein, 24 aa, Cryptosporidium hominis
IEDLKAQLEREIAELNSEYRSNLS

SEQ ID NO: 2172963 - protein, 23 aa, Cryptosporidium hominis
IEDLYQKRIHEINKLVNNDVWSL

SEQ ID NO: 2172964 - protein, 24 aa, Cryptosporidium hominis
IEEALKLKDEFSIDIKESQTKEAE

SEQ ID NO: 2172965 - protein, 21 aa, Cryptosporidium hominis
IEEDVRWLGVDWGEHKYYASD

SEQ ID NO: 2172966 - protein, 24 aa, Cryptosporidium hominis
IEEFPHIRLGPSVSQVLTTLTNGF

SEQ ID NO: 2172967 - protein, 26 aa, Cryptosporidium hominis
IEEFYLMMRFRWDGMDHYRMDKFTFL

SEQ ID NO: 2172968 - protein, 24 aa, Cryptosporidium hominis
IEEGERRAGVGVGEEEEEEEEVIM

SEQ ID NO: 2172969 - protein, 26 aa, Cryptosporidium hominis
IEEIFFLKFSDLISELLIIGSKFVDS

SEQ ID NO: 2172970 - protein, 22 aa, Cryptosporidium hominis
IEEIKECLEVYIPIGSKSFVPC

SEQ ID NO: 2172971 - protein, 19 aa, Cryptosporidium hominis
IEEINKILLDLGKAADTYR

SEQ ID NO: 2172972 - protein, 17 aa, Cryptosporidium hominis
IEEKIEFSLSVDGKIQS

SEQ ID NO: 2172973 - protein, 23 aa, Cryptosporidium hominis
IEELSKWFSKMVGKFETFGLNIQ

SEQ ID NO: 2172974 - protein, 19 aa, Cryptosporidium hominis
IEEPKNYLLELERLHSVLI

SEQ ID NO: 2172975 - protein, 24 aa, Cryptosporidium hominis
IEERYGKCRFQVINTIEMDDIVEL

SEQ ID NO: 2172976 - protein, 22 aa, Cryptosporidium hominis
IEFDLPFLLNICNTKQYKRLKA

SEQ ID NO: 2172977 - protein, 27 aa, Cryptosporidium hominis
IEGGSIGARGADIWMGGGGSSMGIGGR

SEQ ID NO: 2172978 - protein, 17 aa, Cryptosporidium hominis
IEGLPPLIVEYSSLNAK

SEQ ID NO: 2172979 - protein, 19 aa, Cryptosporidium hominis
IEHIAKFSFSYKNIPSAVN

SEQ ID NO: 2172980 - protein, 24 aa, Cryptosporidium hominis
IEHLRPTFWFSGHHHCFFDASIEF

SEQ ID NO: 2172981 - protein, 17 aa, Cryptosporidium hominis
IEHVIKCPLSKRQKELY

SEQ ID NO: 2172982 - protein, 18 aa, Cryptosporidium hominis
IEICFKKIDSKLHIIEEG

SEQ ID NO: 2172983 - protein, 26 aa, Cryptosporidium hominis
IEIDFTTPWKRFSFVEEIESGLGEKL

SEQ ID NO: 2172984 - protein, 18 aa, Cryptosporidium hominis
IEIGFLILDLGSFIMSIR

SEQ ID NO: 2172985 - protein, 28 aa, Cryptosporidium hominis
IEINLWFCIKYLEYYGSGRKHERSLSDK

SEQ ID NO: 2172986 - protein, 17 aa, Cryptosporidium hominis
IEISVLTSSLGFESNFD

SEQ ID NO: 2172987 - protein, 21 aa, Cryptosporidium hominis
IEKFPHLVFHSSGNSSQQPQN

SEQ ID NO: 2172988 - protein, 24 aa, Cryptosporidium hominis
IEKISRHLIMNFGYTDLLLRFTTP

SEQ ID NO: 2172989 - protein, 22 aa, Cryptosporidium hominis
IEKKKFTGFGIWEDIQKKYGKE

SEQ ID NO: 2172990 - protein, 31 aa, Cryptosporidium hominis
IEKNFKPRSMKMIFTRWLSFEKEFGSLQTQK

SEQ ID NO: 2172991 - protein, 27 aa, Cryptosporidium hominis
IEKNKWILDSACEIIRIPLPENPIENV

SEQ ID NO: 2172992 - protein, 26 aa, Cryptosporidium hominis
IEKRKVSLQKGLSLQMNPTMTALTYQ

SEQ ID NO: 2172993 - protein, 22 aa, Cryptosporidium hominis
IEKRRIKTYTRLRIINEAKSKG

SEQ ID NO: 2172994 - protein, 20 aa, Cryptosporidium hominis
IEKVKFILYRNLMRRIRNWC

SEQ ID NO: 2172995 - protein, 18 aa, Cryptosporidium hominis
IELEFKSMELDWERRALE

SEQ ID NO: 2172996 - protein, 24 aa, Cryptosporidium hominis
IELFWKNLKFHTSNYILKYLNLYL

SEQ ID NO: 2172997 - protein, 17 aa, Cryptosporidium hominis
IELKFDIQSPIPNSLEK

SEQ ID NO: 2172998 - protein, 23 aa, Cryptosporidium hominis
IELKKIKNSLIHFSEETVNEDNE

SEQ ID NO: 2172999 - protein, 24 aa, Cryptosporidium hominis
IELLKGSGVGALISSMIQYKPSDG

SEQ ID NO: 2173000 - protein, 25 aa, Cryptosporidium hominis
IELLQQVCILVSYLSIGNLRDESFS

SEQ ID NO: 2173001 - protein, 27 aa, Cryptosporidium hominis
IELPFFVPSCVSLPFGTLNKLLNSSTF

SEQ ID NO: 2173002 - protein, 22 aa, Cryptosporidium hominis
IELQEGFRLSSDIERKLYPDGP

SEQ ID NO: 2173003 - protein, 34 aa, Cryptosporidium hominis
IELRKRFARKCLRRCILVTDLVSWMKNRFIVLIR

SEQ ID NO: 2173004 - protein, 25 aa, Cryptosporidium hominis
IELRVRLVPCIIRYDENIYASALND

SEQ ID NO: 2173005 - protein, 24 aa, Cryptosporidium hominis
IELSHPIRLYCRFVDKLYIIIKLS

SEQ ID NO: 2173006 - protein, 21 aa, Cryptosporidium hominis
IELTILIPNKIDWERLEGKQS

SEQ ID NO: 2173007 - protein, 17 aa, Cryptosporidium hominis
IELYKQYLAQWLKNAED

SEQ ID NO: 2173008 - protein, 25 aa, Cryptosporidium hominis
IEMEWDLRCNICLNLQETLNLLDHL

SEQ ID NO: 2173009 - protein, 18 aa, Cryptosporidium hominis
IENEGHRGIPRAIDISQD

SEQ ID NO: 2173010 - protein, 25 aa, Cryptosporidium hominis
IENEIFDLLSKCPHFHTGETSSENK

SEQ ID NO: 2173011 - protein, 24 aa, Cryptosporidium hominis
IENELRENFPLIFCGLSNGEWRTY

SEQ ID NO: 2173012 - protein, 21 aa, Cryptosporidium hominis
IENIKSLQFRAQDSIESVISE

SEQ ID NO: 2173013 - protein, 20 aa, Cryptosporidium hominis
IENKFYWSLCTSNVPSTSVD

SEQ ID NO: 2173014 - protein, 28 aa, Cryptosporidium hominis
IENRFPAILRRFYLDFFSFCCKDDFGEV

SEQ ID NO: 2173015 - protein, 26 aa, Cryptosporidium hominis
IENSLSLQLFRDFIMGVSSYSSEHRL

SEQ ID NO: 2173016 - protein, 18 aa, Cryptosporidium hominis
IENYWLKSSNGFEDSNSN

SEQ ID NO: 2173017 - protein, 24 aa, Cryptosporidium hominis
IEPCTEIPGNFTFSVTGVNLSHLI

SEQ ID NO: 2173018 - protein, 26 aa, Cryptosporidium hominis
IEPFPDCSTIELWKSNISRQMDTIFL

SEQ ID NO: 2173019 - protein, 20 aa, Cryptosporidium hominis
IEPPPWRKLNRPLKYINDQI

SEQ ID NO: 2173020 - protein, 17 aa, Cryptosporidium hominis
IEPRFAINISSRSENIC

SEQ ID NO: 2173021 - protein, 17 aa, Cryptosporidium hominis
IEPTPLFIDAVKMVKPE

SEQ ID NO: 2173022 - protein, 18 aa, Cryptosporidium hominis
IERDFKLIQELFTEHVKR

SEQ ID NO: 2173023 - protein, 23 aa, Cryptosporidium hominis
IERFNEVKLYFDFDHSNLAKTQN

SEQ ID NO: 2173024 - protein, 17 aa, Cryptosporidium hominis
IERIFKLGTYSNVNNQE

SEQ ID NO: 2173025 - protein, 29 aa, Cryptosporidium hominis
IERLSLKLASRISQVSIFCERLNSRRSCE

SEQ ID NO: 2173026 - protein, 17 aa, Cryptosporidium hominis
IESFSYFDSDKISQRIK

SEQ ID NO: 2173027 - protein, 20 aa, Cryptosporidium hominis
IESIESLKLFTERFDIKIFN

SEQ ID NO: 2173028 - protein, 17 aa, Cryptosporidium hominis
IESINEFILLNWTPGEQ

SEQ ID NO: 2173029 - protein, 24 aa, Cryptosporidium hominis
IESISAIFFLRNLKRLSLVNNPIT

SEQ ID NO: 2173030 - protein, 17 aa, Cryptosporidium hominis
IESSALRTAKNDSKVEY

SEQ ID NO: 2173031 - protein, 18 aa, Cryptosporidium hominis
IESSGIITGFDHWYKIQL

SEQ ID NO: 2173032 - protein, 22 aa, Cryptosporidium hominis
IESTTPRCLQKFQPLSNYLSLI

SEQ ID NO: 2173033 - protein, 17 aa, Cryptosporidium hominis
IESVCATSSVPINENDQ

SEQ ID NO: 2173034 - protein, 26 aa, Cryptosporidium hominis
IETDFKLSIPILIELIKKDNLDEIED

SEQ ID NO: 2173035 - protein, 25 aa, Cryptosporidium hominis
IETDSSCSIYHFIPSERNFHKTKLI

SEQ ID NO: 2173036 - protein, 18 aa, Cryptosporidium hominis
IETLLIFSLSDEKWSLLP

SEQ ID NO: 2173037 - protein, 25 aa, Cryptosporidium hominis
IETLNEILPLIAQRIVFSNIINSNN

SEQ ID NO: 2173038 - protein, 17 aa, Cryptosporidium hominis
IETLQLLLEHFSFEEQI

SEQ ID NO: 2173039 - protein, 17 aa, Cryptosporidium hominis
IETSFLPLITFDFEFPY

SEQ ID NO: 2173040 - protein, 24 aa, Cryptosporidium hominis
IETTTSCSLIWEGVRPSRIFFKWK

SEQ ID NO: 2173041 - protein, 18 aa, Cryptosporidium hominis
IEVDSMLTKWLREHQRQG

SEQ ID NO: 2173042 - protein, 19 aa, Cryptosporidium hominis
IEVFNWSASGSIILEGLSI

SEQ ID NO: 2173043 - protein, 24 aa, Cryptosporidium hominis
IEVFPVLLEKGSTRLAIYGIGNIR

SEQ ID NO: 2173044 - protein, 20 aa, Cryptosporidium hominis
IEVKSKIPILKTITIVLSFV

SEQ ID NO: 2173045 - protein, 21 aa, Cryptosporidium hominis
IEVRRAISWLFSESLSNANEM

SEQ ID NO: 2173046 - protein, 19 aa, Cryptosporidium hominis
IEWKVLKKALRKEIVLKGN

SEQ ID NO: 2173047 - protein, 17 aa, Cryptosporidium hominis
IEYARGDTHYLLYIYDI

SEQ ID NO: 2173048 - protein, 21 aa, Cryptosporidium hominis
IEYDFCKMVSKKSKLDDSDSK

SEQ ID NO: 2173049 - protein, 19 aa, Cryptosporidium hominis
IEYKKQRFAMDKLISNFKQ

SEQ ID NO: 2173050 - protein, 17 aa, Cryptosporidium hominis
IEYRKKMEKEFYVVPNT

SEQ ID NO: 2173051 - protein, 18 aa, Cryptosporidium hominis
IEYSPWIMYRIYFSNQVK

SEQ ID NO: 2173052 - protein, 21 aa, Cryptosporidium hominis
IFADGRAKLMVKKTSDNNYQS

SEQ ID NO: 2173053 - protein, 25 aa, Cryptosporidium hominis
IFAFEGDLWIKINIEFLDKYVSFFN

SEQ ID NO: 2173054 - protein, 20 aa, Cryptosporidium hominis
IFALKLSKLQWKYLDETISK

SEQ ID NO: 2173055 - protein, 17 aa, Cryptosporidium hominis
IFALKSRGTKWCLTGTP

SEQ ID NO: 2173056 - protein, 26 aa, Cryptosporidium hominis
IFAPCKSCKLGMAYPISYNAVLCKKC

SEQ ID NO: 2173057 - protein, 17 aa, Cryptosporidium hominis
IFCELSVHSSNKIINEN

SEQ ID NO: 2173058 - protein, 18 aa, Cryptosporidium hominis
IFCMNRKNVFSFSDTAIK

SEQ ID NO: 2173059 - protein, 19 aa, Cryptosporidium hominis
IFCYQMINWIILGKLVDPF

SEQ ID NO: 2173060 - protein, 39 aa, Cryptosporidium hominis
IFDEVQFAPAPAFRRINGIVKAHCKLGLTATLVREDDLI

SEQ ID NO: 2173061 - protein, 26 aa, Cryptosporidium hominis
IFDIISSNLLDWVKFKSPAICCVFDH

SEQ ID NO: 2173062 - protein, 21 aa, Cryptosporidium hominis
IFEKMKNYLVELSIDSHSSKM

SEQ ID NO: 2173063 - protein, 25 aa, Cryptosporidium hominis
IFEMITNRCGVVFSECKSYPVEEAK

SEQ ID NO: 2173064 - protein, 21 aa, Cryptosporidium hominis
IFESLDLAWELLRTFPEDMLK

SEQ ID NO: 2173065 - protein, 18 aa, Cryptosporidium hominis
IFFGKPIRDFSSFSNVIR

SEQ ID NO: 2173066 - protein, 17 aa, Cryptosporidium hominis
IFFSNIFCRNTNIAQQI

SEQ ID NO: 2173067 - protein, 20 aa, Cryptosporidium hominis
IFFYSIDCKYSHDFVQEIVD

SEQ ID NO: 2173068 - protein, 19 aa, Cryptosporidium hominis
IFGNFRWNNKRRRLGSYIA

SEQ ID NO: 2173069 - protein, 18 aa, Cryptosporidium hominis
IFIDEIDSIFSKRTSKDD

SEQ ID NO: 2173070 - protein, 25 aa, Cryptosporidium hominis
IFIENCVGCIFLVNGVISSIEIVNC

SEQ ID NO: 2173071 - protein, 20 aa, Cryptosporidium hominis
IFIKELLNSLLISTENEEID

SEQ ID NO: 2173072 - protein, 23 aa, Cryptosporidium hominis
IFIKSHILSLYLYYNQEYDTQKS

SEQ ID NO: 2173073 - protein, 24 aa, Cryptosporidium hominis
IFKLLENIPMPWERVKYVDCLYHT

SEQ ID NO: 2173074 - protein, 17 aa, Cryptosporidium hominis
IFLAIGIHSHESPISQI

SEQ ID NO: 2173075 - protein, 18 aa, Cryptosporidium hominis
IFLALKLYLVQRESSMGL

SEQ ID NO: 2173076 - protein, 18 aa, Cryptosporidium hominis
IFLKNFLKLCNIIKNKSF

SEQ ID NO: 2173077 - protein, 20 aa, Cryptosporidium hominis
IFLLRAVLVLLSLNKTQFAH

SEQ ID NO: 2173078 - protein, 27 aa, Cryptosporidium hominis
IFLNNKIEMLKILAANFGATQEDIEAT

SEQ ID NO: 2173079 - protein, 19 aa, Cryptosporidium hominis
IFLSDGRFHLESAMIQNPS

SEQ ID NO: 2173080 - protein, 19 aa, Cryptosporidium hominis
IFLYILKLWLLCWPSPISL

SEQ ID NO: 2173081 - protein, 19 aa, Cryptosporidium hominis
IFNCPICPYFGRNSISHSF

SEQ ID NO: 2173082 - protein, 18 aa, Cryptosporidium hominis
IFNDECVHIPSLETQPFP

SEQ ID NO: 2173083 - protein, 17 aa, Cryptosporidium hominis
IFNECLYIHGGEYSTEN

SEQ ID NO: 2173084 - protein, 27 aa, Cryptosporidium hominis
IFNFVTGFIIKFRLPIDPHILSYYLKE

SEQ ID NO: 2173085 - protein, 19 aa, Cryptosporidium hominis
IFNSKHIYEIYSLHKSIQV

SEQ ID NO: 2173086 - protein, 28 aa, Cryptosporidium hominis
IFRNYLRCLLKAGFPHIVLTTLLNTNKI

SEQ ID NO: 2173087 - protein, 19 aa, Cryptosporidium hominis
IFSCEGCGSKTKSKLSCPQ

SEQ ID NO: 2173088 - protein, 19 aa, Cryptosporidium hominis
IFSFSKELFTSFKNNEMNA

SEQ ID NO: 2173089 - protein, 24 aa, Cryptosporidium hominis
IFSKLELLRNYLLKVKKNESDFLE

SEQ ID NO: 2173090 - protein, 20 aa, Cryptosporidium hominis
IFSLARRALVSWAENHQDQT

SEQ ID NO: 2173091 - protein, 19 aa, Cryptosporidium hominis
IFSSHGGELIFVIRPAPSM

SEQ ID NO: 2173092 - protein, 19 aa, Cryptosporidium hominis
IFSSPAIIIGYYLQSSEYT

SEQ ID NO: 2173093 - protein, 25 aa, Cryptosporidium hominis
IFSYFKQIISLFGINNLYISFEPFQ

SEQ ID NO: 2173094 - protein, 28 aa, Cryptosporidium hominis
IFTKLSKWTRYIFPEADDPLLTYLYDDG

SEQ ID NO: 2173095 - protein, 25 aa, Cryptosporidium hominis
IFTSKLAIVPLIFGIQGSNKSSVII

SEQ ID NO: 2173096 - protein, 17 aa, Cryptosporidium hominis
IFTSNLINFDTWMIEVE

SEQ ID NO: 2173097 - protein, 26 aa, Cryptosporidium hominis
IFVLFNFKLKLNKEIGNSLCELEIMD

SEQ ID NO: 2173098 - protein, 31 aa, Cryptosporidium hominis
IFWERRPGLYCLPRSCIKGGGNLLGTGLDTI

SEQ ID NO: 2173099 - protein, 19 aa, Cryptosporidium hominis
IFWGLWGICKSDIRSNNSS

SEQ ID NO: 2173100 - protein, 17 aa, Cryptosporidium hominis
IFYGCLTSIFAGSLPSS

SEQ ID NO: 2173101 - protein, 17 aa, Cryptosporidium hominis
IGAFYIRSKPRRRIKPL

SEQ ID NO: 2173102 - protein, 19 aa, Cryptosporidium hominis
IGAPFCQNSTFSLKYDYNN

SEQ ID NO: 2173103 - protein, 18 aa, Cryptosporidium hominis
IGDEIEVRPGIYNKDADG

SEQ ID NO: 2173104 - protein, 23 aa, Cryptosporidium hominis
IGDNISMVYFRLSTFFASSTYRN

SEQ ID NO: 2173105 - protein, 19 aa, Cryptosporidium hominis
IGDNMPILFSTASGKKVSI

SEQ ID NO: 2173106 - protein, 17 aa, Cryptosporidium hominis
IGDPISLCLEIEDLPGI

SEQ ID NO: 2173107 - protein, 26 aa, Cryptosporidium hominis
IGELNMYLKPVFGIFHGFSGTKFWRR

SEQ ID NO: 2173108 - protein, 20 aa, Cryptosporidium hominis
IGESWPFDQYQATGLLPVDY

SEQ ID NO: 2173109 - protein, 25 aa, Cryptosporidium hominis
IGEVGCTYHALGWISGDVNVVAIDC

SEQ ID NO: 2173110 - protein, 24 aa, Cryptosporidium hominis
IGFFPLKSSYIWVITTKKTVSEKI

SEQ ID NO: 2173111 - protein, 19 aa, Cryptosporidium hominis
IGFIKFIPLIGKEVITTPI

SEQ ID NO: 2173112 - protein, 30 aa, Cryptosporidium hominis
IGFKGGIILPNKHIWLITEFIQGCDLHSLK

SEQ ID NO: 2173113 - protein, 17 aa, Cryptosporidium hominis
IGFNILMSSEFNSAFDP

SEQ ID NO: 2173114 - protein, 17 aa, Cryptosporidium hominis
IGFTKCFYGRIQHNSDV

SEQ ID NO: 2173115 - protein, 26 aa, Cryptosporidium hominis
IGGHSFPIYCMELLGSKGSQSIITID

SEQ ID NO: 2173116 - protein, 18 aa, Cryptosporidium hominis
IGGLPGLLLTLIGVGVQK

SEQ ID NO: 2173117 - protein, 23 aa, Cryptosporidium hominis
IGHNSFHPYSCSQSSKSTVSTNN

SEQ ID NO: 2173118 - protein, 24 aa, Cryptosporidium hominis
IGHRVGQLGSRVWSMMCNPHLISR

SEQ ID NO: 2173119 - protein, 28 aa, Cryptosporidium hominis
IGHSGEIYLNIESWKGSNKGTKFTICMI

SEQ ID NO: 2173120 - protein, 20 aa, Cryptosporidium hominis
IGICIPKFEINICHLVSDSK

SEQ ID NO: 2173121 - protein, 25 aa, Cryptosporidium hominis
IGILDIYGFEVFKVNGFEQFLINFA

SEQ ID NO: 2173122 - protein, 20 aa, Cryptosporidium hominis
IGIRVPECLLNPEMIINDSE

SEQ ID NO: 2173123 - protein, 27 aa, Cryptosporidium hominis
IGIWNIRTGKCLKRLSAHINAKSVSVI

SEQ ID NO: 2173124 - protein, 17 aa, Cryptosporidium hominis
IGKEENIVFGRLSDMCH

SEQ ID NO: 2173125 - protein, 26 aa, Cryptosporidium hominis
IGKEFKELRRQLGWEKNTEKNFKNEE

SEQ ID NO: 2173126 - protein, 21 aa, Cryptosporidium hominis
IGKFPFKVTPFFFFKKNNLGI

SEQ ID NO: 2173127 - protein, 25 aa, Cryptosporidium hominis
IGKPIIKQRLNEMYTNRNLNTSTTN

SEQ ID NO: 2173128 - protein, 25 aa, Cryptosporidium hominis
IGKYYNWKDCEAVLSPSRSISSPIK

SEQ ID NO: 2173129 - protein, 18 aa, Cryptosporidium hominis
IGLDGAVEFEWLYCILKY

SEQ ID NO: 2173130 - protein, 18 aa, Cryptosporidium hominis
IGLDLRGNEKMIKRIGLK

SEQ ID NO: 2173131 - protein, 25 aa, Cryptosporidium hominis
IGLKYVPEVIEWRISKNIGGNKAEY

SEQ ID NO: 2173132 - protein, 21 aa, Cryptosporidium hominis
  misc_feature (17)..(17): Xaa can be any naturally occurring amino acid
IGLLDIYGFEVFDCNSXEQFC

SEQ ID NO: 2173133 - protein, 18 aa, Cryptosporidium hominis
IGLSKCLQKKLIKLNKEL

SEQ ID NO: 2173134 - protein, 19 aa, Cryptosporidium hominis
IGMEFWKQLCTEHGLDANG

SEQ ID NO: 2173135 - protein, 24 aa, Cryptosporidium hominis
IGMKNCAMPILPTMNEGVIGEIPN

SEQ ID NO: 2173136 - protein, 17 aa, Cryptosporidium hominis
IGNACKLIVERSPVSRR

SEQ ID NO: 2173137 - protein, 25 aa, Cryptosporidium hominis
IGNALFPMFWSSFLASQQFNNTHSF

SEQ ID NO: 2173138 - protein, 25 aa, Cryptosporidium hominis
IGNHARFMNHCCDPNSICKVISIDS

SEQ ID NO: 2173139 - protein, 19 aa, Cryptosporidium hominis
IGNQYPEFSCDVSNTQTVY

SEQ ID NO: 2173140 - protein, 18 aa, Cryptosporidium hominis
IGNRWKAIGVPIFIEGSQ

SEQ ID NO: 2173141 - protein, 19 aa, Cryptosporidium hominis
IGNVFLWCLENERRQLPSR

SEQ ID NO: 2173142 - protein, 17 aa, Cryptosporidium hominis
IGPCYSCSEQTLNTLRY

SEQ ID NO: 2173143 - protein, 17 aa, Cryptosporidium hominis
IGPGFGIFSGIHRFKCR

SEQ ID NO: 2173144 - protein, 33 aa, Cryptosporidium hominis
IGPSPLWFENSIFRFPAEIEFNVYDQDPIKPVK

SEQ ID NO: 2173145 - protein, 17 aa, Cryptosporidium hominis
IGQIISRVLGFLQDQFP

SEQ ID NO: 2173146 - protein, 19 aa, Cryptosporidium hominis
IGRELYLLYSSLFNIVVNR

SEQ ID NO: 2173147 - protein, 17 aa, Cryptosporidium hominis
IGRHQVKINIYNSLSTR

SEQ ID NO: 2173148 - protein, 17 aa, Cryptosporidium hominis
IGRKARFEMYKMQAKTL

SEQ ID NO: 2173149 - protein, 23 aa, Cryptosporidium hominis
IGRLVWEGVAFHLPPGSLLQEAG

SEQ ID NO: 2173150 - protein, 23 aa, Cryptosporidium hominis
IGSCGYNIYHFLKSGSIKVFVNI

SEQ ID NO: 2173151 - protein, 27 aa, Cryptosporidium hominis
IGSKFEINRLITICAFINLSFEIFIDD

SEQ ID NO: 2173152 - protein, 26 aa, Cryptosporidium hominis
IGSKLSFLRYYVRHYFSLCDDYDFSS

SEQ ID NO: 2173153 - protein, 20 aa, Cryptosporidium hominis
IGSMLPWFVNLSLKLNAHVL

SEQ ID NO: 2173154 - protein, 17 aa, Cryptosporidium hominis
IGSNCSFISSSIDVQKM

SEQ ID NO: 2173155 - protein, 27 aa, Cryptosporidium hominis
IGSSRWKYPIVDMSELLVIGWEALKKG

SEQ ID NO: 2173156 - protein, 24 aa, Cryptosporidium hominis
IGTGKLRYYVFNWKIPQISPSNVG

SEQ ID NO: 2173157 - protein, 25 aa, Cryptosporidium hominis
IGTLRLLIRICRSIIRNPHCSKTTY

SEQ ID NO: 2173158 - protein, 25 aa, Cryptosporidium hominis
IGTPGRLSSIISYPGSNISDLLRNL

SEQ ID NO: 2173159 - protein, 19 aa, Cryptosporidium hominis
IGVGPSPKVDITIKKKELS

SEQ ID NO: 2173160 - protein, 18 aa, Cryptosporidium hominis
IGVTSAKIGKPIFGYSES

SEQ ID NO: 2173161 - protein, 18 aa, Cryptosporidium hominis
IGYKEMIEPTPLFIDAVK

SEQ ID NO: 2173162 - protein, 20 aa, Cryptosporidium hominis
IGYMPLRGDFDVEYDNDAEL

SEQ ID NO: 2173163 - protein, 21 aa, Cryptosporidium hominis
IGYSLSRLCFEIDDNIDKSIG

SEQ ID NO: 2173164 - protein, 17 aa, Cryptosporidium hominis
IHAVVKCMQEYIVRFLQ

SEQ ID NO: 2173165 - protein, 24 aa, Cryptosporidium hominis
IHEITAILSCFVFPEKMESLSNSN

SEQ ID NO: 2173166 - protein, 18 aa, Cryptosporidium hominis
IHFFKFIVDGEWRYSPEY

SEQ ID NO: 2173167 - protein, 22 aa, Cryptosporidium hominis
IHGHLVFLLPLMVSDANIVIPN

SEQ ID NO: 2173168 - protein, 25 aa, Cryptosporidium hominis
IHGINRLRIVYKDMISSNVMTKSVQ

SEQ ID NO: 2173169 - protein, 20 aa, Cryptosporidium hominis
IHGITPFYYGISGLSEVQPV

SEQ ID NO: 2173170 - protein, 18 aa, Cryptosporidium hominis
IHGSLKIPYHPDGPEGKC

SEQ ID NO: 2173171 - protein, 17 aa, Cryptosporidium hominis
IHHPNFRSWTHEQIIEH

SEQ ID NO: 2173172 - protein, 17 aa, Cryptosporidium hominis
IHIEDALNFVIRTFGRD

SEQ ID NO: 2173173 - protein, 20 aa, Cryptosporidium hominis
IHIHRPFLFSSKMVHTDFKS

SEQ ID NO: 2173174 - protein, 24 aa, Cryptosporidium hominis
IHKWRILQQRSYIAIGKFKQTCES

SEQ ID NO: 2173175 - protein, 24 aa, Cryptosporidium hominis
IHLHWLAVEGKFVFNSENDTTYIK

SEQ ID NO: 2173176 - protein, 19 aa, Cryptosporidium hominis
IHLIAHYDGVFGFNAFYNS

SEQ ID NO: 2173177 - protein, 25 aa, Cryptosporidium hominis
IHLKESGNCIPLFFNNSQDKERFVA

SEQ ID NO: 2173178 - protein, 21 aa, Cryptosporidium hominis
IHLLFQFSEIIILDNSSSKLV

SEQ ID NO: 2173179 - protein, 34 aa, Cryptosporidium hominis
IHNLFFFKNIILETSSKFFTLFFGDFISPDQDQD

SEQ ID NO: 2173180 - protein, 23 aa, Cryptosporidium hominis
IHPNGWHPIYYVGYVTKHKTGSK

SEQ ID NO: 2173181 - protein, 26 aa, Cryptosporidium hominis
IHPNIMPRISPIIGPCLGSIYQNNLV

SEQ ID NO: 2173182 - protein, 52 aa, Cryptosporidium hominis
IHPSEACKSWPLCPYGPGCFFIHPTVPCRYGLACYNSLCNYSHPNGWDPNHV

SEQ ID NO: 2173183 - protein, 17 aa, Cryptosporidium hominis
IHPSLILGVCASIIPFP

SEQ ID NO: 2173184 - protein, 23 aa, Cryptosporidium hominis
IHRDIKCANLLISGDGVVKLADF

SEQ ID NO: 2173185 - protein, 17 aa, Cryptosporidium hominis
IHRLRIAQFGPLEEPEV

SEQ ID NO: 2173186 - protein, 17 aa, Cryptosporidium hominis
IHSGQLILPDNSEINQP

SEQ ID NO: 2173187 - protein, 28 aa, Cryptosporidium hominis
IHSKKPSVLWCYKKELGFSSHKKVRQKQ

SEQ ID NO: 2173188 - protein, 24 aa, Cryptosporidium hominis
IHSLAIDFKNAFKIEETKAKIEII

SEQ ID NO: 2173189 - protein, 18 aa, Cryptosporidium hominis
IHSNCFYLGQGNVGRSRT

SEQ ID NO: 2173190 - protein, 22 aa, Cryptosporidium hominis
IHSSLFSIPSIIILRNAKQFIF

SEQ ID NO: 2173191 - protein, 19 aa, Cryptosporidium hominis
IHTKYIWRLAYTTLNPSSR

SEQ ID NO: 2173192 - protein, 31 aa, Cryptosporidium hominis
IHVDLRWPAIKTWIYVCNQIKVDPRSIALAR

SEQ ID NO: 2173193 - protein, 18 aa, Cryptosporidium hominis
IHVGRLGKMVLSPRQEHI

SEQ ID NO: 2173194 - protein, 17 aa, Cryptosporidium hominis
IHYNKMKLSNLIIPGRG

SEQ ID NO: 2173195 - protein, 23 aa, Cryptosporidium hominis
IHYPMPLPKPWDELLLEDVCLTR

SEQ ID NO: 2173196 - protein, 18 aa, Cryptosporidium hominis
IIAHPSQPCTIRLYSSSS

SEQ ID NO: 2173197 - protein, 18 aa, Cryptosporidium hominis
IIAKCCGLTGELRKGEQY

SEQ ID NO: 2173198 - protein, 24 aa, Cryptosporidium hominis
IIAKLSHVFTLFSTAMRCIDDVIL

SEQ ID NO: 2173199 - protein, 34 aa, Cryptosporidium hominis
IIASNGLFILKIIKDFSIGNKWDGVIFTNYCDYL

SEQ ID NO: 2173200 - protein, 25 aa, Cryptosporidium hominis
IICGFKKKNLEAIKTCLETHLNREN

SEQ ID NO: 2173201 - protein, 19 aa, Cryptosporidium hominis
IICILTLLTCRVQNSYIPS

SEQ ID NO: 2173202 - protein, 18 aa, Cryptosporidium hominis
IICLHVKSGTCFYAGMEQ

SEQ ID NO: 2173203 - protein, 25 aa, Cryptosporidium hominis
IIDGFSSSLIKHAPIKENGHLNNKG

SEQ ID NO: 2173204 - protein, 23 aa, Cryptosporidium hominis
IIDKELWYEKKINEKRKSKKRSI

SEQ ID NO: 2173205 - protein, 18 aa, Cryptosporidium hominis
IIDMLSIYINKSSHNKFR

SEQ ID NO: 2173206 - protein, 18 aa, Cryptosporidium hominis
IIDNCKNFNYLGEIVYSL

SEQ ID NO: 2173207 - protein, 20 aa, Cryptosporidium hominis
IIDNPCCDHNVFQSFGVLPI

SEQ ID NO: 2173208 - protein, 24 aa, Cryptosporidium hominis
IIDRFKNCIGNWIAINTINDKDLE

SEQ ID NO: 2173209 - protein, 24 aa, Cryptosporidium hominis
IIEIPSGKMGLIIGTKGSVLNEIR

SEQ ID NO: 2173210 - protein, 26 aa, Cryptosporidium hominis
IIEKMPKLLGSYFIKANKMPIAIKIR

SEQ ID NO: 2173211 - protein, 20 aa, Cryptosporidium hominis
IIESCKRPTVTMEVGTENIA

SEQ ID NO: 2173212 - protein, 18 aa, Cryptosporidium hominis
IIEYAVILSNIYKFKEIR

SEQ ID NO: 2173213 - protein, 18 aa, Cryptosporidium hominis
IIFGKLWIEIVGISTIIN

SEQ ID NO: 2173214 - protein, 31 aa, Cryptosporidium hominis
IIGEMSEIIWKYHLNEEILFLTVHFMDNVLI

SEQ ID NO: 2173215 - protein, 18 aa, Cryptosporidium hominis
IIGGKARLGKLIGKKTAA

SEQ ID NO: 2173216 - protein, 19 aa, Cryptosporidium hominis
IIGGLPPKPAETSLKELKN

SEQ ID NO: 2173217 - protein, 27 aa, Cryptosporidium hominis
IIGTRGINMKRIFKLTQSKLRLRGKGS

SEQ ID NO: 2173218 - protein, 20 aa, Cryptosporidium hominis
IIHKPKIILLNINNIISESN

SEQ ID NO: 2173219 - protein, 20 aa, Cryptosporidium hominis
IIHMQRFYLSEDWRPKKINL

SEQ ID NO: 2173220 - protein, 25 aa, Cryptosporidium hominis
IIHVVYYWFEFVITNMLAWNRVEQW

SEQ ID NO: 2173221 - protein, 23 aa, Cryptosporidium hominis
IIIDLFYLKSMKIWKIDHELRIT

SEQ ID NO: 2173222 - protein, 27 aa, Cryptosporidium hominis
IIIILKEIWIGMGIKNLLLINILRNKE

SEQ ID NO: 2173223 - protein, 33 aa, Cryptosporidium hominis
IIIRNLRKYLPKLNCLFNFALNLGRKPDLMYSH

SEQ ID NO: 2173224 - protein, 17 aa, Cryptosporidium hominis
IIISLITIYRCGFASSI

SEQ ID NO: 2173225 - protein, 28 aa, Cryptosporidium hominis
IIKAKICNFKLRSLLLCDNWITRSKSRR

SEQ ID NO: 2173226 - protein, 17 aa, Cryptosporidium hominis
IIKEKNKEIEIISKEKE

SEQ ID NO: 2173227 - protein, 18 aa, Cryptosporidium hominis
IIKGEFFIHYQIDLLAFR

SEQ ID NO: 2173228 - protein, 17 aa, Cryptosporidium hominis
IIKGFSKNGIKRYLELY

SEQ ID NO: 2173229 - protein, 20 aa, Cryptosporidium hominis
IIKIPWTISEASNLLKPKDV

SEQ ID NO: 2173230 - protein, 19 aa, Cryptosporidium hominis
IIKLKSRLLNYLQEPLYDY

SEQ ID NO: 2173231 - protein, 17 aa, Cryptosporidium hominis
IIKPYGIDIKLTDNFTY

SEQ ID NO: 2173232 - protein, 24 aa, Cryptosporidium hominis
IIKSLDIIFQFSFNEYNHVSTKTD

SEQ ID NO: 2173233 - protein, 34 aa, Cryptosporidium hominis
IIKSLRYFQDQLFKFLIRKNHRRTTLKVPIYNSE

SEQ ID NO: 2173234 - protein, 26 aa, Cryptosporidium hominis
IILDVHFPLAVYKKLLGYKVDIGDLY

SEQ ID NO: 2173235 - protein, 23 aa, Cryptosporidium hominis
IILHLRSTFYNNIKDLSTLENIN

SEQ ID NO: 2173236 - protein, 24 aa, Cryptosporidium hominis
IILQCFDCGLIYYTDLPLNKQQLG

SEQ ID NO: 2173237 - protein, 19 aa, Cryptosporidium hominis
IIMARVLPYGICFVTSSYN

SEQ ID NO: 2173238 - protein, 17 aa, Cryptosporidium hominis
IIMRLSKLKKGLRGEVE

SEQ ID NO: 2173239 - protein, 23 aa, Cryptosporidium hominis
IINCIYKCHCDIIQDKFWHENDH

SEQ ID NO: 2173240 - protein, 26 aa, Cryptosporidium hominis
IIPKPFPGLISKVSVPWKRVKTSSPC

SEQ ID NO: 2173241 - protein, 18 aa, Cryptosporidium hominis
IIPLEIRKMWCVQLVKAV

SEQ ID NO: 2173242 - protein, 18 aa, Cryptosporidium hominis
IIPLLKPLLTGYMDDQIP

SEQ ID NO: 2173243 - protein, 18 aa, Cryptosporidium hominis
IIPLPMSSYGQFRKSRRD

SEQ ID NO: 2173244 - protein, 24 aa, Cryptosporidium hominis
IIQDACKVPCHLISSNAGFDGSVI

SEQ ID NO: 2173245 - protein, 18 aa, Cryptosporidium hominis
IIQEFSLEELAYFQEWDV

SEQ ID NO: 2173246 - protein, 25 aa, Cryptosporidium hominis
IIQIADPIGIMWLELNGINLGEERF

SEQ ID NO: 2173247 - protein, 28 aa, Cryptosporidium hominis
IIQLLTRFESFRTKWARLILNHNQEALY

SEQ ID NO: 2173248 - protein, 29 aa, Cryptosporidium hominis
IIQRFRTGKIWILICTDLMARGVDFKNVS

SEQ ID NO: 2173249 - protein, 17 aa, Cryptosporidium hominis
IIRDLKLTWKLHYSSLK

SEQ ID NO: 2173250 - protein, 25 aa, Cryptosporidium hominis
IIREDWKPTLTISIVICGLLNLLIE

SEQ ID NO: 2173251 - protein, 20 aa, Cryptosporidium hominis
IIRNPHCSKTTYYIHKIIES

SEQ ID NO: 2173252 - protein, 19 aa, Cryptosporidium hominis
IIRSNTVICFAKLMNVLPE

SEQ ID NO: 2173253 - protein, 22 aa, Cryptosporidium hominis
IIRTLIQRWVRLISKDRPPSLE

SEQ ID NO: 2173254 - protein, 20 aa, Cryptosporidium hominis
IIRTNFEQIGTFYCPGINKV

SEQ ID NO: 2173255 - protein, 17 aa, Cryptosporidium hominis
IISDLEYKMEISKISME

SEQ ID NO: 2173256 - protein, 18 aa, Cryptosporidium hominis
IISEEIFDFQSLKDINGL

SEQ ID NO: 2173257 - protein, 18 aa, Cryptosporidium hominis
IISGFPRHLISLIRPKLE

SEQ ID NO: 2173258 - protein, 17 aa, Cryptosporidium hominis
IISGFRKASQIAIDKVN

SEQ ID NO: 2173259 - protein, 17 aa, Cryptosporidium hominis
IISKCIEVYRPGAIVLQ

SEQ ID NO: 2173260 - protein, 30 aa, Cryptosporidium hominis
IISKGHWNELIEVLKYIKIPANLQIILFEH

SEQ ID NO: 2173261 - protein, 18 aa, Cryptosporidium hominis
IISKSIQSNIRFQYMESK

SEQ ID NO: 2173262 - protein, 20 aa, Cryptosporidium hominis
IISLANFYYLYSLKDKSAET

SEQ ID NO: 2173263 - protein, 30 aa, Cryptosporidium hominis
IISLKARSKLWWFCRMAEHCGLVGREGNNM

SEQ ID NO: 2173264 - protein, 20 aa, Cryptosporidium hominis
IISQIFKFPTVFRTNIKDDI

SEQ ID NO: 2173265 - protein, 18 aa, Cryptosporidium hominis
IISTLGIEFLQPGGSTSS

SEQ ID NO: 2173266 - protein, 17 aa, Cryptosporidium hominis
IISVFGVDEIIIYEDKC

SEQ ID NO: 2173267 - protein, 21 aa, Cryptosporidium hominis
IITDCIYKEIEMLNNLESKKA

SEQ ID NO: 2173268 - protein, 24 aa, Cryptosporidium hominis
IITDRVMVSLGFVDNLIEGLKSVG

SEQ ID NO: 2173269 - protein, 28 aa, Cryptosporidium hominis
IITPRAIFHFVRCIPFINTSFREPPKRT

SEQ ID NO: 2173270 - protein, 17 aa, Cryptosporidium hominis
IIVKIIIILKEIWIGMG

SEQ ID NO: 2173271 - protein, 23 aa, Cryptosporidium hominis
IIVSLELPVKVVRLEKMEFNNDI

SEQ ID NO: 2173272 - protein, 18 aa, Cryptosporidium hominis
IIVYNWNKQYSILLESDI

SEQ ID NO: 2173273 - protein, 24 aa, Cryptosporidium hominis
IIYLDGAWRPPFITSGSVRRLSIQ

SEQ ID NO: 2173274 - protein, 22 aa, Cryptosporidium hominis
IIYLLEILRICIRIPTEGNWLF

SEQ ID NO: 2173275 - protein, 17 aa, Cryptosporidium hominis
IIYYSCSISSKWQINEP

SEQ ID NO: 2173276 - protein, 17 aa, Cryptosporidium hominis
IKAFGYQICEDCEFEEK

SEQ ID NO: 2173277 - protein, 28 aa, Cryptosporidium hominis
IKAISGIHKYFLNKAFEHESEKELELHD

SEQ ID NO: 2173278 - protein, 21 aa, Cryptosporidium hominis
IKAKAPLGVINFKIAEWNLQI

SEQ ID NO: 2173279 - protein, 19 aa, Cryptosporidium hominis
IKARNGVVIATEKKVASPL

SEQ ID NO: 2173280 - protein, 17 aa, Cryptosporidium hominis
IKASLLLDDSASNDTIS

SEQ ID NO: 2173281 - protein, 19 aa, Cryptosporidium hominis
IKAYLPVADSFKFTTVLRA

SEQ ID NO: 2173282 - protein, 20 aa, Cryptosporidium hominis
IKCIETIYLSSIILLYTQLK

SEQ ID NO: 2173283 - protein, 29 aa, Cryptosporidium hominis
IKCQIWKTQYIEYCFKSSVVPAKKVITFI

SEQ ID NO: 2173284 - protein, 18 aa, Cryptosporidium hominis
IKDALDWLEHNQTAEKDE

SEQ ID NO: 2173285 - protein, 20 aa, Cryptosporidium hominis
IKDAVNLDELMCNRCNAKYS

SEQ ID NO: 2173286 - protein, 18 aa, Cryptosporidium hominis
IKDFPALPKFLINFRDDL

SEQ ID NO: 2173287 - protein, 21 aa, Cryptosporidium hominis
IKDILIRLLVFTFTLGTYKDI

SEQ ID NO: 2173288 - protein, 22 aa, Cryptosporidium hominis
IKDKKISSVIIFDSSVKSEYYD

SEQ ID NO: 2173289 - protein, 19 aa, Cryptosporidium hominis
IKDLIEFCSLFGNKDPFIW

SEQ ID NO: 2173290 - protein, 19 aa, Cryptosporidium hominis
IKDLIKWSNPKYEELMEWL

SEQ ID NO: 2173291 - protein, 21 aa, Cryptosporidium hominis
IKDPFPICRKAAIQALLSTIH

SEQ ID NO: 2173292 - protein, 19 aa, Cryptosporidium hominis
IKDRFPITLAPSISSISCR

SEQ ID NO: 2173293 - protein, 38 aa, Cryptosporidium hominis
IKDSEIRQCYRLQFKGSDGKWYFAPKIKIEEFEEKFPN

SEQ ID NO: 2173294 - protein, 18 aa, Cryptosporidium hominis
IKDSIGGLMDSYVASYDL

SEQ ID NO: 2173295 - protein, 17 aa, Cryptosporidium hominis
IKDTKIFLSSKIDIDVD

SEQ ID NO: 2173296 - protein, 22 aa, Cryptosporidium hominis
IKDYHQGLGFVVAFFLLQLTPE

SEQ ID NO: 2173297 - protein, 21 aa, Cryptosporidium hominis
IKEAREISEINLLEQVKNFYY

SEQ ID NO: 2173298 - protein, 20 aa, Cryptosporidium hominis
IKECCEILNLKISNLNNDGE

SEQ ID NO: 2173299 - protein, 18 aa, Cryptosporidium hominis
IKEFPRTPIHCIAYANFI

SEQ ID NO: 2173300 - protein, 31 aa, Cryptosporidium hominis
IKELFRRNIDICLPKDSKFSSIIDFADPNWE

SEQ ID NO: 2173301 - protein, 21 aa, Cryptosporidium hominis
IKEMWKSLISKKGMNLEDIIR

SEQ ID NO: 2173302 - protein, 24 aa, Cryptosporidium hominis
IKENISACIDYDCMERNNKSIEEI

SEQ ID NO: 2173303 - protein, 22 aa, Cryptosporidium hominis
IKEPRKGKIRRIKMKNPKFAST

SEQ ID NO: 2173304 - protein, 20 aa, Cryptosporidium hominis
IKESGNLPDWVLDNIMNISK

SEQ ID NO: 2173305 - protein, 17 aa, Cryptosporidium hominis
IKFCAKIPDKDELHPGT

SEQ ID NO: 2173306 - protein, 33 aa, Cryptosporidium hominis
IKFDKLKQRTLRVMKHLHSVMVIGKTARKKRKF

SEQ ID NO: 2173307 - protein, 17 aa, Cryptosporidium hominis
IKFEHILIDMESNKDRE

SEQ ID NO: 2173308 - protein, 25 aa, Cryptosporidium hominis
IKFFMKRYWLDIKLFGKMLYENKRE

SEQ ID NO: 2173309 - protein, 20 aa, Cryptosporidium hominis
IKFKTCLFELLKAMDHTEDF

SEQ ID NO: 2173310 - protein, 18 aa, Cryptosporidium hominis
IKFRAKKAFMISTTDLNS

SEQ ID NO: 2173311 - protein, 20 aa, Cryptosporidium hominis
IKGEVPFSKLTVLRSNTNSK

SEQ ID NO: 2173312 - protein, 17 aa, Cryptosporidium hominis
IKGFLGSIFLAIKSLSK

SEQ ID NO: 2173313 - protein, 17 aa, Cryptosporidium hominis
IKGGNLLINNEKDQDNE

SEQ ID NO: 2173314 - protein, 18 aa, Cryptosporidium hominis
IKGICIIGYNHLKDENLG

SEQ ID NO: 2173315 - protein, 20 aa, Cryptosporidium hominis
IKGKCSRAARRQQKLDVLDD

SEQ ID NO: 2173316 - protein, 21 aa, Cryptosporidium hominis
IKGKYVINPIISTEKETTLVD

SEQ ID NO: 2173317 - protein, 26 aa, Cryptosporidium hominis
IKGSAFLWHQVRLMMGILFEIGQQKF

SEQ ID NO: 2173318 - protein, 18 aa, Cryptosporidium hominis
IKHDACNLITSIDNSELS

SEQ ID NO: 2173319 - protein, 26 aa, Cryptosporidium hominis
IKHIVLKRIKYGFSQLSKNAISKKDE

SEQ ID NO: 2173320 - protein, 21 aa, Cryptosporidium hominis
IKHSRPQSEHLIKYPVPEINR

SEQ ID NO: 2173321 - protein, 25 aa, Cryptosporidium hominis
IKHVPCYECENFLKSISIIEYNKKK

SEQ ID NO: 2173322 - protein, 19 aa, Cryptosporidium hominis
IKIIKAVMFLGNITFIENE

SEQ ID NO: 2173323 - protein, 23 aa, Cryptosporidium hominis
IKIIKKWKWIEFMITGQKPILNS

SEQ ID NO: 2173324 - protein, 17 aa, Cryptosporidium hominis
IKIQRAINSANKIKNLR

SEQ ID NO: 2173325 - protein, 25 aa, Cryptosporidium hominis
IKIQYSRLNFCDELLIENILSIEKM

SEQ ID NO: 2173326 - protein, 19 aa, Cryptosporidium hominis
IKIRHRLALKGDWIDNEST

SEQ ID NO: 2173327 - protein, 21 aa, Cryptosporidium hominis
IKISETKPIFEISEKEGNPYS

SEQ ID NO: 2173328 - protein, 23 aa, Cryptosporidium hominis
IKISGLFWGIGSMKLLFNNLQSE

SEQ ID NO: 2173329 - protein, 20 aa, Cryptosporidium hominis
IKISKKCKMNKNNIRNRTKQ

SEQ ID NO: 2173330 - protein, 19 aa, Cryptosporidium hominis
IKISSVMPNFSCPTDYKLR

SEQ ID NO: 2173331 - protein, 17 aa, Cryptosporidium hominis
IKITSLFFIDSDNKLSS

SEQ ID NO: 2173332 - protein, 30 aa, Cryptosporidium hominis
IKKEEMLKFKGVFKGLSFILLAGNALSQTT

SEQ ID NO: 2173333 - protein, 24 aa, Cryptosporidium hominis
IKKFKHWFTYLGITNYILKVIKRL

SEQ ID NO: 2173334 - protein, 23 aa, Cryptosporidium hominis
IKKFKRFLRLQGFQSQDQYKRKI

SEQ ID NO: 2173335 - protein, 19 aa, Cryptosporidium hominis
IKKGVLGVVHVKYRKGACT

SEQ ID NO: 2173336 - protein, 18 aa, Cryptosporidium hominis
IKKLQKWVSLKNEYNNKI

SEQ ID NO: 2173337 - protein, 26 aa, Cryptosporidium hominis
IKKLQTWLSDWKSVVIEGKKKAPPKA

SEQ ID NO: 2173338 - protein, 18 aa, Cryptosporidium hominis
IKKNGYCMLKGKPCKVVD

SEQ ID NO: 2173339 - protein, 29 aa, Cryptosporidium hominis
IKKNNRYLLKIARFEEAFITIIPTLKGYY

SEQ ID NO: 2173340 - protein, 19 aa, Cryptosporidium hominis
IKKPIKLLKYKNSNSKLGI

SEQ ID NO: 2173341 - protein, 29 aa, Cryptosporidium hominis
IKKSENVVCHFFRPSTLRCEIFDRHLEII

SEQ ID NO: 2173342 - protein, 20 aa, Cryptosporidium hominis
IKKWQKEFFSAEKSSLPQED

SEQ ID NO: 2173343 - protein, 24 aa, Cryptosporidium hominis
IKLEEKKREFMLASEKLEGYEREN

SEQ ID NO: 2173344 - protein, 20 aa, Cryptosporidium hominis
IKLEGSFNRRLIIILNKIYN

SEQ ID NO: 2173345 - protein, 24 aa, Cryptosporidium hominis
IKLFNCLPNKVSINNCFNKIISEY

SEQ ID NO: 2173346 - protein, 17 aa, Cryptosporidium hominis
IKLFVGRVPRNIEEDDL

SEQ ID NO: 2173347 - protein, 25 aa, Cryptosporidium hominis
IKLIITNCYTYNKIGTMVYRMGLIL

SEQ ID NO: 2173348 - protein, 21 aa, Cryptosporidium hominis
IKLKCELGMVNKLFVIKLKII

SEQ ID NO: 2173349 - protein, 17 aa, Cryptosporidium hominis
IKLLESILEESKDDHTL

SEQ ID NO: 2173350 - protein, 24 aa, Cryptosporidium hominis
IKLLKDKFHFIFSIETTGCIPPVE

SEQ ID NO: 2173351 - protein, 21 aa, Cryptosporidium hominis
IKLLMMATRCKIILGCRDLMF

SEQ ID NO: 2173352 - protein, 20 aa, Cryptosporidium hominis
IKLLQRHPSHYGGYHALVNL

SEQ ID NO: 2173353 - protein, 17 aa, Cryptosporidium hominis
IKLLSREDLEDAIRRLN

SEQ ID NO: 2173354 - protein, 20 aa, Cryptosporidium hominis
IKLNRLCWAVGSISGSLSKN

SEQ ID NO: 2173355 - protein, 28 aa, Cryptosporidium hominis
IKLNVKVYKRKESDIIVIKTLVVALYRN

SEQ ID NO: 2173356 - protein, 18 aa, Cryptosporidium hominis
IKLRALKVLFSVINENNI

SEQ ID NO: 2173357 - protein, 24 aa, Cryptosporidium hominis
IKLRSKEALCYAHEKQIEYLKCDL

SEQ ID NO: 2173358 - protein, 27 aa, Cryptosporidium hominis
IKLSKYLMRCLCSFCSKTTLIKLVNNQ

SEQ ID NO: 2173359 - protein, 20 aa, Cryptosporidium hominis
IKLSRPYVAPNPGFLNQLYN

SEQ ID NO: 2173360 - protein, 25 aa, Cryptosporidium hominis
IKLTRLQRMGTIWCNSILSISVGNT

SEQ ID NO: 2173361 - protein, 20 aa, Cryptosporidium hominis
IKMDNCKVLLNLVSEIESIS

SEQ ID NO: 2173362 - protein, 17 aa, Cryptosporidium hominis
IKMNRYQFERIGYFTRD

SEQ ID NO: 2173363 - protein, 25 aa, Cryptosporidium hominis
IKNDLSIPLYRHWNLMDSVYHSEYL

SEQ ID NO: 2173364 - protein, 21 aa, Cryptosporidium hominis
IKNEIRIYNPLLFKNYPQLIL

SEQ ID NO: 2173365 - protein, 31 aa, Cryptosporidium hominis
IKNISIDIQFVWNIVLCRKYKYLSENNLSKT

SEQ ID NO: 2173366 - protein, 26 aa, Cryptosporidium hominis
IKNITSYLHRWRIVGRVVSKSDIRKF

SEQ ID NO: 2173367 - protein, 23 aa, Cryptosporidium hominis
IKNLCIKAAEFSYDETIEKYNGI

SEQ ID NO: 2173368 - protein, 17 aa, Cryptosporidium hominis
IKNLCISVFQFSEHSIY

SEQ ID NO: 2173369 - protein, 17 aa, Cryptosporidium hominis
IKNLICFDHPTTEINQR

SEQ ID NO: 2173370 - protein, 17 aa, Cryptosporidium hominis
IKNLIISAIQKLKSGGN

SEQ ID NO: 2173371 - protein, 26 aa, Cryptosporidium hominis
IKNNFKLKVVFIYDLKFQFGNHTNSS

SEQ ID NO: 2173372 - protein, 23 aa, Cryptosporidium hominis
IKNPDFEISNSFIQSIKLLDEKL

SEQ ID NO: 2173373 - protein, 17 aa, Cryptosporidium hominis
IKNPMDFSTMRKKVSQD

SEQ ID NO: 2173374 - protein, 17 aa, Cryptosporidium hominis
IKNQISFGNKFENDRNS

SEQ ID NO: 2173375 - protein, 25 aa, Cryptosporidium hominis
IKNRKYFIKDGICFIPDTEIESLFI

SEQ ID NO: 2173376 - protein, 19 aa, Cryptosporidium hominis
IKNRRERFGTMSRVNDPDH

SEQ ID NO: 2173377 - protein, 21 aa, Cryptosporidium hominis
IKNSFKTSVIQLKKIERELNR

SEQ ID NO: 2173378 - protein, 28 aa, Cryptosporidium hominis
IKNTTLWLSKYFFGRSVCDCSLIIVVLY

SEQ ID NO: 2173379 - protein, 17 aa, Cryptosporidium hominis
IKNWKEIIDLFRFSDKY

SEQ ID NO: 2173380 - protein, 28 aa, Cryptosporidium hominis
IKNWRFHKIPMFWLQVKLIEILELFPEV

SEQ ID NO: 2173381 - protein, 17 aa, Cryptosporidium hominis
IKPHWLVDFAPNLFQFA

SEQ ID NO: 2173382 - protein, 32 aa, Cryptosporidium hominis
IKPIGNLRFLRYCKILWVMIGIDDFSMNDIYR

SEQ ID NO: 2173383 - protein, 17 aa, Cryptosporidium hominis
IKPILALYSDYNNENLS

SEQ ID NO: 2173384 - protein, 19 aa, Cryptosporidium hominis
IKPIVARCYILSARGLLPP

SEQ ID NO: 2173385 - protein, 26 aa, Cryptosporidium hominis
IKPNGRSWDIFVNVPKKFANVTTLGF

SEQ ID NO: 2173386 - protein, 21 aa, Cryptosporidium hominis
IKPNKSVVCLVMEYMEFGTLS

SEQ ID NO: 2173387 - protein, 20 aa, Cryptosporidium hominis
IKPQMPPMFPAGYYHNVHYI

SEQ ID NO: 2173388 - protein, 23 aa, Cryptosporidium hominis
IKPYLTKFCEFIISKFEIDANSK

SEQ ID NO: 2173389 - protein, 19 aa, Cryptosporidium hominis
IKQFIKMKFILGTESEEFI

SEQ ID NO: 2173390 - protein, 24 aa, Cryptosporidium hominis
IKQFLMDLLEVIKELTLVCENMKS

SEQ ID NO: 2173391 - protein, 20 aa, Cryptosporidium hominis
IKQLKMRSPTIFSLSFDRPN

SEQ ID NO: 2173392 - protein, 18 aa, Cryptosporidium hominis
IKQNTVYCIRTLHRPVPL

SEQ ID NO: 2173393 - protein, 18 aa, Cryptosporidium hominis
IKQPSVICDQALLIRNLP

SEQ ID NO: 2173394 - protein, 19 aa, Cryptosporidium hominis
IKQVFACRPDLVELGMTNF

SEQ ID NO: 2173395 - protein, 24 aa, Cryptosporidium hominis
IKQVQELTQWVGVGGSNLAQNSIS

SEQ ID NO: 2173396 - protein, 17 aa, Cryptosporidium hominis
IKQVRIFSNTMRSAVED

SEQ ID NO: 2173397 - protein, 24 aa, Cryptosporidium hominis
IKRDEMKEKFMVLGGSLKDIELEE

SEQ ID NO: 2173398 - protein, 19 aa, Cryptosporidium hominis
IKRKETLSICYIESEYIQD

SEQ ID NO: 2173399 - protein, 21 aa, Cryptosporidium hominis
IKRKIKVFLNGNWVGCFDDSE

SEQ ID NO: 2173400 - protein, 17 aa, Cryptosporidium hominis
IKRKRLFTDENVKEMDD

SEQ ID NO: 2173401 - protein, 17 aa, Cryptosporidium hominis
IKRLYQGSINFIKLKLL

SEQ ID NO: 2173402 - protein, 21 aa, Cryptosporidium hominis
IKRNICERLSLGERCEKCGSR

SEQ ID NO: 2173403 - protein, 20 aa, Cryptosporidium hominis
IKRQVLIRWVNKYNENYRNK

SEQ ID NO: 2173404 - protein, 19 aa, Cryptosporidium hominis
IKRRIILFKIEQGSNHLKR

SEQ ID NO: 2173405 - protein, 19 aa, Cryptosporidium hominis
IKRSFPCMIDNSAGTLQIN

SEQ ID NO: 2173406 - protein, 19 aa, Cryptosporidium hominis
IKRSISIASISKCEISKMD

SEQ ID NO: 2173407 - protein, 27 aa, Cryptosporidium hominis
IKRSLHFIYHRYKRYVAYNEMLNSERD

SEQ ID NO: 2173408 - protein, 24 aa, Cryptosporidium hominis
IKRWDLDEDSRWISCPSSVSITFS

SEQ ID NO: 2173409 - protein, 21 aa, Cryptosporidium hominis
IKSAGKRAAKKLKEKSKSLKR

SEQ ID NO: 2173410 - protein, 19 aa, Cryptosporidium hominis
IKSDIEFYEFVKKRLNILE

SEQ ID NO: 2173411 - protein, 25 aa, Cryptosporidium hominis
IKSELPEPILKYYIGLKILSYPSIL

SEQ ID NO: 2173412 - protein, 24 aa, Cryptosporidium hominis
IKSFPIKVIHELLGSPGTKECIIF

SEQ ID NO: 2173413 - protein, 18 aa, Cryptosporidium hominis
IKSGIKFAEYSLELSKRQ

SEQ ID NO: 2173414 - protein, 30 aa, Cryptosporidium hominis
IKSICNHILCWKCIINVDEIFYLDSNTSKN

SEQ ID NO: 2173415 - protein, 20 aa, Cryptosporidium hominis
IKSKIVYNYYKLRNIVGNKF

SEQ ID NO: 2173416 - protein, 20 aa, Cryptosporidium hominis
IKSKTWRKNRRKQMQIEEEK

SEQ ID NO: 2173417 - protein, 24 aa, Cryptosporidium hominis
IKSLGMTPSRFESSIGNLSNNNNK

SEQ ID NO: 2173418 - protein, 20 aa, Cryptosporidium hominis
IKSLIKYKVLYEYIGHRVGQ

SEQ ID NO: 2173419 - protein, 20 aa, Cryptosporidium hominis
IKSLNIFLSLPIKSNADVPI

SEQ ID NO: 2173420 - protein, 43 aa, Cryptosporidium hominis
IKSNFTFPPICLARRYFPRSISCPGILLRNGLIVTDRYIVDNE

SEQ ID NO: 2173421 - protein, 22 aa, Cryptosporidium hominis
IKSQVKMDWLFDLDAFNIHKIT

SEQ ID NO: 2173422 - protein, 18 aa, Cryptosporidium hominis
IKSRELCQTNIIVIQLII

SEQ ID NO: 2173423 - protein, 21 aa, Cryptosporidium hominis
IKSRLLSWRSKDYTEKEKESK

SEQ ID NO: 2173424 - protein, 17 aa, Cryptosporidium hominis
IKSSYGVKVTFKLENSL

SEQ ID NO: 2173425 - protein, 24 aa, Cryptosporidium hominis
IKSYPKHKIGLIIDNPIKSPDLSL

SEQ ID NO: 2173426 - protein, 17 aa, Cryptosporidium hominis
IKTGAIFFGEPGTNAQH

SEQ ID NO: 2173427 - protein, 25 aa, Cryptosporidium hominis
IKTKSDFMPFLFFTNGHVWKMAFSP

SEQ ID NO: 2173428 - protein, 18 aa, Cryptosporidium hominis
IKTLIVGGSLQLSPKTQI

SEQ ID NO: 2173429 - protein, 20 aa, Cryptosporidium hominis
IKTLRYILRPKLLTKPIVEP

SEQ ID NO: 2173430 - protein, 23 aa, Cryptosporidium hominis
IKTRKYCIYVAIGQKRSSVAQIV

SEQ ID NO: 2173431 - protein, 22 aa, Cryptosporidium hominis
IKTVHPWFKSTATVECYNSNNG

SEQ ID NO: 2173432 - protein, 18 aa, Cryptosporidium hominis
IKTVLPFLDPNYSLFYYI

SEQ ID NO: 2173433 - protein, 19 aa, Cryptosporidium hominis
IKTYLRIHVTKALRKKSNI

SEQ ID NO: 2173434 - protein, 19 aa, Cryptosporidium hominis
IKTYRFIKDSSKIGNHQYY

SEQ ID NO: 2173435 - protein, 20 aa, Cryptosporidium hominis
IKVETDFYYGFPLIENHPDN

SEQ ID NO: 2173436 - protein, 17 aa, Cryptosporidium hominis
IKVKWPNFIEYLLDKIL

SEQ ID NO: 2173437 - protein, 31 aa, Cryptosporidium hominis
IKVLIPGAGLGRLLFEVARLGYSCQGNEISY

SEQ ID NO: 2173438 - protein, 17 aa, Cryptosporidium hominis
IKVLPSFSDKNFIRDDF

SEQ ID NO: 2173439 - protein, 25 aa, Cryptosporidium hominis
IKVNNFRFGNSIWKTNKDSKINEMP

SEQ ID NO: 2173440 - protein, 25 aa, Cryptosporidium hominis
IKWAPRFKLNKVISGHKGWVRSIAV

SEQ ID NO: 2173441 - protein, 25 aa, Cryptosporidium hominis
IKYGELDDLVAIYGLNKVVWCRIHI

SEQ ID NO: 2173442 - protein, 20 aa, Cryptosporidium hominis
IKYLDARRKGIILTTPPPLS

SEQ ID NO: 2173443 - protein, 19 aa, Cryptosporidium hominis
IKYLEEKFAMIIKDKEEEF

SEQ ID NO: 2173444 - protein, 20 aa, Cryptosporidium hominis
IKYLWETKRDFNIHEVFDDE

SEQ ID NO: 2173445 - protein, 25 aa, Cryptosporidium hominis
IKYNMSDFYLRLDGTTPILERQNMI

SEQ ID NO: 2173446 - protein, 19 aa, Cryptosporidium hominis
IKYNTNIGEIGMKNCAMPI

SEQ ID NO: 2173447 - protein, 22 aa, Cryptosporidium hominis
IKYPLNCLRSAESDSEKKNIFQ

SEQ ID NO: 2173448 - protein, 26 aa, Cryptosporidium hominis
IKYPVLSEAFLLDWITSDVLQSTIDY

SEQ ID NO: 2173449 - protein, 20 aa, Cryptosporidium hominis
IKYSESWSECIEIDSHGNKK

SEQ ID NO: 2173450 - protein, 17 aa, Cryptosporidium hominis
IKYSFIIPDKEYLVDYK

SEQ ID NO: 2173451 - protein, 18 aa, Cryptosporidium hominis
IKYSLIKIYRELKVKGTS

SEQ ID NO: 2173452 - protein, 28 aa, Cryptosporidium hominis
IKYSSQRPLINWKFSDGCIVSITDFSCG

SEQ ID NO: 2173453 - protein, 18 aa, Cryptosporidium hominis
IKYVINFDFPLSPKLFVH

SEQ ID NO: 2173454 - protein, 24 aa, Cryptosporidium hominis
ILAEREFEIEFALFQNSSTIQKKQ

SEQ ID NO: 2173455 - protein, 25 aa, Cryptosporidium hominis
ILAIDASIWLKQFLMGLKDKEGKIP

SEQ ID NO: 2173456 - protein, 19 aa, Cryptosporidium hominis
ILASGDWNGEVLLTCVNEG

SEQ ID NO: 2173457 - protein, 22 aa, Cryptosporidium hominis
ILCCISPFPSDTVRFLKGLLEH

SEQ ID NO: 2173458 - protein, 29 aa, Cryptosporidium hominis
ILCGEEFWAWIMIWMRLNSLGVLDWQRNY

SEQ ID NO: 2173459 - protein, 27 aa, Cryptosporidium hominis
ILDEIIAKVSSCFFCQQGQNSQIEDNH

SEQ ID NO: 2173460 - protein, 30 aa, Cryptosporidium hominis
ILDIHGIKFKIPWKYPKIIHEHVIQQLESI

SEQ ID NO: 2173461 - protein, 25 aa, Cryptosporidium hominis
ILDIPRLKWMILLRIIPVDFFSLSI

SEQ ID NO: 2173462 - protein, 23 aa, Cryptosporidium hominis
ILDLRIGGEFSQTLFLDKKTTNL

SEQ ID NO: 2173463 - protein, 24 aa, Cryptosporidium hominis
ILDNCKLAPCVLKNTKEILETSSF

SEQ ID NO: 2173464 - protein, 21 aa, Cryptosporidium hominis
ILDNHLLLGMNCNNNTGNNNM

SEQ ID NO: 2173465 - protein, 17 aa, Cryptosporidium hominis
ILDTDVFIKALLEEINV

SEQ ID NO: 2173466 - protein, 19 aa, Cryptosporidium hominis
ILDYLKWMSSESHVIVVLE

SEQ ID NO: 2173467 - protein, 21 aa, Cryptosporidium hominis
ILECEKSIKFYELEKDDGELI

SEQ ID NO: 2173468 - protein, 26 aa, Cryptosporidium hominis
ILECLIPVKFRLGFIPNISLLKKYNL

SEQ ID NO: 2173469 - protein, 23 aa, Cryptosporidium hominis
ILECQECKKIKFCSKKCMEESKT

SEQ ID NO: 2173470 - protein, 27 aa, Cryptosporidium hominis
ILEDYCHMRGFPYCRIDGNTSGDDRDR

SEQ ID NO: 2173471 - protein, 21 aa, Cryptosporidium hominis
ILEELKTLNLDSVTKNSTIDE

SEQ ID NO: 2173472 - protein, 18 aa, Cryptosporidium hominis
ILEFTTGNNAVFNRQSEM

SEQ ID NO: 2173473 - protein, 18 aa, Cryptosporidium hominis
ILEGLRKNLLKSYSRITS

SEQ ID NO: 2173474 - protein, 18 aa, Cryptosporidium hominis
ILEKEFYIHESVFLFARE

SEQ ID NO: 2173475 - protein, 20 aa, Cryptosporidium hominis
ILELLKYHARVMYIDIDVHH

SEQ ID NO: 2173476 - protein, 26 aa, Cryptosporidium hominis
ILENFLMDILEAFDCHTDFPPTIQRI

SEQ ID NO: 2173477 - protein, 36 aa, Cryptosporidium hominis
ILEQNCIVRPCFKKIKGKYGSVPISIGDCVQIGENS

SEQ ID NO: 2173478 - protein, 34 aa, Cryptosporidium hominis
ILERAVRLSKNWSCEVWFYVPFEITFHPYCLISN

SEQ ID NO: 2173479 - protein, 22 aa, Cryptosporidium hominis
ILERHSLIRLGFDLEQISWASQ

SEQ ID NO: 2173480 - protein, 17 aa, Cryptosporidium hominis
ILESFQLLLKDFDQRIA

SEQ ID NO: 2173481 - protein, 25 aa, Cryptosporidium hominis
ILESKGIPGIFRGQSIHPVENMMIG

SEQ ID NO: 2173482 - protein, 26 aa, Cryptosporidium hominis
ILESLWISLLKSRIVSRDTFNLWLSK

SEQ ID NO: 2173483 - protein, 17 aa, Cryptosporidium hominis
ILESVNHLHCLKMLHRD

SEQ ID NO: 2173484 - protein, 20 aa, Cryptosporidium hominis
ILETLGLELTENGIINIPNN

SEQ ID NO: 2173485 - protein, 18 aa, Cryptosporidium hominis
ILETSSFAKAYMHMRRMN

SEQ ID NO: 2173486 - protein, 18 aa, Cryptosporidium hominis
ILEVGCGRGGGSVVVCSV

SEQ ID NO: 2173487 - protein, 25 aa, Cryptosporidium hominis
ILEVVKGCNCKKLLLDFNNLGPNKT

SEQ ID NO: 2173488 - protein, 18 aa, Cryptosporidium hominis
ILEYEKWLDPEIYEEIRQ

SEQ ID NO: 2173489 - protein, 18 aa, Cryptosporidium hominis
ILFKFPRVSPIINDEKNK

SEQ ID NO: 2173490 - protein, 17 aa, Cryptosporidium hominis
ILFLWSKHMILYNFDPK

SEQ ID NO: 2173491 - protein, 19 aa, Cryptosporidium hominis
ILFQRRHSVLFKYFGSLEN

SEQ ID NO: 2173492 - protein, 27 aa, Cryptosporidium hominis
ILGFDPVKCNPSWFINTVIPIPPPTVR

SEQ ID NO: 2173493 - protein, 18 aa, Cryptosporidium hominis
ILGSRSWTCSSFLHHAIF

SEQ ID NO: 2173494 - protein, 18 aa, Cryptosporidium hominis
ILGTKIIFEDDVFKHIFE

SEQ ID NO: 2173495 - protein, 17 aa, Cryptosporidium hominis
ILGWGLFSYSSLFNHSC

SEQ ID NO: 2173496 - protein, 20 aa, Cryptosporidium hominis
ILHAILNCAGNRGIYSKEDL

SEQ ID NO: 2173497 - protein, 19 aa, Cryptosporidium hominis
ILHQSLRNLELWFISDPEI

SEQ ID NO: 2173498 - protein, 18 aa, Cryptosporidium hominis
ILIDLKFTGKLIQDLSIC

SEQ ID NO: 2173499 - protein, 18 aa, Cryptosporidium hominis
ILIHGIPGSCERLEKILL

SEQ ID NO: 2173500 - protein, 24 aa, Cryptosporidium hominis
ILILSSLECLGMWLYNPKYSSLLY

SEQ ID NO: 2173501 - protein, 29 aa, Cryptosporidium hominis
ILINEWKKLRWSNKLNLVINIDEYNKGEH

SEQ ID NO: 2173502 - protein, 19 aa, Cryptosporidium hominis
ILKEFIPIRLEMYEKRKNY

SEQ ID NO: 2173503 - protein, 17 aa, Cryptosporidium hominis
ILKEVNKSVFVPVAKSR

SEQ ID NO: 2173504 - protein, 38 aa, Cryptosporidium hominis
ILKKKWKISQSCSRMRQPGCLLKYLIINELEVKKAFRE

SEQ ID NO: 2173505 - protein, 18 aa, Cryptosporidium hominis
ILKLPGNVVIELFSETLM

SEQ ID NO: 2173506 - protein, 23 aa, Cryptosporidium hominis
ILKLSMSVDGEWLILGSQDGSIR

SEQ ID NO: 2173507 - protein, 23 aa, Cryptosporidium hominis
ILKNKVDIAYSFKAVLNSLLSDL

SEQ ID NO: 2173508 - protein, 25 aa, Cryptosporidium hominis
ILKNWLRKNIVVVRYLYLFEQFMNK

SEQ ID NO: 2173509 - protein, 17 aa, Cryptosporidium hominis
ILKPKLLLVPSDVLTLF

SEQ ID NO: 2173510 - protein, 20 aa, Cryptosporidium hominis
ILKQRLKSIQTKLSIEENIS

SEQ ID NO: 2173511 - protein, 18 aa, Cryptosporidium hominis
ILKSHALDSIKIDNIQQI

SEQ ID NO: 2173512 - protein, 20 aa, Cryptosporidium hominis
ILKTENWGLFGVFDGHGPFG

SEQ ID NO: 2173513 - protein, 24 aa, Cryptosporidium hominis
ILLAESSPILSFRVEVEDTEKNNP

SEQ ID NO: 2173514 - protein, 18 aa, Cryptosporidium hominis
ILLCDRLIMTGTFTEYDP

SEQ ID NO: 2173515 - protein, 17 aa, Cryptosporidium hominis
ILLEIYNIIPTWGSFKE

SEQ ID NO: 2173516 - protein, 27 aa, Cryptosporidium hominis
ILLFSSCIGCSIIPTKIREEKKFFSEY

SEQ ID NO: 2173517 - protein, 17 aa, Cryptosporidium hominis
ILLKHSVHFIISVANSF

SEQ ID NO: 2173518 - protein, 27 aa, Cryptosporidium hominis
ILLLEGFRLACKHALYYSIRSTLTIFS

SEQ ID NO: 2173519 - protein, 25 aa, Cryptosporidium hominis
ILLLKMKFNYSWSEFAILARTNDTL

SEQ ID NO: 2173520 - protein, 18 aa, Cryptosporidium hominis
ILLNTCIQESKQLRNIFQ

SEQ ID NO: 2173521 - protein, 19 aa, Cryptosporidium hominis
ILLPGEKLLLFSKECGISA

SEQ ID NO: 2173522 - protein, 25 aa, Cryptosporidium hominis
ILLPRAYPLPAKREKTRWEKFAELK

SEQ ID NO: 2173523 - protein, 24 aa, Cryptosporidium hominis
ILLQNGMLWNWDRRQAQTEEPEQS

SEQ ID NO: 2173524 - protein, 17 aa, Cryptosporidium hominis
ILLRTSIINHRRDLARK

SEQ ID NO: 2173525 - protein, 19 aa, Cryptosporidium hominis
ILLSDIVFCKTWVSMTPRE

SEQ ID NO: 2173526 - protein, 19 aa, Cryptosporidium hominis
ILLYLSRYVEYKTNNNPKW

SEQ ID NO: 2173527 - protein, 17 aa, Cryptosporidium hominis
ILMACGFVKDSNEEFLV

SEQ ID NO: 2173528 - protein, 21 aa, Cryptosporidium hominis
ILMPFGFTMMHHYLGYEGRCA

SEQ ID NO: 2173529 - protein, 28 aa, Cryptosporidium hominis
ILNCCTDIKTKLRVKGGIYFTPDSDISP

SEQ ID NO: 2173530 - protein, 17 aa, Cryptosporidium hominis
ILNCFSKFSRKFQNMID

SEQ ID NO: 2173531 - protein, 23 aa, Cryptosporidium hominis
ILNEFYLRNGMTMEEPILLFLTY

SEQ ID NO: 2173532 - protein, 34 aa, Cryptosporidium hominis
ILNEMKRKLLSFKPRVTFKKGTYFKPRGRDIKTL

SEQ ID NO: 2173533 - protein, 23 aa, Cryptosporidium hominis
ILNEPRAAIDMAKEAFEMAIEQL

SEQ ID NO: 2173534 - protein, 18 aa, Cryptosporidium hominis
ILNERNLHCFLTDNDCVR

SEQ ID NO: 2173535 - protein, 18 aa, Cryptosporidium hominis
ILNILLSRWSGIPIVSKL

SEQ ID NO: 2173536 - protein, 18 aa, Cryptosporidium hominis
ILNKRQDYILDFTKKLEL

SEQ ID NO: 2173537 - protein, 25 aa, Cryptosporidium hominis
ILNLGGIPPRKECINSIRKQTVDSQ

SEQ ID NO: 2173538 - protein, 24 aa, Cryptosporidium hominis
ILNPGRLILFNSFYLTGKSLPMFA

SEQ ID NO: 2173539 - protein, 20 aa, Cryptosporidium hominis
ILNQFPWLIPSYFNSNSGGF

SEQ ID NO: 2173540 - protein, 18 aa, Cryptosporidium hominis
ILNSLSILVYPKIYADNR

SEQ ID NO: 2173541 - protein, 18 aa, Cryptosporidium hominis
ILNSLSWPSEILTSLLEK

SEQ ID NO: 2173542 - protein, 20 aa, Cryptosporidium hominis
ILNTSRCNQCHLPLELPIIH

SEQ ID NO: 2173543 - protein, 24 aa, Cryptosporidium hominis
ILNWPKVDCLISFYSTGFPLNKAI

SEQ ID NO: 2173544 - protein, 26 aa, Cryptosporidium hominis
ILPDSLKLTLIYVSSLFKHPSLMPLN

SEQ ID NO: 2173545 - protein, 24 aa, Cryptosporidium hominis
ILPHLRKIQAPVMECLDKVTSALE

SEQ ID NO: 2173546 - protein, 18 aa, Cryptosporidium hominis
ILPISKRRVGLHCSIKSE

SEQ ID NO: 2173547 - protein, 24 aa, Cryptosporidium hominis
ILPKLTSVQLDWLYALAPKDLFGN

SEQ ID NO: 2173548 - protein, 17 aa, Cryptosporidium hominis
ILPNININWDIKSRRDE

SEQ ID NO: 2173549 - protein, 24 aa, Cryptosporidium hominis
ILPNIPFSLCISYLRQERSQICNK

SEQ ID NO: 2173550 - protein, 26 aa, Cryptosporidium hominis
ILPNRIKFKTCRQLFNKAGEILTGSH

SEQ ID NO: 2173551 - protein, 24 aa, Cryptosporidium hominis
ILPPADFLFAWLKHCHYREEVFQL

SEQ ID NO: 2173552 - protein, 25 aa, Cryptosporidium hominis
ILPPEMRLDTKIPLIARKVQDAVQK

SEQ ID NO: 2173553 - protein, 17 aa, Cryptosporidium hominis
ILPPRNHSSLLLNLLGN

SEQ ID NO: 2173554 - protein, 24 aa, Cryptosporidium hominis
ILPTGEYDLILAFDSPICKSSETT

SEQ ID NO: 2173555 - protein, 31 aa, Cryptosporidium hominis
ILQHLSESWRCWKANLPWKVHGMPPAVENII

SEQ ID NO: 2173556 - protein, 23 aa, Cryptosporidium hominis
ILQSHYLYSIIVGFEKSISYWKL

SEQ ID NO: 2173557 - protein, 21 aa, Cryptosporidium hominis
ILQVLKFTGFYKIIANRMQFD

SEQ ID NO: 2173558 - protein, 26 aa, Cryptosporidium hominis
ILRDRVFSSIYWKGECFALDSETILD

SEQ ID NO: 2173559 - protein, 20 aa, Cryptosporidium hominis
ILRLYLFKNSWFVEVIKDIN

SEQ ID NO: 2173560 - protein, 18 aa, Cryptosporidium hominis
ILRMKSCNSKVIHAVNNH

SEQ ID NO: 2173561 - protein, 21 aa, Cryptosporidium hominis
ILRNMDQFIFFGLPFFFPPVL

SEQ ID NO: 2173562 - protein, 27 aa, Cryptosporidium hominis
ILRPFLPRLLICLLENSIFTDFDYIEM

SEQ ID NO: 2173563 - protein, 24 aa, Cryptosporidium hominis
ILRSYFSGSIVDLFNCDENCECPK

SEQ ID NO: 2173564 - protein, 19 aa, Cryptosporidium hominis
ILSDPLLPIATRNVEQVDD

SEQ ID NO: 2173565 - protein, 23 aa, Cryptosporidium hominis
ILSEMKKKLVVKLRKKLMEFHNK

SEQ ID NO: 2173566 - protein, 23 aa, Cryptosporidium hominis
ILSEYSYFLNIFYKLKCEHKHEY

SEQ ID NO: 2173567 - protein, 19 aa, Cryptosporidium hominis
ILSGIILLGNIVFKNSEEK

SEQ ID NO: 2173568 - protein, 24 aa, Cryptosporidium hominis
ILSHLPKLECLMLNGNRFKEISFI

SEQ ID NO: 2173569 - protein, 24 aa, Cryptosporidium hominis
ILSLCKRSRDSLEFDAGSDSPTEL

SEQ ID NO: 2173570 - protein, 19 aa, Cryptosporidium hominis
ILSLFEIIRELKLSECNAQ

SEQ ID NO: 2173571 - protein, 17 aa, Cryptosporidium hominis
ILSLPGILQKKARDLNN

SEQ ID NO: 2173572 - protein, 18 aa, Cryptosporidium hominis
ILSMLWPQENMPFSESGM

SEQ ID NO: 2173573 - protein, 23 aa, Cryptosporidium hominis
ILSNCFPCLKDIVITRLFHETNT

SEQ ID NO: 2173574 - protein, 25 aa, Cryptosporidium hominis
ILSNIYKFKEIRILLSEVSEILYGN

SEQ ID NO: 2173575 - protein, 18 aa, Cryptosporidium hominis
ILSPSWILCIDIAAILLT

SEQ ID NO: 2173576 - protein, 25 aa, Cryptosporidium hominis
ILSSSECLFGYGFIPKTEPVSGLFD

SEQ ID NO: 2173577 - protein, 17 aa, Cryptosporidium hominis
ILTDGLELKNEISSLLP

SEQ ID NO: 2173578 - protein, 18 aa, Cryptosporidium hominis
ILVSCFKQFPSSYLLINS

SEQ ID NO: 2173579 - protein, 17 aa, Cryptosporidium hominis
ILYEEKLSLVRRTNKNE

SEQ ID NO: 2173580 - protein, 23 aa, Cryptosporidium hominis
ILYSKRFSPYFVEPIVAGLDNNN

SEQ ID NO: 2173581 - protein, 25 aa, Cryptosporidium hominis
IMDFKTKYIFPFSFESVLDAILYKA

SEQ ID NO: 2173582 - protein, 19 aa, Cryptosporidium hominis
IMDLYYSFWNHLISRFTNT

SEQ ID NO: 2173583 - protein, 26 aa, Cryptosporidium hominis
IMDSSLIRKCFEVFVSIGGSVSKRDK

SEQ ID NO: 2173584 - protein, 19 aa, Cryptosporidium hominis
IMELCTGGELFDRLSHVGR

SEQ ID NO: 2173585 - protein, 18 aa, Cryptosporidium hominis
IMGLFSIDNYILIILGTW

SEQ ID NO: 2173586 - protein, 28 aa, Cryptosporidium hominis
IMGNDHVCCFMKYYQIIYERLKKAKSTI

SEQ ID NO: 2173587 - protein, 21 aa, Cryptosporidium hominis
IMGPVFMKVLLFMFVVDPPYH

SEQ ID NO: 2173588 - protein, 18 aa, Cryptosporidium hominis
IMIRCWDPQPSKRGTMLV

SEQ ID NO: 2173589 - protein, 24 aa, Cryptosporidium hominis
IMKNEIRYAWEHGIKSRKYDKIQG

SEQ ID NO: 2173590 - protein, 25 aa, Cryptosporidium hominis
IMKRSDLQKAIPYFLKAVELYNKNG

SEQ ID NO: 2173591 - protein, 18 aa, Cryptosporidium hominis
IMKYITLFIPDNYKGILI

SEQ ID NO: 2173592 - protein, 21 aa, Cryptosporidium hominis
IMLRSEYCWTHNISERELQSA

SEQ ID NO: 2173593 - protein, 19 aa, Cryptosporidium hominis
IMNASSIKQVFACRPDLVE

SEQ ID NO: 2173594 - protein, 18 aa, Cryptosporidium hominis
IMTTEILRTMLYRNDPCI

SEQ ID NO: 2173595 - protein, 25 aa, Cryptosporidium hominis
INAKWPNYELTKGRSHEDLVELLKK

SEQ ID NO: 2173596 - protein, 23 aa, Cryptosporidium hominis
INAPESLPIFPPNPIEIDENTVV

SEQ ID NO: 2173597 - protein, 24 aa, Cryptosporidium hominis
INARKLVERLLLKIYQEYDDFLLS

SEQ ID NO: 2173598 - protein, 17 aa, Cryptosporidium hominis
INCKSTENCSKNASSSS

SEQ ID NO: 2173599 - protein, 18 aa, Cryptosporidium hominis
INCKYDLPSETPINSEGY

SEQ ID NO: 2173600 - protein, 23 aa, Cryptosporidium hominis
INDFACQACIKGVRPENTSCILC

SEQ ID NO: 2173601 - protein, 17 aa, Cryptosporidium hominis
INDHLKSSVSIRNVKYL

SEQ ID NO: 2173602 - protein, 25 aa, Cryptosporidium hominis
INDKFKSCMGLGIFGLDKSTTNQNI

SEQ ID NO: 2173603 - protein, 17 aa, Cryptosporidium hominis
INDPLVILRNRINDKYL

SEQ ID NO: 2173604 - protein, 24 aa, Cryptosporidium hominis
INDRLGSLSYNWKIMSDAPELFNL

SEQ ID NO: 2173605 - protein, 23 aa, Cryptosporidium hominis
INDSVQKLLHFQDILGKGSKIES

SEQ ID NO: 2173606 - protein, 24 aa, Cryptosporidium hominis
INEAFPPVFPLFTLPPLPPKRNGP

SEQ ID NO: 2173607 - protein, 22 aa, Cryptosporidium hominis
INEKIACCHIYKGNASYISAMN

SEQ ID NO: 2173608 - protein, 19 aa, Cryptosporidium hominis
INELHNWFIIHRDLAPANI

SEQ ID NO: 2173609 - protein, 24 aa, Cryptosporidium hominis
INELLKHRGGDCTIETILNELSAS

SEQ ID NO: 2173610 - protein, 18 aa, Cryptosporidium hominis
INEPSLYELCTRFITTLS

SEQ ID NO: 2173611 - protein, 33 aa, Cryptosporidium hominis
INFAMSCIFEIDLLFKQLNLRNASSYNSSDAIK

SEQ ID NO: 2173612 - protein, 24 aa, Cryptosporidium hominis
INFNLRVTWKKNLYPSSSTRIIKI

SEQ ID NO: 2173613 - protein, 18 aa, Cryptosporidium hominis
INFRDFHVRLIAILRSSQ

SEQ ID NO: 2173614 - protein, 26 aa, Cryptosporidium hominis
INFSQCTPSVFPLVLTLMEPFKDATT

SEQ ID NO: 2173615 - protein, 18 aa, Cryptosporidium hominis
INFYSIPSSEMFSTQIVV

SEQ ID NO: 2173616 - protein, 21 aa, Cryptosporidium hominis
INGELLPGFDGGKTGNINQNL

SEQ ID NO: 2173617 - protein, 19 aa, Cryptosporidium hominis
INGGCLLENDLERLHSHAE

SEQ ID NO: 2173618 - protein, 17 aa, Cryptosporidium hominis
INGGSVMDSFLVKGVAF

SEQ ID NO: 2173619 - protein, 27 aa, Cryptosporidium hominis
INGKIYKRWVFPFTYYLTYENEFNLLE

SEQ ID NO: 2173620 - protein, 34 aa, Cryptosporidium hominis
INGKKMFGQNIIRCSFGTNKYCNSFIRNSVCNNP

SEQ ID NO: 2173621 - protein, 22 aa, Cryptosporidium hominis
INGKSRIGIVGKYIASDDTYLS

SEQ ID NO: 2173622 - protein, 28 aa, Cryptosporidium hominis
INGLRIKILKLILNILLDISEFQDESSQ

SEQ ID NO: 2173623 - protein, 18 aa, Cryptosporidium hominis
INGPLALSGTWDGKLILW

SEQ ID NO: 2173624 - protein, 27 aa, Cryptosporidium hominis
INGYYMIFCGLKILYLLLNTTDISFFL

SEQ ID NO: 2173625 - protein, 17 aa, Cryptosporidium hominis
INHEVINYPPIIKNYYK

SEQ ID NO: 2173626 - protein, 26 aa, Cryptosporidium hominis
INIAMAISLLLERSCILVSKETEDSL

SEQ ID NO: 2173627 - protein, 18 aa, Cryptosporidium hominis
INIDFVFNNTNVMLFDST

SEQ ID NO: 2173628 - protein, 28 aa, Cryptosporidium hominis
INISLSRRILICLSYFIITESYREININ

SEQ ID NO: 2173629 - protein, 24 aa, Cryptosporidium hominis
INISRIPFWIKQDVDTENKSSKFF

SEQ ID NO: 2173630 - protein, 17 aa, Cryptosporidium hominis
INKARLKKMAARAQVLT

SEQ ID NO: 2173631 - protein, 17 aa, Cryptosporidium hominis
INKDFKRSLFYIEKINK

SEQ ID NO: 2173632 - protein, 23 aa, Cryptosporidium hominis
INKEQFSHLLAEYAEIIDLKDQN

SEQ ID NO: 2173633 - protein, 17 aa, Cryptosporidium hominis
INKGVAVQAILNQINSL

SEQ ID NO: 2173634 - protein, 23 aa, Cryptosporidium hominis
INKHKRLTIELEQICDKFNSYNK

SEQ ID NO: 2173635 - protein, 22 aa, Cryptosporidium hominis
INKINNCQIVWYTRRDPEKGSI

SEQ ID NO: 2173636 - protein, 18 aa, Cryptosporidium hominis
INKNRINLIQAKDLHFNG

SEQ ID NO: 2173637 - protein, 23 aa, Cryptosporidium hominis
INKRFSMDLIYSYAGRLLVAVNP

SEQ ID NO: 2173638 - protein, 25 aa, Cryptosporidium hominis
INKYGQCRRSYLLGYFGEKFNREKS

SEQ ID NO: 2173639 - protein, 17 aa, Cryptosporidium hominis
INLKGVHLLQLIEAEDV

SEQ ID NO: 2173640 - protein, 25 aa, Cryptosporidium hominis
INLKSELELLYLDFIKKQLQETRIP

SEQ ID NO: 2173641 - protein, 17 aa, Cryptosporidium hominis
INLLEYILNFLSFSTQE

SEQ ID NO: 2173642 - protein, 20 aa, Cryptosporidium hominis
INLMPEYEYETLYVASTEKQ

SEQ ID NO: 2173643 - protein, 22 aa, Cryptosporidium hominis
INLNPLIWKKFSGLPLSLKDLV

SEQ ID NO: 2173644 - protein, 17 aa, Cryptosporidium hominis
INLQTDLECEFGSESEY

SEQ ID NO: 2173645 - protein, 18 aa, Cryptosporidium hominis
INLSEFILREIKIHNRNI

SEQ ID NO: 2173646 - protein, 17 aa, Cryptosporidium hominis
INLTESHFKEIVSELEN

SEQ ID NO: 2173647 - protein, 20 aa, Cryptosporidium hominis
INLVKLLIIRSIISNNSDTE

SEQ ID NO: 2173648 - protein, 17 aa, Cryptosporidium hominis
INLYTGHVYSNWPTART

SEQ ID NO: 2173649 - protein, 23 aa, Cryptosporidium hominis
INMIPRLNAGFSNDSIKAEDAIE

SEQ ID NO: 2173650 - protein, 21 aa, Cryptosporidium hominis
INNHKSCLIILSKGLGIFNIV

SEQ ID NO: 2173651 - protein, 30 aa, Cryptosporidium hominis
INNKDIVCSGLIPKFFSRISLLNDPKAIEL

SEQ ID NO: 2173652 - protein, 17 aa, Cryptosporidium hominis
INNKISIFNQEESYTKK

SEQ ID NO: 2173653 - protein, 25 aa, Cryptosporidium hominis
INNLFKWYLKYGMRDSVSQLVGQLT

SEQ ID NO: 2173654 - protein, 31 aa, Cryptosporidium hominis
INNLFSKYGLKYSQLRNATIHELCRMAYVCG

SEQ ID NO: 2173655 - protein, 25 aa, Cryptosporidium hominis
INNSNICFFSSIYFLAIHKINEFLS

SEQ ID NO: 2173656 - protein, 25 aa, Cryptosporidium hominis
INNSRILLCAITWMREVSSGNNSNN

SEQ ID NO: 2173657 - protein, 17 aa, Cryptosporidium hominis
INPGLLRHAIHESTSQY

SEQ ID NO: 2173658 - protein, 20 aa, Cryptosporidium hominis
INPKPLRTGNICSHKFRITS

SEQ ID NO: 2173659 - protein, 18 aa, Cryptosporidium hominis
INPSAWRWYHSVVGEERC

SEQ ID NO: 2173660 - protein, 21 aa, Cryptosporidium hominis
INPVDVIRTFLVLRKNSEHSH

SEQ ID NO: 2173661 - protein, 20 aa, Cryptosporidium hominis
INPVGLYIHAVVKCMQEYIV

SEQ ID NO: 2173662 - protein, 18 aa, Cryptosporidium hominis
INPVYTIMSLGRYAGTSI

SEQ ID NO: 2173663 - protein, 25 aa, Cryptosporidium hominis
INPYYDAFVKWQFRTLKVSFKSTLG

SEQ ID NO: 2173664 - protein, 17 aa, Cryptosporidium hominis
INQLLICIKHLHESLKL

SEQ ID NO: 2173665 - protein, 24 aa, Cryptosporidium hominis
INQNSKVYGCFQWLDQPEIGESIV

SEQ ID NO: 2173666 - protein, 22 aa, Cryptosporidium hominis
INRAESWLDIALNPNNDIKQLN

SEQ ID NO: 2173667 - protein, 18 aa, Cryptosporidium hominis
INRDFLLNSHATINNYNL

SEQ ID NO: 2173668 - protein, 19 aa, Cryptosporidium hominis
INREILKQTKIGVVMTAVK

SEQ ID NO: 2173669 - protein, 21 aa, Cryptosporidium hominis
INRVDAIFCMGSDESSFNGID

SEQ ID NO: 2173670 - protein, 18 aa, Cryptosporidium hominis
INRVGLCTIRKFMYSDFE

SEQ ID NO: 2173671 - protein, 18 aa, Cryptosporidium hominis
INSAAMIVLTDWFNGKIP

SEQ ID NO: 2173672 - protein, 25 aa, Cryptosporidium hominis
INSKAPMKLLFCREDPYNRPIYSDF

SEQ ID NO: 2173673 - protein, 17 aa, Cryptosporidium hominis
INSKIIIENVNKYLMLH

SEQ ID NO: 2173674 - protein, 24 aa, Cryptosporidium hominis
INSLIDLFHRIYRIMYQDLRNEVE

SEQ ID NO: 2173675 - protein, 17 aa, Cryptosporidium hominis
INSLLTFMNEPAKSENK

SEQ ID NO: 2173676 - protein, 25 aa, Cryptosporidium hominis
INSMLRPALNIGKRAKSTVNLDDKD

SEQ ID NO: 2173677 - protein, 18 aa, Cryptosporidium hominis
INSNEFLSEFTIIENTEF

SEQ ID NO: 2173678 - protein, 17 aa, Cryptosporidium hominis
INSNIVRNTYGKGNLFY

SEQ ID NO: 2173679 - protein, 19 aa, Cryptosporidium hominis
INSRSSLSLIDFDYNKENN

SEQ ID NO: 2173680 - protein, 18 aa, Cryptosporidium hominis
INSSCFRFGSLTLEGDKY

SEQ ID NO: 2173681 - protein, 17 aa, Cryptosporidium hominis
INSVLSFEIDLINKHDL

SEQ ID NO: 2173682 - protein, 25 aa, Cryptosporidium hominis
INSWLEKQILIWNGIPINKLSGKNR

SEQ ID NO: 2173683 - protein, 19 aa, Cryptosporidium hominis
INTEFSLQPCRILDKSKKI

SEQ ID NO: 2173684 - protein, 17 aa, Cryptosporidium hominis
INVAICLITTGNELSMF

SEQ ID NO: 2173685 - protein, 19 aa, Cryptosporidium hominis
INVIKRLIKKEGNEKENSQ

SEQ ID NO: 2173686 - protein, 25 aa, Cryptosporidium hominis
INVISCLKEMVELIKLENFNLHENL

SEQ ID NO: 2173687 - protein, 26 aa, Cryptosporidium hominis
INWIKKIEIEIGIKIDLKYFLLSDYV

SEQ ID NO: 2173688 - protein, 27 aa, Cryptosporidium hominis
INYCARKLKWWLDAFQPIVSPIFPNMD

SEQ ID NO: 2173689 - protein, 17 aa, Cryptosporidium hominis
INYKSQESFLRNKKEMD

SEQ ID NO: 2173690 - protein, 24 aa, Cryptosporidium hominis
INYKVSLSLLKRSIQISIHNNDIS

SEQ ID NO: 2173691 - protein, 18 aa, Cryptosporidium hominis
INYNVLKHALSFDLTLIQ

SEQ ID NO: 2173692 - protein, 17 aa, Cryptosporidium hominis
IPASLLKKLSFIPTSEV

SEQ ID NO: 2173693 - protein, 19 aa, Cryptosporidium hominis
IPASVETWGEYTLNENSSC

SEQ ID NO: 2173694 - protein, 20 aa, Cryptosporidium hominis
IPAVGFSVGVERIMSIIEKK

SEQ ID NO: 2173695 - protein, 22 aa, Cryptosporidium hominis
IPCLRYLAKKLGEYGRNYYIDF

SEQ ID NO: 2173696 - protein, 20 aa, Cryptosporidium hominis
IPDAICFLSSSFFFKRVVIN

SEQ ID NO: 2173697 - protein, 27 aa, Cryptosporidium hominis
IPDCAVRALSHCLLELTGINNDLKKIP

SEQ ID NO: 2173698 - protein, 21 aa, Cryptosporidium hominis
IPDIIIGDIFDYLVKENLKLC

SEQ ID NO: 2173699 - protein, 22 aa, Cryptosporidium hominis
IPDKFFPFPVQKQGATLLNYKD

SEQ ID NO: 2173700 - protein, 31 aa, Cryptosporidium hominis
IPDLSEYTIEITLAAAIGCRQNVVARGAHKR

SEQ ID NO: 2173701 - protein, 20 aa, Cryptosporidium hominis
IPDPLTVPFISCGDLSEYDP

SEQ ID NO: 2173702 - protein, 18 aa, Cryptosporidium hominis
IPDPPRFPTAALKIKQHT

SEQ ID NO: 2173703 - protein, 17 aa, Cryptosporidium hominis
IPDSCSLTSNIYIASSE

SEQ ID NO: 2173704 - protein, 18 aa, Cryptosporidium hominis
IPECFLSKYGDMIRHSEI

SEQ ID NO: 2173705 - protein, 20 aa, Cryptosporidium hominis
IPEDLYFLIKRAVSIRKHLE

SEQ ID NO: 2173706 - protein, 17 aa, Cryptosporidium hominis
IPEHIKDSIGGLMDSYV

SEQ ID NO: 2173707 - protein, 24 aa, Cryptosporidium hominis
IPELEHWDMPFVKPKENVLEGEFP

SEQ ID NO: 2173708 - protein, 22 aa, Cryptosporidium hominis
IPELSISISRRFILFSYVEGIR

SEQ ID NO: 2173709 - protein, 26 aa, Cryptosporidium hominis
IPESMYRSVESWLLSNAYNQWDKLSI

SEQ ID NO: 2173710 - protein, 19 aa, Cryptosporidium hominis
IPETECFYATIDLPDPNGQ

SEQ ID NO: 2173711 - protein, 24 aa, Cryptosporidium hominis
IPETFLPVYMSQTFCTKNISYDFM

SEQ ID NO: 2173712 - protein, 24 aa, Cryptosporidium hominis
IPEVGELFSIHFQDLLEIYSKYFI

SEQ ID NO: 2173713 - protein, 18 aa, Cryptosporidium hominis
IPFDFVFSTINETGTGII

SEQ ID NO: 2173714 - protein, 20 aa, Cryptosporidium hominis
IPFEMLKWMEFLIRMTRELV

SEQ ID NO: 2173715 - protein, 20 aa, Cryptosporidium hominis
IPFEYHWEKPLFNSKLFEID

SEQ ID NO: 2173716 - protein, 29 aa, Cryptosporidium hominis
IPFHSYEFLKHILCRSCSNCASYGSTTCL

SEQ ID NO: 2173717 - protein, 18 aa, Cryptosporidium hominis
IPFNGIKNILKRIYDIKL

SEQ ID NO: 2173718 - protein, 17 aa, Cryptosporidium hominis
IPGIHYFNPKSCKKNTR

SEQ ID NO: 2173719 - protein, 18 aa, Cryptosporidium hominis
IPGRRFPVNIYYTKSPEA

SEQ ID NO: 2173720 - protein, 19 aa, Cryptosporidium hominis
IPGSCERLEKILLQDLQSY

SEQ ID NO: 2173721 - protein, 19 aa, Cryptosporidium hominis
IPGSIAGDLNPIMKTPTQT

SEQ ID NO: 2173722 - protein, 23 aa, Cryptosporidium hominis
IPHFMKSRVYSIILDENKLKSFL

SEQ ID NO: 2173723 - protein, 23 aa, Cryptosporidium hominis
IPHSLEGFISGHLMLRYNKGGMS

SEQ ID NO: 2173724 - protein, 18 aa, Cryptosporidium hominis
IPHSYAIDVQNAMITFFH

SEQ ID NO: 2173725 - protein, 18 aa, Cryptosporidium hominis
IPIENGLLHLISSELKVI

SEQ ID NO: 2173726 - protein, 33 aa, Cryptosporidium hominis
IPIENVIREIGCCHIKYIMPFPKDLKPKIFKGT

SEQ ID NO: 2173727 - protein, 26 aa, Cryptosporidium hominis
IPIFKEFTFFLSLRRSLLELRKKIWR

SEQ ID NO: 2173728 - protein, 20 aa, Cryptosporidium hominis
IPILLTSSINPIWNVNQINQ

SEQ ID NO: 2173729 - protein, 27 aa, Cryptosporidium hominis
IPILMVIQECFTRRNELMRELDILLIL

SEQ ID NO: 2173730 - protein, 24 aa, Cryptosporidium hominis
IPIPQEMRITIVLDLFSDMKKEIA

SEQ ID NO: 2173731 - protein, 17 aa, Cryptosporidium hominis
IPIPVKRTIEKPVPIGL

SEQ ID NO: 2173732 - protein, 18 aa, Cryptosporidium hominis
IPIQIGQLLAKKSTSATP

SEQ ID NO: 2173733 - protein, 24 aa, Cryptosporidium hominis
IPISHLVLCKAIFPERYEDCMNCL

SEQ ID NO: 2173734 - protein, 24 aa, Cryptosporidium hominis
IPISRILLSFDICANIPTENDINI

SEQ ID NO: 2173735 - protein, 18 aa, Cryptosporidium hominis
IPKIKSLIKYKVLYEYIG

SEQ ID NO: 2173736 - protein, 17 aa, Cryptosporidium hominis
IPKIQALIKEFFDGKEP

SEQ ID NO: 2173737 - protein, 21 aa, Cryptosporidium hominis
IPKLIIRDDCEEFSEQDEESI

SEQ ID NO: 2173738 - protein, 23 aa, Cryptosporidium hominis
IPKLRINVLQVYYDIFGQDLELL

SEQ ID NO: 2173739 - protein, 27 aa, Cryptosporidium hominis
IPKRDFKRILLLIGDYAIHRFQDYGLQ

SEQ ID NO: 2173740 - protein, 22 aa, Cryptosporidium hominis
IPKYYEGIKISLGEAGREILRC

SEQ ID NO: 2173741 - protein, 29 aa, Cryptosporidium hominis
IPLDPRIVMRILFNFRKLHPVSYKTRIIK

SEQ ID NO: 2173742 - protein, 18 aa, Cryptosporidium hominis
IPLEICFINENNIPIQLF

SEQ ID NO: 2173743 - protein, 20 aa, Cryptosporidium hominis
IPLELMFCHFFHTKYVYDLL

SEQ ID NO: 2173744 - protein, 26 aa, Cryptosporidium hominis
IPLEYSNLLCSLPYEYNQITQMIDNI

SEQ ID NO: 2173745 - protein, 21 aa, Cryptosporidium hominis
IPLIFRQFIDISYMYDKFKTI

SEQ ID NO: 2173746 - protein, 30 aa, Cryptosporidium hominis
IPLISPMPHQFWYNHLVPQCNFGHIVPPPP

SEQ ID NO: 2173747 - protein, 22 aa, Cryptosporidium hominis
IPLLSISVDFYVRVFVKVKTSA

SEQ ID NO: 2173748 - protein, 23 aa, Cryptosporidium hominis
IPLNTRGLRRETMNWRIEKPCIN

SEQ ID NO: 2173749 - protein, 18 aa, Cryptosporidium hominis
IPLPESRLRDRYGQIHHP

SEQ ID NO: 2173750 - protein, 17 aa, Cryptosporidium hominis
IPLPKNFVMDLNKLEKE

SEQ ID NO: 2173751 - protein, 26 aa, Cryptosporidium hominis
IPLSRYKKSIISWNFQRKSGSAYPFW

SEQ ID NO: 2173752 - protein, 17 aa, Cryptosporidium hominis
IPMETLYNFISLGKSTH

SEQ ID NO: 2173753 - protein, 23 aa, Cryptosporidium hominis
IPNEPCNFLLYNIQDRISISNSC

SEQ ID NO: 2173754 - protein, 17 aa, Cryptosporidium hominis
IPNLDRNGGFQQKPGEN

SEQ ID NO: 2173755 - protein, 19 aa, Cryptosporidium hominis
IPNLPRGRRLQSLENLENC

SEQ ID NO: 2173756 - protein, 23 aa, Cryptosporidium hominis
IPNNLTPIDWARLNKEAFLLNNQ

SEQ ID NO: 2173757 - protein, 32 aa, Cryptosporidium hominis
IPNNWKFQATVARKQLRQFTGLEGTDFNLKEL

SEQ ID NO: 2173758 - protein, 27 aa, Cryptosporidium hominis
IPNPHSLMPLRSCFSSRNGLWVASAAE

SEQ ID NO: 2173759 - protein, 18 aa, Cryptosporidium hominis
IPPDQQRLIFAGKQLEDG

SEQ ID NO: 2173760 - protein, 19 aa, Cryptosporidium hominis
IPPKLLKELGIQHVKGLIL

SEQ ID NO: 2173761 - protein, 19 aa, Cryptosporidium hominis
IPPNIHSGANIISKSKNNE

SEQ ID NO: 2173762 - protein, 18 aa, Cryptosporidium hominis
IPPNLPINADGSYLEKRQ

SEQ ID NO: 2173763 - protein, 20 aa, Cryptosporidium hominis
IPPRMSPLLRSQRQRLKQIL

SEQ ID NO: 2173764 - protein, 26 aa, Cryptosporidium hominis
IPPTIKCPRDFEIIFPTYPTEDTIKS

SEQ ID NO: 2173765 - protein, 18 aa, Cryptosporidium hominis
IPQAPSFPDIRPNISPIS

SEQ ID NO: 2173766 - protein, 24 aa, Cryptosporidium hominis
IPQNRISDIQTIFHLFDKDKDGSI

SEQ ID NO: 2173767 - protein, 19 aa, Cryptosporidium hominis
IPQTCLKDRIKLFLENKND

SEQ ID NO: 2173768 - protein, 19 aa, Cryptosporidium hominis
IPRIPRRRSRSPSLEEGQS

SEQ ID NO: 2173769 - protein, 22 aa, Cryptosporidium hominis
IPRVSRCYECYPPPTQKTFPVC

SEQ ID NO: 2173770 - protein, 26 aa, Cryptosporidium hominis
IPSENEPFHCLYCLERKHKGKRGRKR

SEQ ID NO: 2173771 - protein, 20 aa, Cryptosporidium hominis
IPSGECFVLSLAYKFDPCVW

SEQ ID NO: 2173772 - protein, 19 aa, Cryptosporidium hominis
IPSIFLKGGQILPRNHSLE

SEQ ID NO: 2173773 - protein, 18 aa, Cryptosporidium hominis
IPSLCELQDKHYRNKNLS

SEQ ID NO: 2173774 - protein, 23 aa, Cryptosporidium hominis
IPSNSLQLFSFILNDIISSLVEN

SEQ ID NO: 2173775 - protein, 23 aa, Cryptosporidium hominis
IPSQNWPSNWVWLNTRYSVTLIN

SEQ ID NO: 2173776 - protein, 18 aa, Cryptosporidium hominis
IPSSEMFSTQIVVTDFYL

SEQ ID NO: 2173777 - protein, 25 aa, Cryptosporidium hominis
IPSVFRIVYILPEYAKALLKSYKIN

SEQ ID NO: 2173778 - protein, 22 aa, Cryptosporidium hominis
IPTCPLASPSERLRCVFESLQE

SEQ ID NO: 2173779 - protein, 17 aa, Cryptosporidium hominis
IPTCSEWFDMDSVHPIE

SEQ ID NO: 2173780 - protein, 21 aa, Cryptosporidium hominis
IPTENSKQFYGLDQKFENNYV

SEQ ID NO: 2173781 - protein, 19 aa, Cryptosporidium hominis
IPTWNRIFITSSKESKDSK

SEQ ID NO: 2173782 - protein, 23 aa, Cryptosporidium hominis
IPVCNKPMIWYPLSNLIQHRIRD

SEQ ID NO: 2173783 - protein, 19 aa, Cryptosporidium hominis
IPVNIKTLFMKIVKESAEG

SEQ ID NO: 2173784 - protein, 17 aa, Cryptosporidium hominis
IPVPYEKTIYLFVNNTI

SEQ ID NO: 2173785 - protein, 18 aa, Cryptosporidium hominis
IPVSDFVDFGEYVIGTSK

SEQ ID NO: 2173786 - protein, 17 aa, Cryptosporidium hominis
IPVSIGWTLESTLLSIF

SEQ ID NO: 2173787 - protein, 17 aa, Cryptosporidium hominis
IPYETSIVLDVVNREVK

SEQ ID NO: 2173788 - protein, 18 aa, Cryptosporidium hominis
IQAWWRGEMVRRRLTLYR

SEQ ID NO: 2173789 - protein, 18 aa, Cryptosporidium hominis
IQCAYKYTRLNNSRNLYS

SEQ ID NO: 2173790 - protein, 18 aa, Cryptosporidium hominis
IQDILCPKIEAIYKDIPI

SEQ ID NO: 2173791 - protein, 21 aa, Cryptosporidium hominis
IQDINAFKLTKIIGKLDELNS

SEQ ID NO: 2173792 - protein, 17 aa, Cryptosporidium hominis
IQDSKLILDDLINDLNT

SEQ ID NO: 2173793 - protein, 25 aa, Cryptosporidium hominis
IQDSLCRYNRLIGKEVLWIPGTDHA

SEQ ID NO: 2173794 - protein, 21 aa, Cryptosporidium hominis
IQEILGGKGIVEFSKLNRNLE

SEQ ID NO: 2173795 - protein, 24 aa, Cryptosporidium hominis
IQELLHKLQYIFREEEFSVVTRSE

SEQ ID NO: 2173796 - protein, 25 aa, Cryptosporidium hominis
IQFFKSLRISVGINDVTCARMLLSK

SEQ ID NO: 2173797 - protein, 19 aa, Cryptosporidium hominis
IQFPTHLVELALQEQEVKD

SEQ ID NO: 2173798 - protein, 17 aa, Cryptosporidium hominis
IQGDLGFISSVYSSSDE

SEQ ID NO: 2173799 - protein, 18 aa, Cryptosporidium hominis
IQGGDFSSSFNFGDLSMF

SEQ ID NO: 2173800 - protein, 19 aa, Cryptosporidium hominis
IQGNVQFTSSRWKNISSSV

SEQ ID NO: 2173801 - protein, 26 aa, Cryptosporidium hominis
IQGRNRLDILLSQWVSYFSGRQSIDI

SEQ ID NO: 2173802 - protein, 18 aa, Cryptosporidium hominis
IQGVKGFENLLIRMASYT

SEQ ID NO: 2173803 - protein, 20 aa, Cryptosporidium hominis
IQGYKFKIKYPLLGKAENSG

SEQ ID NO: 2173804 - protein, 23 aa, Cryptosporidium hominis
IQHDWEYPRKILIGSNKSEKLFY

SEQ ID NO: 2173805 - protein, 17 aa, Cryptosporidium hominis
IQIAQLALKHRLNKNLR

SEQ ID NO: 2173806 - protein, 19 aa, Cryptosporidium hominis
IQIIHYWGGDVIKFSGDAI

SEQ ID NO: 2173807 - protein, 23 aa, Cryptosporidium hominis
IQIKPNELYSIFQEYNISMKRMG

SEQ ID NO: 2173808 - protein, 17 aa, Cryptosporidium hominis
IQILLGFNTKSEIIKFI

SEQ ID NO: 2173809 - protein, 22 aa, Cryptosporidium hominis
IQINARIGALERFQRCLRLTFN

SEQ ID NO: 2173810 - protein, 29 aa, Cryptosporidium hominis
IQINNSKLCICLNCNQTGHVNCGRQAPMF

SEQ ID NO: 2173811 - protein, 18 aa, Cryptosporidium hominis
IQIQKIRLILPPRGIDIQ

SEQ ID NO: 2173812 - protein, 18 aa, Cryptosporidium hominis
IQISDSFLEKWNLTKKCN

SEQ ID NO: 2173813 - protein, 25 aa, Cryptosporidium hominis
IQKCIKILLEKGLHEILKFNPNIEL

SEQ ID NO: 2173814 - protein, 22 aa, Cryptosporidium hominis
IQKKFSLLMVLGRPSRELDTGI

SEQ ID NO: 2173815 - protein, 29 aa, Cryptosporidium hominis
IQKLREYSAIFGRSWNRIILDEAHRIKAR

SEQ ID NO: 2173816 - protein, 17 aa, Cryptosporidium hominis
IQKWLGLDQNEEQNDKD

SEQ ID NO: 2173817 - protein, 17 aa, Cryptosporidium hominis
IQLFKVGPRALPFDPLN

SEQ ID NO: 2173818 - protein, 26 aa, Cryptosporidium hominis
IQLIAIPLYASMSFDEQKKAFKLPES

SEQ ID NO: 2173819 - protein, 19 aa, Cryptosporidium hominis
IQLPSGTHFCMYVKHKLLF

SEQ ID NO: 2173820 - protein, 24 aa, Cryptosporidium hominis
IQLSCLDSSIAMRPILKRYQSIVL

SEQ ID NO: 2173821 - protein, 22 aa, Cryptosporidium hominis
IQLSFREIFIIFSQNNKNIEYK

SEQ ID NO: 2173822 - protein, 24 aa, Cryptosporidium hominis
IQMQCIPIGLKLRDMIGIAETGSG

SEQ ID NO: 2173823 - protein, 18 aa, Cryptosporidium hominis
IQNALPVSKFDLSRSQNL

SEQ ID NO: 2173824 - protein, 25 aa, Cryptosporidium hominis
IQNDLKELWSLIDFVYPGKLGTLPV

SEQ ID NO: 2173825 - protein, 19 aa, Cryptosporidium hominis
IQNKICRDFHCCGEGGEYE

SEQ ID NO: 2173826 - protein, 25 aa, Cryptosporidium hominis
IQNMPRNIFVCGGNWLNSNIEHGHP

SEQ ID NO: 2173827 - protein, 17 aa, Cryptosporidium hominis
IQNSVSIFGSNIANMLK

SEQ ID NO: 2173828 - protein, 24 aa, Cryptosporidium hominis
IQNYLACRLCEFDVVVVKKKDAKF

SEQ ID NO: 2173829 - protein, 21 aa, Cryptosporidium hominis
IQPLELCPSIFVLMYDECVPI

SEQ ID NO: 2173830 - protein, 17 aa, Cryptosporidium hominis
IQPLQGIEQNIGENIQI

SEQ ID NO: 2173831 - protein, 26 aa, Cryptosporidium hominis
IQRESSMSFAPVRFGSMSISDTLALQ

SEQ ID NO: 2173832 - protein, 26 aa, Cryptosporidium hominis
IQRFKKSQGIFMIIRYYLNMNQDSQS

SEQ ID NO: 2173833 - protein, 22 aa, Cryptosporidium hominis
IQRKCFPSILAGRDVVAMARTG

SEQ ID NO: 2173834 - protein, 22 aa, Cryptosporidium hominis
IQRNKCCIACSDKLIDQIHKDE

SEQ ID NO: 2173835 - protein, 27 aa, Cryptosporidium hominis
IQRSLARLWFDYVFSVKCLSPSASPYL

SEQ ID NO: 2173836 - protein, 20 aa, Cryptosporidium hominis
IQSILKWGSNTYRKAIFEKM

SEQ ID NO: 2173837 - protein, 22 aa, Cryptosporidium hominis
IQSLKHWNEYGGMSPEEHEEFV

SEQ ID NO: 2173838 - protein, 18 aa, Cryptosporidium hominis
IQSNIRFQYMESKALAEK

SEQ ID NO: 2173839 - protein, 18 aa, Cryptosporidium hominis
IQSSIPINEMNGFNGKVD

SEQ ID NO: 2173840 - protein, 24 aa, Cryptosporidium hominis
IQSYAALRYKFADKAVIENSFDEI

SEQ ID NO: 2173841 - protein, 18 aa, Cryptosporidium hominis
IQTEFGWNTYKSSDEVPH

SEQ ID NO: 2173842 - protein, 19 aa, Cryptosporidium hominis
IQTEISWIQASLISLKSPE

SEQ ID NO: 2173843 - protein, 26 aa, Cryptosporidium hominis
IQTKLKSFCILLDYDSVIILKNTCLY

SEQ ID NO: 2173844 - protein, 24 aa, Cryptosporidium hominis
IQTRRVSLKNGFNCPQSHCKSKKS

SEQ ID NO: 2173845 - protein, 20 aa, Cryptosporidium hominis
IQVLMIINDMIQILLLNINH

SEQ ID NO: 2173846 - protein, 17 aa, Cryptosporidium hominis
IQYAKELFEKELLPHVG

SEQ ID NO: 2173847 - protein, 21 aa, Cryptosporidium hominis
IRAHLKYIGFPIVRDILYSDK

SEQ ID NO: 2173848 - protein, 17 aa, Cryptosporidium hominis
IRALCAGFMIVHDENSA

SEQ ID NO: 2173849 - protein, 26 aa, Cryptosporidium hominis
IRAYLIRLAQNFGCSNECFVLAIIYV

SEQ ID NO: 2173850 - protein, 27 aa, Cryptosporidium hominis
IRCIKPNSRKAVHEFDSLDVLRQLRCA

SEQ ID NO: 2173851 - protein, 21 aa, Cryptosporidium hominis
IRCLLPEKYIYGLSDRMIVEF

SEQ ID NO: 2173852 - protein, 19 aa, Cryptosporidium hominis
IRDRCLRYTPVNVEKYSAT

SEQ ID NO: 2173853 - protein, 32 aa, Cryptosporidium hominis
IRDWPINVLEKFACCLRIEIFMDNDIILEMGP

SEQ ID NO: 2173854 - protein, 22 aa, Cryptosporidium hominis
IREIPVPSIVDLIGIVRHFSPS

SEQ ID NO: 2173855 - protein, 19 aa, Cryptosporidium hominis
IRELYRFIPDISEEELLNR

SEQ ID NO: 2173856 - protein, 19 aa, Cryptosporidium hominis
IRERRGYCDFELDELREDD

SEQ ID NO: 2173857 - protein, 18 aa, Cryptosporidium hominis
IRFDKKGIPKDCKGEDKN

SEQ ID NO: 2173858 - protein, 24 aa, Cryptosporidium hominis
IRFSESHIKCLLKQIILGINELHN

SEQ ID NO: 2173859 - protein, 28 aa, Cryptosporidium hominis
IRFSFIGKVCSIEFYLYNPLSFPIVCES

SEQ ID NO: 2173860 - protein, 17 aa, Cryptosporidium hominis
IRGEFRASNMNTRVMKS

SEQ ID NO: 2173861 - protein, 26 aa, Cryptosporidium hominis
IRGEILKLIQVCLLTIWSQYKGLGAF

SEQ ID NO: 2173862 - protein, 19 aa, Cryptosporidium hominis
IRGEWLLEISPKYYNLEDF

SEQ ID NO: 2173863 - protein, 22 aa, Cryptosporidium hominis
IRGNIRVFCRVRPPTISEQDFC

SEQ ID NO: 2173864 - protein, 19 aa, Cryptosporidium hominis
IRGSSSLNNLRSWDSNSKS

SEQ ID NO: 2173865 - protein, 17 aa, Cryptosporidium hominis
IRHAMIFLSGERSLSSM

SEQ ID NO: 2173866 - protein, 19 aa, Cryptosporidium hominis
IRIDLWLELANFISTTTNC

SEQ ID NO: 2173867 - protein, 17 aa, Cryptosporidium hominis
IRIFRYNGDLLKRVNFD

SEQ ID NO: 2173868 - protein, 18 aa, Cryptosporidium hominis
IRILILVVHPLKSNQLRK

SEQ ID NO: 2173869 - protein, 27 aa, Cryptosporidium hominis
IRIPTEGNWLFSLFCSINNKLIEFNID

SEQ ID NO: 2173870 - protein, 19 aa, Cryptosporidium hominis
IRISHIVYKEGIKGYSISE

SEQ ID NO: 2173871 - protein, 20 aa, Cryptosporidium hominis
IRIVLEGSYYISILLSPFIT

SEQ ID NO: 2173872 - protein, 18 aa, Cryptosporidium hominis
IRIVSIRCDIEGIKMDKE

SEQ ID NO: 2173873 - protein, 23 aa, Cryptosporidium hominis
IRKAYLKAAMKWHPDKMNSSTNE

SEQ ID NO: 2173874 - protein, 19 aa, Cryptosporidium hominis
IRKELGLLFNQNFSNVDLI

SEQ ID NO: 2173875 - protein, 19 aa, Cryptosporidium hominis
IRKEYRRELLDNSLRKFEM

SEQ ID NO: 2173876 - protein, 19 aa, Cryptosporidium hominis
IRKGHIPNQYFIFTSPSLL

SEQ ID NO: 2173877 - protein, 17 aa, Cryptosporidium hominis
IRKIGFDLSDKLSKNEF

SEQ ID NO: 2173878 - protein, 25 aa, Cryptosporidium hominis
IRKKIGPLFLNFEIPMFNLSNIQVK

SEQ ID NO: 2173879 - protein, 20 aa, Cryptosporidium hominis
IRKKNCSLRKPHLNEKINRL

SEQ ID NO: 2173880 - protein, 21 aa, Cryptosporidium hominis
IRKSCAGRPRLDRSDWCCSLC

SEQ ID NO: 2173881 - protein, 17 aa, Cryptosporidium hominis
IRLALRGKAAVLMGKNT

SEQ ID NO: 2173882 - protein, 22 aa, Cryptosporidium hominis
IRLELLPFLAKNQHVPGSELWG

SEQ ID NO: 2173883 - protein, 18 aa, Cryptosporidium hominis
IRLKYGIISLKARSKLWW

SEQ ID NO: 2173884 - protein, 20 aa, Cryptosporidium hominis
IRLSLELLEEVVIDMFHPLS

SEQ ID NO: 2173885 - protein, 20 aa, Cryptosporidium hominis
IRLSNKWPEYIKLGDSTVDR

SEQ ID NO: 2173886 - protein, 19 aa, Cryptosporidium hominis
IRLSSLRLESQMILFYPRM

SEQ ID NO: 2173887 - protein, 19 aa, Cryptosporidium hominis
IRLTEIFSIVIKNISKSQK

SEQ ID NO: 2173888 - protein, 25 aa, Cryptosporidium hominis
IRLVPKEQLNSVFFLVSSLISKSIN

SEQ ID NO: 2173889 - protein, 23 aa, Cryptosporidium hominis
IRLYYCKSLDFLWDWNSRIFMDC

SEQ ID NO: 2173890 - protein, 31 aa, Cryptosporidium hominis
IRMDHMKQIACLRQRLLGISKNHAISHKLGQ

SEQ ID NO: 2173891 - protein, 19 aa, Cryptosporidium hominis
IRNIPDLMTMLDLSDIPPH

SEQ ID NO: 2173892 - protein, 19 aa, Cryptosporidium hominis
IRNNWIYRNDIYLETISVF

SEQ ID NO: 2173893 - protein, 19 aa, Cryptosporidium hominis
IRNQFPYNLVGCIDDIEYW

SEQ ID NO: 2173894 - protein, 17 aa, Cryptosporidium hominis
IRNSISFRYSFMKSKVA

SEQ ID NO: 2173895 - protein, 19 aa, Cryptosporidium hominis
IRNSMKLNLDGILTTTDPS

SEQ ID NO: 2173896 - protein, 18 aa, Cryptosporidium hominis
IRPEMKLIDMCNILESKV

SEQ ID NO: 2173897 - protein, 22 aa, Cryptosporidium hominis
IRPIPDCFSDFLKEGAIIERSE

SEQ ID NO: 2173898 - protein, 21 aa, Cryptosporidium hominis
IRPKRAAAIKAEESIQKKIQS

SEQ ID NO: 2173899 - protein, 17 aa, Cryptosporidium hominis
IRPKTDLTRYVRYPRYI

SEQ ID NO: 2173900 - protein, 17 aa, Cryptosporidium hominis
IRQLLRFKYKNGLPINS

SEQ ID NO: 2173901 - protein, 19 aa, Cryptosporidium hominis
IRQNLTLAINFLVSLLKKN

SEQ ID NO: 2173902 - protein, 24 aa, Cryptosporidium hominis
IRQNPKPCLVMWEPIIDCPSDLSS

SEQ ID NO: 2173903 - protein, 18 aa, Cryptosporidium hominis
IRQWKFKGDEFGDSGMIS

SEQ ID NO: 2173904 - protein, 19 aa, Cryptosporidium hominis
IRREKIWIWIGSQVNEGVR

SEQ ID NO: 2173905 - protein, 24 aa, Cryptosporidium hominis
IRRGPTQHCVDSFKAFDSSLTSTI

SEQ ID NO: 2173906 - protein, 21 aa, Cryptosporidium hominis
IRRLRSLKIIKVNVLDSNSQK

SEQ ID NO: 2173907 - protein, 21 aa, Cryptosporidium hominis
IRRRLHFSRQKSDIMIDGTRI

SEQ ID NO: 2173908 - protein, 17 aa, Cryptosporidium hominis
IRRVFGSIYNLFIVLEQ

SEQ ID NO: 2173909 - protein, 17 aa, Cryptosporidium hominis
IRSAYNIPENANLTISY

SEQ ID NO: 2173910 - protein, 25 aa, Cryptosporidium hominis
IRSFKPNPMCFHRTVTPIQRRRKIT

SEQ ID NO: 2173911 - protein, 28 aa, Cryptosporidium hominis
IRSKAICCLTKLFQCCPDRLRANEWGER

SEQ ID NO: 2173912 - protein, 18 aa, Cryptosporidium hominis
IRSKRSGNIYALKVMSVE

SEQ ID NO: 2173913 - protein, 19 aa, Cryptosporidium hominis
IRSKYWIEALRAYVNQSKG

SEQ ID NO: 2173914 - protein, 20 aa, Cryptosporidium hominis
IRSRIRRIREKLGNYQNSDI

SEQ ID NO: 2173915 - protein, 30 aa, Cryptosporidium hominis
IRSSIWSYVFKLCGIVKFEMTELVHNSFLP

SEQ ID NO: 2173916 - protein, 29 aa, Cryptosporidium hominis
IRSSQSDCLVPWDSTITWKNASNSASLPL

SEQ ID NO: 2173917 - protein, 18 aa, Cryptosporidium hominis
IRSSSFILFHSLLDKYFK

SEQ ID NO: 2173918 - protein, 19 aa, Cryptosporidium hominis
IRSTRIATILLFIKEILLS

SEQ ID NO: 2173919 - protein, 23 aa, Cryptosporidium hominis
IRSVCTEAGMFAIRARRKSISEK

SEQ ID NO: 2173920 - protein, 18 aa, Cryptosporidium hominis
IRSWDLRKKGFFSQVLSH

SEQ ID NO: 2173921 - protein, 23 aa, Cryptosporidium hominis
IRTDIPIAILFRALGVLSDKDIL

SEQ ID NO: 2173922 - protein, 18 aa, Cryptosporidium hominis
IRTEQKWRRNRGRAGEKR

SEQ ID NO: 2173923 - protein, 21 aa, Cryptosporidium hominis
IRTGDLLLEFGSLKSESELHS

SEQ ID NO: 2173924 - protein, 20 aa, Cryptosporidium hominis
IRTVKVCPLPSAGSSMKSNR

SEQ ID NO: 2173925 - protein, 27 aa, Cryptosporidium hominis
IRWHPRGPCIFGGGVDGTGWLWMAPDG

SEQ ID NO: 2173926 - protein, 18 aa, Cryptosporidium hominis
IRYGRKDPIESWLHNLLC

SEQ ID NO: 2173927 - protein, 18 aa, Cryptosporidium hominis
IRYIFNRLILESSAVRAA

SEQ ID NO: 2173928 - protein, 25 aa, Cryptosporidium hominis
IRYKWKEVYDDIPVVKYVPKFDVEV

SEQ ID NO: 2173929 - protein, 17 aa, Cryptosporidium hominis
IRYPNYFNNQGFCEHNF

SEQ ID NO: 2173930 - protein, 19 aa, Cryptosporidium hominis
ISALYGEEQFCPIVGDAKE

SEQ ID NO: 2173931 - protein, 20 aa, Cryptosporidium hominis
ISARAMLKFVKGLTPTQLGI

SEQ ID NO: 2173932 - protein, 28 aa, Cryptosporidium hominis
ISCTFGQEFYLRIYGTGLLNEIQNLTTS

SEQ ID NO: 2173933 - protein, 24 aa, Cryptosporidium hominis
ISCVDSRCLLSYSDVIIANSLNLL

SEQ ID NO: 2173934 - protein, 17 aa, Cryptosporidium hominis
ISDIFAFEGDLWIKINI

SEQ ID NO: 2173935 - protein, 19 aa, Cryptosporidium hominis
ISDLKEWQVIDAKIIIPEI

SEQ ID NO: 2173936 - protein, 18 aa, Cryptosporidium hominis
ISDMLAFEVARKFVQARF

SEQ ID NO: 2173937 - protein, 18 aa, Cryptosporidium hominis
ISDNYSRRFILRLFRQFW

SEQ ID NO: 2173938 - protein, 20 aa, Cryptosporidium hominis
ISDVPGVKFFSFIISGNKPS

SEQ ID NO: 2173939 - protein, 25 aa, Cryptosporidium hominis
ISEALGFGTKCCSKCIFEGEKETLQ

SEQ ID NO: 2173940 - protein, 18 aa, Cryptosporidium hominis
ISEECCLNVAKTVLSSKL

SEQ ID NO: 2173941 - protein, 17 aa, Cryptosporidium hominis
ISEFCFTELNNIIPISL

SEQ ID NO: 2173942 - protein, 26 aa, Cryptosporidium hominis
ISEIRWFSFTSLPNWHANQSLRHRKP

SEQ ID NO: 2173943 - protein, 18 aa, Cryptosporidium hominis
ISEKYGQQNNYRWVRYVT

SEQ ID NO: 2173944 - protein, 17 aa, Cryptosporidium hominis
ISEPEYSPSSFEFNPNI

SEQ ID NO: 2173945 - protein, 22 aa, Cryptosporidium hominis
ISEQFLLALSFLRKMKLTHTDL

SEQ ID NO: 2173946 - protein, 24 aa, Cryptosporidium hominis
ISEVEGRLSVYMAIASKGFNGCWQ

SEQ ID NO: 2173947 - protein, 23 aa, Cryptosporidium hominis
ISEVPYLAGPFVYKKKNFETIQI

SEQ ID NO: 2173948 - protein, 24 aa, Cryptosporidium hominis
ISEVTYGWTCLPIGIRDEFLDLCT

SEQ ID NO: 2173949 - protein, 17 aa, Cryptosporidium hominis
ISFACVKGKRINKSMVN

SEQ ID NO: 2173950 - protein, 24 aa, Cryptosporidium hominis
ISFDEALQICRERGLSSIKNQQAL

SEQ ID NO: 2173951 - protein, 19 aa, Cryptosporidium hominis
ISFFLPLVRHIFSNLQVVY

SEQ ID NO: 2173952 - protein, 21 aa, Cryptosporidium hominis
ISFKFIRSLSKIWGYSIMEHF

SEQ ID NO: 2173953 - protein, 29 aa, Cryptosporidium hominis
ISFLRRQAARPVISYTFKQLRHSLLPKHF

SEQ ID NO: 2173954 - protein, 21 aa, Cryptosporidium hominis
ISFPTDRSFIHILIGVIFTIF

SEQ ID NO: 2173955 - protein, 17 aa, Cryptosporidium hominis
ISGCTDPQIAKMYLEMY

SEQ ID NO: 2173956 - protein, 25 aa, Cryptosporidium hominis
ISGGLEFWDPWIMTLPRRNIQDNEL

SEQ ID NO: 2173957 - protein, 19 aa, Cryptosporidium hominis
ISGGQLLVKYQHGIDKEIA

SEQ ID NO: 2173958 - protein, 18 aa, Cryptosporidium hominis
ISGHKGWVRSIAVDPSNN

SEQ ID NO: 2173959 - protein, 30 aa, Cryptosporidium hominis
ISGLASIHYRWSRGPSRAVCTFHPSQVATL

SEQ ID NO: 2173960 - protein, 25 aa, Cryptosporidium hominis
ISGRRMIEHCLKESGAEFKVKNYYC

SEQ ID NO: 2173961 - protein, 18 aa, Cryptosporidium hominis
ISGSLLAIGLEDGVVDIW

SEQ ID NO: 2173962 - protein, 20 aa, Cryptosporidium hominis
ISGTPILGVMLDSIWMKDSD

SEQ ID NO: 2173963 - protein, 18 aa, Cryptosporidium hominis
ISHDDMKILGFDPVKCNP

SEQ ID NO: 2173964 - protein, 17 aa, Cryptosporidium hominis
ISHKALTIDGGYQLNIN

SEQ ID NO: 2173965 - protein, 17 aa, Cryptosporidium hominis
ISHLICHLVTLHGNSGD

SEQ ID NO: 2173966 - protein, 24 aa, Cryptosporidium hominis
ISHSRFKVFSWNVLAEIYASQEAF

SEQ ID NO: 2173967 - protein, 22 aa, Cryptosporidium hominis
ISHSTMVLCIIRDLDNYYLSTW

SEQ ID NO: 2173968 - protein, 27 aa, Cryptosporidium hominis
ISHYFEFPDLITIIYRFPFYINPMKLS

SEQ ID NO: 2173969 - protein, 26 aa, Cryptosporidium hominis
ISIIDNWRKSVGFIFNDSYKNLKYTL

SEQ ID NO: 2173970 - protein, 29 aa, Cryptosporidium hominis
ISIIRIPIYPNRCVFLSSIGGGLSSSSIN

SEQ ID NO: 2173971 - protein, 25 aa, Cryptosporidium hominis
ISIIRPDRQIAIFSATFPNIIEQFT

SEQ ID NO: 2173972 - protein, 24 aa, Cryptosporidium hominis
ISIKEAACHVGITLCSHLRHSDRV

SEQ ID NO: 2173973 - protein, 24 aa, Cryptosporidium hominis
ISINDLKVSVYLYLNQFMDNIMGE

SEQ ID NO: 2173974 - protein, 24 aa, Cryptosporidium hominis
ISIPSCGKKTIAVDKIENKDIHQL

SEQ ID NO: 2173975 - protein, 19 aa, Cryptosporidium hominis
ISIREAIKIFTSENSENNQ

SEQ ID NO: 2173976 - protein, 17 aa, Cryptosporidium hominis
ISISEILTSEIINELKQ

SEQ ID NO: 2173977 - protein, 26 aa, Cryptosporidium hominis
ISISLWKTIFPWIWNNLEYQQRNELT

SEQ ID NO: 2173978 - protein, 23 aa, Cryptosporidium hominis
ISKAENFDSISILSKNEQESTKN

SEQ ID NO: 2173979 - protein, 17 aa, Cryptosporidium hominis
ISKELKEKLGLDNSSKH

SEQ ID NO: 2173980 - protein, 27 aa, Cryptosporidium hominis
ISKEMRRLCSILTFLFDSKNSGCLEFT

SEQ ID NO: 2173981 - protein, 25 aa, Cryptosporidium hominis
ISKFPRQIIRYCFGGTPLYSESPKK

SEQ ID NO: 2173982 - protein, 25 aa, Cryptosporidium hominis
ISKIWPLSFLKPRFTPEVLSDQVQH

SEQ ID NO: 2173983 - protein, 17 aa, Cryptosporidium hominis
ISKKEGSIHKFIENIEK

SEQ ID NO: 2173984 - protein, 20 aa, Cryptosporidium hominis
ISKKLSIKFLENIIKKFNNC

SEQ ID NO: 2173985 - protein, 20 aa, Cryptosporidium hominis
ISKLFLKSGQYGLLLDQVNE

SEQ ID NO: 2173986 - protein, 18 aa, Cryptosporidium hominis
ISKLKPIFAKLAPPNIVK

SEQ ID NO: 2173987 - protein, 21 aa, Cryptosporidium hominis
ISKLPQIVLHISMCNKEFVER

SEQ ID NO: 2173988 - protein, 27 aa, Cryptosporidium hominis
ISKNKKLLVFLIWKIVNNPEINYKVSL

SEQ ID NO: 2173989 - protein, 21 aa, Cryptosporidium hominis
ISKNLYDWALILAKNGNVSNS

SEQ ID NO: 2173990 - protein, 23 aa, Cryptosporidium hominis
ISKNYNHHFGFFGHLINKIIIYN

SEQ ID NO: 2173991 - protein, 20 aa, Cryptosporidium hominis
ISKPQDARVPTLLKSTYIST

SEQ ID NO: 2173992 - protein, 22 aa, Cryptosporidium hominis
ISKSVLLYYFFEKWMNEKFVGE

SEQ ID NO: 2173993 - protein, 22 aa, Cryptosporidium hominis
ISKSYCPYCIKAINSLKSAGYS

SEQ ID NO: 2173994 - protein, 21 aa, Cryptosporidium hominis
ISKTLESRGCFIQNKETSIDG

SEQ ID NO: 2173995 - protein, 25 aa, Cryptosporidium hominis
ISKYKLRGMDWYKYLNVSNCYDVQN

SEQ ID NO: 2173996 - protein, 29 aa, Cryptosporidium hominis
ISLDKWNSDWIKRCMKIGNYISNKYYEHK

SEQ ID NO: 2173997 - protein, 17 aa, Cryptosporidium hominis
ISLFAYIKLETASNNPN

SEQ ID NO: 2173998 - protein, 27 aa, Cryptosporidium hominis
ISLFGKYTWSWISPRLLHGVSSTPTTK

SEQ ID NO: 2173999 - protein, 20 aa, Cryptosporidium hominis
ISLIRPKLEYEIGPIDHWIN

SEQ ID NO: 2174000 - protein, 17 aa, Cryptosporidium hominis
ISLKQSRIIYEIMRTDI

SEQ ID NO: 2174001 - protein, 18 aa, Cryptosporidium hominis
ISLKSELLISSSTISSKL

SEQ ID NO: 2174002 - protein, 17 aa, Cryptosporidium hominis
ISLKSKIINHNQLNYFR

SEQ ID NO: 2174003 - protein, 19 aa, Cryptosporidium hominis
ISLLKEWYKNNNISSEQPV

SEQ ID NO: 2174004 - protein, 30 aa, Cryptosporidium hominis
ISLLTFCYGYFPDQVILFILKNINREEIQN

SEQ ID NO: 2174005 - protein, 19 aa, Cryptosporidium hominis
ISLQDVWYSLISLGVVNEH

SEQ ID NO: 2174006 - protein, 24 aa, Cryptosporidium hominis
ISLQRFCAGLNFILQGKVIITNRL

SEQ ID NO: 2174007 - protein, 23 aa, Cryptosporidium hominis
ISLSILLRLNIKSVQEKNLDEIY

SEQ ID NO: 2174008 - protein, 29 aa, Cryptosporidium hominis
ISLSNCDVPWPLTGGDQFLHFNESDNAIS

SEQ ID NO: 2174009 - protein, 21 aa, Cryptosporidium hominis
ISLSSLNSWVTFFESKDINQI

SEQ ID NO: 2174010 - protein, 20 aa, Cryptosporidium hominis
ISLYHALSFYNAIYSEDFGY

SEQ ID NO: 2174011 - protein, 17 aa, Cryptosporidium hominis
ISMLLHPKFDESRIDTC

SEQ ID NO: 2174012 - protein, 28 aa, Cryptosporidium hominis
ISNCGHIYCWPCIIKLMNIILENDEYAK

SEQ ID NO: 2174013 - protein, 25 aa, Cryptosporidium hominis
ISNKEFKTIPGVILILRTSDDIPPN

SEQ ID NO: 2174014 - protein, 18 aa, Cryptosporidium hominis
ISNLLSIRNPNLLHYLQK

SEQ ID NO: 2174015 - protein, 20 aa, Cryptosporidium hominis
ISNLMWWINDIHVRELATEF

SEQ ID NO: 2174016 - protein, 18 aa, Cryptosporidium hominis
ISNNILRLQISKKVYKRY

SEQ ID NO: 2174017 - protein, 18 aa, Cryptosporidium hominis
ISNSCVIPSEGESNQKIS

SEQ ID NO: 2174018 - protein, 20 aa, Cryptosporidium hominis
ISNWCVLDYILYLFHNLEVY

SEQ ID NO: 2174019 - protein, 17 aa, Cryptosporidium hominis
ISPELFNELLILIHNIL

SEQ ID NO: 2174020 - protein, 20 aa, Cryptosporidium hominis
ISPFPLITAWFKGVGKPSDS

SEQ ID NO: 2174021 - protein, 19 aa, Cryptosporidium hominis
ISPKGWTCETCGASTNLWL

SEQ ID NO: 2174022 - protein, 28 aa, Cryptosporidium hominis
ISPNGKYLACGFKDGGVAFYDARTLKYR

SEQ ID NO: 2174023 - protein, 26 aa, Cryptosporidium hominis
ISPPSSPTCFSFKASVPVNILGENPF

SEQ ID NO: 2174024 - protein, 20 aa, Cryptosporidium hominis
ISPSEKCIRDSGIPKEKIND

SEQ ID NO: 2174025 - protein, 17 aa, Cryptosporidium hominis
ISPSLPIPSSIQGRNRL

SEQ ID NO: 2174026 - protein, 17 aa, Cryptosporidium hominis
ISPYLFKGMNGLKFSYY

SEQ ID NO: 2174027 - protein, 20 aa, Cryptosporidium hominis
ISQIFLRYLGVPFIKENDFN

SEQ ID NO: 2174028 - protein, 23 aa, Cryptosporidium hominis
ISQKCWKYLFGHTGDLLKGQESD

SEQ ID NO: 2174029 - protein, 21 aa, Cryptosporidium hominis
ISRAIGILNWKPTVDIKTGIK

SEQ ID NO: 2174030 - protein, 17 aa, Cryptosporidium hominis
ISRDFTSEIKIIRSRSE

SEQ ID NO: 2174031 - protein, 22 aa, Cryptosporidium hominis
ISRKESLECIEWSGEERVFSPE

SEQ ID NO: 2174032 - protein, 22 aa, Cryptosporidium hominis
ISRKLIERKGLLPKRFETKYNE

SEQ ID NO: 2174033 - protein, 27 aa, Cryptosporidium hominis
ISRLHSILRPFLLRRVKSDVLQDLPEK

SEQ ID NO: 2174034 - protein, 19 aa, Cryptosporidium hominis
ISRMGALGIASWTKEEVQK

SEQ ID NO: 2174035 - protein, 17 aa, Cryptosporidium hominis
ISRMIVSALNRFRSLFR

SEQ ID NO: 2174036 - protein, 18 aa, Cryptosporidium hominis
ISRNACIPEVTSFSDFQD

SEQ ID NO: 2174037 - protein, 17 aa, Cryptosporidium hominis
ISRQAIISFCRQCERFQ

SEQ ID NO: 2174038 - protein, 17 aa, Cryptosporidium hominis
ISRRSRNSRWRGASEDN

SEQ ID NO: 2174039 - protein, 27 aa, Cryptosporidium hominis
ISSAIWHPRQPWIFTAGINKDGKPSLV

SEQ ID NO: 2174040 - protein, 32 aa, Cryptosporidium hominis
ISSAPRLPFIIKRPQINLAISRGIFFELDISQ

SEQ ID NO: 2174041 - protein, 17 aa, Cryptosporidium hominis
ISSFFIEYSEFIINVIR

SEQ ID NO: 2174042 - protein, 21 aa, Cryptosporidium hominis
ISSGLLKDIFGYMEIKESKIT

SEQ ID NO: 2174043 - protein, 20 aa, Cryptosporidium hominis
ISSICIPYFQALLKFDPEIV

SEQ ID NO: 2174044 - protein, 19 aa, Cryptosporidium hominis
ISSISCRLFINEYVQLLGL

SEQ ID NO: 2174045 - protein, 24 aa, Cryptosporidium hominis
ISSISSTMSILWVKHRRKTYISQI

SEQ ID NO: 2174046 - protein, 24 aa, Cryptosporidium hominis
ISSKIIRHRALIGIQAEIILKDGS

SEQ ID NO: 2174047 - protein, 26 aa, Cryptosporidium hominis
ISSLLRISSPFLWHFFQNGGNVHDLP

SEQ ID NO: 2174048 - protein, 21 aa, Cryptosporidium hominis
ISSLRFASKVQNCVTNRNREK

SEQ ID NO: 2174049 - protein, 18 aa, Cryptosporidium hominis
ISSNGEWLITASNSGSRF

SEQ ID NO: 2174050 - protein, 17 aa, Cryptosporidium hominis
ISSQAGVICTSNKRRVL

SEQ ID NO: 2174051 - protein, 25 aa, Cryptosporidium hominis
ISSQATCCEICLPPLTEKGLDESQD

SEQ ID NO: 2174052 - protein, 25 aa, Cryptosporidium hominis
ISSREWKASKLIFLPSSDKHLERPP

SEQ ID NO: 2174053 - protein, 18 aa, Cryptosporidium hominis
ISSSIAIAAGRTQVNIVD

SEQ ID NO: 2174054 - protein, 26 aa, Cryptosporidium hominis
ISSSIGVCKNILLAQYINYLKNFSNF

SEQ ID NO: 2174055 - protein, 24 aa, Cryptosporidium hominis
ISSSRIDLNIAKKTEFGGYANAKS

SEQ ID NO: 2174056 - protein, 18 aa, Cryptosporidium hominis
ISTECPWGAQIFLESEII

SEQ ID NO: 2174057 - protein, 17 aa, Cryptosporidium hominis
ISTKMGLILVNNYKKIG

SEQ ID NO: 2174058 - protein, 23 aa, Cryptosporidium hominis
ISTNCVRIMFGISEFMKESQDAE

SEQ ID NO: 2174059 - protein, 22 aa, Cryptosporidium hominis
ISTSLYQLWSLGALDDNGSLTD

SEQ ID NO: 2174060 - protein, 22 aa, Cryptosporidium hominis
ISTSRIAFKLDISKLAQQVNIY

SEQ ID NO: 2174061 - protein, 19 aa, Cryptosporidium hominis
ISTTFICLEEDLTIDLIDQ

SEQ ID NO: 2174062 - protein, 17 aa, Cryptosporidium hominis
ISTYLGVKTDKILEMIQ

SEQ ID NO: 2174063 - protein, 21 aa, Cryptosporidium hominis
ISVDIVLDFLCEWKECIESDI

SEQ ID NO: 2174064 - protein, 25 aa, Cryptosporidium hominis
ISVFLKLIRDFIHQIVPLKDQQIDF

SEQ ID NO: 2174065 - protein, 24 aa, Cryptosporidium hominis
ISVISLGSGILFEFNELSKRKNLD

SEQ ID NO: 2174066 - protein, 24 aa, Cryptosporidium hominis
ISVKGPELLTLWFGESEANVREVF

SEQ ID NO: 2174067 - protein, 20 aa, Cryptosporidium hominis
ISVNCTVVGSKTWSQNTSKK

SEQ ID NO: 2174068 - protein, 19 aa, Cryptosporidium hominis
ISVSGCGNYVVVGYSDGSI

SEQ ID NO: 2174069 - protein, 20 aa, Cryptosporidium hominis
ISVSLIIAKALQFNFLPTVR

SEQ ID NO: 2174070 - protein, 18 aa, Cryptosporidium hominis
ISWCVRRKTWRVWFITSG

SEQ ID NO: 2174071 - protein, 24 aa, Cryptosporidium hominis
ISYKDIFEQNGFRFIFNSNSEIGS

SEQ ID NO: 2174072 - protein, 19 aa, Cryptosporidium hominis
ISYPHCIKMLRLLQIEDFR

SEQ ID NO: 2174073 - protein, 25 aa, Cryptosporidium hominis
ISYRWFCIHLLPKYYLIIQFSITNK

SEQ ID NO: 2174074 - protein, 24 aa, Cryptosporidium hominis
ISYSAPLWLEFEGYNSSLDTVSKH

SEQ ID NO: 2174075 - protein, 36 aa, Cryptosporidium hominis
ISYSEFITACHIWRRNEIRQLKSFFMKIDRNNQGKI

SEQ ID NO: 2174076 - protein, 25 aa, Cryptosporidium hominis
ISYVYRLAPLLSLVLVCKDTHEKEL

SEQ ID NO: 2174077 - protein, 17 aa, Cryptosporidium hominis
ITADARGPKHLQIKLSR

SEQ ID NO: 2174078 - protein, 17 aa, Cryptosporidium hominis
ITAEEALSHPYFNGINI

SEQ ID NO: 2174079 - protein, 22 aa, Cryptosporidium hominis
ITANLKRYLIKLFPTEITQEHY

SEQ ID NO: 2174080 - protein, 27 aa, Cryptosporidium hominis
ITANLMPRCIGMWKEYFTSDGKPYYHN

SEQ ID NO: 2174081 - protein, 18 aa, Cryptosporidium hominis
ITCDYCYDSFHKYCLYNN

SEQ ID NO: 2174082 - protein, 23 aa, Cryptosporidium hominis
ITCFKLWRFFIYYRKTRNSRFEK

SEQ ID NO: 2174083 - protein, 21 aa, Cryptosporidium hominis
ITCKIHSWTIEFGGNLFDTPH

SEQ ID NO: 2174084 - protein, 23 aa, Cryptosporidium hominis
ITDDFVPRWGRNSIKKIQKKHNE

SEQ ID NO: 2174085 - protein, 17 aa, Cryptosporidium hominis
ITDLSYVFIRLGDILQL

SEQ ID NO: 2174086 - protein, 28 aa, Cryptosporidium hominis
ITDQLIKWRLELIPSILNIFQSPLSKLL

SEQ ID NO: 2174087 - protein, 21 aa, Cryptosporidium hominis
ITEAAQVLWLIRASGRVGLVS

SEQ ID NO: 2174088 - protein, 23 aa, Cryptosporidium hominis
ITEAHFSWAQPIVRIPNAQKLKI

SEQ ID NO: 2174089 - protein, 25 aa, Cryptosporidium hominis
ITEKLFGFKGVKVIQFLDSTDKLFE

SEQ ID NO: 2174090 - protein, 25 aa, Cryptosporidium hominis
ITEKSGYQALPWVRYITQNGNYEIR

SEQ ID NO: 2174091 - protein, 25 aa, Cryptosporidium hominis
ITESLYNFISAFHFNQADFPDSNEF

SEQ ID NO: 2174092 - protein, 25 aa, Cryptosporidium hominis
ITFEEMKYFFGRGGIIKIDPTTLSP

SEQ ID NO: 2174093 - protein, 18 aa, Cryptosporidium hominis
ITFHSWLKILSIEQYSLR

SEQ ID NO: 2174094 - protein, 24 aa, Cryptosporidium hominis
ITFKFPSGLVEIVFYDEQEDSVCP

SEQ ID NO: 2174095 - protein, 18 aa, Cryptosporidium hominis
ITFLPSIKILEIGLSDKR

SEQ ID NO: 2174096 - protein, 22 aa, Cryptosporidium hominis
ITFPEIRCVYELMNESNSNIYI

SEQ ID NO: 2174097 - protein, 21 aa, Cryptosporidium hominis
ITGDWIPVSLSSDIANNLEFK

SEQ ID NO: 2174098 - protein, 18 aa, Cryptosporidium hominis
ITIMYGLETILFEKFEYE

SEQ ID NO: 2174099 - protein, 27 aa, Cryptosporidium hominis
ITITCKREIKCWIYKNQIKEWVNSSII

SEQ ID NO: 2174100 - protein, 25 aa, Cryptosporidium hominis
ITIYTVCFSELISQFESWRVNHRIT

SEQ ID NO: 2174101 - protein, 30 aa, Cryptosporidium hominis
ITKFNDLICCLNIWENIKITIIQENENIDF

SEQ ID NO: 2174102 - protein, 26 aa, Cryptosporidium hominis
ITKQKIDVCFYIGFVPFYSKVILRLL

SEQ ID NO: 2174103 - protein, 18 aa, Cryptosporidium hominis
ITLFHWQNSLALERIVGT

SEQ ID NO: 2174104 - protein, 25 aa, Cryptosporidium hominis
ITLKHTLRLASRVSISNNAKVSQKN

SEQ ID NO: 2174105 - protein, 19 aa, Cryptosporidium hominis
ITLKSLIEEISRNMFHYLT

SEQ ID NO: 2174106 - protein, 21 aa, Cryptosporidium hominis
ITLLQQWWRVTSTLKKHIDSG

SEQ ID NO: 2174107 - protein, 18 aa, Cryptosporidium hominis
ITLMKWGNAIIQDISQID

SEQ ID NO: 2174108 - protein, 17 aa, Cryptosporidium hominis
ITLNRFGSVQIIEKLNL

SEQ ID NO: 2174109 - protein, 19 aa, Cryptosporidium hominis
ITLRQGFHLFDQRTQGTLS

SEQ ID NO: 2174110 - protein, 18 aa, Cryptosporidium hominis
ITLVEALTGFKFIITHLD

SEQ ID NO: 2174111 - protein, 18 aa, Cryptosporidium hominis
ITMKSTWFGEEMRNKINK

SEQ ID NO: 2174112 - protein, 18 aa, Cryptosporidium hominis
ITNCILTYWDNFSFHKIF

SEQ ID NO: 2174113 - protein, 26 aa, Cryptosporidium hominis
ITNDLKGNMFKLGYDKIVSTISSALI

SEQ ID NO: 2174114 - protein, 23 aa, Cryptosporidium hominis
ITNEWMGNSLIEYLTNKRITKNF

SEQ ID NO: 2174115 - protein, 17 aa, Cryptosporidium hominis
ITPLCKECYKSLSNSSG

SEQ ID NO: 2174116 - protein, 17 aa, Cryptosporidium hominis
ITPLREVRAEYVGGYVQ

SEQ ID NO: 2174117 - protein, 27 aa, Cryptosporidium hominis
ITPNKSNFRWVWPAHVFVTHTGTIIFS

SEQ ID NO: 2174118 - protein, 27 aa, Cryptosporidium hominis
ITPQNRFSIESGYRWDGVIRGNGFEEN

SEQ ID NO: 2174119 - protein, 24 aa, Cryptosporidium hominis
ITPTCRRVMYAAALTASPRLLEPM

SEQ ID NO: 2174120 - protein, 24 aa, Cryptosporidium hominis
ITQKIRFSIQFIVDIYYGYFSMQY

SEQ ID NO: 2174121 - protein, 19 aa, Cryptosporidium hominis
ITREFWKTYGRNYYTRFDY

SEQ ID NO: 2174122 - protein, 24 aa, Cryptosporidium hominis
ITRGDEFNAFLILEKTQESDYSKN

SEQ ID NO: 2174123 - protein, 20 aa, Cryptosporidium hominis
ITRIYGLHALRFKKPLLQPF

SEQ ID NO: 2174124 - protein, 17 aa, Cryptosporidium hominis
ITSFGIGYKEMIEPTPL

SEQ ID NO: 2174125 - protein, 18 aa, Cryptosporidium hominis
ITSGPWGQSAYMQKIQKA

SEQ ID NO: 2174126 - protein, 20 aa, Cryptosporidium hominis
ITSHFCQLHHFYGPGCKARS

SEQ ID NO: 2174127 - protein, 18 aa, Cryptosporidium hominis
ITSICCTSISNMLVSCDL

SEQ ID NO: 2174128 - protein, 24 aa, Cryptosporidium hominis
ITSKICIGNVFLIKTIPITIYNEF

SEQ ID NO: 2174129 - protein, 17 aa, Cryptosporidium hominis
ITSLEFVKGFQAHKNEV

SEQ ID NO: 2174130 - protein, 17 aa, Cryptosporidium hominis
ITSLFFIDSDNKLSSGY

SEQ ID NO: 2174131 - protein, 28 aa, Cryptosporidium hominis
ITSPDYPVRCAFSLLNEYLKTYIDSSKN

SEQ ID NO: 2174132 - protein, 24 aa, Cryptosporidium hominis
ITSPWAMSLCMLHISRHIYNSRQL

SEQ ID NO: 2174133 - protein, 25 aa, Cryptosporidium hominis
ITTILKARCSILAAANPTFGSYDDS

SEQ ID NO: 2174134 - protein, 23 aa, Cryptosporidium hominis
ITTIQLFKINPFKYLIDIQIYDG

SEQ ID NO: 2174135 - protein, 18 aa, Cryptosporidium hominis
ITTKGAVELSLEGTNEMV

SEQ ID NO: 2174136 - protein, 18 aa, Cryptosporidium hominis
ITTSFQLPTREDLLPSLM

SEQ ID NO: 2174137 - protein, 30 aa, Cryptosporidium hominis
ITVGIKMQLIYSLLCKSEFQSLTQLIFHLL

SEQ ID NO: 2174138 - protein, 20 aa, Cryptosporidium hominis
ITVQMLLARSWDWSIEDQDL

SEQ ID NO: 2174139 - protein, 17 aa, Cryptosporidium hominis
ITYELLKIFKTSNGEFI

SEQ ID NO: 2174140 - protein, 33 aa, Cryptosporidium hominis
ITYIKLLLRVSFIKSICLLKMYGKKLPIYLFDG

SEQ ID NO: 2174141 - protein, 30 aa, Cryptosporidium hominis
ITYKEIRYNTWFRYNLPFYLEPQYYHLLSY

SEQ ID NO: 2174142 - protein, 26 aa, Cryptosporidium hominis
ITYLCRSCFLPEIFSTNSKLSNFQHE

SEQ ID NO: 2174143 - protein, 18 aa, Cryptosporidium hominis
IVAKLMNSRGVYCGMHTE

SEQ ID NO: 2174144 - protein, 20 aa, Cryptosporidium hominis
IVALKRIRLDAEDEGIPSTA

SEQ ID NO: 2174145 - protein, 22 aa, Cryptosporidium hominis
IVALKYKHGLVLAADGRTSTGP

SEQ ID NO: 2174146 - protein, 19 aa, Cryptosporidium hominis
IVALNAHLFLKNNGYFIIS

SEQ ID NO: 2174147 - protein, 17 aa, Cryptosporidium hominis
IVAPSGIRVRPETLEGQ

SEQ ID NO: 2174148 - protein, 24 aa, Cryptosporidium hominis
IVCDRCLGESKFLRMTKSNQERSC

SEQ ID NO: 2174149 - protein, 20 aa, Cryptosporidium hominis
IVDFPSKFKSVGENNSKSTL

SEQ ID NO: 2174150 - protein, 20 aa, Cryptosporidium hominis
IVDGEWRYSPEYPIESDSEG

SEQ ID NO: 2174151 - protein, 21 aa, Cryptosporidium hominis
IVDIPLRYEKVSSIIQMDLVN

SEQ ID NO: 2174152 - protein, 18 aa, Cryptosporidium hominis
IVDLHLKTTLSFGSISEL

SEQ ID NO: 2174153 - protein, 23 aa, Cryptosporidium hominis
IVDRLLFAIPFFFKSDVFTNPFV

SEQ ID NO: 2174154 - protein, 24 aa, Cryptosporidium hominis
IVEKKLMINYSFSSLIFFPNICIT

SEQ ID NO: 2174155 - protein, 31 aa, Cryptosporidium hominis
IVEPESRSAFVWIIGEVYEFVQGTKPSTKNE

SEQ ID NO: 2174156 - protein, 19 aa, Cryptosporidium hominis
IVESILLPLSTTSCGTSAE

SEQ ID NO: 2174157 - protein, 17 aa, Cryptosporidium hominis
IVFAEDLTRCIIDHLSK

SEQ ID NO: 2174158 - protein, 24 aa, Cryptosporidium hominis
IVFENIKIPLISGEYDDIRKYWEF

SEQ ID NO: 2174159 - protein, 17 aa, Cryptosporidium hominis
IVFKVSGGTQFNISVPR

SEQ ID NO: 2174160 - protein, 23 aa, Cryptosporidium hominis
IVFPPCPILLFSLHDINSNYQNK

SEQ ID NO: 2174161 - protein, 17 aa, Cryptosporidium hominis
IVGQRGYSINYLKENET

SEQ ID NO: 2174162 - protein, 27 aa, Cryptosporidium hominis
IVHSVWPRILFIQSIIIGRFKFLDDYK

SEQ ID NO: 2174163 - protein, 21 aa, Cryptosporidium hominis
IVIDGKLDYPAACNSLETLLI

SEQ ID NO: 2174164 - protein, 17 aa, Cryptosporidium hominis
IVIKTAYRKRRSKRKQN

SEQ ID NO: 2174165 - protein, 26 aa, Cryptosporidium hominis
IVISGLRCPIPIYIKKHIFVMSYIGD

SEQ ID NO: 2174166 - protein, 36 aa, Cryptosporidium hominis
IVKLGIKLYPNWKWSQRWHGIREKFYLWVTNPNDGA

SEQ ID NO: 2174167 - protein, 20 aa, Cryptosporidium hominis
IVKRCYKVDVQYDFASVDTG

SEQ ID NO: 2174168 - protein, 23 aa, Cryptosporidium hominis
IVKRIVLVGNLFKVRKSKAVVRN

SEQ ID NO: 2174169 - protein, 19 aa, Cryptosporidium hominis
IVKTDWRQINHTFKSDLRD

SEQ ID NO: 2174170 - protein, 17 aa, Cryptosporidium hominis
IVLFLRANLGINVAKNF

SEQ ID NO: 2174171 - protein, 26 aa, Cryptosporidium hominis
IVLRLLERRQKPFFYPTFIKEQVENI

SEQ ID NO: 2174172 - protein, 19 aa, Cryptosporidium hominis
IVLSERRRILASNRNSNRR

SEQ ID NO: 2174173 - protein, 25 aa, Cryptosporidium hominis
IVMAFLYTKIRIFKELSKQISIKKM

SEQ ID NO: 2174174 - protein, 17 aa, Cryptosporidium hominis
IVNEMQHESGGAFITSM

SEQ ID NO: 2174175 - protein, 18 aa, Cryptosporidium hominis
IVNILYEYLIHIDKQIDR

SEQ ID NO: 2174176 - protein, 19 aa, Cryptosporidium hominis
IVNPSFWSASKILEIAGIN

SEQ ID NO: 2174177 - protein, 24 aa, Cryptosporidium hominis
IVNSPKVFACMCSRCLDDSENNLF

SEQ ID NO: 2174178 - protein, 23 aa, Cryptosporidium hominis
IVPGPGMSECLLLAFNTKSNNSG

SEQ ID NO: 2174179 - protein, 19 aa, Cryptosporidium hominis
IVQRYICRICIPRVNRMPA

SEQ ID NO: 2174180 - protein, 19 aa, Cryptosporidium hominis
IVREQCITMVAVIAGVIEN

SEQ ID NO: 2174181 - protein, 27 aa, Cryptosporidium hominis
IVREWSGREIGSCICCHLIYEDEMNVY

SEQ ID NO: 2174182 - protein, 17 aa, Cryptosporidium hominis
IVSHNFNALKYCNRIIN

SEQ ID NO: 2174183 - protein, 18 aa, Cryptosporidium hominis
IVSKCTLLYFSMPSNQLN

SEQ ID NO: 2174184 - protein, 28 aa, Cryptosporidium hominis
IVSKEKFGCIIGIQFASKITRSIDKGPF

SEQ ID NO: 2174185 - protein, 22 aa, Cryptosporidium hominis
IVSRARKVQKFLTQPFFMSEAF

SEQ ID NO: 2174186 - protein, 35 aa, Cryptosporidium hominis
IVSRTQKWLLRNVKLEDFKYLIRVDQLREENILRN

SEQ ID NO: 2174187 - protein, 22 aa, Cryptosporidium hominis
IVTCPPRFVLNLQTQVCERKIE

SEQ ID NO: 2174188 - protein, 26 aa, Cryptosporidium hominis
IVTNARSTGWLKVIDTMFPELSNALN

SEQ ID NO: 2174189 - protein, 25 aa, Cryptosporidium hominis
IVTTLRARCSIIAAANPIFGKYDSS

SEQ ID NO: 2174190 - protein, 18 aa, Cryptosporidium hominis
IVVKETKETFVIISADDK

SEQ ID NO: 2174191 - protein, 35 aa, Cryptosporidium hominis
IWEGVRPSRIFFKWKIYYCHSKEDAYRFFLDNNSL

SEQ ID NO: 2174192 - protein, 23 aa, Cryptosporidium hominis
IWEHYKNSFIYKGSLPKHDLFHN

SEQ ID NO: 2174193 - protein, 18 aa, Cryptosporidium hominis
IWELSHKSIYDVSKKANY

SEQ ID NO: 2174194 - protein, 19 aa, Cryptosporidium hominis
IWLHNLIPIGISRVKLLNF

SEQ ID NO: 2174195 - protein, 17 aa, Cryptosporidium hominis
IWNDLLYNQVFDHVDFE

SEQ ID NO: 2174196 - protein, 25 aa, Cryptosporidium hominis
IWQYYFWLMGDFLPKILFKNEQFKV

SEQ ID NO: 2174197 - protein, 29 aa, Cryptosporidium hominis
IWRYCKGNCGIKFKSRRDSIENMLFEQQK

SEQ ID NO: 2174198 - protein, 22 aa, Cryptosporidium hominis
IWSKQWEMHEIWDGDYVTDGED

SEQ ID NO: 2174199 - protein, 25 aa, Cryptosporidium hominis
IWSLGCTIFELLTGDLLFTPKATED

SEQ ID NO: 2174200 - protein, 18 aa, Cryptosporidium hominis
IWSLGVLCYELVKGEPPF

SEQ ID NO: 2174201 - protein, 20 aa, Cryptosporidium hominis
IWSSFGSFNWDGFSANRNLE

SEQ ID NO: 2174202 - protein, 17 aa, Cryptosporidium hominis
IWVSSTIVKKHFPVRKK

SEQ ID NO: 2174203 - protein, 21 aa, Cryptosporidium hominis
IWYEKRVVRSLELFDSSIDGY

SEQ ID NO: 2174204 - protein, 19 aa, Cryptosporidium hominis
IYAAMCTKCAGELQQKLNP

SEQ ID NO: 2174205 - protein, 19 aa, Cryptosporidium hominis
IYCRIHKSIDLNVISNELS

SEQ ID NO: 2174206 - protein, 17 aa, Cryptosporidium hominis
IYDSKFKYLILNFSSLY

SEQ ID NO: 2174207 - protein, 18 aa, Cryptosporidium hominis
IYEKAFHIIVSYFPYEYE

SEQ ID NO: 2174208 - protein, 17 aa, Cryptosporidium hominis
IYEQCLNKELAEKNLLD

SEQ ID NO: 2174209 - protein, 24 aa, Cryptosporidium hominis
IYERPGEFVLLALLDQFEERLLFY

SEQ ID NO: 2174210 - protein, 19 aa, Cryptosporidium hominis
IYFICSWDPIKENEYGISL

SEQ ID NO: 2174211 - protein, 27 aa, Cryptosporidium hominis
IYFKLLESLIFCIPFGNSLNSGIERQS

SEQ ID NO: 2174212 - protein, 17 aa, Cryptosporidium hominis
IYFPCILLDEIDKKGKK

SEQ ID NO: 2174213 - protein, 18 aa, Cryptosporidium hominis
IYGAMNVSELLNLCSYHL

SEQ ID NO: 2174214 - protein, 19 aa, Cryptosporidium hominis
IYGHNHIKTAIACSLFSGV

SEQ ID NO: 2174215 - protein, 24 aa, Cryptosporidium hominis
IYGMSCLRSVLSMHDLVNNVSENR

SEQ ID NO: 2174216 - protein, 19 aa, Cryptosporidium hominis
IYHAKRMHNVWATKFTADG

SEQ ID NO: 2174217 - protein, 19 aa, Cryptosporidium hominis
IYHGNLFIVRNLLYLKYEL

SEQ ID NO: 2174218 - protein, 23 aa, Cryptosporidium hominis
IYHRLKKHLLTFSKSSYQQNSKE

SEQ ID NO: 2174219 - protein, 22 aa, Cryptosporidium hominis
IYIDSYCHLVPTFSLGQFEVEE

SEQ ID NO: 2174220 - protein, 23 aa, Cryptosporidium hominis
IYISIPCGYILDYFYLGVSAGDL

SEQ ID NO: 2174221 - protein, 18 aa, Cryptosporidium hominis
IYITGARVTFDIYSYSIF

SEQ ID NO: 2174222 - protein, 17 aa, Cryptosporidium hominis
IYKASLIATDNESKNLL

SEQ ID NO: 2174223 - protein, 21 aa, Cryptosporidium hominis
IYKDIPIPIPVKRTIEKPVPI

SEQ ID NO: 2174224 - protein, 17 aa, Cryptosporidium hominis
IYKLHVWASNYYFIHQN

SEQ ID NO: 2174225 - protein, 17 aa, Cryptosporidium hominis
IYKRLDINYTNKQVNSC

SEQ ID NO: 2174226 - protein, 25 aa, Cryptosporidium hominis
IYKYRYQCLRCFQMFGRQTKINDET

SEQ ID NO: 2174227 - protein, 33 aa, Cryptosporidium hominis
IYKYWRMRRHKLGKPLLRHFWPITSPHDSSPYA

SEQ ID NO: 2174228 - protein, 19 aa, Cryptosporidium hominis
IYLRQKRSPYLIGKFISLN

SEQ ID NO: 2174229 - protein, 17 aa, Cryptosporidium hominis
IYLVLWIQLHVRKEFSL

SEQ ID NO: 2174230 - protein, 20 aa, Cryptosporidium hominis
IYMKSCSLDAIVDLVSKSIL

SEQ ID NO: 2174231 - protein, 24 aa, Cryptosporidium hominis
IYNDLKILRFHDGISGKTYKALPS

SEQ ID NO: 2174232 - protein, 24 aa, Cryptosporidium hominis
IYNFIIKKYINWFLIPAADIFGFG

SEQ ID NO: 2174233 - protein, 18 aa, Cryptosporidium hominis
IYNGAKLFYLSGIHNGFY

SEQ ID NO: 2174234 - protein, 26 aa, Cryptosporidium hominis
IYNRLKLLVIDEAHIYTGHFGINTSY

SEQ ID NO: 2174235 - protein, 17 aa, Cryptosporidium hominis
IYNSCKFQSFTTLCTET

SEQ ID NO: 2174236 - protein, 24 aa, Cryptosporidium hominis
IYNYKKCTLWDLGFSHQINPLSSF

SEQ ID NO: 2174237 - protein, 24 aa, Cryptosporidium hominis
IYPELKYDRRGILSMASKGASKKP

SEQ ID NO: 2174238 - protein, 18 aa, Cryptosporidium hominis
IYPIYSIIKGEFFIHYQI

SEQ ID NO: 2174239 - protein, 23 aa, Cryptosporidium hominis
IYPKYPLDVTWRHDLFVKSNLDR

SEQ ID NO: 2174240 - protein, 43 aa, Cryptosporidium hominis
IYPSLEVGGPIARMNGTCGGFVPCFPGTYLNMHYDPHFGNFPG

SEQ ID NO: 2174241 - protein, 20 aa, Cryptosporidium hominis
IYPVDDWKVHFLSIIKKNLS

SEQ ID NO: 2174242 - protein, 27 aa, Cryptosporidium hominis
IYRSEWKRPPMYLLITHKGRNCKGNYP

SEQ ID NO: 2174243 - protein, 21 aa, Cryptosporidium hominis
IYRVLKRFIERAMMQENFNIH

SEQ ID NO: 2174244 - protein, 24 aa, Cryptosporidium hominis
IYSIKNCKLINSLFKSILGCKSDS

SEQ ID NO: 2174245 - protein, 18 aa, Cryptosporidium hominis
IYSRVVIQRIPWRELKEI

SEQ ID NO: 2174246 - protein, 18 aa, Cryptosporidium hominis
IYSSSLLSIQSFQSKSFV

SEQ ID NO: 2174247 - protein, 25 aa, Cryptosporidium hominis
IYSTCFSHAFNKLFLASSKGIIVYN

SEQ ID NO: 2174248 - protein, 26 aa, Cryptosporidium hominis
IYTSLRCPLFYMALMKLLFDEYPMIT

SEQ ID NO: 2174249 - protein, 19 aa, Cryptosporidium hominis
IYTYVSSYFGVIFIITRGG

SEQ ID NO: 2174250 - protein, 30 aa, Cryptosporidium hominis
IYVRNEILCGLNFCTLCYGKYSGISNQKVR

SEQ ID NO: 2174251 - protein, 18 aa, Cryptosporidium hominis
IYWTPCSQPSNIDHYDKE

SEQ ID NO: 2174252 - protein, 17 aa, Cryptosporidium hominis
IYYKLKLSIESFQQKLL

SEQ ID NO: 2174253 - protein, 20 aa, Cryptosporidium hominis
IYYLFGCRLIIIMELIELPK

SEQ ID NO: 2174254 - protein, 24 aa, Cryptosporidium hominis
KAAAQLKAAILARASSKKNISADN

SEQ ID NO: 2174255 - protein, 25 aa, Cryptosporidium hominis
KAAKFTCPICLEDWDNIMSRTLTIN

SEQ ID NO: 2174256 - protein, 19 aa, Cryptosporidium hominis
KACEKGFFSVLGLLLRDID

SEQ ID NO: 2174257 - protein, 18 aa, Cryptosporidium hominis
KADFPRVSIDPFDPKEKN

SEQ ID NO: 2174258 - protein, 25 aa, Cryptosporidium hominis
KADHAFRTGKYYDFPRFGINLNEIR

SEQ ID NO: 2174259 - protein, 19 aa, Cryptosporidium hominis
KADIIGVCSISIDMSSIGI

SEQ ID NO: 2174260 - protein, 18 aa, Cryptosporidium hominis
KADRIIIRSIGLGKINNL

SEQ ID NO: 2174261 - protein, 24 aa, Cryptosporidium hominis
KADYGELLVEGFKMVTINIFKFRI

SEQ ID NO: 2174262 - protein, 20 aa, Cryptosporidium hominis
KAEANSFFKEGQFDKSIEMY

SEQ ID NO: 2174263 - protein, 26 aa, Cryptosporidium hominis
KAEEEKEVWNIFSFSPVEDKSVYDID

SEQ ID NO: 2174264 - protein, 20 aa, Cryptosporidium hominis
KAEEKLRMEEELKVLKSMKR

SEQ ID NO: 2174265 - protein, 26 aa, Cryptosporidium hominis
KAEKLRLIYKTRFEEDLRAFMVSHKA

SEQ ID NO: 2174266 - protein, 20 aa, Cryptosporidium hominis
KAELGLNLHQLYNGRIPAAP

SEQ ID NO: 2174267 - protein, 24 aa, Cryptosporidium hominis
KAFDRIELIISIFSLLLEIINRGI

SEQ ID NO: 2174268 - protein, 23 aa, Cryptosporidium hominis
KAFFPKLLTWLSLPQTLQRYFLA

SEQ ID NO: 2174269 - protein, 25 aa, Cryptosporidium hominis
KAGLGRTGTLLGCYAIKNYRFTASA

SEQ ID NO: 2174270 - protein, 18 aa, Cryptosporidium hominis
KAGLQFPVGRVARYLKKG

SEQ ID NO: 2174271 - protein, 17 aa, Cryptosporidium hominis
KAGRMHLAILLLQHEPN

SEQ ID NO: 2174272 - protein, 20 aa, Cryptosporidium hominis
KAGSGWDVESMFALNEQKFG

SEQ ID NO: 2174273 - protein, 24 aa, Cryptosporidium hominis
KAIFKRWPSTVLQWEDLTTSRAID

SEQ ID NO: 2174274 - protein, 18 aa, Cryptosporidium hominis
KAIGLDWKIISSMQKLIS

SEQ ID NO: 2174275 - protein, 17 aa, Cryptosporidium hominis
KAIINILKFLDIERQNN

SEQ ID NO: 2174276 - protein, 17 aa, Cryptosporidium hominis
KAIKKIASMLGGGSFTA

SEQ ID NO: 2174277 - protein, 18 aa, Cryptosporidium hominis
KAITAGFFLQSARINKGG

SEQ ID NO: 2174278 - protein, 19 aa, Cryptosporidium hominis
KAKAGTLIDEILTKEAHLE

SEQ ID NO: 2174279 - protein, 18 aa, Cryptosporidium hominis
KAKEKALYRKKGGIPEGL

SEQ ID NO: 2174280 - protein, 24 aa, Cryptosporidium hominis
KAKIEMLTFYAIEICFKKIDSKLH

SEQ ID NO: 2174281 - protein, 20 aa, Cryptosporidium hominis
KAKLRKIRQMRSIRNQLESS

SEQ ID NO: 2174282 - protein, 21 aa, Cryptosporidium hominis
KAKRIIEESVSYWRTKDDQVK

SEQ ID NO: 2174283 - protein, 20 aa, Cryptosporidium hominis
KAKRVKRRLKKRKKRSYNLT

SEQ ID NO: 2174284 - protein, 34 aa, Cryptosporidium hominis
KALFHPDCIQQLLFCFHNNFPILWHPQVIAIIKS

SEQ ID NO: 2174285 - protein, 17 aa, Cryptosporidium hominis
KALLGRLAVNATKQVVS

SEQ ID NO: 2174286 - protein, 20 aa, Cryptosporidium hominis
KALPASIILQNAWRTLKPRL

SEQ ID NO: 2174287 - protein, 21 aa, Cryptosporidium hominis
KALQLDGFACMGSKIKVSRPN

SEQ ID NO: 2174288 - protein, 19 aa, Cryptosporidium hominis
KALRFYKRALLMDSRSSQT

SEQ ID NO: 2174289 - protein, 20 aa, Cryptosporidium hominis
KALTIDGGYQLNINLDPTYQ

SEQ ID NO: 2174290 - protein, 17 aa, Cryptosporidium hominis
KALVLESILSPVASVRG

SEQ ID NO: 2174291 - protein, 31 aa, Cryptosporidium hominis
KAMRCFVEAVLRYGVPPQFASFMISMDSNQS

SEQ ID NO: 2174292 - protein, 21 aa, Cryptosporidium hominis
KANELLDYILMSIIKDNGHNG

SEQ ID NO: 2174293 - protein, 18 aa, Cryptosporidium hominis
KANSLPIIQSRLGILTWY

SEQ ID NO: 2174294 - protein, 22 aa, Cryptosporidium hominis
KAPEGSKRFFDLVKFKDPKFKI

SEQ ID NO: 2174295 - protein, 19 aa, Cryptosporidium hominis
KAQEFKQKYLAEMAAYRAS

SEQ ID NO: 2174296 - protein, 25 aa, Cryptosporidium hominis
KAQFFKEPACSLVVAVHSANCTPLQ

SEQ ID NO: 2174297 - protein, 22 aa, Cryptosporidium hominis
KAQKKIPLWARSMNWIPKMKEQ

SEQ ID NO: 2174298 - protein, 19 aa, Cryptosporidium hominis
KAREAFEILNKAYEELQKA

SEQ ID NO: 2174299 - protein, 19 aa, Cryptosporidium hominis
KAREYAIHLIAHYDGVFGF

SEQ ID NO: 2174300 - protein, 26 aa, Cryptosporidium hominis
KARKCFVESHAAYSLVSYFLQVKDRH

SEQ ID NO: 2174301 - protein, 20 aa, Cryptosporidium hominis
KARVAKIIRNLMDMMSKIPD

SEQ ID NO: 2174302 - protein, 19 aa, Cryptosporidium hominis
KASDGSGLFELMPNNQLRL

SEQ ID NO: 2174303 - protein, 22 aa, Cryptosporidium hominis
KASPESFIFAQYLKLIIENRLN

SEQ ID NO: 2174304 - protein, 17 aa, Cryptosporidium hominis
KASRIFMLNNECISLSN

SEQ ID NO: 2174305 - protein, 24 aa, Cryptosporidium hominis
KATHICDLVKPSLYLDGEKDPKPY

SEQ ID NO: 2174306 - protein, 17 aa, Cryptosporidium hominis
KATWKLVSEEISMASII

SEQ ID NO: 2174307 - protein, 19 aa, Cryptosporidium hominis
KAVGYSSAGTVEFLYDIER

SEQ ID NO: 2174308 - protein, 18 aa, Cryptosporidium hominis
KAVIIGINYVETEGISLR

SEQ ID NO: 2174309 - protein, 24 aa, Cryptosporidium hominis
KAVKEYGLKCPWDPNDKLTEINWP

SEQ ID NO: 2174310 - protein, 20 aa, Cryptosporidium hominis
KAWENPRIVLANFLKSMFLT

SEQ ID NO: 2174311 - protein, 20 aa, Cryptosporidium hominis
KAYDYLIGFFETFKSKDEIS

SEQ ID NO: 2174312 - protein, 28 aa, Cryptosporidium hominis
KAYKMYYKCLVEWSCLTLDILPDKLGDN

SEQ ID NO: 2174313 - protein, 20 aa, Cryptosporidium hominis
KAYLYLKYLVQQKHGPVTID

SEQ ID NO: 2174314 - protein, 21 aa, Cryptosporidium hominis
KCFNMHMLIRFLAKNLSLYKY

SEQ ID NO: 2174315 - protein, 18 aa, Cryptosporidium hominis
KCGNKFSVGFSVSINFNL

SEQ ID NO: 2174316 - protein, 20 aa, Cryptosporidium hominis
KCGNLLACLEFIHGNINGPT

SEQ ID NO: 2174317 - protein, 19 aa, Cryptosporidium hominis
KCIDASICKFHEEETCIKL

SEQ ID NO: 2174318 - protein, 23 aa, Cryptosporidium hominis
KCIEVYRPGAIVLQCGADSVRGD

SEQ ID NO: 2174319 - protein, 17 aa, Cryptosporidium hominis
KCIKISSVMPNFSCPTD

SEQ ID NO: 2174320 - protein, 17 aa, Cryptosporidium hominis
KCITLYAQYHLFSSGNA

SEQ ID NO: 2174321 - protein, 20 aa, Cryptosporidium hominis
KCLLEVKSLIIFNYLFIIKL

SEQ ID NO: 2174322 - protein, 17 aa, Cryptosporidium hominis
KCLVKIHACSFLKNTAH

SEQ ID NO: 2174323 - protein, 25 aa, Cryptosporidium hominis
KCNPKCLICSQVLVKIKIVSFDKWN

SEQ ID NO: 2174324 - protein, 19 aa, Cryptosporidium hominis
KCNYYRGLLSREFPNIFEV

SEQ ID NO: 2174325 - protein, 18 aa, Cryptosporidium hominis
KCQLEKLKSWRSNVQSAI

SEQ ID NO: 2174326 - protein, 20 aa, Cryptosporidium hominis
KCREFLLKVMHYHSMRQFVD

SEQ ID NO: 2174327 - protein, 17 aa, Cryptosporidium hominis
KCSCGYWQTPSFQIHKS

SEQ ID NO: 2174328 - protein, 25 aa, Cryptosporidium hominis
KCSDKSILWKIFVKRRLRRLDLAHL

SEQ ID NO: 2174329 - protein, 26 aa, Cryptosporidium hominis
KCSDYKIRLFLIQTGKCYKIFDENIS

SEQ ID NO: 2174330 - protein, 21 aa, Cryptosporidium hominis
KCSESNWFKKVVIMNNNDEIT

SEQ ID NO: 2174331 - protein, 20 aa, Cryptosporidium hominis
KCSEYTPLYIYKSFGSSVRS

SEQ ID NO: 2174332 - protein, 23 aa, Cryptosporidium hominis
KCSIDCLPCFSMENSLINNYLMN

SEQ ID NO: 2174333 - protein, 21 aa, Cryptosporidium hominis
KCSQLDLLKFLKYSNDKLSKY

SEQ ID NO: 2174334 - protein, 17 aa, Cryptosporidium hominis
KCVDEFYSSIDIVKESK

SEQ ID NO: 2174335 - protein, 19 aa, Cryptosporidium hominis
KCVGREYRLNFSVGTKLKK

SEQ ID NO: 2174336 - protein, 19 aa, Cryptosporidium hominis
KCYCRIVGTTFEYTTSSNV

SEQ ID NO: 2174337 - protein, 27 aa, Cryptosporidium hominis
KCYIEEAKLLLSLKLKYVKMLLSSSIN

SEQ ID NO: 2174338 - protein, 28 aa, Cryptosporidium hominis
KCYQSWWHMRVIRELLGFDIEELNFINK

SEQ ID NO: 2174339 - protein, 22 aa, Cryptosporidium hominis
KDAKTGYLIVEDDVDFVMEKEN

SEQ ID NO: 2174340 - protein, 26 aa, Cryptosporidium hominis
KDATTCPKFILKSFYTVTKFLLCQND

SEQ ID NO: 2174341 - protein, 23 aa, Cryptosporidium hominis
KDAYEYAKQLWLKARNKSKLNKC

SEQ ID NO: 2174342 - protein, 19 aa, Cryptosporidium hominis
KDCHFVKEMESFKVNLIYS

SEQ ID NO: 2174343 - protein, 18 aa, Cryptosporidium hominis
KDDGCLILPISKRRVGLH

SEQ ID NO: 2174344 - protein, 21 aa, Cryptosporidium hominis
KDDYPLNWTMSNCEVNPSEDL

SEQ ID NO: 2174345 - protein, 24 aa, Cryptosporidium hominis
KDEATLEWSHRWNSQCEYIVRCFK

SEQ ID NO: 2174346 - protein, 19 aa, Cryptosporidium hominis
KDELLELFPENSKEEVNEK

SEQ ID NO: 2174347 - protein, 25 aa, Cryptosporidium hominis
KDELRKPYFVKCMKKVQERRNCAKV

SEQ ID NO: 2174348 - protein, 20 aa, Cryptosporidium hominis
KDEPVPWWLANVDKPNLVEV

SEQ ID NO: 2174349 - protein, 19 aa, Cryptosporidium hominis
KDERLIIKRNYIQIPNTKN

SEQ ID NO: 2174350 - protein, 20 aa, Cryptosporidium hominis
KDETVLWTWISKRSSKLETL

SEQ ID NO: 2174351 - protein, 17 aa, Cryptosporidium hominis
KDFAIGFNRWLQSHHNY

SEQ ID NO: 2174352 - protein, 19 aa, Cryptosporidium hominis
KDFECSFVLIPNQNKILEK

SEQ ID NO: 2174353 - protein, 19 aa, Cryptosporidium hominis
KDFEKGWKIHVKKSDRDFD

SEQ ID NO: 2174354 - protein, 21 aa, Cryptosporidium hominis
KDFIGCISSQAGVICTSNKRR

SEQ ID NO: 2174355 - protein, 17 aa, Cryptosporidium hominis
KDFNSSIVSTRKGTGTR

SEQ ID NO: 2174356 - protein, 20 aa, Cryptosporidium hominis
KDFQHRFVFFPSSTIHTKSL

SEQ ID NO: 2174357 - protein, 29 aa, Cryptosporidium hominis
KDGIWVHLVCAIWHLPLVTCEDWKNLSNW

SEQ ID NO: 2174358 - protein, 26 aa, Cryptosporidium hominis
KDGKNSFKVLFSWLNEELKLPSIENY

SEQ ID NO: 2174359 - protein, 25 aa, Cryptosporidium hominis
KDGKSRGYAFVTFKTIESALLACKN

SEQ ID NO: 2174360 - protein, 19 aa, Cryptosporidium hominis
KDGLFKYKTVVKSVNSKLS

SEQ ID NO: 2174361 - protein, 18 aa, Cryptosporidium hominis
KDGRLCGISMENNECIAL

SEQ ID NO: 2174362 - protein, 20 aa, Cryptosporidium hominis
KDGVKEGFGVYKLATGRIYE

SEQ ID NO: 2174363 - protein, 19 aa, Cryptosporidium hominis
KDGWIAVERFFRSVTKSLA

SEQ ID NO: 2174364 - protein, 20 aa, Cryptosporidium hominis
KDHMRQAGNVIRADVFEDEV

SEQ ID NO: 2174365 - protein, 19 aa, Cryptosporidium hominis
KDIDDALSIELINPNDDNS

SEQ ID NO: 2174366 - protein, 19 aa, Cryptosporidium hominis
KDIDFWKQQCENLNKTDIA

SEQ ID NO: 2174367 - protein, 17 aa, Cryptosporidium hominis
KDIFNRFNHYIYNDLGI

SEQ ID NO: 2174368 - protein, 17 aa, Cryptosporidium hominis
KDIFYFYQLFDGQLVYL

SEQ ID NO: 2174369 - protein, 19 aa, Cryptosporidium hominis
KDIGLAYCKVLLVGVGGIG

SEQ ID NO: 2174370 - protein, 25 aa, Cryptosporidium hominis
KDIIVSICCLILRIISCTWSNNFSS

SEQ ID NO: 2174371 - protein, 19 aa, Cryptosporidium hominis
KDILSIFWKFYLDGKFTMV

SEQ ID NO: 2174372 - protein, 24 aa, Cryptosporidium hominis
KDIMYEIIHRLYKRDKQQIFAEPV

SEQ ID NO: 2174373 - protein, 27 aa, Cryptosporidium hominis
KDINLFSMRCREWYSWHFPELAKIITD

SEQ ID NO: 2174374 - protein, 39 aa, Cryptosporidium hominis
KDINPVHGCLVPCLKCCIYPCRAFFLTGRCISQKRRVKK

SEQ ID NO: 2174375 - protein, 20 aa, Cryptosporidium hominis
KDIPHRFFLNQVKLLQIKYS

SEQ ID NO: 2174376 - protein, 17 aa, Cryptosporidium hominis
KDIPSSINSSICFVSPD

SEQ ID NO: 2174377 - protein, 32 aa, Cryptosporidium hominis
KDIQSLKTFGFRGEALSSISFVSQLSITSKTE

SEQ ID NO: 2174378 - protein, 18 aa, Cryptosporidium hominis
KDKDCLVSPNRTNEFSDI

SEQ ID NO: 2174379 - protein, 18 aa, Cryptosporidium hominis
KDKKLFKLLDEIFITHPN

SEQ ID NO: 2174380 - protein, 18 aa, Cryptosporidium hominis
KDKLIFIEGCSKSKAVTV

SEQ ID NO: 2174381 - protein, 24 aa, Cryptosporidium hominis
KDKLKELSPSLAVFAPEILQKVGL

SEQ ID NO: 2174382 - protein, 27 aa, Cryptosporidium hominis
KDKLRLFKENFGFEIYIKEKEYKLKNN

SEQ ID NO: 2174383 - protein, 19 aa, Cryptosporidium hominis
KDKPWDTDDIDHWNVPKLT

SEQ ID NO: 2174384 - protein, 18 aa, Cryptosporidium hominis
KDKVVLIVNICKILLSYM

SEQ ID NO: 2174385 - protein, 23 aa, Cryptosporidium hominis
KDLFEFPPCIGKAYNGNKPSLSL

SEQ ID NO: 2174386 - protein, 25 aa, Cryptosporidium hominis
KDLFTELIFNLLVNFDFEASQKILN

SEQ ID NO: 2174387 - protein, 22 aa, Cryptosporidium hominis
KDLKFLVSIHNLFFFKNIILET

SEQ ID NO: 2174388 - protein, 22 aa, Cryptosporidium hominis
KDLKSHIHWEIEREEDNMKLHE

SEQ ID NO: 2174389 - protein, 19 aa, Cryptosporidium hominis
KDLKSRYVNNFIFDDNPIA

SEQ ID NO: 2174390 - protein, 19 aa, Cryptosporidium hominis
KDLKYCFQKNGIGAQQTQT

SEQ ID NO: 2174391 - protein, 17 aa, Cryptosporidium hominis
KDLPLSYDEARFIREIW

SEQ ID NO: 2174392 - protein, 20 aa, Cryptosporidium hominis
KDLQGIMTCFNLLKTYINNV

SEQ ID NO: 2174393 - protein, 21 aa, Cryptosporidium hominis
KDMLVGLGLDIPVEVVSPTRV

SEQ ID NO: 2174394 - protein, 22 aa, Cryptosporidium hominis
KDMPEFRLLSVEEIDNYLTSIA

SEQ ID NO: 2174395 - protein, 33 aa, Cryptosporidium hominis
KDNDKEIFKNCILCRDYSSPICKECSKHNSKTS

SEQ ID NO: 2174396 - protein, 21 aa, Cryptosporidium hominis
KDNDPVFTLLFNETYLTIKDW

SEQ ID NO: 2174397 - protein, 20 aa, Cryptosporidium hominis
KDNESLKCFVPINRSDILHP

SEQ ID NO: 2174398 - protein, 18 aa, Cryptosporidium hominis
KDNIEVLPNIIVVDSNNE

SEQ ID NO: 2174399 - protein, 20 aa, Cryptosporidium hominis
KDNLADVVLFDIAEGIPQGK

SEQ ID NO: 2174400 - protein, 25 aa, Cryptosporidium hominis
KDNLLRGIYSYGFEFPSAIQRRAIV

SEQ ID NO: 2174401 - protein, 39 aa, Cryptosporidium hominis
KDPESRCTAAQAIYHPWFEKIQLSPGIMISCNNNNNNNI

SEQ ID NO: 2174402 - protein, 25 aa, Cryptosporidium hominis
KDPFEIEYFWKVFNPDIHFKPTLGY

SEQ ID NO: 2174403 - protein, 29 aa, Cryptosporidium hominis
KDPIKSDFCMLQFSRFISHYFEFPDLITI

SEQ ID NO: 2174404 - protein, 26 aa, Cryptosporidium hominis
KDPILLRIPLLFSDIYSNPADVAPFD

SEQ ID NO: 2174405 - protein, 21 aa, Cryptosporidium hominis
KDPSLSLGIFEDWRSIHNQEE

SEQ ID NO: 2174406 - protein, 25 aa, Cryptosporidium hominis
KDPVYKAQCQLSFKDSFSEGGLYVN

SEQ ID NO: 2174407 - protein, 18 aa, Cryptosporidium hominis
KDPYEIIDPAIIGTKNVI

SEQ ID NO: 2174408 - protein, 18 aa, Cryptosporidium hominis
KDQFEFERYFKLNEEFPK

SEQ ID NO: 2174409 - protein, 30 aa, Cryptosporidium hominis
KDQGIELHILFKRWDIRALNASNIMFETIF

SEQ ID NO: 2174410 - protein, 19 aa, Cryptosporidium hominis
KDQSILLYLSRYVEYKTNN

SEQ ID NO: 2174411 - protein, 17 aa, Cryptosporidium hominis
KDRIHGFGNPNFTDKIE

SEQ ID NO: 2174412 - protein, 17 aa, Cryptosporidium hominis
KDRPIDDYIILPLQLPP

SEQ ID NO: 2174413 - protein, 25 aa, Cryptosporidium hominis
KDRRELCSGYDLFLSDDRIIEKMPK

SEQ ID NO: 2174414 - protein, 25 aa, Cryptosporidium hominis
KDSDKPCTRFRGFVFDIVHSDIPTY

SEQ ID NO: 2174415 - protein, 21 aa, Cryptosporidium hominis
KDSEIVVCFIMQLPYYIKVQA

SEQ ID NO: 2174416 - protein, 18 aa, Cryptosporidium hominis
KDSFGLCHKETLIHEGNP

SEQ ID NO: 2174417 - protein, 25 aa, Cryptosporidium hominis
KDSIDLKVRHLRAKDLPKHLREQSR

SEQ ID NO: 2174418 - protein, 17 aa, Cryptosporidium hominis
KDSNIVKTDWRQINHTF

SEQ ID NO: 2174419 - protein, 27 aa, Cryptosporidium hominis
KDSQNFPLCIFKSNIISSKNHPLEGRS

SEQ ID NO: 2174420 - protein, 26 aa, Cryptosporidium hominis
KDSREVYCGNLPYSCTEEEIRGLFEE

SEQ ID NO: 2174421 - protein, 18 aa, Cryptosporidium hominis
KDSVKPLAKETFFSEGTD

SEQ ID NO: 2174422 - protein, 19 aa, Cryptosporidium hominis
KDTFLFRNHRKLLIADEKA

SEQ ID NO: 2174423 - protein, 22 aa, Cryptosporidium hominis
KDTLPPSWLRKINKEPMNSNNF

SEQ ID NO: 2174424 - protein, 19 aa, Cryptosporidium hominis
KDTLVELLIVVMFQNSNIN

SEQ ID NO: 2174425 - protein, 25 aa, Cryptosporidium hominis
KDTVRPPTAPTFFPSNKLNLDNNSN

SEQ ID NO: 2174426 - protein, 17 aa, Cryptosporidium hominis
KDVGIRPTIGQGRRQHG

SEQ ID NO: 2174427 - protein, 17 aa, Cryptosporidium hominis
KDVLSAVAYCHKLNVAH

SEQ ID NO: 2174428 - protein, 30 aa, Cryptosporidium hominis
KDYSLLSVRGHPIYADVGGFLISESTGNSK

SEQ ID NO: 2174429 - protein, 25 aa, Cryptosporidium hominis
KEAEITRLINLWKKMCPRTLEGKSQ

SEQ ID NO: 2174430 - protein, 25 aa, Cryptosporidium hominis
KEAQSLLRFPPEWRSLNNEEVLGHS

SEQ ID NO: 2174431 - protein, 21 aa, Cryptosporidium hominis
KECEIPHEFVGIGLNTGENVP

SEQ ID NO: 2174432 - protein, 30 aa, Cryptosporidium hominis
KEDESSISHCNRGGGCPFAHSYEEINYHPL

SEQ ID NO: 2174433 - protein, 26 aa, Cryptosporidium hominis
KEDILDFIDIYSLSSYFMGLTKIEGE

SEQ ID NO: 2174434 - protein, 19 aa, Cryptosporidium hominis
KEDIYRESINLLPKNSYSL

SEQ ID NO: 2174435 - protein, 21 aa, Cryptosporidium hominis
KEDLVTRLFIFTADQKSKLSK

SEQ ID NO: 2174436 - protein, 29 aa, Cryptosporidium hominis
KEDRLRRISTHSNRAWPSNVTNYLKGIDI

SEQ ID NO: 2174437 - protein, 17 aa, Cryptosporidium hominis
KEEKEILEVINSSEASI

SEQ ID NO: 2174438 - protein, 23 aa, Cryptosporidium hominis
KEEKVSGWFSMGGGGQHEESSPS

SEQ ID NO: 2174439 - protein, 19 aa, Cryptosporidium hominis
KEELRRKKIKTSETNNMSL

SEQ ID NO: 2174440 - protein, 25 aa, Cryptosporidium hominis
KEEMERWNIWIAYINMEIAYGKNEL

SEQ ID NO: 2174441 - protein, 25 aa, Cryptosporidium hominis
KEENGRTGVRGELFLNFEEVGRIQK

SEQ ID NO: 2174442 - protein, 17 aa, Cryptosporidium hominis
KEENIVFGRLSDMCHSN

SEQ ID NO: 2174443 - protein, 21 aa, Cryptosporidium hominis
KEERIKRFLDMGFNRESIITA

SEQ ID NO: 2174444 - protein, 17 aa, Cryptosporidium hominis
KEERREEQNLGRLRMPK

SEQ ID NO: 2174445 - protein, 22 aa, Cryptosporidium hominis
KEEWEERFGCPYPEEKTNEVPK

SEQ ID NO: 2174446 - protein, 19 aa, Cryptosporidium hominis
KEFFPKETLNFIANKLDMF

SEQ ID NO: 2174447 - protein, 21 aa, Cryptosporidium hominis
KEFGETVNWRWILINYCLPLS

SEQ ID NO: 2174448 - protein, 21 aa, Cryptosporidium hominis
KEFGFELKLAISTQEESPFTG

SEQ ID NO: 2174449 - protein, 21 aa, Cryptosporidium hominis
KEFMDSPIFIIWCANHIRSRL

SEQ ID NO: 2174450 - protein, 22 aa, Cryptosporidium hominis
KEFMIDKRFIIQIIQKHNEDGS

SEQ ID NO: 2174451 - protein, 20 aa, Cryptosporidium hominis
KEFNSFVSIERDLIFVFQLM

SEQ ID NO: 2174452 - protein, 20 aa, Cryptosporidium hominis
KEFPDKFGFSISHTSRSPRG

SEQ ID NO: 2174453 - protein, 22 aa, Cryptosporidium hominis
KEFQRLERIGAHSHIRGLGLND

SEQ ID NO: 2174454 - protein, 21 aa, Cryptosporidium hominis
KEFSYRFSPGLEKWQMTSVVE

SEQ ID NO: 2174455 - protein, 21 aa, Cryptosporidium hominis
KEFTVPVSWGMDLGSEHEKYI

SEQ ID NO: 2174456 - protein, 27 aa, Cryptosporidium hominis
KEFYIHESVFLFAREELQRIELPMQQI

SEQ ID NO: 2174457 - protein, 17 aa, Cryptosporidium hominis
KEGFDVFERNLCELESN

SEQ ID NO: 2174458 - protein, 21 aa, Cryptosporidium hominis
KEGFFKESDVWSFGMSMLEVL

SEQ ID NO: 2174459 - protein, 23 aa, Cryptosporidium hominis
KEGGELYNIWYGKYQFDYDKRGK

SEQ ID NO: 2174460 - protein, 39 aa, Cryptosporidium hominis
KEGKIPQGAHLLGFFKRLCKLLYYGILPVIVFDGTPPDI

SEQ ID NO: 2174461 - protein, 23 aa, Cryptosporidium hominis
KEGKTGIHSLKFRLTSDPSSNTN

SEQ ID NO: 2174462 - protein, 20 aa, Cryptosporidium hominis
KEGKVFSFEICDADGSEIRA

SEQ ID NO: 2174463 - protein, 17 aa, Cryptosporidium hominis
KEGLLVYSTCSFNPLEN

SEQ ID NO: 2174464 - protein, 32 aa, Cryptosporidium hominis
KEGLNALLRWLFRYVPDLSLSIRNLYIRYEDD

SEQ ID NO: 2174465 - protein, 18 aa, Cryptosporidium hominis
KEGLSFYRSVQKATLGCI

SEQ ID NO: 2174466 - protein, 31 aa, Cryptosporidium hominis
KEGRFLFKPFAEIARAVGIPAHSSYKEKSEL

SEQ ID NO: 2174467 - protein, 17 aa, Cryptosporidium hominis
KEGRFRGNLSGKRVDFS

SEQ ID NO: 2174468 - protein, 20 aa, Cryptosporidium hominis
KEGSEKLIFLLSTRAGGIGI

SEQ ID NO: 2174469 - protein, 17 aa, Cryptosporidium hominis
KEGTSFSDLYSGIYQKI

SEQ ID NO: 2174470 - protein, 24 aa, Cryptosporidium hominis
KEGVDSLVVLLGFAKAQQRKKLLK

SEQ ID NO: 2174471 - protein, 17 aa, Cryptosporidium hominis
KEHDCIMISCGDPQTSN

SEQ ID NO: 2174472 - protein, 21 aa, Cryptosporidium hominis
KEHFDKLLFFKMGKFYELFYI

SEQ ID NO: 2174473 - protein, 23 aa, Cryptosporidium hominis
KEIDRLFLNAGQFFKYIERCSPI

SEQ ID NO: 2174474 - protein, 20 aa, Cryptosporidium hominis
KEIEISILLKKNIKIPPKKD

SEQ ID NO: 2174475 - protein, 21 aa, Cryptosporidium hominis
KEIKEFAWIQICDKYNNGKSC

SEQ ID NO: 2174476 - protein, 18 aa, Cryptosporidium hominis
KEIKEQNFELAVFSFTNI

SEQ ID NO: 2174477 - protein, 20 aa, Cryptosporidium hominis
KEIKKSGAPSEEILKHLQKS

SEQ ID NO: 2174478 - protein, 21 aa, Cryptosporidium hominis
KEILKTILPYLNNWKDKRLEI

SEQ ID NO: 2174479 - protein, 25 aa, Cryptosporidium hominis
KEIQEKLRLKMEGWTIHGSGLQDPR

SEQ ID NO: 2174480 - protein, 21 aa, Cryptosporidium hominis
KEIQSSIHFNQVAALCFQLKQ

SEQ ID NO: 2174481 - protein, 18 aa, Cryptosporidium hominis
KEIRKLELEQTVNKIQEN

SEQ ID NO: 2174482 - protein, 26 aa, Cryptosporidium hominis
KEIRKRLDSYFSIVVRNIRDSVPKII

SEQ ID NO: 2174483 - protein, 17 aa, Cryptosporidium hominis
KEIRNIPELNTVPKDID

SEQ ID NO: 2174484 - protein, 28 aa, Cryptosporidium hominis
KEISAPIPIKIVPKIIPKPAITKEQPTN

SEQ ID NO: 2174485 - protein, 21 aa, Cryptosporidium hominis
KEISCGGHHTAILLVTGKLYM

SEQ ID NO: 2174486 - protein, 18 aa, Cryptosporidium hominis
KEISGIDILFNLDKISGS

SEQ ID NO: 2174487 - protein, 18 aa, Cryptosporidium hominis
KEIVDFYYCIWKRTSRYK

SEQ ID NO: 2174488 - protein, 21 aa, Cryptosporidium hominis
KEKDLKLARHVLYVHKNEKAP

SEQ ID NO: 2174489 - protein, 24 aa, Cryptosporidium hominis
KEKIPTCRTHFCGYDENLENSNIE

SEQ ID NO: 2174490 - protein, 24 aa, Cryptosporidium hominis
KEKIYECLKNIGIILKNVISFPNN

SEQ ID NO: 2174491 - protein, 21 aa, Cryptosporidium hominis
KEKKLSDKKEKPIVQEKDPKI

SEQ ID NO: 2174492 - protein, 18 aa, Cryptosporidium hominis
KEKLRMKRFEEKNKKFEK

SEQ ID NO: 2174493 - protein, 18 aa, Cryptosporidium hominis
KEKYNLKSTDNWKNPDEF

SEQ ID NO: 2174494 - protein, 20 aa, Cryptosporidium hominis
KEKYRWGEATSLLSVTESLI

SEQ ID NO: 2174495 - protein, 18 aa, Cryptosporidium hominis
KELCYKEPHGSFLCEIKT

SEQ ID NO: 2174496 - protein, 17 aa, Cryptosporidium hominis
KELELHDIMSWIPEVKY

SEQ ID NO: 2174497 - protein, 19 aa, Cryptosporidium hominis
KELERERQRLLRTDIIRQM

SEQ ID NO: 2174498 - protein, 20 aa, Cryptosporidium hominis
KELEWKEVIAYFRGSELQTY

SEQ ID NO: 2174499 - protein, 20 aa, Cryptosporidium hominis
KELGEMAGLCKVDREGNPRK

SEQ ID NO: 2174500 - protein, 19 aa, Cryptosporidium hominis
KELGWKAKHSIFDACKSAY

SEQ ID NO: 2174501 - protein, 21 aa, Cryptosporidium hominis
KELHAIWIISILRQLRSEVDT

SEQ ID NO: 2174502 - protein, 20 aa, Cryptosporidium hominis
KELIREAVNILKLTRKSKKN

SEQ ID NO: 2174503 - protein, 20 aa, Cryptosporidium hominis
KELISIFNIDVVVVMDDPST

SEQ ID NO: 2174504 - protein, 22 aa, Cryptosporidium hominis
KELKCDEDVKIVMHSNELGVEL

SEQ ID NO: 2174505 - protein, 24 aa, Cryptosporidium hominis
KELKEFNLDISFIINAFEAVIATL

SEQ ID NO: 2174506 - protein, 27 aa, Cryptosporidium hominis
KELKRQIMLHRCSMPIMNNKGSEGTSS

SEQ ID NO: 2174507 - protein, 20 aa, Cryptosporidium hominis
KELNNRCIIEIEKKESLEKV

SEQ ID NO: 2174508 - protein, 24 aa, Cryptosporidium hominis
KELRLDGWPALCIHGDKKQEERTW

SEQ ID NO: 2174509 - protein, 21 aa, Cryptosporidium hominis
KELRQSCNQKRKHQVSITFIF

SEQ ID NO: 2174510 - protein, 27 aa, Cryptosporidium hominis
KELSALSFLIPIDFFCQLKLNRIQVLK

SEQ ID NO: 2174511 - protein, 24 aa, Cryptosporidium hominis
KELTHPSFHWTLHKLKPVLQGLVL

SEQ ID NO: 2174512 - protein, 32 aa, Cryptosporidium hominis
KELTSICTISPFKLKEEWLNYLVKLDNYEKEI

SEQ ID NO: 2174513 - protein, 28 aa, Cryptosporidium hominis
KELTYCCTSCNYMLICETCIIIDGHGSH

SEQ ID NO: 2174514 - protein, 19 aa, Cryptosporidium hominis
KEMKAAMQSLGFESQNPTM

SEQ ID NO: 2174515 - protein, 17 aa, Cryptosporidium hominis
KEMRILVLGLDNAGKTT

SEQ ID NO: 2174516 - protein, 21 aa, Cryptosporidium hominis
KEMSEKPFFVNFLNDKVKIDN

SEQ ID NO: 2174517 - protein, 17 aa, Cryptosporidium hominis
KENAYWYNIDHMIDSKF

SEQ ID NO: 2174518 - protein, 20 aa, Cryptosporidium hominis
KENICAVLAQLLTNTDHSKN

SEQ ID NO: 2174519 - protein, 21 aa, Cryptosporidium hominis
KENKFHPPVTTWWVEGANHNL

SEQ ID NO: 2174520 - protein, 19 aa, Cryptosporidium hominis
KENLAALLQSVSKLDTDLR

SEQ ID NO: 2174521 - protein, 18 aa, Cryptosporidium hominis
KENLEKMALYLGEPQNTI

SEQ ID NO: 2174522 - protein, 20 aa, Cryptosporidium hominis
KENVLDFNINGFDDFQIIDL

SEQ ID NO: 2174523 - protein, 17 aa, Cryptosporidium hominis
KEPRSSLQYSASATDLS

SEQ ID NO: 2174524 - protein, 23 aa, Cryptosporidium hominis
KEPSPFPISPIINYNNYKQNIHS

SEQ ID NO: 2174525 - protein, 23 aa, Cryptosporidium hominis
KEPVRLGFEASQAMQQVIQSENL

SEQ ID NO: 2174526 - protein, 19 aa, Cryptosporidium hominis
KEQFEVFIFHIEKRIEKSS

SEQ ID NO: 2174527 - protein, 28 aa, Cryptosporidium hominis
KEQFKIHKEFIIPISWSSDGLRLSKISF

SEQ ID NO: 2174528 - protein, 21 aa, Cryptosporidium hominis
KEQIGGIIPAVGFNSSNANAT

SEQ ID NO: 2174529 - protein, 23 aa, Cryptosporidium hominis
KEQKIWISSLFKLMNGILQLSLL

SEQ ID NO: 2174530 - protein, 23 aa, Cryptosporidium hominis
KERCWRIGQKKEVIVYRLITRDT

SEQ ID NO: 2174531 - protein, 17 aa, Cryptosporidium hominis
KEREIDNELYIQNDCIY

SEQ ID NO: 2174532 - protein, 25 aa, Cryptosporidium hominis
KERKHWRYNLLDTRILGKKHVEAWA

SEQ ID NO: 2174533 - protein, 25 aa, Cryptosporidium hominis
KERMSELLKLEAFLIREVSRHRKSL

SEQ ID NO: 2174534 - protein, 20 aa, Cryptosporidium hominis
KERRLEAGATVLADRGIVCI

SEQ ID NO: 2174535 - protein, 21 aa, Cryptosporidium hominis
KERRRASSIIFSYEEDEPELK

SEQ ID NO: 2174536 - protein, 17 aa, Cryptosporidium hominis
KERSHAFFVKKVAKDKA

SEQ ID NO: 2174537 - protein, 24 aa, Cryptosporidium hominis
KERTFYLDHIFPMDTNQSYVYKTA

SEQ ID NO: 2174538 - protein, 18 aa, Cryptosporidium hominis
KERYPCFVDALRDLDDAL

SEQ ID NO: 2174539 - protein, 21 aa, Cryptosporidium hominis
KESCLSCPKDIIVSICCLILR

SEQ ID NO: 2174540 - protein, 22 aa, Cryptosporidium hominis
KESKKWWQIVVEIVQKPNSYVK

SEQ ID NO: 2174541 - protein, 29 aa, Cryptosporidium hominis
KESKRMIGEILKWYFGMSHVSLNDITPDI

SEQ ID NO: 2174542 - protein, 20 aa, Cryptosporidium hominis
KESKYDISCISVPTFCNKAK

SEQ ID NO: 2174543 - protein, 18 aa, Cryptosporidium hominis
KESLLAIYNLCKRLNKKA

SEQ ID NO: 2174544 - protein, 23 aa, Cryptosporidium hominis
KESQKRINILLSRINLPENENGI

SEQ ID NO: 2174545 - protein, 20 aa, Cryptosporidium hominis
KESRWKNKQRVLVLSTRGIN

SEQ ID NO: 2174546 - protein, 22 aa, Cryptosporidium hominis
KESRWLPTVLIGLINRYYSRKR

SEQ ID NO: 2174547 - protein, 24 aa, Cryptosporidium hominis
KESRYPIFTEERARLLKLDKTPEN

SEQ ID NO: 2174548 - protein, 22 aa, Cryptosporidium hominis
KESWLCKSCNERIYSINGYLNP

SEQ ID NO: 2174549 - protein, 18 aa, Cryptosporidium hominis
KETFSEKSIIKRDLENKL

SEQ ID NO: 2174550 - protein, 18 aa, Cryptosporidium hominis
KETLKLPPGIRVYTKLSK

SEQ ID NO: 2174551 - protein, 20 aa, Cryptosporidium hominis
KETSIKLSIFYCCNSTPNEH

SEQ ID NO: 2174552 - protein, 19 aa, Cryptosporidium hominis
KETYCTHTMIVFIKILNEE

SEQ ID NO: 2174553 - protein, 20 aa, Cryptosporidium hominis
KEVIEHDLLLGLENPLKKII

SEQ ID NO: 2174554 - protein, 18 aa, Cryptosporidium hominis
KEVKVLLLSLLKVDPLLR

SEQ ID NO: 2174555 - protein, 20 aa, Cryptosporidium hominis
KEVLIGVIFEFDHVLNKRLG

SEQ ID NO: 2174556 - protein, 25 aa, Cryptosporidium hominis
KEVNKRMTFLIDYCKLHPDDDISPE

SEQ ID NO: 2174557 - protein, 23 aa, Cryptosporidium hominis
KEVQKRFVICPLDVVVVQGKSNP

SEQ ID NO: 2174558 - protein, 18 aa, Cryptosporidium hominis
KEVSIWAPRIRAVKYHGS

SEQ ID NO: 2174559 - protein, 19 aa, Cryptosporidium hominis
KEVYLKCFEYLIDLVNKAI

SEQ ID NO: 2174560 - protein, 19 aa, Cryptosporidium hominis
KEYEIILLLLKDLISYFSK

SEQ ID NO: 2174561 - protein, 24 aa, Cryptosporidium hominis
KEYEIKRSLIYETLNRKINLKSEL

SEQ ID NO: 2174562 - protein, 21 aa, Cryptosporidium hominis
KEYKVLLELFDICYQGTVGDF

SEQ ID NO: 2174563 - protein, 20 aa, Cryptosporidium hominis
KEYLFSFIEEFYLMMRFRWD

SEQ ID NO: 2174564 - protein, 18 aa, Cryptosporidium hominis
KEYLIKWKVPGQPVQPTW

SEQ ID NO: 2174565 - protein, 25 aa, Cryptosporidium hominis
KEYLVSNIFLYRSCISDSHRVELEF

SEQ ID NO: 2174566 - protein, 20 aa, Cryptosporidium hominis
KEYLYLMALVDDSKFIDVDK

SEQ ID NO: 2174567 - protein, 23 aa, Cryptosporidium hominis
KEYPRFLTQYFKIRKEWKEYNRS

SEQ ID NO: 2174568 - protein, 21 aa, Cryptosporidium hominis
KEYSEGSAFNFKENHITECST

SEQ ID NO: 2174569 - protein, 19 aa, Cryptosporidium hominis
KEYSSSCLEDLSNNLIFNN

SEQ ID NO: 2174570 - protein, 35 aa, Cryptosporidium hominis
KEYSTDTNIEFSRNSIKIIALISIKFKETASNCFQ

SEQ ID NO: 2174571 - protein, 17 aa, Cryptosporidium hominis
KFAHVPCTIGAFEAEEV

SEQ ID NO: 2174572 - protein, 31 aa, Cryptosporidium hominis
KFASDLLYRAEILDILSYCRLIIDETADDCF

SEQ ID NO: 2174573 - protein, 19 aa, Cryptosporidium hominis
KFDQIVKHFDYLDIEESEP

SEQ ID NO: 2174574 - protein, 18 aa, Cryptosporidium hominis
KFEEILHWNNFYKILDGF

SEQ ID NO: 2174575 - protein, 18 aa, Cryptosporidium hominis
KFELKMSLIKSELNLQKD

SEQ ID NO: 2174576 - protein, 23 aa, Cryptosporidium hominis
KFEMAGKIAERFQFHDKYMQIQL

SEQ ID NO: 2174577 - protein, 18 aa, Cryptosporidium hominis
KFENCNRASLGQLIGVDY

SEQ ID NO: 2174578 - protein, 26 aa, Cryptosporidium hominis
KFERRCKPDYYQFFFGYLDYEKEKKD

SEQ ID NO: 2174579 - protein, 20 aa, Cryptosporidium hominis
KFFGCELGALSKWEDKEEKS

SEQ ID NO: 2174580 - protein, 17 aa, Cryptosporidium hominis
KFFQARPPLPYVPYPNR

SEQ ID NO: 2174581 - protein, 20 aa, Cryptosporidium hominis
KFFRFFDFFISFSNKDPTKK

SEQ ID NO: 2174582 - protein, 21 aa, Cryptosporidium hominis
KFGKGNFKFEKGIEKIKKDIT

SEQ ID NO: 2174583 - protein, 18 aa, Cryptosporidium hominis
KFGWIAYHEYLFTKERLH

SEQ ID NO: 2174584 - protein, 20 aa, Cryptosporidium hominis
KFHFKGELLEKIKASKEKIN

SEQ ID NO: 2174585 - protein, 21 aa, Cryptosporidium hominis
KFIPKNVNVEFYWDKFQVNDI

SEQ ID NO: 2174586 - protein, 18 aa, Cryptosporidium hominis
KFIPRHLVKLTEYVILFW

SEQ ID NO: 2174587 - protein, 19 aa, Cryptosporidium hominis
KFISNSNVILWHEFETNNK

SEQ ID NO: 2174588 - protein, 19 aa, Cryptosporidium hominis
KFIYCTSCSDFYNNKKITS

SEQ ID NO: 2174589 - protein, 19 aa, Cryptosporidium hominis
KFKDFYNRYKILYPSFESH

SEQ ID NO: 2174590 - protein, 18 aa, Cryptosporidium hominis
KFKDVPTLIKAVNFQSNN

SEQ ID NO: 2174591 - protein, 18 aa, Cryptosporidium hominis
KFKGDEFGDSGMISSSGH

SEQ ID NO: 2174592 - protein, 17 aa, Cryptosporidium hominis
KFKKIVERLTFMNVEKE

SEQ ID NO: 2174593 - protein, 21 aa, Cryptosporidium hominis
KFKKNMRDGSGLGVEGYSSVA

SEQ ID NO: 2174594 - protein, 18 aa, Cryptosporidium hominis
KFKNIRPGKLSQRLKDAL

SEQ ID NO: 2174595 - protein, 23 aa, Cryptosporidium hominis
KFKSHLYYSRFLLEQLVNSNWKK

SEQ ID NO: 2174596 - protein, 24 aa, Cryptosporidium hominis
KFKTEVYRLQVFLKLLEKNDQLPV

SEQ ID NO: 2174597 - protein, 25 aa, Cryptosporidium hominis
KFLDERPIDVSVIFWDKMSFNADNQ

SEQ ID NO: 2174598 - protein, 22 aa, Cryptosporidium hominis
KFLQICRKPVYSRGIQSILKWG

SEQ ID NO: 2174599 - protein, 22 aa, Cryptosporidium hominis
KFLTEACLRGALDNLKSPASSI

SEQ ID NO: 2174600 - protein, 19 aa, Cryptosporidium hominis
KFMSFGVASLRSMNSNALS

SEQ ID NO: 2174601 - protein, 24 aa, Cryptosporidium hominis
KFNEMDFCMSGMMVINSLNNTTGE

SEQ ID NO: 2174602 - protein, 19 aa, Cryptosporidium hominis
KFNKLEEFDSLSLTYNSKN

SEQ ID NO: 2174603 - protein, 18 aa, Cryptosporidium hominis
KFNTMVVIFPEFNDMEMS

SEQ ID NO: 2174604 - protein, 23 aa, Cryptosporidium hominis
KFPCRYLNTVGFCRNLKDCRFSH

SEQ ID NO: 2174605 - protein, 18 aa, Cryptosporidium hominis
KFPKLRVLLDPEGIPCND

SEQ ID NO: 2174606 - protein, 23 aa, Cryptosporidium hominis
KFPLMEICKVNGPDALEFVQKLK

SEQ ID NO: 2174607 - protein, 22 aa, Cryptosporidium hominis
KFPNFFDFGVNLTLPASFQVSE

SEQ ID NO: 2174608 - protein, 21 aa, Cryptosporidium hominis
KFPRSVCSKNHLIKSQDSNEI

SEQ ID NO: 2174609 - protein, 18 aa, Cryptosporidium hominis
KFQDCGILELKDGINCTL

SEQ ID NO: 2174610 - protein, 18 aa, Cryptosporidium hominis
KFSAYFLLIRKQIQQGSS

SEQ ID NO: 2174611 - protein, 31 aa, Cryptosporidium hominis
KFSEIFGIEHLLRLLIILPKLIGDHISFGEY

SEQ ID NO: 2174612 - protein, 21 aa, Cryptosporidium hominis
KFSGDAICVVWPVDDESINLN

SEQ ID NO: 2174613 - protein, 19 aa, Cryptosporidium hominis
KFSGRFICIEGMYTFLDIS

SEQ ID NO: 2174614 - protein, 26 aa, Cryptosporidium hominis
KFSKLEESRKFWGISESRYISTIKSN

SEQ ID NO: 2174615 - protein, 17 aa, Cryptosporidium hominis
KFSKNNKFRLGITSLQY

SEQ ID NO: 2174616 - protein, 20 aa, Cryptosporidium hominis
KFSVKCIKGSSIEEYEYGHF

SEQ ID NO: 2174617 - protein, 20 aa, Cryptosporidium hominis
KFSYYSKIKFVLVVEKDTIF

SEQ ID NO: 2174618 - protein, 20 aa, Cryptosporidium hominis
KFTEVFPRSKTRSTYISDAY

SEQ ID NO: 2174619 - protein, 25 aa, Cryptosporidium hominis
KFTEYLCGSYVKVPIINPSTNSEIF

SEQ ID NO: 2174620 - protein, 18 aa, Cryptosporidium hominis
KFTSLPSCQVYSYQDKET

SEQ ID NO: 2174621 - protein, 20 aa, Cryptosporidium hominis
KFVLEDIKEMFSIKNIEILE

SEQ ID NO: 2174622 - protein, 24 aa, Cryptosporidium hominis
KFYLTEMKHIIGILEDMDTKRIKC

SEQ ID NO: 2174623 - protein, 27 aa, Cryptosporidium hominis
KFYYNKELKSWVVRGEEHLVEQKQNLP

SEQ ID NO: 2174624 - protein, 24 aa, Cryptosporidium hominis
KGAKLKFDIGYNMEERTGPQNELD

SEQ ID NO: 2174625 - protein, 18 aa, Cryptosporidium hominis
KGAPELFTGGIYGLNLTS

SEQ ID NO: 2174626 - protein, 34 aa, Cryptosporidium hominis
KGAYMPPECWKIFWRLEENKIQFPLEELMDIDTY

SEQ ID NO: 2174627 - protein, 22 aa, Cryptosporidium hominis
KGDAGINWSQYLVFKRLNIKII

SEQ ID NO: 2174628 - protein, 19 aa, Cryptosporidium hominis
KGDGNFRVFKFDNEEDSLT

SEQ ID NO: 2174629 - protein, 24 aa, Cryptosporidium hominis
KGDRLKYKTVWMGPGGGYSLMEEY

SEQ ID NO: 2174630 - protein, 23 aa, Cryptosporidium hominis
KGDRRRGRGRGRGRGMRGRGRGG

SEQ ID NO: 2174631 - protein, 24 aa, Cryptosporidium hominis
KGDYIVGWFSPFAIDSETIGSVKL

SEQ ID NO: 2174632 - protein, 21 aa, Cryptosporidium hominis
KGEIKKRIALVGKGITMDTGG

SEQ ID NO: 2174633 - protein, 21 aa, Cryptosporidium hominis
KGELLISLYRRLYILRPFIEK

SEQ ID NO: 2174634 - protein, 17 aa, Cryptosporidium hominis
KGELVNILVIQDSRSGF

SEQ ID NO: 2174635 - protein, 18 aa, Cryptosporidium hominis
KGENRYGDKWEEEWKEDF

SEQ ID NO: 2174636 - protein, 25 aa, Cryptosporidium hominis
KGESSILIWDCNKYIIKDNTKNYNQ

SEQ ID NO: 2174637 - protein, 22 aa, Cryptosporidium hominis
KGFKQRRLDSWVRVRKNTEGGS

SEQ ID NO: 2174638 - protein, 27 aa, Cryptosporidium hominis
KGFTDHGWRMAVEFILFGSIPNMPYYT

SEQ ID NO: 2174639 - protein, 18 aa, Cryptosporidium hominis
KGGEGGGLQGNQQEGGSI

SEQ ID NO: 2174640 - protein, 20 aa, Cryptosporidium hominis
KGGGGECWAEGGGKETEKRG

SEQ ID NO: 2174641 - protein, 21 aa, Cryptosporidium hominis
KGGQIIISFTQLLPVPKAHFV

SEQ ID NO: 2174642 - protein, 20 aa, Cryptosporidium hominis
KGGRGCGGHSNCNINSLDEF

SEQ ID NO: 2174643 - protein, 30 aa, Cryptosporidium hominis
KGGVLRQILKLILKIGNFLNHGTSRGKSCG

SEQ ID NO: 2174644 - protein, 18 aa, Cryptosporidium hominis
KGGVNFRENLKYGTSGRV

SEQ ID NO: 2174645 - protein, 21 aa, Cryptosporidium hominis
KGHGHAVSFLKKFNVPLLILG

SEQ ID NO: 2174646 - protein, 29 aa, Cryptosporidium hominis
KGHLKLLDFGLCKFSPLIEGDKNSEYQTE

SEQ ID NO: 2174647 - protein, 20 aa, Cryptosporidium hominis
KGIDIFLRIPEYIRPKKDGA

SEQ ID NO: 2174648 - protein, 22 aa, Cryptosporidium hominis
KGIEFLSEYIFLTKGRFHILDI

SEQ ID NO: 2174649 - protein, 20 aa, Cryptosporidium hominis
KGIHPSILREIGILKELSNH

SEQ ID NO: 2174650 - protein, 18 aa, Cryptosporidium hominis
KGIIFAKDLRDGYWDYGR

SEQ ID NO: 2174651 - protein, 21 aa, Cryptosporidium hominis
KGIPYQSALEKFWLVDSKGLI

SEQ ID NO: 2174652 - protein, 18 aa, Cryptosporidium hominis
KGIQRWGEKVTNELTKVT

SEQ ID NO: 2174653 - protein, 17 aa, Cryptosporidium hominis
KGKLCTFAHSKEEQLYH

SEQ ID NO: 2174654 - protein, 26 aa, Cryptosporidium hominis
KGKVVIDCFRLISPHSVIAGQEPRQT

SEQ ID NO: 2174655 - protein, 18 aa, Cryptosporidium hominis
KGLDLVRRDWSILTRNVS

SEQ ID NO: 2174656 - protein, 25 aa, Cryptosporidium hominis
KGLGCSFLDIIYSFAIKDEDIMEIT

SEQ ID NO: 2174657 - protein, 18 aa, Cryptosporidium hominis
KGLGELGFVIGRHGPDSD

SEQ ID NO: 2174658 - protein, 17 aa, Cryptosporidium hominis
KGLRYQLPMRGHTGYLS

SEQ ID NO: 2174659 - protein, 25 aa, Cryptosporidium hominis
KGLTPTQLGINWHACTQRFCVTYTT

SEQ ID NO: 2174660 - protein, 20 aa, Cryptosporidium hominis
KGLVLFIGKLIADTWLKSKV

SEQ ID NO: 2174661 - protein, 17 aa, Cryptosporidium hominis
KGNIFGMKLAKKDEIVE

SEQ ID NO: 2174662 - protein, 17 aa, Cryptosporidium hominis
KGNYGFIEFRTVEETEK

SEQ ID NO: 2174663 - protein, 24 aa, Cryptosporidium hominis
KGPELKFPLGYVLTEKEQNRVKKG

SEQ ID NO: 2174664 - protein, 23 aa, Cryptosporidium hominis
KGPELSYDFNLYLEKYIHDQIKP

SEQ ID NO: 2174665 - protein, 18 aa, Cryptosporidium hominis
KGPLKEFRGYSLAGNDDG

SEQ ID NO: 2174666 - protein, 17 aa, Cryptosporidium hominis
KGPTLADICKGGVTSIK

SEQ ID NO: 2174667 - protein, 24 aa, Cryptosporidium hominis
KGQKMSLNWSVLIIRSRNETPDLI

SEQ ID NO: 2174668 - protein, 20 aa, Cryptosporidium hominis
KGQTKLGRFKFSKNKKKSKK

SEQ ID NO: 2174669 - protein, 20 aa, Cryptosporidium hominis
KGRFYAFGRVFSGTVATGQK

SEQ ID NO: 2174670 - protein, 18 aa, Cryptosporidium hominis
KGRISRYLANKCSIAARI

SEQ ID NO: 2174671 - protein, 18 aa, Cryptosporidium hominis
KGRIYEILKDFKSDDIEI

SEQ ID NO: 2174672 - protein, 24 aa, Cryptosporidium hominis
KGRKCSSSRCILRGRCICYNDVFF

SEQ ID NO: 2174673 - protein, 19 aa, Cryptosporidium hominis
KGRKIRYVPIPKLENFMAS

SEQ ID NO: 2174674 - protein, 23 aa, Cryptosporidium hominis
KGRNCKGNYPLAKEDNINYDIDT

SEQ ID NO: 2174675 - protein, 28 aa, Cryptosporidium hominis
KGSAGLLFCVLGDGFAYLLSIPLLNNMI

SEQ ID NO: 2174676 - protein, 24 aa, Cryptosporidium hominis
KGSDSSHFTVEWISKASASQRSGR

SEQ ID NO: 2174677 - protein, 31 aa, Cryptosporidium hominis
KGSERRRGSGRYKFGGGYAEEDRRRGEEEDD

SEQ ID NO: 2174678 - protein, 18 aa, Cryptosporidium hominis
KGSLPEDCYYSADEDFQL

SEQ ID NO: 2174679 - protein, 24 aa, Cryptosporidium hominis
KGTAAWKGMKVCVKLTVQNRQAKI

SEQ ID NO: 2174680 - protein, 23 aa, Cryptosporidium hominis
KGVAFKKTFSYAGFEQQPKHFVN

SEQ ID NO: 2174681 - protein, 21 aa, Cryptosporidium hominis
KGVFDLLKPGGMMLFADISPT

SEQ ID NO: 2174682 - protein, 22 aa, Cryptosporidium hominis
KGVKIIGPIALHIFPKSEFYYN

SEQ ID NO: 2174683 - protein, 22 aa, Cryptosporidium hominis
KGVPLRLQFPLNDKYEHGNMQF

SEQ ID NO: 2174684 - protein, 26 aa, Cryptosporidium hominis
KGVSKIWLPTEYEMSITPNWSQDINN

SEQ ID NO: 2174685 - protein, 26 aa, Cryptosporidium hominis
KGYENKRIYAIPVIEKVKCYVDTNYG

SEQ ID NO: 2174686 - protein, 26 aa, Cryptosporidium hominis
KGYISLKSIEQWAKMQYNSFCQDNNS

SEQ ID NO: 2174687 - protein, 22 aa, Cryptosporidium hominis
KHDRLNCPICRGMHLEDAPLLY

SEQ ID NO: 2174688 - protein, 20 aa, Cryptosporidium hominis
KHEVAKLLCLDRIPSSNELI

SEQ ID NO: 2174689 - protein, 19 aa, Cryptosporidium hominis
KHFIPKSYYWILIIVWYRI

SEQ ID NO: 2174690 - protein, 22 aa, Cryptosporidium hominis
KHGVLIPKRIHTILVSVQHDEN

SEQ ID NO: 2174691 - protein, 24 aa, Cryptosporidium hominis
KHIEKRINGNIPLMANERKNEILD

SEQ ID NO: 2174692 - protein, 22 aa, Cryptosporidium hominis
KHIKRKKIMIRNEISNIKRSLH

SEQ ID NO: 2174693 - protein, 21 aa, Cryptosporidium hominis
KHILSFNKKWEKPSKYHKIPQ

SEQ ID NO: 2174694 - protein, 17 aa, Cryptosporidium hominis
KHINWLESEISRVDEEW

SEQ ID NO: 2174695 - protein, 19 aa, Cryptosporidium hominis
KHIYEIYSLHKSIQVYNPT

SEQ ID NO: 2174696 - protein, 24 aa, Cryptosporidium hominis
KHKKMPCKSALNFGENIINMGAPS

SEQ ID NO: 2174697 - protein, 19 aa, Cryptosporidium hominis
KHKLLTFLLAWKFGTQYFH

SEQ ID NO: 2174698 - protein, 28 aa, Cryptosporidium hominis
KHKRWRKFFPCLKKNINYDVNTINNTTN

SEQ ID NO: 2174699 - protein, 17 aa, Cryptosporidium hominis
KHLGQSNINLGLNSPDG

SEQ ID NO: 2174700 - protein, 19 aa, Cryptosporidium hominis
KHLILYFNLIIFSIKSDKS

SEQ ID NO: 2174701 - protein, 23 aa, Cryptosporidium hominis
KHLKLPLKLIKDLFIQVFGTPRY

SEQ ID NO: 2174702 - protein, 24 aa, Cryptosporidium hominis
KHMKEHLVCIMCMFEDHVNIMLDN

SEQ ID NO: 2174703 - protein, 24 aa, Cryptosporidium hominis
KHPRGELKLWPTSYDRVISQNSSK

SEQ ID NO: 2174704 - protein, 17 aa, Cryptosporidium hominis
KHRTVKEMVDKYISFLR

SEQ ID NO: 2174705 - protein, 17 aa, Cryptosporidium hominis
KHSLECGNSCGTIYLED

SEQ ID NO: 2174706 - protein, 18 aa, Cryptosporidium hominis
KHSLNFRQPNLNNFFDSS

SEQ ID NO: 2174707 - protein, 22 aa, Cryptosporidium hominis
KHSMRIPGLVLDSCPFQSSQGA

SEQ ID NO: 2174708 - protein, 25 aa, Cryptosporidium hominis
KHTFVKDKLNGIVHSFKNGTDYYSS

SEQ ID NO: 2174709 - protein, 17 aa, Cryptosporidium hominis
KHTSAYKRLEHLRESGL

SEQ ID NO: 2174710 - protein, 24 aa, Cryptosporidium hominis
KHVLRTVCGSLSPSQGILSLGFGF

SEQ ID NO: 2174711 - protein, 23 aa, Cryptosporidium hominis
KHVRSKSAASFIGIDITGPSSYI

SEQ ID NO: 2174712 - protein, 22 aa, Cryptosporidium hominis
KHYCQVCKIWIENHPNNIRSHQ

SEQ ID NO: 2174713 - protein, 19 aa, Cryptosporidium hominis
KHYLLPLILLYSDLKESEA

SEQ ID NO: 2174714 - protein, 28 aa, Cryptosporidium hominis
KIAALRDIRNLFPIYRNPLYAGFGNRDT

SEQ ID NO: 2174715 - protein, 21 aa, Cryptosporidium hominis
KIACTQPRRVAAMSVAQRVSE

SEQ ID NO: 2174716 - protein, 17 aa, Cryptosporidium hominis
KIALSLLCIIFKDYKFE

SEQ ID NO: 2174717 - protein, 28 aa, Cryptosporidium hominis
KIAPLSRVAIYTWHGCILQIRGLVQQEY

SEQ ID NO: 2174718 - protein, 17 aa, Cryptosporidium hominis
KIAVEIIIQNCKKCLVN

SEQ ID NO: 2174719 - protein, 24 aa, Cryptosporidium hominis
KICNFSFQLIGRFVHSKRLNISIF

SEQ ID NO: 2174720 - protein, 23 aa, Cryptosporidium hominis
KICSCLSESSAKIWEYLPENIRE

SEQ ID NO: 2174721 - protein, 18 aa, Cryptosporidium hominis
KIDLLVSCVDNYSARSII

SEQ ID NO: 2174722 - protein, 20 aa, Cryptosporidium hominis
KIDPAGYFASYRACAVGTKE

SEQ ID NO: 2174723 - protein, 19 aa, Cryptosporidium hominis
KIDVRRLDDYVLRLDNYDA

SEQ ID NO: 2174724 - protein, 20 aa, Cryptosporidium hominis
KIEINPHPTTTFGTGTNPQS

SEQ ID NO: 2174725 - protein, 24 aa, Cryptosporidium hominis
KIEKEYLKDILIKQMSTYCVLKSL

SEQ ID NO: 2174726 - protein, 18 aa, Cryptosporidium hominis
KIELYNIKAFLSATRQLI

SEQ ID NO: 2174727 - protein, 17 aa, Cryptosporidium hominis
KIFAARIAAAAGISTFL

SEQ ID NO: 2174728 - protein, 20 aa, Cryptosporidium hominis
KIFEALSIRLETPFNEVSIT

SEQ ID NO: 2174729 - protein, 23 aa, Cryptosporidium hominis
KIFYYDFMERCFGSAFQTNDVYN

SEQ ID NO: 2174730 - protein, 18 aa, Cryptosporidium hominis
KIGAWKLRNCIMNIFPYL

SEQ ID NO: 2174731 - protein, 20 aa, Cryptosporidium hominis
KIGDEYFCFLTESKTPKACS

SEQ ID NO: 2174732 - protein, 25 aa, Cryptosporidium hominis
KIGFGDFRIEYCTRIIQLLKKNFPI

SEQ ID NO: 2174733 - protein, 21 aa, Cryptosporidium hominis
KIGIEVSTSFLWFSILNNSQK

SEQ ID NO: 2174734 - protein, 25 aa, Cryptosporidium hominis
KIGLSINIHQLFACTVFNDNKRQEN

SEQ ID NO: 2174735 - protein, 25 aa, Cryptosporidium hominis
KIGMEILKMIYLNWVPEEKILMMNV

SEQ ID NO: 2174736 - protein, 25 aa, Cryptosporidium hominis
KIGNEDYLRYGVRYIGNKAINGNNE

SEQ ID NO: 2174737 - protein, 22 aa, Cryptosporidium hominis
KIHKVNIIPEFGIFKNEDKNGP

SEQ ID NO: 2174738 - protein, 17 aa, Cryptosporidium hominis
KIHLSRLLGKVRNKKKV

SEQ ID NO: 2174739 - protein, 26 aa, Cryptosporidium hominis
KIHNWLCFSTALWYRCYAEHHRGRTA

SEQ ID NO: 2174740 - protein, 18 aa, Cryptosporidium hominis
KIIEGLLNICFNDLQREF

SEQ ID NO: 2174741 - protein, 17 aa, Cryptosporidium hominis
KIILKILVFVNFSSSNY

SEQ ID NO: 2174742 - protein, 24 aa, Cryptosporidium hominis
KIIPVGGDILCFLPGQQEIEETQA

SEQ ID NO: 2174743 - protein, 25 aa, Cryptosporidium hominis
KIIPVPDWMRPLLFTKSPNEALVGK

SEQ ID NO: 2174744 - protein, 17 aa, Cryptosporidium hominis
KIIQGIGSLLVNKSTRM

SEQ ID NO: 2174745 - protein, 25 aa, Cryptosporidium hominis
KIITEISSIISVCIETKVDIKDSID

SEQ ID NO: 2174746 - protein, 20 aa, Cryptosporidium hominis
KIIVVFMINIEYFPREDKKL

SEQ ID NO: 2174747 - protein, 17 aa, Cryptosporidium hominis
KIIYKPLLNCLSAKCGL

SEQ ID NO: 2174748 - protein, 21 aa, Cryptosporidium hominis
KIKAEQWLLEIRRKYDDKFID

SEQ ID NO: 2174749 - protein, 17 aa, Cryptosporidium hominis
KIKASLLRPEYKIKAIY

SEQ ID NO: 2174750 - protein, 22 aa, Cryptosporidium hominis
KIKFHPSFEYRGSYYDIEKEKL

SEQ ID NO: 2174751 - protein, 27 aa, Cryptosporidium hominis
KIKIGALNLYVWCSIPLSELNYIPEWF

SEQ ID NO: 2174752 - protein, 18 aa, Cryptosporidium hominis
KIKNGNEISVTFKNVPKD

SEQ ID NO: 2174753 - protein, 24 aa, Cryptosporidium hominis
KIKPPPCIEGPFTCFGSQLSSDIS

SEQ ID NO: 2174754 - protein, 22 aa, Cryptosporidium hominis
KIKRPICAIPNLAIHLTTSEER

SEQ ID NO: 2174755 - protein, 26 aa, Cryptosporidium hominis
KILCRQCKGTRNINIPIWRQGTMLPR

SEQ ID NO: 2174756 - protein, 17 aa, Cryptosporidium hominis
KILGKLSMETCILVCSK

SEQ ID NO: 2174757 - protein, 17 aa, Cryptosporidium hominis
KILILFRHDSFGVVELC

SEQ ID NO: 2174758 - protein, 22 aa, Cryptosporidium hominis
KILKDVICIGIGGSYLGPEFVY

SEQ ID NO: 2174759 - protein, 23 aa, Cryptosporidium hominis
KILKHGCNVFINRQLIYNYPDQL

SEQ ID NO: 2174760 - protein, 23 aa, Cryptosporidium hominis
KILKIKSKILVYKRYEDYIRLLP

SEQ ID NO: 2174761 - protein, 20 aa, Cryptosporidium hominis
KILKLCLSSLKVIVESKTWD

SEQ ID NO: 2174762 - protein, 24 aa, Cryptosporidium hominis
KILKRQLEILTHVNTSFGINYTPS

SEQ ID NO: 2174763 - protein, 18 aa, Cryptosporidium hominis
KILPKRFSSKPKQARLAF

SEQ ID NO: 2174764 - protein, 18 aa, Cryptosporidium hominis
KILPRINPVYTIMSLGRY

SEQ ID NO: 2174765 - protein, 18 aa, Cryptosporidium hominis
KILSIVCNICKQTFMCTA

SEQ ID NO: 2174766 - protein, 20 aa, Cryptosporidium hominis
KILVVPDYINYVGLNISEKR

SEQ ID NO: 2174767 - protein, 21 aa, Cryptosporidium hominis
KILYNRIIELADIIWNHMEGL

SEQ ID NO: 2174768 - protein, 17 aa, Cryptosporidium hominis
KIMESEGKLLLPAINVN

SEQ ID NO: 2174769 - protein, 19 aa, Cryptosporidium hominis
KIMFAHELALYSGLNLLVP

SEQ ID NO: 2174770 - protein, 24 aa, Cryptosporidium hominis
KIMGQCLTGEFGLFSMMNCNEDKH

SEQ ID NO: 2174771 - protein, 18 aa, Cryptosporidium hominis
KINFGFKKSVGYSCIGHC

SEQ ID NO: 2174772 - protein, 25 aa, Cryptosporidium hominis
KINFLTRISDKWISISTNQFSKDYD

SEQ ID NO: 2174773 - protein, 23 aa, Cryptosporidium hominis
KINHPNYIIGYFKLEKMEKNVIW

SEQ ID NO: 2174774 - protein, 18 aa, Cryptosporidium hominis
KIPFVAISGFVGDNMVER

SEQ ID NO: 2174775 - protein, 19 aa, Cryptosporidium hominis
KIQCLIKYNKLEEATTEFN

SEQ ID NO: 2174776 - protein, 43 aa, Cryptosporidium hominis
KIQEHWLWKKNVPFIYDYLFITPLRWPTLTFSIPPIRFNSEDM

SEQ ID NO: 2174777 - protein, 17 aa, Cryptosporidium hominis
KIQEVSGISRISDEKLD

SEQ ID NO: 2174778 - protein, 18 aa, Cryptosporidium hominis
KIQGESFVSEFFPNSMVP

SEQ ID NO: 2174779 - protein, 18 aa, Cryptosporidium hominis
KIQRFNLLLEKINKMEQM

SEQ ID NO: 2174780 - protein, 19 aa, Cryptosporidium hominis
KIRDYFTCMLFITLKLQDI

SEQ ID NO: 2174781 - protein, 22 aa, Cryptosporidium hominis
KIREVNKGDNLCMVAVDDIALE

SEQ ID NO: 2174782 - protein, 24 aa, Cryptosporidium hominis
KIRKKGYILIEWVNRIRILLRMRN

SEQ ID NO: 2174783 - protein, 26 aa, Cryptosporidium hominis
KIRPVKLKWSVGWRRMNKKLTNQGAT

SEQ ID NO: 2174784 - protein, 21 aa, Cryptosporidium hominis
KIRTTNIVKWAFFDKNTILCV

SEQ ID NO: 2174785 - protein, 26 aa, Cryptosporidium hominis
KISDSLRFPVPIKKLLFALELVQHKF

SEQ ID NO: 2174786 - protein, 23 aa, Cryptosporidium hominis
KISEALNIFEYIISECRNLKFQG

SEQ ID NO: 2174787 - protein, 25 aa, Cryptosporidium hominis
KISEIYRGLVRINFGLDQRIKSLEE

SEQ ID NO: 2174788 - protein, 20 aa, Cryptosporidium hominis
KISEKWCMIFIYSKGVEITL

SEQ ID NO: 2174789 - protein, 27 aa, Cryptosporidium hominis
KISHYSRIPVKIKHYIVSDKDNSKEGE

SEQ ID NO: 2174790 - protein, 18 aa, Cryptosporidium hominis
KISLSIGILKSLIRVISA

SEQ ID NO: 2174791 - protein, 24 aa, Cryptosporidium hominis
KISMIPKLHDILLILANSISSTVV

SEQ ID NO: 2174792 - protein, 18 aa, Cryptosporidium hominis
KISQEVCELIRENGEKEK

SEQ ID NO: 2174793 - protein, 22 aa, Cryptosporidium hominis
KISSAYEWCIEIIRNVSAGKSD

SEQ ID NO: 2174794 - protein, 18 aa, Cryptosporidium hominis
KISSCNWNPFTSDHLIGN

SEQ ID NO: 2174795 - protein, 20 aa, Cryptosporidium hominis
KISSFIFQHGFGIDIRYHFT

SEQ ID NO: 2174796 - protein, 19 aa, Cryptosporidium hominis
KISSVVWTHTNELLMLVYD

SEQ ID NO: 2174797 - protein, 18 aa, Cryptosporidium hominis
KISYSVIEHYFKVEANSK

SEQ ID NO: 2174798 - protein, 19 aa, Cryptosporidium hominis
KITAFPDVRIIPLTNEDEF

SEQ ID NO: 2174799 - protein, 21 aa, Cryptosporidium hominis
KITANELLNVFSYNSEQGSAG

SEQ ID NO: 2174800 - protein, 19 aa, Cryptosporidium hominis
KITLLIPRIKCLMKESRAI

SEQ ID NO: 2174801 - protein, 29 aa, Cryptosporidium hominis
KITPYEWKCRWRGLHFKVYTLRFPNSFFG

SEQ ID NO: 2174802 - protein, 30 aa, Cryptosporidium hominis
KITSEEVACFRYRIEDCMRILTKGNIQRHK

SEQ ID NO: 2174803 - protein, 19 aa, Cryptosporidium hominis
KIVINKAIEGFLSEEQREF

SEQ ID NO: 2174804 - protein, 17 aa, Cryptosporidium hominis
KIVITLNKFCLRNNMSF

SEQ ID NO: 2174805 - protein, 18 aa, Cryptosporidium hominis
KIVKACTDKGKLQFIKES

SEQ ID NO: 2174806 - protein, 21 aa, Cryptosporidium hominis
KIYLYQLLRGVAHCHQHRILH

SEQ ID NO: 2174807 - protein, 31 aa, Cryptosporidium hominis
KIYNVKVIILWKNRGIFYPTLGDQVDYTKIV

SEQ ID NO: 2174808 - protein, 24 aa, Cryptosporidium hominis
KIYWGELNPSLSMVYICRNLEDFD

SEQ ID NO: 2174809 - protein, 23 aa, Cryptosporidium hominis
KKAKSGLSDFVLKSKRISSSGSL

SEQ ID NO: 2174810 - protein, 24 aa, Cryptosporidium hominis
KKANIGCVMLAGSMSILQRNSILY

SEQ ID NO: 2174811 - protein, 23 aa, Cryptosporidium hominis
KKARLKMFLGQVMVESAPKVLIF

SEQ ID NO: 2174812 - protein, 18 aa, Cryptosporidium hominis
KKASEWRNELLSFPHIFN

SEQ ID NO: 2174813 - protein, 21 aa, Cryptosporidium hominis
KKAVVPCSAFCSNHYGVKGIY

SEQ ID NO: 2174814 - protein, 18 aa, Cryptosporidium hominis
KKCHSMGIIHRDVKPENI

SEQ ID NO: 2174815 - protein, 33 aa, Cryptosporidium hominis
KKCPELKSTASICFNCLSLTLPSIIETTMGISN

SEQ ID NO: 2174816 - protein, 21 aa, Cryptosporidium hominis
KKCVCKKLPVKSLISGRANCI

SEQ ID NO: 2174817 - protein, 20 aa, Cryptosporidium hominis
KKDEMFWKKSVVNNEDVATH

SEQ ID NO: 2174818 - protein, 20 aa, Cryptosporidium hominis
KKDIPPRVLFALNTPEGSQL

SEQ ID NO: 2174819 - protein, 23 aa, Cryptosporidium hominis
KKDKVKISKCITWDEETIAMHDA

SEQ ID NO: 2174820 - protein, 22 aa, Cryptosporidium hominis
KKDLDKFVLDCDLREYFVGESI

SEQ ID NO: 2174821 - protein, 23 aa, Cryptosporidium hominis
KKDSEGYSELFGISSENSEDGNI

SEQ ID NO: 2174822 - protein, 19 aa, Cryptosporidium hominis
KKDVEFILGNICELDQVHN

SEQ ID NO: 2174823 - protein, 26 aa, Cryptosporidium hominis
KKEALRLTFDSSITNEWMGNSLIEYL

SEQ ID NO: 2174824 - protein, 19 aa, Cryptosporidium hominis
KKEAYQFSKNNIKFGNMKI

SEQ ID NO: 2174825 - protein, 18 aa, Cryptosporidium hominis
KKEFCGFNYNIKKKIIYL

SEQ ID NO: 2174826 - protein, 19 aa, Cryptosporidium hominis
KKEGYDGCTVVGSDCLCWR

SEQ ID NO: 2174827 - protein, 19 aa, Cryptosporidium hominis
KKELVASGIVVKKRPPPNR

SEQ ID NO: 2174828 - protein, 21 aa, Cryptosporidium hominis
KKERDLRKLMGVRGTKSSESL

SEQ ID NO: 2174829 - protein, 26 aa, Cryptosporidium hominis
KKESKLSRLSFRGDKESKGLDKINSM

SEQ ID NO: 2174830 - protein, 18 aa, Cryptosporidium hominis
KKESPRSIIEKKFIDTEE

SEQ ID NO: 2174831 - protein, 17 aa, Cryptosporidium hominis
KKEVKKNRGEIEAERRN

SEQ ID NO: 2174832 - protein, 18 aa, Cryptosporidium hominis
KKFKAIESIEQFENKSKA

SEQ ID NO: 2174833 - protein, 18 aa, Cryptosporidium hominis
KKFLYIWTKCSNLKSEMI

SEQ ID NO: 2174834 - protein, 19 aa, Cryptosporidium hominis
KKFNEGCIIFIDEIDTLAS

SEQ ID NO: 2174835 - protein, 20 aa, Cryptosporidium hominis
KKFPIPIRFDKKGIPKDCKG

SEQ ID NO: 2174836 - protein, 30 aa, Cryptosporidium hominis
KKFRKAVYISSEWLKVFKINHFNIIDNIKA

SEQ ID NO: 2174837 - protein, 17 aa, Cryptosporidium hominis
KKFRSNEDFPEYYHDLF

SEQ ID NO: 2174838 - protein, 35 aa, Cryptosporidium hominis
KKFSKRKMLYNFANSVWDYVKPVSLDELERKQSES

SEQ ID NO: 2174839 - protein, 23 aa, Cryptosporidium hominis
KKGDPETCPAFLFVTPEKLKHSK

SEQ ID NO: 2174840 - protein, 21 aa, Cryptosporidium hominis
KKGGILGNFFSQVYNTFISGS

SEQ ID NO: 2174841 - protein, 24 aa, Cryptosporidium hominis
KKGKHIRGKILVLISSLSSAYSNI

SEQ ID NO: 2174842 - protein, 21 aa, Cryptosporidium hominis
KKGKKQWILGLDKFQDNNTNK

SEQ ID NO: 2174843 - protein, 19 aa, Cryptosporidium hominis
KKGLPEFVLECSNMDEKEL

SEQ ID NO: 2174844 - protein, 24 aa, Cryptosporidium hominis
KKGNVHKGLYISWHPKTRRFVVAL

SEQ ID NO: 2174845 - protein, 18 aa, Cryptosporidium hominis
KKGVDIVVGCPGRVLDFI

SEQ ID NO: 2174846 - protein, 25 aa, Cryptosporidium hominis
KKHIMLAKFIRYILRPDPNLRPTPE

SEQ ID NO: 2174847 - protein, 18 aa, Cryptosporidium hominis
KKHIRNFEMEKVYYIFEK

SEQ ID NO: 2174848 - protein, 17 aa, Cryptosporidium hominis
KKHIVQFYYDYFLMDSP

SEQ ID NO: 2174849 - protein, 19 aa, Cryptosporidium hominis
KKHLLDNIDLYFSQDREDE

SEQ ID NO: 2174850 - protein, 25 aa, Cryptosporidium hominis
KKHSRYLGCSIIRKNLAKVRKQIKK

SEQ ID NO: 2174851 - protein, 21 aa, Cryptosporidium hominis
KKHSYRELLIDEILNTLTIES

SEQ ID NO: 2174852 - protein, 17 aa, Cryptosporidium hominis
KKIGLKTIWVGGVCDPG

SEQ ID NO: 2174853 - protein, 18 aa, Cryptosporidium hominis
KKIGNCNLINSFQNSGKR

SEQ ID NO: 2174854 - protein, 19 aa, Cryptosporidium hominis
KKIHRKSTNNVTWDESAID

SEQ ID NO: 2174855 - protein, 21 aa, Cryptosporidium hominis
KKIISEWGAPVSKNLSGQAEK

SEQ ID NO: 2174856 - protein, 26 aa, Cryptosporidium hominis
KKIKNRPFKNCPICHTKWSRNPESLQ

SEQ ID NO: 2174857 - protein, 19 aa, Cryptosporidium hominis
KKILQKLLHVSRQLTEKLK

SEQ ID NO: 2174858 - protein, 19 aa, Cryptosporidium hominis
KKINEHFSNFEINPVDVIR

SEQ ID NO: 2174859 - protein, 21 aa, Cryptosporidium hominis
KKIPIVIPTCSEWFDMDSVHP

SEQ ID NO: 2174860 - protein, 28 aa, Cryptosporidium hominis
KKIQKSIDFIYWLLKKKTDFYCSESETE

SEQ ID NO: 2174861 - protein, 23 aa, Cryptosporidium hominis
KKIQKSLLFRLFKSEIHIYEKKM

SEQ ID NO: 2174862 - protein, 21 aa, Cryptosporidium hominis
KKIRSHRGLRHHWGVRVRGQH

SEQ ID NO: 2174863 - protein, 19 aa, Cryptosporidium hominis
KKISEKFIFENSDINDDKD

SEQ ID NO: 2174864 - protein, 17 aa, Cryptosporidium hominis
KKIVERLTFMNVEKETN

SEQ ID NO: 2174865 - protein, 19 aa, Cryptosporidium hominis
KKKETILITGINKKFVLED

SEQ ID NO: 2174866 - protein, 25 aa, Cryptosporidium hominis
KKKGLEPMMAITYLLNYILHRDDYC

SEQ ID NO: 2174867 - protein, 19 aa, Cryptosporidium hominis
KKKGLLGLFNDKLSKSAPE

SEQ ID NO: 2174868 - protein, 33 aa, Cryptosporidium hominis
KKKKEFQGRCNYIKYSTQWYLWAKRRNAETYSQ

SEQ ID NO: 2174869 - protein, 20 aa, Cryptosporidium hominis
KKKKGLIRKKWSIEDERDVS

SEQ ID NO: 2174870 - protein, 23 aa, Cryptosporidium hominis
KKKKYKRNLIFSGENNTIVSNPE

SEQ ID NO: 2174871 - protein, 17 aa, Cryptosporidium hominis
KKKNEFFSKLQINDLFN

SEQ ID NO: 2174872 - protein, 24 aa, Cryptosporidium hominis
KKKNQIKGLIKFMGEDIVSIKSCT

SEQ ID NO: 2174873 - protein, 26 aa, Cryptosporidium hominis
KKKRSRVIYCHVCCQYKPRSTRARFQ

SEQ ID NO: 2174874 - protein, 25 aa, Cryptosporidium hominis
KKKSMSRPFGVAMLIAGADSDGSSS

SEQ ID NO: 2174875 - protein, 20 aa, Cryptosporidium hominis
KKKSNDFVGTISKFKIPIEL

SEQ ID NO: 2174876 - protein, 25 aa, Cryptosporidium hominis
KKKVLPLGRRIHWKPLTEEMAQKTI

SEQ ID NO: 2174877 - protein, 20 aa, Cryptosporidium hominis
KKKYACIQIVDFHRKQLKLE

SEQ ID NO: 2174878 - protein, 26 aa, Cryptosporidium hominis
KKKYIKPKLINRLEISEEGISGENAL

SEQ ID NO: 2174879 - protein, 17 aa, Cryptosporidium hominis
KKKYILIDIILEIISNY

SEQ ID NO: 2174880 - protein, 22 aa, Cryptosporidium hominis
KKKYNKYMLDGFYALARQTQSI

SEQ ID NO: 2174881 - protein, 17 aa, Cryptosporidium hominis
KKLALKIFKKCTPQNPT

SEQ ID NO: 2174882 - protein, 29 aa, Cryptosporidium hominis
KKLEDYASWEMIKDLAISELKDIVYSDAE

SEQ ID NO: 2174883 - protein, 27 aa, Cryptosporidium hominis
KKLEIMSFSGLIDFSSIFVPYMSTAKR

SEQ ID NO: 2174884 - protein, 17 aa, Cryptosporidium hominis
KKLFKKLFVNDFNQNIP

SEQ ID NO: 2174885 - protein, 17 aa, Cryptosporidium hominis
KKLFWNATVEEIHNQVK

SEQ ID NO: 2174886 - protein, 20 aa, Cryptosporidium hominis
KKLHLGHVASSFGINEQPNK

SEQ ID NO: 2174887 - protein, 25 aa, Cryptosporidium hominis
KKLIKILKKFCVLVSGNWVYKSELM

SEQ ID NO: 2174888 - protein, 17 aa, Cryptosporidium hominis
KKLILPLNIVSLVEIPS

SEQ ID NO: 2174889 - protein, 20 aa, Cryptosporidium hominis
KKLKKLGLSMSYFIKSKSGN

SEQ ID NO: 2174890 - protein, 24 aa, Cryptosporidium hominis
KKLKRINFLDVNRFPNLIKLSWNS

SEQ ID NO: 2174891 - protein, 20 aa, Cryptosporidium hominis
KKLNEFNVFPISSEEKHNTY

SEQ ID NO: 2174892 - protein, 27 aa, Cryptosporidium hominis
KKLNFILNLQCMWRHYNLKIQLKAEEY

SEQ ID NO: 2174893 - protein, 20 aa, Cryptosporidium hominis
KKLNQWMGHLTSLSSILANN

SEQ ID NO: 2174894 - protein, 26 aa, Cryptosporidium hominis
KKLNVVERILAISIELLENGVCNQIV

SEQ ID NO: 2174895 - protein, 21 aa, Cryptosporidium hominis
KKLNVVYIIDFGLAKKYRDPK

SEQ ID NO: 2174896 - protein, 17 aa, Cryptosporidium hominis
KKLRSKLSLQQQIFHTA

SEQ ID NO: 2174897 - protein, 21 aa, Cryptosporidium hominis
KKLRSKRLAPVLIKEITRRIR

SEQ ID NO: 2174898 - protein, 25 aa, Cryptosporidium hominis
KKLYRISVEIERDWFQIYNVDMEVT

SEQ ID NO: 2174899 - protein, 23 aa, Cryptosporidium hominis
KKMFGESCKLLIGLDHENILEEK

SEQ ID NO: 2174900 - protein, 17 aa, Cryptosporidium hominis
KKMGEGVIRSKLKRMVD

SEQ ID NO: 2174901 - protein, 19 aa, Cryptosporidium hominis
KKMGLCLNTKILQLGDVEL

SEQ ID NO: 2174902 - protein, 36 aa, Cryptosporidium hominis
KKMLNEICELLRSPRFCRSTSIIYCLSRNECEEVSK

SEQ ID NO: 2174903 - protein, 23 aa, Cryptosporidium hominis
KKMNLKLIIYLSNIFEYRNNQKS

SEQ ID NO: 2174904 - protein, 17 aa, Cryptosporidium hominis
KKMVGFISAIPIKVRIH

SEQ ID NO: 2174905 - protein, 20 aa, Cryptosporidium hominis
KKNEESFSMYSIRAEYQNQF

SEQ ID NO: 2174906 - protein, 21 aa, Cryptosporidium hominis
KKNFIYMLLPMIIKKAFLAYN

SEQ ID NO: 2174907 - protein, 20 aa, Cryptosporidium hominis
KKNFLEKQVVRWLTQALLGL

SEQ ID NO: 2174908 - protein, 19 aa, Cryptosporidium hominis
KKNGVSWKNASFFKSISKD

SEQ ID NO: 2174909 - protein, 33 aa, Cryptosporidium hominis
KKNIFQFIINYLKLMSSHLLFMAETDPKECLII

SEQ ID NO: 2174910 - protein, 22 aa, Cryptosporidium hominis
KKNKLEVLKLRAAESNQRKIIE

SEQ ID NO: 2174911 - protein, 17 aa, Cryptosporidium hominis
KKNMSLYAFGGTQGSSG

SEQ ID NO: 2174912 - protein, 36 aa, Cryptosporidium hominis
KKNSWSWGHKLRWVKIFKCEMHYFLSPKESNIKAKA

SEQ ID NO: 2174913 - protein, 17 aa, Cryptosporidium hominis
KKNWNMYNEILNRERKN

SEQ ID NO: 2174914 - protein, 18 aa, Cryptosporidium hominis
KKPIRLYYCKSLDFLWDW

SEQ ID NO: 2174915 - protein, 22 aa, Cryptosporidium hominis
KKPYDCSFVSREFRGIEKSRQL

SEQ ID NO: 2174916 - protein, 25 aa, Cryptosporidium hominis
KKQFFDFVKRILIEDVTLQDENISL

SEQ ID NO: 2174917 - protein, 19 aa, Cryptosporidium hominis
KKQLCKRLTICLDKNNPKL

SEQ ID NO: 2174918 - protein, 22 aa, Cryptosporidium hominis
KKRCKLKYFNKDGADASMSKQP

SEQ ID NO: 2174919 - protein, 24 aa, Cryptosporidium hominis
KKRDGKCLPLQIGMNNNLNCSNIG

SEQ ID NO: 2174920 - protein, 19 aa, Cryptosporidium hominis
KKRFKYKIVSKFMSLISHR

SEQ ID NO: 2174921 - protein, 19 aa, Cryptosporidium hominis
KKRISSLLTSLVNKIVFLL

SEQ ID NO: 2174922 - protein, 18 aa, Cryptosporidium hominis
KKRLIPVDQDELFVNVNA

SEQ ID NO: 2174923 - protein, 19 aa, Cryptosporidium hominis
KKRMEGYKIFGLEQTSSSI

SEQ ID NO: 2174924 - protein, 18 aa, Cryptosporidium hominis
KKRMEIRELSKVYDKTED

SEQ ID NO: 2174925 - protein, 24 aa, Cryptosporidium hominis
KKRREWRQNFQINRIFFEEFPIYR

SEQ ID NO: 2174926 - protein, 20 aa, Cryptosporidium hominis
KKSDCIDIILNNSPDTPLSS

SEQ ID NO: 2174927 - protein, 20 aa, Cryptosporidium hominis
KKSFLPPLFISRPLNLYSYS

SEQ ID NO: 2174928 - protein, 34 aa, Cryptosporidium hominis
KKSFYKRFLYDSLPLESCFGVSPLIEIFNAEVSS

SEQ ID NO: 2174929 - protein, 19 aa, Cryptosporidium hominis
KKSIKFYDEHPELLEDFDR

SEQ ID NO: 2174930 - protein, 19 aa, Cryptosporidium hominis
KKSKYNYIGPWRKDQKEKV

SEQ ID NO: 2174931 - protein, 26 aa, Cryptosporidium hominis
KKSNSLVGLYAEWVDKNTIWDVRKGP

SEQ ID NO: 2174932 - protein, 26 aa, Cryptosporidium hominis
KKSPLEFLKMIKAMVNKDVFEVCDKI

SEQ ID NO: 2174933 - protein, 18 aa, Cryptosporidium hominis
KKTFLDEYYKVVSKQDTH

SEQ ID NO: 2174934 - protein, 19 aa, Cryptosporidium hominis
KKTLETICDHFSTKSNSAF

SEQ ID NO: 2174935 - protein, 19 aa, Cryptosporidium hominis
KKTNLSISLLDILFDHFKS

SEQ ID NO: 2174936 - protein, 18 aa, Cryptosporidium hominis
KKTTFKWHPKKPALKSFI

SEQ ID NO: 2174937 - protein, 25 aa, Cryptosporidium hominis
KKTVLRFPISISMYSLLLFASDSLQ

SEQ ID NO: 2174938 - protein, 26 aa, Cryptosporidium hominis
KKVGRRSCSPSNVFLNRSKKFKTKEY

SEQ ID NO: 2174939 - protein, 24 aa, Cryptosporidium hominis
KKVKFYLDPIMDFDINLYNQTNLV

SEQ ID NO: 2174940 - protein, 20 aa, Cryptosporidium hominis
KKVQDFTCVSLQMSPYCDED

SEQ ID NO: 2174941 - protein, 17 aa, Cryptosporidium hominis
KKVVLKYQDEFLHDWTL

SEQ ID NO: 2174942 - protein, 22 aa, Cryptosporidium hominis
KKYGKNCILNYWANAYNTNINN

SEQ ID NO: 2174943 - protein, 32 aa, Cryptosporidium hominis
KKYKKNLIWDGPRWDLAHFDPTMSARERKKLV

SEQ ID NO: 2174944 - protein, 24 aa, Cryptosporidium hominis
KKYKLRSYISILRYITMMIESCAS

SEQ ID NO: 2174945 - protein, 20 aa, Cryptosporidium hominis
KKYRKAFDIFSMKFDSYSEY

SEQ ID NO: 2174946 - protein, 19 aa, Cryptosporidium hominis
KKYRSEFVNTGGYINGISV

SEQ ID NO: 2174947 - protein, 23 aa, Cryptosporidium hominis
KKYVFKIKYILANKYNLSVEFND

SEQ ID NO: 2174948 - protein, 17 aa, Cryptosporidium hominis
KKYVPCMILRRKIQKTV

SEQ ID NO: 2174949 - protein, 30 aa, Cryptosporidium hominis
KKYYDAGARFAKWRAVLTIDQAKGKPSCLS

SEQ ID NO: 2174950 - protein, 23 aa, Cryptosporidium hominis
KKYYLCLWAGFYSTIPQTLPQGL

SEQ ID NO: 2174951 - protein, 19 aa, Cryptosporidium hominis
KLAFCNAQECVNALDYMLE

SEQ ID NO: 2174952 - protein, 20 aa, Cryptosporidium hominis
KLAFDFYPALTMVGTPSPNI

SEQ ID NO: 2174953 - protein, 19 aa, Cryptosporidium hominis
KLAQKCYLASLKLIKSHIV

SEQ ID NO: 2174954 - protein, 19 aa, Cryptosporidium hominis
KLCGVFECNYTNTGGEIIH

SEQ ID NO: 2174955 - protein, 20 aa, Cryptosporidium hominis
KLCIVGAGPSGCYLAKYLLA

SEQ ID NO: 2174956 - protein, 20 aa, Cryptosporidium hominis
KLDAGYGIKSNVFINDLSNQ

SEQ ID NO: 2174957 - protein, 23 aa, Cryptosporidium hominis
KLDDITVVVAWVVSERDQIILNS

SEQ ID NO: 2174958 - protein, 19 aa, Cryptosporidium hominis
KLDDLDIVFISKFSACDLT

SEQ ID NO: 2174959 - protein, 20 aa, Cryptosporidium hominis
KLDEMILFPPVKVVEIRDNI

SEQ ID NO: 2174960 - protein, 27 aa, Cryptosporidium hominis
KLDGRLFCFLCTFKYKKLKHEEVKKTN

SEQ ID NO: 2174961 - protein, 21 aa, Cryptosporidium hominis
KLDLEFYKSEYCKLKEKLESI

SEQ ID NO: 2174962 - protein, 20 aa, Cryptosporidium hominis
KLDLYFLMYEYQKILSYNRY

SEQ ID NO: 2174963 - protein, 18 aa, Cryptosporidium hominis
KLDSNFPKNCHNPKWNSY

SEQ ID NO: 2174964 - protein, 19 aa, Cryptosporidium hominis
KLEECIDERVNLRNIDKQK

SEQ ID NO: 2174965 - protein, 17 aa, Cryptosporidium hominis
KLEELRGIMSQHGVDAY

SEQ ID NO: 2174966 - protein, 21 aa, Cryptosporidium hominis
KLEEVKPLPSYYGDMSQVLTL

SEQ ID NO: 2174967 - protein, 26 aa, Cryptosporidium hominis
KLEFRCSSCEIYLRRMHGLENELQIL

SEQ ID NO: 2174968 - protein, 22 aa, Cryptosporidium hominis
KLEHLAHAAAYFSSSLKSKKSL

SEQ ID NO: 2174969 - protein, 21 aa, Cryptosporidium hominis
KLEIFFIDFDLMPLLLEENYI

SEQ ID NO: 2174970 - protein, 18 aa, Cryptosporidium hominis
KLENIFVICCELISQALV

SEQ ID NO: 2174971 - protein, 21 aa, Cryptosporidium hominis
KLESVCINREILKQTKIGVVM

SEQ ID NO: 2174972 - protein, 21 aa, Cryptosporidium hominis
KLETELFSILSPELLNEIMIE

SEQ ID NO: 2174973 - protein, 19 aa, Cryptosporidium hominis
KLFGHSGPVKACICSKDKI

SEQ ID NO: 2174974 - protein, 19 aa, Cryptosporidium hominis
KLFKCHECSKAFGRSDHLR

SEQ ID NO: 2174975 - protein, 18 aa, Cryptosporidium hominis
KLFNELALIWCILKTFAI

SEQ ID NO: 2174976 - protein, 21 aa, Cryptosporidium hominis
KLFPEEDYFSLTPNYLKETNF

SEQ ID NO: 2174977 - protein, 22 aa, Cryptosporidium hominis
KLFREFSTGIVLGDEGDSREKM

SEQ ID NO: 2174978 - protein, 27 aa, Cryptosporidium hominis
KLFRTEWGIKYDFWLIEHINQYEYVVP

SEQ ID NO: 2174979 - protein, 19 aa, Cryptosporidium hominis
KLFSSEIIPDFNSIMPEGQ

SEQ ID NO: 2174980 - protein, 22 aa, Cryptosporidium hominis
KLGESLLPLGFHLRDLHGTGII

SEQ ID NO: 2174981 - protein, 17 aa, Cryptosporidium hominis
KLGFILELSDLIEKFSD

SEQ ID NO: 2174982 - protein, 23 aa, Cryptosporidium hominis
KLGGRLSSMLSIDSNNTAFANNI

SEQ ID NO: 2174983 - protein, 18 aa, Cryptosporidium hominis
KLGNIFREISLRNESNAY

SEQ ID NO: 2174984 - protein, 25 aa, Cryptosporidium hominis
KLGVPRRRLYDITNVLEAVGLFTKP

SEQ ID NO: 2174985 - protein, 24 aa, Cryptosporidium hominis
KLHILMDIEFVYYFFIRLKNKQMI

SEQ ID NO: 2174986 - protein, 30 aa, Cryptosporidium hominis
KLHSVWKGYKTRSILRGSLQGITLLKTSNS

SEQ ID NO: 2174987 - protein, 18 aa, Cryptosporidium hominis
KLIDLEIVELKRFTEKVT

SEQ ID NO: 2174988 - protein, 18 aa, Cryptosporidium hominis
KLIKQTIIPLIPNAEYNS

SEQ ID NO: 2174989 - protein, 25 aa, Cryptosporidium hominis
KLILSETYNGFFLIPEDGVWSYNSM

SEQ ID NO: 2174990 - protein, 18 aa, Cryptosporidium hominis
KLIPYSLYWFTGEAVDED

SEQ ID NO: 2174991 - protein, 17 aa, Cryptosporidium hominis
KLISPKLAEKWYVNKYL

SEQ ID NO: 2174992 - protein, 17 aa, Cryptosporidium hominis
KLKDLQIEFNLIEKEYL

SEQ ID NO: 2174993 - protein, 26 aa, Cryptosporidium hominis
KLKDLVLRYSQFINFPIYIYNPEGVN

SEQ ID NO: 2174994 - protein, 31 aa, Cryptosporidium hominis
KLKELKLKILICFRENYFINNYSKKWKFGTY

SEQ ID NO: 2174995 - protein, 18 aa, Cryptosporidium hominis
KLKFPAIRKLPMAPKALR

SEQ ID NO: 2174996 - protein, 26 aa, Cryptosporidium hominis
KLKGHSKAVVSLAWQPLHLMDYSAET

SEQ ID NO: 2174997 - protein, 35 aa, Cryptosporidium hominis
KLKIIKNNCELLIFTSFRFYVYILIELKKIKNSLI

SEQ ID NO: 2174998 - protein, 28 aa, Cryptosporidium hominis
KLKLELFHKEMIKFSGISLQGRESLPPL

SEQ ID NO: 2174999 - protein, 23 aa, Cryptosporidium hominis
KLKLHIVELNDTFQKRWDETQKE

SEQ ID NO: 2175000 - protein, 22 aa, Cryptosporidium hominis
KLKLRRRGRRRRPGKLNISKQL

SEQ ID NO: 2175001 - protein, 19 aa, Cryptosporidium hominis
KLKSLRFATEAAITLLRID

SEQ ID NO: 2175002 - protein, 33 aa, Cryptosporidium hominis
KLLGETCKYIFMEVIKHGRISTKILISELSETV

SEQ ID NO: 2175003 - protein, 18 aa, Cryptosporidium hominis
KLLGGSPMQSFTINGMMV

SEQ ID NO: 2175004 - protein, 30 aa, Cryptosporidium hominis
KLLHLAKLFPCQWRTIAPLVGRTAHQCLEH

SEQ ID NO: 2175005 - protein, 20 aa, Cryptosporidium hominis
KLLIKGEAPLVLIEKNSNKQ

SEQ ID NO: 2175006 - protein, 18 aa, Cryptosporidium hominis
KLLIKSLLEKGEITHHQK

SEQ ID NO: 2175007 - protein, 18 aa, Cryptosporidium hominis
KLLKRKKAQAELAQKSKY

SEQ ID NO: 2175008 - protein, 20 aa, Cryptosporidium hominis
KLLLTFSFEGGIWRVLLGLL

SEQ ID NO: 2175009 - protein, 23 aa, Cryptosporidium hominis
KLLMRLYMKLVIKQLVEPAFDVV

SEQ ID NO: 2175010 - protein, 25 aa, Cryptosporidium hominis
KLLRCVCYACSKLFVDTLDPKFKQI

SEQ ID NO: 2175011 - protein, 19 aa, Cryptosporidium hominis
KLLREPIILLIDPKRMQII

SEQ ID NO: 2175012 - protein, 19 aa, Cryptosporidium hominis
KLLRNGYCYIHGRDKLLRP

SEQ ID NO: 2175013 - protein, 21 aa, Cryptosporidium hominis
KLLSYRPRVHFKKGTRFFTQD

SEQ ID NO: 2175014 - protein, 20 aa, Cryptosporidium hominis
KLLVEKKISSAYEWCIEIIR

SEQ ID NO: 2175015 - protein, 20 aa, Cryptosporidium hominis
KLLVSRLISKLAPNYKILVS

SEQ ID NO: 2175016 - protein, 20 aa, Cryptosporidium hominis
KLMNSRGVYCGMHTELSLYE

SEQ ID NO: 2175017 - protein, 22 aa, Cryptosporidium hominis
KLNCCASLKCAITLFNSPLPNV

SEQ ID NO: 2175018 - protein, 24 aa, Cryptosporidium hominis
KLNHCMGEALLAKYMGKKKLIAET

SEQ ID NO: 2175019 - protein, 19 aa, Cryptosporidium hominis
KLNKLSNEEYIVFCSIEDA

SEQ ID NO: 2175020 - protein, 24 aa, Cryptosporidium hominis
KLNLTDNALLYWREEPTFPDQQPS

SEQ ID NO: 2175021 - protein, 18 aa, Cryptosporidium hominis
KLNMEFEVMKNLLMLVLS

SEQ ID NO: 2175022 - protein, 25 aa, Cryptosporidium hominis
KLNRPFSGFCYRALSTIYVDQKKLE

SEQ ID NO: 2175023 - protein, 23 aa, Cryptosporidium hominis
KLPIEIKKAPKFLRLKVPLNNDI

SEQ ID NO: 2175024 - protein, 18 aa, Cryptosporidium hominis
KLPKAWFVENVANFETSN

SEQ ID NO: 2175025 - protein, 18 aa, Cryptosporidium hominis
KLPKGGIGNFEDSNECVI

SEQ ID NO: 2175026 - protein, 19 aa, Cryptosporidium hominis
KLPNRVVAISEALQRTYIK

SEQ ID NO: 2175027 - protein, 24 aa, Cryptosporidium hominis
KLQDIMPCMEWNIVEGILKEELGK

SEQ ID NO: 2175028 - protein, 29 aa, Cryptosporidium hominis
KLQEIIQKSIPWISNNNINMNINTGNDLL

SEQ ID NO: 2175029 - protein, 20 aa, Cryptosporidium hominis
KLQFPDILDHFNVKWDILQT

SEQ ID NO: 2175030 - protein, 20 aa, Cryptosporidium hominis
KLQLLIGVSIRRIHEALEDL

SEQ ID NO: 2175031 - protein, 32 aa, Cryptosporidium hominis
KLQLSLELSKALRLPVLYLLQFKNNLTNFLYD

SEQ ID NO: 2175032 - protein, 20 aa, Cryptosporidium hominis
KLQMTMPIITLIASETKYCG

SEQ ID NO: 2175033 - protein, 19 aa, Cryptosporidium hominis
KLQNGFKLLLELVQYHQMR

SEQ ID NO: 2175034 - protein, 18 aa, Cryptosporidium hominis
KLQWEIYERLGDVSYEKL

SEQ ID NO: 2175035 - protein, 20 aa, Cryptosporidium hominis
KLRARIHVCCCGYDGIDAVR

SEQ ID NO: 2175036 - protein, 17 aa, Cryptosporidium hominis
KLREIIKPYGIDIKLTD

SEQ ID NO: 2175037 - protein, 20 aa, Cryptosporidium hominis
KLRLIEMSTNFELEEVSNKE

SEQ ID NO: 2175038 - protein, 20 aa, Cryptosporidium hominis
KLRLILLYISHYIGINNDDL

SEQ ID NO: 2175039 - protein, 21 aa, Cryptosporidium hominis
KLRNEALLNQGLWYSSLSEED

SEQ ID NO: 2175040 - protein, 22 aa, Cryptosporidium hominis
KLSEALFSQGLIRVLITTATLA

SEQ ID NO: 2175041 - protein, 23 aa, Cryptosporidium hominis
KLSELNFKIMIQKNIEKDSKILK

SEQ ID NO: 2175042 - protein, 21 aa, Cryptosporidium hominis
KLSESCLIIELFDSRQSNENL

SEQ ID NO: 2175043 - protein, 20 aa, Cryptosporidium hominis
KLSIPGSAKISRESKMLMQQ

SEQ ID NO: 2175044 - protein, 21 aa, Cryptosporidium hominis
KLSKFEGKKGFNMKKLKSNGK

SEQ ID NO: 2175045 - protein, 25 aa, Cryptosporidium hominis
KLSKIPGSRWFLQPVDPELDGVPDY

SEQ ID NO: 2175046 - protein, 18 aa, Cryptosporidium hominis
KLSKSECVQAYDDQIMEM

SEQ ID NO: 2175047 - protein, 22 aa, Cryptosporidium hominis
KLSLKEGKWGHPERPLSDLGRA

SEQ ID NO: 2175048 - protein, 18 aa, Cryptosporidium hominis
KLSPCKIFRDCFFEVDSI

SEQ ID NO: 2175049 - protein, 19 aa, Cryptosporidium hominis
KLSSPNGGFVRKSTRFTEA

SEQ ID NO: 2175050 - protein, 23 aa, Cryptosporidium hominis
KLSSSFIPLRFGKDHTEGAGSSK

SEQ ID NO: 2175051 - protein, 25 aa, Cryptosporidium hominis
KLSYFYSREEFYVYQAIFNYSISLI

SEQ ID NO: 2175052 - protein, 24 aa, Cryptosporidium hominis
KLTECGCVFVFYVADWFALLNNKM

SEQ ID NO: 2175053 - protein, 17 aa, Cryptosporidium hominis
KLTWKLHYSSLKLRLIF

SEQ ID NO: 2175054 - protein, 23 aa, Cryptosporidium hominis
KLVDSCYSFWFTGLLFCIEEILR

SEQ ID NO: 2175055 - protein, 19 aa, Cryptosporidium hominis
KLVNCKEILDLKDFDAELK

SEQ ID NO: 2175056 - protein, 20 aa, Cryptosporidium hominis
KLWGKFKSIPYFVVLEICKE

SEQ ID NO: 2175057 - protein, 21 aa, Cryptosporidium hominis
KLWNACKFAFGNIENVANHMK

SEQ ID NO: 2175058 - protein, 24 aa, Cryptosporidium hominis
KLYFELLNGLNLVKFDLFQYNIYL

SEQ ID NO: 2175059 - protein, 26 aa, Cryptosporidium hominis
KLYLRSYYTMKECHTLVSPYTIDNSE

SEQ ID NO: 2175060 - protein, 22 aa, Cryptosporidium hominis
KLYQDFSKFVVFVESDNKNEEI

SEQ ID NO: 2175061 - protein, 17 aa, Cryptosporidium hominis
KMACYNLSLLSKADIFG

SEQ ID NO: 2175062 - protein, 32 aa, Cryptosporidium hominis
KMCHEVDLIKPLWTMPLLLRIFLNNINLDNNP

SEQ ID NO: 2175063 - protein, 26 aa, Cryptosporidium hominis
KMELLKNPFRWRGMLKDLYGVSEETT

SEQ ID NO: 2175064 - protein, 20 aa, Cryptosporidium hominis
KMFRLESSAESWVVKQKEQK

SEQ ID NO: 2175065 - protein, 17 aa, Cryptosporidium hominis
KMFVWDVGIPIVVKHIA

SEQ ID NO: 2175066 - protein, 19 aa, Cryptosporidium hominis
KMGKFYELFYIDAYICQKH

SEQ ID NO: 2175067 - protein, 20 aa, Cryptosporidium hominis
KMGVIPRMVHDVFETISNAE

SEQ ID NO: 2175068 - protein, 18 aa, Cryptosporidium hominis
KMICRKCYARLPPRATNC

SEQ ID NO: 2175069 - protein, 25 aa, Cryptosporidium hominis
KMIELSGKMVLMGKLLPKLKAEGHR

SEQ ID NO: 2175070 - protein, 19 aa, Cryptosporidium hominis
KMIFYNSLFQIRRITFSIK

SEQ ID NO: 2175071 - protein, 17 aa, Cryptosporidium hominis
KMISAINHIIERSHCKI

SEQ ID NO: 2175072 - protein, 25 aa, Cryptosporidium hominis
KMKEQRNVDPFSIFGDSCMFMDLED

SEQ ID NO: 2175073 - protein, 19 aa, Cryptosporidium hominis
KMKFILGTESEEFIKLHCN

SEQ ID NO: 2175074 - protein, 17 aa, Cryptosporidium hominis
KMMIELGHEVNYNTETT

SEQ ID NO: 2175075 - protein, 18 aa, Cryptosporidium hominis
KMMNRGTTTLGFIYQGGV

SEQ ID NO: 2175076 - protein, 21 aa, Cryptosporidium hominis
KMNRPGFKLAVVGLGGLGHMA

SEQ ID NO: 2175077 - protein, 36 aa, Cryptosporidium hominis
KMPPEIQKPYFLLFKLPRSLSLVALEPKSPLELGIS

SEQ ID NO: 2175078 - protein, 22 aa, Cryptosporidium hominis
KMPREYIVRLIFDRNHYSFCLL

SEQ ID NO: 2175079 - protein, 18 aa, Cryptosporidium hominis
KMRDEWNYELPKIEHDHL

SEQ ID NO: 2175080 - protein, 23 aa, Cryptosporidium hominis
KMRIEAHKRLKAIRKKRMKLKRK

SEQ ID NO: 2175081 - protein, 30 aa, Cryptosporidium hominis
KMRPETYVPLEIKTSIFAAYFAAEPVVIHF

SEQ ID NO: 2175082 - protein, 30 aa, Cryptosporidium hominis
KMRSEILENCIVCFTGFLKADEKPIVKGLP

SEQ ID NO: 2175083 - protein, 19 aa, Cryptosporidium hominis
KMTPWSLALFKSLPRFIRR

SEQ ID NO: 2175084 - protein, 22 aa, Cryptosporidium hominis
KMVKPEIIAYPISLQRNQTINT

SEQ ID NO: 2175085 - protein, 18 aa, Cryptosporidium hominis
KMYEEMSSEITFDDLYSK

SEQ ID NO: 2175086 - protein, 18 aa, Cryptosporidium hominis
KMYKDAKTGYLIVEDDVD

SEQ ID NO: 2175087 - protein, 25 aa, Cryptosporidium hominis
KMYKRCNQCDLILKKSDFEKHTHCN

SEQ ID NO: 2175088 - protein, 20 aa, Cryptosporidium hominis
KMYNKWKKPLEILSNDDDFK

SEQ ID NO: 2175089 - protein, 17 aa, Cryptosporidium hominis
KMYRCPITGQLIPDEEI

SEQ ID NO: 2175090 - protein, 20 aa, Cryptosporidium hominis
KNALLRTIIGLIRFSPTAAS

SEQ ID NO: 2175091 - protein, 17 aa, Cryptosporidium hominis
KNCKLYLTTEYSRKMLK

SEQ ID NO: 2175092 - protein, 19 aa, Cryptosporidium hominis
KNCPEKQILWLKAAQNQSA

SEQ ID NO: 2175093 - protein, 25 aa, Cryptosporidium hominis
KNCRQECKSFCPVVRTGKLCVEVDS

SEQ ID NO: 2175094 - protein, 24 aa, Cryptosporidium hominis
KNCTHFRISCKLFEGKSDSNLVKK

SEQ ID NO: 2175095 - protein, 19 aa, Cryptosporidium hominis
KNDCLERLLTFSIISILWI

SEQ ID NO: 2175096 - protein, 17 aa, Cryptosporidium hominis
KNDDFRGNVSIVPTSAV

SEQ ID NO: 2175097 - protein, 23 aa, Cryptosporidium hominis
KNDEIREVFNFENLQILIQNIIK

SEQ ID NO: 2175098 - protein, 20 aa, Cryptosporidium hominis
KNDHIFSFDWFIKTRSSNDI

SEQ ID NO: 2175099 - protein, 23 aa, Cryptosporidium hominis
KNDIITEFVGWVIDRKEALRLRS

SEQ ID NO: 2175100 - protein, 20 aa, Cryptosporidium hominis
KNDIYLRSNLIKVFKDDNNE

SEQ ID NO: 2175101 - protein, 20 aa, Cryptosporidium hominis
KNDPWMKIKCENEPNMADIQ

SEQ ID NO: 2175102 - protein, 18 aa, Cryptosporidium hominis
KNDRFCIESGLIISRTFS

SEQ ID NO: 2175103 - protein, 25 aa, Cryptosporidium hominis
KNEIKHFKGLITGAGEEYRKYKGNN

SEQ ID NO: 2175104 - protein, 18 aa, Cryptosporidium hominis
KNEISGLAWPMYYKFDEK

SEQ ID NO: 2175105 - protein, 18 aa, Cryptosporidium hominis
KNELLKEWFDNEDIILKE

SEQ ID NO: 2175106 - protein, 23 aa, Cryptosporidium hominis
KNESKILPCFGIIDLPGTAQIQD

SEQ ID NO: 2175107 - protein, 20 aa, Cryptosporidium hominis
KNFLRLMCLLDRSTPHTTTS

SEQ ID NO: 2175108 - protein, 21 aa, Cryptosporidium hominis
KNFPKRVIWYTSQVSKLKNLR

SEQ ID NO: 2175109 - protein, 22 aa, Cryptosporidium hominis
KNFPNIRFSNWLNNPKNSGLIT

SEQ ID NO: 2175110 - protein, 19 aa, Cryptosporidium hominis
KNGETLLPRMSLPFTGENK

SEQ ID NO: 2175111 - protein, 20 aa, Cryptosporidium hominis
KNGTKFRVIQGLIRRSYGNS

SEQ ID NO: 2175112 - protein, 23 aa, Cryptosporidium hominis
KNHDSFKKGVQIVTPRPLVIDDD

SEQ ID NO: 2175113 - protein, 17 aa, Cryptosporidium hominis
KNHFSIFSLFNKHKLQL

SEQ ID NO: 2175114 - protein, 19 aa, Cryptosporidium hominis
KNILTLLAYGLHIQTDSSV

SEQ ID NO: 2175115 - protein, 20 aa, Cryptosporidium hominis
KNIPELKNELSLLLSGEESV

SEQ ID NO: 2175116 - protein, 18 aa, Cryptosporidium hominis
KNIPGYNRGRGMGPGGGF

SEQ ID NO: 2175117 - protein, 24 aa, Cryptosporidium hominis
KNIPKLYLCHNVEIPDSCSLTSNI

SEQ ID NO: 2175118 - protein, 22 aa, Cryptosporidium hominis
KNIPSLVTICVNKLRTIRNSIT

SEQ ID NO: 2175119 - protein, 18 aa, Cryptosporidium hominis
KNIQSFTVVLGFDNVVSS

SEQ ID NO: 2175120 - protein, 31 aa, Cryptosporidium hominis
KNIYPIEVLLKLYKPLNVPRSIFKLETAVQR

SEQ ID NO: 2175121 - protein, 24 aa, Cryptosporidium hominis
KNKEITDLFSFFIIESTVINNERF

SEQ ID NO: 2175122 - protein, 18 aa, Cryptosporidium hominis
KNKFPTTIKDIFKDIESS

SEQ ID NO: 2175123 - protein, 21 aa, Cryptosporidium hominis
KNKIKIAMDMHGHVLGEQDPS

SEQ ID NO: 2175124 - protein, 22 aa, Cryptosporidium hominis
KNKLLLDFILCIEVYNNIQNNP

SEQ ID NO: 2175125 - protein, 25 aa, Cryptosporidium hominis
KNKPMICDFILFSILFDDISLIEFN

SEQ ID NO: 2175126 - protein, 18 aa, Cryptosporidium hominis
KNKSLAEYSESCDSIKTE

SEQ ID NO: 2175127 - protein, 24 aa, Cryptosporidium hominis
KNKTQYFKSIRVVIKIENPENDAS

SEQ ID NO: 2175128 - protein, 24 aa, Cryptosporidium hominis
KNLEFWRQLWRTIERSHVVVEIID

SEQ ID NO: 2175129 - protein, 19 aa, Cryptosporidium hominis
KNLHKKRHHILIDDHYNNQ

SEQ ID NO: 2175130 - protein, 22 aa, Cryptosporidium hominis
KNLKENYLFILKIIKMLKYNIQ

SEQ ID NO: 2175131 - protein, 22 aa, Cryptosporidium hominis
KNLKGLSFKSLFVVSDCTPIEK

SEQ ID NO: 2175132 - protein, 17 aa, Cryptosporidium hominis
KNLKMTVSDIIGDRSEI

SEQ ID NO: 2175133 - protein, 17 aa, Cryptosporidium hominis
KNLKYSFYDGIFDETNI

SEQ ID NO: 2175134 - protein, 17 aa, Cryptosporidium hominis
KNLLNIIIKECKIYLFS

SEQ ID NO: 2175135 - protein, 20 aa, Cryptosporidium hominis
KNLLRLSRNHAYLYVKKNNK

SEQ ID NO: 2175136 - protein, 23 aa, Cryptosporidium hominis
KNLLRTFFISSFIDHIAVRNDGN

SEQ ID NO: 2175137 - protein, 25 aa, Cryptosporidium hominis
KNLLSDLWIRYHVISSIARNGHPLR

SEQ ID NO: 2175138 - protein, 20 aa, Cryptosporidium hominis
KNLQRLKGFEVRPDSKYTGR

SEQ ID NO: 2175139 - protein, 20 aa, Cryptosporidium hominis
KNLRKLYISDGEHFKKVAEK

SEQ ID NO: 2175140 - protein, 24 aa, Cryptosporidium hominis
KNLRNLMLKVFRKDMFSDYCQKCK

SEQ ID NO: 2175141 - protein, 17 aa, Cryptosporidium hominis
KNLRRVARELGESISDD

SEQ ID NO: 2175142 - protein, 25 aa, Cryptosporidium hominis
KNLRSRVLMNYALWLVETDLCDPAI

SEQ ID NO: 2175143 - protein, 20 aa, Cryptosporidium hominis
KNLTKIIIYFIQSYAALRYK

SEQ ID NO: 2175144 - protein, 25 aa, Cryptosporidium hominis
KNMDWKQIEVGYCNKPKFYMYQHDR

SEQ ID NO: 2175145 - protein, 25 aa, Cryptosporidium hominis
KNMLKSIKCIQSWWRGDRVRQIIRE

SEQ ID NO: 2175146 - protein, 17 aa, Cryptosporidium hominis
KNMLLPKGFEIGGGIAS

SEQ ID NO: 2175147 - protein, 20 aa, Cryptosporidium hominis
KNNIGFTFDKCFTSEYVRAM

SEQ ID NO: 2175148 - protein, 24 aa, Cryptosporidium hominis
KNNIKEVILFPAMRNIKQNAQHSN

SEQ ID NO: 2175149 - protein, 21 aa, Cryptosporidium hominis
KNNPQCYGMMNYIHVSGACFG

SEQ ID NO: 2175150 - protein, 30 aa, Cryptosporidium hominis
KNPDFYAFLKGCLELDPLKRLTALQLQDLK

SEQ ID NO: 2175151 - protein, 24 aa, Cryptosporidium hominis
KNPDIASIKLMWKTSNIQEQVIPS

SEQ ID NO: 2175152 - protein, 24 aa, Cryptosporidium hominis
KNPNGLFCFDFKLRINPNSSESDR

SEQ ID NO: 2175153 - protein, 23 aa, Cryptosporidium hominis
KNPQWFKLYIHYEPDSYKEIDGF

SEQ ID NO: 2175154 - protein, 24 aa, Cryptosporidium hominis
KNPSLDFCLGFGALLPNFINNSIF

SEQ ID NO: 2175155 - protein, 31 aa, Cryptosporidium hominis
KNQHGMVGYSFQTLECCSGKNYHPNISSEFI

SEQ ID NO: 2175156 - protein, 18 aa, Cryptosporidium hominis
KNQIKEWVNSSIIHPESE

SEQ ID NO: 2175157 - protein, 19 aa, Cryptosporidium hominis
KNQRAIYSYLFKEGAIVVH

SEQ ID NO: 2175158 - protein, 17 aa, Cryptosporidium hominis
KNQVMKRNIPRDSQSIS

SEQ ID NO: 2175159 - protein, 18 aa, Cryptosporidium hominis
KNQVPSFITSNNRLASGY

SEQ ID NO: 2175160 - protein, 20 aa, Cryptosporidium hominis
KNRCRSFFSFVANWSDDDVS

SEQ ID NO: 2175161 - protein, 17 aa, Cryptosporidium hominis
KNRLTNTILKIVIIPAI

SEQ ID NO: 2175162 - protein, 17 aa, Cryptosporidium hominis
KNRYSIRTYVPTTFSNL

SEQ ID NO: 2175163 - protein, 24 aa, Cryptosporidium hominis
KNSDSCPFSHCLTWQRRNPNDHYY

SEQ ID NO: 2175164 - protein, 24 aa, Cryptosporidium hominis
KNSESYRSIVFETLPNLQILDEMN

SEQ ID NO: 2175165 - protein, 25 aa, Cryptosporidium hominis
KNSFPWACSECISCTVCKKSDRPSI

SEQ ID NO: 2175166 - protein, 25 aa, Cryptosporidium hominis
KNSLEFLKNIRFEQMAPHDLLKIRT

SEQ ID NO: 2175167 - protein, 33 aa, Cryptosporidium hominis
KNSLKLMLGLMLKGPLFMRSCKDTIDERSQGYE

SEQ ID NO: 2175168 - protein, 17 aa, Cryptosporidium hominis
KNSLKYRLFESCQLILY

SEQ ID NO: 2175169 - protein, 17 aa, Cryptosporidium hominis
KNSNVVCLCCRKKGHQM

SEQ ID NO: 2175170 - protein, 23 aa, Cryptosporidium hominis
KNSPKINFVRVICNGKGSDNNKS

SEQ ID NO: 2175171 - protein, 28 aa, Cryptosporidium hominis
KNSPRTDWRVSNILPLKSRHFYKDITNI

SEQ ID NO: 2175172 - protein, 22 aa, Cryptosporidium hominis
KNSRLIQDYPIYDIMKEPENTL

SEQ ID NO: 2175173 - protein, 17 aa, Cryptosporidium hominis
KNSSFSILNYKDNNNNN

SEQ ID NO: 2175174 - protein, 19 aa, Cryptosporidium hominis
KNTAFLMSNMVSVPINLLQ

SEQ ID NO: 2175175 - protein, 20 aa, Cryptosporidium hominis
KNTHGFIVVHILSCKADSLI

SEQ ID NO: 2175176 - protein, 19 aa, Cryptosporidium hominis
KNTLKRVEFLSVKDITEII

SEQ ID NO: 2175177 - protein, 24 aa, Cryptosporidium hominis
KNVIDLVRVCISVGLRVGAILEEK

SEQ ID NO: 2175178 - protein, 25 aa, Cryptosporidium hominis
KNVIFRIEPISGFYYETGGLHSVKV

SEQ ID NO: 2175179 - protein, 26 aa, Cryptosporidium hominis
KNVNLQFKHYFSIFWSKTMRPHLKFD

SEQ ID NO: 2175180 - protein, 20 aa, Cryptosporidium hominis
KNVQSYERLRTIRILLNTCI

SEQ ID NO: 2175181 - protein, 24 aa, Cryptosporidium hominis
KNVREFLKGLPIQKSDLILKIDQM

SEQ ID NO: 2175182 - protein, 21 aa, Cryptosporidium hominis
KNVSCVVNYDFPHSPSNYIHR

SEQ ID NO: 2175183 - protein, 26 aa, Cryptosporidium hominis
KNWPNCDKGDHCFYIHPSEACKSWPL

SEQ ID NO: 2175184 - protein, 22 aa, Cryptosporidium hominis
KNWTRKYHIALLMNDIPERINI

SEQ ID NO: 2175185 - protein, 18 aa, Cryptosporidium hominis
KNYLKSRFCGYTFQCSIS

SEQ ID NO: 2175186 - protein, 27 aa, Cryptosporidium hominis
KNYSEKFGLWSFELYKNSNACITKPNS

SEQ ID NO: 2175187 - protein, 25 aa, Cryptosporidium hominis
KNYSGRFGGKMGLPLVPETIETSGD

SEQ ID NO: 2175188 - protein, 18 aa, Cryptosporidium hominis
KPAGLYGGNLVPFGLSGG

SEQ ID NO: 2175189 - protein, 19 aa, Cryptosporidium hominis
KPAIRRLARRGGVKRISAL

SEQ ID NO: 2175190 - protein, 18 aa, Cryptosporidium hominis
KPCDSNCMPESPSEHCPA

SEQ ID NO: 2175191 - protein, 17 aa, Cryptosporidium hominis
KPCQSMIQFKYYCNSGL

SEQ ID NO: 2175192 - protein, 20 aa, Cryptosporidium hominis
KPDPTPAYNFSDEKLRDVQK

SEQ ID NO: 2175193 - protein, 24 aa, Cryptosporidium hominis
KPELLGYKSVEDWVSSQPKSVLTY

SEQ ID NO: 2175194 - protein, 21 aa, Cryptosporidium hominis
KPFWEVFPLSQIVVLSPDSSE

SEQ ID NO: 2175195 - protein, 20 aa, Cryptosporidium hominis
KPGLMVECLIHAYGNTNQKD

SEQ ID NO: 2175196 - protein, 22 aa, Cryptosporidium hominis
KPGNLQRFLHLFIINQLFSENL

SEQ ID NO: 2175197 - protein, 20 aa, Cryptosporidium hominis
KPGNSMLPAGRFIVAKESKN

SEQ ID NO: 2175198 - protein, 20 aa, Cryptosporidium hominis
KPGSLKVHIYHGSKRNKNQG

SEQ ID NO: 2175199 - protein, 19 aa, Cryptosporidium hominis
KPHPGVRPYPTEKPSNGEH

SEQ ID NO: 2175200 - protein, 27 aa, Cryptosporidium hominis
KPIFSSKMITYCWIKYNNLYLVLLSRK

SEQ ID NO: 2175201 - protein, 26 aa, Cryptosporidium hominis
KPIKISWSSPFVYNSRNCRLYIIPNQ

SEQ ID NO: 2175202 - protein, 17 aa, Cryptosporidium hominis
KPIRYLNDGLPVYRLED

SEQ ID NO: 2175203 - protein, 18 aa, Cryptosporidium hominis
KPISLCPRQTPTIRSLIP

SEQ ID NO: 2175204 - protein, 18 aa, Cryptosporidium hominis
KPKAIVCPMIEDIDRYTW

SEQ ID NO: 2175205 - protein, 18 aa, Cryptosporidium hominis
KPKIPSWFHPSISNLLSK

SEQ ID NO: 2175206 - protein, 22 aa, Cryptosporidium hominis
KPKKGRKRRLLFPSTVTKKQIK

SEQ ID NO: 2175207 - protein, 19 aa, Cryptosporidium hominis
KPKYIPGNDSFKFRDESKL

SEQ ID NO: 2175208 - protein, 20 aa, Cryptosporidium hominis
KPLFHSYIRISANEMLRYSS

SEQ ID NO: 2175209 - protein, 19 aa, Cryptosporidium hominis
KPLKVKRPKGPKDIMYEII

SEQ ID NO: 2175210 - protein, 21 aa, Cryptosporidium hominis
KPLLNCLSAKCGLDATKSLEY

SEQ ID NO: 2175211 - protein, 17 aa, Cryptosporidium hominis
KPLLQPFNTIREQISSN

SEQ ID NO: 2175212 - protein, 23 aa, Cryptosporidium hominis
KPLLRIQRFIKYCETIQESINQC

SEQ ID NO: 2175213 - protein, 22 aa, Cryptosporidium hominis
KPLTKKEIEAMLPNDPMSKTRS

SEQ ID NO: 2175214 - protein, 25 aa, Cryptosporidium hominis
KPLVSRFHPLISMIQLLSKFTHQME

SEQ ID NO: 2175215 - protein, 20 aa, Cryptosporidium hominis
KPNFFCIYRYNDGCTDAVKM

SEQ ID NO: 2175216 - protein, 18 aa, Cryptosporidium hominis
KPNPATMKDCFEYRKVIS

SEQ ID NO: 2175217 - protein, 20 aa, Cryptosporidium hominis
KPNQNMRISAARANALSSEL

SEQ ID NO: 2175218 - protein, 37 aa, Cryptosporidium hominis
KPPSGFKVFCGMLDIFGFEVFKNNSLEQFFINVTNEY

SEQ ID NO: 2175219 - protein, 20 aa, Cryptosporidium hominis
KPQIATFIPCYDVIPPKFIN

SEQ ID NO: 2175220 - protein, 19 aa, Cryptosporidium hominis
KPQKHTFLRKGEGKIKAFK

SEQ ID NO: 2175221 - protein, 20 aa, Cryptosporidium hominis
KPQRIRMAHNLILSYDLYKH

SEQ ID NO: 2175222 - protein, 24 aa, Cryptosporidium hominis
KPRRRIKPLIFGGGQERGMRSGTM

SEQ ID NO: 2175223 - protein, 24 aa, Cryptosporidium hominis
KPSELKSFCRTLLERRLRDGEIQI

SEQ ID NO: 2175224 - protein, 26 aa, Cryptosporidium hominis
KPSIPGRCYHCNKKVGIYGFNCRCGF

SEQ ID NO: 2175225 - protein, 20 aa, Cryptosporidium hominis
KPSPYRKVIVATNIAETSLT

SEQ ID NO: 2175226 - protein, 17 aa, Cryptosporidium hominis
KPSRRKVLQRQNQEVKA

SEQ ID NO: 2175227 - protein, 17 aa, Cryptosporidium hominis
KPVNARLDFQLEDHENS

SEQ ID NO: 2175228 - protein, 17 aa, Cryptosporidium hominis
KPYGLSCVPDISIIGLN

SEQ ID NO: 2175229 - protein, 19 aa, Cryptosporidium hominis
KPYIFKIAALRDIRNLFPI

SEQ ID NO: 2175230 - protein, 20 aa, Cryptosporidium hominis
KPYLSCPENTVLVATNTCKM

SEQ ID NO: 2175231 - protein, 18 aa, Cryptosporidium hominis
KQADLLQNQHIFKKYTTT

SEQ ID NO: 2175232 - protein, 26 aa, Cryptosporidium hominis
KQAKAIKIQRVWRYYYLRQIMIHYIR

SEQ ID NO: 2175233 - protein, 24 aa, Cryptosporidium hominis
KQEADEPLHLCISSTNSEQYINAR

SEQ ID NO: 2175234 - protein, 19 aa, Cryptosporidium hominis
KQFFFCFFIEESLEANIKE

SEQ ID NO: 2175235 - protein, 24 aa, Cryptosporidium hominis
KQFFRLERHLIWVESIIRVHGNTF

SEQ ID NO: 2175236 - protein, 20 aa, Cryptosporidium hominis
KQFKLTCAKSQTNFVGINLE

SEQ ID NO: 2175237 - protein, 17 aa, Cryptosporidium hominis
KQFLCVCSDGFTGPSCE

SEQ ID NO: 2175238 - protein, 33 aa, Cryptosporidium hominis
KQFLSSCKRLLGLDHYFKPGGLIGIDKTTASSS

SEQ ID NO: 2175239 - protein, 27 aa, Cryptosporidium hominis
KQGHPFVKCRLCFLVKKDHCICMDLSR

SEQ ID NO: 2175240 - protein, 20 aa, Cryptosporidium hominis
KQGKQMSGRDLFVYDPSLFV

SEQ ID NO: 2175241 - protein, 23 aa, Cryptosporidium hominis
KQIMSSKLIPFFNSNEIMVIDNK

SEQ ID NO: 2175242 - protein, 20 aa, Cryptosporidium hominis
  misc_feature (16)..(16): Xaa can be any naturally occurring amino acid
KQKAVHSMDLFSGKIXYRSV

SEQ ID NO: 2175243 - protein, 19 aa, Cryptosporidium hominis
KQKELKELTFELATDPSPN

SEQ ID NO: 2175244 - protein, 19 aa, Cryptosporidium hominis
KQKFGMNGETIWERINDAF

SEQ ID NO: 2175245 - protein, 17 aa, Cryptosporidium hominis
KQKRFYYSYFLPNNHMM

SEQ ID NO: 2175246 - protein, 23 aa, Cryptosporidium hominis
KQKVKKPESSICEHIESETLNSD

SEQ ID NO: 2175247 - protein, 22 aa, Cryptosporidium hominis
KQLNNCLSCLLRGFKCQDVLIR

SEQ ID NO: 2175248 - protein, 20 aa, Cryptosporidium hominis
KQLSELICQYCIGMRLELAR

SEQ ID NO: 2175249 - protein, 21 aa, Cryptosporidium hominis
KQLSGLFTEIMCKLDNLSNQY

SEQ ID NO: 2175250 - protein, 23 aa, Cryptosporidium hominis
KQMDIWKCTAWDLKNGDSNNTNE

SEQ ID NO: 2175251 - protein, 19 aa, Cryptosporidium hominis
KQMNILFIHYLVFTLKNLN

SEQ ID NO: 2175252 - protein, 19 aa, Cryptosporidium hominis
KQNKCNIRKLSALVHGVSG

SEQ ID NO: 2175253 - protein, 17 aa, Cryptosporidium hominis
KQNKFVMQIHEKLTCGN

SEQ ID NO: 2175254 - protein, 25 aa, Cryptosporidium hominis
KQNLKWALNHARIDKIIDRFSEFEK

SEQ ID NO: 2175255 - protein, 17 aa, Cryptosporidium hominis
KQNLLLSKRIKNVNLKV

SEQ ID NO: 2175256 - protein, 17 aa, Cryptosporidium hominis
KQNNDWINHLGLVSELR

SEQ ID NO: 2175257 - protein, 29 aa, Cryptosporidium hominis
KQPKPKLIGWRAQVGGGYDHQFFNIKRLD

SEQ ID NO: 2175258 - protein, 28 aa, Cryptosporidium hominis
KQPLYRLLRVTLNCINRSLPYAEVQIKI

SEQ ID NO: 2175259 - protein, 17 aa, Cryptosporidium hominis
KQPRKVVIYSSTTKSIH

SEQ ID NO: 2175260 - protein, 19 aa, Cryptosporidium hominis
KQPVFILGYELLRVHATES

SEQ ID NO: 2175261 - protein, 17 aa, Cryptosporidium hominis
KQQCENLNKTDIASIQN

SEQ ID NO: 2175262 - protein, 18 aa, Cryptosporidium hominis
KQQIRDFLRVVATSKGSY

SEQ ID NO: 2175263 - protein, 22 aa, Cryptosporidium hominis
KQQYELVVSRGYNVVMCDVYPN

SEQ ID NO: 2175264 - protein, 29 aa, Cryptosporidium hominis
KQRKEIVNCCPKDVFALGGNTSKTEYALN

SEQ ID NO: 2175265 - protein, 17 aa, Cryptosporidium hominis
KQRLEFIEEMLKKKDAP

SEQ ID NO: 2175266 - protein, 19 aa, Cryptosporidium hominis
KQRLRNIEINLSRFEPLIK

SEQ ID NO: 2175267 - protein, 27 aa, Cryptosporidium hominis
KQSCSSCYIREAILSSIFSKVLETFNI

SEQ ID NO: 2175268 - protein, 25 aa, Cryptosporidium hominis
KQSLETICLLFAYKIKYPENFFLLR

SEQ ID NO: 2175269 - protein, 24 aa, Cryptosporidium hominis
KQSQFRHDLVFTLLRQTLQYYENV

SEQ ID NO: 2175270 - protein, 20 aa, Cryptosporidium hominis
KQSRPIVGRFAHMDASASSF

SEQ ID NO: 2175271 - protein, 18 aa, Cryptosporidium hominis
KQTIILFQDCIEAKAGLN

SEQ ID NO: 2175272 - protein, 27 aa, Cryptosporidium hominis
KQTIPSVILSPSFKMIFHDDGVTTKWL

SEQ ID NO: 2175273 - protein, 25 aa, Cryptosporidium hominis
KQTKCQETMKGTGYETSIQGQDQAR

SEQ ID NO: 2175274 - protein, 27 aa, Cryptosporidium hominis
KQVEDVKKLLGFLGMPCIDAPSEAEAQ

SEQ ID NO: 2175275 - protein, 20 aa, Cryptosporidium hominis
KQVVSASWVKYASRVLESSQ

SEQ ID NO: 2175276 - protein, 17 aa, Cryptosporidium hominis
KQWKVRRLIATLEAARG

SEQ ID NO: 2175277 - protein, 19 aa, Cryptosporidium hominis
KQYLKLLVFGIHGECDELI

SEQ ID NO: 2175278 - protein, 19 aa, Cryptosporidium hominis
KQYLKLSTFIPLSDLDHID

SEQ ID NO: 2175279 - protein, 24 aa, Cryptosporidium hominis
KRAKRLLDEIIILFSQSLNIEFIR

SEQ ID NO: 2175280 - protein, 24 aa, Cryptosporidium hominis
KRAQNMAIVLARLSVPTDYIIEIL

SEQ ID NO: 2175281 - protein, 19 aa, Cryptosporidium hominis
KRASERLIYYPYESSDKIY

SEQ ID NO: 2175282 - protein, 27 aa, Cryptosporidium hominis
KRATRLQEMWDRVVAGESIINGGKIPQ

SEQ ID NO: 2175283 - protein, 23 aa, Cryptosporidium hominis
KRCASCGYPSAKMRSYNWGQKAK

SEQ ID NO: 2175284 - protein, 18 aa, Cryptosporidium hominis
KRCISNLSAKRFVHSRDD

SEQ ID NO: 2175285 - protein, 23 aa, Cryptosporidium hominis
KRCMACKRLVIKPQLNPLSQPPF

SEQ ID NO: 2175286 - protein, 22 aa, Cryptosporidium hominis
KRCVPFRRFNGGVGRTAKANEF

SEQ ID NO: 2175287 - protein, 21 aa, Cryptosporidium hominis
KRDAIKSCFVFQYVSEQQLSL

SEQ ID NO: 2175288 - protein, 31 aa, Cryptosporidium hominis
KRDALDWIKKTFLYIRIIRNPSLYGLDIDEI

SEQ ID NO: 2175289 - protein, 20 aa, Cryptosporidium hominis
KRDSLCIFLEHGAIDVFEGV

SEQ ID NO: 2175290 - protein, 28 aa, Cryptosporidium hominis
KRDTLQIPICKFPLIKKIIVALDNSQNN

SEQ ID NO: 2175291 - protein, 26 aa, Cryptosporidium hominis
KREFKNLDIEFIIRVLAVYKSYNLAQ

SEQ ID NO: 2175292 - protein, 23 aa, Cryptosporidium hominis
KRELKAALRALGFDVKKKDIELV

SEQ ID NO: 2175293 - protein, 33 aa, Cryptosporidium hominis
KRETLKFTTNNYLKWDPSHLITDLRGIHIPLSL

SEQ ID NO: 2175294 - protein, 23 aa, Cryptosporidium hominis
KREVPFDIAANFAQENNLFFSEA

SEQ ID NO: 2175295 - protein, 25 aa, Cryptosporidium hominis
KRFDFTRFRSVLNLLDRLTFENFTS

SEQ ID NO: 2175296 - protein, 17 aa, Cryptosporidium hominis
KRFDFVVLMLNENFQIL

SEQ ID NO: 2175297 - protein, 19 aa, Cryptosporidium hominis
KRFLRRIRNVLPGINTPIY

SEQ ID NO: 2175298 - protein, 17 aa, Cryptosporidium hominis
KRFNVRRGNKSAHNLES

SEQ ID NO: 2175299 - protein, 22 aa, Cryptosporidium hominis
KRFTEFRRAKEMIVLNNLENRN

SEQ ID NO: 2175300 - protein, 25 aa, Cryptosporidium hominis
KRGDNATHSWTCFLRSPDNEDISYY

SEQ ID NO: 2175301 - protein, 18 aa, Cryptosporidium hominis
KRGKIGFEASAFFPNLFG

SEQ ID NO: 2175302 - protein, 21 aa, Cryptosporidium hominis
KRIATVYPRDIVNIRYLHGYN

SEQ ID NO: 2175303 - protein, 23 aa, Cryptosporidium hominis
KRIDLKGNLPLEYNQYSNQNIIM

SEQ ID NO: 2175304 - protein, 24 aa, Cryptosporidium hominis
KRIEEFRKGLMITHAQLNKEREIF

SEQ ID NO: 2175305 - protein, 21 aa, Cryptosporidium hominis
KRIKCILDTLMKMMVYEMSYV

SEQ ID NO: 2175306 - protein, 19 aa, Cryptosporidium hominis
KRILSHVIPELSISQFNES

SEQ ID NO: 2175307 - protein, 19 aa, Cryptosporidium hominis
KRILSQMGFEEMPTNRWVE

SEQ ID NO: 2175308 - protein, 20 aa, Cryptosporidium hominis
KRINKSMVNQDDFCIVKLAN

SEQ ID NO: 2175309 - protein, 20 aa, Cryptosporidium hominis
KRIQSVPLVIGQFLEMIDSR

SEQ ID NO: 2175310 - protein, 25 aa, Cryptosporidium hominis
KRISANDALKHPFVSIFHNPNEEPN

SEQ ID NO: 2175311 - protein, 21 aa, Cryptosporidium hominis
KRISCKNALLHPWFDDIDRSK

SEQ ID NO: 2175312 - protein, 17 aa, Cryptosporidium hominis
KRITALEALQHPWLNTN

SEQ ID NO: 2175313 - protein, 19 aa, Cryptosporidium hominis
KRIYLGALKYIPHSIFKLL

SEQ ID NO: 2175314 - protein, 17 aa, Cryptosporidium hominis
KRKCIKISSVMPNFSCP

SEQ ID NO: 2175315 - protein, 23 aa, Cryptosporidium hominis
KRKDHKFTPGFLFVSMDVSRALV

SEQ ID NO: 2175316 - protein, 18 aa, Cryptosporidium hominis
KRKFRRPFQRSPTNGAQK

SEQ ID NO: 2175317 - protein, 19 aa, Cryptosporidium hominis
KRKMMERYGHLFENEAEES

SEQ ID NO: 2175318 - protein, 19 aa, Cryptosporidium hominis
KRKPPSICSKYLPQCKQRQ

SEQ ID NO: 2175319 - protein, 21 aa, Cryptosporidium hominis
KRKQISMSIEEFLEKSQTLSL

SEQ ID NO: 2175320 - protein, 21 aa, Cryptosporidium hominis
KRKSFEWKNFPIYDSNKPIIV

SEQ ID NO: 2175321 - protein, 34 aa, Cryptosporidium hominis
KRKSSNWKEICHYIFTFRIYKDFNEIESGKNNQM

SEQ ID NO: 2175322 - protein, 20 aa, Cryptosporidium hominis
KRKVQSITIVSKIILARIDL

SEQ ID NO: 2175323 - protein, 21 aa, Cryptosporidium hominis
KRLAEHLCALYTSYSSKEKPA

SEQ ID NO: 2175324 - protein, 20 aa, Cryptosporidium hominis
KRLAIKELLRRYASKDYSEQ

SEQ ID NO: 2175325 - protein, 24 aa, Cryptosporidium hominis
KRLARLDLLRVFDSTLKYVSNKSK

SEQ ID NO: 2175326 - protein, 18 aa, Cryptosporidium hominis
KRLEIIFNSMIKLDITNE

SEQ ID NO: 2175327 - protein, 19 aa, Cryptosporidium hominis
KRLERAKKFGIALDLNLEK

SEQ ID NO: 2175328 - protein, 25 aa, Cryptosporidium hominis
KRLFKKNVNNIFMWYSYFRGNIYLE

SEQ ID NO: 2175329 - protein, 18 aa, Cryptosporidium hominis
KRLFMHRSPLPSLEESAI

SEQ ID NO: 2175330 - protein, 17 aa, Cryptosporidium hominis
KRLGELLEIDYKSIGVI

SEQ ID NO: 2175331 - protein, 20 aa, Cryptosporidium hominis
KRLGKAKTFLEQTISGIKDA

SEQ ID NO: 2175332 - protein, 23 aa, Cryptosporidium hominis
KRLKAYVYCLLGFYDSAMSVCLK

SEQ ID NO: 2175333 - protein, 17 aa, Cryptosporidium hominis
KRLKMQRQLEMQRRREE

SEQ ID NO: 2175334 - protein, 21 aa, Cryptosporidium hominis
KRLLNQGVFTKSHFSECLTQF

SEQ ID NO: 2175335 - protein, 19 aa, Cryptosporidium hominis
KRLLRINPVGLYIHAVVKC

SEQ ID NO: 2175336 - protein, 22 aa, Cryptosporidium hominis
KRLNSDFGDSPLCFISLIDCPS

SEQ ID NO: 2175337 - protein, 20 aa, Cryptosporidium hominis
KRLRDELGIIRDLKLTWKLH

SEQ ID NO: 2175338 - protein, 20 aa, Cryptosporidium hominis
KRLRIEKRLENENKKRMLKQ

SEQ ID NO: 2175339 - protein, 18 aa, Cryptosporidium hominis
KRLRSDILNLTYYGKLYD

SEQ ID NO: 2175340 - protein, 26 aa, Cryptosporidium hominis
KRLSWEEFKYILVHFSPNFPIKLNSC

SEQ ID NO: 2175341 - protein, 21 aa, Cryptosporidium hominis
KRLSWNSAHEKLLTWSLSGFS

SEQ ID NO: 2175342 - protein, 18 aa, Cryptosporidium hominis
KRLVARDASHCELYSEFS

SEQ ID NO: 2175343 - protein, 21 aa, Cryptosporidium hominis
KRMCFAGFSEIFISWIHVKAM

SEQ ID NO: 2175344 - protein, 20 aa, Cryptosporidium hominis
KRNFHRNRKSLGLHPNPISE

SEQ ID NO: 2175345 - protein, 36 aa, Cryptosporidium hominis
KRNHSNYRHSWVFPPDFPCFDAIHAMKNPNIISNFK

SEQ ID NO: 2175346 - protein, 18 aa, Cryptosporidium hominis
KRNLRKMNSDLETIVPKV

SEQ ID NO: 2175347 - protein, 19 aa, Cryptosporidium hominis
KRNSSLWCSHYYSRRSSSN

SEQ ID NO: 2175348 - protein, 17 aa, Cryptosporidium hominis
KRPAVMQGVELVLLRLG

SEQ ID NO: 2175349 - protein, 18 aa, Cryptosporidium hominis
KRPDIKYKCVAVDVMMEE

SEQ ID NO: 2175350 - protein, 21 aa, Cryptosporidium hominis
KRPHTAYTLWCEHIRQKVREN

SEQ ID NO: 2175351 - protein, 24 aa, Cryptosporidium hominis
KRPLVELQDKITYEGEWLGDNKHG

SEQ ID NO: 2175352 - protein, 18 aa, Cryptosporidium hominis
KRQCVLYNGKAFEIQNIF

SEQ ID NO: 2175353 - protein, 19 aa, Cryptosporidium hominis
KRQICTSVEKYLRSLSLLK

SEQ ID NO: 2175354 - protein, 19 aa, Cryptosporidium hominis
KRQRIGVQILDDLDKLEKL

SEQ ID NO: 2175355 - protein, 20 aa, Cryptosporidium hominis
KRQTEISRYFSAKRYGVEKS

SEQ ID NO: 2175356 - protein, 18 aa, Cryptosporidium hominis
KRRELKAAGMLSHASIMR

SEQ ID NO: 2175357 - protein, 19 aa, Cryptosporidium hominis
KRRKREFLKEMKNRNNGVI

SEQ ID NO: 2175358 - protein, 25 aa, Cryptosporidium hominis
KRRLKEIQAEFDWMILVFLSEEQLP

SEQ ID NO: 2175359 - protein, 21 aa, Cryptosporidium hominis
KRRLLPYHMHLSLEVIDCIYL

SEQ ID NO: 2175360 - protein, 17 aa, Cryptosporidium hominis
KRRLSGATWLYSPIELL

SEQ ID NO: 2175361 - protein, 18 aa, Cryptosporidium hominis
KRRLSSEICFYREKRDTR

SEQ ID NO: 2175362 - protein, 17 aa, Cryptosporidium hominis
KRRSRIGLFESELESSS

SEQ ID NO: 2175363 - protein, 19 aa, Cryptosporidium hominis
KRSDACLNKLASLNEYVQV

SEQ ID NO: 2175364 - protein, 20 aa, Cryptosporidium hominis
KRSELYLKLFDQEVNEYHNS

SEQ ID NO: 2175365 - protein, 19 aa, Cryptosporidium hominis
KRSGFKRSFGGNSQKHSHL

SEQ ID NO: 2175366 - protein, 42 aa, Cryptosporidium hominis
KRSMRFKKSYPILASLITNIDWWRIVLDEAQMTEGYSLVSKM

SEQ ID NO: 2175367 - protein, 18 aa, Cryptosporidium hominis
KRSSFCLGPELICEPNIL

SEQ ID NO: 2175368 - protein, 18 aa, Cryptosporidium hominis
KRTLKYPYIKKISTTKKY

SEQ ID NO: 2175369 - protein, 24 aa, Cryptosporidium hominis
KRTNLEIVQDILLLSIIRGPLSSD

SEQ ID NO: 2175370 - protein, 26 aa, Cryptosporidium hominis
KRTQMELKLLSTCLHDMALRYHQCKS

SEQ ID NO: 2175371 - protein, 24 aa, Cryptosporidium hominis
KRVEECKKRHQSIIHQLVHISCMI

SEQ ID NO: 2175372 - protein, 18 aa, Cryptosporidium hominis
KRVLKLLMNSCKMYQDFG

SEQ ID NO: 2175373 - protein, 17 aa, Cryptosporidium hominis
KRVLSLFGETVLSREKL

SEQ ID NO: 2175374 - protein, 17 aa, Cryptosporidium hominis
KRYCLVFKDQYTGNKAT

SEQ ID NO: 2175375 - protein, 22 aa, Cryptosporidium hominis
KRYENSLNFSVEYHVGNLLSRT

SEQ ID NO: 2175376 - protein, 19 aa, Cryptosporidium hominis
KRYGCSVEYYDCMNLLCGT

SEQ ID NO: 2175377 - protein, 23 aa, Cryptosporidium hominis
KRYILRYLIYDCICIERDDSVKS

SEQ ID NO: 2175378 - protein, 17 aa, Cryptosporidium hominis
KRYNINVNFQFKENVHT

SEQ ID NO: 2175379 - protein, 19 aa, Cryptosporidium hominis
KRYSRDCRTLGRVRFQLFD

SEQ ID NO: 2175380 - protein, 22 aa, Cryptosporidium hominis
KSAFFCKLLHEFYQIDKHPDNV

SEQ ID NO: 2175381 - protein, 19 aa, Cryptosporidium hominis
KSAFYILYSMSYKSQPIVP

SEQ ID NO: 2175382 - protein, 30 aa, Cryptosporidium hominis
KSALPLRSSEFFMINILGLNRFKIRAQCVL

SEQ ID NO: 2175383 - protein, 20 aa, Cryptosporidium hominis
KSANGKAKFGLDIFADALLA

SEQ ID NO: 2175384 - protein, 31 aa, Cryptosporidium hominis
KSANINTGFFERFNCHGAKILEFTTGNNAVF

SEQ ID NO: 2175385 - protein, 18 aa, Cryptosporidium hominis
KSARIYFMDLDLMKKNQI

SEQ ID NO: 2175386 - protein, 19 aa, Cryptosporidium hominis
KSCELQCNDRRAELWVEVF

SEQ ID NO: 2175387 - protein, 31 aa, Cryptosporidium hominis
KSCPVWIPPWWTAFRIGGWNWQYSLEVELSW

SEQ ID NO: 2175388 - protein, 24 aa, Cryptosporidium hominis
KSDEILRIYMSYLLDSGGIRIHEL

SEQ ID NO: 2175389 - protein, 19 aa, Cryptosporidium hominis
KSDFIIIRFYGEAYGSMSY

SEQ ID NO: 2175390 - protein, 18 aa, Cryptosporidium hominis
KSDFPRDYARESNKRNYD

SEQ ID NO: 2175391 - protein, 27 aa, Cryptosporidium hominis
KSDGRLFVWKKICYENMTQQEKIQIVN

SEQ ID NO: 2175392 - protein, 20 aa, Cryptosporidium hominis
KSDILKTLFLKQDIDHDKLK

SEQ ID NO: 2175393 - protein, 25 aa, Cryptosporidium hominis
KSDKGVFNYFELVEKYTTRNSYNRR

SEQ ID NO: 2175394 - protein, 28 aa, Cryptosporidium hominis
KSDLRDVPWEFLDEISKLGTMPSQELNK

SEQ ID NO: 2175395 - protein, 18 aa, Cryptosporidium hominis
KSDQQKCNTFSWIEETNS

SEQ ID NO: 2175396 - protein, 18 aa, Cryptosporidium hominis
KSDRPSIQVFWRCLQPLF

SEQ ID NO: 2175397 - protein, 23 aa, Cryptosporidium hominis
KSEAIRVASKVSSVVNSFESANN

SEQ ID NO: 2175398 - protein, 17 aa, Cryptosporidium hominis
KSEALIFEIDGYTRKKS

SEQ ID NO: 2175399 - protein, 26 aa, Cryptosporidium hominis
KSEIPVVFVPVCLENSISHQMIETCI

SEQ ID NO: 2175400 - protein, 24 aa, Cryptosporidium hominis
KSELFRSTPDWKRLETYKDLISCE

SEQ ID NO: 2175401 - protein, 23 aa, Cryptosporidium hominis
KSEPKMNEKFVFESSPVLSSVAD

SEQ ID NO: 2175402 - protein, 29 aa, Cryptosporidium hominis
KSESGFEPFGPWLVTPLFLGAKGGGGSQG

SEQ ID NO: 2175403 - protein, 18 aa, Cryptosporidium hominis
KSEYCKLKEKLESIENKE

SEQ ID NO: 2175404 - protein, 25 aa, Cryptosporidium hominis
KSFKEMFRSINLPIFHRNLNRKLKR

SEQ ID NO: 2175405 - protein, 21 aa, Cryptosporidium hominis
KSFMKKLKFILFQQQRENKRL

SEQ ID NO: 2175406 - protein, 27 aa, Cryptosporidium hominis
KSFNEFCQLFLWPLFHNVLNPEELSNA

SEQ ID NO: 2175407 - protein, 22 aa, Cryptosporidium hominis
KSGHFLHVDFGYIFGEDPKPFP

SEQ ID NO: 2175408 - protein, 18 aa, Cryptosporidium hominis
KSGILSMKIVEFGFQGTN

SEQ ID NO: 2175409 - protein, 18 aa, Cryptosporidium hominis
KSGKDMQKGIAFDSSSVR

SEQ ID NO: 2175410 - protein, 24 aa, Cryptosporidium hominis
KSGLLDYYGTLFIPSEQDLSSKID

SEQ ID NO: 2175411 - protein, 18 aa, Cryptosporidium hominis
KSGSLLGLTVMNLENAHE

SEQ ID NO: 2175412 - protein, 25 aa, Cryptosporidium hominis
KSGWIPENMKLFLAIKSPFKGVHSI

SEQ ID NO: 2175413 - protein, 38 aa, Cryptosporidium hominis
KSHFKIYTCKNVDFIRNLKLCRLNLELEELVSFSEDNS

SEQ ID NO: 2175414 - protein, 20 aa, Cryptosporidium hominis
KSHMVCFALVAMDVGFDNPM

SEQ ID NO: 2175415 - protein, 25 aa, Cryptosporidium hominis
KSHPTFPEYFIVAYGTKFSQNSSFE

SEQ ID NO: 2175416 - protein, 18 aa, Cryptosporidium hominis
KSHVEVGKNAFSVEESIT

SEQ ID NO: 2175417 - protein, 21 aa, Cryptosporidium hominis
KSICGGLRVLNSYFVCQDATY

SEQ ID NO: 2175418 - protein, 17 aa, Cryptosporidium hominis
KSIDRWKSKYYSSNDDY

SEQ ID NO: 2175419 - protein, 17 aa, Cryptosporidium hominis
KSIFEICKDTKQVENRS

SEQ ID NO: 2175420 - protein, 23 aa, Cryptosporidium hominis
KSIFRRGECYMMLGRFEEAKKDF

SEQ ID NO: 2175421 - protein, 20 aa, Cryptosporidium hominis
KSIFWNCVETIAVNNAGIIK

SEQ ID NO: 2175422 - protein, 20 aa, Cryptosporidium hominis
KSIFWNSLVSTIRCMEIIKY

SEQ ID NO: 2175423 - protein, 17 aa, Cryptosporidium hominis
KSIFYYKQVLDIRKEDR

SEQ ID NO: 2175424 - protein, 27 aa, Cryptosporidium hominis
KSIKMSDLRPLIWVCDLHHRVEELISY

SEQ ID NO: 2175425 - protein, 27 aa, Cryptosporidium hominis
KSILEYLDLFPCFVLAIFKSLVLLDQV

SEQ ID NO: 2175426 - protein, 28 aa, Cryptosporidium hominis
KSINISKTILCRYIWSFFIPTWNRIFIT

SEQ ID NO: 2175427 - protein, 18 aa, Cryptosporidium hominis
KSIPYFVVLEICKESFKE

SEQ ID NO: 2175428 - protein, 24 aa, Cryptosporidium hominis
KSIRCYKKKLRVHIFNTYESQKPT

SEQ ID NO: 2175429 - protein, 17 aa, Cryptosporidium hominis
KSIVESILLPLSTTSCG

SEQ ID NO: 2175430 - protein, 18 aa, Cryptosporidium hominis
KSIVFRPSEYFDYNLRHF

SEQ ID NO: 2175431 - protein, 27 aa, Cryptosporidium hominis
KSIVFSGLCSRCLVQVSYGIGIARPLS

SEQ ID NO: 2175432 - protein, 17 aa, Cryptosporidium hominis
KSIYDICLLLSRLISKY

SEQ ID NO: 2175433 - protein, 19 aa, Cryptosporidium hominis
KSKCKQVDLAVSRQVEIEI

SEQ ID NO: 2175434 - protein, 32 aa, Cryptosporidium hominis
KSKFELLRRVLREMPHLIGFEDRLHFYYHYIA

SEQ ID NO: 2175435 - protein, 23 aa, Cryptosporidium hominis
KSKIKSIECFLVLTNFMDEQASV

SEQ ID NO: 2175436 - protein, 23 aa, Cryptosporidium hominis
KSKKLASQVIRDYLNKEFCSYDD

SEQ ID NO: 2175437 - protein, 25 aa, Cryptosporidium hominis
KSKLNFCTWPSPQLSTAVVEPYNAV

SEQ ID NO: 2175438 - protein, 31 aa, Cryptosporidium hominis
KSKNILCKAFWKILRSYEISASISLIESKTN

SEQ ID NO: 2175439 - protein, 17 aa, Cryptosporidium hominis
KSKRCKAKNTQSMEHVL

SEQ ID NO: 2175440 - protein, 18 aa, Cryptosporidium hominis
KSKSCPFKGIGKDSQGKS

SEQ ID NO: 2175441 - protein, 19 aa, Cryptosporidium hominis
KSKSGSNCRQHFITEKEED

SEQ ID NO: 2175442 - protein, 24 aa, Cryptosporidium hominis
KSKSLNKRGKLVIETHEHESFNKR

SEQ ID NO: 2175443 - protein, 20 aa, Cryptosporidium hominis
KSKTLELLQVTDIIKNVHKE

SEQ ID NO: 2175444 - protein, 20 aa, Cryptosporidium hominis
KSKVNRCCRICLSDDADGFT

SEQ ID NO: 2175445 - protein, 24 aa, Cryptosporidium hominis
KSLANMLATIDWDKFNYPVRNSEA

SEQ ID NO: 2175446 - protein, 19 aa, Cryptosporidium hominis
KSLCVEVKLVKWRENTWCP

SEQ ID NO: 2175447 - protein, 26 aa, Cryptosporidium hominis
KSLDLWNLGCLIYWSYQVSSNLNPSD

SEQ ID NO: 2175448 - protein, 17 aa, Cryptosporidium hominis
KSLEISEKFYSKCGNLS

SEQ ID NO: 2175449 - protein, 17 aa, Cryptosporidium hominis
KSLFFFTPHKYRKSVGI

SEQ ID NO: 2175450 - protein, 22 aa, Cryptosporidium hominis
KSLFPSFILSMFDMITKYSHFF

SEQ ID NO: 2175451 - protein, 20 aa, Cryptosporidium hominis
KSLFPYLHLMCKEFHSELSS

SEQ ID NO: 2175452 - protein, 17 aa, Cryptosporidium hominis
KSLIHPCILKVYDTLEV

SEQ ID NO: 2175453 - protein, 23 aa, Cryptosporidium hominis
KSLKIGQKVTGYISRICIQSTQK

SEQ ID NO: 2175454 - protein, 17 aa, Cryptosporidium hominis
KSLKTLSNALAFDQFDA

SEQ ID NO: 2175455 - protein, 17 aa, Cryptosporidium hominis
KSLKYAKILLGIHLIQK

SEQ ID NO: 2175456 - protein, 17 aa, Cryptosporidium hominis
KSLLNKITVEKFTVIAE

SEQ ID NO: 2175457 - protein, 24 aa, Cryptosporidium hominis
KSLLPTIYPYLSIQFIAQVENSKV

SEQ ID NO: 2175458 - protein, 19 aa, Cryptosporidium hominis
KSLNSPISYIPITKSPTSF

SEQ ID NO: 2175459 - protein, 22 aa, Cryptosporidium hominis
KSLPLAKAISVSGCGNYVVVGY

SEQ ID NO: 2175460 - protein, 25 aa, Cryptosporidium hominis
KSLPRFIRREILSLDVDSAFSAIET

SEQ ID NO: 2175461 - protein, 18 aa, Cryptosporidium hominis
KSLRVRAGDFANIHVSKH

SEQ ID NO: 2175462 - protein, 20 aa, Cryptosporidium hominis
KSLSNFLTKKGWILKMEAVT

SEQ ID NO: 2175463 - protein, 21 aa, Cryptosporidium hominis
KSLVVQLSISYSCIRKSKIPL

SEQ ID NO: 2175464 - protein, 20 aa, Cryptosporidium hominis
KSLWNKCPKYFVTTPSSVSL

SEQ ID NO: 2175465 - protein, 18 aa, Cryptosporidium hominis
KSMFSNQVYLEYEDHLDN

SEQ ID NO: 2175466 - protein, 19 aa, Cryptosporidium hominis
KSMKEQIRLFKTVKKDELD

SEQ ID NO: 2175467 - protein, 19 aa, Cryptosporidium hominis
KSMKIWKIDHELRITNIGS

SEQ ID NO: 2175468 - protein, 20 aa, Cryptosporidium hominis
KSMLDKGWDFSKLYQKPIVF

SEQ ID NO: 2175469 - protein, 25 aa, Cryptosporidium hominis
KSMLEKRIGPVFSRNINGEKSDGTY

SEQ ID NO: 2175470 - protein, 19 aa, Cryptosporidium hominis
KSNGLNIDIEWYKTQQLLP

SEQ ID NO: 2175471 - protein, 23 aa, Cryptosporidium hominis
KSNKLEVCTVIGLVYPKEIIDML

SEQ ID NO: 2175472 - protein, 18 aa, Cryptosporidium hominis
KSNLRGCEGLIERIQCMT

SEQ ID NO: 2175473 - protein, 23 aa, Cryptosporidium hominis
KSNNILPCIIEYTELNKLGDKKE

SEQ ID NO: 2175474 - protein, 20 aa, Cryptosporidium hominis
KSNNVCSISKTMNVCKSNVV

SEQ ID NO: 2175475 - protein, 24 aa, Cryptosporidium hominis
KSNPRYLVSHIKESVEITAIENFF

SEQ ID NO: 2175476 - protein, 19 aa, Cryptosporidium hominis
KSNSLEEISTYLGVKTDKI

SEQ ID NO: 2175477 - protein, 19 aa, Cryptosporidium hominis
KSNYWAFVSVRIPSETIDP

SEQ ID NO: 2175478 - protein, 21 aa, Cryptosporidium hominis
KSPDLVIHPSILKGLSELGFL

SEQ ID NO: 2175479 - protein, 25 aa, Cryptosporidium hominis
KSPNSGGIGSVFCCAPEKSGIMTPE

SEQ ID NO: 2175480 - protein, 30 aa, Cryptosporidium hominis
KSPRLFACGYPGCHASFKRRSHLERHAQTH

SEQ ID NO: 2175481 - protein, 21 aa, Cryptosporidium hominis
KSPRLKTKRVNTTKEIEIVTK

SEQ ID NO: 2175482 - protein, 18 aa, Cryptosporidium hominis
KSPTCIFPSMVGQYRSRY

SEQ ID NO: 2175483 - protein, 28 aa, Cryptosporidium hominis
KSPWMRPPGEWLRLCDNCLLPFHDVSGC

SEQ ID NO: 2175484 - protein, 32 aa, Cryptosporidium hominis
KSPYGPGPLEFKGKDGWLIEPQEWIEFAKMAL

SEQ ID NO: 2175485 - protein, 25 aa, Cryptosporidium hominis
KSQEKIKFECCFTDHIFSKMEKLPK

SEQ ID NO: 2175486 - protein, 20 aa, Cryptosporidium hominis
KSQILRFVNEFSTRTVYTSG

SEQ ID NO: 2175487 - protein, 21 aa, Cryptosporidium hominis
KSQILYFMNFVYELLLRAFEI

SEQ ID NO: 2175488 - protein, 25 aa, Cryptosporidium hominis
KSQTECIRLLVAFILNSLSMNELKC

SEQ ID NO: 2175489 - protein, 18 aa, Cryptosporidium hominis
KSRCEWMGGTMGNPNWLL

SEQ ID NO: 2175490 - protein, 18 aa, Cryptosporidium hominis
KSRDINCGEISKGSVPGS

SEQ ID NO: 2175491 - protein, 19 aa, Cryptosporidium hominis
KSRELWEKISREKARLEEY

SEQ ID NO: 2175492 - protein, 19 aa, Cryptosporidium hominis
KSREYRKTKALIDNIKNDY

SEQ ID NO: 2175493 - protein, 24 aa, Cryptosporidium hominis
KSRGPESPIFKFVPLMQYWRHYWF

SEQ ID NO: 2175494 - protein, 20 aa, Cryptosporidium hominis
KSRIRISQVLIFPQYQGKGL

SEQ ID NO: 2175495 - protein, 24 aa, Cryptosporidium hominis
KSRMKDLPASEQFLYGSHYSTPGY

SEQ ID NO: 2175496 - protein, 18 aa, Cryptosporidium hominis
KSRSEAVSLEASRGICDI

SEQ ID NO: 2175497 - protein, 20 aa, Cryptosporidium hominis
KSRTCYLKLVPSVIEIFKIV

SEQ ID NO: 2175498 - protein, 18 aa, Cryptosporidium hominis
KSSAFKFTGAVVSGSQQF

SEQ ID NO: 2175499 - protein, 17 aa, Cryptosporidium hominis
KSSASSSSFIVGGVNML

SEQ ID NO: 2175500 - protein, 24 aa, Cryptosporidium hominis
KSSEIKLKLLDTLSINKSSIDCVS

SEQ ID NO: 2175501 - protein, 24 aa, Cryptosporidium hominis
KSSFELLLNMNIRRTFSLDHNSPD

SEQ ID NO: 2175502 - protein, 26 aa, Cryptosporidium hominis
KSSIDCVSWPVILDLLLTKMNESSMN

SEQ ID NO: 2175503 - protein, 26 aa, Cryptosporidium hominis
KSSLDFLPLDILESEFSQFYEIPLNI

SEQ ID NO: 2175504 - protein, 17 aa, Cryptosporidium hominis
KSSLSGNNYSSFSDDLD

SEQ ID NO: 2175505 - protein, 19 aa, Cryptosporidium hominis
KSSLVSFQINSLIGSAENK

SEQ ID NO: 2175506 - protein, 21 aa, Cryptosporidium hominis
KSSNEILPWSKGIISIDGLAS

SEQ ID NO: 2175507 - protein, 20 aa, Cryptosporidium hominis
KSSNLLAFICRNIMTNWLPL

SEQ ID NO: 2175508 - protein, 19 aa, Cryptosporidium hominis
KSSSISETFLNGPANLSLF

SEQ ID NO: 2175509 - protein, 19 aa, Cryptosporidium hominis
KSSSTLNLTLAWTKAFIYL

SEQ ID NO: 2175510 - protein, 18 aa, Cryptosporidium hominis
KSSVVPAKKVITFISNAF

SEQ ID NO: 2175511 - protein, 20 aa, Cryptosporidium hominis
KSTSCDRELYALASTHKISF

SEQ ID NO: 2175512 - protein, 19 aa, Cryptosporidium hominis
KSVCEKLRNNAKNTELNFS

SEQ ID NO: 2175513 - protein, 17 aa, Cryptosporidium hominis
KSVGKTLEEAVCTENSN

SEQ ID NO: 2175514 - protein, 18 aa, Cryptosporidium hominis
KSVHFEGFGTFYMPPPTR

SEQ ID NO: 2175515 - protein, 22 aa, Cryptosporidium hominis
KSVKATEYFYVIQKCIKILLEK

SEQ ID NO: 2175516 - protein, 21 aa, Cryptosporidium hominis
KSVKISALAFWEFSDKKKELF

SEQ ID NO: 2175517 - protein, 19 aa, Cryptosporidium hominis
KSVTTKFTEVFPRSKTRST

SEQ ID NO: 2175518 - protein, 24 aa, Cryptosporidium hominis
KSVVNKIVISWSFIDNKNVEISDF

SEQ ID NO: 2175519 - protein, 21 aa, Cryptosporidium hominis
KSWKDDPYYLGSIPIHSSNSK

SEQ ID NO: 2175520 - protein, 19 aa, Cryptosporidium hominis
KSWTHSLITHSSRQNCQGR

SEQ ID NO: 2175521 - protein, 20 aa, Cryptosporidium hominis
KSYFCLYFAKGACVNGSKCK

SEQ ID NO: 2175522 - protein, 20 aa, Cryptosporidium hominis
KSYFLRQKMLLLTTGILEYI

SEQ ID NO: 2175523 - protein, 21 aa, Cryptosporidium hominis
KSYRCICYISTPIYIHEYHEI

SEQ ID NO: 2175524 - protein, 25 aa, Cryptosporidium hominis
KSYRFAISGQGAWKYLDVLPDKGGK

SEQ ID NO: 2175525 - protein, 21 aa, Cryptosporidium hominis
KSYYWILIIVWYRIMHDYSRM

SEQ ID NO: 2175526 - protein, 19 aa, Cryptosporidium hominis
KTAAFLFPIVMKMLNDGPP

SEQ ID NO: 2175527 - protein, 20 aa, Cryptosporidium hominis
KTAETFLRLVRNLQQENMLP

SEQ ID NO: 2175528 - protein, 20 aa, Cryptosporidium hominis
KTALKKNLLLIGSHRANALE

SEQ ID NO: 2175529 - protein, 24 aa, Cryptosporidium hominis
KTAQTCVWLQYLFDSGKLVKPVII

SEQ ID NO: 2175530 - protein, 23 aa, Cryptosporidium hominis
KTASNCLSRILLSYPKLFEKNLL

SEQ ID NO: 2175531 - protein, 19 aa, Cryptosporidium hominis
KTDEKRLANNISNREEEEE

SEQ ID NO: 2175532 - protein, 17 aa, Cryptosporidium hominis
KTDPYLFWADIYEISGL

SEQ ID NO: 2175533 - protein, 17 aa, Cryptosporidium hominis
KTDRFALVSSLENQHLL

SEQ ID NO: 2175534 - protein, 24 aa, Cryptosporidium hominis
KTDSKLLSLCWMNEHTIYTGGSTG

SEQ ID NO: 2175535 - protein, 28 aa, Cryptosporidium hominis
KTESSFLRKYWWLIAIGFITYSVLTTDQ

SEQ ID NO: 2175536 - protein, 19 aa, Cryptosporidium hominis
KTFHQARMSLLALILEKQE

SEQ ID NO: 2175537 - protein, 18 aa, Cryptosporidium hominis
KTFLKYKIFDNAIKIIWL

SEQ ID NO: 2175538 - protein, 18 aa, Cryptosporidium hominis
KTFLLYSIVGYIFEEYIT

SEQ ID NO: 2175539 - protein, 17 aa, Cryptosporidium hominis
KTFQFIRNYLELHLNRL

SEQ ID NO: 2175540 - protein, 24 aa, Cryptosporidium hominis
KTFTDCFNCLPVAAIIDEKILCMH

SEQ ID NO: 2175541 - protein, 19 aa, Cryptosporidium hominis
KTFVKFEICEPINKGQEVY

SEQ ID NO: 2175542 - protein, 20 aa, Cryptosporidium hominis
KTGEARVGLIGFPSVGKSTL

SEQ ID NO: 2175543 - protein, 26 aa, Cryptosporidium hominis
KTGELYALKCVRVFTKNHDHSNAHKD

SEQ ID NO: 2175544 - protein, 18 aa, Cryptosporidium hominis
KTGKRVGQYISRKNEISG

SEQ ID NO: 2175545 - protein, 18 aa, Cryptosporidium hominis
KTIFKVLFSLEFRESPQS

SEQ ID NO: 2175546 - protein, 20 aa, Cryptosporidium hominis
KTIIRNCIDLKKAIESDPEI

SEQ ID NO: 2175547 - protein, 17 aa, Cryptosporidium hominis
KTIKDCIDFYYKYKYTL

SEQ ID NO: 2175548 - protein, 23 aa, Cryptosporidium hominis
KTIRISDFGSMHFTTDASPACYL

SEQ ID NO: 2175549 - protein, 18 aa, Cryptosporidium hominis
KTIWNVLAILCSKLDEGE

SEQ ID NO: 2175550 - protein, 25 aa, Cryptosporidium hominis
KTKCSCTSFLWKGVNMDLGTSDEGM

SEQ ID NO: 2175551 - protein, 26 aa, Cryptosporidium hominis
KTKEFLRRVFDPVFGFPNIVRFSWST

SEQ ID NO: 2175552 - protein, 17 aa, Cryptosporidium hominis
KTKIKLIEWCERKSGSI

SEQ ID NO: 2175553 - protein, 24 aa, Cryptosporidium hominis
KTKNWLKCDWNRWIDTDEEENPSS

SEQ ID NO: 2175554 - protein, 18 aa, Cryptosporidium hominis
KTKYILEVNNSLKGNHGK

SEQ ID NO: 2175555 - protein, 18 aa, Cryptosporidium hominis
KTLAFLIPAANLLYNVEF

SEQ ID NO: 2175556 - protein, 17 aa, Cryptosporidium hominis
KTLELFQFSILKTNDTT

SEQ ID NO: 2175557 - protein, 20 aa, Cryptosporidium hominis
KTLFCGWSSPLWSQADSGKR

SEQ ID NO: 2175558 - protein, 17 aa, Cryptosporidium hominis
KTLICSRKVVFIQTLYL

SEQ ID NO: 2175559 - protein, 33 aa, Cryptosporidium hominis
KTLIFKSRRKSGVSMRLRYSRMITKIGSKRTRT

SEQ ID NO: 2175560 - protein, 20 aa, Cryptosporidium hominis
KTLNFAHNWTKSDNESAALI

SEQ ID NO: 2175561 - protein, 21 aa, Cryptosporidium hominis
KTLNVNLFFSHEIEKVIKECD

SEQ ID NO: 2175562 - protein, 25 aa, Cryptosporidium hominis
KTLQEFKWNHEIVYYSFQTIHKYLS

SEQ ID NO: 2175563 - protein, 19 aa, Cryptosporidium hominis
KTLSNALAFDQFDADLQSR

SEQ ID NO: 2175564 - protein, 29 aa, Cryptosporidium hominis
KTLSPNGVFWLARRLFRKPVNTLLPGTYL

SEQ ID NO: 2175565 - protein, 23 aa, Cryptosporidium hominis
KTNGEIVFSLVFPKSKSYYDRRV

SEQ ID NO: 2175566 - protein, 22 aa, Cryptosporidium hominis
KTNILIRWIIHISKQLLHPIMN

SEQ ID NO: 2175567 - protein, 25 aa, Cryptosporidium hominis
KTNREIIKRLGILNGSNNFEVNDDM

SEQ ID NO: 2175568 - protein, 22 aa, Cryptosporidium hominis
KTNSRLQVIGWYSTCSGINSVS

SEQ ID NO: 2175569 - protein, 31 aa, Cryptosporidium hominis
KTPCFLLAVKCSIDLTLPIYVYKRNLESNYC

SEQ ID NO: 2175570 - protein, 19 aa, Cryptosporidium hominis
KTPELRIIGNVVIHPTSSI

SEQ ID NO: 2175571 - protein, 17 aa, Cryptosporidium hominis
KTPEPMKGMQIQETISL

SEQ ID NO: 2175572 - protein, 18 aa, Cryptosporidium hominis
KTPFRRSIPFMGSSQDSV

SEQ ID NO: 2175573 - protein, 19 aa, Cryptosporidium hominis
KTPVFIKELMIRSEDGKTL

SEQ ID NO: 2175574 - protein, 23 aa, Cryptosporidium hominis
KTQSLNCIYCYKEILQSLKEKYD

SEQ ID NO: 2175575 - protein, 17 aa, Cryptosporidium hominis
KTQVFIGCLFEHIESQA

SEQ ID NO: 2175576 - protein, 25 aa, Cryptosporidium hominis
KTQVKELFDRVSLSTASYGRRDKAL

SEQ ID NO: 2175577 - protein, 19 aa, Cryptosporidium hominis
KTRECLEIIYNDLNQDLLV

SEQ ID NO: 2175578 - protein, 26 aa, Cryptosporidium hominis
KTSCPIMIKLLREWILNANRGEFDHI

SEQ ID NO: 2175579 - protein, 18 aa, Cryptosporidium hominis
KTSILQAIPVRKAQNHSR

SEQ ID NO: 2175580 - protein, 26 aa, Cryptosporidium hominis
KTSLKEAVILPAKFPELFQGKLKPWK

SEQ ID NO: 2175581 - protein, 18 aa, Cryptosporidium hominis
KTSLPIIFIRYIQYTLCL

SEQ ID NO: 2175582 - protein, 32 aa, Cryptosporidium hominis
KTSNSDGFCSFGKIYLGYNIHKILLSIIDLYD

SEQ ID NO: 2175583 - protein, 23 aa, Cryptosporidium hominis
KTSRYTFYMPVFFGLTLSEIQVS

SEQ ID NO: 2175584 - protein, 17 aa, Cryptosporidium hominis
KTTFWKPVLHMIPQKMF

SEQ ID NO: 2175585 - protein, 19 aa, Cryptosporidium hominis
KTTILRCLCNNNIKILEWD

SEQ ID NO: 2175586 - protein, 36 aa, Cryptosporidium hominis
KTVGSPQWGPYCSTYPKGYFAFWLTYDEDNDLYEIS

SEQ ID NO: 2175587 - protein, 27 aa, Cryptosporidium hominis
KTVVSKPGWGAVRWADLSISDASNSWI

SEQ ID NO: 2175588 - protein, 19 aa, Cryptosporidium hominis
KTWYCPGCTRDEEYRALWS

SEQ ID NO: 2175589 - protein, 22 aa, Cryptosporidium hominis
KTYILPCLYPGIYSTNIPCLAP

SEQ ID NO: 2175590 - protein, 40 aa, Cryptosporidium hominis
KTYTTPRTLLGILRLSQALARLRFSNIVERADFEEATRLM

SEQ ID NO: 2175591 - protein, 24 aa, Cryptosporidium hominis
KVADFVLLSGFGFSAAVPVDTHIL

SEQ ID NO: 2175592 - protein, 26 aa, Cryptosporidium hominis
KVALGRACGVSRPVIAAAITSKDGSS

SEQ ID NO: 2175593 - protein, 20 aa, Cryptosporidium hominis
KVCEMFKLSFLKSLLLTNIG

SEQ ID NO: 2175594 - protein, 19 aa, Cryptosporidium hominis
KVCTFRGNYSYQVTPSGLF

SEQ ID NO: 2175595 - protein, 18 aa, Cryptosporidium hominis
KVDETWGIAKKQFNKLVS

SEQ ID NO: 2175596 - protein, 21 aa, Cryptosporidium hominis
KVDLILCCGDMQTIRDESDLQ

SEQ ID NO: 2175597 - protein, 17 aa, Cryptosporidium hominis
KVDLLLGSNERWDPNIP

SEQ ID NO: 2175598 - protein, 19 aa, Cryptosporidium hominis
KVDLNRISSQLAISEELQN

SEQ ID NO: 2175599 - protein, 19 aa, Cryptosporidium hominis
KVDSIFRNEIYKILDNTRL

SEQ ID NO: 2175600 - protein, 22 aa, Cryptosporidium hominis
KVDSSLLAFGIRSDKPRNLNYD

SEQ ID NO: 2175601 - protein, 21 aa, Cryptosporidium hominis
KVDSWSVGILIYELYMGNVPF

SEQ ID NO: 2175602 - protein, 35 aa, Cryptosporidium hominis
KVDVWSMGCIFLEILCKRTPLQHVLDKVDESGKHS

SEQ ID NO: 2175603 - protein, 26 aa, Cryptosporidium hominis
KVEDLYKILLCFIYTDFLIWDPFSDS

SEQ ID NO: 2175604 - protein, 17 aa, Cryptosporidium hominis
KVEELGWELDQLKSGKS

SEQ ID NO: 2175605 - protein, 21 aa, Cryptosporidium hominis
KVELPLAITNGFDYQKEFKKV

SEQ ID NO: 2175606 - protein, 23 aa, Cryptosporidium hominis
KVFDWARKSNKGMLLFIDEAEAF

SEQ ID NO: 2175607 - protein, 23 aa, Cryptosporidium hominis
KVFIDKEVVDWSQYTTMDSTQED

SEQ ID NO: 2175608 - protein, 28 aa, Cryptosporidium hominis
KVFNPDIHFKPTLGYAVVPVELNLNQET

SEQ ID NO: 2175609 - protein, 20 aa, Cryptosporidium hominis
KVFPTNTWHKGRYCPSTSKF

SEQ ID NO: 2175610 - protein, 19 aa, Cryptosporidium hominis
KVGESLCIVELFKELESKI

SEQ ID NO: 2175611 - protein, 18 aa, Cryptosporidium hominis
KVGFSKNNFSLWKKQEDL

SEQ ID NO: 2175612 - protein, 29 aa, Cryptosporidium hominis
KVGHSNIFCPYPFRFGDSSEYGTMIVASS

SEQ ID NO: 2175613 - protein, 19 aa, Cryptosporidium hominis
KVGKMTWDGKIVKACTDKG

SEQ ID NO: 2175614 - protein, 30 aa, Cryptosporidium hominis
KVGSELILYKRSWDWLARTRLDEACRKKIG

SEQ ID NO: 2175615 - protein, 24 aa, Cryptosporidium hominis
KVHNWKVKWGPRIIVHKNKSISEL

SEQ ID NO: 2175616 - protein, 17 aa, Cryptosporidium hominis
KVIKRLPPDIILKQNIE

SEQ ID NO: 2175617 - protein, 17 aa, Cryptosporidium hominis
KVILAYLELCGFEQVMI

SEQ ID NO: 2175618 - protein, 18 aa, Cryptosporidium hominis
KVINPESKIDEKDSEKET

SEQ ID NO: 2175619 - protein, 29 aa, Cryptosporidium hominis
KVIRILRRLLKGASIININCNIHKEILQG

SEQ ID NO: 2175620 - protein, 21 aa, Cryptosporidium hominis
KVIRKEACWTVSNITAGNKEQ

SEQ ID NO: 2175621 - protein, 24 aa, Cryptosporidium hominis
KVIRPEQWHPWKSFGKLMDEAILE

SEQ ID NO: 2175622 - protein, 17 aa, Cryptosporidium hominis
KVKATLRQFVRDWSEHG

SEQ ID NO: 2175623 - protein, 22 aa, Cryptosporidium hominis
KVKLEIVTKMLLDLNKQISEAR

SEQ ID NO: 2175624 - protein, 24 aa, Cryptosporidium hominis
KVKLWDISSGYNFATFSDHIAPVS

SEQ ID NO: 2175625 - protein, 29 aa, Cryptosporidium hominis
KVKQRSALFKALILYSLKNKEYMNGESAK

SEQ ID NO: 2175626 - protein, 19 aa, Cryptosporidium hominis
KVLESINLKLMKSVHLTKD

SEQ ID NO: 2175627 - protein, 49 aa, Cryptosporidium hominis
KVLKKRRKKVSINRHIKNPLDAYSLLNSHEFYKSITLDYLNKNLRNLML

SEQ ID NO: 2175628 - protein, 17 aa, Cryptosporidium hominis
KVLLDRFLHSFNLMELQ

SEQ ID NO: 2175629 - protein, 17 aa, Cryptosporidium hominis
KVLPLKTPNIISNDSET

SEQ ID NO: 2175630 - protein, 24 aa, Cryptosporidium hominis
KVLRKVPVSGVYELSGSRIPSISS

SEQ ID NO: 2175631 - protein, 17 aa, Cryptosporidium hominis
KVMHLCRQKELNISQLY

SEQ ID NO: 2175632 - protein, 17 aa, Cryptosporidium hominis
KVMQWEKLLLLPHPCRK

SEQ ID NO: 2175633 - protein, 18 aa, Cryptosporidium hominis
KVNLGGFTEADWYKKIPN

SEQ ID NO: 2175634 - protein, 27 aa, Cryptosporidium hominis
KVNSLDWSRCGRFLLTASNDMTVRLIS

SEQ ID NO: 2175635 - protein, 19 aa, Cryptosporidium hominis
KVNVSILWIYIDKASPESF

SEQ ID NO: 2175636 - protein, 18 aa, Cryptosporidium hominis
KVPFPILILHGTNDQVIH

SEQ ID NO: 2175637 - protein, 27 aa, Cryptosporidium hominis
KVPKLDKEFNCPFCNNVKTVGVRMNHK

SEQ ID NO: 2175638 - protein, 24 aa, Cryptosporidium hominis
KVPREKCSYLLFILTPSENSKDLT

SEQ ID NO: 2175639 - protein, 25 aa, Cryptosporidium hominis
KVPTHKIYLAMNFFFPFENKKMASI

SEQ ID NO: 2175640 - protein, 25 aa, Cryptosporidium hominis
KVQEWCSLGIRTLEEVKRYEEEKKR

SEQ ID NO: 2175641 - protein, 18 aa, Cryptosporidium hominis
KVRCPVTIAGDIHGQFFD

SEQ ID NO: 2175642 - protein, 24 aa, Cryptosporidium hominis
KVREELEKALGLPLDSLKPKKNQI

SEQ ID NO: 2175643 - protein, 17 aa, Cryptosporidium hominis
KVSAFKVNNSILIVIVM

SEQ ID NO: 2175644 - protein, 18 aa, Cryptosporidium hominis
KVSALYCYAIALDWNPVL

SEQ ID NO: 2175645 - protein, 37 aa, Cryptosporidium hominis
KVSFGKSRRNTIRWNPSGKWFAYGGFGNLAGDLDIWD

SEQ ID NO: 2175646 - protein, 24 aa, Cryptosporidium hominis
KVSLNFCAKYSYYILLKQSIVNQY

SEQ ID NO: 2175647 - protein, 20 aa, Cryptosporidium hominis
KVVDECRKSLNLIVVNPGMV

SEQ ID NO: 2175648 - protein, 18 aa, Cryptosporidium hominis
KVVECFSSKSILEIIQHL

SEQ ID NO: 2175649 - protein, 22 aa, Cryptosporidium hominis
KVVIPKLNFAFKGGDKSLEDRS

SEQ ID NO: 2175650 - protein, 25 aa, Cryptosporidium hominis
KVVKKLCKKYDLFLASQVLLPQIPR

SEQ ID NO: 2175651 - protein, 17 aa, Cryptosporidium hominis
KVVRLITDIARLEFEYG

SEQ ID NO: 2175652 - protein, 19 aa, Cryptosporidium hominis
KVVRVTLNLLKNVMNNDAA

SEQ ID NO: 2175653 - protein, 21 aa, Cryptosporidium hominis
KVYFDGDCVNMEMEIKEIGIE

SEQ ID NO: 2175654 - protein, 19 aa, Cryptosporidium hominis
KWERSYISACRDLRIVKAV

SEQ ID NO: 2175655 - protein, 21 aa, Cryptosporidium hominis
KWFMKLHEKPFWEVFPLSQIV

SEQ ID NO: 2175656 - protein, 17 aa, Cryptosporidium hominis
KWGHPERPLSDLGRAIY

SEQ ID NO: 2175657 - protein, 19 aa, Cryptosporidium hominis
KWHDLKDHMRQAGNVIRAD

SEQ ID NO: 2175658 - protein, 18 aa, Cryptosporidium hominis
KWILNLIKPLGYNRDIQG

SEQ ID NO: 2175659 - protein, 19 aa, Cryptosporidium hominis
KWINKIKGVMIGREVMNNP

SEQ ID NO: 2175660 - protein, 21 aa, Cryptosporidium hominis
KWISQKRFGIVTSSFLTKLMH

SEQ ID NO: 2175661 - protein, 20 aa, Cryptosporidium hominis
KWKCSNCGEFSNEINNCCNE

SEQ ID NO: 2175662 - protein, 21 aa, Cryptosporidium hominis
KWLPSSFCYPHSSSIGSVATV

SEQ ID NO: 2175663 - protein, 23 aa, Cryptosporidium hominis
KWLSCPYDQCTWESYETLEEHKF

SEQ ID NO: 2175664 - protein, 18 aa, Cryptosporidium hominis
KWLSEVIVNVVFSINGCI

SEQ ID NO: 2175665 - protein, 19 aa, Cryptosporidium hominis
KWNHSRFHWADLTSVHPLL

SEQ ID NO: 2175666 - protein, 32 aa, Cryptosporidium hominis
KWTSPLIPYIIKDFSCPNCFEIEDFDFTGNAI

SEQ ID NO: 2175667 - protein, 18 aa, Cryptosporidium hominis
KWVNLDFEIDFNLRPALD

SEQ ID NO: 2175668 - protein, 20 aa, Cryptosporidium hominis
KWVYDVVLDFTIIKPTSKRN

SEQ ID NO: 2175669 - protein, 21 aa, Cryptosporidium hominis
KWYLESFHSVHLIPQKEFFSL

SEQ ID NO: 2175670 - protein, 19 aa, Cryptosporidium hominis
KWYYPIRIILFHGKGESER

SEQ ID NO: 2175671 - protein, 26 aa, Cryptosporidium hominis
KYADIPERLYLLYGSRWKSLKERKIS

SEQ ID NO: 2175672 - protein, 17 aa, Cryptosporidium hominis
KYAEIYNGVAYREVLED

SEQ ID NO: 2175673 - protein, 18 aa, Cryptosporidium hominis
KYAFDLPQWRTISDDAKD

SEQ ID NO: 2175674 - protein, 19 aa, Cryptosporidium hominis
KYAVCSSSNVRLYPALSEQ

SEQ ID NO: 2175675 - protein, 23 aa, Cryptosporidium hominis
KYDKQCDMWSLGVILYILLCGYP

SEQ ID NO: 2175676 - protein, 18 aa, Cryptosporidium hominis
KYDNIVRFSIPMPTNHKK

SEQ ID NO: 2175677 - protein, 17 aa, Cryptosporidium hominis
KYDWKSSEVELLNEHQF

SEQ ID NO: 2175678 - protein, 18 aa, Cryptosporidium hominis
KYDWKYLEEQFRSIRQDL

SEQ ID NO: 2175679 - protein, 17 aa, Cryptosporidium hominis
KYEEIELIIKEKDQVIE

SEQ ID NO: 2175680 - protein, 17 aa, Cryptosporidium hominis
KYGCDLGYSPMYHSGLF

SEQ ID NO: 2175681 - protein, 18 aa, Cryptosporidium hominis
KYGFITFNNLGDMMKVLQ

SEQ ID NO: 2175682 - protein, 19 aa, Cryptosporidium hominis
KYGQEIAVAEAFPRTINNS

SEQ ID NO: 2175683 - protein, 18 aa, Cryptosporidium hominis
KYGSFRYNILISTPGDIL

SEQ ID NO: 2175684 - protein, 20 aa, Cryptosporidium hominis
KYHRIIKSGIKFAEYSLELS

SEQ ID NO: 2175685 - protein, 20 aa, Cryptosporidium hominis
KYIERCSPIKPISLNCIISK

SEQ ID NO: 2175686 - protein, 19 aa, Cryptosporidium hominis
KYIHSAGIYHRDLKPANCL

SEQ ID NO: 2175687 - protein, 18 aa, Cryptosporidium hominis
KYIIYALIFHKGKTTNSG

SEQ ID NO: 2175688 - protein, 17 aa, Cryptosporidium hominis
KYIKPGILNSALANCIE

SEQ ID NO: 2175689 - protein, 17 aa, Cryptosporidium hominis
KYIYDDVDFSWKVKSIG

SEQ ID NO: 2175690 - protein, 20 aa, Cryptosporidium hominis
KYKAQYGCFNNFETMESSLD

SEQ ID NO: 2175691 - protein, 19 aa, Cryptosporidium hominis
KYKNGLPINSVRNLMYTLL

SEQ ID NO: 2175692 - protein, 24 aa, Cryptosporidium hominis
KYKSGKLPKAFSIIPKLENWEEVV

SEQ ID NO: 2175693 - protein, 20 aa, Cryptosporidium hominis
KYKYLIFKERYHNGNYYDKY

SEQ ID NO: 2175694 - protein, 18 aa, Cryptosporidium hominis
KYLALRYSRNNVKKLKTL

SEQ ID NO: 2175695 - protein, 30 aa, Cryptosporidium hominis
KYLDKSYMLQRRWKVVIWDLSIENLCDEEA

SEQ ID NO: 2175696 - protein, 23 aa, Cryptosporidium hominis
KYLECSGALEMLYRSFLSLYISI

SEQ ID NO: 2175697 - protein, 22 aa, Cryptosporidium hominis
KYLEQIRDLYSYDFHVAYIPTL

SEQ ID NO: 2175698 - protein, 25 aa, Cryptosporidium hominis
KYLEYRFNHIIGHGISIGDNNYSSN

SEQ ID NO: 2175699 - protein, 33 aa, Cryptosporidium hominis
KYLIKRFIQNNVRFFFTRNIHCHAKYITIDGIW

SEQ ID NO: 2175700 - protein, 24 aa, Cryptosporidium hominis
KYLKQDRFRICRSLPSSMNNQQLQ

SEQ ID NO: 2175701 - protein, 19 aa, Cryptosporidium hominis
KYLPEDRILSCGSKENFWE

SEQ ID NO: 2175702 - protein, 29 aa, Cryptosporidium hominis
KYLRESLHWEWPAGLLPASRGVRSRKYRN

SEQ ID NO: 2175703 - protein, 23 aa, Cryptosporidium hominis
KYLRIPIPMLIEQHRQLLLPYPE

SEQ ID NO: 2175704 - protein, 18 aa, Cryptosporidium hominis
KYLSEPFIDRVLKLNGQL

SEQ ID NO: 2175705 - protein, 21 aa, Cryptosporidium hominis
KYMNAGCKINKILNGEKITSE

SEQ ID NO: 2175706 - protein, 24 aa, Cryptosporidium hominis
KYNEIRMIESWVIKLLQRHPSHYG

SEQ ID NO: 2175707 - protein, 26 aa, Cryptosporidium hominis
KYNHVKICPWLAISNFVDEFVLRTPI

SEQ ID NO: 2175708 - protein, 18 aa, Cryptosporidium hominis
KYNLWIVGNSRYLLGNPE

SEQ ID NO: 2175709 - protein, 22 aa, Cryptosporidium hominis
KYNYAVGSFFSFVYSHYDNMVN

SEQ ID NO: 2175710 - protein, 26 aa, Cryptosporidium hominis
KYNYSVKPKHFWKLIEPTVVSPAHGL

SEQ ID NO: 2175711 - protein, 22 aa, Cryptosporidium hominis
KYPPMLHNWFFKKFSTKSSYIW

SEQ ID NO: 2175712 - protein, 20 aa, Cryptosporidium hominis
KYRIRVEMFHSSHLRYKNPD

SEQ ID NO: 2175713 - protein, 25 aa, Cryptosporidium hominis
KYRPLEVVNFNPPIDAIRHGFGENG

SEQ ID NO: 2175714 - protein, 28 aa, Cryptosporidium hominis
KYSDHLPCAVWLPWIPQLIAGIDRIEGS

SEQ ID NO: 2175715 - protein, 18 aa, Cryptosporidium hominis
KYSETYLHRIGRSGRFGH

SEQ ID NO: 2175716 - protein, 19 aa, Cryptosporidium hominis
KYSKEYLKYGYDDLQFEID

SEQ ID NO: 2175717 - protein, 23 aa, Cryptosporidium hominis
KYSLLKEKYLFLVQKNEYLISRL

SEQ ID NO: 2175718 - protein, 19 aa, Cryptosporidium hominis
KYSNIRLKLLVNELELCNR

SEQ ID NO: 2175719 - protein, 21 aa, Cryptosporidium hominis
KYTKSTAVWSMFGYIVGLGDR

SEQ ID NO: 2175720 - protein, 19 aa, Cryptosporidium hominis
KYTREFSEKILTKEKDDFL

SEQ ID NO: 2175721 - protein, 37 aa, Cryptosporidium hominis
KYVKSETLVNLWLTAYFEKRIKKKQLMSINIDESVQE

SEQ ID NO: 2175722 - protein, 18 aa, Cryptosporidium hominis
KYVPIKLTSFLIKRMTRK

SEQ ID NO: 2175723 - protein, 30 aa, Cryptosporidium hominis
KYVPTWEVREVPKLVPKFVGEQKVLYIEIS

SEQ ID NO: 2175724 - protein, 21 aa, Cryptosporidium hominis
KYVVECFRLPIKKESGHISSD

SEQ ID NO: 2175725 - protein, 20 aa, Cryptosporidium hominis
KYWIPDEFLEIKFQENNDDH

SEQ ID NO: 2175726 - protein, 18 aa, Cryptosporidium hominis
KYYEASIEYKNSLFILET

SEQ ID NO: 2175727 - protein, 17 aa, Cryptosporidium hominis
KYYWSSCPKCKRKVTEI

SEQ ID NO: 2175728 - protein, 28 aa, Cryptosporidium hominis
LAAFDFEKELDLLYGILSTCFEFVSEGE

SEQ ID NO: 2175729 - protein, 24 aa, Cryptosporidium hominis
LAATSPAYFPAWLAEEHDIGTNVG

SEQ ID NO: 2175730 - protein, 22 aa, Cryptosporidium hominis
LACADGSIKMFSLLNNELSFSY

SEQ ID NO: 2175731 - protein, 18 aa, Cryptosporidium hominis
LACKEVFNRLGTPEKIIP

SEQ ID NO: 2175732 - protein, 19 aa, Cryptosporidium hominis
LADEGICLIDEFDKMSDKD

SEQ ID NO: 2175733 - protein, 25 aa, Cryptosporidium hominis
LADEPRVCTNICWIIHQIAESSQFV

SEQ ID NO: 2175734 - protein, 18 aa, Cryptosporidium hominis
LADICKGGVTSIKENLEK

SEQ ID NO: 2175735 - protein, 21 aa, Cryptosporidium hominis
LADKVCRRLGLSIREPGKLLA

SEQ ID NO: 2175736 - protein, 23 aa, Cryptosporidium hominis
LAEDPFSVFGLVLVPSRELSYQV

SEQ ID NO: 2175737 - protein, 18 aa, Cryptosporidium hominis
LAEKKAQLAKAVKNPAPI

SEQ ID NO: 2175738 - protein, 17 aa, Cryptosporidium hominis
LAELCQRAAKAAIRDAI

SEQ ID NO: 2175739 - protein, 17 aa, Cryptosporidium hominis
LAENIAMIIEDSQSFFS

SEQ ID NO: 2175740 - protein, 19 aa, Cryptosporidium hominis
LAENIPPNYSELVKETMKV

SEQ ID NO: 2175741 - protein, 24 aa, Cryptosporidium hominis
LAENWPWMLGKSITVPFMNIKYET

SEQ ID NO: 2175742 - protein, 23 aa, Cryptosporidium hominis
LAEWERNEVKNIMPYLIDNTINR

SEQ ID NO: 2175743 - protein, 32 aa, Cryptosporidium hominis
LAFEVARKFVQARFGCKFSMRLYDDLNVIQDK

SEQ ID NO: 2175744 - protein, 20 aa, Cryptosporidium hominis
LAGLSLLFQLNIRILDISKN

SEQ ID NO: 2175745 - protein, 19 aa, Cryptosporidium hominis
LAGTCISLGGLGYDQVQKS

SEQ ID NO: 2175746 - protein, 19 aa, Cryptosporidium hominis
LAGTTGFKRGIFIFTGNDL

SEQ ID NO: 2175747 - protein, 22 aa, Cryptosporidium hominis
LAIESCQFVNYIPIYLVCHCDS

SEQ ID NO: 2175748 - protein, 50 aa, Cryptosporidium hominis
LAILYRKRKLHVLGIIRLIGELFIRKMFPMRSLNELVFDLVMIQENPDEY

SEQ ID NO: 2175749 - protein, 18 aa, Cryptosporidium hominis
LAISEFEYIYNFKIEKEM

SEQ ID NO: 2175750 - protein, 20 aa, Cryptosporidium hominis
LAKSPIWDGGNFKQPPLSVL

SEQ ID NO: 2175751 - protein, 18 aa, Cryptosporidium hominis
LAKTGLWKNINVKWSHNI

SEQ ID NO: 2175752 - protein, 17 aa, Cryptosporidium hominis
LALELLKLLSNKYREEF

SEQ ID NO: 2175753 - protein, 18 aa, Cryptosporidium hominis
LALIKNSFKTSVIQLKKI

SEQ ID NO: 2175754 - protein, 17 aa, Cryptosporidium hominis
LALNADCVVVLDNTALS

SEQ ID NO: 2175755 - protein, 23 aa, Cryptosporidium hominis
LALTRIAQYSALGIRHNDIKPDN

SEQ ID NO: 2175756 - protein, 17 aa, Cryptosporidium hominis
LANTFITSFELEFTAQP

SEQ ID NO: 2175757 - protein, 25 aa, Cryptosporidium hominis
LAPKCYDLRFSRPSKVQIIKRMQEI

SEQ ID NO: 2175758 - protein, 19 aa, Cryptosporidium hominis
LAQCANIVAACKLMSQSEF

SEQ ID NO: 2175759 - protein, 17 aa, Cryptosporidium hominis
LARDALCSLILGTPPGK

SEQ ID NO: 2175760 - protein, 17 aa, Cryptosporidium hominis
LARQIFHSVRMSLQEQA

SEQ ID NO: 2175761 - protein, 23 aa, Cryptosporidium hominis
LASASWDGTVRIWDLYARVGKGA

SEQ ID NO: 2175762 - protein, 23 aa, Cryptosporidium hominis
LASEAAECFRFVLEDLGDSNNDS

SEQ ID NO: 2175763 - protein, 28 aa, Cryptosporidium hominis
LASESEFWHFLSLGAIFLKYSKKNSIAV

SEQ ID NO: 2175764 - protein, 28 aa, Cryptosporidium hominis
LASLRKCFEYQYVCLLARHLEDDEILEL

SEQ ID NO: 2175765 - protein, 17 aa, Cryptosporidium hominis
LASMVMRSDSIVFKNGL

SEQ ID NO: 2175766 - protein, 17 aa, Cryptosporidium hominis
LATAGADEFIHIWEITR

SEQ ID NO: 2175767 - protein, 18 aa, Cryptosporidium hominis
LATCRLMAMNLAYRDTIF

SEQ ID NO: 2175768 - protein, 18 aa, Cryptosporidium hominis
LATIFYLKKLKKLGLSMS

SEQ ID NO: 2175769 - protein, 25 aa, Cryptosporidium hominis
LATQPCIRTPTVDDWYVFDKQLSEI

SEQ ID NO: 2175770 - protein, 20 aa, Cryptosporidium hominis
LAVACFDIGEFARLYPMGKQ

SEQ ID NO: 2175771 - protein, 24 aa, Cryptosporidium hominis
LAVEGYGLLKLMGINGIIGTTTVS

SEQ ID NO: 2175772 - protein, 18 aa, Cryptosporidium hominis
LAYHLRYATKVIIGSCAI

SEQ ID NO: 2175773 - protein, 23 aa, Cryptosporidium hominis
LAYNGSHFKVNWNNYLQIFSELT

SEQ ID NO: 2175774 - protein, 17 aa, Cryptosporidium hominis
LCAPTCHKLPEIKETEE

SEQ ID NO: 2175775 - protein, 23 aa, Cryptosporidium hominis
LCDAKFWGFNSFIFLVSNHTIIA

SEQ ID NO: 2175776 - protein, 29 aa, Cryptosporidium hominis
LCECRKVINCRDCNLFIYDSINNVFYHGF

SEQ ID NO: 2175777 - protein, 18 aa, Cryptosporidium hominis
LCELLDYEQAVFPHLNYS

SEQ ID NO: 2175778 - protein, 20 aa, Cryptosporidium hominis
LCENIKLIILDEADMMTSTA

SEQ ID NO: 2175779 - protein, 19 aa, Cryptosporidium hominis
LCFQLKQVVSASWVKYASR

SEQ ID NO: 2175780 - protein, 25 aa, Cryptosporidium hominis
LCGNGKVVRIEVWFGTPRHQSAINT

SEQ ID NO: 2175781 - protein, 18 aa, Cryptosporidium hominis
LCHCIPFNRFCYNLCNSG

SEQ ID NO: 2175782 - protein, 25 aa, Cryptosporidium hominis
LCHNSGEFIKFWSYENLYCKHSVVE

SEQ ID NO: 2175783 - protein, 27 aa, Cryptosporidium hominis
LCIILKPPFWYCPIEGTGMDEDEQDEE

SEQ ID NO: 2175784 - protein, 32 aa, Cryptosporidium hominis
LCILLEIYWRRMQIRFPIFFGGSMTEKANSYY

SEQ ID NO: 2175785 - protein, 20 aa, Cryptosporidium hominis
LCKLKFYNNCEFYKIEKDFI

SEQ ID NO: 2175786 - protein, 17 aa, Cryptosporidium hominis
LCLGLTFDGDRIICGFL

SEQ ID NO: 2175787 - protein, 18 aa, Cryptosporidium hominis
LCLVKASRKEVFFNVPIN

SEQ ID NO: 2175788 - protein, 19 aa, Cryptosporidium hominis
LCNLAASCLNKWYEKYSSV

SEQ ID NO: 2175789 - protein, 20 aa, Cryptosporidium hominis
LCNLPADSIGAIDQENQQLA

SEQ ID NO: 2175790 - protein, 23 aa, Cryptosporidium hominis
LCNNNIKILEWDPPTILNEGLGA

SEQ ID NO: 2175791 - protein, 34 aa, Cryptosporidium hominis
LCPCQCRGSIKFVHLECLRHWINGRLNLANENGS

SEQ ID NO: 2175792 - protein, 17 aa, Cryptosporidium hominis
LCQHLSVQPTDKFAQFI

SEQ ID NO: 2175793 - protein, 24 aa, Cryptosporidium hominis
LCQIQFRATLLWIHRISVEDCKRE

SEQ ID NO: 2175794 - protein, 18 aa, Cryptosporidium hominis
LCQYLTRRVKGVNIGLFL

SEQ ID NO: 2175795 - protein, 27 aa, Cryptosporidium hominis
LCREFIKGIDRVICMIREIYNEKNESN

SEQ ID NO: 2175796 - protein, 17 aa, Cryptosporidium hominis
LCSDFPNRIKVITQNID

SEQ ID NO: 2175797 - protein, 18 aa, Cryptosporidium hominis
LCSLFGEAFVDKSLREEE

SEQ ID NO: 2175798 - protein, 34 aa, Cryptosporidium hominis
LCSPNFPTEFIYFWKKCCRKINEKLGINLQPIDG

SEQ ID NO: 2175799 - protein, 17 aa, Cryptosporidium hominis
LCTGGELFERVVHKRVF

SEQ ID NO: 2175800 - protein, 20 aa, Cryptosporidium hominis
LCTKLYLSFVNDFKEIGIRH

SEQ ID NO: 2175801 - protein, 20 aa, Cryptosporidium hominis
LCTPLHFSASNGFDEIVNKL

SEQ ID NO: 2175802 - protein, 25 aa, Cryptosporidium hominis
LCTYFIKGRCKNGSSCQFKHSTIPI

SEQ ID NO: 2175803 - protein, 23 aa, Cryptosporidium hominis
LCVKSLNKRNSFKMSNSKLTKNP

SEQ ID NO: 2175804 - protein, 20 aa, Cryptosporidium hominis
LDAPCTGLGIIARDPSVKVK

SEQ ID NO: 2175805 - protein, 19 aa, Cryptosporidium hominis
LDAPIKICGDIHGQYYDLL

SEQ ID NO: 2175806 - protein, 20 aa, Cryptosporidium hominis
LDAPYSPERLECLIDCAIVD

SEQ ID NO: 2175807 - protein, 28 aa, Cryptosporidium hominis
LDCGYQCCFSVPFFQGSPIYKACRRLDI

SEQ ID NO: 2175808 - protein, 21 aa, Cryptosporidium hominis
LDCNTPLPAPPSPRYTTIKVN

SEQ ID NO: 2175809 - protein, 20 aa, Cryptosporidium hominis
LDDIFFKNMMLEIATENKKL

SEQ ID NO: 2175810 - protein, 24 aa, Cryptosporidium hominis
LDDIPDPWSPVPNSIFLYRDANGN

SEQ ID NO: 2175811 - protein, 23 aa, Cryptosporidium hominis
LDDRVLYCIKIHYLIQRNLGICM

SEQ ID NO: 2175812 - protein, 19 aa, Cryptosporidium hominis
LDDSIKHLQENIIEFEKKS

SEQ ID NO: 2175813 - protein, 22 aa, Cryptosporidium hominis
LDEALLRPGRLDQLIYIPLPDL

SEQ ID NO: 2175814 - protein, 34 aa, Cryptosporidium hominis
LDEAQPFKNCKGILFAIQVCKAIMEGNYCRYFKL

SEQ ID NO: 2175815 - protein, 23 aa, Cryptosporidium hominis
LDECDKCLESLDMRKDVQEIFMS

SEQ ID NO: 2175816 - protein, 23 aa, Cryptosporidium hominis
LDEKNMPGFFFGQGNSDGTSTKS

SEQ ID NO: 2175817 - protein, 20 aa, Cryptosporidium hominis
LDELNTFYGIVNGYIDVEYS

SEQ ID NO: 2175818 - protein, 18 aa, Cryptosporidium hominis
LDEMLFKYSSEEFEKQLF

SEQ ID NO: 2175819 - protein, 21 aa, Cryptosporidium hominis
LDERLLRIEQLEMNYQNVNLE

SEQ ID NO: 2175820 - protein, 22 aa, Cryptosporidium hominis
LDFEWCKSREQGLISPDIVVFL

SEQ ID NO: 2175821 - protein, 17 aa, Cryptosporidium hominis
LDFFGNKKVCLLGDEEY

SEQ ID NO: 2175822 - protein, 18 aa, Cryptosporidium hominis
LDFFKHIFPSLISQVCKK

SEQ ID NO: 2175823 - protein, 18 aa, Cryptosporidium hominis
LDFLWDWNSRIFMDCQSK

SEQ ID NO: 2175824 - protein, 23 aa, Cryptosporidium hominis
LDFSYLNIRWRRKMGEKLIDIQG

SEQ ID NO: 2175825 - protein, 19 aa, Cryptosporidium hominis
LDGCKRLIVTSADVALNER

SEQ ID NO: 2175826 - protein, 20 aa, Cryptosporidium hominis
LDGKNALIIRKLVNGDKDMQ

SEQ ID NO: 2175827 - protein, 24 aa, Cryptosporidium hominis
LDGLKPGQRKVLFATFKKKLNNEL

SEQ ID NO: 2175828 - protein, 17 aa, Cryptosporidium hominis
LDHCGALPFFTEKIGYK

SEQ ID NO: 2175829 - protein, 24 aa, Cryptosporidium hominis
LDHIPCDLDSLSIEFFTIQKSGNF

SEQ ID NO: 2175830 - protein, 25 aa, Cryptosporidium hominis
LDHLKRYQIGKVYRRDEPQMARGRF

SEQ ID NO: 2175831 - protein, 18 aa, Cryptosporidium hominis
LDHPNIIKLFEVFEDTNY

SEQ ID NO: 2175832 - protein, 23 aa, Cryptosporidium hominis
LDHWKRTFEDWTDLNVVSYYDEG

SEQ ID NO: 2175833 - protein, 20 aa, Cryptosporidium hominis
LDIFPLPFLNIEVAEQYCAM

SEQ ID NO: 2175834 - protein, 25 aa, Cryptosporidium hominis
LDIGCGYGGLLVWLSENFKDKLALG

SEQ ID NO: 2175835 - protein, 20 aa, Cryptosporidium hominis
LDIKHEWLNYKINTHSKGDL

SEQ ID NO: 2175836 - protein, 20 aa, Cryptosporidium hominis
LDILKDAWSPALTLRTVMLS

SEQ ID NO: 2175837 - protein, 18 aa, Cryptosporidium hominis
LDILKDKWSPALQIRTVL

SEQ ID NO: 2175838 - protein, 27 aa, Cryptosporidium hominis
LDILLERWNPFLLYKFEQEYFKNGAVL

SEQ ID NO: 2175839 - protein, 18 aa, Cryptosporidium hominis
LDILSLCFVIQSVPNCPS

SEQ ID NO: 2175840 - protein, 18 aa, Cryptosporidium hominis
LDINVSKDLGHLLKAPFC

SEQ ID NO: 2175841 - protein, 19 aa, Cryptosporidium hominis
LDINYGYIKPIRYLNDGLP

SEQ ID NO: 2175842 - protein, 23 aa, Cryptosporidium hominis
LDIPNIIWKLILGENVSLNDLKQ

SEQ ID NO: 2175843 - protein, 19 aa, Cryptosporidium hominis
LDITDLFVMFEIIDSEFMI

SEQ ID NO: 2175844 - protein, 17 aa, Cryptosporidium hominis
LDIVDGFLSKDDDTEKK

SEQ ID NO: 2175845 - protein, 25 aa, Cryptosporidium hominis
LDKDIVSILSIWPIKSRLPVWKVWR

SEQ ID NO: 2175846 - protein, 27 aa, Cryptosporidium hominis
LDKFDICPIDRLFTLKPVDKFPLTIDE

SEQ ID NO: 2175847 - protein, 19 aa, Cryptosporidium hominis
LDKIYTFTGPILIAVNPYR

SEQ ID NO: 2175848 - protein, 29 aa, Cryptosporidium hominis
LDLDPKFTKAWSRKGNIHYFLKEYHKALH

SEQ ID NO: 2175849 - protein, 20 aa, Cryptosporidium hominis
LDLFLNLANWFGLHSGIPFV

SEQ ID NO: 2175850 - protein, 17 aa, Cryptosporidium hominis
LDLGGVMAIYGKENCGI

SEQ ID NO: 2175851 - protein, 20 aa, Cryptosporidium hominis
LDLGKSCYTIRGGVSSMTER

SEQ ID NO: 2175852 - protein, 17 aa, Cryptosporidium hominis
LDLIKLHALTPRTNNLL

SEQ ID NO: 2175853 - protein, 18 aa, Cryptosporidium hominis
LDLIRISAPLFLEKESGL

SEQ ID NO: 2175854 - protein, 22 aa, Cryptosporidium hominis
LDLKEFYTCIGLVSDLLVSILK

SEQ ID NO: 2175855 - protein, 20 aa, Cryptosporidium hominis
LDLKVMRDVENFLGNSGGID

SEQ ID NO: 2175856 - protein, 21 aa, Cryptosporidium hominis
LDLMERVLFLWAIRNPASGYV

SEQ ID NO: 2175857 - protein, 21 aa, Cryptosporidium hominis
LDLPCLVLGTVYGMKLNRGYN

SEQ ID NO: 2175858 - protein, 18 aa, Cryptosporidium hominis
LDLPEPVDFSMLSKLVLE

SEQ ID NO: 2175859 - protein, 17 aa, Cryptosporidium hominis
LDLPVICRKVFCGSNSD

SEQ ID NO: 2175860 - protein, 34 aa, Cryptosporidium hominis
LDLQKSKIEWWKKPRGWKVTYFKQGQKLSQIFRV

SEQ ID NO: 2175861 - protein, 23 aa, Cryptosporidium hominis
LDLRAKQKFEYNRRFSREKAGNF

SEQ ID NO: 2175862 - protein, 17 aa, Cryptosporidium hominis
LDLRGCKNILNIELERF

SEQ ID NO: 2175863 - protein, 21 aa, Cryptosporidium hominis
LDLRVINGWFCSYVNPHMIKD

SEQ ID NO: 2175864 - protein, 29 aa, Cryptosporidium hominis
LDMPEKVDLTLPCEFVGEIYSIIDDGAIF

SEQ ID NO: 2175865 - protein, 18 aa, Cryptosporidium hominis
LDNMTIDTFLRVIGFGHR

SEQ ID NO: 2175866 - protein, 26 aa, Cryptosporidium hominis
LDNYCGCTGYAGLVSHMFEYEGTNLL

SEQ ID NO: 2175867 - protein, 17 aa, Cryptosporidium hominis
LDPALLRPGRLDRKVEF

SEQ ID NO: 2175868 - protein, 18 aa, Cryptosporidium hominis
LDPELRFFHSKRIFYRNN

SEQ ID NO: 2175869 - protein, 24 aa, Cryptosporidium hominis
LDPHLVKHLSVFGINVGQLEKTEK

SEQ ID NO: 2175870 - protein, 18 aa, Cryptosporidium hominis
LDPIDFAGCRNVAEYYFM

SEQ ID NO: 2175871 - protein, 24 aa, Cryptosporidium hominis
LDPIRRLKVVNIRENVQILMITGG

SEQ ID NO: 2175872 - protein, 25 aa, Cryptosporidium hominis
LDPKLYTGMHKYRFDKDGNGLGKAG

SEQ ID NO: 2175873 - protein, 25 aa, Cryptosporidium hominis
LDPNRLRVAFRIIFLDEQGDIEPGI

SEQ ID NO: 2175874 - protein, 19 aa, Cryptosporidium hominis
LDPYKPIKLTREVKDKDRF

SEQ ID NO: 2175875 - protein, 25 aa, Cryptosporidium hominis
LDQLIKYPLLDSFNPKPGFFQKLIH

SEQ ID NO: 2175876 - protein, 17 aa, Cryptosporidium hominis
LDQLSGLQLKLKAFDNF

SEQ ID NO: 2175877 - protein, 17 aa, Cryptosporidium hominis
LDQTCHLAHRMGLAPSK

SEQ ID NO: 2175878 - protein, 19 aa, Cryptosporidium hominis
LDREYKDVIPFTDIQNRMM

SEQ ID NO: 2175879 - protein, 22 aa, Cryptosporidium hominis
LDRLCSNIAIFGECKLDHNICK

SEQ ID NO: 2175880 - protein, 23 aa, Cryptosporidium hominis
LDRLKNEFCRFIDFKYHASTIGN

SEQ ID NO: 2175881 - protein, 21 aa, Cryptosporidium hominis
LDRLKSEWQNLMISQAFILSS

SEQ ID NO: 2175882 - protein, 21 aa, Cryptosporidium hominis
LDRRYFPNIFFYCTHLEIPLM

SEQ ID NO: 2175883 - protein, 29 aa, Cryptosporidium hominis
LDRYFGNVCELDLIFNFHKAYFILDEIIL

SEQ ID NO: 2175884 - protein, 28 aa, Cryptosporidium hominis
LDSEIRKTEVLDNWSFGSNEEFNLLSIF

SEQ ID NO: 2175885 - protein, 18 aa, Cryptosporidium hominis
LDSFMGPSHKFTIKLLMM

SEQ ID NO: 2175886 - protein, 17 aa, Cryptosporidium hominis
LDSLSSFSMKVISNTKS

SEQ ID NO: 2175887 - protein, 27 aa, Cryptosporidium hominis
LDSNYTPRLAFRGSVAPNSYYTVNDGR

SEQ ID NO: 2175888 - protein, 18 aa, Cryptosporidium hominis
LDSSRFRTFIAQHFGVNA

SEQ ID NO: 2175889 - protein, 33 aa, Cryptosporidium hominis
LDSTRGSSIARCFKKGLGGSILSSCMGVNDTHR

SEQ ID NO: 2175890 - protein, 21 aa, Cryptosporidium hominis
LDSTTAASCLGKFYESKYLGS

SEQ ID NO: 2175891 - protein, 17 aa, Cryptosporidium hominis
LDTCSKSLISRNSSLSS

SEQ ID NO: 2175892 - protein, 22 aa, Cryptosporidium hominis
LDTSALLPFSFGKQQWGDYGGY

SEQ ID NO: 2175893 - protein, 17 aa, Cryptosporidium hominis
LDTSCYLNQHDGQLAPF

SEQ ID NO: 2175894 - protein, 17 aa, Cryptosporidium hominis
LDTVLFCRDKWLNEDGL

SEQ ID NO: 2175895 - protein, 20 aa, Cryptosporidium hominis
LDVFRYLSNINIAPNIIADF

SEQ ID NO: 2175896 - protein, 20 aa, Cryptosporidium hominis
LDVGCGTGILSMLAAKCGAK

SEQ ID NO: 2175897 - protein, 17 aa, Cryptosporidium hominis
LDVGFLTDASKFVAGSV

SEQ ID NO: 2175898 - protein, 21 aa, Cryptosporidium hominis
LDVIEILPLTEWLVNTYQNYG

SEQ ID NO: 2175899 - protein, 23 aa, Cryptosporidium hominis
LDVIFGFLLRKTDFFTAMNQGEE

SEQ ID NO: 2175900 - protein, 27 aa, Cryptosporidium hominis
LDVLEPVYLRRLIRLMSNKLYELEMNR

SEQ ID NO: 2175901 - protein, 27 aa, Cryptosporidium hominis
LDVLRWLDRKLIRLVSRFADYQKDDPN

SEQ ID NO: 2175902 - protein, 22 aa, Cryptosporidium hominis
LDVWSVGVIMYSVITGRHPFSG

SEQ ID NO: 2175903 - protein, 19 aa, Cryptosporidium hominis
LDWIPYHVSSGIGITVAIS

SEQ ID NO: 2175904 - protein, 24 aa, Cryptosporidium hominis
LDWLFDCYEEGRIVSYKKYIYNSK

SEQ ID NO: 2175905 - protein, 18 aa, Cryptosporidium hominis
LDYIEMVFAKRIYIDNTC

SEQ ID NO: 2175906 - protein, 26 aa, Cryptosporidium hominis
LDYYQFRWFHSWKKLLRNSSGYFFPH

SEQ ID NO: 2175907 - protein, 20 aa, Cryptosporidium hominis
LEAGIKPVFVFDGAPPEMKK

SEQ ID NO: 2175908 - protein, 17 aa, Cryptosporidium hominis
LEAKLQLLIGVSIRRIH

SEQ ID NO: 2175909 - protein, 25 aa, Cryptosporidium hominis
LEAKRLKCKFITPQNRFSIESGYRW

SEQ ID NO: 2175910 - protein, 20 aa, Cryptosporidium hominis
LEAVGLFTKPRHNIYKLNMD

SEQ ID NO: 2175911 - protein, 21 aa, Cryptosporidium hominis
LEAYSYKSCVEKLEELQNEQI

SEQ ID NO: 2175912 - protein, 25 aa, Cryptosporidium hominis
LEDGESMYLWLGRAIPTTFIQQVFG

SEQ ID NO: 2175913 - protein, 18 aa, Cryptosporidium hominis
LEDGRIFAIGGFNGESII

SEQ ID NO: 2175914 - protein, 17 aa, Cryptosporidium hominis
LEDLFNLCHRRFTMKTI

SEQ ID NO: 2175915 - protein, 24 aa, Cryptosporidium hominis
LEDLKWDINQGLQVDHVRANSQSI

SEQ ID NO: 2175916 - protein, 26 aa, Cryptosporidium hominis
LEDSLLDIYSFISWYIYDYNNEITQK

SEQ ID NO: 2175917 - protein, 17 aa, Cryptosporidium hominis
LEDWPYWNKSILSELKH

SEQ ID NO: 2175918 - protein, 24 aa, Cryptosporidium hominis
LEDYRFKTLYGHLAEYDTVSSNAN

SEQ ID NO: 2175919 - protein, 24 aa, Cryptosporidium hominis
LEEAKELFSYSGIWLDTHSIPLLW

SEQ ID NO: 2175920 - protein, 18 aa, Cryptosporidium hominis
LEECDVIALLALPKICCI

SEQ ID NO: 2175921 - protein, 18 aa, Cryptosporidium hominis
LEEFKIYFQRFGNIKDAV

SEQ ID NO: 2175922 - protein, 24 aa, Cryptosporidium hominis
LEEKAKNYFIMFSKERKEREKLER

SEQ ID NO: 2175923 - protein, 30 aa, Cryptosporidium hominis
LEELIFDWIKLRCWNFTDSDLRWIDGCKYI

SEQ ID NO: 2175924 - protein, 24 aa, Cryptosporidium hominis
LEELKRKYDVVVLAVGGLQSFHTL

SEQ ID NO: 2175925 - protein, 17 aa, Cryptosporidium hominis
LEEMALICMNKKHSRYL

SEQ ID NO: 2175926 - protein, 23 aa, Cryptosporidium hominis
LEESAKCLVEHGFHYSGKEYLTS

SEQ ID NO: 2175927 - protein, 24 aa, Cryptosporidium hominis
LEESGFYLGIRLVERLVTRLFTAQ

SEQ ID NO: 2175928 - protein, 34 aa, Cryptosporidium hominis
LEESKSDILECFIKWKNDHYYTKWEEFNQPPNEM

SEQ ID NO: 2175929 - protein, 23 aa, Cryptosporidium hominis
LEESLKLLIKHVIAQCKREYLRE

SEQ ID NO: 2175930 - protein, 29 aa, Cryptosporidium hominis
LEEVCHRLKLQSFCFMWMLPEHALLNSII

SEQ ID NO: 2175931 - protein, 19 aa, Cryptosporidium hominis
LEFKLKRSNEIHKKKLSKI

SEQ ID NO: 2175932 - protein, 20 aa, Cryptosporidium hominis
LEFLFKDLIESVKMSKEPIE

SEQ ID NO: 2175933 - protein, 19 aa, Cryptosporidium hominis
LEFTENWDLILFPEKFDIS

SEQ ID NO: 2175934 - protein, 33 aa, Cryptosporidium hominis
LEGDSFGTCFVMKHVINPFNFLNDNINEKSSTN

SEQ ID NO: 2175935 - protein, 18 aa, Cryptosporidium hominis
LEGFEIFDAEEEFLGIDW

SEQ ID NO: 2175936 - protein, 25 aa, Cryptosporidium hominis
LEGGRAALVVFPFVSLVSEKRDSYY

SEQ ID NO: 2175937 - protein, 26 aa, Cryptosporidium hominis
LEGLTKLKPCYLCYSSSTISNQMIGI

SEQ ID NO: 2175938 - protein, 17 aa, Cryptosporidium hominis
LEGLVEYDKLVSKQLGN

SEQ ID NO: 2175939 - protein, 19 aa, Cryptosporidium hominis
LEGQILAIDASIWLKQFLM

SEQ ID NO: 2175940 - protein, 17 aa, Cryptosporidium hominis
LEGQISKILEYSSVLEE

SEQ ID NO: 2175941 - protein, 18 aa, Cryptosporidium hominis
LEGSRARYEQSIKNVEEY

SEQ ID NO: 2175942 - protein, 23 aa, Cryptosporidium hominis
LEHIVICRMMFILFPVTDAQHPI

SEQ ID NO: 2175943 - protein, 17 aa, Cryptosporidium hominis
LEHKITDVIYVFANTHF

SEQ ID NO: 2175944 - protein, 19 aa, Cryptosporidium hominis
LEHNPDLWGAKRYTLKPPQ

SEQ ID NO: 2175945 - protein, 20 aa, Cryptosporidium hominis
LEHNRFFGIDFRNYLHILQK

SEQ ID NO: 2175946 - protein, 18 aa, Cryptosporidium hominis
LEICLRKFQIRGFEKDNF

SEQ ID NO: 2175947 - protein, 24 aa, Cryptosporidium hominis
LEIFCPRPKVIEEFHSCSGAGKVF

SEQ ID NO: 2175948 - protein, 22 aa, Cryptosporidium hominis
LEIFNIVAVESFNFGAMENKSL

SEQ ID NO: 2175949 - protein, 21 aa, Cryptosporidium hominis
LEIHFLRLVRFQLFVTEHEYE

SEQ ID NO: 2175950 - protein, 17 aa, Cryptosporidium hominis
LEIHKNEVLSPVKEPNI

SEQ ID NO: 2175951 - protein, 19 aa, Cryptosporidium hominis
LEIIDLILCQIQFRATLLW

SEQ ID NO: 2175952 - protein, 19 aa, Cryptosporidium hominis
LEIIFNFLVLFKATPVIPE

SEQ ID NO: 2175953 - protein, 29 aa, Cryptosporidium hominis
LEIIRILFQRDKLFLSWVNYHKGSLRRLF

SEQ ID NO: 2175954 - protein, 18 aa, Cryptosporidium hominis
LEIIRYDKVYVICPDSIK

SEQ ID NO: 2175955 - protein, 17 aa, Cryptosporidium hominis
LEIKTLAYILSREIKTS

SEQ ID NO: 2175956 - protein, 18 aa, Cryptosporidium hominis
LEILGYFDIRILKDSLIS

SEQ ID NO: 2175957 - protein, 23 aa, Cryptosporidium hominis
LEIPENIYSLFGRNKLKTNKNRQ

SEQ ID NO: 2175958 - protein, 20 aa, Cryptosporidium hominis
LEIPIFLQLLNFCVYSVMDS

SEQ ID NO: 2175959 - protein, 23 aa, Cryptosporidium hominis
LEIRKMWCVQLVKAVAYLHEGCA

SEQ ID NO: 2175960 - protein, 18 aa, Cryptosporidium hominis
LEISEKFYSKCGNLSLNG

SEQ ID NO: 2175961 - protein, 17 aa, Cryptosporidium hominis
LEISNLLSIRNPNLLHY

SEQ ID NO: 2175962 - protein, 17 aa, Cryptosporidium hominis
LEIVDTFVKNSSKKLEI

SEQ ID NO: 2175963 - protein, 20 aa, Cryptosporidium hominis
LEIYNIIPTWGSFKENFYFH

SEQ ID NO: 2175964 - protein, 24 aa, Cryptosporidium hominis
LEKAVEGILRWFDIESEIGANDSV

SEQ ID NO: 2175965 - protein, 24 aa, Cryptosporidium hominis
LEKEENWWAILIKIGVPNLPKENS

SEQ ID NO: 2175966 - protein, 23 aa, Cryptosporidium hominis
LEKEWWIDCLIEIGLNHENLNVR

SEQ ID NO: 2175967 - protein, 23 aa, Cryptosporidium hominis
LEKFKAAHPEMDFSQAKINYGSG

SEQ ID NO: 2175968 - protein, 22 aa, Cryptosporidium hominis
LEKFKMMDCYFITGTSFEEILE

SEQ ID NO: 2175969 - protein, 24 aa, Cryptosporidium hominis
LEKHIQLPSIVSFRDLCMEAFGEE

SEQ ID NO: 2175970 - protein, 18 aa, Cryptosporidium hominis
LEKHLKLKSEFDEKFANR

SEQ ID NO: 2175971 - protein, 20 aa, Cryptosporidium hominis
LEKIKFIYPSLEIVKVSDLE

SEQ ID NO: 2175972 - protein, 21 aa, Cryptosporidium hominis
LEKKFILAIEILEEIVVKAPG

SEQ ID NO: 2175973 - protein, 24 aa, Cryptosporidium hominis
LEKKKIRVAGIVKFVDLIEQEIAI

SEQ ID NO: 2175974 - protein, 19 aa, Cryptosporidium hominis
LEKLKHVLSKVGISNFTYE

SEQ ID NO: 2175975 - protein, 18 aa, Cryptosporidium hominis
LEKLRMERRQKFLKFQRT

SEQ ID NO: 2175976 - protein, 17 aa, Cryptosporidium hominis
LEKMGTNLMNLRILSFH

SEQ ID NO: 2175977 - protein, 20 aa, Cryptosporidium hominis
LEKQLSFSNFKIFLKLPNRL

SEQ ID NO: 2175978 - protein, 17 aa, Cryptosporidium hominis
LEKRIRAKIVQDRIDLK

SEQ ID NO: 2175979 - protein, 27 aa, Cryptosporidium hominis
LEKVCKYSRCCISPMAAFLGGIAAQEI

SEQ ID NO: 2175980 - protein, 20 aa, Cryptosporidium hominis
LELDSYLFSYGVKLPLEKDS

SEQ ID NO: 2175981 - protein, 19 aa, Cryptosporidium hominis
LELEEFCGIVSLENDYQSE

SEQ ID NO: 2175982 - protein, 26 aa, Cryptosporidium hominis
LELENLCLIRQLFKDFVRIITQGRIE

SEQ ID NO: 2175983 - protein, 23 aa, Cryptosporidium hominis
LELFPEVINDYFVNYKINKIMED

SEQ ID NO: 2175984 - protein, 21 aa, Cryptosporidium hominis
LELICSLNIILNSASYVFLGT

SEQ ID NO: 2175985 - protein, 18 aa, Cryptosporidium hominis
LELIFSRFGEVKSCNIIR

SEQ ID NO: 2175986 - protein, 17 aa, Cryptosporidium hominis
LELKGWSSFFNIENCVE

SEQ ID NO: 2175987 - protein, 17 aa, Cryptosporidium hominis
LELLRLLINTIKNDLNN

SEQ ID NO: 2175988 - protein, 24 aa, Cryptosporidium hominis
LELMIKGHILKRFSSVNFEGQKIK

SEQ ID NO: 2175989 - protein, 20 aa, Cryptosporidium hominis
LELRKKIWRLYSIIETKSSV

SEQ ID NO: 2175990 - protein, 24 aa, Cryptosporidium hominis
LELSRPKTMWEFIGNKDCADELYN

SEQ ID NO: 2175991 - protein, 18 aa, Cryptosporidium hominis
LELSTSITSYGRAMIDIT

SEQ ID NO: 2175992 - protein, 23 aa, Cryptosporidium hominis
LELTWKYPIENSSNFPNDKSMIG

SEQ ID NO: 2175993 - protein, 20 aa, Cryptosporidium hominis
LELVCTFFTILGSYSKGFIV

SEQ ID NO: 2175994 - protein, 18 aa, Cryptosporidium hominis
LEMAQGKLNLSMVSEKGY

SEQ ID NO: 2175995 - protein, 19 aa, Cryptosporidium hominis
LEMEVCLRCVQSSNKNTLS

SEQ ID NO: 2175996 - protein, 18 aa, Cryptosporidium hominis
LEMLSWLRDIAIGMEHAH

SEQ ID NO: 2175997 - protein, 23 aa, Cryptosporidium hominis
LEMPQYRYQIRLIAQSIIRGGSR

SEQ ID NO: 2175998 - protein, 17 aa, Cryptosporidium hominis
LENCSRVSPEFYPGKLS

SEQ ID NO: 2175999 - protein, 26 aa, Cryptosporidium hominis
LENKLSINIIHEFYLNLEIDEINYEI

SEQ ID NO: 2176000 - protein, 23 aa, Cryptosporidium hominis
LENLENCYLVISPNISNMLSLCY

SEQ ID NO: 2176001 - protein, 18 aa, Cryptosporidium hominis
LENLRLVLREKKIAKFTI

SEQ ID NO: 2176002 - protein, 20 aa, Cryptosporidium hominis
LENMKPPPLIILPVYSSQPS

SEQ ID NO: 2176003 - protein, 18 aa, Cryptosporidium hominis
LENNFLCLKEYMVNLNNE

SEQ ID NO: 2176004 - protein, 23 aa, Cryptosporidium hominis
LENNVLGLPSWFIEDENKHNKPE

SEQ ID NO: 2176005 - protein, 18 aa, Cryptosporidium hominis
LENPDFNGINLLLSSTNT

SEQ ID NO: 2176006 - protein, 21 aa, Cryptosporidium hominis
LEPAVKYPGYKLEVNGKYYEI

SEQ ID NO: 2176007 - protein, 19 aa, Cryptosporidium hominis
LEPCFKSIIYNIPQIGSGS

SEQ ID NO: 2176008 - protein, 22 aa, Cryptosporidium hominis
LEPIRYIYPKGYAPSTSNFTQI

SEQ ID NO: 2176009 - protein, 27 aa, Cryptosporidium hominis
LEPKDLIQLCSWIERYGKNLNYIHIRV

SEQ ID NO: 2176010 - protein, 17 aa, Cryptosporidium hominis
LEPQSLLFLSVLMGPKW

SEQ ID NO: 2176011 - protein, 17 aa, Cryptosporidium hominis
LEPVHKQYVVYQLIKVI

SEQ ID NO: 2176012 - protein, 23 aa, Cryptosporidium hominis
LEREIYIAKLLLHLEEQRDAMRH

SEQ ID NO: 2176013 - protein, 17 aa, Cryptosporidium hominis
LERELRKKLPDNVIELL

SEQ ID NO: 2176014 - protein, 28 aa, Cryptosporidium hominis
LERFDDLEFYLGPSLDCEGIIIYGYYED

SEQ ID NO: 2176015 - protein, 23 aa, Cryptosporidium hominis
LERILRKYFSSIVRKLVLEISQS

SEQ ID NO: 2176016 - protein, 17 aa, Cryptosporidium hominis
LERIRTLVLPKLYTYIN

SEQ ID NO: 2176017 - protein, 26 aa, Cryptosporidium hominis
LERKHKGKRGRKRKNLRMDDFNNNYS

SEQ ID NO: 2176018 - protein, 26 aa, Cryptosporidium hominis
LERLRTYPGPIPWNYGAFPQTWEDPN

SEQ ID NO: 2176019 - protein, 24 aa, Cryptosporidium hominis
LERYIRPTGLRFKKAHVTHPELKT

SEQ ID NO: 2176020 - protein, 22 aa, Cryptosporidium hominis
LESCGFNRAKLCKQSLSHRSPS

SEQ ID NO: 2176021 - protein, 24 aa, Cryptosporidium hominis
LESELRWYKENFVQIKNDLLSKLN

SEQ ID NO: 2176022 - protein, 17 aa, Cryptosporidium hominis
LESESPKELSIIPFEDV

SEQ ID NO: 2176023 - protein, 23 aa, Cryptosporidium hominis
LESIFEWIRVCGVSIESEFLIKA

SEQ ID NO: 2176024 - protein, 17 aa, Cryptosporidium hominis
LESILCRCEKVEAKFIS

SEQ ID NO: 2176025 - protein, 24 aa, Cryptosporidium hominis
LESIPENKNRLIFAVLPFGTGNDW

SEQ ID NO: 2176026 - protein, 23 aa, Cryptosporidium hominis
LESLRTNPLFQQLRSVVQQDPRI

SEQ ID NO: 2176027 - protein, 22 aa, Cryptosporidium hominis
LESNAKWKGYVKLLVDQISKKN

SEQ ID NO: 2176028 - protein, 23 aa, Cryptosporidium hominis
LESQRHGWGFLADKSKIIYEGMW

SEQ ID NO: 2176029 - protein, 23 aa, Cryptosporidium hominis
LESRAERSLKEIITDTLGKSSKL

SEQ ID NO: 2176030 - protein, 18 aa, Cryptosporidium hominis
LESSWGKQFGSFRYPEIK

SEQ ID NO: 2176031 - protein, 25 aa, Cryptosporidium hominis
LESVKRRLSELIHDYDHGLGIFSKH

SEQ ID NO: 2176032 - protein, 25 aa, Cryptosporidium hominis
LETDCRFSYCALSSLTILNRINEID

SEQ ID NO: 2176033 - protein, 18 aa, Cryptosporidium hominis
LETEEIISDFKDFFSKID

SEQ ID NO: 2176034 - protein, 33 aa, Cryptosporidium hominis
LETENRIAFDFIIDEVFLRGTIYDYMRQNEKTS

SEQ ID NO: 2176035 - protein, 29 aa, Cryptosporidium hominis
LETFYQFIWRPHPPSLLSQEKFDEIPRKL

SEQ ID NO: 2176036 - protein, 18 aa, Cryptosporidium hominis
LETGFWNEMPSKMKIESP

SEQ ID NO: 2176037 - protein, 20 aa, Cryptosporidium hominis
LETHMGLALMQQAEWSKAQE

SEQ ID NO: 2176038 - protein, 20 aa, Cryptosporidium hominis
LETLTGALFQRPPVISAVKR

SEQ ID NO: 2176039 - protein, 17 aa, Cryptosporidium hominis
LETLVSRYIKLNMSEER

SEQ ID NO: 2176040 - protein, 24 aa, Cryptosporidium hominis
LETNLEAIFAYHCTDGVGLLDYET

SEQ ID NO: 2176041 - protein, 27 aa, Cryptosporidium hominis
LETNLRYYQDREMYLQHELELKENELN

SEQ ID NO: 2176042 - protein, 18 aa, Cryptosporidium hominis
LETRMCINKMSVCTGKKS

SEQ ID NO: 2176043 - protein, 17 aa, Cryptosporidium hominis
LEVFIRKAPWQILVKNL

SEQ ID NO: 2176044 - protein, 18 aa, Cryptosporidium hominis
LEVLKVISDQGGFQFDAP

SEQ ID NO: 2176045 - protein, 25 aa, Cryptosporidium hominis
LEVMKEANCNILVFSSSATVYLPKP

SEQ ID NO: 2176046 - protein, 20 aa, Cryptosporidium hominis
LEVVRPGIYRNYGVQLDFKQ

SEQ ID NO: 2176047 - protein, 17 aa, Cryptosporidium hominis
LEWKTAISSSDFEDEEV

SEQ ID NO: 2176048 - protein, 22 aa, Cryptosporidium hominis
LEYFISCYLLEICLYDIEILKY

SEQ ID NO: 2176049 - protein, 19 aa, Cryptosporidium hominis
LEYFPQTLLQYLEKSPKGL

SEQ ID NO: 2176050 - protein, 19 aa, Cryptosporidium hominis
LEYLSRVDGIVNFENKLCE

SEQ ID NO: 2176051 - protein, 19 aa, Cryptosporidium hominis
LEYNLKIPILIDAGKNEIE

SEQ ID NO: 2176052 - protein, 17 aa, Cryptosporidium hominis
LEYPYLITNMEIIGSIP

SEQ ID NO: 2176053 - protein, 18 aa, Cryptosporidium hominis
LFALGYKKIALVKMDNNA

SEQ ID NO: 2176054 - protein, 19 aa, Cryptosporidium hominis
LFCEGVVLDALDWSIEFPK

SEQ ID NO: 2176055 - protein, 19 aa, Cryptosporidium hominis
LFCLSKIVNTVEQFSLKQE

SEQ ID NO: 2176056 - protein, 17 aa, Cryptosporidium hominis
LFCRRGVEVTVISQGEF

SEQ ID NO: 2176057 - protein, 20 aa, Cryptosporidium hominis
LFDIFNSMCIAFDVYISNYK

SEQ ID NO: 2176058 - protein, 23 aa, Cryptosporidium hominis
LFDPELYTAMIISFQPNGIYSNE

SEQ ID NO: 2176059 - protein, 18 aa, Cryptosporidium hominis
LFEEIRFQLNVIVNNLEL

SEQ ID NO: 2176060 - protein, 20 aa, Cryptosporidium hominis
LFEEKCLWEDAPIFESTSGA

SEQ ID NO: 2176061 - protein, 19 aa, Cryptosporidium hominis
LFEEQPLWLRPVIESKISP

SEQ ID NO: 2176062 - protein, 17 aa, Cryptosporidium hominis
LFEKVFISPLSIPASVS

SEQ ID NO: 2176063 - protein, 26 aa, Cryptosporidium hominis
LFELSELWDMINLESFGVKWNPVINI

SEQ ID NO: 2176064 - protein, 24 aa, Cryptosporidium hominis
LFEMPNIQLIFSFLYNPSSFNFIN

SEQ ID NO: 2176065 - protein, 22 aa, Cryptosporidium hominis
LFENLKDGFDWNIKSSLEILIL

SEQ ID NO: 2176066 - protein, 18 aa, Cryptosporidium hominis
LFENWKDELLELFPENSK

SEQ ID NO: 2176067 - protein, 18 aa, Cryptosporidium hominis
LFETIALNSVNNFSTNQI

SEQ ID NO: 2176068 - protein, 18 aa, Cryptosporidium hominis
LFEWQGRRIGIMGLVEKD

SEQ ID NO: 2176069 - protein, 17 aa, Cryptosporidium hominis
LFFFSAPSLLPYVDEIV

SEQ ID NO: 2176070 - protein, 19 aa, Cryptosporidium hominis
LFFGYHYFVLLSFMPGSGL

SEQ ID NO: 2176071 - protein, 20 aa, Cryptosporidium hominis
LFFKICDDMKIELSSYSIND

SEQ ID NO: 2176072 - protein, 19 aa, Cryptosporidium hominis
LFGLVIIFYKYEIVGSEHN

SEQ ID NO: 2176073 - protein, 17 aa, Cryptosporidium hominis
LFGSSLFQINKTSENST

SEQ ID NO: 2176074 - protein, 20 aa, Cryptosporidium hominis
LFIDKWPHLVVLTIPGIEIK

SEQ ID NO: 2176075 - protein, 24 aa, Cryptosporidium hominis
LFIEWSIGCEIFRKIWGPDDKPIL

SEQ ID NO: 2176076 - protein, 25 aa, Cryptosporidium hominis
LFILVLKLPSICFAEDSEASTDIEE

SEQ ID NO: 2176077 - protein, 17 aa, Cryptosporidium hominis
LFINELREKVPLKNNYV

SEQ ID NO: 2176078 - protein, 25 aa, Cryptosporidium hominis
LFIPDNYKGILIWKSTNFIRHCDII

SEQ ID NO: 2176079 - protein, 17 aa, Cryptosporidium hominis
LFIPKAIGLDWKIISSM

SEQ ID NO: 2176080 - protein, 18 aa, Cryptosporidium hominis
LFIVTSLGTWGEIPPLLA

SEQ ID NO: 2176081 - protein, 18 aa, Cryptosporidium hominis
LFKAEIDLSSFGHIINYF

SEQ ID NO: 2176082 - protein, 19 aa, Cryptosporidium hominis
LFKEFWGNDKIETRRFRDG

SEQ ID NO: 2176083 - protein, 18 aa, Cryptosporidium hominis
LFKEGNLICDLRLKDLEL

SEQ ID NO: 2176084 - protein, 23 aa, Cryptosporidium hominis
LFKNYCSPEIVSMAPKQRIQSWK

SEQ ID NO: 2176085 - protein, 22 aa, Cryptosporidium hominis
LFKPCMDVIWEFNKHVMTRSPT

SEQ ID NO: 2176086 - protein, 19 aa, Cryptosporidium hominis
LFKPCTEFLPRLHQNLGPD

SEQ ID NO: 2176087 - protein, 18 aa, Cryptosporidium hominis
LFKVMKMMVGDNLEDLQV

SEQ ID NO: 2176088 - protein, 21 aa, Cryptosporidium hominis
LFLCKEGGFKCDLLSSKEILD

SEQ ID NO: 2176089 - protein, 31 aa, Cryptosporidium hominis
LFLHIPFPSFEIFRCLPVREELLRSILMADL

SEQ ID NO: 2176090 - protein, 18 aa, Cryptosporidium hominis
LFLIPGIDENTPLEPKKR

SEQ ID NO: 2176091 - protein, 20 aa, Cryptosporidium hominis
LFLKGFDHLILVTAYETDNE

SEQ ID NO: 2176092 - protein, 26 aa, Cryptosporidium hominis
LFLNKLIIQKCCDKLVSAKEFICNEF

SEQ ID NO: 2176093 - protein, 18 aa, Cryptosporidium hominis
LFLYKFRLSNSYGTNMNI

SEQ ID NO: 2176094 - protein, 18 aa, Cryptosporidium hominis
LFNHCYCTSFYNIIPKYI

SEQ ID NO: 2176095 - protein, 17 aa, Cryptosporidium hominis
LFNIHDMSFSRKKFEPF

SEQ ID NO: 2176096 - protein, 19 aa, Cryptosporidium hominis
LFNNFTIQWLNAIYQFDQL

SEQ ID NO: 2176097 - protein, 19 aa, Cryptosporidium hominis
LFPEINFNSLINCIHSVLS

SEQ ID NO: 2176098 - protein, 19 aa, Cryptosporidium hominis
LFPERRKVVVDTRKGLHNK

SEQ ID NO: 2176099 - protein, 20 aa, Cryptosporidium hominis
LFPMLPKIFEALSIRLETPF

SEQ ID NO: 2176100 - protein, 18 aa, Cryptosporidium hominis
LFPSPSFPLPLSPLPSPP

SEQ ID NO: 2176101 - protein, 25 aa, Cryptosporidium hominis
LFPSWEYGLSLPLPVPFNHPDLLLN

SEQ ID NO: 2176102 - protein, 17 aa, Cryptosporidium hominis
LFPVQNIGIATFPGRTR

SEQ ID NO: 2176103 - protein, 28 aa, Cryptosporidium hominis
LFQDCIEAKAGLNLKCLSKLERCVNESK

SEQ ID NO: 2176104 - protein, 27 aa, Cryptosporidium hominis
LFQGKLKPWKGILLYGPPGTGKTFLAK

SEQ ID NO: 2176105 - protein, 23 aa, Cryptosporidium hominis
LFQRNQIKVAIHFYEMITSNRSN

SEQ ID NO: 2176106 - protein, 19 aa, Cryptosporidium hominis
LFQSGSCWHVDNILGSHII

SEQ ID NO: 2176107 - protein, 18 aa, Cryptosporidium hominis
LFRLVSTKDEFLCDSKMI

SEQ ID NO: 2176108 - protein, 21 aa, Cryptosporidium hominis
LFRRYCPDPLYLIADVTADDF

SEQ ID NO: 2176109 - protein, 17 aa, Cryptosporidium hominis
LFSAILLMGNFELGEHE

SEQ ID NO: 2176110 - protein, 18 aa, Cryptosporidium hominis
LFSFSKRKKFDIQINNSK

SEQ ID NO: 2176111 - protein, 21 aa, Cryptosporidium hominis
LFSNGMVKLSDFGISNILSSN

SEQ ID NO: 2176112 - protein, 18 aa, Cryptosporidium hominis
LFSPFSINITIGDDFFQS

SEQ ID NO: 2176113 - protein, 34 aa, Cryptosporidium hominis
LFSRSCLLFKYYCLRYPCLINYLFKLYSRIVDEI

SEQ ID NO: 2176114 - protein, 42 aa, Cryptosporidium hominis
LFTHLPVMRILVTALQRWDFRICGVYCLDVGFLTDASKFVAG

SEQ ID NO: 2176115 - protein, 18 aa, Cryptosporidium hominis
LFTKEMIEQFHAMSKDPM

SEQ ID NO: 2176116 - protein, 22 aa, Cryptosporidium hominis
LFTKQIRCCKASNDRKPLDIGA

SEQ ID NO: 2176117 - protein, 24 aa, Cryptosporidium hominis
LFTVFKRLLLYDSKAVRKCAVKVI

SEQ ID NO: 2176118 - protein, 19 aa, Cryptosporidium hominis
LFVKFSRLVVPVIKNSIDD

SEQ ID NO: 2176119 - protein, 17 aa, Cryptosporidium hominis
LFVLCSGNNVLSGSTSI

SEQ ID NO: 2176120 - protein, 22 aa, Cryptosporidium hominis
LGACAPAIFNYQIPYFQPYSLR

SEQ ID NO: 2176121 - protein, 25 aa, Cryptosporidium hominis
LGADMFDCVYPCRTARFGTAMVHNG

SEQ ID NO: 2176122 - protein, 25 aa, Cryptosporidium hominis
LGASFYRFIFNSVFFSKSNLNEKVL

SEQ ID NO: 2176123 - protein, 18 aa, Cryptosporidium hominis
LGCGSWGHTSTAEGIGVK

SEQ ID NO: 2176124 - protein, 27 aa, Cryptosporidium hominis
LGDDFLKEFALPKVRVFDNINICNMRE

SEQ ID NO: 2176125 - protein, 28 aa, Cryptosporidium hominis
LGDSRAILCKCGRAYSLTKDHRIKSNLE

SEQ ID NO: 2176126 - protein, 17 aa, Cryptosporidium hominis
LGDVMQIICKFVNKQDC

SEQ ID NO: 2176127 - protein, 22 aa, Cryptosporidium hominis
LGEDELRDAVLLVFANKQDLPN

SEQ ID NO: 2176128 - protein, 22 aa, Cryptosporidium hominis
LGEGLLKYTVEYVLINNMPDLL

SEQ ID NO: 2176129 - protein, 19 aa, Cryptosporidium hominis
LGERAIEFVSELWEYISKF

SEQ ID NO: 2176130 - protein, 20 aa, Cryptosporidium hominis
LGFFILWKIIEDFEPVISYD

SEQ ID NO: 2176131 - protein, 17 aa, Cryptosporidium hominis
LGGEIPRIVILGQQSMG

SEQ ID NO: 2176132 - protein, 25 aa, Cryptosporidium hominis
LGGFSQGSAIVFLISMASRKYTLGS

SEQ ID NO: 2176133 - protein, 25 aa, Cryptosporidium hominis
LGGIPRVGGISGIPGMAKGGIPGIG

SEQ ID NO: 2176134 - protein, 18 aa, Cryptosporidium hominis
LGGISSGLVISWNKDNLY

SEQ ID NO: 2176135 - protein, 26 aa, Cryptosporidium hominis
LGGNSRTIIICNCSPDKVNYYETLST

SEQ ID NO: 2176136 - protein, 19 aa, Cryptosporidium hominis
LGGVFTRLINRNTTIPTKK

SEQ ID NO: 2176137 - protein, 19 aa, Cryptosporidium hominis
LGGVMAIYGKENCGIDEII

SEQ ID NO: 2176138 - protein, 22 aa, Cryptosporidium hominis
LGHGRSSVVFSAIHKLSGKIVA

SEQ ID NO: 2176139 - protein, 28 aa, Cryptosporidium hominis
LGHLALAKQCYRGMMGVQGREFLIMGRN

SEQ ID NO: 2176140 - protein, 17 aa, Cryptosporidium hominis
LGHLRYLLTDVPPQPNS

SEQ ID NO: 2176141 - protein, 24 aa, Cryptosporidium hominis
LGHMAVKFGVSFGCEVAVITRSES

SEQ ID NO: 2176142 - protein, 26 aa, Cryptosporidium hominis
LGIEKQEQFYILAILLGCDYTVGVNG

SEQ ID NO: 2176143 - protein, 18 aa, Cryptosporidium hominis
LGILLKAGPITTITVKST

SEQ ID NO: 2176144 - protein, 17 aa, Cryptosporidium hominis
LGIPDIVDFPFPTPPEK

SEQ ID NO: 2176145 - protein, 23 aa, Cryptosporidium hominis
LGKELPGLYPVGVGAINALPNTN

SEQ ID NO: 2176146 - protein, 19 aa, Cryptosporidium hominis
LGKLCSLRGTITRTSDVRP

SEQ ID NO: 2176147 - protein, 17 aa, Cryptosporidium hominis
LGKLLSDLCKIKIINKI

SEQ ID NO: 2176148 - protein, 17 aa, Cryptosporidium hominis
LGKRVDLGVDIPISAIH

SEQ ID NO: 2176149 - protein, 24 aa, Cryptosporidium hominis
LGKSLEIITLILMNPRKEYYYYLN

SEQ ID NO: 2176150 - protein, 22 aa, Cryptosporidium hominis
LGKTLCKLWKNSAETIENRQII

SEQ ID NO: 2176151 - protein, 17 aa, Cryptosporidium hominis
LGLALNFSVFHYEILNE

SEQ ID NO: 2176152 - protein, 27 aa, Cryptosporidium hominis
LGLELDPGMELRIIWQRSSYTIQQYLR

SEQ ID NO: 2176153 - protein, 24 aa, Cryptosporidium hominis
LGLGSEFERVFSIAVEIATNDESE

SEQ ID NO: 2176154 - protein, 20 aa, Cryptosporidium hominis
LGLNCKFGLSHFNESIMANV

SEQ ID NO: 2176155 - protein, 28 aa, Cryptosporidium hominis
LGLNRFKIRAQCVLAMKAFEEEYQSCLE

SEQ ID NO: 2176156 - protein, 31 aa, Cryptosporidium hominis
LGLPSEVYIELSVGSWTYWVIPNFQKKISDS

SEQ ID NO: 2176157 - protein, 25 aa, Cryptosporidium hominis
LGLSLACAVSQGFSNIFITAPSAEN

SEQ ID NO: 2176158 - protein, 26 aa, Cryptosporidium hominis
LGMMKQRVGWMYGYYREDSTYPMGIR

SEQ ID NO: 2176159 - protein, 18 aa, Cryptosporidium hominis
LGMQLSVVEFCKNVLKLP

SEQ ID NO: 2176160 - protein, 18 aa, Cryptosporidium hominis
LGNASHILRIPKQGVGNM

SEQ ID NO: 2176161 - protein, 17 aa, Cryptosporidium hominis
LGNCIACNDYVALIHTD

SEQ ID NO: 2176162 - protein, 19 aa, Cryptosporidium hominis
LGNCLSAILILSGKEEIDG

SEQ ID NO: 2176163 - protein, 20 aa, Cryptosporidium hominis
LGNINCPIINHWRLNERHYG

SEQ ID NO: 2176164 - protein, 18 aa, Cryptosporidium hominis
LGNPRVRTNPALAAASTT

SEQ ID NO: 2176165 - protein, 20 aa, Cryptosporidium hominis
LGNSTPIWVHKLEKLLLNAQ

SEQ ID NO: 2176166 - protein, 17 aa, Cryptosporidium hominis
LGPILRPVSLKARNDEL

SEQ ID NO: 2176167 - protein, 19 aa, Cryptosporidium hominis
LGPKVPFCPMVASEVYSAE

SEQ ID NO: 2176168 - protein, 18 aa, Cryptosporidium hominis
LGRNSLYSPTSVLSLLNL

SEQ ID NO: 2176169 - protein, 27 aa, Cryptosporidium hominis
LGRPKVLILGTGWGFMKLAKGLDVNSN

SEQ ID NO: 2176170 - protein, 25 aa, Cryptosporidium hominis
LGSFSSILGYIPYNILLASENIQNE

SEQ ID NO: 2176171 - protein, 17 aa, Cryptosporidium hominis
LGSLIGVDESYIRRTNI

SEQ ID NO: 2176172 - protein, 17 aa, Cryptosporidium hominis
LGSSCFYIHARMLQSHR

SEQ ID NO: 2176173 - protein, 24 aa, Cryptosporidium hominis
LGSVCSGPLPGAKEVNFGDKIKLS

SEQ ID NO: 2176174 - protein, 17 aa, Cryptosporidium hominis
LGSVIVYELVSRQQTRI

SEQ ID NO: 2176175 - protein, 27 aa, Cryptosporidium hominis
LGTGIIGRFFIFSSFNHRGNELMLTQF

SEQ ID NO: 2176176 - protein, 17 aa, Cryptosporidium hominis
LGVGFGRLKQIFGSFSD

SEQ ID NO: 2176177 - protein, 20 aa, Cryptosporidium hominis
LGVGGPNFAAPTMLAHPDEF

SEQ ID NO: 2176178 - protein, 20 aa, Cryptosporidium hominis
LGVLEIPECFLSKYGDMIRH

SEQ ID NO: 2176179 - protein, 25 aa, Cryptosporidium hominis
LGYFPEIRAFVALDLSSSFDELYKS

SEQ ID NO: 2176180 - protein, 20 aa, Cryptosporidium hominis
LGYQYAINWAGGLHHGKKHE

SEQ ID NO: 2176181 - protein, 20 aa, Cryptosporidium hominis
LHALRFKKPLLQPFNTIREQ

SEQ ID NO: 2176182 - protein, 19 aa, Cryptosporidium hominis
LHCNAIKMVSEVFKYSPSP

SEQ ID NO: 2176183 - protein, 25 aa, Cryptosporidium hominis
LHELGIKCFITISGSGLKFIPVDET

SEQ ID NO: 2176184 - protein, 30 aa, Cryptosporidium hominis
LHERIYPSPLNEIVKILNMHQLTLQSIESE

SEQ ID NO: 2176185 - protein, 19 aa, Cryptosporidium hominis
LHESWICLVTLIFQMKDLI

SEQ ID NO: 2176186 - protein, 18 aa, Cryptosporidium hominis
LHFKEIIGHSKKRLMTSS

SEQ ID NO: 2176187 - protein, 17 aa, Cryptosporidium hominis
LHGELHIALDNITPHWS

SEQ ID NO: 2176188 - protein, 19 aa, Cryptosporidium hominis
LHHLKAYRSFNNGNTSGNS

SEQ ID NO: 2176189 - protein, 25 aa, Cryptosporidium hominis
LHHNEIMSRLGFYDSVKGAELAGHR

SEQ ID NO: 2176190 - protein, 20 aa, Cryptosporidium hominis
LHIMSHPWLLAINNLTNIDI

SEQ ID NO: 2176191 - protein, 31 aa, Cryptosporidium hominis
LHINRSTNMLKMYLKQRIMKISEFPDFSIAN

SEQ ID NO: 2176192 - protein, 23 aa, Cryptosporidium hominis
LHKKLCSDFNKFGRYSEIKSYFT

SEQ ID NO: 2176193 - protein, 21 aa, Cryptosporidium hominis
LHLKGLCHLDFTPENILIGPN

SEQ ID NO: 2176194 - protein, 38 aa, Cryptosporidium hominis
LHLKRRLTKRLGIKLLKLLKLLLEFTKEYGYIKDIESN

SEQ ID NO: 2176195 - protein, 25 aa, Cryptosporidium hominis
LHMPEHPFIIASRVVNGDILVFDYS

SEQ ID NO: 2176196 - protein, 20 aa, Cryptosporidium hominis
LHPYLRSDFREIIFKVQCLW

SEQ ID NO: 2176197 - protein, 17 aa, Cryptosporidium hominis
LHQLKRKTPEPMKGMQI

SEQ ID NO: 2176198 - protein, 17 aa, Cryptosporidium hominis
LHSAALIISQELNEQNN

SEQ ID NO: 2176199 - protein, 19 aa, Cryptosporidium hominis
LHSAMPFSSNIGINLLQKM

SEQ ID NO: 2176200 - protein, 18 aa, Cryptosporidium hominis
LHSGIKGKMSGDCSESTN

SEQ ID NO: 2176201 - protein, 17 aa, Cryptosporidium hominis
LHSINLPTGLKCGNPSA

SEQ ID NO: 2176202 - protein, 25 aa, Cryptosporidium hominis
LHSKELRNPLSFFFGHLNVTDDLQL

SEQ ID NO: 2176203 - protein, 26 aa, Cryptosporidium hominis
LHSLKYKFKYEIPREKAIKMIKQLIK

SEQ ID NO: 2176204 - protein, 18 aa, Cryptosporidium hominis
LHSLNGHSGQINRLSFLL

SEQ ID NO: 2176205 - protein, 17 aa, Cryptosporidium hominis
LHSPRAQLLFSKQTEEI

SEQ ID NO: 2176206 - protein, 19 aa, Cryptosporidium hominis
LHTFCKACIIEHIESKGAE

SEQ ID NO: 2176207 - protein, 20 aa, Cryptosporidium hominis
LHTLSPPLIRFSELGRSRVH

SEQ ID NO: 2176208 - protein, 24 aa, Cryptosporidium hominis
LHYKGCKFHRIIPEFMCQGGDISS

SEQ ID NO: 2176209 - protein, 27 aa, Cryptosporidium hominis
LHYSSLKLRLIFRFILKSMEVSNARKI

SEQ ID NO: 2176210 - protein, 19 aa, Cryptosporidium hominis
LIAACGFGSGGALKLICNG

SEQ ID NO: 2176211 - protein, 19 aa, Cryptosporidium hominis
LIAILRSSQLVEILENMLR

SEQ ID NO: 2176212 - protein, 19 aa, Cryptosporidium hominis
LIAIPLFMPCNGRAAWGKE

SEQ ID NO: 2176213 - protein, 23 aa, Cryptosporidium hominis
LIAKKCGYIPIEMNASDDRTKEV

SEQ ID NO: 2176214 - protein, 30 aa, Cryptosporidium hominis
LIANNCFDVIFAFDEIVSFGYRESINLSQI

SEQ ID NO: 2176215 - protein, 19 aa, Cryptosporidium hominis
LICDSCQGTTCKISKVGVM

SEQ ID NO: 2176216 - protein, 22 aa, Cryptosporidium hominis
LIDCIIKGIGFHHSGLSHIERR

SEQ ID NO: 2176217 - protein, 25 aa, Cryptosporidium hominis
LIDCPSELFSTLLLNPDLESLSVQK

SEQ ID NO: 2176218 - protein, 20 aa, Cryptosporidium hominis
LIDIYIQGVLLFLLEHVEST

SEQ ID NO: 2176219 - protein, 25 aa, Cryptosporidium hominis
LIDSFRFERGLSLFLEIPKETIKYI

SEQ ID NO: 2176220 - protein, 24 aa, Cryptosporidium hominis
LIDYRNKYKIAICEGDLNTDITDK

SEQ ID NO: 2176221 - protein, 18 aa, Cryptosporidium hominis
LIEADFYLLESLCSILSN

SEQ ID NO: 2176222 - protein, 25 aa, Cryptosporidium hominis
LIEAFKVFDRDGNGFISAAELRHVM

SEQ ID NO: 2176223 - protein, 18 aa, Cryptosporidium hominis
LIEEYIRCNNSCPITKSE

SEQ ID NO: 2176224 - protein, 20 aa, Cryptosporidium hominis
LIEGYSVPFPYDAYKCQINY

SEQ ID NO: 2176225 - protein, 22 aa, Cryptosporidium hominis
LIEHISSLMLKNQVRTYDKVDS

SEQ ID NO: 2176226 - protein, 25 aa, Cryptosporidium hominis
LIEIGPRFVLEPILILDGTFSGQVL

SEQ ID NO: 2176227 - protein, 19 aa, Cryptosporidium hominis
LIEKCLIHLFSDFSGKPNI

SEQ ID NO: 2176228 - protein, 19 aa, Cryptosporidium hominis
LIELYKLYSNFIAGEVQRK

SEQ ID NO: 2176229 - protein, 18 aa, Cryptosporidium hominis
LIEYYSALHESRKALQKK

SEQ ID NO: 2176230 - protein, 33 aa, Cryptosporidium hominis
LIFGDLRPSWSLYYLLKKIICKEMSGYYVQEKE

SEQ ID NO: 2176231 - protein, 17 aa, Cryptosporidium hominis
LIFKCKVLPDWIANNTN

SEQ ID NO: 2176232 - protein, 17 aa, Cryptosporidium hominis
LIFKIVLLLLDELEKSS

SEQ ID NO: 2176233 - protein, 18 aa, Cryptosporidium hominis
LIGNGVANMFLISSQKTT

SEQ ID NO: 2176234 - protein, 17 aa, Cryptosporidium hominis
LIHFGYSCYHNIRNFRL

SEQ ID NO: 2176235 - protein, 18 aa, Cryptosporidium hominis
LIHGSCKEGNDCGEYYTP

SEQ ID NO: 2176236 - protein, 23 aa, Cryptosporidium hominis
LIHRPELDPSQGITIASIQHQLV

SEQ ID NO: 2176237 - protein, 17 aa, Cryptosporidium hominis
LIIEHCLSVKAYRELLG

SEQ ID NO: 2176238 - protein, 18 aa, Cryptosporidium hominis
LIIEVIKSLLMLCERKRG

SEQ ID NO: 2176239 - protein, 27 aa, Cryptosporidium hominis
LIIKWPKYDKLFIGNWIDTDAFAEYKT

SEQ ID NO: 2176240 - protein, 18 aa, Cryptosporidium hominis
LIIMSATLRVTDFSENPK

SEQ ID NO: 2176241 - protein, 18 aa, Cryptosporidium hominis
LIINEYIDLVIISHYHLD

SEQ ID NO: 2176242 - protein, 17 aa, Cryptosporidium hominis
LIIPKINTLISIESEVA

SEQ ID NO: 2176243 - protein, 24 aa, Cryptosporidium hominis
LIIQRSLVKLSLREKPVYRILACY

SEQ ID NO: 2176244 - protein, 25 aa, Cryptosporidium hominis
LIIVWYRIMHDYSRMIDCYNGDFKE

SEQ ID NO: 2176245 - protein, 19 aa, Cryptosporidium hominis
LIKALICITSPNSLSQEDE

SEQ ID NO: 2176246 - protein, 18 aa, Cryptosporidium hominis
LIKESRQVVNIVSERTLI

SEQ ID NO: 2176247 - protein, 30 aa, Cryptosporidium hominis
LIKKILPWEIELEIIPWSLLFGDSLSNKLF

SEQ ID NO: 2176248 - protein, 17 aa, Cryptosporidium hominis
LIKLHALTPRTNNLLDD

SEQ ID NO: 2176249 - protein, 41 aa, Cryptosporidium hominis
LIKLSLGIHCSFRFVNIVRYFRYFRKCFGIISNLIKDENNS

SEQ ID NO: 2176250 - protein, 23 aa, Cryptosporidium hominis
LIKMSLFTCLNRNRGLFEIIIFN

SEQ ID NO: 2176251 - protein, 24 aa, Cryptosporidium hominis
LIKNIKQNFIWESIEVTWKQEESN

SEQ ID NO: 2176252 - protein, 23 aa, Cryptosporidium hominis
LIKSFLPEFWPAYEPSSSLELFS

SEQ ID NO: 2176253 - protein, 17 aa, Cryptosporidium hominis
LIKSMKTGISNFAKNKG

SEQ ID NO: 2176254 - protein, 19 aa, Cryptosporidium hominis
LIKVAAFRSKGRIPILSWT

SEQ ID NO: 2176255 - protein, 25 aa, Cryptosporidium hominis
LILNHQRLPLLFKAVVDSRNILNSK

SEQ ID NO: 2176256 - protein, 24 aa, Cryptosporidium hominis
LILPPRWDPLDGRLDHEFDHARYI

SEQ ID NO: 2176257 - protein, 18 aa, Cryptosporidium hominis
LILYILKMYCIKTISCTF

SEQ ID NO: 2176258 - protein, 18 aa, Cryptosporidium hominis
LIMIEGRLKNSILDLNKL

SEQ ID NO: 2176259 - protein, 17 aa, Cryptosporidium hominis
LIMLCGLGSSGKTSIIK

SEQ ID NO: 2176260 - protein, 18 aa, Cryptosporidium hominis
LINAHLWRDTTIEELDLA

SEQ ID NO: 2176261 - protein, 17 aa, Cryptosporidium hominis
LINAISEKVFNFKKNNT

SEQ ID NO: 2176262 - protein, 19 aa, Cryptosporidium hominis
LINEKYYFFQIQYIKENKL

SEQ ID NO: 2176263 - protein, 27 aa, Cryptosporidium hominis
LINKNNGSCPFCFFKGNNKGQKSSISI

SEQ ID NO: 2176264 - protein, 18 aa, Cryptosporidium hominis
LINSIRFDKDFQHYDNEE

SEQ ID NO: 2176265 - protein, 23 aa, Cryptosporidium hominis
LINSKRFGFQFVSKTANPHEILM

SEQ ID NO: 2176266 - protein, 22 aa, Cryptosporidium hominis
LIPFDSALCIYDHNCPPTIEED

SEQ ID NO: 2176267 - protein, 22 aa, Cryptosporidium hominis
LIPKWVASKWISFYGSIRPTIA

SEQ ID NO: 2176268 - protein, 19 aa, Cryptosporidium hominis
LIPPFPQVSGIPMFEDGTP

SEQ ID NO: 2176269 - protein, 18 aa, Cryptosporidium hominis
LIPYLRINSKIIIENVNK

SEQ ID NO: 2176270 - protein, 23 aa, Cryptosporidium hominis
LIQAFAGICSYITFNEPTDRREI

SEQ ID NO: 2176271 - protein, 18 aa, Cryptosporidium hominis
LIQDLSICECWIKSVKGD

SEQ ID NO: 2176272 - protein, 23 aa, Cryptosporidium hominis
LIQGGLLPGLGIPITQPGVPGVP

SEQ ID NO: 2176273 - protein, 17 aa, Cryptosporidium hominis
LIQILVYEVVSRFVYGI

SEQ ID NO: 2176274 - protein, 24 aa, Cryptosporidium hominis
LIQKQESCIFCIIQTHIEELEYSL

SEQ ID NO: 2176275 - protein, 18 aa, Cryptosporidium hominis
LIQLKSDKKYEFVKIEQA

SEQ ID NO: 2176276 - protein, 31 aa, Cryptosporidium hominis
LIQMGVKFQFSENMGSFSLYLGNKLPNRLED

SEQ ID NO: 2176277 - protein, 18 aa, Cryptosporidium hominis
LIQSILWKIIKFAHKSNI

SEQ ID NO: 2176278 - protein, 26 aa, Cryptosporidium hominis
LIQSLRMIQKIDQFRVGSIDQSSDIK

SEQ ID NO: 2176279 - protein, 27 aa, Cryptosporidium hominis
LIRCLRRNGTLLIYVWAFEQKKGTVGS

SEQ ID NO: 2176280 - protein, 20 aa, Cryptosporidium hominis
LIRETCGFSSNNECPESTLY

SEQ ID NO: 2176281 - protein, 28 aa, Cryptosporidium hominis
LIRFTKMYYPHYICVGISDRKSLELAGL

SEQ ID NO: 2176282 - protein, 19 aa, Cryptosporidium hominis
LIRKIAWSPCGGMIISASF

SEQ ID NO: 2176283 - protein, 24 aa, Cryptosporidium hominis
LIRLEDFPCIIFSQNCFPTSNNKF

SEQ ID NO: 2176284 - protein, 19 aa, Cryptosporidium hominis
LIRMTRELVPSSLLVHQKI

SEQ ID NO: 2176285 - protein, 17 aa, Cryptosporidium hominis
LISCLDINEGKKQKINE

SEQ ID NO: 2176286 - protein, 22 aa, Cryptosporidium hominis
LISENELDFSLNIESSSKNMLV

SEQ ID NO: 2176287 - protein, 35 aa, Cryptosporidium hominis
LISGVKGLSFLSALELRSTLSVKTPNQFLMIPKKI

SEQ ID NO: 2176288 - protein, 18 aa, Cryptosporidium hominis
LISKIGLLNLNINRLNKA

SEQ ID NO: 2176289 - protein, 18 aa, Cryptosporidium hominis
LISKLAPNYKILVSCFKQ

SEQ ID NO: 2176290 - protein, 18 aa, Cryptosporidium hominis
LISKMICFGLKFEDQTRG

SEQ ID NO: 2176291 - protein, 22 aa, Cryptosporidium hominis
LISLPLKLRFHCENLEKQPNSI

SEQ ID NO: 2176292 - protein, 19 aa, Cryptosporidium hominis
LISNTSMAIEWTFEDVQAM

SEQ ID NO: 2176293 - protein, 23 aa, Cryptosporidium hominis
LISRLEYYEDFNLLSKRITRDNQ

SEQ ID NO: 2176294 - protein, 23 aa, Cryptosporidium hominis
LISRPLPLSHEWIVWEQLNVETR

SEQ ID NO: 2176295 - protein, 18 aa, Cryptosporidium hominis
LISSKCIRETIKSTMATM

SEQ ID NO: 2176296 - protein, 21 aa, Cryptosporidium hominis
LISSPLLCYGSMKMNSDISRF

SEQ ID NO: 2176297 - protein, 22 aa, Cryptosporidium hominis
LITEGNCDVFVEIIAKEDLENA

SEQ ID NO: 2176298 - protein, 26 aa, Cryptosporidium hominis
LITEVLKRLTILGVLDDAIFDIPNAI

SEQ ID NO: 2176299 - protein, 19 aa, Cryptosporidium hominis
LITIYRCGFASSIVIQNFI

SEQ ID NO: 2176300 - protein, 25 aa, Cryptosporidium hominis
LITKFKACRVFKDAITPISNMDWSE

SEQ ID NO: 2176301 - protein, 22 aa, Cryptosporidium hominis
LITSAWWSPGIDTYRIAASKIK

SEQ ID NO: 2176302 - protein, 18 aa, Cryptosporidium hominis
LIVENCKIYNGINHPLVS

SEQ ID NO: 2176303 - protein, 25 aa, Cryptosporidium hominis
LIVHWDLSKDSGFEVLKNLRKRFYS

SEQ ID NO: 2176304 - protein, 21 aa, Cryptosporidium hominis
LIVILHLHLKHSIWLGKKKTQ

SEQ ID NO: 2176305 - protein, 17 aa, Cryptosporidium hominis
LIVSQCPGVVRLHKIVV

SEQ ID NO: 2176306 - protein, 18 aa, Cryptosporidium hominis
LIYIGHCARYTQIRKYNQ

SEQ ID NO: 2176307 - protein, 20 aa, Cryptosporidium hominis
LKAHNGVVYDLRIIGDGAGI

SEQ ID NO: 2176308 - protein, 24 aa, Cryptosporidium hominis
LKAIKRLLPTVGKYIIKLTRLQRM

SEQ ID NO: 2176309 - protein, 17 aa, Cryptosporidium hominis
LKAKLLQAITEGKEGFA

SEQ ID NO: 2176310 - protein, 23 aa, Cryptosporidium hominis
LKALDFRMVDFIKAAINPDTTKY

SEQ ID NO: 2176311 - protein, 17 aa, Cryptosporidium hominis
LKALQLFDSSNELDLSP

SEQ ID NO: 2176312 - protein, 20 aa, Cryptosporidium hominis
LKANVIFTDPYFRYRTDFVL

SEQ ID NO: 2176313 - protein, 22 aa, Cryptosporidium hominis
LKCKIEGLYYGHLISLENKTID

SEQ ID NO: 2176314 - protein, 25 aa, Cryptosporidium hominis
LKCPILMVLHIWKAYVYFNYQENNT

SEQ ID NO: 2176315 - protein, 22 aa, Cryptosporidium hominis
LKDADFCLLDSTGIKGPKEFET

SEQ ID NO: 2176316 - protein, 19 aa, Cryptosporidium hominis
LKDCKSCCVLVTGPNDHSI

SEQ ID NO: 2176317 - protein, 19 aa, Cryptosporidium hominis
LKDEFVSICLVRDIHNSKE

SEQ ID NO: 2176318 - protein, 22 aa, Cryptosporidium hominis
LKDLQIQVCEEVEKLLEPFKED

SEQ ID NO: 2176319 - protein, 18 aa, Cryptosporidium hominis
LKDQLKEIKKSGAPSEEI

SEQ ID NO: 2176320 - protein, 20 aa, Cryptosporidium hominis
LKDRLSLFMDEYLKYSNDDV

SEQ ID NO: 2176321 - protein, 21 aa, Cryptosporidium hominis
LKDSMSRRFEWLLDKNFTNKI

SEQ ID NO: 2176322 - protein, 23 aa, Cryptosporidium hominis
LKDTGNCIPLKFDSKKSKEDFLN

SEQ ID NO: 2176323 - protein, 32 aa, Cryptosporidium hominis
LKDYQRYGVHWLLCAFSIKGGAILADEMGLGK

SEQ ID NO: 2176324 - protein, 17 aa, Cryptosporidium hominis
LKDYRVVTIRVACRLLI

SEQ ID NO: 2176325 - protein, 21 aa, Cryptosporidium hominis
LKEAEDLALIVLRQVMEEKIN

SEQ ID NO: 2176326 - protein, 18 aa, Cryptosporidium hominis
LKEALRKAFKARTSLLLG

SEQ ID NO: 2176327 - protein, 23 aa, Cryptosporidium hominis
LKEDYKILIGKYLPFFTARDNYM

SEQ ID NO: 2176328 - protein, 17 aa, Cryptosporidium hominis
LKEENAWGIVRALVDLL

SEQ ID NO: 2176329 - protein, 31 aa, Cryptosporidium hominis
LKEIKMKRLSLKRRLYLKGYFDITDFDDIEQ

SEQ ID NO: 2176330 - protein, 17 aa, Cryptosporidium hominis
LKEILLFLENSLVALNE

SEQ ID NO: 2176331 - protein, 17 aa, Cryptosporidium hominis
LKEILPCGIGIHHAGLV

SEQ ID NO: 2176332 - protein, 19 aa, Cryptosporidium hominis
LKEKVGMKINCDRNLSNVI

SEQ ID NO: 2176333 - protein, 23 aa, Cryptosporidium hominis
LKELGPRISMRLVKVVDEVCDGA

SEQ ID NO: 2176334 - protein, 18 aa, Cryptosporidium hominis
LKELLTFGNRVEKMDVDA

SEQ ID NO: 2176335 - protein, 18 aa, Cryptosporidium hominis
LKELPKLETLSLLLNPIA

SEQ ID NO: 2176336 - protein, 24 aa, Cryptosporidium hominis
LKELVQRGPHEWPGATSIIQEDGT

SEQ ID NO: 2176337 - protein, 19 aa, Cryptosporidium hominis
LKENLWYSIEKNISLLYDR

SEQ ID NO: 2176338 - protein, 26 aa, Cryptosporidium hominis
LKENPRKVCLMDAVLKEGELEEEAIN

SEQ ID NO: 2176339 - protein, 25 aa, Cryptosporidium hominis
LKESYIGRVCLFDIIENLQVFIDDI

SEQ ID NO: 2176340 - protein, 34 aa, Cryptosporidium hominis
LKESYNNRVFKEWKEIIIPLLPLILTYYYDSIDE

SEQ ID NO: 2176341 - protein, 23 aa, Cryptosporidium hominis
LKEYSLKGLMEFMNGFSPKSQWK

SEQ ID NO: 2176342 - protein, 22 aa, Cryptosporidium hominis
LKFDLPNKWRFFYLNITNYEIV

SEQ ID NO: 2176343 - protein, 20 aa, Cryptosporidium hominis
LKFELKCYLTHFDLYLYILF

SEQ ID NO: 2176344 - protein, 34 aa, Cryptosporidium hominis
LKFELPPVLVKSLRTPSWGIPWTLQTDIDILKGI

SEQ ID NO: 2176345 - protein, 25 aa, Cryptosporidium hominis
LKFFIQEIFLSLGILIGNIEVEYIT

SEQ ID NO: 2176346 - protein, 27 aa, Cryptosporidium hominis
LKFINKWYLPNNMCLFIVGDIPASNEL

SEQ ID NO: 2176347 - protein, 26 aa, Cryptosporidium hominis
LKFIYCVLRVKIEWINEYLKYIACNI

SEQ ID NO: 2176348 - protein, 19 aa, Cryptosporidium hominis
LKFKDKISKIILDSRKIGS

SEQ ID NO: 2176349 - protein, 35 aa, Cryptosporidium hominis
LKFKHLEFFNTLLIRLEKFLSWIAKNNIQEYGVNN

SEQ ID NO: 2176350 - protein, 22 aa, Cryptosporidium hominis
LKFNHLRTTFLLEHISNKSASL

SEQ ID NO: 2176351 - protein, 17 aa, Cryptosporidium hominis
LKFVGVSSFLGTGMKSF

SEQ ID NO: 2176352 - protein, 20 aa, Cryptosporidium hominis
LKGFAPFLDVYWKGDITFRI

SEQ ID NO: 2176353 - protein, 18 aa, Cryptosporidium hominis
LKGGVGVIDCSWNKIDQV

SEQ ID NO: 2176354 - protein, 23 aa, Cryptosporidium hominis
LKGKAYRWLKIVQEHWAMQDRFC

SEQ ID NO: 2176355 - protein, 23 aa, Cryptosporidium hominis
LKGKKRRDTICIVLVDPDLEEGK

SEQ ID NO: 2176356 - protein, 22 aa, Cryptosporidium hominis
LKGLVMDLRYLMSPWSAIKLQE

SEQ ID NO: 2176357 - protein, 20 aa, Cryptosporidium hominis
LKGLYKENVLDFNINGFDDF

SEQ ID NO: 2176358 - protein, 24 aa, Cryptosporidium hominis
LKGNKICGINAFRTDNEISHDDRH

SEQ ID NO: 2176359 - protein, 20 aa, Cryptosporidium hominis
LKGRDIHSLSYWYIPNSVKH

SEQ ID NO: 2176360 - protein, 19 aa, Cryptosporidium hominis
LKGRIRIGSKSIIIEPDDS

SEQ ID NO: 2176361 - protein, 17 aa, Cryptosporidium hominis
LKGRPIRVGRPTNAASS

SEQ ID NO: 2176362 - protein, 23 aa, Cryptosporidium hominis
LKGSKCRLYLFGEVFEQFQNELI

SEQ ID NO: 2176363 - protein, 20 aa, Cryptosporidium hominis
LKGSLLGRKVIDFSSLNGEF

SEQ ID NO: 2176364 - protein, 22 aa, Cryptosporidium hominis
LKGYCKSFFLNTIISHDNINQV

SEQ ID NO: 2176365 - protein, 17 aa, Cryptosporidium hominis
LKHILCNIGEKLTVSYI

SEQ ID NO: 2176366 - protein, 25 aa, Cryptosporidium hominis
LKHLSLKKSGSWNDFLSFLYSKGHS

SEQ ID NO: 2176367 - protein, 18 aa, Cryptosporidium hominis
LKIDIKKFEFSIGKETIR

SEQ ID NO: 2176368 - protein, 30 aa, Cryptosporidium hominis
LKIDPRCHRAHWGIGYVWFKREEYYQAKSH

SEQ ID NO: 2176369 - protein, 39 aa, Cryptosporidium hominis
LKIFDFENELWKANVINVLKRFDQSWVEFEREYITELIA

SEQ ID NO: 2176370 - protein, 17 aa, Cryptosporidium hominis
LKIPFNSFEEIKQEIYN

SEQ ID NO: 2176371 - protein, 24 aa, Cryptosporidium hominis
LKIPIKCDDQIYLYLGNCQSKHEF

SEQ ID NO: 2176372 - protein, 23 aa, Cryptosporidium hominis
LKIPKLTVCALRFTETARKHIEK

SEQ ID NO: 2176373 - protein, 19 aa, Cryptosporidium hominis
LKIPPMEAESVPPIKKEVD

SEQ ID NO: 2176374 - protein, 20 aa, Cryptosporidium hominis
LKIQGGGALARLVRKNKDKL

SEQ ID NO: 2176375 - protein, 22 aa, Cryptosporidium hominis
LKIRDGYSLFKIVFSGDTATPC

SEQ ID NO: 2176376 - protein, 19 aa, Cryptosporidium hominis
LKIRIPKSLWEYWEAFAND

SEQ ID NO: 2176377 - protein, 28 aa, Cryptosporidium hominis
LKISLIQIFRAHLWQKIHESIVMDICQV

SEQ ID NO: 2176378 - protein, 24 aa, Cryptosporidium hominis
LKISRDICCGMAYLHENGVLHCDL

SEQ ID NO: 2176379 - protein, 28 aa, Cryptosporidium hominis
LKIVKSIISWLYVNGCIEVKYSTNAPND

SEQ ID NO: 2176380 - protein, 21 aa, Cryptosporidium hominis
LKIVLKKDFSVTVMKKEADTS

SEQ ID NO: 2176381 - protein, 32 aa, Cryptosporidium hominis
LKIWYTKNGLKWCRNNETCICMRNSVLAHYLI

SEQ ID NO: 2176382 - protein, 27 aa, Cryptosporidium hominis
LKKAAEISRPLSLQAYADVLTHLISAQ

SEQ ID NO: 2176383 - protein, 26 aa, Cryptosporidium hominis
LKKACSIRKIKIYFCPINEMEIRKNN

SEQ ID NO: 2176384 - protein, 19 aa, Cryptosporidium hominis
LKKAFLKAAEGLDESEDEL

SEQ ID NO: 2176385 - protein, 26 aa, Cryptosporidium hominis
LKKDPVQRLLILLAHVYLTKPMTRNS

SEQ ID NO: 2176386 - protein, 23 aa, Cryptosporidium hominis
LKKFFKPRYSYGLPDMNGPNFRV

SEQ ID NO: 2176387 - protein, 19 aa, Cryptosporidium hominis
LKKGCKGSMSIQNGLEKAK

SEQ ID NO: 2176388 - protein, 17 aa, Cryptosporidium hominis
LKKHVFLLLKLKIDKKN

SEQ ID NO: 2176389 - protein, 21 aa, Cryptosporidium hominis
LKKIQELAEDFSIKRQKKYTE

SEQ ID NO: 2176390 - protein, 18 aa, Cryptosporidium hominis
LKKIRDIEEYRKLRKQGN

SEQ ID NO: 2176391 - protein, 17 aa, Cryptosporidium hominis
LKKIVTFGLPFVPFSIR

SEQ ID NO: 2176392 - protein, 17 aa, Cryptosporidium hominis
LKKKFKSGVIKKNKHVS

SEQ ID NO: 2176393 - protein, 17 aa, Cryptosporidium hominis
LKKKIGLNNNNSNNNNS

SEQ ID NO: 2176394 - protein, 20 aa, Cryptosporidium hominis
LKKKLQVFLASPLCKESYNE

SEQ ID NO: 2176395 - protein, 31 aa, Cryptosporidium hominis
LKKKMIELILIKKFKDFYILIMKNYGIKMNH

SEQ ID NO: 2176396 - protein, 17 aa, Cryptosporidium hominis
LKKLALTCVAYHLNDAD

SEQ ID NO: 2176397 - protein, 22 aa, Cryptosporidium hominis
LKKLLGLGLCNSFDDIAAGNGK

SEQ ID NO: 2176398 - protein, 18 aa, Cryptosporidium hominis
LKKLVPIMDLQKEFESRQ

SEQ ID NO: 2176399 - protein, 17 aa, Cryptosporidium hominis
LKKRKKRSYNLTDDESD

SEQ ID NO: 2176400 - protein, 26 aa, Cryptosporidium hominis
LKKRSFPTEFMKLMVIDEADEMIDHR

SEQ ID NO: 2176401 - protein, 25 aa, Cryptosporidium hominis
LKKRVCGYLYDYLCEDEISEILYNS

SEQ ID NO: 2176402 - protein, 30 aa, Cryptosporidium hominis
LKKSDFCDFKKVSLLPLLFGETTCNQQLTN

SEQ ID NO: 2176403 - protein, 17 aa, Cryptosporidium hominis
LKKYLGEYFIKKQEELA

SEQ ID NO: 2176404 - protein, 18 aa, Cryptosporidium hominis
LKLDKMIIKGSARDDNHN

SEQ ID NO: 2176405 - protein, 25 aa, Cryptosporidium hominis
LKLDLFKIGLFLLQGKTKKAVQYIN

SEQ ID NO: 2176406 - protein, 21 aa, Cryptosporidium hominis
LKLEEFGLHFTLEKLFGDVPG

SEQ ID NO: 2176407 - protein, 21 aa, Cryptosporidium hominis
LKLEVFLVFKSGLDPNSELFE

SEQ ID NO: 2176408 - protein, 20 aa, Cryptosporidium hominis
LKLGCKRLILVGDPKQLPAT

SEQ ID NO: 2176409 - protein, 20 aa, Cryptosporidium hominis
LKLGSKTRCISKIIENLNLI

SEQ ID NO: 2176410 - protein, 17 aa, Cryptosporidium hominis
LKLGSSSSIEWNPSGVE

SEQ ID NO: 2176411 - protein, 25 aa, Cryptosporidium hominis
LKLHAYLEFWGLINFQADIKTLPPK

SEQ ID NO: 2176412 - protein, 19 aa, Cryptosporidium hominis
LKLKEKFLEFNRQTLESSS

SEQ ID NO: 2176413 - protein, 24 aa, Cryptosporidium hominis
LKLKQKECLDYSSKIQQIELEMRK

SEQ ID NO: 2176414 - protein, 18 aa, Cryptosporidium hominis
LKLKSAFNGKEFEHETFN

SEQ ID NO: 2176415 - protein, 34 aa, Cryptosporidium hominis
LKLLKELFNAVLYLFNPCWTFTLSSKTDIFDKEK

SEQ ID NO: 2176416 - protein, 24 aa, Cryptosporidium hominis
LKLLLDFLDYTVFLYGDFSAGSCP

SEQ ID NO: 2176417 - protein, 20 aa, Cryptosporidium hominis
LKLLPQFKGLSVGEKVQVLF

SEQ ID NO: 2176418 - protein, 21 aa, Cryptosporidium hominis
LKLLSPEIIKQITLANKIVLN

SEQ ID NO: 2176419 - protein, 24 aa, Cryptosporidium hominis
LKLLSPKSHLFCLVHKMDKLSAIE

SEQ ID NO: 2176420 - protein, 17 aa, Cryptosporidium hominis
LKLMKSVHLTKDRIEFM

SEQ ID NO: 2176421 - protein, 20 aa, Cryptosporidium hominis
LKLQKKLLFFVTGSDRVPMK

SEQ ID NO: 2176422 - protein, 27 aa, Cryptosporidium hominis
LKLWLLCWPSPISLCSIDERFRQTVLE

SEQ ID NO: 2176423 - protein, 28 aa, Cryptosporidium hominis
LKLYVASCYYFGDISTFLPIGAKSIQRK

SEQ ID NO: 2176424 - protein, 23 aa, Cryptosporidium hominis
LKMLFESVAVLPLIDQWVKGKYF

SEQ ID NO: 2176425 - protein, 19 aa, Cryptosporidium hominis
LKMYCIKTISCTFGQEFYL

SEQ ID NO: 2176426 - protein, 23 aa, Cryptosporidium hominis
LKNACKRNVILAGDFNIILEKID

SEQ ID NO: 2176427 - protein, 18 aa, Cryptosporidium hominis
LKNDLKLIQIFERETKSM

SEQ ID NO: 2176428 - protein, 18 aa, Cryptosporidium hominis
LKNELSLLLSGEESVTAP

SEQ ID NO: 2176429 - protein, 22 aa, Cryptosporidium hominis
LKNHGLNKMALIISQERENKRI

SEQ ID NO: 2176430 - protein, 19 aa, Cryptosporidium hominis
LKNILKACGLKSSTNTSSN

SEQ ID NO: 2176431 - protein, 18 aa, Cryptosporidium hominis
LKNIRIVKKLGGTVEDTE

SEQ ID NO: 2176432 - protein, 18 aa, Cryptosporidium hominis
LKNLRNLQTLYLERNPIQ

SEQ ID NO: 2176433 - protein, 17 aa, Cryptosporidium hominis
LKNLYDWQYECITQPGV

SEQ ID NO: 2176434 - protein, 25 aa, Cryptosporidium hominis
LKNNVILTRSWVCKLYILSGITGKD

SEQ ID NO: 2176435 - protein, 20 aa, Cryptosporidium hominis
LKNPAIEVSFGFDTAARTYA

SEQ ID NO: 2176436 - protein, 20 aa, Cryptosporidium hominis
LKNPLPLKITKIRVNDLEMK

SEQ ID NO: 2176437 - protein, 23 aa, Cryptosporidium hominis
LKNSNEGFAIAINRNNDEAIIQV

SEQ ID NO: 2176438 - protein, 31 aa, Cryptosporidium hominis
LKNVILRPSIDRWREEWTKRLEASKDDDNEL

SEQ ID NO: 2176439 - protein, 17 aa, Cryptosporidium hominis
LKNWKDKYMNKKHRQND

SEQ ID NO: 2176440 - protein, 17 aa, Cryptosporidium hominis
LKPFDWNTLFETNDDRN

SEQ ID NO: 2176441 - protein, 22 aa, Cryptosporidium hominis
LKPHPDGLILGGIVPNGNIVDI

SEQ ID NO: 2176442 - protein, 22 aa, Cryptosporidium hominis
LKPKMCLKKCFDGRVFDPMNPL

SEQ ID NO: 2176443 - protein, 19 aa, Cryptosporidium hominis
LKPLNWLLFEFKNHDLIGK

SEQ ID NO: 2176444 - protein, 30 aa, Cryptosporidium hominis
LKPLPDFEKVVVRGARGLSFQIVNPEVYCV

SEQ ID NO: 2176445 - protein, 21 aa, Cryptosporidium hominis
LKPNIESLYSFQCLTNSIESG

SEQ ID NO: 2176446 - protein, 17 aa, Cryptosporidium hominis
LKPPEGEIIVMNYRISK

SEQ ID NO: 2176447 - protein, 20 aa, Cryptosporidium hominis
LKPPPKRGATSQGFGGPPGA

SEQ ID NO: 2176448 - protein, 18 aa, Cryptosporidium hominis
LKPQLSIFGKQSPVDEEK

SEQ ID NO: 2176449 - protein, 17 aa, Cryptosporidium hominis
LKPRLFISKLRLMSVRI

SEQ ID NO: 2176450 - protein, 18 aa, Cryptosporidium hominis
LKPSNFIVLCEKIIDSSF

SEQ ID NO: 2176451 - protein, 23 aa, Cryptosporidium hominis
LKPSNRAENKMTFGSEKDLATTL

SEQ ID NO: 2176452 - protein, 18 aa, Cryptosporidium hominis
LKQEIIEVVFSYWDGSGH

SEQ ID NO: 2176453 - protein, 19 aa, Cryptosporidium hominis
LKQKHYDRAFAIAISADQS

SEQ ID NO: 2176454 - protein, 20 aa, Cryptosporidium hominis
LKQLIEIGNELTIYEMTILQ

SEQ ID NO: 2176455 - protein, 17 aa, Cryptosporidium hominis
LKQSRIIYEIMRTDIAN

SEQ ID NO: 2176456 - protein, 17 aa, Cryptosporidium hominis
LKQSYSIAHSYRLQFRK

SEQ ID NO: 2176457 - protein, 28 aa, Cryptosporidium hominis
LKQVAVRICTLLKVWRISTQTDIADNLI

SEQ ID NO: 2176458 - protein, 19 aa, Cryptosporidium hominis
LKRKEHPICYDGFEPSGRM

SEQ ID NO: 2176459 - protein, 20 aa, Cryptosporidium hominis
LKRKHLKNILNHIYNSIMHS

SEQ ID NO: 2176460 - protein, 24 aa, Cryptosporidium hominis
LKRPIKKIEYMIGGNQTRNSSNTK

SEQ ID NO: 2176461 - protein, 20 aa, Cryptosporidium hominis
LKRQFYYYLKFISTEYNLKD

SEQ ID NO: 2176462 - protein, 18 aa, Cryptosporidium hominis
LKRSSVCSTYNKSKSQIS

SEQ ID NO: 2176463 - protein, 26 aa, Cryptosporidium hominis
LKRVYFRPRNCQCIRKSEEILSLSPI

SEQ ID NO: 2176464 - protein, 19 aa, Cryptosporidium hominis
LKSEHVLEEKSPPSLNYED

SEQ ID NO: 2176465 - protein, 17 aa, Cryptosporidium hominis
LKSFHSPCIIKRMESLT

SEQ ID NO: 2176466 - protein, 17 aa, Cryptosporidium hominis
LKSHLHKNFSLAFNQLK

SEQ ID NO: 2176467 - protein, 26 aa, Cryptosporidium hominis
LKSIKFKDVVDFASYIIKMGSIESLV

SEQ ID NO: 2176468 - protein, 24 aa, Cryptosporidium hominis
LKSIKRLLKVWCMEMCPEEYLDAG

SEQ ID NO: 2176469 - protein, 24 aa, Cryptosporidium hominis
LKSIWKIGNLVPYVTSNINSIISR

SEQ ID NO: 2176470 - protein, 23 aa, Cryptosporidium hominis
LKSKMPFVIDVFVLYCIERYTGK

SEQ ID NO: 2176471 - protein, 19 aa, Cryptosporidium hominis
LKSLEEILIRNGEKSISEI

SEQ ID NO: 2176472 - protein, 22 aa, Cryptosporidium hominis
LKSLKEGSCHTALVGGVNLMLS

SEQ ID NO: 2176473 - protein, 18 aa, Cryptosporidium hominis
LKSLRRYYVSPLLKKIAL

SEQ ID NO: 2176474 - protein, 18 aa, Cryptosporidium hominis
LKSMETIQLIPLDTNEGC

SEQ ID NO: 2176475 - protein, 21 aa, Cryptosporidium hominis
LKSNEIYSALVEISAQKVQDT

SEQ ID NO: 2176476 - protein, 20 aa, Cryptosporidium hominis
LKSPIPRQFLSEVNKRFPTL

SEQ ID NO: 2176477 - protein, 26 aa, Cryptosporidium hominis
LKSPIVFKPKLETFFGGKNKIVEVES

SEQ ID NO: 2176478 - protein, 21 aa, Cryptosporidium hominis
LKSSEFMDFFSRASRLIERAL

SEQ ID NO: 2176479 - protein, 19 aa, Cryptosporidium hominis
LKSSLLLIYTKLFKLKLDS

SEQ ID NO: 2176480 - protein, 20 aa, Cryptosporidium hominis
LKSTFKVEGPHIILTPRSTL

SEQ ID NO: 2176481 - protein, 18 aa, Cryptosporidium hominis
LKSVKLRASIAPIEALCT

SEQ ID NO: 2176482 - protein, 21 aa, Cryptosporidium hominis
LKTGLIRFPVEIIKDEFESLI

SEQ ID NO: 2176483 - protein, 19 aa, Cryptosporidium hominis
LKTGSIYIYSIKGGNLLIN

SEQ ID NO: 2176484 - protein, 21 aa, Cryptosporidium hominis
LKTIVRVAGGWVRDKILRFIY

SEQ ID NO: 2176485 - protein, 23 aa, Cryptosporidium hominis
LKTIWVGGVCDPGAFFTASKQYA

SEQ ID NO: 2176486 - protein, 23 aa, Cryptosporidium hominis
LKTNRDIEGREKLESSIPASENN

SEQ ID NO: 2176487 - protein, 22 aa, Cryptosporidium hominis
LKTPPKRPFLRKGEGKSLVISN

SEQ ID NO: 2176488 - protein, 25 aa, Cryptosporidium hominis
LKTQCKRDGVKMILSNQIRLLEEKQ

SEQ ID NO: 2176489 - protein, 17 aa, Cryptosporidium hominis
LKTSSKNWFCFQCLSLT

SEQ ID NO: 2176490 - protein, 28 aa, Cryptosporidium hominis
LKVDRMIIGGGMAFTFKKVMDNMEIGKS

SEQ ID NO: 2176491 - protein, 19 aa, Cryptosporidium hominis
LKVGAIYWHGKDIKCRPIL

SEQ ID NO: 2176492 - protein, 20 aa, Cryptosporidium hominis
LKVHGGGYVIDIERARVSGR

SEQ ID NO: 2176493 - protein, 17 aa, Cryptosporidium hominis
LKVLPNKLINGISNYYG

SEQ ID NO: 2176494 - protein, 28 aa, Cryptosporidium hominis
LKVQRLRCIKKIKELKISRAKIRRNEAI

SEQ ID NO: 2176495 - protein, 17 aa, Cryptosporidium hominis
LKVSRFKNVNLLAMHFP

SEQ ID NO: 2176496 - protein, 22 aa, Cryptosporidium hominis
LKWELKHFKGFELAHGKKMYLT

SEQ ID NO: 2176497 - protein, 26 aa, Cryptosporidium hominis
LKWKSFVMVLKCCFSLLQRGNQLNEQ

SEQ ID NO: 2176498 - protein, 22 aa, Cryptosporidium hominis
LKWTKDCLEIYSGPQKCDPKTL

SEQ ID NO: 2176499 - protein, 21 aa, Cryptosporidium hominis
LKYFSEVFVNFEISIEKFVEA

SEQ ID NO: 2176500 - protein, 20 aa, Cryptosporidium hominis
LKYICKHVKFLNNTSLSKNK

SEQ ID NO: 2176501 - protein, 23 aa, Cryptosporidium hominis
LKYKKAIKMIKCIQVKKLNNIII

SEQ ID NO: 2176502 - protein, 17 aa, Cryptosporidium hominis
LKYLPSIVLDSELHPHL

SEQ ID NO: 2176503 - protein, 20 aa, Cryptosporidium hominis
LKYLVLRIIFNTNKTRLEKH

SEQ ID NO: 2176504 - protein, 20 aa, Cryptosporidium hominis
LKYNGFYILYAKSNKPDSQW

SEQ ID NO: 2176505 - protein, 18 aa, Cryptosporidium hominis
LKYNILKESLIKEASGSI

SEQ ID NO: 2176506 - protein, 17 aa, Cryptosporidium hominis
LKYNIMLIINYLLNIGF

SEQ ID NO: 2176507 - protein, 19 aa, Cryptosporidium hominis
LKYSFYDGIFDETNINTKE

SEQ ID NO: 2176508 - protein, 23 aa, Cryptosporidium hominis
LKYWRQILDGIIVRHRRITRSPK

SEQ ID NO: 2176509 - protein, 18 aa, Cryptosporidium hominis
LLAPNCHRDQAFSIVIDM

SEQ ID NO: 2176510 - protein, 18 aa, Cryptosporidium hominis
LLARRSAIVNSDFNHTLK

SEQ ID NO: 2176511 - protein, 30 aa, Cryptosporidium hominis
LLAYLREYRDIKGLHLVLSPKSTLGNWMNE

SEQ ID NO: 2176512 - protein, 18 aa, Cryptosporidium hominis
LLCGYNLALRGHGDIPKR

SEQ ID NO: 2176513 - protein, 19 aa, Cryptosporidium hominis
LLCPLCMTPQCFGRGNSPP

SEQ ID NO: 2176514 - protein, 17 aa, Cryptosporidium hominis
LLCSLCQSIELNERLIV

SEQ ID NO: 2176515 - protein, 19 aa, Cryptosporidium hominis
LLDALKFIHKNGIIHRDLK

SEQ ID NO: 2176516 - protein, 23 aa, Cryptosporidium hominis
LLDEIYEGCEIPVLVSTFKDTFL

SEQ ID NO: 2176517 - protein, 26 aa, Cryptosporidium hominis
LLDFEKLRISYNLPIMNINDNIGIST

SEQ ID NO: 2176518 - protein, 25 aa, Cryptosporidium hominis
LLDILEEMKHRFAINEPSIDKNRLI

SEQ ID NO: 2176519 - protein, 20 aa, Cryptosporidium hominis
LLDKCGFTGAPYMDRIRTLK

SEQ ID NO: 2176520 - protein, 23 aa, Cryptosporidium hominis
LLDKFLRFCVKFHIEWLYKHQNH

SEQ ID NO: 2176521 - protein, 18 aa, Cryptosporidium hominis
LLDMDGSGSIEYSEFIAS

SEQ ID NO: 2176522 - protein, 18 aa, Cryptosporidium hominis
LLDSCCYNELDIIRRLSS

SEQ ID NO: 2176523 - protein, 18 aa, Cryptosporidium hominis
LLDSTGIKGPKEFETKQG

SEQ ID NO: 2176524 - protein, 25 aa, Cryptosporidium hominis
LLDYSEYILSIDIFTGSLVIRDSNF

SEQ ID NO: 2176525 - protein, 17 aa, Cryptosporidium hominis
LLDYSYLEDIKEIIQKE

SEQ ID NO: 2176526 - protein, 18 aa, Cryptosporidium hominis
LLEEAMILHKLRHPNIVS

SEQ ID NO: 2176527 - protein, 19 aa, Cryptosporidium hominis
LLEELSFSSLQHFLLSNTR

SEQ ID NO: 2176528 - protein, 23 aa, Cryptosporidium hominis
LLEENKSKCEFVILNDKFEKENI

SEQ ID NO: 2176529 - protein, 17 aa, Cryptosporidium hominis
LLEEYSVGLGVKSKISF

SEQ ID NO: 2176530 - protein, 20 aa, Cryptosporidium hominis
LLEGKINFLPGIAGRKDKRY

SEQ ID NO: 2176531 - protein, 24 aa, Cryptosporidium hominis
LLEISYKLLNEWNANSSIITYKVT

SEQ ID NO: 2176532 - protein, 17 aa, Cryptosporidium hominis
LLEKGLSKLFSIKQNMS

SEQ ID NO: 2176533 - protein, 19 aa, Cryptosporidium hominis
LLEKLKMSMNMKSNSNHNN

SEQ ID NO: 2176534 - protein, 18 aa, Cryptosporidium hominis
LLELIKYLDKSYMLQRRW

SEQ ID NO: 2176535 - protein, 19 aa, Cryptosporidium hominis
LLEPARLYLENKFEHCQSI

SEQ ID NO: 2176536 - protein, 19 aa, Cryptosporidium hominis
LLEQCICNGYNVPGYGKIP

SEQ ID NO: 2176537 - protein, 18 aa, Cryptosporidium hominis
LLERCLKLVKKVQEYEKE

SEQ ID NO: 2176538 - protein, 25 aa, Cryptosporidium hominis
LLESEGIVANELFTFSMIDEISEKF

SEQ ID NO: 2176539 - protein, 17 aa, Cryptosporidium hominis
LLETKGFSLSSLLRLVE

SEQ ID NO: 2176540 - protein, 23 aa, Cryptosporidium hominis
LLEVRSGSIAYASFGKVCIWGGI

SEQ ID NO: 2176541 - protein, 21 aa, Cryptosporidium hominis
LLEVTNYHFLIWISSREISIY

SEQ ID NO: 2176542 - protein, 19 aa, Cryptosporidium hominis
LLEYRICGVKLYQNPPYTS

SEQ ID NO: 2176543 - protein, 17 aa, Cryptosporidium hominis
LLFAFGYDKDMSKVLDL

SEQ ID NO: 2176544 - protein, 19 aa, Cryptosporidium hominis
LLFEDISCVTELFSSLSEI

SEQ ID NO: 2176545 - protein, 23 aa, Cryptosporidium hominis
LLFKSTEFSSVFKTTIDQFCLEK

SEQ ID NO: 2176546 - protein, 18 aa, Cryptosporidium hominis
LLFRRYLEKNDRYIHADI

SEQ ID NO: 2176547 - protein, 17 aa, Cryptosporidium hominis
LLFRWDKKSLPPDLHRL

SEQ ID NO: 2176548 - protein, 19 aa, Cryptosporidium hominis
LLGARRFQVNVTWQQQSST

SEQ ID NO: 2176549 - protein, 26 aa, Cryptosporidium hominis
LLGCPYGEVGTSYFSCLYPFRDISDI

SEQ ID NO: 2176550 - protein, 17 aa, Cryptosporidium hominis
LLGFELQDAIALLRLDD

SEQ ID NO: 2176551 - protein, 17 aa, Cryptosporidium hominis
LLGIIAFSISKSFKSLN

SEQ ID NO: 2176552 - protein, 17 aa, Cryptosporidium hominis
LLGLEVGASTKEIKSSF

SEQ ID NO: 2176553 - protein, 27 aa, Cryptosporidium hominis
LLGLVIKMRICCSHPRGLVARGSQLDK

SEQ ID NO: 2176554 - protein, 26 aa, Cryptosporidium hominis
LLGQFEMMGIPPAPRGVPQIEVTFDI

SEQ ID NO: 2176555 - protein, 18 aa, Cryptosporidium hominis
LLGSNFALNYMFKVNSIV

SEQ ID NO: 2176556 - protein, 23 aa, Cryptosporidium hominis
LLGTEYMTKFGLELSYICQALYQ

SEQ ID NO: 2176557 - protein, 23 aa, Cryptosporidium hominis
LLGWVKDRCIVFVGETRYFFLVL

SEQ ID NO: 2176558 - protein, 29 aa, Cryptosporidium hominis
LLHKCSNVLFRFKPMHHYNIYQLSSEMKL

SEQ ID NO: 2176559 - protein, 20 aa, Cryptosporidium hominis
LLHSLYMILSLCHLFASHSN

SEQ ID NO: 2176560 - protein, 31 aa, Cryptosporidium hominis
LLHYRYNINWDIPDKFLIPTIPSRANYVHFI

SEQ ID NO: 2176561 - protein, 19 aa, Cryptosporidium hominis
LLIDLLRFICNELQIYKII

SEQ ID NO: 2176562 - protein, 18 aa, Cryptosporidium hominis
LLIDRSIEIRNWRRGEKY

SEQ ID NO: 2176563 - protein, 17 aa, Cryptosporidium hominis
LLIFCIIQSNPTKIKAH

SEQ ID NO: 2176564 - protein, 34 aa, Cryptosporidium hominis
LLIHCSECPTTFCIDCFPPEYARHQVLDSFFENL

SEQ ID NO: 2176565 - protein, 17 aa, Cryptosporidium hominis
LLIKIEPFFGPTQILNW

SEQ ID NO: 2176566 - protein, 18 aa, Cryptosporidium hominis
LLIKLAPPHYESYLKNTI

SEQ ID NO: 2176567 - protein, 21 aa, Cryptosporidium hominis
LLIQKSCPLFENYGICHLGLN

SEQ ID NO: 2176568 - protein, 17 aa, Cryptosporidium hominis
LLIRGCHNRGFFTQRSI

SEQ ID NO: 2176569 - protein, 25 aa, Cryptosporidium hominis
LLKAHSIGPPFLVRLMRYNLLENKF

SEQ ID NO: 2176570 - protein, 19 aa, Cryptosporidium hominis
LLKDNVAVVILLEYRQNDS

SEQ ID NO: 2176571 - protein, 17 aa, Cryptosporidium hominis
LLKKHIRNFEMEKVYYI

SEQ ID NO: 2176572 - protein, 23 aa, Cryptosporidium hominis
LLKQKIQAFVCIGTVAGGHFHSW

SEQ ID NO: 2176573 - protein, 25 aa, Cryptosporidium hominis
LLKRNWKINPLLSINIRNQLEKYAR

SEQ ID NO: 2176574 - protein, 17 aa, Cryptosporidium hominis
LLKSDVVGGGFQQEDNI

SEQ ID NO: 2176575 - protein, 20 aa, Cryptosporidium hominis
LLKSEFWGTIVEHLETEIFE

SEQ ID NO: 2176576 - protein, 20 aa, Cryptosporidium hominis
LLKSLIFSKIRLMKNKIDDE

SEQ ID NO: 2176577 - protein, 17 aa, Cryptosporidium hominis
LLLEGLVEYDKLVSKQL

SEQ ID NO: 2176578 - protein, 17 aa, Cryptosporidium hominis
LLLIKRRIILFKIEQGS

SEQ ID NO: 2176579 - protein, 19 aa, Cryptosporidium hominis
LLLLFPSILFITIQKHKNS

SEQ ID NO: 2176580 - protein, 23 aa, Cryptosporidium hominis
LLLNDPVSFFVCMEQTFVKPLLY

SEQ ID NO: 2176581 - protein, 25 aa, Cryptosporidium hominis
LLLPNEIPQSFDLIELAMKYSNNNA

SEQ ID NO: 2176582 - protein, 25 aa, Cryptosporidium hominis
LLLRVDGLVGLLARIRRDEIESLFS

SEQ ID NO: 2176583 - protein, 19 aa, Cryptosporidium hominis
LLLVPSDVLTLFIDYRLLS

SEQ ID NO: 2176584 - protein, 26 aa, Cryptosporidium hominis
LLMNSCKMYQDFGASYLTDFSDIAII

SEQ ID NO: 2176585 - protein, 20 aa, Cryptosporidium hominis
LLMYSEEGARAFCIKLKGDL

SEQ ID NO: 2176586 - protein, 17 aa, Cryptosporidium hominis
LLNDEIWELNRIIKSNN

SEQ ID NO: 2176587 - protein, 34 aa, Cryptosporidium hominis
LLNEMSFRLIFKWFKETFKSLKLKSTYNEQILCQ

SEQ ID NO: 2176588 - protein, 24 aa, Cryptosporidium hominis
LLNKARRAYIAFVRSYMSYDREFS

SEQ ID NO: 2176589 - protein, 17 aa, Cryptosporidium hominis
LLNKCRIDIEESVRKYV

SEQ ID NO: 2176590 - protein, 23 aa, Cryptosporidium hominis
LLNKKVMNFWGFETNKLINDHYN

SEQ ID NO: 2176591 - protein, 21 aa, Cryptosporidium hominis
LLNLQLPIILKKSEEEIKYIR

SEQ ID NO: 2176592 - protein, 23 aa, Cryptosporidium hominis
LLNNWIDLCYLYLLDLEDNPKLR

SEQ ID NO: 2176593 - protein, 35 aa, Cryptosporidium hominis
LLNPKSGCKGVSWSNRQMAWLAFWKEDNQRRSKTF

SEQ ID NO: 2176594 - protein, 23 aa, Cryptosporidium hominis
LLNRKDFKMAFDSMHGVAGPYAR

SEQ ID NO: 2176595 - protein, 24 aa, Cryptosporidium hominis
LLNSECWKELVKGCRIVIHCASPY

SEQ ID NO: 2176596 - protein, 24 aa, Cryptosporidium hominis
LLNSFPSCSLAIIKSLTKGDEIDE

SEQ ID NO: 2176597 - protein, 21 aa, Cryptosporidium hominis
LLNTIRLRVAKKVKDKVRKRK

SEQ ID NO: 2176598 - protein, 18 aa, Cryptosporidium hominis
LLNYLFYRGLDIDPIDSS

SEQ ID NO: 2176599 - protein, 18 aa, Cryptosporidium hominis
LLPICNAYYIGQLLALYE

SEQ ID NO: 2176600 - protein, 21 aa, Cryptosporidium hominis
LLPMIIKKAFLAYNSLKEICT

SEQ ID NO: 2176601 - protein, 22 aa, Cryptosporidium hominis
LLPNQKRPTLSVIIKVNQKGEV

SEQ ID NO: 2176602 - protein, 17 aa, Cryptosporidium hominis
LLPWKTLCTDIVESWRL

SEQ ID NO: 2176603 - protein, 26 aa, Cryptosporidium hominis
LLQHSALDGGCDWLTCTCNLENIDRD

SEQ ID NO: 2176604 - protein, 17 aa, Cryptosporidium hominis
LLQNKVYEEIADFHPEI

SEQ ID NO: 2176605 - protein, 19 aa, Cryptosporidium hominis
LLQYSRFILSKKISLCIKS

SEQ ID NO: 2176606 - protein, 30 aa, Cryptosporidium hominis
LLRDLFPVMMSRFIATFARTDKRNSCCCQI

SEQ ID NO: 2176607 - protein, 18 aa, Cryptosporidium hominis
LLREERLLIAEMIKQIAA

SEQ ID NO: 2176608 - protein, 29 aa, Cryptosporidium hominis
LLRKIIHCLCDHYCIISRSISTIGNNNNN

SEQ ID NO: 2176609 - protein, 22 aa, Cryptosporidium hominis
LLRLIEVWSKYRLELQKSVQKY

SEQ ID NO: 2176610 - protein, 20 aa, Cryptosporidium hominis
LLRPHLLRRVKEDVMKEIPP

SEQ ID NO: 2176611 - protein, 17 aa, Cryptosporidium hominis
LLRPIIVFRAKAFLDGE

SEQ ID NO: 2176612 - protein, 20 aa, Cryptosporidium hominis
LLRRESIHLVNAFKDYFEPK

SEQ ID NO: 2176613 - protein, 21 aa, Cryptosporidium hominis
LLRSRKCPFIIALNKIDRLYG

SEQ ID NO: 2176614 - protein, 35 aa, Cryptosporidium hominis
LLRVAHQCGLWNAAVRLHLEFIGEIPMTASHAEMR

SEQ ID NO: 2176615 - protein, 25 aa, Cryptosporidium hominis
LLSCFLVCPHWLLTITEFINEYYCK

SEQ ID NO: 2176616 - protein, 21 aa, Cryptosporidium hominis
LLSECSCINIFAFGSSGTGKT

SEQ ID NO: 2176617 - protein, 25 aa, Cryptosporidium hominis
LLSENPCIFRDLYFYKHSEESTIEC

SEQ ID NO: 2176618 - protein, 25 aa, Cryptosporidium hominis
LLSFKLVCLKRLMGSLSDDQYLRNS

SEQ ID NO: 2176619 - protein, 19 aa, Cryptosporidium hominis
LLSGLAFCHGKRILHRDLK

SEQ ID NO: 2176620 - protein, 18 aa, Cryptosporidium hominis
LLSILDKFIETFTLLHGE

SEQ ID NO: 2176621 - protein, 18 aa, Cryptosporidium hominis
LLSLLILKMSQKYKIFNN

SEQ ID NO: 2176622 - protein, 21 aa, Cryptosporidium hominis
LLSNAKFTLSVIKIGGNTKTK

SEQ ID NO: 2176623 - protein, 22 aa, Cryptosporidium hominis
LLSNFYFCCLYFHRLDSMARKE

SEQ ID NO: 2176624 - protein, 18 aa, Cryptosporidium hominis
LLSQICSYLPLKDFSNFR

SEQ ID NO: 2176625 - protein, 19 aa, Cryptosporidium hominis
LLSQRGIYIQGLKYKVSNV

SEQ ID NO: 2176626 - protein, 18 aa, Cryptosporidium hominis
LLSREFPNIFEVMINIAS

SEQ ID NO: 2176627 - protein, 18 aa, Cryptosporidium hominis
LLSSRGALHLIARENEYE

SEQ ID NO: 2176628 - protein, 17 aa, Cryptosporidium hominis
LLSYHGVMACVGAPPAG

SEQ ID NO: 2176629 - protein, 18 aa, Cryptosporidium hominis
LLTECFVPYLASFLELEK

SEQ ID NO: 2176630 - protein, 22 aa, Cryptosporidium hominis
LLTHPFIDTCIVSRYVMQQIPK

SEQ ID NO: 2176631 - protein, 17 aa, Cryptosporidium hominis
LLTKNVRRVFAWHPLTK

SEQ ID NO: 2176632 - protein, 19 aa, Cryptosporidium hominis
LLTLQYYFSLWRQESRKER

SEQ ID NO: 2176633 - protein, 18 aa, Cryptosporidium hominis
LLTMARKKIIKIITENLN

SEQ ID NO: 2176634 - protein, 25 aa, Cryptosporidium hominis
LLTRFPVPAASTFSFSLICNDDELP

SEQ ID NO: 2176635 - protein, 23 aa, Cryptosporidium hominis
LLTRKSTFLTRDKFLQLLLCIPY

SEQ ID NO: 2176636 - protein, 19 aa, Cryptosporidium hominis
LLTVLLEYCEKNWNSSNLN

SEQ ID NO: 2176637 - protein, 17 aa, Cryptosporidium hominis
LLVAKWGGELTRVGCEQ

SEQ ID NO: 2176638 - protein, 17 aa, Cryptosporidium hominis
LLVAYREKSVRIFGDGL

SEQ ID NO: 2176639 - protein, 19 aa, Cryptosporidium hominis
LLVGLKYIHSAGIYHRDLK

SEQ ID NO: 2176640 - protein, 23 aa, Cryptosporidium hominis
LLVHYAHSCLIPFEELAMSKDIN

SEQ ID NO: 2176641 - protein, 25 aa, Cryptosporidium hominis
LLVPGSRIAACVLINILISYDPILQ

SEQ ID NO: 2176642 - protein, 24 aa, Cryptosporidium hominis
LLVQLRTDCWVYYSPKNAQQNKEQ

SEQ ID NO: 2176643 - protein, 18 aa, Cryptosporidium hominis
LLWGCLNFTPCQRLTLAQ

SEQ ID NO: 2176644 - protein, 26 aa, Cryptosporidium hominis
LLYASWKHGLSLNRLVSLIEGYSSNV

SEQ ID NO: 2176645 - protein, 21 aa, Cryptosporidium hominis
LLYEDSFKKFGLDGVKLEPSM

SEQ ID NO: 2176646 - protein, 22 aa, Cryptosporidium hominis
LLYNEISIFLSIDSDIPFLSYF

SEQ ID NO: 2176647 - protein, 19 aa, Cryptosporidium hominis
LLYNMYKLQWEIYERLGDV

SEQ ID NO: 2176648 - protein, 17 aa, Cryptosporidium hominis
LLYTILHLHKQINSIGS

SEQ ID NO: 2176649 - protein, 18 aa, Cryptosporidium hominis
LMALTLMSHFDFNASDII

SEQ ID NO: 2176650 - protein, 17 aa, Cryptosporidium hominis
LMAMNLAYRDTIFDHYK

SEQ ID NO: 2176651 - protein, 17 aa, Cryptosporidium hominis
LMDALSFALGLSSNDMR

SEQ ID NO: 2176652 - protein, 25 aa, Cryptosporidium hominis
LMDEQDYRYSIIFYQAIPNYSRLTS

SEQ ID NO: 2176653 - protein, 17 aa, Cryptosporidium hominis
LMDRIPPNLPINADGSY

SEQ ID NO: 2176654 - protein, 17 aa, Cryptosporidium hominis
LMGSHLHLWSFNTSPVS

SEQ ID NO: 2176655 - protein, 18 aa, Cryptosporidium hominis
LMIIPLKIVGKLIERFHN

SEQ ID NO: 2176656 - protein, 18 aa, Cryptosporidium hominis
LMKESLERLILNKESEST

SEQ ID NO: 2176657 - protein, 17 aa, Cryptosporidium hominis
LMKGCKWADEIVIGTPY

SEQ ID NO: 2176658 - protein, 20 aa, Cryptosporidium hominis
LMKKNCQWANILINGTVILN

SEQ ID NO: 2176659 - protein, 18 aa, Cryptosporidium hominis
LMNPDAFNRIPMIYEKKD

SEQ ID NO: 2176660 - protein, 17 aa, Cryptosporidium hominis
LMNREVTELNALKHILD

SEQ ID NO: 2176661 - protein, 22 aa, Cryptosporidium hominis
LMNTCRIRHGALTLALEHWVED

SEQ ID NO: 2176662 - protein, 24 aa, Cryptosporidium hominis
LMNTNIYLKWSRLVYEELENQKKL

SEQ ID NO: 2176663 - protein, 24 aa, Cryptosporidium hominis
LMPLNSFIEIFGFYIESIESLKLF

SEQ ID NO: 2176664 - protein, 24 aa, Cryptosporidium hominis
LMQLCQRFGHIVGIRLPTANNNGK

SEQ ID NO: 2176665 - protein, 18 aa, Cryptosporidium hominis
LMRELDILLILEFLVDLR

SEQ ID NO: 2176666 - protein, 19 aa, Cryptosporidium hominis
LMRELRIAVEKGYTESAKI

SEQ ID NO: 2176667 - protein, 23 aa, Cryptosporidium hominis
LMRSFGWDASDAFTQHDAQELNR

SEQ ID NO: 2176668 - protein, 23 aa, Cryptosporidium hominis
LMSDLCRRYHRAGLWDSSCPTLY

SEQ ID NO: 2176669 - protein, 17 aa, Cryptosporidium hominis
LMSQYALFKTPQIFHEY

SEQ ID NO: 2176670 - protein, 20 aa, Cryptosporidium hominis
LMSRECFELTILKNGINNEP

SEQ ID NO: 2176671 - protein, 17 aa, Cryptosporidium hominis
LMVCINCVKESFDNFLF

SEQ ID NO: 2176672 - protein, 26 aa, Cryptosporidium hominis
LMVMDMSYSLELFTSPISSEFDILGQ

SEQ ID NO: 2176673 - protein, 18 aa, Cryptosporidium hominis
LMYECLYGGVPFNDDTHN

SEQ ID NO: 2176674 - protein, 19 aa, Cryptosporidium hominis
LMYVREVLDKLYFYPHFRG

SEQ ID NO: 2176675 - protein, 18 aa, Cryptosporidium hominis
LNACQVLLLAPTRELAQQ

SEQ ID NO: 2176676 - protein, 17 aa, Cryptosporidium hominis
LNAKLGRNLNILSKSIY

SEQ ID NO: 2176677 - protein, 21 aa, Cryptosporidium hominis
LNAQILWKCQYLIKSLNTYNS

SEQ ID NO: 2176678 - protein, 18 aa, Cryptosporidium hominis
LNATKCAIEQGIVPGGGS

SEQ ID NO: 2176679 - protein, 25 aa, Cryptosporidium hominis
LNAYPEMLEILLSCQSEDLRPNNGT

SEQ ID NO: 2176680 - protein, 24 aa, Cryptosporidium hominis
LNCGTELFHVPKFALAARSKYFQN

SEQ ID NO: 2176681 - protein, 19 aa, Cryptosporidium hominis
LNCTLDRLVGPKCLELKVS

SEQ ID NO: 2176682 - protein, 23 aa, Cryptosporidium hominis
LNDFPEPSRINLKHTKRNFHRNR

SEQ ID NO: 2176683 - protein, 18 aa, Cryptosporidium hominis
LNDGFWNHSHNSVALQNN

SEQ ID NO: 2176684 - protein, 23 aa, Cryptosporidium hominis
LNDQFWRIFGISLTTSSRSERVY

SEQ ID NO: 2176685 - protein, 17 aa, Cryptosporidium hominis
LNDSFVKLISWYDNESG

SEQ ID NO: 2176686 - protein, 20 aa, Cryptosporidium hominis
LNDTFGIIFCESKQGWTKFL

SEQ ID NO: 2176687 - protein, 23 aa, Cryptosporidium hominis
LNDVKIKVCISSHLQNFIFDTIN

SEQ ID NO: 2176688 - protein, 18 aa, Cryptosporidium hominis
LNECLKYSGISLIQGPPG

SEQ ID NO: 2176689 - protein, 20 aa, Cryptosporidium hominis
LNECTEWGQIYILNVVAEWK

SEQ ID NO: 2176690 - protein, 18 aa, Cryptosporidium hominis
LNEFGITMKSTWFGEEMR

SEQ ID NO: 2176691 - protein, 22 aa, Cryptosporidium hominis
LNEGKNYVCGSTRSVFEPINEK

SEQ ID NO: 2176692 - protein, 18 aa, Cryptosporidium hominis
LNEIIELYLQFFNNTLEI

SEQ ID NO: 2176693 - protein, 20 aa, Cryptosporidium hominis
LNEISCAPPPQVIEALKNLC

SEQ ID NO: 2176694 - protein, 17 aa, Cryptosporidium hominis
LNEKLNELMGIFKKRES

SEQ ID NO: 2176695 - protein, 21 aa, Cryptosporidium hominis
LNERIRPVLHVNKVDRALLEL

SEQ ID NO: 2176696 - protein, 30 aa, Cryptosporidium hominis
LNERSMSPLSIYAVHVWTGSQNCEFANKLS

SEQ ID NO: 2176697 - protein, 25 aa, Cryptosporidium hominis
LNETEIRPGFKVKIEKAIFNKSSKP

SEQ ID NO: 2176698 - protein, 23 aa, Cryptosporidium hominis
LNEVAWKIIRQFGELKELDFSES

SEQ ID NO: 2176699 - protein, 25 aa, Cryptosporidium hominis
LNEYYNGRQLLGFIGDICEKENSVL

SEQ ID NO: 2176700 - protein, 20 aa, Cryptosporidium hominis
LNFDFSRGMRTLSAPSMSTP

SEQ ID NO: 2176701 - protein, 19 aa, Cryptosporidium hominis
LNFGTCNRYEFLAWLQQIQ

SEQ ID NO: 2176702 - protein, 19 aa, Cryptosporidium hominis
LNFKHEVDQSFHISIYIPQ

SEQ ID NO: 2176703 - protein, 26 aa, Cryptosporidium hominis
LNFNEPVWRVSWSVTGTVLAASSGED

SEQ ID NO: 2176704 - protein, 22 aa, Cryptosporidium hominis
LNFNGTITFIWIMLGLCSSLSN

SEQ ID NO: 2176705 - protein, 17 aa, Cryptosporidium hominis
LNFPTDRIFLLGQSIGS

SEQ ID NO: 2176706 - protein, 18 aa, Cryptosporidium hominis
LNFRDVLNVMGLYPGDPG

SEQ ID NO: 2176707 - protein, 19 aa, Cryptosporidium hominis
LNGATGCTILQDFMEREEK

SEQ ID NO: 2176708 - protein, 24 aa, Cryptosporidium hominis
LNGCYKCTLRTSGVGLGSYKCDVI

SEQ ID NO: 2176709 - protein, 17 aa, Cryptosporidium hominis
LNGFLTQGLNSIEMLNS

SEQ ID NO: 2176710 - protein, 28 aa, Cryptosporidium hominis
LNGIGVWSAEMAMIFCMNRKNVFSFSDT

SEQ ID NO: 2176711 - protein, 17 aa, Cryptosporidium hominis
LNGLEVININDLNKAID

SEQ ID NO: 2176712 - protein, 19 aa, Cryptosporidium hominis
LNHLPRLNWINVDISTLNN

SEQ ID NO: 2176713 - protein, 26 aa, Cryptosporidium hominis
LNIAPSFWRFCYNACNSLFTKLQYTS

SEQ ID NO: 2176714 - protein, 19 aa, Cryptosporidium hominis
LNIDIEWYKTQQLLPPLSR

SEQ ID NO: 2176715 - protein, 25 aa, Cryptosporidium hominis
LNIEYPPYWYCLKIPKKEENEQDLL

SEQ ID NO: 2176716 - protein, 28 aa, Cryptosporidium hominis
LNIKVKSFFLKLIIYIDWLIYLINHSNK

SEQ ID NO: 2176717 - protein, 18 aa, Cryptosporidium hominis
LNIKWPPSLPNYTQKNLL

SEQ ID NO: 2176718 - protein, 21 aa, Cryptosporidium hominis
LNILELLSMDIEEQAKYKDKY

SEQ ID NO: 2176719 - protein, 18 aa, Cryptosporidium hominis
LNILKEFNYFGIKFYDNS

SEQ ID NO: 2176720 - protein, 26 aa, Cryptosporidium hominis
LNINNGNKWKGWGIKSGESTNADLFE

SEQ ID NO: 2176721 - protein, 41 aa, Cryptosporidium hominis
LNIPTIFALNRHRIGRAMGKHMRMSVLGLLSIRGVEKQFQA

SEQ ID NO: 2176722 - protein, 35 aa, Cryptosporidium hominis
LNIRRAHCLANYSFKYRRGGIVVAPEICIPKQHVT

SEQ ID NO: 2176723 - protein, 27 aa, Cryptosporidium hominis
LNISFSKLRQMVWCGNESVALNVVTST

SEQ ID NO: 2176724 - protein, 23 aa, Cryptosporidium hominis
LNISLKFLENAQIQWMNEKESLL

SEQ ID NO: 2176725 - protein, 19 aa, Cryptosporidium hominis
LNIVALFLIELGYKPSEVI

SEQ ID NO: 2176726 - protein, 18 aa, Cryptosporidium hominis
LNKDCAKYEEFLSQNKKF

SEQ ID NO: 2176727 - protein, 22 aa, Cryptosporidium hominis
LNKDILLSLSFMVMNQLVSFDL

SEQ ID NO: 2176728 - protein, 24 aa, Cryptosporidium hominis
LNKFPSAKNSLSFVYVKNEDYTEQ

SEQ ID NO: 2176729 - protein, 26 aa, Cryptosporidium hominis
LNKKFFVRKGEVILRILENYYPPIFE

SEQ ID NO: 2176730 - protein, 23 aa, Cryptosporidium hominis
LNKKLSERLTFFNCDVRQILPKT

SEQ ID NO: 2176731 - protein, 24 aa, Cryptosporidium hominis
LNKLNSLFFLKRLIGEKNVHNAAM

SEQ ID NO: 2176732 - protein, 18 aa, Cryptosporidium hominis
LNKNLRQRIVCFVGSPLE

SEQ ID NO: 2176733 - protein, 19 aa, Cryptosporidium hominis
LNKQLPYLVANIVESLDFS

SEQ ID NO: 2176734 - protein, 32 aa, Cryptosporidium hominis
LNKSFPENIHIIFDYSLPLTFSDDLINNLYGG

SEQ ID NO: 2176735 - protein, 22 aa, Cryptosporidium hominis
LNKSSHLLPVGSLGPYSFQPYK

SEQ ID NO: 2176736 - protein, 23 aa, Cryptosporidium hominis
LNKTFKKALLFGDKENITKKNSK

SEQ ID NO: 2176737 - protein, 27 aa, Cryptosporidium hominis
LNKTLPIRLSDEFLMSFISNEGHRVKN

SEQ ID NO: 2176738 - protein, 17 aa, Cryptosporidium hominis
LNLDFSNLAFKPRNSYI

SEQ ID NO: 2176739 - protein, 24 aa, Cryptosporidium hominis
LNLENLKFLIFFKINNDINPCKED

SEQ ID NO: 2176740 - protein, 18 aa, Cryptosporidium hominis
LNLFRLILELIQTDLVKD

SEQ ID NO: 2176741 - protein, 20 aa, Cryptosporidium hominis
LNLLAKRCVELSKYSVDTCV

SEQ ID NO: 2176742 - protein, 24 aa, Cryptosporidium hominis
LNLLEPCGQFGSRKEGGKDASAAR

SEQ ID NO: 2176743 - protein, 21 aa, Cryptosporidium hominis
LNLLKKGGCFVELGKRGIWTE

SEQ ID NO: 2176744 - protein, 17 aa, Cryptosporidium hominis
LNLLKYIHIRTFEVLYK

SEQ ID NO: 2176745 - protein, 17 aa, Cryptosporidium hominis
LNLLRRKYEALEKENES

SEQ ID NO: 2176746 - protein, 18 aa, Cryptosporidium hominis
LNLMDDWIRSISFTETNK

SEQ ID NO: 2176747 - protein, 28 aa, Cryptosporidium hominis
LNLNCKKCGFLLSEYCENWVTAPLPSEM

SEQ ID NO: 2176748 - protein, 20 aa, Cryptosporidium hominis
LNLNVKFGYLKHSILNGKQG

SEQ ID NO: 2176749 - protein, 18 aa, Cryptosporidium hominis
LNLPCIYPTVYSFGNILA

SEQ ID NO: 2176750 - protein, 18 aa, Cryptosporidium hominis
LNLPCMYSVPFIEQEHLT

SEQ ID NO: 2176751 - protein, 17 aa, Cryptosporidium hominis
LNLRCIYKYCKKVDNLL

SEQ ID NO: 2176752 - protein, 18 aa, Cryptosporidium hominis
LNLRYNKIIIEVDSKLSD

SEQ ID NO: 2176753 - protein, 25 aa, Cryptosporidium hominis
LNLSDTVSLIAMELFPCGKWPDLLP

SEQ ID NO: 2176754 - protein, 24 aa, Cryptosporidium hominis
LNLSEKEIQRFTGLSPIMTGKFWD

SEQ ID NO: 2176755 - protein, 28 aa, Cryptosporidium hominis
LNLSKSMCLKCVESLYGILNISLKQSRI

SEQ ID NO: 2176756 - protein, 38 aa, Cryptosporidium hominis
LNLSKYKIYFDFSNNFIKSNFLNNIEKFILELVNDSLF

SEQ ID NO: 2176757 - protein, 31 aa, Cryptosporidium hominis
LNLTKLALCHTFKYGEIWSYLEYILTEYYER

SEQ ID NO: 2176758 - protein, 18 aa, Cryptosporidium hominis
LNLTNSFSDISIISIGGD

SEQ ID NO: 2176759 - protein, 20 aa, Cryptosporidium hominis
LNLWWELMVYILRWSFELGP

SEQ ID NO: 2176760 - protein, 22 aa, Cryptosporidium hominis
LNMPGWITGVGLEISSIVTAFS

SEQ ID NO: 2176761 - protein, 17 aa, Cryptosporidium hominis
LNNELKVAQLAGYVAEH

SEQ ID NO: 2176762 - protein, 18 aa, Cryptosporidium hominis
LNNERYISSSLILTNGTS

SEQ ID NO: 2176763 - protein, 18 aa, Cryptosporidium hominis
LNNILSGSGSKGFSGSKN

SEQ ID NO: 2176764 - protein, 18 aa, Cryptosporidium hominis
LNNINLCLNFILNPPEKS

SEQ ID NO: 2176765 - protein, 24 aa, Cryptosporidium hominis
LNNPEMMRMMLNPQMIQSVLNSNN

SEQ ID NO: 2176766 - protein, 30 aa, Cryptosporidium hominis
LNNPYFEEWKFLYKRLCYIEKEVDSMLLKL

SEQ ID NO: 2176767 - protein, 23 aa, Cryptosporidium hominis
LNNRELYSGISLDPTVEYKAMIQ

SEQ ID NO: 2176768 - protein, 26 aa, Cryptosporidium hominis
LNPDDGLFLCRFCNEKLKSVDSASFR

SEQ ID NO: 2176769 - protein, 22 aa, Cryptosporidium hominis
LNPDSYFKLANMPYYNVPLYFN

SEQ ID NO: 2176770 - protein, 27 aa, Cryptosporidium hominis
LNPEIFNAYHFTSWLSEDFQEFLKELE

SEQ ID NO: 2176771 - protein, 19 aa, Cryptosporidium hominis
LNPISSLFLLQFQMGIIME

SEQ ID NO: 2176772 - protein, 29 aa, Cryptosporidium hominis
LNPLLKIEFLIRFLLNMKRELESGKQIKC

SEQ ID NO: 2176773 - protein, 31 aa, Cryptosporidium hominis
LNPNPSKCYTLPIKGFGELVQREQQQRKELE

SEQ ID NO: 2176774 - protein, 18 aa, Cryptosporidium hominis
LNPNWFALLVSIVIGSNI

SEQ ID NO: 2176775 - protein, 21 aa, Cryptosporidium hominis
LNPPYFRIGPQFEPDPMSYNW

SEQ ID NO: 2176776 - protein, 18 aa, Cryptosporidium hominis
LNPYCPRCKVDTVCNLKR

SEQ ID NO: 2176777 - protein, 27 aa, Cryptosporidium hominis
LNQAIKMAYSVGLTYEAGLGERKLKKL

SEQ ID NO: 2176778 - protein, 23 aa, Cryptosporidium hominis
LNQDECDEIISLVQDRLEDSKIS

SEQ ID NO: 2176779 - protein, 21 aa, Cryptosporidium hominis
LNQLIRVSGIITRRTDILTKF

SEQ ID NO: 2176780 - protein, 17 aa, Cryptosporidium hominis
LNQLKVHGGGYVIDIER

SEQ ID NO: 2176781 - protein, 19 aa, Cryptosporidium hominis
LNQMERLNEIISMRLSYNQ

SEQ ID NO: 2176782 - protein, 24 aa, Cryptosporidium hominis
LNQRKEFMRLGGITVLVSLLNPPT

SEQ ID NO: 2176783 - protein, 24 aa, Cryptosporidium hominis
LNQSSFKTGYSFTLEISQSYKRTF

SEQ ID NO: 2176784 - protein, 17 aa, Cryptosporidium hominis
LNRGFKRLVRRKRSARN

SEQ ID NO: 2176785 - protein, 20 aa, Cryptosporidium hominis
LNRHPLVLTINGCIGTEGIG

SEQ ID NO: 2176786 - protein, 17 aa, Cryptosporidium hominis
LNSAFGALLARMLDPNK

SEQ ID NO: 2176787 - protein, 18 aa, Cryptosporidium hominis
LNSCGPDVGISGKLVDSE

SEQ ID NO: 2176788 - protein, 25 aa, Cryptosporidium hominis
LNSCKIFYLNLPKLRSIRLKCKSIL

SEQ ID NO: 2176789 - protein, 31 aa, Cryptosporidium hominis
LNSDNLYRALRFGGLLVRIPPYNQKSYEHFN

SEQ ID NO: 2176790 - protein, 32 aa, Cryptosporidium hominis
LNSFKRPDIKCSICGDKGHITKDCKQYVPNNN

SEQ ID NO: 2176791 - protein, 20 aa, Cryptosporidium hominis
LNSHAFKCINPKPLRTGNIC

SEQ ID NO: 2176792 - protein, 25 aa, Cryptosporidium hominis
LNSIGRPKFGGILKSQKGDMLCDYD

SEQ ID NO: 2176793 - protein, 18 aa, Cryptosporidium hominis
LNSIKFINKEGSNPKIDR

SEQ ID NO: 2176794 - protein, 28 aa, Cryptosporidium hominis
LNSNLLRWTQRYGYQGTDEFSIRMFNES

SEQ ID NO: 2176795 - protein, 24 aa, Cryptosporidium hominis
LNSQEIRGLLNLCGTSGKIEPNFS

SEQ ID NO: 2176796 - protein, 25 aa, Cryptosporidium hominis
LNSQMAELLKFCGINEFDDEESLNS

SEQ ID NO: 2176797 - protein, 21 aa, Cryptosporidium hominis
LNSRIKLLIAQTGPNNLQSFA

SEQ ID NO: 2176798 - protein, 21 aa, Cryptosporidium hominis
LNSRLLLKVQLPESINQLYSL

SEQ ID NO: 2176799 - protein, 26 aa, Cryptosporidium hominis
LNSSECLYLNFDSPWSSSKPAQPESE

SEQ ID NO: 2176800 - protein, 25 aa, Cryptosporidium hominis
LNTDRPGSCFFGRFSVPTHAQSMVG

SEQ ID NO: 2176801 - protein, 25 aa, Cryptosporidium hominis
LNTIRFSAIEILAWTQSLLSEIFIK

SEQ ID NO: 2176802 - protein, 18 aa, Cryptosporidium hominis
LNTKCSYVSKRFISASST

SEQ ID NO: 2176803 - protein, 21 aa, Cryptosporidium hominis
LNTKLLVEFSRKIAQLPDLLN

SEQ ID NO: 2176804 - protein, 28 aa, Cryptosporidium hominis
LNTLCEAGQMSICYSKAWVNKTVISAWW

SEQ ID NO: 2176805 - protein, 18 aa, Cryptosporidium hominis
LNTLFPYDHRTLVILDDI

SEQ ID NO: 2176806 - protein, 17 aa, Cryptosporidium hominis
LNTNLANMFGINQASGA

SEQ ID NO: 2176807 - protein, 26 aa, Cryptosporidium hominis
LNTSIRLWWKRIFKGGIETDISKFNR

SEQ ID NO: 2176808 - protein, 18 aa, Cryptosporidium hominis
LNTVYIYDFLDLFEEAIK

SEQ ID NO: 2176809 - protein, 24 aa, Cryptosporidium hominis
LNVGCPSCKVASKGSFGASLFKNP

SEQ ID NO: 2176810 - protein, 21 aa, Cryptosporidium hominis
LNVGISPKFDSFIIKKISEVT

SEQ ID NO: 2176811 - protein, 25 aa, Cryptosporidium hominis
LNWTEIETPWEWERDFTIDEMDPLK

SEQ ID NO: 2176812 - protein, 25 aa, Cryptosporidium hominis
LNYDKGRYICISYGQPNYRLNYLKS

SEQ ID NO: 2176813 - protein, 33 aa, Cryptosporidium hominis
LNYEKCLLEQKILFLKLVIQGVIGLSNKSKETL

SEQ ID NO: 2176814 - protein, 23 aa, Cryptosporidium hominis
LNYLSHLVIRVWESKSVSESNQD

SEQ ID NO: 2176815 - protein, 17 aa, Cryptosporidium hominis
LNYPFGYVNSVLEGSPA

SEQ ID NO: 2176816 - protein, 28 aa, Cryptosporidium hominis
LNYSMKFTLIETICCFAKKHPMITQIEN

SEQ ID NO: 2176817 - protein, 17 aa, Cryptosporidium hominis
LPAEERNTIALGKVSIP

SEQ ID NO: 2176818 - protein, 19 aa, Cryptosporidium hominis
LPARHVIIKGTNVYDSKKG

SEQ ID NO: 2176819 - protein, 27 aa, Cryptosporidium hominis
LPCPLSELCVPVAQGLEFLHELIDRIP

SEQ ID NO: 2176820 - protein, 25 aa, Cryptosporidium hominis
LPCRHACLCKICSNTLFKNTRDCPI

SEQ ID NO: 2176821 - protein, 17 aa, Cryptosporidium hominis
LPDACLAISQVKNGYDY

SEQ ID NO: 2176822 - protein, 23 aa, Cryptosporidium hominis
LPDDWYSCMSFTIKTFTCDSNGN

SEQ ID NO: 2176823 - protein, 17 aa, Cryptosporidium hominis
LPDFLKLKDCSSKSKNY

SEQ ID NO: 2176824 - protein, 18 aa, Cryptosporidium hominis
LPDVMSIRLDRKLSAKKT

SEQ ID NO: 2176825 - protein, 17 aa, Cryptosporidium hominis
LPDYSLRNIKLGQISFE

SEQ ID NO: 2176826 - protein, 17 aa, Cryptosporidium hominis
LPEDVSCNVWMMDSIGE

SEQ ID NO: 2176827 - protein, 30 aa, Cryptosporidium hominis
LPEGNRASIIQPFFETMNIFILQFSSCCKE

SEQ ID NO: 2176828 - protein, 17 aa, Cryptosporidium hominis
LPEPALETYTFDGMKGR

SEQ ID NO: 2176829 - protein, 24 aa, Cryptosporidium hominis
LPERSIKYIPCFCFPDRNYKIASL

SEQ ID NO: 2176830 - protein, 19 aa, Cryptosporidium hominis
LPFEKSYCLYRTNNYKDAL

SEQ ID NO: 2176831 - protein, 17 aa, Cryptosporidium hominis
LPFFKLSGPNIINGVSG

SEQ ID NO: 2176832 - protein, 20 aa, Cryptosporidium hominis
LPFMLELLLMSTAYQQWVSK

SEQ ID NO: 2176833 - protein, 17 aa, Cryptosporidium hominis
LPFPNYGTFLGKETAEY

SEQ ID NO: 2176834 - protein, 17 aa, Cryptosporidium hominis
LPFRNFYSSVYFINIAE

SEQ ID NO: 2176835 - protein, 19 aa, Cryptosporidium hominis
LPGITSICWGGDRNNTLIA

SEQ ID NO: 2176836 - protein, 17 aa, Cryptosporidium hominis
LPGLLKYNNPASVTVVI

SEQ ID NO: 2176837 - protein, 24 aa, Cryptosporidium hominis
LPGTDVGMRIAFGHLDENSTGSRT

SEQ ID NO: 2176838 - protein, 24 aa, Cryptosporidium hominis
LPGTFKIALCVGLRHEPIKDVSCV

SEQ ID NO: 2176839 - protein, 22 aa, Cryptosporidium hominis
LPGYPNEVQVVPEISKPQDARV

SEQ ID NO: 2176840 - protein, 25 aa, Cryptosporidium hominis
LPHTCAPCRGGPISSKAIHFAAIRG

SEQ ID NO: 2176841 - protein, 19 aa, Cryptosporidium hominis
LPIAQSFKNQFLLFNENSS

SEQ ID NO: 2176842 - protein, 36 aa, Cryptosporidium hominis
LPIDPRNRLSILFRKKKHWHISELNAYISPVLQPSI

SEQ ID NO: 2176843 - protein, 17 aa, Cryptosporidium hominis
LPIGMALFEDHTESLAT

SEQ ID NO: 2176844 - protein, 24 aa, Cryptosporidium hominis
LPIKWTEEHVELYLEATIVSCWSS

SEQ ID NO: 2176845 - protein, 18 aa, Cryptosporidium hominis
LPIKYAGISTCFRKEAGA

SEQ ID NO: 2176846 - protein, 22 aa, Cryptosporidium hominis
LPILNRHGFGPLTIVATSLNNK

SEQ ID NO: 2176847 - protein, 22 aa, Cryptosporidium hominis
LPINITEGFPSVGFQFETYLTR

SEQ ID NO: 2176848 - protein, 17 aa, Cryptosporidium hominis
LPISHPVILGISKILSD

SEQ ID NO: 2176849 - protein, 24 aa, Cryptosporidium hominis
LPIVKKFLGNHLFIFSSTINGYEG

SEQ ID NO: 2176850 - protein, 25 aa, Cryptosporidium hominis
LPKALLRARRKIIWIGPSAESMETV

SEQ ID NO: 2176851 - protein, 28 aa, Cryptosporidium hominis
LPKECDIMKRKKCNCYRTDYSGKISKAN

SEQ ID NO: 2176852 - protein, 25 aa, Cryptosporidium hominis
LPKHHVLKSLPLFDLDPNIFGIACG

SEQ ID NO: 2176853 - protein, 24 aa, Cryptosporidium hominis
LPKNERKLKCEDFSLNKIVKNLNH

SEQ ID NO: 2176854 - protein, 23 aa, Cryptosporidium hominis
LPKSCTGRQTLLFSATLTNAIKE

SEQ ID NO: 2176855 - protein, 21 aa, Cryptosporidium hominis
LPKSQFCSFILRKDIFLNSSY

SEQ ID NO: 2176856 - protein, 19 aa, Cryptosporidium hominis
LPKTFGFPNVPSFICKTEG

SEQ ID NO: 2176857 - protein, 26 aa, Cryptosporidium hominis
LPKVIRFLIKTIRKFQFITGKCVSVE

SEQ ID NO: 2176858 - protein, 18 aa, Cryptosporidium hominis
LPLDPEFQEMVKSEIADL

SEQ ID NO: 2176859 - protein, 23 aa, Cryptosporidium hominis
LPLDYRSRRPRGFGFVEYVEEED

SEQ ID NO: 2176860 - protein, 18 aa, Cryptosporidium hominis
LPLEKDSNLIWSISESLV

SEQ ID NO: 2176861 - protein, 17 aa, Cryptosporidium hominis
LPLGFGVLAKSSADMKN

SEQ ID NO: 2176862 - protein, 20 aa, Cryptosporidium hominis
LPLIILANWRGFSGGQKDMF

SEQ ID NO: 2176863 - protein, 19 aa, Cryptosporidium hominis
LPLTNCMHQIVGTKEFNPY

SEQ ID NO: 2176864 - protein, 26 aa, Cryptosporidium hominis
LPLTNPELFKRVGIKTPKGVLLYGPP

SEQ ID NO: 2176865 - protein, 24 aa, Cryptosporidium hominis
LPLTQGRMGFIFVCDINDIDSIKA

SEQ ID NO: 2176866 - protein, 20 aa, Cryptosporidium hominis
LPMIISHCPGWICYSEKSLN

SEQ ID NO: 2176867 - protein, 21 aa, Cryptosporidium hominis
LPNCGAVNFSSLCNYTNVYIF

SEQ ID NO: 2176868 - protein, 20 aa, Cryptosporidium hominis
LPNLSCFNWGNVKCDEIRSL

SEQ ID NO: 2176869 - protein, 17 aa, Cryptosporidium hominis
LPNNSAFPSGRIILDYI

SEQ ID NO: 2176870 - protein, 23 aa, Cryptosporidium hominis
LPPEHFRKAPPRCVSKQTVFTHY

SEQ ID NO: 2176871 - protein, 23 aa, Cryptosporidium hominis
LPPEHLRKLINIHGDMSSRKFQN

SEQ ID NO: 2176872 - protein, 20 aa, Cryptosporidium hominis
LPPEIGIQFNGRRIFARLAL

SEQ ID NO: 2176873 - protein, 17 aa, Cryptosporidium hominis
LPPFKYWEYFQADPSQN

SEQ ID NO: 2176874 - protein, 26 aa, Cryptosporidium hominis
LPPHPGIHAPPPFMDPWNMQGHPYPA

SEQ ID NO: 2176875 - protein, 23 aa, Cryptosporidium hominis
LPPKLRKLRDYRLNDIDVNHSNN

SEQ ID NO: 2176876 - protein, 26 aa, Cryptosporidium hominis
LPPKSPGLIPRFTIDMWDSSITSGPI

SEQ ID NO: 2176877 - protein, 25 aa, Cryptosporidium hominis
LPPKYPFKYLMLISFDENKNTSPVF

SEQ ID NO: 2176878 - protein, 19 aa, Cryptosporidium hominis
LPPLKLIIMSATLRVTDFS

SEQ ID NO: 2176879 - protein, 23 aa, Cryptosporidium hominis
LPPSLMSRFDLIYLILDKQSEES

SEQ ID NO: 2176880 - protein, 17 aa, Cryptosporidium hominis
LPPVMLENLPWLHHIDI

SEQ ID NO: 2176881 - protein, 21 aa, Cryptosporidium hominis
LPQKPCRCILLSNILAVEELL

SEQ ID NO: 2176882 - protein, 18 aa, Cryptosporidium hominis
LPRGNIHPLTRTSRKFKR

SEQ ID NO: 2176883 - protein, 23 aa, Cryptosporidium hominis
LPSARDGIISSFRNCVALGLDVD

SEQ ID NO: 2176884 - protein, 18 aa, Cryptosporidium hominis
LPSDLLAILNDIDSDGSG

SEQ ID NO: 2176885 - protein, 22 aa, Cryptosporidium hominis
LPSEAFPEYSITEDPRFQFKTH

SEQ ID NO: 2176886 - protein, 22 aa, Cryptosporidium hominis
LPSIVKRIWQYVEMKGLQNSKA

SEQ ID NO: 2176887 - protein, 20 aa, Cryptosporidium hominis
LPSLESRLYISEGIFCKTKL

SEQ ID NO: 2176888 - protein, 19 aa, Cryptosporidium hominis
LPSNFGYTIGEKVKGEDYS

SEQ ID NO: 2176889 - protein, 24 aa, Cryptosporidium hominis
LPSPHFKICGWISSSQFKFVDLWK

SEQ ID NO: 2176890 - protein, 17 aa, Cryptosporidium hominis
LPSRKNSFFGINRTAER

SEQ ID NO: 2176891 - protein, 20 aa, Cryptosporidium hominis
LPSTELIKYGNYKSDFVRQN

SEQ ID NO: 2176892 - protein, 18 aa, Cryptosporidium hominis
LPSTFRVVGVSPYSSSIK

SEQ ID NO: 2176893 - protein, 24 aa, Cryptosporidium hominis
LPTLRTAGLPKIYTAYQYPPCCPN

SEQ ID NO: 2176894 - protein, 19 aa, Cryptosporidium hominis
LPVCCVDAIMNINISLSIL

SEQ ID NO: 2176895 - protein, 27 aa, Cryptosporidium hominis
LPVICRKVFCGSNSDFGLILLQNGMLW

SEQ ID NO: 2176896 - protein, 17 aa, Cryptosporidium hominis
LPVLLGLLSVYNSTFMD

SEQ ID NO: 2176897 - protein, 19 aa, Cryptosporidium hominis
LPVRVYEFEILDAIENNDV

SEQ ID NO: 2176898 - protein, 21 aa, Cryptosporidium hominis
LPWREYWCYPKNNLERLKFSA

SEQ ID NO: 2176899 - protein, 17 aa, Cryptosporidium hominis
LPYETIRSIKLLEMNSY

SEQ ID NO: 2176900 - protein, 24 aa, Cryptosporidium hominis
LPYHFLLCSIGEFGELRYQDVSTG

SEQ ID NO: 2176901 - protein, 22 aa, Cryptosporidium hominis
LPYLQHSMIAFANRIPYQTTPE

SEQ ID NO: 2176902 - protein, 19 aa, Cryptosporidium hominis
LPYSTFRLNLSVTSPYNAD

SEQ ID NO: 2176903 - protein, 18 aa, Cryptosporidium hominis
LQAFKMWAPDSNNLTIIP

SEQ ID NO: 2176904 - protein, 23 aa, Cryptosporidium hominis
LQAGFRRFYICPIVSNCPRISSA

SEQ ID NO: 2176905 - protein, 17 aa, Cryptosporidium hominis
LQAQIYYMFNCREDQSV

SEQ ID NO: 2176906 - protein, 17 aa, Cryptosporidium hominis
LQCIFLLNLKDEFISKV

SEQ ID NO: 2176907 - protein, 21 aa, Cryptosporidium hominis
LQCKSPFLKEINHILRDWAVF

SEQ ID NO: 2176908 - protein, 17 aa, Cryptosporidium hominis
LQCNSCGTRMRFLLQVY

SEQ ID NO: 2176909 - protein, 18 aa, Cryptosporidium hominis
LQDFVLIGIFVKKGSITI

SEQ ID NO: 2176910 - protein, 25 aa, Cryptosporidium hominis
LQDLFKSCGSINRITIMNDKRTGMP

SEQ ID NO: 2176911 - protein, 19 aa, Cryptosporidium hominis
LQDNFNFLISENFLKPENE

SEQ ID NO: 2176912 - protein, 18 aa, Cryptosporidium hominis
LQDPRSAKKLLLVDDNTC

SEQ ID NO: 2176913 - protein, 22 aa, Cryptosporidium hominis
LQEKGLTCFINLVKNSEDVPQD

SEQ ID NO: 2176914 - protein, 33 aa, Cryptosporidium hominis
LQFHLPHHLEALCVFLHHVGPFLDSERWKHYED

SEQ ID NO: 2176915 - protein, 27 aa, Cryptosporidium hominis
LQFSSNYARKWPGIILSPRAKKKVSME

SEQ ID NO: 2176916 - protein, 19 aa, Cryptosporidium hominis
LQGACKFPNEFLYLNIPIY

SEQ ID NO: 2176917 - protein, 17 aa, Cryptosporidium hominis
LQGHGLNIENYEKENES

SEQ ID NO: 2176918 - protein, 25 aa, Cryptosporidium hominis
LQGKGLIPVCVFDGATLPMKRVTEE

SEQ ID NO: 2176919 - protein, 23 aa, Cryptosporidium hominis
LQGSYPLSFPVQSGYFYDYYNAL

SEQ ID NO: 2176920 - protein, 25 aa, Cryptosporidium hominis
LQHKPELGRNFTIKRYSSNDRKSPR

SEQ ID NO: 2176921 - protein, 17 aa, Cryptosporidium hominis
LQHLKSKHLLISTFLAA

SEQ ID NO: 2176922 - protein, 21 aa, Cryptosporidium hominis
LQHPWLRSWDTPNIPLCGIGM

SEQ ID NO: 2176923 - protein, 17 aa, Cryptosporidium hominis
LQHQCYLMRLGDGHTLE

SEQ ID NO: 2176924 - protein, 19 aa, Cryptosporidium hominis
LQHRILKKAFKVFNKEICM

SEQ ID NO: 2176925 - protein, 17 aa, Cryptosporidium hominis
LQIECIVDQLNVDIFIN

SEQ ID NO: 2176926 - protein, 21 aa, Cryptosporidium hominis
LQILELIGVVVNSGVWPFGRI

SEQ ID NO: 2176927 - protein, 25 aa, Cryptosporidium hominis
LQILTTIVKCFLKAPIHNQQLVTDI

SEQ ID NO: 2176928 - protein, 23 aa, Cryptosporidium hominis
LQIPNEKLFEWFIKKESINSKKV

SEQ ID NO: 2176929 - protein, 26 aa, Cryptosporidium hominis
LQKDNFKAGLLFYKKKYHEVVTPSLL

SEQ ID NO: 2176930 - protein, 24 aa, Cryptosporidium hominis
LQKICSPFGRINRLCLSPSKTIAI

SEQ ID NO: 2176931 - protein, 17 aa, Cryptosporidium hominis
LQKKYIADLKMIGEKIN

SEQ ID NO: 2176932 - protein, 22 aa, Cryptosporidium hominis
LQKLLRFVSGRSRLPQVNNNLS

SEQ ID NO: 2176933 - protein, 20 aa, Cryptosporidium hominis
LQKNKCYAINMVVSNDERNL

SEQ ID NO: 2176934 - protein, 22 aa, Cryptosporidium hominis
LQKRLSEELERASEFASKAEAN

SEQ ID NO: 2176935 - protein, 20 aa, Cryptosporidium hominis
LQKRLSIAIIKPQDRLDKRR

SEQ ID NO: 2176936 - protein, 24 aa, Cryptosporidium hominis
LQLEKRYAALFALRNILTGIIDSN

SEQ ID NO: 2176937 - protein, 23 aa, Cryptosporidium hominis
LQLKPRVAFNMACGNRRCVHLRH

SEQ ID NO: 2176938 - protein, 17 aa, Cryptosporidium hominis
LQLMMGITNTRINNKQK

SEQ ID NO: 2176939 - protein, 19 aa, Cryptosporidium hominis
LQLNGCHKVDVLNHHRQKN

SEQ ID NO: 2176940 - protein, 19 aa, Cryptosporidium hominis
LQLPLENIFFKQGSFVSRP

SEQ ID NO: 2176941 - protein, 19 aa, Cryptosporidium hominis
LQLRKGGIQSLQISDDGSG

SEQ ID NO: 2176942 - protein, 21 aa, Cryptosporidium hominis
LQLSDYFRLLIDRSIEIRNWR

SEQ ID NO: 2176943 - protein, 37 aa, Cryptosporidium hominis
LQLSELRYGISMWSGCTAAVCVRIFNEAHIAWVGDSR

SEQ ID NO: 2176944 - protein, 20 aa, Cryptosporidium hominis
LQLYSWLDMKLSQYESKQRK

SEQ ID NO: 2176945 - protein, 18 aa, Cryptosporidium hominis
LQNFKISSVVWTHTNELL

SEQ ID NO: 2176946 - protein, 17 aa, Cryptosporidium hominis
LQNNLMELWSLLHFLMP

SEQ ID NO: 2176947 - protein, 26 aa, Cryptosporidium hominis
LQNNLRELWSLLNFLMPNLFSSSEDF

SEQ ID NO: 2176948 - protein, 24 aa, Cryptosporidium hominis
LQNPRFVRDYCFVPSVMARFVNSG

SEQ ID NO: 2176949 - protein, 18 aa, Cryptosporidium hominis
LQNPRWTSSEVNNDGFGG

SEQ ID NO: 2176950 - protein, 22 aa, Cryptosporidium hominis
LQNSHPIKTCAQIESKKEILLE

SEQ ID NO: 2176951 - protein, 27 aa, Cryptosporidium hominis
LQNSLRELWSLLNFLYPEIFSSSEEFE

SEQ ID NO: 2176952 - protein, 18 aa, Cryptosporidium hominis
LQNWKKARTFLDLARSKN

SEQ ID NO: 2176953 - protein, 17 aa, Cryptosporidium hominis
LQNYWKELVQSVEKQLE

SEQ ID NO: 2176954 - protein, 41 aa, Cryptosporidium hominis
LQPKVLSLTRRLWQKGIRSEYRLTPVRSLAIFLEKLKKDTL

SEQ ID NO: 2176955 - protein, 22 aa, Cryptosporidium hominis
LQQERLRMWAKDNAKYTSSISN

SEQ ID NO: 2176956 - protein, 21 aa, Cryptosporidium hominis
LQQFMLRMQINASKDQIPPGT

SEQ ID NO: 2176957 - protein, 19 aa, Cryptosporidium hominis
LQQLSGWTVVADRLNFNRF

SEQ ID NO: 2176958 - protein, 27 aa, Cryptosporidium hominis
LQQRIRGGAVPPVLRPGAIPPGPPGVH

SEQ ID NO: 2176959 - protein, 18 aa, Cryptosporidium hominis
LQRFILYILVCNATQLIL

SEQ ID NO: 2176960 - protein, 23 aa, Cryptosporidium hominis
LQRLRWKHFIVRGEIIKNVSIDK

SEQ ID NO: 2176961 - protein, 45 aa, Cryptosporidium hominis
LQRRYRTMLLARGFWRIWSSCYSPLFKRKTNCGVVRGPGMSSFRP

SEQ ID NO: 2176962 - protein, 25 aa, Cryptosporidium hominis
LQRSCKRLMTHINIRETEFGNKLLD

SEQ ID NO: 2176963 - protein, 25 aa, Cryptosporidium hominis
LQRWFYELFHDFPFFSISPYTKTLK

SEQ ID NO: 2176964 - protein, 41 aa, Cryptosporidium hominis
LQSEEVIELFIDRNGFLFQYILDYLRTGTIVAIPNKDHIIR

SEQ ID NO: 2176965 - protein, 22 aa, Cryptosporidium hominis
LQSELIFEMTLFDTHVKEIKEM

SEQ ID NO: 2176966 - protein, 17 aa, Cryptosporidium hominis
LQSGIILADEEDFKTSF

SEQ ID NO: 2176967 - protein, 17 aa, Cryptosporidium hominis
LQSLFLNVFNLLSHLTE

SEQ ID NO: 2176968 - protein, 17 aa, Cryptosporidium hominis
LQSLKYMLLSKIMSQQT

SEQ ID NO: 2176969 - protein, 20 aa, Cryptosporidium hominis
LQSLQCEYIYLACKFKNDST

SEQ ID NO: 2176970 - protein, 24 aa, Cryptosporidium hominis
LQSRCTRFRFSPLPIEDIRNRISE

SEQ ID NO: 2176971 - protein, 17 aa, Cryptosporidium hominis
LQSRLSVLDSCKDEITS

SEQ ID NO: 2176972 - protein, 25 aa, Cryptosporidium hominis
LQTDWSTKCCCTSRVKFSDTDIQED

SEQ ID NO: 2176973 - protein, 36 aa, Cryptosporidium hominis
LQTKRRLSKRISVLSKFGAPVVRRADGEETIEYRDG

SEQ ID NO: 2176974 - protein, 31 aa, Cryptosporidium hominis
LQTMINKAILPWFRLGSRPILSDESDEYSET

SEQ ID NO: 2176975 - protein, 24 aa, Cryptosporidium hominis
LQVKEISNLLLLFKKLQENVDASI

SEQ ID NO: 2176976 - protein, 22 aa, Cryptosporidium hominis
LQVTLYCRLLDWVIFTCNENLR

SEQ ID NO: 2176977 - protein, 25 aa, Cryptosporidium hominis
LQVYRFGETVSIPFFDGSWQPSSFY

SEQ ID NO: 2176978 - protein, 21 aa, Cryptosporidium hominis
LQYKLALALNNLHLKGLCHLD

SEQ ID NO: 2176979 - protein, 21 aa, Cryptosporidium hominis
LQYRCIDSIAPLNTHQVNNGY

SEQ ID NO: 2176980 - protein, 23 aa, Cryptosporidium hominis
LRAHKEWVKRFAISAESSSLIAT

SEQ ID NO: 2176981 - protein, 24 aa, Cryptosporidium hominis
LRAIGSSSRLAMSLMTTGYNNSSE

SEQ ID NO: 2176982 - protein, 17 aa, Cryptosporidium hominis
LRAKRLFQNAIQVKPGI

SEQ ID NO: 2176983 - protein, 21 aa, Cryptosporidium hominis
LRANLGINVAKNFKEEVEALG

SEQ ID NO: 2176984 - protein, 17 aa, Cryptosporidium hominis
LRCYAEITSTPEIITIY

SEQ ID NO: 2176985 - protein, 22 aa, Cryptosporidium hominis
LRDEIFSSLLFPGSKVSAGTLY

SEQ ID NO: 2176986 - protein, 18 aa, Cryptosporidium hominis
LRDFTKVRSSGTCLQDRL

SEQ ID NO: 2176987 - protein, 17 aa, Cryptosporidium hominis
LRDGGKLCIFRRLTQEL

SEQ ID NO: 2176988 - protein, 22 aa, Cryptosporidium hominis
LRDHVDVGWYHMVVTFNTTQNN

SEQ ID NO: 2176989 - protein, 19 aa, Cryptosporidium hominis
LRDLLLKLIDLEIVELKRF

SEQ ID NO: 2176990 - protein, 17 aa, Cryptosporidium hominis
LRDSQSYRRSVYNSNGD

SEQ ID NO: 2176991 - protein, 17 aa, Cryptosporidium hominis
LRECPQCRLHIASRRSL

SEQ ID NO: 2176992 - protein, 17 aa, Cryptosporidium hominis
LREEYDREMKLFMEYQS

SEQ ID NO: 2176993 - protein, 20 aa, Cryptosporidium hominis
LREGEILKHLSVQEAETTKD

SEQ ID NO: 2176994 - protein, 18 aa, Cryptosporidium hominis
LREHQRQGVTFIFECLMG

SEQ ID NO: 2176995 - protein, 18 aa, Cryptosporidium hominis
LREITIFSITPYVSSIGR

SEQ ID NO: 2176996 - protein, 22 aa, Cryptosporidium hominis
LREKGSRVLIFSQMVRMLNIIS

SEQ ID NO: 2176997 - protein, 23 aa, Cryptosporidium hominis
LRELGAYEVLRVWHLYESKDEII

SEQ ID NO: 2176998 - protein, 24 aa, Cryptosporidium hominis
LREMSLDDSCLFSIRQFLHLVPRL

SEQ ID NO: 2176999 - protein, 22 aa, Cryptosporidium hominis
LRESAIEFAKSIPLPDEPPADH

SEQ ID NO: 2177000 - protein, 24 aa, Cryptosporidium hominis
LREVGLKPDFLFGRCEVPIDDLCR

SEQ ID NO: 2177001 - protein, 20 aa, Cryptosporidium hominis
LRFAMGHSIQGVWKDGVLSQ

SEQ ID NO: 2177002 - protein, 20 aa, Cryptosporidium hominis
LRFATEAAITLLRIDDYIKV

SEQ ID NO: 2177003 - protein, 18 aa, Cryptosporidium hominis
LRFKDFKNTDLVDILINM

SEQ ID NO: 2177004 - protein, 19 aa, Cryptosporidium hominis
LRFVKEISNKFSFGKQHDA

SEQ ID NO: 2177005 - protein, 29 aa, Cryptosporidium hominis
LRGHEGPVWQVCWAHPTFGSVLASCSYDK

SEQ ID NO: 2177006 - protein, 22 aa, Cryptosporidium hominis
LRGKVVSSFSFFPPKLSGLVLR

SEQ ID NO: 2177007 - protein, 20 aa, Cryptosporidium hominis
LRGVALKFAQFINLNNIGIP

SEQ ID NO: 2177008 - protein, 19 aa, Cryptosporidium hominis
LRGVLDSMLLSEKKEGNSN

SEQ ID NO: 2177009 - protein, 21 aa, Cryptosporidium hominis
LRGWIEVLKRIPLYNPSNPGG

SEQ ID NO: 2177010 - protein, 18 aa, Cryptosporidium hominis
LRIHPGMLDSVFQASSVL

SEQ ID NO: 2177011 - protein, 17 aa, Cryptosporidium hominis
LRIIDARMVAKEIRKER

SEQ ID NO: 2177012 - protein, 24 aa, Cryptosporidium hominis
LRILSRDILIEFARQEKDTIKSSS

SEQ ID NO: 2177013 - protein, 27 aa, Cryptosporidium hominis
LRIQKGASITPRFSLEESLNYRRSSVG

SEQ ID NO: 2177014 - protein, 27 aa, Cryptosporidium hominis
LRITNAYKYAKYFAVIRRYKISRAIFE

SEQ ID NO: 2177015 - protein, 18 aa, Cryptosporidium hominis
LRIYWDYYSRGILQESVK

SEQ ID NO: 2177016 - protein, 26 aa, Cryptosporidium hominis
LRKAFKARTSLLLGQGIIEEPEDTGL

SEQ ID NO: 2177017 - protein, 20 aa, Cryptosporidium hominis
LRKDSHVIASAWHENRTEKS

SEQ ID NO: 2177018 - protein, 18 aa, Cryptosporidium hominis
LRKKVWPAVIVRQRKAFR

SEQ ID NO: 2177019 - protein, 17 aa, Cryptosporidium hominis
LRKLDCALLGLTPPVPS

SEQ ID NO: 2177020 - protein, 23 aa, Cryptosporidium hominis
LRKLPRQAAWSFVSMLKSNSSER

SEQ ID NO: 2177021 - protein, 18 aa, Cryptosporidium hominis
LRKMSCILKLKILTLNDH

SEQ ID NO: 2177022 - protein, 20 aa, Cryptosporidium hominis
LRKMYCKYNQPYLTCLDCLE

SEQ ID NO: 2177023 - protein, 34 aa, Cryptosporidium hominis
LRKNHTFTLCQLILKKPRLRDIKQLQYTVEPEVS

SEQ ID NO: 2177024 - protein, 26 aa, Cryptosporidium hominis
LRKNPDIWTIWRPEKALSLHKKQVSL

SEQ ID NO: 2177025 - protein, 20 aa, Cryptosporidium hominis
LRKRKLVELQKRFGGKKEEK

SEQ ID NO: 2177026 - protein, 19 aa, Cryptosporidium hominis
LRKSLEEVVIFPNQNLWLQ

SEQ ID NO: 2177027 - protein, 17 aa, Cryptosporidium hominis
LRKSRYSLSSNYINMSD

SEQ ID NO: 2177028 - protein, 18 aa, Cryptosporidium hominis
LRKTDFFTAMNQGEEEKI

SEQ ID NO: 2177029 - protein, 26 aa, Cryptosporidium hominis
LRKVGINLPPYVPFSLGSVVIPESDS

SEQ ID NO: 2177030 - protein, 21 aa, Cryptosporidium hominis
LRKVIWNSILGLERFDTFSVS

SEQ ID NO: 2177031 - protein, 25 aa, Cryptosporidium hominis
LRKYKEWYNDVVVICNFSSRRYNHY

SEQ ID NO: 2177032 - protein, 26 aa, Cryptosporidium hominis
LRLAMESLKLAMKWDEDRFGLEYDLE

SEQ ID NO: 2177033 - protein, 20 aa, Cryptosporidium hominis
LRLAYNIGTSIWHWSGSVPL

SEQ ID NO: 2177034 - protein, 21 aa, Cryptosporidium hominis
LRLDFSNLFCGGNTILTLFAE

SEQ ID NO: 2177035 - protein, 19 aa, Cryptosporidium hominis
LRLEYRVSRIERTLESLIK

SEQ ID NO: 2177036 - protein, 20 aa, Cryptosporidium hominis
LRLFRSGQRPILVATDVAAR

SEQ ID NO: 2177037 - protein, 20 aa, Cryptosporidium hominis
LRLILKAFLLLGNYVNHGIN

SEQ ID NO: 2177038 - protein, 25 aa, Cryptosporidium hominis
LRLISQKLFPGWLSPDMLKCNSELP

SEQ ID NO: 2177039 - protein, 26 aa, Cryptosporidium hominis
LRLKQQYFFVCATIQDILRRFKKSGK

SEQ ID NO: 2177040 - protein, 18 aa, Cryptosporidium hominis
LRLLKLQRWFYELFHDFP

SEQ ID NO: 2177041 - protein, 27 aa, Cryptosporidium hominis
LRLNSLYGSIYYFKLGIIKDLPPPIQP

SEQ ID NO: 2177042 - protein, 19 aa, Cryptosporidium hominis
LRLYEKWSNTRSNHVTITQ

SEQ ID NO: 2177043 - protein, 19 aa, Cryptosporidium hominis
LRMKFLQLWNIYSNKNLIE

SEQ ID NO: 2177044 - protein, 18 aa, Cryptosporidium hominis
LRMYARLANKLSEVSFEC

SEQ ID NO: 2177045 - protein, 18 aa, Cryptosporidium hominis
LRNAISRKSANYGKDRNQ

SEQ ID NO: 2177046 - protein, 25 aa, Cryptosporidium hominis
LRNEEIKTYWSIRVAYDTLTQERDS

SEQ ID NO: 2177047 - protein, 23 aa, Cryptosporidium hominis
LRNEQFSSVSLELVKQKSLFAKE

SEQ ID NO: 2177048 - protein, 18 aa, Cryptosporidium hominis
LRNKMVLVLERRREEYLK

SEQ ID NO: 2177049 - protein, 19 aa, Cryptosporidium hominis
LRNLELWFISDPEITSIKS

SEQ ID NO: 2177050 - protein, 19 aa, Cryptosporidium hominis
LRNLLKFDTRTGVSDRIKT

SEQ ID NO: 2177051 - protein, 17 aa, Cryptosporidium hominis
LRNLRFLVLDEADRLLS

SEQ ID NO: 2177052 - protein, 23 aa, Cryptosporidium hominis
LRNSFQFTVCIIVEKKPYNFYQE

SEQ ID NO: 2177053 - protein, 19 aa, Cryptosporidium hominis
LRNSIIRLVPKEQLNSVFF

SEQ ID NO: 2177054 - protein, 21 aa, Cryptosporidium hominis
LRNVPKCWTYETSLIVDTYID

SEQ ID NO: 2177055 - protein, 32 aa, Cryptosporidium hominis
LRNYNIPIEKVVWDYLHFLYRQNTGVLGYLAP

SEQ ID NO: 2177056 - protein, 17 aa, Cryptosporidium hominis
LRPDEYLNRFLEQGVRC

SEQ ID NO: 2177057 - protein, 17 aa, Cryptosporidium hominis
LRPFLLKAVQRKWKCHL

SEQ ID NO: 2177058 - protein, 33 aa, Cryptosporidium hominis
LRPFPHGITWCYRSARFKVRYRRSSDGCWTATS

SEQ ID NO: 2177059 - protein, 25 aa, Cryptosporidium hominis
LRPLSGDCLTCLYSVGQEEPLVEVP

SEQ ID NO: 2177060 - protein, 17 aa, Cryptosporidium hominis
LRPSLEETFEFFSQDVC

SEQ ID NO: 2177061 - protein, 25 aa, Cryptosporidium hominis
LRQLRCAGMLESIRIRRSGYSVRRK

SEQ ID NO: 2177062 - protein, 18 aa, Cryptosporidium hominis
LRQWIKKKMPGISEKEIN

SEQ ID NO: 2177063 - protein, 23 aa, Cryptosporidium hominis
LRQYKMRMNLYIDKSNEVYVTEP

SEQ ID NO: 2177064 - protein, 23 aa, Cryptosporidium hominis
LRRAEHQSGVPGVYWQESSQRWI

SEQ ID NO: 2177065 - protein, 18 aa, Cryptosporidium hominis
LRRCIKEVLEQSEVNTVF

SEQ ID NO: 2177066 - protein, 25 aa, Cryptosporidium hominis
LRRDHLKALVLRYAKENGKDTFSEV

SEQ ID NO: 2177067 - protein, 35 aa, Cryptosporidium hominis
LRRLFKDLFFREGYQYDFIFDWSFLQPEKDRRRTG

SEQ ID NO: 2177068 - protein, 19 aa, Cryptosporidium hominis
LRRREWLLWHSKNLDKIEL

SEQ ID NO: 2177069 - protein, 21 aa, Cryptosporidium hominis
LRRRLARGVPQDFRWKIWNSL

SEQ ID NO: 2177070 - protein, 23 aa, Cryptosporidium hominis
LRSAAIRFGMRYISSGKELSFGG

SEQ ID NO: 2177071 - protein, 17 aa, Cryptosporidium hominis
LRSAYSMAKAMVEGHNP

SEQ ID NO: 2177072 - protein, 25 aa, Cryptosporidium hominis
LRSEACPRLVELLGHPSPLVQTPAL

SEQ ID NO: 2177073 - protein, 18 aa, Cryptosporidium hominis
LRSECLNYSFTYDSPMPL

SEQ ID NO: 2177074 - protein, 18 aa, Cryptosporidium hominis
LRSESIKIVLGYFDSDYY

SEQ ID NO: 2177075 - protein, 23 aa, Cryptosporidium hominis
LRSEVDTIFLLSRLIEITELLDP

SEQ ID NO: 2177076 - protein, 20 aa, Cryptosporidium hominis
LRSIANILFPSYIMEEKELT

SEQ ID NO: 2177077 - protein, 22 aa, Cryptosporidium hominis
LRSIRYIKELPHEIDHVVCGDI

SEQ ID NO: 2177078 - protein, 17 aa, Cryptosporidium hominis
LRSKLSLQQQIFHTASE

SEQ ID NO: 2177079 - protein, 20 aa, Cryptosporidium hominis
LRSPLSIKEVSAFEGMGEME

SEQ ID NO: 2177080 - protein, 20 aa, Cryptosporidium hominis
LRSRCLCIRVPLPSPEEVLQ

SEQ ID NO: 2177081 - protein, 21 aa, Cryptosporidium hominis
LRTDIIRQMRSSIHEGPEEVG

SEQ ID NO: 2177082 - protein, 20 aa, Cryptosporidium hominis
LRTDNEWSLLSEIAVNCAVA

SEQ ID NO: 2177083 - protein, 17 aa, Cryptosporidium hominis
LRTGKRQKKSWKRVVNK

SEQ ID NO: 2177084 - protein, 17 aa, Cryptosporidium hominis
LRTGNICSHKFRITSKL

SEQ ID NO: 2177085 - protein, 24 aa, Cryptosporidium hominis
LRTLKGKCIECITIIGFSIDYSIF

SEQ ID NO: 2177086 - protein, 26 aa, Cryptosporidium hominis
LRTMIEFSQHINLIFWTVLSPTWNEE

SEQ ID NO: 2177087 - protein, 27 aa, Cryptosporidium hominis
LRTVELFYLKYCLPKLGDILKKYNVEI

SEQ ID NO: 2177088 - protein, 17 aa, Cryptosporidium hominis
LRVAKKVKDKVRKRKDK

SEQ ID NO: 2177089 - protein, 19 aa, Cryptosporidium hominis
LRVDNAIRIFRYNGDLLKR

SEQ ID NO: 2177090 - protein, 17 aa, Cryptosporidium hominis
LRVDSIVFSCKYLPFKF

SEQ ID NO: 2177091 - protein, 19 aa, Cryptosporidium hominis
LRVIFSIVYFEISFLLCDS

SEQ ID NO: 2177092 - protein, 25 aa, Cryptosporidium hominis
LRVKAILLLWKILYLHFTNSDSIED

SEQ ID NO: 2177093 - protein, 21 aa, Cryptosporidium hominis
LRVKCVISTDTIRHVLRSTEK

SEQ ID NO: 2177094 - protein, 18 aa, Cryptosporidium hominis
LRVKGKLSKFGLEQQNSL

SEQ ID NO: 2177095 - protein, 17 aa, Cryptosporidium hominis
LRVKLRRDTEKPEYNPF

SEQ ID NO: 2177096 - protein, 28 aa, Cryptosporidium hominis
LRVKPNWRKPKGIDCRVRRKFKGNYLMP

SEQ ID NO: 2177097 - protein, 21 aa, Cryptosporidium hominis
LRVLAKKGLLERVEEKVNDVF

SEQ ID NO: 2177098 - protein, 17 aa, Cryptosporidium hominis
LRVLIQHVYNMALHDNY

SEQ ID NO: 2177099 - protein, 17 aa, Cryptosporidium hominis
LRVLPTRYARFNSTLSF

SEQ ID NO: 2177100 - protein, 17 aa, Cryptosporidium hominis
LRVPSYLNNSPLIDKHN

SEQ ID NO: 2177101 - protein, 22 aa, Cryptosporidium hominis
LRYLADKCKLMGKSPEERNKIE

SEQ ID NO: 2177102 - protein, 17 aa, Cryptosporidium hominis
LRYQLPMRGHTGYLSFA

SEQ ID NO: 2177103 - protein, 19 aa, Cryptosporidium hominis
LRYRRAVETLYRMGYLCII

SEQ ID NO: 2177104 - protein, 21 aa, Cryptosporidium hominis
LSACASRLGLSMSEEELKTML

SEQ ID NO: 2177105 - protein, 27 aa, Cryptosporidium hominis
LSACMKTLPGVDLKPILTNLMNRLSNY

SEQ ID NO: 2177106 - protein, 17 aa, Cryptosporidium hominis
LSALGIPNTCHFKEITK

SEQ ID NO: 2177107 - protein, 23 aa, Cryptosporidium hominis
LSANLFFPNFRIVSIKDNSSGDR

SEQ ID NO: 2177108 - protein, 19 aa, Cryptosporidium hominis
LSCIAHLHVGESITTFQQG

SEQ ID NO: 2177109 - protein, 23 aa, Cryptosporidium hominis
LSCLKCGNSFIYPSLSRVLFLIF

SEQ ID NO: 2177110 - protein, 23 aa, Cryptosporidium hominis
LSCPQCKKLGLKTSFFCSQVCFK

SEQ ID NO: 2177111 - protein, 18 aa, Cryptosporidium hominis
LSDCESSQCKNNKRTGNL

SEQ ID NO: 2177112 - protein, 21 aa, Cryptosporidium hominis
LSDCRFCILFNTFGSSSDSWP

SEQ ID NO: 2177113 - protein, 18 aa, Cryptosporidium hominis
LSDDHFRVLILLEIKEKC

SEQ ID NO: 2177114 - protein, 21 aa, Cryptosporidium hominis
LSDDYLSQFGIILDNNKCTKS

SEQ ID NO: 2177115 - protein, 23 aa, Cryptosporidium hominis
LSDEASQFGTWVFQLVESSKNDY

SEQ ID NO: 2177116 - protein, 38 aa, Cryptosporidium hominis
LSDFPKTTMKFSLRRNRLLLWRSIKCQIWKTQYIEYCF

SEQ ID NO: 2177117 - protein, 39 aa, Cryptosporidium hominis
LSDPQFKSGYKGVSWNSRMEAWLAFFVENGVRKSKTFSS

SEQ ID NO: 2177118 - protein, 22 aa, Cryptosporidium hominis
LSDPQFRLVLEQLKQNPATLTQ

SEQ ID NO: 2177119 - protein, 17 aa, Cryptosporidium hominis
LSDQELQLMMGITNTRI

SEQ ID NO: 2177120 - protein, 20 aa, Cryptosporidium hominis
LSDRMIVEFFLSAYSIPSNT

SEQ ID NO: 2177121 - protein, 28 aa, Cryptosporidium hominis
LSEECYWVRIKLSYLFKEGEELPASHIL

SEQ ID NO: 2177122 - protein, 17 aa, Cryptosporidium hominis
LSEIKWAEITTDDLDRL

SEQ ID NO: 2177123 - protein, 31 aa, Cryptosporidium hominis
LSEIPHFKLFRKGNCSNGIREVQFSKRQESP

SEQ ID NO: 2177124 - protein, 20 aa, Cryptosporidium hominis
LSEIQYRNSVKRFIGDDSIQ

SEQ ID NO: 2177125 - protein, 20 aa, Cryptosporidium hominis
LSEIRLMSIQLFNITKKKYL

SEQ ID NO: 2177126 - protein, 21 aa, Cryptosporidium hominis
LSEKFKYIVSVIVLQRSPAGF

SEQ ID NO: 2177127 - protein, 25 aa, Cryptosporidium hominis
LSELKVGVFYLEQFINLQIEYWSLK

SEQ ID NO: 2177128 - protein, 28 aa, Cryptosporidium hominis
LSELNYIPEWFRIGLRILTVSNALELRG

SEQ ID NO: 2177129 - protein, 19 aa, Cryptosporidium hominis
LSENSRLLGIKKVELDEAR

SEQ ID NO: 2177130 - protein, 26 aa, Cryptosporidium hominis
LSERKRAKEYLAWLIAQRTSTVSVDT

SEQ ID NO: 2177131 - protein, 23 aa, Cryptosporidium hominis
LSESFAQFYTECRIIGLEEQQLE

SEQ ID NO: 2177132 - protein, 40 aa, Cryptosporidium hominis
LSESGKRKFRFSSFCPKLLNCLFPWIRSEQYFEDHDQPIF

SEQ ID NO: 2177133 - protein, 27 aa, Cryptosporidium hominis
LSESGMCPQRIALELSEDRVAALKSGS

SEQ ID NO: 2177134 - protein, 24 aa, Cryptosporidium hominis
LSETFRSLSNWEIIYNPRSLPFQE

SEQ ID NO: 2177135 - protein, 17 aa, Cryptosporidium hominis
LSFDPRRLNEWILNNME

SEQ ID NO: 2177136 - protein, 20 aa, Cryptosporidium hominis
LSFICLKPEPSSISSISKEM

SEQ ID NO: 2177137 - protein, 19 aa, Cryptosporidium hominis
LSFIPKLSYDILLAHVPGC

SEQ ID NO: 2177138 - protein, 20 aa, Cryptosporidium hominis
LSFIQWKFPTRVLNNSNQII

SEQ ID NO: 2177139 - protein, 19 aa, Cryptosporidium hominis
LSFLYSKGHSVDWKIEAIE

SEQ ID NO: 2177140 - protein, 27 aa, Cryptosporidium hominis
LSFPIVCESLQLWGHLRLYDGSTATNH

SEQ ID NO: 2177141 - protein, 28 aa, Cryptosporidium hominis
LSGGCKLSIGTACTGGFGYFDKTNDSTW

SEQ ID NO: 2177142 - protein, 17 aa, Cryptosporidium hominis
LSGNERIIVQDRDDEEE

SEQ ID NO: 2177143 - protein, 18 aa, Cryptosporidium hominis
LSGPYRNFAFLFRNPSYK

SEQ ID NO: 2177144 - protein, 18 aa, Cryptosporidium hominis
LSGSDFFVKPAQNILSIA

SEQ ID NO: 2177145 - protein, 18 aa, Cryptosporidium hominis
LSGTFRYLTTILLCDRLI

SEQ ID NO: 2177146 - protein, 17 aa, Cryptosporidium hominis
LSHIKHYGMLLGSFILR

SEQ ID NO: 2177147 - protein, 26 aa, Cryptosporidium hominis
LSHKLNYLISIMFEKLYHGTEVRKYY

SEQ ID NO: 2177148 - protein, 26 aa, Cryptosporidium hominis
LSHKVFKNEGFFDIAREIKLRKLSYS

SEQ ID NO: 2177149 - protein, 27 aa, Cryptosporidium hominis
LSHLWRASLNILLLLARCSNLVLISES

SEQ ID NO: 2177150 - protein, 25 aa, Cryptosporidium hominis
LSIECMKDIGAFLVSLSKRFEDQLG

SEQ ID NO: 2177151 - protein, 22 aa, Cryptosporidium hominis
LSIGEIAASFALLRIPRVKEIL

SEQ ID NO: 2177152 - protein, 17 aa, Cryptosporidium hominis
LSILNSLSWPSEILTSL

SEQ ID NO: 2177153 - protein, 25 aa, Cryptosporidium hominis
LSIREPGKLLADWFNIIDLSILTDK

SEQ ID NO: 2177154 - protein, 19 aa, Cryptosporidium hominis
LSISLNVKECLALFPIKKF

SEQ ID NO: 2177155 - protein, 24 aa, Cryptosporidium hominis
LSISRASFSWGVPVPNDQEHVMYV

SEQ ID NO: 2177156 - protein, 38 aa, Cryptosporidium hominis
LSISYSCIRKSKIPLKMIICGVSQRLKQGLYKTLAESW

SEQ ID NO: 2177157 - protein, 22 aa, Cryptosporidium hominis
LSKALPLDLGIDFNSNSSQKFR

SEQ ID NO: 2177158 - protein, 28 aa, Cryptosporidium hominis
LSKATRSRLLLKERIFSMNPFGVNINGR

SEQ ID NO: 2177159 - protein, 20 aa, Cryptosporidium hominis
LSKDEFSRVIRLDAQRAGQL

SEQ ID NO: 2177160 - protein, 26 aa, Cryptosporidium hominis
LSKFIWERIKNIFNYHEFEINENDSY

SEQ ID NO: 2177161 - protein, 27 aa, Cryptosporidium hominis
LSKHEYSECLVIVLGYDFLFEKSPILF

SEQ ID NO: 2177162 - protein, 17 aa, Cryptosporidium hominis
LSKIGMRAKISNWKKPE

SEQ ID NO: 2177163 - protein, 25 aa, Cryptosporidium hominis
LSKIPFPILLVYIGLNAGLFRGSEF

SEQ ID NO: 2177164 - protein, 21 aa, Cryptosporidium hominis
LSKIPLKLAYFNISKFWEEAE

SEQ ID NO: 2177165 - protein, 47 aa, Cryptosporidium hominis
LSKLVPDILSSICGGEGLKMVAKEKLSFWMDLPCNMDRKKAKTGIGP

SEQ ID NO: 2177166 - protein, 19 aa, Cryptosporidium hominis
LSKRFLLERRITNNSDIGD

SEQ ID NO: 2177167 - protein, 25 aa, Cryptosporidium hominis
LSKRNCISLSFLLEEERLIINSPCI

SEQ ID NO: 2177168 - protein, 17 aa, Cryptosporidium hominis
LSKRNLRKMNSDLETIV

SEQ ID NO: 2177169 - protein, 22 aa, Cryptosporidium hominis
LSKSELEAECKLRGLNSKGSKE

SEQ ID NO: 2177170 - protein, 24 aa, Cryptosporidium hominis
LSKSNMPIPNFVPKAVPSFIAKQI

SEQ ID NO: 2177171 - protein, 17 aa, Cryptosporidium hominis
LSLDAAAILENFYVKIR

SEQ ID NO: 2177172 - protein, 25 aa, Cryptosporidium hominis
LSLELIKLFIYIWGLDKSFSMDESK

SEQ ID NO: 2177173 - protein, 20 aa, Cryptosporidium hominis
LSLESFGSCFSEFQSQSSFY

SEQ ID NO: 2177174 - protein, 17 aa, Cryptosporidium hominis
LSLFRSKIPQLIRHLGW

SEQ ID NO: 2177175 - protein, 24 aa, Cryptosporidium hominis
LSLHKALLIKVSLKLFIHLLLFTI

SEQ ID NO: 2177176 - protein, 25 aa, Cryptosporidium hominis
LSLICKCMARIYLILLKKGIINAHQ

SEQ ID NO: 2177177 - protein, 25 aa, Cryptosporidium hominis
LSLKHPRILFRIYGKHVGKFYDSKV

SEQ ID NO: 2177178 - protein, 23 aa, Cryptosporidium hominis
LSLLKFGETFFRSENYDSDTVIT

SEQ ID NO: 2177179 - protein, 26 aa, Cryptosporidium hominis
LSLNALKALPGWGARQKLERFGLRFI

SEQ ID NO: 2177180 - protein, 18 aa, Cryptosporidium hominis
LSLPKTIFAHGFVTAPDG

SEQ ID NO: 2177181 - protein, 19 aa, Cryptosporidium hominis
LSLRFVRGTLVVCDIHNKL

SEQ ID NO: 2177182 - protein, 20 aa, Cryptosporidium hominis
LSLRSLCSIKDQIPIELYEH

SEQ ID NO: 2177183 - protein, 28 aa, Cryptosporidium hominis
LSLRYHPFENICGFTNPYYGENNGLTEL

SEQ ID NO: 2177184 - protein, 26 aa, Cryptosporidium hominis
LSLSSEKKWRMKIENIMKSNDKSSQN

SEQ ID NO: 2177185 - protein, 28 aa, Cryptosporidium hominis
LSNCCSGCSFLNSIFEFHGLDPLISFSI

SEQ ID NO: 2177186 - protein, 21 aa, Cryptosporidium hominis
LSNDFKHWSIKLAKRNSERQT

SEQ ID NO: 2177187 - protein, 24 aa, Cryptosporidium hominis
LSNEFWIPICLPTISTVSYVYCYI

SEQ ID NO: 2177188 - protein, 19 aa, Cryptosporidium hominis
LSNEVVLNFSLVKNLNISN

SEQ ID NO: 2177189 - protein, 22 aa, Cryptosporidium hominis
LSNGELYTWGCSKNGKLGHGQF

SEQ ID NO: 2177190 - protein, 17 aa, Cryptosporidium hominis
LSNKMDINMAFKHFEFS

SEQ ID NO: 2177191 - protein, 17 aa, Cryptosporidium hominis
LSNLCLAIPELNNSSPR

SEQ ID NO: 2177192 - protein, 18 aa, Cryptosporidium hominis
LSNLSILYMFEFPEKRGK

SEQ ID NO: 2177193 - protein, 24 aa, Cryptosporidium hominis
LSNQWKTGIDFMYSKYGQYDLMIA

SEQ ID NO: 2177194 - protein, 18 aa, Cryptosporidium hominis
LSNTTVCSIWKIERLIGG

SEQ ID NO: 2177195 - protein, 26 aa, Cryptosporidium hominis
LSNVFPCVIIPLKVQKIFSILSNHTM

SEQ ID NO: 2177196 - protein, 20 aa, Cryptosporidium hominis
LSNVYMSIAIQRLMNAKYAF

SEQ ID NO: 2177197 - protein, 24 aa, Cryptosporidium hominis
LSNYLSELLINFPVNVISGNDFVE

SEQ ID NO: 2177198 - protein, 20 aa, Cryptosporidium hominis
LSPECLIFAQRFLKPSGTMI

SEQ ID NO: 2177199 - protein, 24 aa, Cryptosporidium hominis
LSPFKLKLEIARWLSNCISCLTSS

SEQ ID NO: 2177200 - protein, 26 aa, Cryptosporidium hominis
LSPHLFVAFCRARMLSPDCRCKTFDA

SEQ ID NO: 2177201 - protein, 20 aa, Cryptosporidium hominis
LSPKLLRYLEQKEKDQDNNP

SEQ ID NO: 2177202 - protein, 18 aa, Cryptosporidium hominis
LSPLSSCLKEIASGEDTN

SEQ ID NO: 2177203 - protein, 19 aa, Cryptosporidium hominis
LSPQQLKLRARIHVCCCGY

SEQ ID NO: 2177204 - protein, 21 aa, Cryptosporidium hominis
LSPSELYSLITITKPNDLIKF

SEQ ID NO: 2177205 - protein, 18 aa, Cryptosporidium hominis
LSPSEWPGTLEINPPEVL

SEQ ID NO: 2177206 - protein, 26 aa, Cryptosporidium hominis
LSPVKIPVCDPLAWGETLGCTSAIID

SEQ ID NO: 2177207 - protein, 24 aa, Cryptosporidium hominis
LSQCKFEKYLACSKNKVQKNEIIE

SEQ ID NO: 2177208 - protein, 23 aa, Cryptosporidium hominis
LSQILFRHMEMIMELIQNEILLG

SEQ ID NO: 2177209 - protein, 18 aa, Cryptosporidium hominis
LSQNCLLISSICKKLDIK

SEQ ID NO: 2177210 - protein, 24 aa, Cryptosporidium hominis
LSRCLPHTKIKKIIKCSGAVNHMI

SEQ ID NO: 2177211 - protein, 23 aa, Cryptosporidium hominis
LSREMLPFKYLIPVGESPYSKMR

SEQ ID NO: 2177212 - protein, 17 aa, Cryptosporidium hominis
LSRESIRAIEIIKKSRK

SEQ ID NO: 2177213 - protein, 21 aa, Cryptosporidium hominis
LSRQLAGLLLKNAVSGIEPRI

SEQ ID NO: 2177214 - protein, 19 aa, Cryptosporidium hominis
LSRRLWDLEETLSFTNLDS

SEQ ID NO: 2177215 - protein, 17 aa, Cryptosporidium hominis
LSSALALSAGVLPQHTF

SEQ ID NO: 2177216 - protein, 18 aa, Cryptosporidium hominis
LSSALPWFTSRRKSQKLV

SEQ ID NO: 2177217 - protein, 17 aa, Cryptosporidium hominis
LSSDIERKLYPDGPNSN

SEQ ID NO: 2177218 - protein, 25 aa, Cryptosporidium hominis
LSSDSWGSFLPYSKITDYCFENSPD

SEQ ID NO: 2177219 - protein, 23 aa, Cryptosporidium hominis
LSSEMKLQYKVRIMLETNSLSEF

SEQ ID NO: 2177220 - protein, 17 aa, Cryptosporidium hominis
LSSFGLCEFDSPEGVIN

SEQ ID NO: 2177221 - protein, 24 aa, Cryptosporidium hominis
LSSGLIKKRITIIPLDKIMDPSIS

SEQ ID NO: 2177222 - protein, 29 aa, Cryptosporidium hominis
LSSIECSILFQKRCTLSFRNQNFDPANWI

SEQ ID NO: 2177223 - protein, 22 aa, Cryptosporidium hominis
LSSINLPILINFSGVFEEKLIF

SEQ ID NO: 2177224 - protein, 25 aa, Cryptosporidium hominis
LSSKAGGCGINLIGANRLVMFDPDW

SEQ ID NO: 2177225 - protein, 38 aa, Cryptosporidium hominis
LSSKILKNYICSGGLLIIGLCPWGWEYISGGKVNSNSI

SEQ ID NO: 2177226 - protein, 20 aa, Cryptosporidium hominis
LSSLALVFALHQFRPSPLYF

SEQ ID NO: 2177227 - protein, 30 aa, Cryptosporidium hominis
LSSLFLELPSYFPAMYVPRAYVNNIKVIMS

SEQ ID NO: 2177228 - protein, 28 aa, Cryptosporidium hominis
LSSLKVYPLFARGWITWAQYTDRLLYIH

SEQ ID NO: 2177229 - protein, 18 aa, Cryptosporidium hominis
LSSLLVKLKNSLEEYQAE

SEQ ID NO: 2177230 - protein, 20 aa, Cryptosporidium hominis
LSSMRWNIVTNGNFLFYSLF

SEQ ID NO: 2177231 - protein, 18 aa, Cryptosporidium hominis
LSSNCDFCSNQTSEIINS

SEQ ID NO: 2177232 - protein, 23 aa, Cryptosporidium hominis
LSSPRSSEVIGEMIYDSGNNSVD

SEQ ID NO: 2177233 - protein, 24 aa, Cryptosporidium hominis
LSSQKFKGEINIGVNSKRASQVMD

SEQ ID NO: 2177234 - protein, 40 aa, Cryptosporidium hominis
LSSSETFAGFITDQGYLYCWPWPGTISGRSEIKINPIAVT

SEQ ID NO: 2177235 - protein, 21 aa, Cryptosporidium hominis
LSSTNWPTWLGLSPLAENVIS

SEQ ID NO: 2177236 - protein, 19 aa, Cryptosporidium hominis
LSSYLNIGGLREFDLEIVN

SEQ ID NO: 2177237 - protein, 18 aa, Cryptosporidium hominis
LSTFGFQISPNIQSGSSE

SEQ ID NO: 2177238 - protein, 18 aa, Cryptosporidium hominis
LSTFVKFKGHINEETLLS

SEQ ID NO: 2177239 - protein, 17 aa, Cryptosporidium hominis
LSTGVPVYGDNSNNIAF

SEQ ID NO: 2177240 - protein, 31 aa, Cryptosporidium hominis
LSTIEVGLLYKSWMCHKNLKKEILNRHIKQE

SEQ ID NO: 2177241 - protein, 23 aa, Cryptosporidium hominis
LSTIKFRAIVYVVNLLQGDKLIF

SEQ ID NO: 2177242 - protein, 23 aa, Cryptosporidium hominis
LSTKTRFLPILPTSPRKEIYENL

SEQ ID NO: 2177243 - protein, 17 aa, Cryptosporidium hominis
LSTQSGIEKRRIKTYTR

SEQ ID NO: 2177244 - protein, 17 aa, Cryptosporidium hominis
LSTYLSWLYLNKTQKIF

SEQ ID NO: 2177245 - protein, 25 aa, Cryptosporidium hominis
LSVISRFAGAVLFKADKYYELFYKS

SEQ ID NO: 2177246 - protein, 26 aa, Cryptosporidium hominis
LSVKTIKRWGLLCCGCYTYERDTSRK

SEQ ID NO: 2177247 - protein, 20 aa, Cryptosporidium hominis
LSVLSLHYIKVCEKLCDAES

SEQ ID NO: 2177248 - protein, 29 aa, Cryptosporidium hominis
LSVQLPSCRSLRTSIRINRSSTLSHLGKN

SEQ ID NO: 2177249 - protein, 31 aa, Cryptosporidium hominis
LSWHRRNPYEYAYRPNLCPNVVFQNENKKMR

SEQ ID NO: 2177250 - protein, 18 aa, Cryptosporidium hominis
LSYEEVFIVKMTSTNKSF

SEQ ID NO: 2177251 - protein, 25 aa, Cryptosporidium hominis
LSYEYEIYGFLSFSHVKIIVVLQDH

SEQ ID NO: 2177252 - protein, 26 aa, Cryptosporidium hominis
LSYLEFLDLPILELIGIDPAVLGGVN

SEQ ID NO: 2177253 - protein, 19 aa, Cryptosporidium hominis
LSYPIKISGLFWGIGSMKL

SEQ ID NO: 2177254 - protein, 20 aa, Cryptosporidium hominis
LSYTLEWPTLTIDWLPNSYK

SEQ ID NO: 2177255 - protein, 27 aa, Cryptosporidium hominis
LSYTTFDHFFLIKSCDFASEERTTKTV

SEQ ID NO: 2177256 - protein, 19 aa, Cryptosporidium hominis
LTAPLPVMYPYHRGIGRAI

SEQ ID NO: 2177257 - protein, 17 aa, Cryptosporidium hominis
LTCSSKFIAFANDGGGG

SEQ ID NO: 2177258 - protein, 18 aa, Cryptosporidium hominis
LTDLKEILLFLENSLVAL

SEQ ID NO: 2177259 - protein, 23 aa, Cryptosporidium hominis
LTDSQNVVFQWAIQDGIDPNNNT

SEQ ID NO: 2177260 - protein, 24 aa, Cryptosporidium hominis
LTEIEMALRKCVKNDYNPSLELNE

SEQ ID NO: 2177261 - protein, 21 aa, Cryptosporidium hominis
LTEIRRIKCIINEGNQRGIED

SEQ ID NO: 2177262 - protein, 24 aa, Cryptosporidium hominis
LTEKGNGVFKLCRIEYLVNTGTIL

SEQ ID NO: 2177263 - protein, 20 aa, Cryptosporidium hominis
LTELEELWLGKNKITTLDDI

SEQ ID NO: 2177264 - protein, 19 aa, Cryptosporidium hominis
LTERILCPIEERVSEEQFN

SEQ ID NO: 2177265 - protein, 18 aa, Cryptosporidium hominis
LTERKSLALELLKLLSNK

SEQ ID NO: 2177266 - protein, 20 aa, Cryptosporidium hominis
LTEYCNLHFIFKKLLSEGLE

SEQ ID NO: 2177267 - protein, 24 aa, Cryptosporidium hominis
LTFSVFDAGFKWQSDELFDQQEMA

SEQ ID NO: 2177268 - protein, 17 aa, Cryptosporidium hominis
LTFTSALSYLRRLNTPL

SEQ ID NO: 2177269 - protein, 17 aa, Cryptosporidium hominis
LTGHSIIVPGDFRSASM

SEQ ID NO: 2177270 - protein, 18 aa, Cryptosporidium hominis
LTGSLAIIEQCVLLIHCV

SEQ ID NO: 2177271 - protein, 19 aa, Cryptosporidium hominis
LTHFPLFLNKPFTSNENNK

SEQ ID NO: 2177272 - protein, 18 aa, Cryptosporidium hominis
LTIDEILGLFNLLPTIAS

SEQ ID NO: 2177273 - protein, 17 aa, Cryptosporidium hominis
LTIFKRISHDDMKILGF

SEQ ID NO: 2177274 - protein, 25 aa, Cryptosporidium hominis
LTIGVGWSRLGFFLLNKDSESLINI

SEQ ID NO: 2177275 - protein, 32 aa, Cryptosporidium hominis
LTIHPNIDVLPWIGSVGVGGVVTWNKQNNFVE

SEQ ID NO: 2177276 - protein, 24 aa, Cryptosporidium hominis
LTIIPGFCVSGTIGSKIINGAKRV

SEQ ID NO: 2177277 - protein, 24 aa, Cryptosporidium hominis
LTILKPCYLLLWNYNIRNCNNTTK

SEQ ID NO: 2177278 - protein, 31 aa, Cryptosporidium hominis
LTIPSRILYRINCLIVDDLLEFWDKVIDTQN

SEQ ID NO: 2177279 - protein, 26 aa, Cryptosporidium hominis
LTIVKRFSVSWMYKSGFLHIPIHSIT

SEQ ID NO: 2177280 - protein, 19 aa, Cryptosporidium hominis
LTIWSQYKGLGAFPVTDGF

SEQ ID NO: 2177281 - protein, 34 aa, Cryptosporidium hominis
LTIYEWSNKFVYPREMLFLGYSICSAYNDCTDDN

SEQ ID NO: 2177282 - protein, 35 aa, Cryptosporidium hominis
LTKGNYLKFGFNVPRTDLLPISISFFDSNDAKSLF

SEQ ID NO: 2177283 - protein, 20 aa, Cryptosporidium hominis
LTKKLEFYRGLEAEILALYH

SEQ ID NO: 2177284 - protein, 17 aa, Cryptosporidium hominis
LTKKPPKFIPFVNKESE

SEQ ID NO: 2177285 - protein, 18 aa, Cryptosporidium hominis
LTKKRLAIKELLRRYASK

SEQ ID NO: 2177286 - protein, 18 aa, Cryptosporidium hominis
LTKQILLKGLDLLGVETL

SEQ ID NO: 2177287 - protein, 18 aa, Cryptosporidium hominis
LTLADALVYACNLKVETV

SEQ ID NO: 2177288 - protein, 26 aa, Cryptosporidium hominis
LTLAKVKLKSCCLELTSDNEDHFDKM

SEQ ID NO: 2177289 - protein, 18 aa, Cryptosporidium hominis
LTLAWTKAFIYLILVSSM

SEQ ID NO: 2177290 - protein, 22 aa, Cryptosporidium hominis
LTLDEFLKFSVSGFDGNFPGLY

SEQ ID NO: 2177291 - protein, 26 aa, Cryptosporidium hominis
LTLKFISVFFKPGWRESNFQELNKSN

SEQ ID NO: 2177292 - protein, 20 aa, Cryptosporidium hominis
LTLKHKYGLIGRNGIGKSTL

SEQ ID NO: 2177293 - protein, 28 aa, Cryptosporidium hominis
LTLLKEIVFAYSYPRLDINVSKDLGHLL

SEQ ID NO: 2177294 - protein, 32 aa, Cryptosporidium hominis
LTLPSEYICKLCGFPLLNPVLIKCAGSCGASA

SEQ ID NO: 2177295 - protein, 28 aa, Cryptosporidium hominis
LTLRNLFGLYCHVVFSLCKFVSVIINTI

SEQ ID NO: 2177296 - protein, 21 aa, Cryptosporidium hominis
LTNFCGKFILSNFIYAHQHIE

SEQ ID NO: 2177297 - protein, 23 aa, Cryptosporidium hominis
LTNKRITKNFGFLSNELARTLTI

SEQ ID NO: 2177298 - protein, 25 aa, Cryptosporidium hominis
LTNTILKIVIIPAINQGVPNPLPEL

SEQ ID NO: 2177299 - protein, 25 aa, Cryptosporidium hominis
LTNVKDCFEPISLLLQKIDHEILLK

SEQ ID NO: 2177300 - protein, 19 aa, Cryptosporidium hominis
LTPDLWKEYSFTPSPYKQF

SEQ ID NO: 2177301 - protein, 23 aa, Cryptosporidium hominis
LTPERKRELALKRKRDRETIRRA

SEQ ID NO: 2177302 - protein, 22 aa, Cryptosporidium hominis
LTPFEYQVFLGITKWSTRYLNT

SEQ ID NO: 2177303 - protein, 23 aa, Cryptosporidium hominis
LTPNIRSLYNLKIISNLVNLEEN

SEQ ID NO: 2177304 - protein, 23 aa, Cryptosporidium hominis
LTPSSNLKPLFKVDVNIENISTT

SEQ ID NO: 2177305 - protein, 17 aa, Cryptosporidium hominis
LTQISWLLNLRGSDVHC

SEQ ID NO: 2177306 - protein, 21 aa, Cryptosporidium hominis
LTQLPVILGIPLKQIDFLDLL

SEQ ID NO: 2177307 - protein, 17 aa, Cryptosporidium hominis
LTQPRRIAATSLSNRIG

SEQ ID NO: 2177308 - protein, 24 aa, Cryptosporidium hominis
LTRAFCTLSSIPKCHFDTKDSDHK

SEQ ID NO: 2177309 - protein, 18 aa, Cryptosporidium hominis
LTRGFPVMGEQSVTMMIN

SEQ ID NO: 2177310 - protein, 28 aa, Cryptosporidium hominis
LTRLRCFSCSYCFEGYGMTELLAASMSE

SEQ ID NO: 2177311 - protein, 18 aa, Cryptosporidium hominis
LTRSEIGLGLNPDATLKM

SEQ ID NO: 2177312 - protein, 17 aa, Cryptosporidium hominis
LTRTRVAIFVYDVANIE

SEQ ID NO: 2177313 - protein, 20 aa, Cryptosporidium hominis
LTRVGRLEVVVVLRVDKNKG

SEQ ID NO: 2177314 - protein, 22 aa, Cryptosporidium hominis
LTSCYYDIFFPPPITNQPSMSS

SEQ ID NO: 2177315 - protein, 18 aa, Cryptosporidium hominis
LTSISWDFYNSSRENCGW

SEQ ID NO: 2177316 - protein, 18 aa, Cryptosporidium hominis
LTSLIVAMSHDFSPYVNE

SEQ ID NO: 2177317 - protein, 25 aa, Cryptosporidium hominis
LTSNAAKCPTEWRVRGITWHAERKA

SEQ ID NO: 2177318 - protein, 18 aa, Cryptosporidium hominis
LTSYCNWDEQIADVSCRL

SEQ ID NO: 2177319 - protein, 25 aa, Cryptosporidium hominis
LTTLWSRIRLALTRITKKNMHISDR

SEQ ID NO: 2177320 - protein, 17 aa, Cryptosporidium hominis
LTTQILEFCLSKLQGLL

SEQ ID NO: 2177321 - protein, 18 aa, Cryptosporidium hominis
LTTSFLRKYIHYCKYVRN

SEQ ID NO: 2177322 - protein, 25 aa, Cryptosporidium hominis
LTTTWRYSSEFEVPSLSSCNLINYD

SEQ ID NO: 2177323 - protein, 21 aa, Cryptosporidium hominis
LTVCNTLKFHLYILNPRNTLE

SEQ ID NO: 2177324 - protein, 18 aa, Cryptosporidium hominis
LTVKWPYQEPEIIFYHPP

SEQ ID NO: 2177325 - protein, 22 aa, Cryptosporidium hominis
LTVLQLRITIWATKNSTIESAE

SEQ ID NO: 2177326 - protein, 28 aa, Cryptosporidium hominis
LTYDACPICKKKVLFSTSYCEKCDESVV

SEQ ID NO: 2177327 - protein, 18 aa, Cryptosporidium hominis
LTYFFPLISCLDINEGKK

SEQ ID NO: 2177328 - protein, 23 aa, Cryptosporidium hominis
LTYLRREHPTLAFKSALNSSTEF

SEQ ID NO: 2177329 - protein, 17 aa, Cryptosporidium hominis
LVAAAQSKYSWHILVTN

SEQ ID NO: 2177330 - protein, 22 aa, Cryptosporidium hominis
LVDGWCFGCVGSTVLVTLSDHY

SEQ ID NO: 2177331 - protein, 18 aa, Cryptosporidium hominis
LVDLRLSYESCGIYDSKF

SEQ ID NO: 2177332 - protein, 26 aa, Cryptosporidium hominis
LVDPLPLFEGFEWYISRETIGHYLSV

SEQ ID NO: 2177333 - protein, 21 aa, Cryptosporidium hominis
LVDRLAEIEAIIKVDHVLAER

SEQ ID NO: 2177334 - protein, 21 aa, Cryptosporidium hominis
LVDRLQLFIGSMMDNIFSIWD

SEQ ID NO: 2177335 - protein, 18 aa, Cryptosporidium hominis
LVDYACPGEEIIVTGIYR

SEQ ID NO: 2177336 - protein, 19 aa, Cryptosporidium hominis
LVEITRRILIRSYTDRVKN

SEQ ID NO: 2177337 - protein, 17 aa, Cryptosporidium hominis
LVELFEVVSDPQICYNP

SEQ ID NO: 2177338 - protein, 28 aa, Cryptosporidium hominis
LVEPAFDVVRMFNFPKSFQIALEQAEKS

SEQ ID NO: 2177339 - protein, 29 aa, Cryptosporidium hominis
LVEPCKDSIAWGCCEILKNFDHSRWMGSR

SEQ ID NO: 2177340 - protein, 24 aa, Cryptosporidium hominis
LVERCKKVKTCPRCMSQQGQLRRT

SEQ ID NO: 2177341 - protein, 23 aa, Cryptosporidium hominis
LVERGSLLLFSWSQSRLEWVQTP

SEQ ID NO: 2177342 - protein, 17 aa, Cryptosporidium hominis
LVFQFKYCEPYFGAWQA

SEQ ID NO: 2177343 - protein, 17 aa, Cryptosporidium hominis
LVGEASLEWSLNFLTRN

SEQ ID NO: 2177344 - protein, 23 aa, Cryptosporidium hominis
LVGKISGLILEFDMNMLSDKISF

SEQ ID NO: 2177345 - protein, 18 aa, Cryptosporidium hominis
LVGLISAARLLVHLYESN

SEQ ID NO: 2177346 - protein, 23 aa, Cryptosporidium hominis
LVGLSGWKRFRVFFNKYQASEME

SEQ ID NO: 2177347 - protein, 24 aa, Cryptosporidium hominis
LVGRLLERVICRFSEISNRKKEDS

SEQ ID NO: 2177348 - protein, 17 aa, Cryptosporidium hominis
LVHAASFTRRDIIRIYS

SEQ ID NO: 2177349 - protein, 22 aa, Cryptosporidium hominis
LVHSRISKVFYMYKDKERGFLG

SEQ ID NO: 2177350 - protein, 20 aa, Cryptosporidium hominis
LVICKFEILEIILQALKSLL

SEQ ID NO: 2177351 - protein, 19 aa, Cryptosporidium hominis
LVIKFLVDFLHFVSTKSSI

SEQ ID NO: 2177352 - protein, 24 aa, Cryptosporidium hominis
LVIPVSGKWSQLVLAKRDVGGPLF

SEQ ID NO: 2177353 - protein, 23 aa, Cryptosporidium hominis
LVITPKLKFGLGGTNLISGSISK

SEQ ID NO: 2177354 - protein, 24 aa, Cryptosporidium hominis
LVKHVSPPSSWRQIQRNSIEDKEK

SEQ ID NO: 2177355 - protein, 24 aa, Cryptosporidium hominis
LVKIWEFIVPNLIFTLSRIRLYKE

SEQ ID NO: 2177356 - protein, 22 aa, Cryptosporidium hominis
LVKKAYRKAIILCHPDKNHNES

SEQ ID NO: 2177357 - protein, 22 aa, Cryptosporidium hominis
LVKKNIATVFAWKNETIEDYWV

SEQ ID NO: 2177358 - protein, 27 aa, Cryptosporidium hominis
LVKRSIDDPANWSWRQKSFLLEELGLG

SEQ ID NO: 2177359 - protein, 25 aa, Cryptosporidium hominis
LVKSCQICLNYYFPSKAIKQMESNS

SEQ ID NO: 2177360 - protein, 20 aa, Cryptosporidium hominis
LVLCQKFIVRSHFQIGNIYQ

SEQ ID NO: 2177361 - protein, 17 aa, Cryptosporidium hominis
LVLHPIVQEFSSIVKGN

SEQ ID NO: 2177362 - protein, 26 aa, Cryptosporidium hominis
LVLMGFPDMFNRSGSPNFQGLDPAMW

SEQ ID NO: 2177363 - protein, 22 aa, Cryptosporidium hominis
LVLMTKRFIQYLYEQGESRIID

SEQ ID NO: 2177364 - protein, 19 aa, Cryptosporidium hominis
LVLRRAMGIAWKHKNYITT

SEQ ID NO: 2177365 - protein, 19 aa, Cryptosporidium hominis
LVLSPCKNLLMGLTCYGWI

SEQ ID NO: 2177366 - protein, 24 aa, Cryptosporidium hominis
LVMDEADRLLSMDFEIALNKIVES

SEQ ID NO: 2177367 - protein, 23 aa, Cryptosporidium hominis
LVMELCSGGELFDRIISQGSFDE

SEQ ID NO: 2177368 - protein, 17 aa, Cryptosporidium hominis
LVMELCTGGELFERVVH

SEQ ID NO: 2177369 - protein, 23 aa, Cryptosporidium hominis
LVNDCLKIVCDLVSESLLKSNRI

SEQ ID NO: 2177370 - protein, 18 aa, Cryptosporidium hominis
LVNIEFKALVFKPKIGEL

SEQ ID NO: 2177371 - protein, 22 aa, Cryptosporidium hominis
LVNKIYMEVCESVRQGKEKELA

SEQ ID NO: 2177372 - protein, 17 aa, Cryptosporidium hominis
LVNPFLMMQRMSAANPM

SEQ ID NO: 2177373 - protein, 25 aa, Cryptosporidium hominis
LVNQKAKWIVRAPCSGTITSKKLTR

SEQ ID NO: 2177374 - protein, 24 aa, Cryptosporidium hominis
LVNVHKGAALLSTFSSDPTFKKNC

SEQ ID NO: 2177375 - protein, 18 aa, Cryptosporidium hominis
LVPGSSRGGRIFDGGLNS

SEQ ID NO: 2177376 - protein, 23 aa, Cryptosporidium hominis
LVPLLRLAPMVVNFENKRCYFRY

SEQ ID NO: 2177377 - protein, 34 aa, Cryptosporidium hominis
LVPPYSSFIKFCVKRLGFSITYNKRRAWFSVRSR

SEQ ID NO: 2177378 - protein, 22 aa, Cryptosporidium hominis
LVPVCRSMIRLSSTRDPTTAMK

SEQ ID NO: 2177379 - protein, 30 aa, Cryptosporidium hominis
LVPYTSIPCVLDFLKQRYLVNQIYTTADPL

SEQ ID NO: 2177380 - protein, 17 aa, Cryptosporidium hominis
LVQKMSHSFLQGQEAEF

SEQ ID NO: 2177381 - protein, 26 aa, Cryptosporidium hominis
LVQSYLNIWISLFWNSLINKSKKKKV

SEQ ID NO: 2177382 - protein, 24 aa, Cryptosporidium hominis
LVRKTHNLFGFKFLNIGINQINLA

SEQ ID NO: 2177383 - protein, 21 aa, Cryptosporidium hominis
LVRREFERFGAIRDVYLPLDY

SEQ ID NO: 2177384 - protein, 22 aa, Cryptosporidium hominis
LVSACWGGKIVFWKFDQASGTF

SEQ ID NO: 2177385 - protein, 25 aa, Cryptosporidium hominis
LVSATCFWIALKYEAAYVQGENLKI

SEQ ID NO: 2177386 - protein, 18 aa, Cryptosporidium hominis
LVSLDIVKVFGISMKRLG

SEQ ID NO: 2177387 - protein, 29 aa, Cryptosporidium hominis
LVSRCCGFSKLSHILHFKEIIGHSKKRLM

SEQ ID NO: 2177388 - protein, 21 aa, Cryptosporidium hominis
LVSRSGVAGLKARHEGEDFHG

SEQ ID NO: 2177389 - protein, 17 aa, Cryptosporidium hominis
LVSTIRCMEIIKYKKHS

SEQ ID NO: 2177390 - protein, 25 aa, Cryptosporidium hominis
LVSTWSELGKVCMWDITESINNLNT

SEQ ID NO: 2177391 - protein, 18 aa, Cryptosporidium hominis
LVSVFSCAVKIQHKDLGL

SEQ ID NO: 2177392 - protein, 17 aa, Cryptosporidium hominis
LVTSYYYPYFDKSINEF

SEQ ID NO: 2177393 - protein, 28 aa, Cryptosporidium hominis
LVYDGLKSSLLFGFNLDLIKLHALTPRT

SEQ ID NO: 2177394 - protein, 17 aa, Cryptosporidium hominis
LVYFIGMIFSKILLQIF

SEQ ID NO: 2177395 - protein, 26 aa, Cryptosporidium hominis
LVYSLWKGQLWKAIILDTSLKIHPNG

SEQ ID NO: 2177396 - protein, 17 aa, Cryptosporidium hominis
LWIDTEGTFRPERIVQI

SEQ ID NO: 2177397 - protein, 19 aa, Cryptosporidium hominis
LWIEIVGISTIINRKTLEF

SEQ ID NO: 2177398 - protein, 26 aa, Cryptosporidium hominis
LWIKCLDIYSSCLWQLSRSIDLINLS

SEQ ID NO: 2177399 - protein, 18 aa, Cryptosporidium hominis
LWKEYSFTPSPYKQFSDF

SEQ ID NO: 2177400 - protein, 21 aa, Cryptosporidium hominis
LWKKMCPRTLEGKSQEKIKFE

SEQ ID NO: 2177401 - protein, 27 aa, Cryptosporidium hominis
LWKNPFYWTEIFSINSLYFKSSFLDHS

SEQ ID NO: 2177402 - protein, 20 aa, Cryptosporidium hominis
LWPTLDKWASLSEESFKLNH

SEQ ID NO: 2177403 - protein, 18 aa, Cryptosporidium hominis
LWSATWPKEVQKLARDLC

SEQ ID NO: 2177404 - protein, 21 aa, Cryptosporidium hominis
LWSIGCVFGELILGKPLFSGE

SEQ ID NO: 2177405 - protein, 17 aa, Cryptosporidium hominis
LWSLIHCMHSAFQRRKL

SEQ ID NO: 2177406 - protein, 17 aa, Cryptosporidium hominis
LWYFRYVVRDFIQFLSQ

SEQ ID NO: 2177407 - protein, 18 aa, Cryptosporidium hominis
LWYRCYAEHHRGRTADRA

SEQ ID NO: 2177408 - protein, 22 aa, Cryptosporidium hominis
LWYRPPELLLGAQFYDTPVDMW

SEQ ID NO: 2177409 - protein, 18 aa, Cryptosporidium hominis
LYAILEHCEDHFNDVNSN

SEQ ID NO: 2177410 - protein, 25 aa, Cryptosporidium hominis
LYAYARICAIFRKVEFIQSDDNMVI

SEQ ID NO: 2177411 - protein, 21 aa, Cryptosporidium hominis
LYCGILDIFGFECFPNNSFEQ

SEQ ID NO: 2177412 - protein, 24 aa, Cryptosporidium hominis
LYCLRKMTLCRYLDFINMQDKLFC

SEQ ID NO: 2177413 - protein, 18 aa, Cryptosporidium hominis
LYCPLAIGYFWIDKFMWQ

SEQ ID NO: 2177414 - protein, 19 aa, Cryptosporidium hominis
LYDDIGIKPPKGVILYGPP

SEQ ID NO: 2177415 - protein, 30 aa, Cryptosporidium hominis
LYDPTKVDVFCLGWMLLFTLTKYQPFETCR

SEQ ID NO: 2177416 - protein, 18 aa, Cryptosporidium hominis
LYESFIHILMEFKGYSGV

SEQ ID NO: 2177417 - protein, 17 aa, Cryptosporidium hominis
LYESGYCQLKKGQNNNH

SEQ ID NO: 2177418 - protein, 18 aa, Cryptosporidium hominis
LYESYGIKSYKYEKIQKM

SEQ ID NO: 2177419 - protein, 19 aa, Cryptosporidium hominis
LYFNYKWTKERIVCDIQIS

SEQ ID NO: 2177420 - protein, 26 aa, Cryptosporidium hominis
LYFNYLRISSILVEVTYRGSVSLNNV

SEQ ID NO: 2177421 - protein, 17 aa, Cryptosporidium hominis
LYFTNLFQGNHGFMPPM

SEQ ID NO: 2177422 - protein, 23 aa, Cryptosporidium hominis
LYIEIIGIMYIMFNECHLIHGDM

SEQ ID NO: 2177423 - protein, 18 aa, Cryptosporidium hominis
LYILSFVGISFNQATVSK

SEQ ID NO: 2177424 - protein, 19 aa, Cryptosporidium hominis
LYINFVFSTKIPPHLEHVN

SEQ ID NO: 2177425 - protein, 18 aa, Cryptosporidium hominis
LYISEGIFCKTKLFIVGP

SEQ ID NO: 2177426 - protein, 24 aa, Cryptosporidium hominis
LYIYDANCLPKWFITSQGVNISSI

SEQ ID NO: 2177427 - protein, 19 aa, Cryptosporidium hominis
LYKDNKLLINRKYKLNINN

SEQ ID NO: 2177428 - protein, 22 aa, Cryptosporidium hominis
LYKFEQEYFKNGAVLMDNNIGI

SEQ ID NO: 2177429 - protein, 25 aa, Cryptosporidium hominis
LYKLLFLLCKLNFINFSIDDSKEID

SEQ ID NO: 2177430 - protein, 18 aa, Cryptosporidium hominis
LYKQYLAQWLKNAEDNGL

SEQ ID NO: 2177431 - protein, 24 aa, Cryptosporidium hominis
LYLKSKELYSKFISRPKSFSERAI

SEQ ID NO: 2177432 - protein, 18 aa, Cryptosporidium hominis
LYLNHKYMLIGHENTFVG

SEQ ID NO: 2177433 - protein, 18 aa, Cryptosporidium hominis
LYLPLSNTPLTFIKEPGD

SEQ ID NO: 2177434 - protein, 25 aa, Cryptosporidium hominis
LYLSELLKLNGLGGEIPRIVILGQQ

SEQ ID NO: 2177435 - protein, 21 aa, Cryptosporidium hominis
LYLSFWCFSAAAALSSLVSAG

SEQ ID NO: 2177436 - protein, 27 aa, Cryptosporidium hominis
LYLSNRKRIPCMFKIIPCNEHSESFRE

SEQ ID NO: 2177437 - protein, 18 aa, Cryptosporidium hominis
LYMECVKCGCDSLGPYED

SEQ ID NO: 2177438 - protein, 21 aa, Cryptosporidium hominis
LYMFGGGAFGKLGFGSTDDVL

SEQ ID NO: 2177439 - protein, 17 aa, Cryptosporidium hominis
LYMSRLPLLCFSEVFKL

SEQ ID NO: 2177440 - protein, 18 aa, Cryptosporidium hominis
LYNIKAFLSATRQLINSY

SEQ ID NO: 2177441 - protein, 25 aa, Cryptosporidium hominis
LYNKAFYVWHENFLKNSDNTVNTSP

SEQ ID NO: 2177442 - protein, 32 aa, Cryptosporidium hominis
LYNLLECCGKLAKLRSYIIWNSIAVIKVLKKR

SEQ ID NO: 2177443 - protein, 32 aa, Cryptosporidium hominis
LYNNGLYCKHVRWIIQIPRLYNIFYKDGCVKT

SEQ ID NO: 2177444 - protein, 19 aa, Cryptosporidium hominis
LYNSIAFKIVLDCLEKNEQ

SEQ ID NO: 2177445 - protein, 18 aa, Cryptosporidium hominis
LYNWIRELVIRYLADERT

SEQ ID NO: 2177446 - protein, 17 aa, Cryptosporidium hominis
LYPKLLGFIPVVSQSLT

SEQ ID NO: 2177447 - protein, 19 aa, Cryptosporidium hominis
LYPLIKFQALYAGRNLHQL

SEQ ID NO: 2177448 - protein, 27 aa, Cryptosporidium hominis
LYPNCNRYYCPFSHGIEQIRAPEKVRE

SEQ ID NO: 2177449 - protein, 28 aa, Cryptosporidium hominis
LYPNTLLYEGYEKCSLYNNCLSNKLECN

SEQ ID NO: 2177450 - protein, 21 aa, Cryptosporidium hominis
LYPRLYPLHHSLILSESNSEL

SEQ ID NO: 2177451 - protein, 17 aa, Cryptosporidium hominis
LYPSEFDMRMSGISSST

SEQ ID NO: 2177452 - protein, 19 aa, Cryptosporidium hominis
LYQRNCMDYQYSKREGCIR

SEQ ID NO: 2177453 - protein, 19 aa, Cryptosporidium hominis
LYQSECLTLAMSIYLKHPL

SEQ ID NO: 2177454 - protein, 24 aa, Cryptosporidium hominis
LYRCYKLLTFWNVIVKDWNSVNYY

SEQ ID NO: 2177455 - protein, 20 aa, Cryptosporidium hominis
LYRMRRLLGVRAHDGSKAQA

SEQ ID NO: 2177456 - protein, 19 aa, Cryptosporidium hominis
LYRRFLRSSACKKLLDSDS

SEQ ID NO: 2177457 - protein, 18 aa, Cryptosporidium hominis
LYRTCYRLTINNYGGMLY

SEQ ID NO: 2177458 - protein, 25 aa, Cryptosporidium hominis
LYRVPECLESVFGIGSCEPSAMLYF

SEQ ID NO: 2177459 - protein, 20 aa, Cryptosporidium hominis
LYSCKFNLKNGKGRNPDLFP

SEQ ID NO: 2177460 - protein, 20 aa, Cryptosporidium hominis
LYSCRKRKDIDFTVISNPEF

SEQ ID NO: 2177461 - protein, 25 aa, Cryptosporidium hominis
LYSDCLMLRQMKNMFFLLCKQDSSW

SEQ ID NO: 2177462 - protein, 18 aa, Cryptosporidium hominis
LYSLGSFRDANYYPNVTV

SEQ ID NO: 2177463 - protein, 19 aa, Cryptosporidium hominis
LYSNRAACYMQLLEYPSAL

SEQ ID NO: 2177464 - protein, 27 aa, Cryptosporidium hominis
LYSSEFKGVIFAGGSGRMLGPLAKNIS

SEQ ID NO: 2177465 - protein, 17 aa, Cryptosporidium hominis
LYSTYGFPMDLTELMAN

SEQ ID NO: 2177466 - protein, 21 aa, Cryptosporidium hominis
LYSVSLFNLIAILKQNIPIES

SEQ ID NO: 2177467 - protein, 27 aa, Cryptosporidium hominis
LYVDVKHIFTFCYKLWDYLNLYPTPVI

SEQ ID NO: 2177468 - protein, 21 aa, Cryptosporidium hominis
LYWCAQLAAGLYYLHNECRII

SEQ ID NO: 2177469 - protein, 19 aa, Cryptosporidium hominis
LYWSCPKSDQQKCNTFSWI

SEQ ID NO: 2177470 - protein, 17 aa, Cryptosporidium hominis
LYYKREVCQAKYHDVIA

SEQ ID NO: 2177471 - protein, 17 aa, Cryptosporidium hominis
LYYLCHNIQCGSIRIVI

SEQ ID NO: 2177472 - protein, 18 aa, Cryptosporidium hominis
LYYWFLNNECGFDSNLNE

SEQ ID NO: 2177473 - protein, 17 aa, Cryptosporidium hominis
MAAHHIVSKGQRGFSGS

SEQ ID NO: 2177474 - protein, 17 aa, Cryptosporidium hominis
MAAKIASAFTFAFTASE

SEQ ID NO: 2177475 - protein, 20 aa, Cryptosporidium hominis
MAASCHYDYHSFGVQSTNSA

SEQ ID NO: 2177476 - protein, 18 aa, Cryptosporidium hominis
MADRLVGIYKTFDITKSV

SEQ ID NO: 2177477 - protein, 17 aa, Cryptosporidium hominis
MADWIPPTRCFSNAESG

SEQ ID NO: 2177478 - protein, 18 aa, Cryptosporidium hominis
MAEKGLIVLYNFLINLIN

SEQ ID NO: 2177479 - protein, 32 aa, Cryptosporidium hominis
MAETDPKECLIIFTYFTFEICHTTFPSVYHKY

SEQ ID NO: 2177480 - protein, 17 aa, Cryptosporidium hominis
MAFKSEMIEKKIWKDEN

SEQ ID NO: 2177481 - protein, 20 aa, Cryptosporidium hominis
MAFYCPTCPYVFKIVSQISK

SEQ ID NO: 2177482 - protein, 20 aa, Cryptosporidium hominis
MAGERIELRVTPTSDLSKTM

SEQ ID NO: 2177483 - protein, 18 aa, Cryptosporidium hominis
MALIMPFSIKINKIKADL

SEQ ID NO: 2177484 - protein, 24 aa, Cryptosporidium hominis
MALSHYAMGFLLKKGYLAIQPPYF

SEQ ID NO: 2177485 - protein, 26 aa, Cryptosporidium hominis
MAMKIPEYEAYISLPSQTTFPDYYQI

SEQ ID NO: 2177486 - protein, 17 aa, Cryptosporidium hominis
MAQSICPGVEEGPWNKT

SEQ ID NO: 2177487 - protein, 24 aa, Cryptosporidium hominis
MARVKRITEVGAFVSLLEYNDIEG

SEQ ID NO: 2177488 - protein, 19 aa, Cryptosporidium hominis
MASNFLKQIGHFFISKIQF

SEQ ID NO: 2177489 - protein, 20 aa, Cryptosporidium hominis
MASNPLNFYFENIYEKSLKT

SEQ ID NO: 2177490 - protein, 23 aa, Cryptosporidium hominis
MASSIPYLLPLLMGSGSNNDQNI

SEQ ID NO: 2177491 - protein, 17 aa, Cryptosporidium hominis
MASTAIRTAMAAQSLQS

SEQ ID NO: 2177492 - protein, 17 aa, Cryptosporidium hominis
MAWGFVSNVCHCPLMRA

SEQ ID NO: 2177493 - protein, 19 aa, Cryptosporidium hominis
MAYESFDFDNFDSKRLSNG

SEQ ID NO: 2177494 - protein, 25 aa, Cryptosporidium hominis
MCFSLKNCLRNLLLSQITSDEDMNT

SEQ ID NO: 2177495 - protein, 19 aa, Cryptosporidium hominis
MCGSINFVDNIGIFGNTTT

SEQ ID NO: 2177496 - protein, 17 aa, Cryptosporidium hominis
MCKKAVRCLRQQQTAGR

SEQ ID NO: 2177497 - protein, 20 aa, Cryptosporidium hominis
MCLSGLKSQVARNFVSERQD

SEQ ID NO: 2177498 - protein, 25 aa, Cryptosporidium hominis
MCMQLYRQALNFALHGLKYEPENPE

SEQ ID NO: 2177499 - protein, 24 aa, Cryptosporidium hominis
MDDLIIRRGFDLFKYGENEQKENE

SEQ ID NO: 2177500 - protein, 17 aa, Cryptosporidium hominis
MDEDPFADFACEVCRLN

SEQ ID NO: 2177501 - protein, 24 aa, Cryptosporidium hominis
MDESRGNLLLSLVAIYNKCMASEI

SEQ ID NO: 2177502 - protein, 18 aa, Cryptosporidium hominis
MDGYKWWFEQNLVTVWSA

SEQ ID NO: 2177503 - protein, 19 aa, Cryptosporidium hominis
MDHDSRIPPIDTNNNNTGL

SEQ ID NO: 2177504 - protein, 25 aa, Cryptosporidium hominis
MDIKTCPGHFAHIELGKPMFHIGFI

SEQ ID NO: 2177505 - protein, 21 aa, Cryptosporidium hominis
MDINMAFKHFEFSYMIVDEAH

SEQ ID NO: 2177506 - protein, 17 aa, Cryptosporidium hominis
MDKGCRVVLVSSGAVGA

SEQ ID NO: 2177507 - protein, 20 aa, Cryptosporidium hominis
MDKIPGKRPFGSTFEDHAKE

SEQ ID NO: 2177508 - protein, 21 aa, Cryptosporidium hominis
MDKRDSILYVIKKRWAKELSF

SEQ ID NO: 2177509 - protein, 21 aa, Cryptosporidium hominis
MDLLRGIKLGVEHVVNELDLL

SEQ ID NO: 2177510 - protein, 17 aa, Cryptosporidium hominis
MDLMIIPLKIVGKLIER

SEQ ID NO: 2177511 - protein, 25 aa, Cryptosporidium hominis
MDPKMVFQHLKYLYKYDNIVRFSIP

SEQ ID NO: 2177512 - protein, 26 aa, Cryptosporidium hominis
MDRLFPTMHLLWIHSSLFSIPSIIIL

SEQ ID NO: 2177513 - protein, 18 aa, Cryptosporidium hominis
MDRWEYVVGGPPFEEIAI

SEQ ID NO: 2177514 - protein, 28 aa, Cryptosporidium hominis
MDSIVSLGERSDIEFARNRKSMFEVTSN

SEQ ID NO: 2177515 - protein, 18 aa, Cryptosporidium hominis
MDSVRAGPFGSLFRPDNF

SEQ ID NO: 2177516 - protein, 17 aa, Cryptosporidium hominis
MDTRASIPLYLYGDLEP

SEQ ID NO: 2177517 - protein, 23 aa, Cryptosporidium hominis
MDYDPRIIIFTSISLALKLEEFG

SEQ ID NO: 2177518 - protein, 17 aa, Cryptosporidium hominis
MDYSLLIGIHYVQDDAM

SEQ ID NO: 2177519 - protein, 19 aa, Cryptosporidium hominis
MDYYSRLRYVFPNNEYYLN

SEQ ID NO: 2177520 - protein, 18 aa, Cryptosporidium hominis
MEAKRIIEKNGLKNKFDA

SEQ ID NO: 2177521 - protein, 18 aa, Cryptosporidium hominis
MECLNSWKNILLIDYHQK

SEQ ID NO: 2177522 - protein, 28 aa, Cryptosporidium hominis
MEDISLLPGWILRNLSLMREIDKKSNDL

SEQ ID NO: 2177523 - protein, 18 aa, Cryptosporidium hominis
MEEILGGILFESKKLVSW

SEQ ID NO: 2177524 - protein, 30 aa, Cryptosporidium hominis
MEEKAKRSFKISKIYLIFYSCNKTVLNIEE

SEQ ID NO: 2177525 - protein, 18 aa, Cryptosporidium hominis
MEELPLIILANWRGFSGG

SEQ ID NO: 2177526 - protein, 24 aa, Cryptosporidium hominis
MEERCQSCNLFIRDIVATSTRNQN

SEQ ID NO: 2177527 - protein, 19 aa, Cryptosporidium hominis
MEEVKRRIELQNEDSSHGE

SEQ ID NO: 2177528 - protein, 18 aa, Cryptosporidium hominis
MEHILNMRILEGEKNTSF

SEQ ID NO: 2177529 - protein, 24 aa, Cryptosporidium hominis
MEKAIEIAYKYGFQNFNLNVGCPS

SEQ ID NO: 2177530 - protein, 19 aa, Cryptosporidium hominis
MEKLRESVELYGVKSREAV

SEQ ID NO: 2177531 - protein, 17 aa, Cryptosporidium hominis
MEKTLIQRKEQLLQACQ

SEQ ID NO: 2177532 - protein, 19 aa, Cryptosporidium hominis
MELDWERRALEHTKEALRQ

SEQ ID NO: 2177533 - protein, 20 aa, Cryptosporidium hominis
MELREIGVLMSQKAKIQAKR

SEQ ID NO: 2177534 - protein, 17 aa, Cryptosporidium hominis
MEMLGLLIKNEFEINYL

SEQ ID NO: 2177535 - protein, 21 aa, Cryptosporidium hominis
MENLKHIQALSVPDLKKDNIA

SEQ ID NO: 2177536 - protein, 24 aa, Cryptosporidium hominis
MEPEDCGWLEPIRLKVHAMEVQQY

SEQ ID NO: 2177537 - protein, 27 aa, Cryptosporidium hominis
MEQESWKIAKMIARIAMIRRKRKVEHD

SEQ ID NO: 2177538 - protein, 35 aa, Cryptosporidium hominis
MEQLLALDDFKKLIGLLERAKESSLRRLDRTLLLI

SEQ ID NO: 2177539 - protein, 17 aa, Cryptosporidium hominis
MEQRYFLVNSLVHKFGD

SEQ ID NO: 2177540 - protein, 40 aa, Cryptosporidium hominis
MEREEKWWESIYNYYSQIYIPGYLFGMISTRLTVDDCQLQ

SEQ ID NO: 2177541 - protein, 19 aa, Cryptosporidium hominis
MERNKICLSVKAQGDVLTH

SEQ ID NO: 2177542 - protein, 18 aa, Cryptosporidium hominis
MESLPLLSLVSLQDIKIF

SEQ ID NO: 2177543 - protein, 25 aa, Cryptosporidium hominis
MESLVLRGDCIGMVGEGYEDLTQDF

SEQ ID NO: 2177544 - protein, 26 aa, Cryptosporidium hominis
MESSILELISFFGFKYDEKSQKLLDN

SEQ ID NO: 2177545 - protein, 31 aa, Cryptosporidium hominis
MESSLKLGMKAFSYSSGAEWNPMNPSLIWRK

SEQ ID NO: 2177546 - protein, 18 aa, Cryptosporidium hominis
METCILVCSKSIYRVYTL

SEQ ID NO: 2177547 - protein, 17 aa, Cryptosporidium hominis
METLYNFISLGKSTHST

SEQ ID NO: 2177548 - protein, 17 aa, Cryptosporidium hominis
MEYCERGDIGAVIDSCI

SEQ ID NO: 2177549 - protein, 23 aa, Cryptosporidium hominis
MEYIKLSILYLRILSKSIALRVV

SEQ ID NO: 2177550 - protein, 29 aa, Cryptosporidium hominis
MEYRYMPELDEFISFWCKYREHVEKNGDS

SEQ ID NO: 2177551 - protein, 18 aa, Cryptosporidium hominis
MFDEPRSATVIANATTEC

SEQ ID NO: 2177552 - protein, 18 aa, Cryptosporidium hominis
MFFFSAYIFELFYMVFYS

SEQ ID NO: 2177553 - protein, 18 aa, Cryptosporidium hominis
MFIFKDKICEPVIIQGNY

SEQ ID NO: 2177554 - protein, 25 aa, Cryptosporidium hominis
MFIPFKYKWSYFIGLLQNLGQYTGI

SEQ ID NO: 2177555 - protein, 20 aa, Cryptosporidium hominis
MFKLGKAYVDDTCVEVMREE

SEQ ID NO: 2177556 - protein, 24 aa, Cryptosporidium hominis
MFLGCKTHRAASIVLRGANEVLLD

SEQ ID NO: 2177557 - protein, 25 aa, Cryptosporidium hominis
MFLTLLRNLYKYAFLDGQNDLPINE

SEQ ID NO: 2177558 - protein, 23 aa, Cryptosporidium hominis
MFMWGHLRVRSLIKRFVSKDQGK

SEQ ID NO: 2177559 - protein, 17 aa, Cryptosporidium hominis
MFRHIFRGINTHCKNEL

SEQ ID NO: 2177560 - protein, 17 aa, Cryptosporidium hominis
MFSSFSVTKYVPIKLTS

SEQ ID NO: 2177561 - protein, 19 aa, Cryptosporidium hominis
MGELLRFRPGVFDGAISIS

SEQ ID NO: 2177562 - protein, 25 aa, Cryptosporidium hominis
MGGCFLNFRRLILANVNFTYFCSIN

SEQ ID NO: 2177563 - protein, 27 aa, Cryptosporidium hominis
MGGGSHPSFPFMYGNFPNNGSQQGQKI

SEQ ID NO: 2177564 - protein, 19 aa, Cryptosporidium hominis
MGGIMDVGYNQKLFYYQGQ

SEQ ID NO: 2177565 - protein, 25 aa, Cryptosporidium hominis
MGKLLKNAFFPKFNKLEEFDSLSLT

SEQ ID NO: 2177566 - protein, 24 aa, Cryptosporidium hominis
MGKSCKYSSLLSLINEVSTGLINS

SEQ ID NO: 2177567 - protein, 18 aa, Cryptosporidium hominis
MGLVPGMSLGGDLGVKEC

SEQ ID NO: 2177568 - protein, 18 aa, Cryptosporidium hominis
MGNPNWLLTTGFSDKGER

SEQ ID NO: 2177569 - protein, 17 aa, Cryptosporidium hominis
MGNRGIVVANNTHSSSS

SEQ ID NO: 2177570 - protein, 19 aa, Cryptosporidium hominis
MGNTFSDFVYCGDSLGIDL

SEQ ID NO: 2177571 - protein, 21 aa, Cryptosporidium hominis
MGNVSLLFSIEFHQSDCYIVA

SEQ ID NO: 2177572 - protein, 17 aa, Cryptosporidium hominis
MGPCKNIHSEVLREKYL

SEQ ID NO: 2177573 - protein, 32 aa, Cryptosporidium hominis
MGPGGGFRGGMGRGGFRGGYSRGGMMSGGHGP

SEQ ID NO: 2177574 - protein, 23 aa, Cryptosporidium hominis
MGSGEGRMCWLYLKNDWKEIKEF

SEQ ID NO: 2177575 - protein, 17 aa, Cryptosporidium hominis
MGSGELDLGKKSISAPK

SEQ ID NO: 2177576 - protein, 22 aa, Cryptosporidium hominis
MGSGSLCARSILEARYRDGLTE

SEQ ID NO: 2177577 - protein, 17 aa, Cryptosporidium hominis
MGSIFPNQLPPGIQNHV

SEQ ID NO: 2177578 - protein, 20 aa, Cryptosporidium hominis
MGSLSRYDSYNSNLSPNTNF

SEQ ID NO: 2177579 - protein, 26 aa, Cryptosporidium hominis
MGTNLMNLRILSFHSNHLNDENALLI

SEQ ID NO: 2177580 - protein, 19 aa, Cryptosporidium hominis
MGVRCLPASTAITSLGSII

SEQ ID NO: 2177581 - protein, 17 aa, Cryptosporidium hominis
MGVSWDPKDEFIASQSS

SEQ ID NO: 2177582 - protein, 30 aa, Cryptosporidium hominis
MHAMDGIRLNGKIDLLRGIQIAQLALKHRL

SEQ ID NO: 2177583 - protein, 25 aa, Cryptosporidium hominis
MHCNALPKLVCKTVKIEENNPEQTK

SEQ ID NO: 2177584 - protein, 25 aa, Cryptosporidium hominis
MHGKGTYIFPCGNVYEGEWVNDVKE

SEQ ID NO: 2177585 - protein, 30 aa, Cryptosporidium hominis
MHLSLEVIDCIYLICSMLLEVPYLAYHKSL

SEQ ID NO: 2177586 - protein, 17 aa, Cryptosporidium hominis
MHQPPARWMQYYRENGL

SEQ ID NO: 2177587 - protein, 18 aa, Cryptosporidium hominis
MHSLGIPDIVDFPFPTPP

SEQ ID NO: 2177588 - protein, 19 aa, Cryptosporidium hominis
MHTRRSCPLLPDEAEQEYE

SEQ ID NO: 2177589 - protein, 28 aa, Cryptosporidium hominis
MIATPSRSSIKWEKLEPQSLLFLSVLMG

SEQ ID NO: 2177590 - protein, 19 aa, Cryptosporidium hominis
MIEHPLIKLSLGIHCSFRF

SEQ ID NO: 2177591 - protein, 26 aa, Cryptosporidium hominis
MIFLRMGLKLLGKWEMSDPYTRDYYK

SEQ ID NO: 2177592 - protein, 26 aa, Cryptosporidium hominis
MIGSEVPALLAIACELFVRDLTSFSW

SEQ ID NO: 2177593 - protein, 25 aa, Cryptosporidium hominis
MIILPTRESIIFPRKNDLLLKNINN

SEQ ID NO: 2177594 - protein, 19 aa, Cryptosporidium hominis
MIKALLVLKSIIKDEISQV

SEQ ID NO: 2177595 - protein, 17 aa, Cryptosporidium hominis
MIKFCGKDNFHLRIRVH

SEQ ID NO: 2177596 - protein, 21 aa, Cryptosporidium hominis
MIKNPRILSYISDSAKNNNEI

SEQ ID NO: 2177597 - protein, 25 aa, Cryptosporidium hominis
MIKRDPKIRIGYFAQHHIESLDLTL

SEQ ID NO: 2177598 - protein, 19 aa, Cryptosporidium hominis
MILHKLRHPNIVSLVDFSD

SEQ ID NO: 2177599 - protein, 17 aa, Cryptosporidium hominis
MILKCLIYLQKVGKYSS

SEQ ID NO: 2177600 - protein, 20 aa, Cryptosporidium hominis
MILKKMMDKLENFTNVMKTS

SEQ ID NO: 2177601 - protein, 17 aa, Cryptosporidium hominis
MIPKKILTQSINNRVYS

SEQ ID NO: 2177602 - protein, 28 aa, Cryptosporidium hominis
MIPNGDIKCILWPFSLLFIHKNELSDDV

SEQ ID NO: 2177603 - protein, 20 aa, Cryptosporidium hominis
MIREVYRAHGAVEIDTPVFE

SEQ ID NO: 2177604 - protein, 26 aa, Cryptosporidium hominis
MIRMKKRLVGTFGYLAPEVLNGGEYS

SEQ ID NO: 2177605 - protein, 25 aa, Cryptosporidium hominis
MISGLKLSYCLNFKANALIQILSNC

SEQ ID NO: 2177606 - protein, 24 aa, Cryptosporidium hominis
MISVFDRNTLCWADVEYTAGKPYS

SEQ ID NO: 2177607 - protein, 24 aa, Cryptosporidium hominis
MITECISNVPFLFEKISSLKKKLV

SEQ ID NO: 2177608 - protein, 20 aa, Cryptosporidium hominis
MITSVYGWDLCYEVILLDFH

SEQ ID NO: 2177609 - protein, 24 aa, Cryptosporidium hominis
MIVIKPGKHCLVCPNSDSKLHLES

SEQ ID NO: 2177610 - protein, 20 aa, Cryptosporidium hominis
MIYKAFISIFEFTRQLFDNA

SEQ ID NO: 2177611 - protein, 19 aa, Cryptosporidium hominis
MIYLFFLDIFRVEKDLNLE

SEQ ID NO: 2177612 - protein, 20 aa, Cryptosporidium hominis
MKDDFSPLIDLARGIFTSNL

SEQ ID NO: 2177613 - protein, 19 aa, Cryptosporidium hominis
MKETAFCAFITISIAEYNS

SEQ ID NO: 2177614 - protein, 20 aa, Cryptosporidium hominis
MKFLKRKATCDLEFCVELFW

SEQ ID NO: 2177615 - protein, 28 aa, Cryptosporidium hominis
MKFMNIQELFLFLSLFYHNYQREWILPL

SEQ ID NO: 2177616 - protein, 25 aa, Cryptosporidium hominis
MKIDRLGAVCDFSYTSYSRGRDAKS

SEQ ID NO: 2177617 - protein, 18 aa, Cryptosporidium hominis
MKIHLEISLGNFHKFALF

SEQ ID NO: 2177618 - protein, 19 aa, Cryptosporidium hominis
MKINCDRNLSNVIKKNEEL

SEQ ID NO: 2177619 - protein, 17 aa, Cryptosporidium hominis
MKKAIGYSDSGNYNHEY

SEQ ID NO: 2177620 - protein, 17 aa, Cryptosporidium hominis
MKKEIEISILLKKNIKI

SEQ ID NO: 2177621 - protein, 22 aa, Cryptosporidium hominis
MKMESECIIMGFVTKEMKNRPT

SEQ ID NO: 2177622 - protein, 19 aa, Cryptosporidium hominis
MKNHKRWIMSLPISGKIFL

SEQ ID NO: 2177623 - protein, 24 aa, Cryptosporidium hominis
MKNITLIINCLFALGYKKIALVKM

SEQ ID NO: 2177624 - protein, 25 aa, Cryptosporidium hominis
MKPDGDFRLGSSIELSFTTEQPESL

SEQ ID NO: 2177625 - protein, 22 aa, Cryptosporidium hominis
MKPFLNQGLPIWERVSKKGNPP

SEQ ID NO: 2177626 - protein, 19 aa, Cryptosporidium hominis
MKPLWLGSDYNIFRRNCLT

SEQ ID NO: 2177627 - protein, 19 aa, Cryptosporidium hominis
MKPSLGFVSGYLVHNIQQL

SEQ ID NO: 2177628 - protein, 21 aa, Cryptosporidium hominis
MKQKEELLYTILHLHKQINSI

SEQ ID NO: 2177629 - protein, 17 aa, Cryptosporidium hominis
MKRERLGIRTSTDDLLS

SEQ ID NO: 2177630 - protein, 26 aa, Cryptosporidium hominis
MKRKSVRGCIVSHDLSVLSLVVVERG

SEQ ID NO: 2177631 - protein, 17 aa, Cryptosporidium hominis
MKSPLVKNALRRLNKSD

SEQ ID NO: 2177632 - protein, 19 aa, Cryptosporidium hominis
MKSSRFYKVLLDITLLEDQ

SEQ ID NO: 2177633 - protein, 26 aa, Cryptosporidium hominis
MKSVHLTKDRIEFMLEHPKFTEYLCG

SEQ ID NO: 2177634 - protein, 18 aa, Cryptosporidium hominis
MKVIPSLKISTDNHHREL

SEQ ID NO: 2177635 - protein, 19 aa, Cryptosporidium hominis
MKYMEPVYLRWRKWNKKYK

SEQ ID NO: 2177636 - protein, 17 aa, Cryptosporidium hominis
MLARLERPLTLVDEENI

SEQ ID NO: 2177637 - protein, 29 aa, Cryptosporidium hominis
MLDKYTRMIYDYNSGLLLDSNDEPIPGSQ

SEQ ID NO: 2177638 - protein, 25 aa, Cryptosporidium hominis
MLDLFLKERYNAVIHFAGLKAVGVS

SEQ ID NO: 2177639 - protein, 19 aa, Cryptosporidium hominis
MLDMGFAPQIREIVEDSEM

SEQ ID NO: 2177640 - protein, 19 aa, Cryptosporidium hominis
MLEGAINISSAFSSEYVDL

SEQ ID NO: 2177641 - protein, 23 aa, Cryptosporidium hominis
MLEMLKRVGRSELVVGWYHSHPG

SEQ ID NO: 2177642 - protein, 25 aa, Cryptosporidium hominis
MLEMSFWSIELMDTIYATNGGMTTL

SEQ ID NO: 2177643 - protein, 24 aa, Cryptosporidium hominis
MLENLPWLHHIDIFGIASTIHCLI

SEQ ID NO: 2177644 - protein, 19 aa, Cryptosporidium hominis
MLENLRLRDSGGVQISQRQ

SEQ ID NO: 2177645 - protein, 22 aa, Cryptosporidium hominis
MLETDWRKGRDGGDLQRTNSKS

SEQ ID NO: 2177646 - protein, 23 aa, Cryptosporidium hominis
MLFKESMNVYLLRNKQLLLHTFI

SEQ ID NO: 2177647 - protein, 19 aa, Cryptosporidium hominis
MLFKLLIHPVHELVNNLKT

SEQ ID NO: 2177648 - protein, 26 aa, Cryptosporidium hominis
MLHGDEVPLRLGYTGVKNRSSADLKA

SEQ ID NO: 2177649 - protein, 18 aa, Cryptosporidium hominis
MLIFSIRNKDQFKKEINN

SEQ ID NO: 2177650 - protein, 32 aa, Cryptosporidium hominis
MLKEKVIRLSGGWRMRVALARAIYANPDILLL

SEQ ID NO: 2177651 - protein, 19 aa, Cryptosporidium hominis
MLKPIFRLANHNILTEEQI

SEQ ID NO: 2177652 - protein, 18 aa, Cryptosporidium hominis
MLKRSCSTPLLYSMNNAY

SEQ ID NO: 2177653 - protein, 20 aa, Cryptosporidium hominis
MLKVIDPFVAYGYPSISMIR

SEQ ID NO: 2177654 - protein, 18 aa, Cryptosporidium hominis
MLLANRVTAEFTVKNRPE

SEQ ID NO: 2177655 - protein, 23 aa, Cryptosporidium hominis
MLLKYKDKIQIISFNKQPQILDE

SEQ ID NO: 2177656 - protein, 32 aa, Cryptosporidium hominis
MLLNCFGKTIVWREIFNLCFAFLQINYSKGTK

SEQ ID NO: 2177657 - protein, 27 aa, Cryptosporidium hominis
MLMTSCPDLKGAVPLRGEIQNFNNILG

SEQ ID NO: 2177658 - protein, 27 aa, Cryptosporidium hominis
MLNNQLEWVRRYSPQVYEAMLENTYQY

SEQ ID NO: 2177659 - protein, 17 aa, Cryptosporidium hominis
MLPAGRFIVAKESKNKQ

SEQ ID NO: 2177660 - protein, 19 aa, Cryptosporidium hominis
MLRELKKPYDCSFVSREFR

SEQ ID NO: 2177661 - protein, 20 aa, Cryptosporidium hominis
MLRRCEKVLESINLKLMKSV

SEQ ID NO: 2177662 - protein, 25 aa, Cryptosporidium hominis
MLSENCAKSRFSVVANHNSKPITSI

SEQ ID NO: 2177663 - protein, 19 aa, Cryptosporidium hominis
MLSKLVLESSLDMLNENDR

SEQ ID NO: 2177664 - protein, 27 aa, Cryptosporidium hominis
MLSNCQQLPCSALEFLTGEYELEEDGI

SEQ ID NO: 2177665 - protein, 25 aa, Cryptosporidium hominis
MLSTLRFRLYEVMENLTVNTQPCFL

SEQ ID NO: 2177666 - protein, 23 aa, Cryptosporidium hominis
MLTNRVVTLWYRPPELLLGAQFY

SEQ ID NO: 2177667 - protein, 26 aa, Cryptosporidium hominis
MLVSGLMTYCKLNFRGFPIEKNGRSI

SEQ ID NO: 2177668 - protein, 24 aa, Cryptosporidium hominis
MLYCDGCPKSAHLGCLGLEEEPDS

SEQ ID NO: 2177669 - protein, 23 aa, Cryptosporidium hominis
MMEVRKRVAVAFYTYKLPEGHIR

SEQ ID NO: 2177670 - protein, 26 aa, Cryptosporidium hominis
MMFSNGRARSGIIVLPCGAGKTLTGI

SEQ ID NO: 2177671 - protein, 30 aa, Cryptosporidium hominis
MMGDKILEEKLCLIHENIARDIIFMTSLYF

SEQ ID NO: 2177672 - protein, 18 aa, Cryptosporidium hominis
MMHSRGRSPVKHTSPRKI

SEQ ID NO: 2177673 - protein, 27 aa, Cryptosporidium hominis
MMKKGLICFSCGSILRSSFGSKINSDI

SEQ ID NO: 2177674 - protein, 18 aa, Cryptosporidium hominis
MMKNSKFKNIIVDFPSKF

SEQ ID NO: 2177675 - protein, 19 aa, Cryptosporidium hominis
MMNRPELLGIIINAIGDHY

SEQ ID NO: 2177676 - protein, 22 aa, Cryptosporidium hominis
MMTESRFALMIVDSATALYRSE

SEQ ID NO: 2177677 - protein, 25 aa, Cryptosporidium hominis
MNAPCSVSFWLFPITLTISRKIFNF

SEQ ID NO: 2177678 - protein, 22 aa, Cryptosporidium hominis
MNCNNSIEFLRIWQNIYRNDQF

SEQ ID NO: 2177679 - protein, 21 aa, Cryptosporidium hominis
MNDKLRSICKVELLDESNEKY

SEQ ID NO: 2177680 - protein, 28 aa, Cryptosporidium hominis
MNEYYLYNKWLIWCKKAYDRIEWVHDFR

SEQ ID NO: 2177681 - protein, 27 aa, Cryptosporidium hominis
MNFISVKGPELFSKWVGESEKSIREIF

SEQ ID NO: 2177682 - protein, 23 aa, Cryptosporidium hominis
MNGLNDLVCNLSLIGGSKKIDQT

SEQ ID NO: 2177683 - protein, 23 aa, Cryptosporidium hominis
MNGREVTIEIALGKNSGGGRGAG

SEQ ID NO: 2177684 - protein, 19 aa, Cryptosporidium hominis
MNIAIGLIDEVLKMRDEWN

SEQ ID NO: 2177685 - protein, 24 aa, Cryptosporidium hominis
MNIELRKGKSVPVIKKYLVDLKGQ

SEQ ID NO: 2177686 - protein, 20 aa, Cryptosporidium hominis
MNIERSWEVILFSKIIGIIK

SEQ ID NO: 2177687 - protein, 17 aa, Cryptosporidium hominis
MNIPCARQRSKKKNNKE

SEQ ID NO: 2177688 - protein, 25 aa, Cryptosporidium hominis
MNISFKEAFLSEKWNLNSNLNSGTR

SEQ ID NO: 2177689 - protein, 26 aa, Cryptosporidium hominis
MNKGSVIRFISTIFHHYLIPYLRINS

SEQ ID NO: 2177690 - protein, 21 aa, Cryptosporidium hominis
MNLINLKWLLVRSSESIRNKL

SEQ ID NO: 2177691 - protein, 27 aa, Cryptosporidium hominis
MNLISIYIYQLFRAVGFIHSLGICHRD

SEQ ID NO: 2177692 - protein, 24 aa, Cryptosporidium hominis
MNNKNVLFPFGFHCTGMPICASAD

SEQ ID NO: 2177693 - protein, 24 aa, Cryptosporidium hominis
MNNYELGTIVLRRLCISESSEIKA

SEQ ID NO: 2177694 - protein, 19 aa, Cryptosporidium hominis
MNPHYLNSVPLLAQIRIEC

SEQ ID NO: 2177695 - protein, 26 aa, Cryptosporidium hominis
MNRGFIPFILCGDLSPIDNIDPSTLT

SEQ ID NO: 2177696 - protein, 31 aa, Cryptosporidium hominis
MNSIYMDVCRTYPSISYFKFEGKSYLSKILL

SEQ ID NO: 2177697 - protein, 37 aa, Cryptosporidium hominis
MNVVQRYQIVNSWNKLKFFLVNGYKDLYPAFLRQADA

SEQ ID NO: 2177698 - protein, 19 aa, Cryptosporidium hominis
MNVYHPKLLLSIVSNVMIV

SEQ ID NO: 2177699 - protein, 21 aa, Cryptosporidium hominis
MNYRALLRIKKIVELRKLDQA

SEQ ID NO: 2177700 - protein, 17 aa, Cryptosporidium hominis
MPHGRAMVTGGFPNQNA

SEQ ID NO: 2177701 - protein, 23 aa, Cryptosporidium hominis
MPIPAHLPTPMPMPMPVPMPMPM

SEQ ID NO: 2177702 - protein, 17 aa, Cryptosporidium hominis
MPISDFIQFGKIFESWD

SEQ ID NO: 2177703 - protein, 20 aa, Cryptosporidium hominis
MPISRAYRAQLERHNKPHPC

SEQ ID NO: 2177704 - protein, 17 aa, Cryptosporidium hominis
MPLLDMDGSGSIEYSEF

SEQ ID NO: 2177705 - protein, 17 aa, Cryptosporidium hominis
MPLSDCESSQCKNNKRT

SEQ ID NO: 2177706 - protein, 18 aa, Cryptosporidium hominis
MPSKIGLINIFKLYNTII

SEQ ID NO: 2177707 - protein, 17 aa, Cryptosporidium hominis
MPSVVRPPTAPNSISKS

SEQ ID NO: 2177708 - protein, 19 aa, Cryptosporidium hominis
MPTAGRVSGVTGLPAPPTL

SEQ ID NO: 2177709 - protein, 25 aa, Cryptosporidium hominis
MPWPIGLCQCSLYCVAIDVSRQEEE

SEQ ID NO: 2177710 - protein, 25 aa, Cryptosporidium hominis
MPYGARIAYEIAEVCYIRRKALLLN

SEQ ID NO: 2177711 - protein, 18 aa, Cryptosporidium hominis
MQCADIFQLKADICQLGM

SEQ ID NO: 2177712 - protein, 17 aa, Cryptosporidium hominis
MQDRFSGLHIVTSRHTV

SEQ ID NO: 2177713 - protein, 21 aa, Cryptosporidium hominis
MQDYESLIKMYNKWKKPLEIL

SEQ ID NO: 2177714 - protein, 19 aa, Cryptosporidium hominis
MQIICKFVNKQDCESFEFF

SEQ ID NO: 2177715 - protein, 24 aa, Cryptosporidium hominis
MQIIKLSLILSELDINMDQFIDLC

SEQ ID NO: 2177716 - protein, 18 aa, Cryptosporidium hominis
MQIINLRNKISMTDLDEI

SEQ ID NO: 2177717 - protein, 23 aa, Cryptosporidium hominis
MQKKELLEDILLEATKKKDRLSD

SEQ ID NO: 2177718 - protein, 17 aa, Cryptosporidium hominis
MQLEQFQKLHLINENVN

SEQ ID NO: 2177719 - protein, 23 aa, Cryptosporidium hominis
MQSLRNNWKFVVSLKGPLHYGTL

SEQ ID NO: 2177720 - protein, 23 aa, Cryptosporidium hominis
MRFRHGVGIWELFIPHLGPGEKY

SEQ ID NO: 2177721 - protein, 17 aa, Cryptosporidium hominis
MRIISCIGRGSKGGIQV

SEQ ID NO: 2177722 - protein, 19 aa, Cryptosporidium hominis
MRIKTEFSIYLSFGSNIDP

SEQ ID NO: 2177723 - protein, 19 aa, Cryptosporidium hominis
MRKATRLVDQLLIKTSNDF

SEQ ID NO: 2177724 - protein, 18 aa, Cryptosporidium hominis
MRKGGTFVAKIFRGENIS

SEQ ID NO: 2177725 - protein, 26 aa, Cryptosporidium hominis
MRKPKKRGFSDFSLKSLNSIGKMSIS

SEQ ID NO: 2177726 - protein, 18 aa, Cryptosporidium hominis
MRKTKIIGGYGIGGDKTV

SEQ ID NO: 2177727 - protein, 29 aa, Cryptosporidium hominis
MRLKQIGVRSLRHFSKIPIVVSELDQMEE

SEQ ID NO: 2177728 - protein, 19 aa, Cryptosporidium hominis
MRLYEELYNKFQTCKNDIE

SEQ ID NO: 2177729 - protein, 26 aa, Cryptosporidium hominis
MRMTACKGIGKFHAKWIPVSVATFTN

SEQ ID NO: 2177730 - protein, 17 aa, Cryptosporidium hominis
MRNSCIGMRNNNVAGTR

SEQ ID NO: 2177731 - protein, 21 aa, Cryptosporidium hominis
MRQTKFNVCLTTFDFIIRESG

SEQ ID NO: 2177732 - protein, 25 aa, Cryptosporidium hominis
MRRHSELAFKPLVLSAVENRRATAP

SEQ ID NO: 2177733 - protein, 18 aa, Cryptosporidium hominis
MRVGEFIKTVNLKLEKGE

SEQ ID NO: 2177734 - protein, 25 aa, Cryptosporidium hominis
MRVNFSYKRIQGILATSILKKHQVL

SEQ ID NO: 2177735 - protein, 22 aa, Cryptosporidium hominis
MSASSDGFWLAVGVGNLLIVFE

SEQ ID NO: 2177736 - protein, 22 aa, Cryptosporidium hominis
MSDLYKYRLVGLGLDGRIIEWD

SEQ ID NO: 2177737 - protein, 23 aa, Cryptosporidium hominis
MSEARSYLPFDVIVQEPKSRRLN

SEQ ID NO: 2177738 - protein, 20 aa, Cryptosporidium hominis
MSELRSCNNIILLEARRHEE

SEQ ID NO: 2177739 - protein, 23 aa, Cryptosporidium hominis
MSERFQAEIKRIFERYENDYNQI

SEQ ID NO: 2177740 - protein, 24 aa, Cryptosporidium hominis
MSGVTCCLRFPGQLNSDLRKMCVN

SEQ ID NO: 2177741 - protein, 19 aa, Cryptosporidium hominis
MSHEVGWNASNSFTPTNSG

SEQ ID NO: 2177742 - protein, 24 aa, Cryptosporidium hominis
MSILQRNSILYSFNKFPDLKIILI

SEQ ID NO: 2177743 - protein, 18 aa, Cryptosporidium hominis
MSILRPKYPTHVVTKQGI

SEQ ID NO: 2177744 - protein, 21 aa, Cryptosporidium hominis
MSKLIVCGKSGHVQMINQLSK

SEQ ID NO: 2177745 - protein, 31 aa, Cryptosporidium hominis
MSKYKCFLHELKLKLIEIFRINSEKFKIQYK

SEQ ID NO: 2177746 - protein, 20 aa, Cryptosporidium hominis
MSLESFIQMHHQDILLSKTQ

SEQ ID NO: 2177747 - protein, 17 aa, Cryptosporidium hominis
MSLIKALICITSPNSLS

SEQ ID NO: 2177748 - protein, 22 aa, Cryptosporidium hominis
MSLKCQICLQPFMKVQTGPLLK

SEQ ID NO: 2177749 - protein, 24 aa, Cryptosporidium hominis
MSNKLSCKGSEYLDGNNKSADFNI

SEQ ID NO: 2177750 - protein, 17 aa, Cryptosporidium hominis
MSPSRGVLFYGPPGCGK

SEQ ID NO: 2177751 - protein, 17 aa, Cryptosporidium hominis
MSQLLISIENSLICLEL

SEQ ID NO: 2177752 - protein, 18 aa, Cryptosporidium hominis
MSRFYRQTIHYLSYTPLN

SEQ ID NO: 2177753 - protein, 25 aa, Cryptosporidium hominis
MSRLPPELLALVVRHIYSQDQQIIQ

SEQ ID NO: 2177754 - protein, 23 aa, Cryptosporidium hominis
MSRRKTIGGVFCYLLKQLVAEDQ

SEQ ID NO: 2177755 - protein, 22 aa, Cryptosporidium hominis
MSRRRFSISYVQNLPNKSIENR

SEQ ID NO: 2177756 - protein, 28 aa, Cryptosporidium hominis
MSRVFPPTRQGYPWSKWAAEQILETAHQ

SEQ ID NO: 2177757 - protein, 19 aa, Cryptosporidium hominis
MSSDNRWIVVSTKNSELFI

SEQ ID NO: 2177758 - protein, 18 aa, Cryptosporidium hominis
MSSFRPINHGGLMHNDSA

SEQ ID NO: 2177759 - protein, 20 aa, Cryptosporidium hominis
MSSNSCSDWSMINEIDQNAY

SEQ ID NO: 2177760 - protein, 28 aa, Cryptosporidium hominis
MSTCTSLRVSSCFKRMELIVWNYNDSNL

SEQ ID NO: 2177761 - protein, 24 aa, Cryptosporidium hominis
MSTNDIFCIPKPSINVNYPQTDSS

SEQ ID NO: 2177762 - protein, 30 aa, Cryptosporidium hominis
MSVLPPKSGKICLPKEFYNMMIDKNNPLSE

SEQ ID NO: 2177763 - protein, 17 aa, Cryptosporidium hominis
MSVYRTRGSGLSLSDNC

SEQ ID NO: 2177764 - protein, 26 aa, Cryptosporidium hominis
MSYDREFSKIFSIKKLHLGHVASSFG

SEQ ID NO: 2177765 - protein, 20 aa, Cryptosporidium hominis
MSYFICDGCEKRHEIFSKGD

SEQ ID NO: 2177766 - protein, 18 aa, Cryptosporidium hominis
MSYHDFIYFYISDEDKTT

SEQ ID NO: 2177767 - protein, 28 aa, Cryptosporidium hominis
MSYQRYGGLSAVGGREGYSSSYVPAPKV

SEQ ID NO: 2177768 - protein, 20 aa, Cryptosporidium hominis
MTAIPFNCLMKIVPSNDETH

SEQ ID NO: 2177769 - protein, 24 aa, Cryptosporidium hominis
MTELSRFRTRICERKALHGVCELD

SEQ ID NO: 2177770 - protein, 29 aa, Cryptosporidium hominis
MTERELRYFFLKEIQRFSPDLVIPDSIKM

SEQ ID NO: 2177771 - protein, 25 aa, Cryptosporidium hominis
MTGGDIGKCALLMRNVAFQVVFDIM

SEQ ID NO: 2177772 - protein, 30 aa, Cryptosporidium hominis
MTKEIKNIVNLLKRFLSIIEDERQSILLLL

SEQ ID NO: 2177773 - protein, 22 aa, Cryptosporidium hominis
MTSKQVWGPINLFYPDVKSTFT

SEQ ID NO: 2177774 - protein, 28 aa, Cryptosporidium hominis
MTSTELYVTLGICKKLNKLFNCKYTDLQ

SEQ ID NO: 2177775 - protein, 17 aa, Cryptosporidium hominis
MTVRRFLTATGHAISLF

SEQ ID NO: 2177776 - protein, 18 aa, Cryptosporidium hominis
MVEAKLVTKPGVDKNKPL

SEQ ID NO: 2177777 - protein, 24 aa, Cryptosporidium hominis
MVFSKANIKLSEFVSADIDERVIT

SEQ ID NO: 2177778 - protein, 21 aa, Cryptosporidium hominis
MVGILYRRFPNIKEFIENHLM

SEQ ID NO: 2177779 - protein, 19 aa, Cryptosporidium hominis
MVIAKSIALSAYYKSLDPF

SEQ ID NO: 2177780 - protein, 17 aa, Cryptosporidium hominis
MVIEAAKGFSWLESNPC

SEQ ID NO: 2177781 - protein, 21 aa, Cryptosporidium hominis
MVIELKGYIRILLKLIDIKAS

SEQ ID NO: 2177782 - protein, 26 aa, Cryptosporidium hominis
MVLQECLQRHGYSCIPAANPRVQDYI

SEQ ID NO: 2177783 - protein, 29 aa, Cryptosporidium hominis
MVNPNIEFLRFGFLFSKDILAPFEMAISQ

SEQ ID NO: 2177784 - protein, 20 aa, Cryptosporidium hominis
MVPLGPLAFSPGYIINTNKV

SEQ ID NO: 2177785 - protein, 18 aa, Cryptosporidium hominis
MVRDRWEALVYNRNSITN

SEQ ID NO: 2177786 - protein, 32 aa, Cryptosporidium hominis
MVRMLNIISEFLVLRGFRHQRLDGTMGKELRK

SEQ ID NO: 2177787 - protein, 33 aa, Cryptosporidium hominis
MVSEKGYDYCLLYFELLRDGLINAHLWRDTTIE

SEQ ID NO: 2177788 - protein, 20 aa, Cryptosporidium hominis
MVSPLQSFRTPRLENQNHNN

SEQ ID NO: 2177789 - protein, 25 aa, Cryptosporidium hominis
MVTRRMEARLSNSHSPWISKGSGGP

SEQ ID NO: 2177790 - protein, 19 aa, Cryptosporidium hominis
MVYILRWSFELGPSKSRSL

SEQ ID NO: 2177791 - protein, 24 aa, Cryptosporidium hominis
MVYSCLKRGGKVLIPVFAIGRAQE

SEQ ID NO: 2177792 - protein, 25 aa, Cryptosporidium hominis
MVYSEKISILILYQLLVCVDYLHEH

SEQ ID NO: 2177793 - protein, 20 aa, Cryptosporidium hominis
MWGTLCRKQKIMASTLDGID

SEQ ID NO: 2177794 - protein, 18 aa, Cryptosporidium hominis
MWKESRRFMFKKLEDELL

SEQ ID NO: 2177795 - protein, 19 aa, Cryptosporidium hominis
MWSVGCIFAELLNMLKENV

SEQ ID NO: 2177796 - protein, 19 aa, Cryptosporidium hominis
MYCPTVNVEKLWTLVSKNT

SEQ ID NO: 2177797 - protein, 19 aa, Cryptosporidium hominis
MYEIYKRKSEIMVNKIHLN

SEQ ID NO: 2177798 - protein, 17 aa, Cryptosporidium hominis
MYENWPFVKSFFDLVSM

SEQ ID NO: 2177799 - protein, 23 aa, Cryptosporidium hominis
MYFMVPRYGDYIIAEVAKQLNQK

SEQ ID NO: 2177800 - protein, 25 aa, Cryptosporidium hominis
MYHTVQEPMWDAAMYNPNTIKANTY

SEQ ID NO: 2177801 - protein, 17 aa, Cryptosporidium hominis
MYKLQWEIYERLGDVSY

SEQ ID NO: 2177802 - protein, 21 aa, Cryptosporidium hominis
MYKQDYCLLILRRALSSTNRR

SEQ ID NO: 2177803 - protein, 31 aa, Cryptosporidium hominis
MYMPEVVDVLSRLTVISARSKYEHKYPGAYH

SEQ ID NO: 2177804 - protein, 23 aa, Cryptosporidium hominis
MYSTSSWLPLSRNTGFNYNCLYS

SEQ ID NO: 2177805 - protein, 25 aa, Cryptosporidium hominis
MYWIYYRIFHGIPFELFEICQIKEM

SEQ ID NO: 2177806 - protein, 25 aa, Cryptosporidium hominis
MYYGDPCGHKFCSECSTKANNNKKS

SEQ ID NO: 2177807 - protein, 18 aa, Cryptosporidium hominis
NAAKDKAERVRSQLQILS

SEQ ID NO: 2177808 - protein, 17 aa, Cryptosporidium hominis
NAAPNCCGSNYNYFIDR

SEQ ID NO: 2177809 - protein, 20 aa, Cryptosporidium hominis
NACWELFCLEHGINPDGTMP

SEQ ID NO: 2177810 - protein, 25 aa, Cryptosporidium hominis
NADDICRFKLTWPLQKSLEIADEEM

SEQ ID NO: 2177811 - protein, 19 aa, Cryptosporidium hominis
NADKFKLSIPPSVPESIPE

SEQ ID NO: 2177812 - protein, 23 aa, Cryptosporidium hominis
NADLFRKTIEPVKKVLEDAGIKK

SEQ ID NO: 2177813 - protein, 24 aa, Cryptosporidium hominis
NADPELYMALRMSMEEERNRQMRL

SEQ ID NO: 2177814 - protein, 22 aa, Cryptosporidium hominis
NADSWLVSWNLLGIADGVSSVE

SEQ ID NO: 2177815 - protein, 19 aa, Cryptosporidium hominis
NAEIARLILSKGYSSSLND

SEQ ID NO: 2177816 - protein, 18 aa, Cryptosporidium hominis
NAFKAFTLNSEYASKLKD

SEQ ID NO: 2177817 - protein, 27 aa, Cryptosporidium hominis
NAFSDFPRTVKVCAGGEYSENKDSEVG

SEQ ID NO: 2177818 - protein, 17 aa, Cryptosporidium hominis
NAFVICITNPLDVMVSH

SEQ ID NO: 2177819 - protein, 20 aa, Cryptosporidium hominis
NAGALWGSIMGGTNRTSTVP

SEQ ID NO: 2177820 - protein, 23 aa, Cryptosporidium hominis
NAKCRLRLLKYERIKDYLMMEQE

SEQ ID NO: 2177821 - protein, 21 aa, Cryptosporidium hominis
NAKEFLPRAISNNSEICEDPL

SEQ ID NO: 2177822 - protein, 18 aa, Cryptosporidium hominis
NAKEGPMMLDDLKSKINA

SEQ ID NO: 2177823 - protein, 20 aa, Cryptosporidium hominis
NAKELSSWLEVGASGYYNFP

SEQ ID NO: 2177824 - protein, 20 aa, Cryptosporidium hominis
NAKGGIPLKVVEKSSTSLLG

SEQ ID NO: 2177825 - protein, 19 aa, Cryptosporidium hominis
NAKILGILHRHFGYNRGKK

SEQ ID NO: 2177826 - protein, 23 aa, Cryptosporidium hominis
NAKLECLILMFIKLIKLQLNEIR

SEQ ID NO: 2177827 - protein, 20 aa, Cryptosporidium hominis
NAKYKMIISHQVYLKHVEIY

SEQ ID NO: 2177828 - protein, 17 aa, Cryptosporidium hominis
NALDYILTGDCRLLSDE

SEQ ID NO: 2177829 - protein, 17 aa, Cryptosporidium hominis
NALHYAKLLEEFEQRRE

SEQ ID NO: 2177830 - protein, 20 aa, Cryptosporidium hominis
NALPFFSGCIGRRVTISDSQ

SEQ ID NO: 2177831 - protein, 17 aa, Cryptosporidium hominis
NAMGVCMYTLLDGQHND

SEQ ID NO: 2177832 - protein, 20 aa, Cryptosporidium hominis
NANEKILRFDFSNIEKKINE

SEQ ID NO: 2177833 - protein, 33 aa, Cryptosporidium hominis
NAPLKYIPICEGVLKEVYLELVGKHKKEISEEE

SEQ ID NO: 2177834 - protein, 24 aa, Cryptosporidium hominis
NAPNLKVYFFSALNEINKREHLES

SEQ ID NO: 2177835 - protein, 32 aa, Cryptosporidium hominis
NAPRHPGALIRRPVRPEIRLIDFGAATYEHDY

SEQ ID NO: 2177836 - protein, 17 aa, Cryptosporidium hominis
NAPSRLVTGASITPAAV

SEQ ID NO: 2177837 - protein, 23 aa, Cryptosporidium hominis
NAQWEPIEFSKLMSDIELVKKAY

SEQ ID NO: 2177838 - protein, 31 aa, Cryptosporidium hominis
NARDIAALTIRCLNIRHTISLEAIIGGGVSW

SEQ ID NO: 2177839 - protein, 19 aa, Cryptosporidium hominis
NARISRSILDEFSKLRDSN

SEQ ID NO: 2177840 - protein, 23 aa, Cryptosporidium hominis
NASWRIVTIASILVPSSKIELSN

SEQ ID NO: 2177841 - protein, 26 aa, Cryptosporidium hominis
NATKPIEVFLIFSLNAIKSVIADLSS

SEQ ID NO: 2177842 - protein, 27 aa, Cryptosporidium hominis
NAVINCSDWPTSVSFHPIQKNIIFIGS

SEQ ID NO: 2177843 - protein, 17 aa, Cryptosporidium hominis
NAWEKSARIYFMDLDLM

SEQ ID NO: 2177844 - protein, 20 aa, Cryptosporidium hominis
NAYICSGLDDIFFKNMMLEI

SEQ ID NO: 2177845 - protein, 26 aa, Cryptosporidium hominis
NCASYGSTTCLLCFLDGNQLWVSNVG

SEQ ID NO: 2177846 - protein, 25 aa, Cryptosporidium hominis
NCDACYRPFHSRCVGFDIKRAEFNN

SEQ ID NO: 2177847 - protein, 20 aa, Cryptosporidium hominis
NCDILPYYIEYYRFQNVAFQ

SEQ ID NO: 2177848 - protein, 25 aa, Cryptosporidium hominis
NCDLRTSMKDCFTEFAVSEYRLARE

SEQ ID NO: 2177849 - protein, 19 aa, Cryptosporidium hominis
NCDMKGLDVDRLMLVSVVV

SEQ ID NO: 2177850 - protein, 19 aa, Cryptosporidium hominis
NCDSGVLISTDLTARGIDI

SEQ ID NO: 2177851 - protein, 20 aa, Cryptosporidium hominis
NCEISLPNCGAVNFSSLCNY

SEQ ID NO: 2177852 - protein, 20 aa, Cryptosporidium hominis
NCEQTACVKIGDLICTPQND

SEQ ID NO: 2177853 - protein, 21 aa, Cryptosporidium hominis
NCGAFAYQIMFEFDPIKWCSK

SEQ ID NO: 2177854 - protein, 30 aa, Cryptosporidium hominis
NCISDLKLRILWIKETIHCFEPFTDTLTPS

SEQ ID NO: 2177855 - protein, 19 aa, Cryptosporidium hominis
NCKCYKPTESGIHREIFLR

SEQ ID NO: 2177856 - protein, 19 aa, Cryptosporidium hominis
NCKGELGKAISILEESKEI

SEQ ID NO: 2177857 - protein, 20 aa, Cryptosporidium hominis
NCLFDYIPKLVLLLRSHETL

SEQ ID NO: 2177858 - protein, 35 aa, Cryptosporidium hominis
NCNHFSDNIVKFLIGEGIPSYILDLPNEVMRTPFG

SEQ ID NO: 2177859 - protein, 18 aa, Cryptosporidium hominis
NCNQVFKTIVPPELVYSG

SEQ ID NO: 2177860 - protein, 26 aa, Cryptosporidium hominis
NCNTQFCNECCKFIFTTLHQCPICCS

SEQ ID NO: 2177861 - protein, 23 aa, Cryptosporidium hominis
NCNWKDDNVLTWLSRPVLSDLII

SEQ ID NO: 2177862 - protein, 20 aa, Cryptosporidium hominis
NCPDDYMFDNIVKRCYKVDV

SEQ ID NO: 2177863 - protein, 25 aa, Cryptosporidium hominis
NCSEANFSFVLKLFISIVGSCVDML

SEQ ID NO: 2177864 - protein, 20 aa, Cryptosporidium hominis
NCTYCSQGRVFLFDSNLGIE

SEQ ID NO: 2177865 - protein, 28 aa, Cryptosporidium hominis
NCVSCGKPCIYSYYILRAGVVCGVSVAV

SEQ ID NO: 2177866 - protein, 21 aa, Cryptosporidium hominis
NCYYMYQRNIPNISISPNSNS

SEQ ID NO: 2177867 - protein, 19 aa, Cryptosporidium hominis
NDAELLLADMEFRDSDTPQ

SEQ ID NO: 2177868 - protein, 23 aa, Cryptosporidium hominis
NDCLRMFSKCILKYYKMTTSQFN

SEQ ID NO: 2177869 - protein, 22 aa, Cryptosporidium hominis
NDELKMRILLKIHEEKTKLMYV

SEQ ID NO: 2177870 - protein, 17 aa, Cryptosporidium hominis
NDFEEFSEIVAFDENIP

SEQ ID NO: 2177871 - protein, 24 aa, Cryptosporidium hominis
NDFLQDLLNFIGYHIESESILESN

SEQ ID NO: 2177872 - protein, 25 aa, Cryptosporidium hominis
NDFLQKAKVIWLYKNGDKYDKGTIY

SEQ ID NO: 2177873 - protein, 27 aa, Cryptosporidium hominis
NDFPIDANCILSAWQYQEVSLYYIFNE

SEQ ID NO: 2177874 - protein, 28 aa, Cryptosporidium hominis
NDFYRILKWDPFEFSEFNSSVFFDPAEI

SEQ ID NO: 2177875 - protein, 23 aa, Cryptosporidium hominis
NDICFVCYRGLFNYQGFTFEDIR

SEQ ID NO: 2177876 - protein, 17 aa, Cryptosporidium hominis
NDIGEMMECISRNCKDV

SEQ ID NO: 2177877 - protein, 26 aa, Cryptosporidium hominis
NDILKRAKNFLSLCETIGNEKVTQSY

SEQ ID NO: 2177878 - protein, 23 aa, Cryptosporidium hominis
NDILPEAVFRLKLDNENYKAGVI

SEQ ID NO: 2177879 - protein, 26 aa, Cryptosporidium hominis
NDILRDYDQIVPKRSNLSLSSPIIDI

SEQ ID NO: 2177880 - protein, 26 aa, Cryptosporidium hominis
NDIYLETISVFGIIHKPKIILLNINN

SEQ ID NO: 2177881 - protein, 21 aa, Cryptosporidium hominis
NDKKHVTCCFFGHTTDSNTKD

SEQ ID NO: 2177882 - protein, 22 aa, Cryptosporidium hominis
NDKKIPIPISWDDIQRKNYIDR

SEQ ID NO: 2177883 - protein, 18 aa, Cryptosporidium hominis
NDKLCSAYNSVIIFFFLY

SEQ ID NO: 2177884 - protein, 22 aa, Cryptosporidium hominis
NDKRVAIAYCNSSGSGLEEIHG

SEQ ID NO: 2177885 - protein, 17 aa, Cryptosporidium hominis
NDKRVLSLFGETVLSRE

SEQ ID NO: 2177886 - protein, 19 aa, Cryptosporidium hominis
NDLEMKVIPSLKISTDNHH

SEQ ID NO: 2177887 - protein, 25 aa, Cryptosporidium hominis
NDLIPRWLHDWLSELLTCMNTNREI

SEQ ID NO: 2177888 - protein, 28 aa, Cryptosporidium hominis
NDLLKKGTKIYCDRRHSTILGKAGKIQC

SEQ ID NO: 2177889 - protein, 17 aa, Cryptosporidium hominis
NDLLRPVFSCDYSSENK

SEQ ID NO: 2177890 - protein, 30 aa, Cryptosporidium hominis
NDLMSLGLHRCWKDIFVENIISPESFLRIK

SEQ ID NO: 2177891 - protein, 26 aa, Cryptosporidium hominis
NDLPDLILVVFYRYILLMRRLQSIYL

SEQ ID NO: 2177892 - protein, 17 aa, Cryptosporidium hominis
NDLRNCDSEYAIDKTAE

SEQ ID NO: 2177893 - protein, 21 aa, Cryptosporidium hominis
NDLSVWFQFMESIESVLASSR

SEQ ID NO: 2177894 - protein, 21 aa, Cryptosporidium hominis
NDLTLLFVRTLRLLLSSCHEK

SEQ ID NO: 2177895 - protein, 17 aa, Cryptosporidium hominis
NDNCLSCNLYQRSCDLG

SEQ ID NO: 2177896 - protein, 22 aa, Cryptosporidium hominis
NDNFRPSKLAIMLEDLEDFDTE

SEQ ID NO: 2177897 - protein, 24 aa, Cryptosporidium hominis
NDPLLLEFLFYIVGYTSLKEENIR

SEQ ID NO: 2177898 - protein, 24 aa, Cryptosporidium hominis
NDPLLRLGAGLPHNSSGTPCIPPF

SEQ ID NO: 2177899 - protein, 27 aa, Cryptosporidium hominis
NDPSCTLYVCRLSLKTKEDDLRRLFED

SEQ ID NO: 2177900 - protein, 25 aa, Cryptosporidium hominis
NDQLPVILFGFSRRKVEQLATNLPN

SEQ ID NO: 2177901 - protein, 26 aa, Cryptosporidium hominis
NDQLWKSPDWMICLRDGISKGIKNKN

SEQ ID NO: 2177902 - protein, 23 aa, Cryptosporidium hominis
NDRFKDNLLRSFRFDEELSNNQA

SEQ ID NO: 2177903 - protein, 25 aa, Cryptosporidium hominis
NDRKRLSFVRFLKLDKVGPHCDCDK

SEQ ID NO: 2177904 - protein, 19 aa, Cryptosporidium hominis
NDRNPLCTLTMKSIDLNPP

SEQ ID NO: 2177905 - protein, 24 aa, Cryptosporidium hominis
NDRWKGIWSDIVFDIINAEVEWGS

SEQ ID NO: 2177906 - protein, 22 aa, Cryptosporidium hominis
NDSEFLFQCVIRDISLDDNIFK

SEQ ID NO: 2177907 - protein, 27 aa, Cryptosporidium hominis
NDSFIPIIIPIFIKWKSKQFNSKLILT

SEQ ID NO: 2177908 - protein, 17 aa, Cryptosporidium hominis
NDSFKFRDESKLLKGSS

SEQ ID NO: 2177909 - protein, 17 aa, Cryptosporidium hominis
NDSKGLINFTIKKSDFR

SEQ ID NO: 2177910 - protein, 25 aa, Cryptosporidium hominis
NDSLLRKISNLNFDEMSLIVGNSQS

SEQ ID NO: 2177911 - protein, 25 aa, Cryptosporidium hominis
NDSQMLMIVPSEFSFGSNHCNRKSD

SEQ ID NO: 2177912 - protein, 25 aa, Cryptosporidium hominis
NDSYIQGFCCSKCFNINDFDYKSNN

SEQ ID NO: 2177913 - protein, 18 aa, Cryptosporidium hominis
NDVLCIGHTHGIETIIAP

SEQ ID NO: 2177914 - protein, 25 aa, Cryptosporidium hominis
NDYFAREGLLGVCESRLNTHRWERN

SEQ ID NO: 2177915 - protein, 25 aa, Cryptosporidium hominis
NDYNPSLELNEWLPTQCIDARSEVA

SEQ ID NO: 2177916 - protein, 18 aa, Cryptosporidium hominis
NDYRGFMKPVQFIDYNPM

SEQ ID NO: 2177917 - protein, 20 aa, Cryptosporidium hominis
NEAFFPLPNNFSLKPCDTKT

SEQ ID NO: 2177918 - protein, 20 aa, Cryptosporidium hominis
NEAIDCIRDILGKFQHFAIK

SEQ ID NO: 2177919 - protein, 18 aa, Cryptosporidium hominis
NEALRQLATIAFYVQDEF

SEQ ID NO: 2177920 - protein, 24 aa, Cryptosporidium hominis
NECSSRPSISLATSVRRKVYHIDS

SEQ ID NO: 2177921 - protein, 22 aa, Cryptosporidium hominis
NEDGKEVFAYFCRCGGLIFLEK

SEQ ID NO: 2177922 - protein, 24 aa, Cryptosporidium hominis
NEDIWRNIFGLIWVIFYTKPFKPK

SEQ ID NO: 2177923 - protein, 20 aa, Cryptosporidium hominis
NEDKEIVAFDCPKEEKTATK

SEQ ID NO: 2177924 - protein, 25 aa, Cryptosporidium hominis
NEDYYRRINVQPAIVDTPMSPRTAK

SEQ ID NO: 2177925 - protein, 25 aa, Cryptosporidium hominis
NEEEMIGLLKLVFDKATTQHHFIPM

SEQ ID NO: 2177926 - protein, 23 aa, Cryptosporidium hominis
NEEFKSNDSFAFAPILKINVHSS

SEQ ID NO: 2177927 - protein, 17 aa, Cryptosporidium hominis
NEEFPKFFWKRKSNFSF

SEQ ID NO: 2177928 - protein, 17 aa, Cryptosporidium hominis
NEEIEIISKEIDAINKE

SEQ ID NO: 2177929 - protein, 24 aa, Cryptosporidium hominis
NEELEEYKHLVLRFMHQQNGNDDY

SEQ ID NO: 2177930 - protein, 17 aa, Cryptosporidium hominis
NEFKSSIVVNSGQLQSE

SEQ ID NO: 2177931 - protein, 18 aa, Cryptosporidium hominis
NEFLKLGVFELITKKLGK

SEQ ID NO: 2177932 - protein, 21 aa, Cryptosporidium hominis
NEFLSLILIEIEDLRNFHISN

SEQ ID NO: 2177933 - protein, 23 aa, Cryptosporidium hominis
NEFPTWRWGEEVSIKEIGDNISM

SEQ ID NO: 2177934 - protein, 17 aa, Cryptosporidium hominis
NEFSISFDIEYIKNKEI

SEQ ID NO: 2177935 - protein, 21 aa, Cryptosporidium hominis
NEFSNQEWVMHYWKEIPLPFS

SEQ ID NO: 2177936 - protein, 23 aa, Cryptosporidium hominis
NEGGESLNGFLISGNHESNSKTT

SEQ ID NO: 2177937 - protein, 20 aa, Cryptosporidium hominis
NEGWSDVFQYNKLVSNSMNY

SEQ ID NO: 2177938 - protein, 24 aa, Cryptosporidium hominis
NEHYPRKLIKTFSVFPMLNNESSD

SEQ ID NO: 2177939 - protein, 23 aa, Cryptosporidium hominis
NEIDISIPNLVPFPEEKESKTNR

SEQ ID NO: 2177940 - protein, 22 aa, Cryptosporidium hominis
NEIGPRFILRLYKIELGTLEMK

SEQ ID NO: 2177941 - protein, 29 aa, Cryptosporidium hominis
NEIINFTSCWKLPTFLFYSDKKGNLLNYL

SEQ ID NO: 2177942 - protein, 25 aa, Cryptosporidium hominis
NEIITCARFSSFLRNNSGRLHWLRV

SEQ ID NO: 2177943 - protein, 21 aa, Cryptosporidium hominis
NEIKGDINLIKIIIKGQSFLL

SEQ ID NO: 2177944 - protein, 17 aa, Cryptosporidium hominis
NEIKITSLFFIDSDNKL

SEQ ID NO: 2177945 - protein, 19 aa, Cryptosporidium hominis
NEIMIIKAQVENLVEEKSK

SEQ ID NO: 2177946 - protein, 20 aa, Cryptosporidium hominis
NEIPVQIILYKDFPFSPPDI

SEQ ID NO: 2177947 - protein, 20 aa, Cryptosporidium hominis
NEIQKILSIPVFVNPDLCEV

SEQ ID NO: 2177948 - protein, 24 aa, Cryptosporidium hominis
NEIRPYGYRGSPMILTQFIENIDL

SEQ ID NO: 2177949 - protein, 22 aa, Cryptosporidium hominis
NEIRQVCAILSGLAVSFDYELG

SEQ ID NO: 2177950 - protein, 25 aa, Cryptosporidium hominis
NEIRSTAWIPKGEYIPEDIIMGYHT

SEQ ID NO: 2177951 - protein, 25 aa, Cryptosporidium hominis
NEISDLIHRCHYDANQIELAVGNVI

SEQ ID NO: 2177952 - protein, 20 aa, Cryptosporidium hominis
NEISELRLKLSNSKEKESSN

SEQ ID NO: 2177953 - protein, 18 aa, Cryptosporidium hominis
NEKFEIMTDSLLLLQRLE

SEQ ID NO: 2177954 - protein, 30 aa, Cryptosporidium hominis
NEKMIKRIGLKLGVEIGGPILIFKNEDMEK

SEQ ID NO: 2177955 - protein, 24 aa, Cryptosporidium hominis
NELCNRIEGIFGIIDQDQSGSWEY

SEQ ID NO: 2177956 - protein, 17 aa, Cryptosporidium hominis
NELDSFSGIGIVDNSLN

SEQ ID NO: 2177957 - protein, 20 aa, Cryptosporidium hominis
NELFKLLIEYTKSSNLKTIV

SEQ ID NO: 2177958 - protein, 19 aa, Cryptosporidium hominis
NELGELVHSISHLGDRKLI

SEQ ID NO: 2177959 - protein, 17 aa, Cryptosporidium hominis
NELGYQYAINWAGGLHH

SEQ ID NO: 2177960 - protein, 21 aa, Cryptosporidium hominis
NELKASIKFQLKKVLCLGVAI

SEQ ID NO: 2177961 - protein, 19 aa, Cryptosporidium hominis
NELKFLIRSMLDPNPVNRP

SEQ ID NO: 2177962 - protein, 23 aa, Cryptosporidium hominis
NELKLDCKASFAVFSSSPLLLNR

SEQ ID NO: 2177963 - protein, 37 aa, Cryptosporidium hominis
NELKLFDYLLSMPLWSLTKEKMELLEADLIKKTEEYE

SEQ ID NO: 2177964 - protein, 25 aa, Cryptosporidium hominis
NELKVTSMGLLYGRKEKEQEREIAR

SEQ ID NO: 2177965 - protein, 19 aa, Cryptosporidium hominis
NELLPIWKISINSQAKNES

SEQ ID NO: 2177966 - protein, 17 aa, Cryptosporidium hominis
NELNAKLGRNLNILSKS

SEQ ID NO: 2177967 - protein, 20 aa, Cryptosporidium hominis
NELRNVFSVYGINVDYRHLT

SEQ ID NO: 2177968 - protein, 22 aa, Cryptosporidium hominis
NELRTRIERKLSINKELSQAAA

SEQ ID NO: 2177969 - protein, 19 aa, Cryptosporidium hominis
NELVWWRMTRKQRYLPGRT

SEQ ID NO: 2177970 - protein, 21 aa, Cryptosporidium hominis
NEMAWDKFIINWIKKIEIEIG

SEQ ID NO: 2177971 - protein, 31 aa, Cryptosporidium hominis
NENEIFNWLLEYDVPLFIANDLINSELNMNN

SEQ ID NO: 2177972 - protein, 23 aa, Cryptosporidium hominis
NENFKLAYPFYSNIFNIENRTDK

SEQ ID NO: 2177973 - protein, 25 aa, Cryptosporidium hominis
NENLWDMPCSEMTSMTLGDIREAEN

SEQ ID NO: 2177974 - protein, 21 aa, Cryptosporidium hominis
NENNLHCAYYCEGFKDINERF

SEQ ID NO: 2177975 - protein, 25 aa, Cryptosporidium hominis
NENQRLSMQNVFKRFYSPGNSSSNT

SEQ ID NO: 2177976 - protein, 24 aa, Cryptosporidium hominis
NENTSRFPLRFTNVNQNFELCSSY

SEQ ID NO: 2177977 - protein, 31 aa, Cryptosporidium hominis
NENYKAGVIHPRILVNVKRVMTGIIEDLQIS

SEQ ID NO: 2177978 - protein, 22 aa, Cryptosporidium hominis
NEPTHIRPAFPNFQKNKEIQNE

SEQ ID NO: 2177979 - protein, 24 aa, Cryptosporidium hominis
NEQFKVIPSFHIKDLQVEFPENKD

SEQ ID NO: 2177980 - protein, 26 aa, Cryptosporidium hominis
NEQIRMLRERIIVLSTNIEDKSSPQA

SEQ ID NO: 2177981 - protein, 24 aa, Cryptosporidium hominis
NEQLSRITIYITLQVVFILENLKS

SEQ ID NO: 2177982 - protein, 27 aa, Cryptosporidium hominis
NERDLLMKRIQSLEVIESSQKMLILET

SEQ ID NO: 2177983 - protein, 17 aa, Cryptosporidium hominis
NERIFSEICDFSILNEM

SEQ ID NO: 2177984 - protein, 32 aa, Cryptosporidium hominis
NERIYRIGNIHPNLRGLSSMIINNINDNNINK

SEQ ID NO: 2177985 - protein, 18 aa, Cryptosporidium hominis
NERYRLLLNNSQINQFTN

SEQ ID NO: 2177986 - protein, 27 aa, Cryptosporidium hominis
NESIKFIKIKVAFLINQGYPEKSPPEI

SEQ ID NO: 2177987 - protein, 17 aa, Cryptosporidium hominis
NESLRCCPEMIHPSTYV

SEQ ID NO: 2177988 - protein, 21 aa, Cryptosporidium hominis
NESRLRIAIVEADRCKPKNCR

SEQ ID NO: 2177989 - protein, 18 aa, Cryptosporidium hominis
NESSFEFIPPPSKHIAEF

SEQ ID NO: 2177990 - protein, 22 aa, Cryptosporidium hominis
NETCNWYTTFDSILPKRKKDNT

SEQ ID NO: 2177991 - protein, 21 aa, Cryptosporidium hominis
NETIEDYWVCLNDAMTWRNPS

SEQ ID NO: 2177992 - protein, 17 aa, Cryptosporidium hominis
NETKLCFDEELKRISKQ

SEQ ID NO: 2177993 - protein, 25 aa, Cryptosporidium hominis
NEVCSFNLLQPLSLNISYSGSNDKS

SEQ ID NO: 2177994 - protein, 21 aa, Cryptosporidium hominis
NEVFELSKLQLFWHPNVSLRT

SEQ ID NO: 2177995 - protein, 26 aa, Cryptosporidium hominis
NEVFQRYNITLSLCGHLLYGGEEDSR

SEQ ID NO: 2177996 - protein, 22 aa, Cryptosporidium hominis
NEVIETWLSSGMMPGDNQIDLP

SEQ ID NO: 2177997 - protein, 24 aa, Cryptosporidium hominis
NEVMTRTVLPGMQYDECYNSTMIT

SEQ ID NO: 2177998 - protein, 18 aa, Cryptosporidium hominis
NEVQNCFLETARLHNEVC

SEQ ID NO: 2177999 - protein, 23 aa, Cryptosporidium hominis
NEVSLLLYEIYETVVPVGEFVSL

SEQ ID NO: 2178000 - protein, 25 aa, Cryptosporidium hominis
NEVVVICTGTGLLLLYRFDDESVLS

SEQ ID NO: 2178001 - protein, 20 aa, Cryptosporidium hominis
NEWFPGIFPMVPGHEIIGIV

SEQ ID NO: 2178002 - protein, 25 aa, Cryptosporidium hominis
NEWGNSWGDMWNWSTKVKSWGEKWE

SEQ ID NO: 2178003 - protein, 31 aa, Cryptosporidium hominis
NEYGNIYGIIFLFKFTEKFKGNHFSQPIEAP

SEQ ID NO: 2178004 - protein, 25 aa, Cryptosporidium hominis
NEYMKRSLDSFAFPITSEKGKKQLI

SEQ ID NO: 2178005 - protein, 18 aa, Cryptosporidium hominis
NEYSCYPVSFAGRDELEG

SEQ ID NO: 2178006 - protein, 24 aa, Cryptosporidium hominis
NFEAAKLAYIKLIYLKKRGDYDTY

SEQ ID NO: 2178007 - protein, 24 aa, Cryptosporidium hominis
NFEEICLWENIFVEKLEECDVIAL

SEQ ID NO: 2178008 - protein, 24 aa, Cryptosporidium hominis
NFEKPFLWLARRLTNQPALQLVGQ

SEQ ID NO: 2178009 - protein, 25 aa, Cryptosporidium hominis
NFELKTEPYINLSKEQLYKIIYQKH

SEQ ID NO: 2178010 - protein, 19 aa, Cryptosporidium hominis
NFENFEWAFASPPWGGYSY

SEQ ID NO: 2178011 - protein, 30 aa, Cryptosporidium hominis
NFESFCSKYFLDICQSEYFGLELLDKSEVI

SEQ ID NO: 2178012 - protein, 24 aa, Cryptosporidium hominis
NFEVIVCWIVKLEAFFSSLFEFFL

SEQ ID NO: 2178013 - protein, 32 aa, Cryptosporidium hominis
NFGEGSFYLHSRCLITIPFLQWELINDQVYTN

SEQ ID NO: 2178014 - protein, 21 aa, Cryptosporidium hominis
NFGKELLLDFEKLRISYNLPI

SEQ ID NO: 2178015 - protein, 18 aa, Cryptosporidium hominis
NFGQRSQLRISILQQVLH

SEQ ID NO: 2178016 - protein, 24 aa, Cryptosporidium hominis
NFIEVRKSLLLEVIGDSLKYKNTL

SEQ ID NO: 2178017 - protein, 18 aa, Cryptosporidium hominis
NFISELIFNPQIKLNKIE

SEQ ID NO: 2178018 - protein, 23 aa, Cryptosporidium hominis
NFITEIDPLLSLTKLKSLNISKN

SEQ ID NO: 2178019 - protein, 22 aa, Cryptosporidium hominis
NFKILDFNGSQFLDNFGGNLWM

SEQ ID NO: 2178020 - protein, 22 aa, Cryptosporidium hominis
NFKKRCKFERLLSGSDDNTMFL

SEQ ID NO: 2178021 - protein, 20 aa, Cryptosporidium hominis
NFKSKGWFDPIGVKLSVFSQ

SEQ ID NO: 2178022 - protein, 24 aa, Cryptosporidium hominis
NFKSQKWQVMLSFNTERRLLLTGT

SEQ ID NO: 2178023 - protein, 19 aa, Cryptosporidium hominis
NFMSWIGPVVFVEEGPSLQ

SEQ ID NO: 2178024 - protein, 19 aa, Cryptosporidium hominis
NFNALKYCNRIINLSYKCR

SEQ ID NO: 2178025 - protein, 24 aa, Cryptosporidium hominis
NFNELFIKFSLNILTEVYKKYYYK

SEQ ID NO: 2178026 - protein, 25 aa, Cryptosporidium hominis
NFNNLRFLRKLIADFIGFQKFNVEI

SEQ ID NO: 2178027 - protein, 18 aa, Cryptosporidium hominis
NFNPKFESNIAFSEHDLR

SEQ ID NO: 2178028 - protein, 21 aa, Cryptosporidium hominis
NFNPLRYAVFVGEVLSRSPIS

SEQ ID NO: 2178029 - protein, 17 aa, Cryptosporidium hominis
NFPLPFKLPPKRYSNSD

SEQ ID NO: 2178030 - protein, 29 aa, Cryptosporidium hominis
NFQVSSDESLFCFIWKNILLIWNTQYPDK

SEQ ID NO: 2178031 - protein, 18 aa, Cryptosporidium hominis
NFRFSVISYSEFLKETLK

SEQ ID NO: 2178032 - protein, 24 aa, Cryptosporidium hominis
NFRTPHGFSQFFFFSSSKVTCELL

SEQ ID NO: 2178033 - protein, 24 aa, Cryptosporidium hominis
NFSQCGLPLPIHHYLKKKNIIKPF

SEQ ID NO: 2178034 - protein, 17 aa, Cryptosporidium hominis
NFTERKGQFSINMLDDE

SEQ ID NO: 2178035 - protein, 18 aa, Cryptosporidium hominis
NFTFGSIGIHLFKLQFIQ

SEQ ID NO: 2178036 - protein, 18 aa, Cryptosporidium hominis
NFVLSMPRFLAAATGLDA

SEQ ID NO: 2178037 - protein, 25 aa, Cryptosporidium hominis
NFYIVDFICEIPVNIKTLFMKIVKE

SEQ ID NO: 2178038 - protein, 23 aa, Cryptosporidium hominis
NGADLMAGGIIFELTSDLKNIRK

SEQ ID NO: 2178039 - protein, 25 aa, Cryptosporidium hominis
NGEFEYMNILKLFGAINRLERDSNI

SEQ ID NO: 2178040 - protein, 22 aa, Cryptosporidium hominis
NGEFVLGYSILPLVSAYYTERL

SEQ ID NO: 2178041 - protein, 27 aa, Cryptosporidium hominis
NGEPTCPLCRVPCSVFTLCDLVNITID

SEQ ID NO: 2178042 - protein, 31 aa, Cryptosporidium hominis
NGESNFLSFVFKLPFYLKMDINLTPVTIVLN

SEQ ID NO: 2178043 - protein, 17 aa, Cryptosporidium hominis
NGFEYACSIALKKLEEI

SEQ ID NO: 2178044 - protein, 25 aa, Cryptosporidium hominis
NGGEITGIIQWVCNLTIEIGFLILD

SEQ ID NO: 2178045 - protein, 21 aa, Cryptosporidium hominis
NGGELDFPYAGIKIKPKKGLA

SEQ ID NO: 2178046 - protein, 24 aa, Cryptosporidium hominis
NGGGSRIGLGLGVGLGSGGIGTGT

SEQ ID NO: 2178047 - protein, 17 aa, Cryptosporidium hominis
NGGRIGNGMAMTMIPNN

SEQ ID NO: 2178048 - protein, 20 aa, Cryptosporidium hominis
NGHRARIGAMDWCGPILATG

SEQ ID NO: 2178049 - protein, 20 aa, Cryptosporidium hominis
NGHVWKMAFSPPSYSINKIF

SEQ ID NO: 2178050 - protein, 24 aa, Cryptosporidium hominis
NGIEFKLAISAILLDFEDEVGSLD

SEQ ID NO: 2178051 - protein, 17 aa, Cryptosporidium hominis
NGIEHTNHLIIFNNEEL

SEQ ID NO: 2178052 - protein, 23 aa, Cryptosporidium hominis
NGIGNNGYHGWSHNQYGQGQNAN

SEQ ID NO: 2178053 - protein, 24 aa, Cryptosporidium hominis
NGIKSEFDPSIFIGYNSARDRVIR

SEQ ID NO: 2178054 - protein, 20 aa, Cryptosporidium hominis
NGIPKRSGFLESIDPSRFSL

SEQ ID NO: 2178055 - protein, 31 aa, Cryptosporidium hominis
NGKLHYKYFGPRSWTVMGLKEALRKAFKART

SEQ ID NO: 2178056 - protein, 21 aa, Cryptosporidium hominis
NGKQHGIGIFYNIKKEGKVGE

SEQ ID NO: 2178057 - protein, 18 aa, Cryptosporidium hominis
NGKWHWYTWCKRPDFNLI

SEQ ID NO: 2178058 - protein, 23 aa, Cryptosporidium hominis
NGLKKCVLALIYIFKSGSQTCSY

SEQ ID NO: 2178059 - protein, 22 aa, Cryptosporidium hominis
NGLRFPPDFPEDAKLLVESLLK

SEQ ID NO: 2178060 - protein, 17 aa, Cryptosporidium hominis
NGMECLISSEGKDGNSI

SEQ ID NO: 2178061 - protein, 17 aa, Cryptosporidium hominis
NGMVPGIIGSGINGGCL

SEQ ID NO: 2178062 - protein, 24 aa, Cryptosporidium hominis
NGNELLERFSIGYFTLSLSCLKWL

SEQ ID NO: 2178063 - protein, 19 aa, Cryptosporidium hominis
NGNIGFRVNYKGNQQVVSL

SEQ ID NO: 2178064 - protein, 26 aa, Cryptosporidium hominis
NGNKQRWKWVALLPFIDQKVLLETVI

SEQ ID NO: 2178065 - protein, 24 aa, Cryptosporidium hominis
NGNKRLSWQQILALGKSTEKIVGL

SEQ ID NO: 2178066 - protein, 21 aa, Cryptosporidium hominis
NGNRAWLIREFIGDELTDQVF

SEQ ID NO: 2178067 - protein, 20 aa, Cryptosporidium hominis
NGNVPWIISTLLEQKIWMHD

SEQ ID NO: 2178068 - protein, 20 aa, Cryptosporidium hominis
NGQHLNRRYGLFTLVKFNIS

SEQ ID NO: 2178069 - protein, 18 aa, Cryptosporidium hominis
NGQLPWSISEDLKFFSKI

SEQ ID NO: 2178070 - protein, 17 aa, Cryptosporidium hominis
NGRDLLRHYEFYHQCLQ

SEQ ID NO: 2178071 - protein, 33 aa, Cryptosporidium hominis
NGRWSVRKFSCKRWGKGKAYSHAMNFLASLTSC

SEQ ID NO: 2178072 - protein, 22 aa, Cryptosporidium hominis
NGSLMSTCLDKLMSGYLDVLYY

SEQ ID NO: 2178073 - protein, 24 aa, Cryptosporidium hominis
NGSPEYRLIKIILEKSDHKIKQDE

SEQ ID NO: 2178074 - protein, 32 aa, Cryptosporidium hominis
NGSSKTCYRLCWPASKYVKLFSSAKIKFEVIS

SEQ ID NO: 2178075 - protein, 27 aa, Cryptosporidium hominis
NGTIDFPEFLSLMARKMKDTDTEDELI

SEQ ID NO: 2178076 - protein, 24 aa, Cryptosporidium hominis
NGTLCAIQRTMCCIVENYQTPDGL

SEQ ID NO: 2178077 - protein, 25 aa, Cryptosporidium hominis
NGTNNGYSWRKNKPITDNNVNQESK

SEQ ID NO: 2178078 - protein, 19 aa, Cryptosporidium hominis
NGYQLFDYQLAGLNWLLQL

SEQ ID NO: 2178079 - protein, 21 aa, Cryptosporidium hominis
NHEVTGCTFCEIKKARISLIE

SEQ ID NO: 2178080 - protein, 21 aa, Cryptosporidium hominis
NHEYANMPWFVLFKSNPQLLE

SEQ ID NO: 2178081 - protein, 17 aa, Cryptosporidium hominis
NHFKLCTRLATLGNASF

SEQ ID NO: 2178082 - protein, 22 aa, Cryptosporidium hominis
NHFRPARSSDILSFNEIPIDTV

SEQ ID NO: 2178083 - protein, 18 aa, Cryptosporidium hominis
NHGKILSTLCFDLDETNG

SEQ ID NO: 2178084 - protein, 32 aa, Cryptosporidium hominis
NHKIAMIKRLWIKLCEILIKYGVNLTISDSNS

SEQ ID NO: 2178085 - protein, 19 aa, Cryptosporidium hominis
NHKSLFSSYGGGLGGGDSG

SEQ ID NO: 2178086 - protein, 20 aa, Cryptosporidium hominis
NHLHPRFSKLNTRNTGKQSK

SEQ ID NO: 2178087 - protein, 25 aa, Cryptosporidium hominis
NHLKNNRSLVRFNLDNDVEKSHRIP

SEQ ID NO: 2178088 - protein, 24 aa, Cryptosporidium hominis
NHLPDLKHPFSLLYSYKRLNELNI

SEQ ID NO: 2178089 - protein, 23 aa, Cryptosporidium hominis
NHLPLLPPSRFPFQSEARRTINR

SEQ ID NO: 2178090 - protein, 19 aa, Cryptosporidium hominis
NHMRLGAWQSSINQIETNI

SEQ ID NO: 2178091 - protein, 25 aa, Cryptosporidium hominis
NHPPHLSIVILLKFITTVIPSIELD

SEQ ID NO: 2178092 - protein, 20 aa, Cryptosporidium hominis
NHPTTRFSLYNKIENKLYKY

SEQ ID NO: 2178093 - protein, 23 aa, Cryptosporidium hominis
NHRIHSGGNFFGGYIHANRIKVP

SEQ ID NO: 2178094 - protein, 24 aa, Cryptosporidium hominis
NHSFLSLYLLFLIYNKIHVSNQLI

SEQ ID NO: 2178095 - protein, 25 aa, Cryptosporidium hominis
NHSKKRWKWVHFDDSEVQEWTPKFS

SEQ ID NO: 2178096 - protein, 24 aa, Cryptosporidium hominis
NHSKYTLSDSIGFKEEIPHNNSSK

SEQ ID NO: 2178097 - protein, 22 aa, Cryptosporidium hominis
NHSLPNFIAKIILPLFTSKNEK

SEQ ID NO: 2178098 - protein, 17 aa, Cryptosporidium hominis
NHVPNANQIRFISNDES

SEQ ID NO: 2178099 - protein, 18 aa, Cryptosporidium hominis
NHYECVFNNNFNFRINVQ

SEQ ID NO: 2178100 - protein, 38 aa, Cryptosporidium hominis
NHYKEIVHLSLPFEMANEAFFRDYILRHLNNYFDLSNR

SEQ ID NO: 2178101 - protein, 28 aa, Cryptosporidium hominis
NIAANIHKLLNCSPHMIQITDFPPTIIE

SEQ ID NO: 2178102 - protein, 21 aa, Cryptosporidium hominis
NIADSCSFFTEKARNSEINNN

SEQ ID NO: 2178103 - protein, 23 aa, Cryptosporidium hominis
NIAFVRYFLRSSAEFAKAAMENQ

SEQ ID NO: 2178104 - protein, 21 aa, Cryptosporidium hominis
NIALSKSFRGRKLNGRIIHLS

SEQ ID NO: 2178105 - protein, 21 aa, Cryptosporidium hominis
NIAQGRLNYLLSDNGEPTCPL

SEQ ID NO: 2178106 - protein, 21 aa, Cryptosporidium hominis
NIDLICQYDDLLVPIEKEEKT

SEQ ID NO: 2178107 - protein, 24 aa, Cryptosporidium hominis
NIDQYICNFGQWTISPELFNELLI

SEQ ID NO: 2178108 - protein, 26 aa, Cryptosporidium hominis
NIEAAWKLTESLIRKGFERLFPPLLY

SEQ ID NO: 2178109 - protein, 20 aa, Cryptosporidium hominis
NIEALGPFVPLLVKILNTIS

SEQ ID NO: 2178110 - protein, 21 aa, Cryptosporidium hominis
NIEFKECIEFSSVFAEANSDS

SEQ ID NO: 2178111 - protein, 29 aa, Cryptosporidium hominis
NIELIGEVIIEIMLYFGKYYQNDEEIKEE

SEQ ID NO: 2178112 - protein, 23 aa, Cryptosporidium hominis
NIEMLKLEFYRISSRLSDSLKEK

SEQ ID NO: 2178113 - protein, 19 aa, Cryptosporidium hominis
NIENRVGIQPNIMNETINE

SEQ ID NO: 2178114 - protein, 23 aa, Cryptosporidium hominis
NIEPKLDSILGLEKIEENDESKQ

SEQ ID NO: 2178115 - protein, 20 aa, Cryptosporidium hominis
NIFFYCTHLEIPLMQNNNVK

SEQ ID NO: 2178116 - protein, 24 aa, Cryptosporidium hominis
NIFKKLSAAFFRFILLKFASSNEE

SEQ ID NO: 2178117 - protein, 33 aa, Cryptosporidium hominis
NIFLKNRRKAILPKVEWILCFPVNQCSINTGSN

SEQ ID NO: 2178118 - protein, 17 aa, Cryptosporidium hominis
NIFQLGVGFGRLKQIFG

SEQ ID NO: 2178119 - protein, 23 aa, Cryptosporidium hominis
NIFSCDLWKTSGHYFAYKENMFI

SEQ ID NO: 2178120 - protein, 21 aa, Cryptosporidium hominis
NIFYPGEYRAFGLAYIAFGDV

SEQ ID NO: 2178121 - protein, 20 aa, Cryptosporidium hominis
NIGKFHCLVTEFCKRQRVSK

SEQ ID NO: 2178122 - protein, 24 aa, Cryptosporidium hominis
NIGLCAEHGYYLKLPKSIDPIHPN

SEQ ID NO: 2178123 - protein, 20 aa, Cryptosporidium hominis
NIGMECFKFIMNDSRFNDIP

SEQ ID NO: 2178124 - protein, 24 aa, Cryptosporidium hominis
NIGNSLIAKEVWKDEPLSHITKLT

SEQ ID NO: 2178125 - protein, 23 aa, Cryptosporidium hominis
NIHFLSNPCELYINDIKISITSS

SEQ ID NO: 2178126 - protein, 25 aa, Cryptosporidium hominis
NIHIKSEKGFPFLNFQYNNIEETVI

SEQ ID NO: 2178127 - protein, 25 aa, Cryptosporidium hominis
NIHKEILQGLSVIFGMIPDFNIFKV

SEQ ID NO: 2178128 - protein, 34 aa, Cryptosporidium hominis
NIHLIMLSPYFKPPQFLLGKGMFEIYLSIEWEAS

SEQ ID NO: 2178129 - protein, 26 aa, Cryptosporidium hominis
NIHSIKPCFYLFITDWIQTILTPILA

SEQ ID NO: 2178130 - protein, 17 aa, Cryptosporidium hominis
NIIFNRLPELILEQMER

SEQ ID NO: 2178131 - protein, 18 aa, Cryptosporidium hominis
NIIHCMVRIILSLNGIDL

SEQ ID NO: 2178132 - protein, 17 aa, Cryptosporidium hominis
NIILKFKRLTESKLKVF

SEQ ID NO: 2178133 - protein, 25 aa, Cryptosporidium hominis
NIINEGGALWKEWLYVGMYEEALIS

SEQ ID NO: 2178134 - protein, 17 aa, Cryptosporidium hominis
NIIPIDLSIPYAGIPIS

SEQ ID NO: 2178135 - protein, 29 aa, Cryptosporidium hominis
NIIRPRFTWYCSHCNFSIDNEILEEKLLL

SEQ ID NO: 2178136 - protein, 28 aa, Cryptosporidium hominis
NIIYRRRFKDCFNIWRGLSLRLRNQKKK

SEQ ID NO: 2178137 - protein, 24 aa, Cryptosporidium hominis
NIKGKGRTSGSIYRLDKTESEKDT

SEQ ID NO: 2178138 - protein, 23 aa, Cryptosporidium hominis
NIKHKINESIGWWIISVNEYGYL

SEQ ID NO: 2178139 - protein, 17 aa, Cryptosporidium hominis
NIKNTPVSKSRRVIDED

SEQ ID NO: 2178140 - protein, 23 aa, Cryptosporidium hominis
NIKRDSIYLLGWVVEAIQALILI

SEQ ID NO: 2178141 - protein, 19 aa, Cryptosporidium hominis
NIKRRCLFLAESATTSFFR

SEQ ID NO: 2178142 - protein, 22 aa, Cryptosporidium hominis
NIKTVLLFLIDFVKRLYNQHIG

SEQ ID NO: 2178143 - protein, 17 aa, Cryptosporidium hominis
NILEWIASVHLSVSNRD

SEQ ID NO: 2178144 - protein, 29 aa, Cryptosporidium hominis
NILHSLRLWLGEDLEIWIFDFHRPAIDEL

SEQ ID NO: 2178145 - protein, 18 aa, Cryptosporidium hominis
NILIPKVRLKKLIENGSL

SEQ ID NO: 2178146 - protein, 18 aa, Cryptosporidium hominis
NILLKVVLEIGEINEASR

SEQ ID NO: 2178147 - protein, 23 aa, Cryptosporidium hominis
NIMGELGGGIGIGGVINGSNSLL

SEQ ID NO: 2178148 - protein, 17 aa, Cryptosporidium hominis
NINAIKRTLKYPYIKKI

SEQ ID NO: 2178149 - protein, 23 aa, Cryptosporidium hominis
NINFKVSELFLADNLNARLDASI

SEQ ID NO: 2178150 - protein, 22 aa, Cryptosporidium hominis
NINFSSAVGIDYIPSAIELAKK

SEQ ID NO: 2178151 - protein, 26 aa, Cryptosporidium hominis
NINGSWPFELLDCISMAICSDDNNKL

SEQ ID NO: 2178152 - protein, 20 aa, Cryptosporidium hominis
NINIKTNRLKVVVKGEVIID

SEQ ID NO: 2178153 - protein, 28 aa, Cryptosporidium hominis
NINSPKKCKLIFKRLINKVNIVRETSSK

SEQ ID NO: 2178154 - protein, 26 aa, Cryptosporidium hominis
NINSVKICNAVRCKKCGIWTEGNANL

SEQ ID NO: 2178155 - protein, 18 aa, Cryptosporidium hominis
NINYPVYSSFIFFNNINH

SEQ ID NO: 2178156 - protein, 22 aa, Cryptosporidium hominis
NIPDFGSLLLRRLINQFRISYS

SEQ ID NO: 2178157 - protein, 17 aa, Cryptosporidium hominis
NIPSFSGGVNLWKISNQ

SEQ ID NO: 2178158 - protein, 36 aa, Cryptosporidium hominis
NIQKNLQSSFGFVEGMGIPPSVSRTGTSKGMSTFTT

SEQ ID NO: 2178159 - protein, 20 aa, Cryptosporidium hominis
NIQRTVLMMGRYVEQIPDVP

SEQ ID NO: 2178160 - protein, 18 aa, Cryptosporidium hominis
NIREYCGILTNYEHQYFS

SEQ ID NO: 2178161 - protein, 20 aa, Cryptosporidium hominis
NIRILGELFLLNYTITNMNI

SEQ ID NO: 2178162 - protein, 18 aa, Cryptosporidium hominis
NIRIQLGKYFPLSKDSLL

SEQ ID NO: 2178163 - protein, 20 aa, Cryptosporidium hominis
NIRKTLWIYQIENISGTNLI

SEQ ID NO: 2178164 - protein, 22 aa, Cryptosporidium hominis
NISECGFCGSSINVYEIERSLN

SEQ ID NO: 2178165 - protein, 23 aa, Cryptosporidium hominis
NISELLAIGSIQFKCIFCKILVQ

SEQ ID NO: 2178166 - protein, 17 aa, Cryptosporidium hominis
NISEYKKSIGVMEGSYV

SEQ ID NO: 2178167 - protein, 26 aa, Cryptosporidium hominis
NISGKICCLNNYFLRDEEHKSNEVYQ

SEQ ID NO: 2178168 - protein, 17 aa, Cryptosporidium hominis
NISGYITSIEWIFHTKL

SEQ ID NO: 2178169 - protein, 31 aa, Cryptosporidium hominis
NISGYWCEVCNLGFNDSHSWIRHLNSQSHNQ

SEQ ID NO: 2178170 - protein, 26 aa, Cryptosporidium hominis
NISIRTDICGRIRIVGANSSEFKTWD

SEQ ID NO: 2178171 - protein, 24 aa, Cryptosporidium hominis
NISKEWKLVNTISLVISNNALIQE

SEQ ID NO: 2178172 - protein, 25 aa, Cryptosporidium hominis
NISKIRFSINFFTAIGLGALTHKLR

SEQ ID NO: 2178173 - protein, 20 aa, Cryptosporidium hominis
NISKPSDRVRIFVVFESPSM

SEQ ID NO: 2178174 - protein, 20 aa, Cryptosporidium hominis
NISNPLPFDLAKIVRHPHLG

SEQ ID NO: 2178175 - protein, 18 aa, Cryptosporidium hominis
NISQLLLFDDTKKKIRNQ

SEQ ID NO: 2178176 - protein, 22 aa, Cryptosporidium hominis
NISYFCSKGFCIRKIGKARARK

SEQ ID NO: 2178177 - protein, 20 aa, Cryptosporidium hominis
NITCNSWYSLTGFLENGISF

SEQ ID NO: 2178178 - protein, 19 aa, Cryptosporidium hominis
NITGILGFIQKTWKESDES

SEQ ID NO: 2178179 - protein, 20 aa, Cryptosporidium hominis
NITGNLLLNPSIRFQRQMVE

SEQ ID NO: 2178180 - protein, 18 aa, Cryptosporidium hominis
NITHVWIIEIFKNEGISL

SEQ ID NO: 2178181 - protein, 27 aa, Cryptosporidium hominis
NITPHWSRGGIITEEILAMICQLVGVD

SEQ ID NO: 2178182 - protein, 18 aa, Cryptosporidium hominis
NITSCLIKDAGRTQIAAG

SEQ ID NO: 2178183 - protein, 20 aa, Cryptosporidium hominis
NIVELYGVVFSRPHNDLNEH

SEQ ID NO: 2178184 - protein, 19 aa, Cryptosporidium hominis
NIVLIKLMSSFSISDLNNN

SEQ ID NO: 2178185 - protein, 24 aa, Cryptosporidium hominis
NIVVYFPKKCIEYIIEGLSNNINN

SEQ ID NO: 2178186 - protein, 25 aa, Cryptosporidium hominis
NIWISLLRKCIDTFIKFIPNTPNSL

SEQ ID NO: 2178187 - protein, 25 aa, Cryptosporidium hominis
NIWKIREIFDNDTLRKLDCALLGLT

SEQ ID NO: 2178188 - protein, 20 aa, Cryptosporidium hominis
NIYILKLRSLSILEEVINLA

SEQ ID NO: 2178189 - protein, 26 aa, Cryptosporidium hominis
NIYKRTCLLLRKILGFGGKNSTIITR

SEQ ID NO: 2178190 - protein, 17 aa, Cryptosporidium hominis
NIYNDFVSRICLSHLLR

SEQ ID NO: 2178191 - protein, 28 aa, Cryptosporidium hominis
NIYVDMMPKVLFCRGHLVEMILSCNISG

SEQ ID NO: 2178192 - protein, 25 aa, Cryptosporidium hominis
NIYYSRSLIPWRVPKSQSNIENSDH

SEQ ID NO: 2178193 - protein, 21 aa, Cryptosporidium hominis
NKARKILGIGLGRVPCTNLFD

SEQ ID NO: 2178194 - protein, 26 aa, Cryptosporidium hominis
NKAVDLLGLIPIYPVKNIKTFTNNLH

SEQ ID NO: 2178195 - protein, 17 aa, Cryptosporidium hominis
NKCKKREYKSRKDFQDD

SEQ ID NO: 2178196 - protein, 21 aa, Cryptosporidium hominis
NKDHIIRGLLIEADFYLLESL

SEQ ID NO: 2178197 - protein, 19 aa, Cryptosporidium hominis
NKDPFIWQESLCLVIKKLS

SEQ ID NO: 2178198 - protein, 23 aa, Cryptosporidium hominis
NKDWQLGYMVIEDFSIYIYDSGF

SEQ ID NO: 2178199 - protein, 20 aa, Cryptosporidium hominis
NKECIDKWCRLRQKEKEYNK

SEQ ID NO: 2178200 - protein, 24 aa, Cryptosporidium hominis
NKEEWKFWMVGLLVSHALAQREKL

SEQ ID NO: 2178201 - protein, 21 aa, Cryptosporidium hominis
NKELFRGIIVARRITNLPIRY

SEQ ID NO: 2178202 - protein, 27 aa, Cryptosporidium hominis
NKELMWKCLVCSQVFESRNKLFAHVKE

SEQ ID NO: 2178203 - protein, 18 aa, Cryptosporidium hominis
NKELSSLLPSVSLKLKHY

SEQ ID NO: 2178204 - protein, 18 aa, Cryptosporidium hominis
NKESCVISSVSSPNKPGK

SEQ ID NO: 2178205 - protein, 17 aa, Cryptosporidium hominis
NKESLKEIMEFVHNSEM

SEQ ID NO: 2178206 - protein, 24 aa, Cryptosporidium hominis
NKETMIRRCVNFFSNEKNVENYNI

SEQ ID NO: 2178207 - protein, 20 aa, Cryptosporidium hominis
NKEYGNCFLADIKGYNTHSN

SEQ ID NO: 2178208 - protein, 29 aa, Cryptosporidium hominis
NKEYMKSLELLWLSHIFELSLSKTGSQSF

SEQ ID NO: 2178209 - protein, 19 aa, Cryptosporidium hominis
NKFNDWYSYIINYSLKDDL

SEQ ID NO: 2178210 - protein, 17 aa, Cryptosporidium hominis
NKFPLKAIKDILRPING

SEQ ID NO: 2178211 - protein, 21 aa, Cryptosporidium hominis
NKFSVGFSVSINFNLRVTWKK

SEQ ID NO: 2178212 - protein, 19 aa, Cryptosporidium hominis
NKFVKLCIQHYLNTKSLTG

SEQ ID NO: 2178213 - protein, 31 aa, Cryptosporidium hominis
NKFVWIRSIPMGRFIICPESLEKCNPKCLIC

SEQ ID NO: 2178214 - protein, 18 aa, Cryptosporidium hominis
NKGFRLFLATELPKKILN

SEQ ID NO: 2178215 - protein, 21 aa, Cryptosporidium hominis
NKGTFVRRFGGIEGSVQQFPF

SEQ ID NO: 2178216 - protein, 23 aa, Cryptosporidium hominis
NKHPNWLISLLGPTFVYLTPNLF

SEQ ID NO: 2178217 - protein, 21 aa, Cryptosporidium hominis
NKIELYWKFNQDRLKDTLKKL

SEQ ID NO: 2178218 - protein, 21 aa, Cryptosporidium hominis
NKIFTKRVIVFFQTKKEAHRC

SEQ ID NO: 2178219 - protein, 20 aa, Cryptosporidium hominis
NKIIVCALIMELIEVLSKKL

SEQ ID NO: 2178220 - protein, 17 aa, Cryptosporidium hominis
NKIKNGMNPVCFSFTDQ

SEQ ID NO: 2178221 - protein, 31 aa, Cryptosporidium hominis
NKIKRPEGVSKKLGSFIAERTDLFKVENNMI

SEQ ID NO: 2178222 - protein, 20 aa, Cryptosporidium hominis
NKIKSIAIWGMNSREKNIKG

SEQ ID NO: 2178223 - protein, 25 aa, Cryptosporidium hominis
NKILELKGLRFAFFKDDLDILDTCI

SEQ ID NO: 2178224 - protein, 24 aa, Cryptosporidium hominis
NKILIICLELIYGIEKSFIVSNEI

SEQ ID NO: 2178225 - protein, 19 aa, Cryptosporidium hominis
NKILSEFTCPVCLDYYMLP

SEQ ID NO: 2178226 - protein, 17 aa, Cryptosporidium hominis
NKIPFLFEYISDNLETE

SEQ ID NO: 2178227 - protein, 17 aa, Cryptosporidium hominis
NKIPRRYSLSNSEKTTL

SEQ ID NO: 2178228 - protein, 17 aa, Cryptosporidium hominis
NKISIQHDWEYPRKILI

SEQ ID NO: 2178229 - protein, 25 aa, Cryptosporidium hominis
NKIWLPENFCNLAAMDTLFKVLNPR

SEQ ID NO: 2178230 - protein, 24 aa, Cryptosporidium hominis
NKKDVRLVIHLSMPKSLENYYQES

SEQ ID NO: 2178231 - protein, 26 aa, Cryptosporidium hominis
NKKENFVACLYTCYEFLRPDTVMEMA

SEQ ID NO: 2178232 - protein, 22 aa, Cryptosporidium hominis
NKKINIEICYDRELPISEFTYK

SEQ ID NO: 2178233 - protein, 32 aa, Cryptosporidium hominis
NKKKFDCKVCENFTLCKSCCRNTNHEHPLEKS

SEQ ID NO: 2178234 - protein, 20 aa, Cryptosporidium hominis
NKKPALLQRIVASKVNPKIF

SEQ ID NO: 2178235 - protein, 22 aa, Cryptosporidium hominis
NKKPRIDDQIGMGLSNETTSNC

SEQ ID NO: 2178236 - protein, 25 aa, Cryptosporidium hominis
NKKSLKRKLPSKSDESTEEEIDDEE

SEQ ID NO: 2178237 - protein, 27 aa, Cryptosporidium hominis
NKKSRSNLMSRLFAKFHKKQPSSSETS

SEQ ID NO: 2178238 - protein, 20 aa, Cryptosporidium hominis
NKKTGKRIRRVFGSIYNLFI

SEQ ID NO: 2178239 - protein, 20 aa, Cryptosporidium hominis
NKKYARVMCLDWETININIA

SEQ ID NO: 2178240 - protein, 17 aa, Cryptosporidium hominis
NKKYKRLMDGLCIFMEA

SEQ ID NO: 2178241 - protein, 22 aa, Cryptosporidium hominis
NKLEAIELLNWIDNNGQWETKL

SEQ ID NO: 2178242 - protein, 19 aa, Cryptosporidium hominis
NKLECNSQVLTGICSTLSP

SEQ ID NO: 2178243 - protein, 25 aa, Cryptosporidium hominis
NKLESISFLKYCWNLTDINLSNNNL

SEQ ID NO: 2178244 - protein, 23 aa, Cryptosporidium hominis
NKLFNISYLLEFTKSSLNQTNIK

SEQ ID NO: 2178245 - protein, 17 aa, Cryptosporidium hominis
NKLKKYLGEYFIKKQEE

SEQ ID NO: 2178246 - protein, 20 aa, Cryptosporidium hominis
NKLKLIFDRVSGIISELETI

SEQ ID NO: 2178247 - protein, 22 aa, Cryptosporidium hominis
NKLKQMNFLVGKVFKSLQDSST

SEQ ID NO: 2178248 - protein, 20 aa, Cryptosporidium hominis
NKLKSGVHMVVGTPGRVFDM

SEQ ID NO: 2178249 - protein, 21 aa, Cryptosporidium hominis
NKLLFQYFTTVFKFHTLNQFE

SEQ ID NO: 2178250 - protein, 21 aa, Cryptosporidium hominis
NKLLVGNKCDLVSKRVVTSDE

SEQ ID NO: 2178251 - protein, 28 aa, Cryptosporidium hominis
NKMKGNMIFMASLVRKKVIASTVVLMCM

SEQ ID NO: 2178252 - protein, 23 aa, Cryptosporidium hominis
NKMKMWPSFDHIFKAARRDNKWY

SEQ ID NO: 2178253 - protein, 17 aa, Cryptosporidium hominis
NKNFGRWYLSNNTKTRS

SEQ ID NO: 2178254 - protein, 24 aa, Cryptosporidium hominis
NKNIIWKGISSINHILCSDNSQSC

SEQ ID NO: 2178255 - protein, 30 aa, Cryptosporidium hominis
NKNNSILCVLPRTPIDRLCLSPIPNVKSDI

SEQ ID NO: 2178256 - protein, 17 aa, Cryptosporidium hominis
NKNRFARKELTSTKLIW

SEQ ID NO: 2178257 - protein, 23 aa, Cryptosporidium hominis
NKPDSQWKQFYSARMRTNAFNSR

SEQ ID NO: 2178258 - protein, 19 aa, Cryptosporidium hominis
NKPLESLNGIWKRDESYPK

SEQ ID NO: 2178259 - protein, 27 aa, Cryptosporidium hominis
NKPLLRIVSRGKLYTLADFVNTHENEE

SEQ ID NO: 2178260 - protein, 25 aa, Cryptosporidium hominis
NKPRDEIFTSLKLIERDFKLIQELF

SEQ ID NO: 2178261 - protein, 17 aa, Cryptosporidium hominis
NKPREILSPKISIRGAN

SEQ ID NO: 2178262 - protein, 22 aa, Cryptosporidium hominis
NKPRYVMGVGYPIDILVCVALG

SEQ ID NO: 2178263 - protein, 30 aa, Cryptosporidium hominis
NKPYKRIPLKNIWFIFKRIYSMKPNSVEII

SEQ ID NO: 2178264 - protein, 25 aa, Cryptosporidium hominis
NKQAKEFNIEFGLEKNTGIKQSNNS

SEQ ID NO: 2178265 - protein, 21 aa, Cryptosporidium hominis
NKQFSINSSRSFNYLNELPHI

SEQ ID NO: 2178266 - protein, 17 aa, Cryptosporidium hominis
NKQKPSLGLIWSNSINW

SEQ ID NO: 2178267 - protein, 19 aa, Cryptosporidium hominis
NKQLKKRVANLNELNSNYQ

SEQ ID NO: 2178268 - protein, 23 aa, Cryptosporidium hominis
NKRKMCLEFSKELLDLDGTDFLK

SEQ ID NO: 2178269 - protein, 17 aa, Cryptosporidium hominis
NKRLFSNKIKIFGNKPT

SEQ ID NO: 2178270 - protein, 24 aa, Cryptosporidium hominis
NKRSPSYFNTGFIPNQLVLNASLL

SEQ ID NO: 2178271 - protein, 32 aa, Cryptosporidium hominis
NKRVNGSRVISCYLEDEFGRLGFFGTSSGQLL

SEQ ID NO: 2178272 - protein, 24 aa, Cryptosporidium hominis
NKSEFLKWRESFLSTVPTKYRMKY

SEQ ID NO: 2178273 - protein, 19 aa, Cryptosporidium hominis
NKSGFSRMFHGGLYSDKQQ

SEQ ID NO: 2178274 - protein, 23 aa, Cryptosporidium hominis
NKSIKSDSKMEFLINNDMFSSAG

SEQ ID NO: 2178275 - protein, 19 aa, Cryptosporidium hominis
NKSRLTIMKTMPAPVTDIK

SEQ ID NO: 2178276 - protein, 21 aa, Cryptosporidium hominis
NKSRPVFDIIGAKDYEYNITL

SEQ ID NO: 2178277 - protein, 21 aa, Cryptosporidium hominis
NKSTDSFDCMSSLNNENKLKG

SEQ ID NO: 2178278 - protein, 17 aa, Cryptosporidium hominis
NKTALLCPLCMTPQCFG

SEQ ID NO: 2178279 - protein, 26 aa, Cryptosporidium hominis
NKTDKSKCILFLDYLILRTKKLSYIV

SEQ ID NO: 2178280 - protein, 22 aa, Cryptosporidium hominis
NKTGLVLWSYRSEDAGPEEILE

SEQ ID NO: 2178281 - protein, 22 aa, Cryptosporidium hominis
NKTKFNICNNLTFIDISKEFKY

SEQ ID NO: 2178282 - protein, 27 aa, Cryptosporidium hominis
NKTRYRLSISLYKLFGCGDVFSDESSK

SEQ ID NO: 2178283 - protein, 18 aa, Cryptosporidium hominis
NKVFPKVWIFSSNDVDSL

SEQ ID NO: 2178284 - protein, 23 aa, Cryptosporidium hominis
NKVKEGRNLICIEGNSEEEKVIS

SEQ ID NO: 2178285 - protein, 23 aa, Cryptosporidium hominis
NKVKPRIPHSLIEFYENYNKKNN

SEQ ID NO: 2178286 - protein, 19 aa, Cryptosporidium hominis
NKVMVEFEAVIGLKYLKAM

SEQ ID NO: 2178287 - protein, 17 aa, Cryptosporidium hominis
NKVPDWCNRDIPSKFGK

SEQ ID NO: 2178288 - protein, 24 aa, Cryptosporidium hominis
NKWIPFYKCLTKSFWQNVAKLDPS

SEQ ID NO: 2178289 - protein, 18 aa, Cryptosporidium hominis
NKYFCFTPLLTQIVSNRL

SEQ ID NO: 2178290 - protein, 17 aa, Cryptosporidium hominis
NLARIEAIINESNMINA

SEQ ID NO: 2178291 - protein, 18 aa, Cryptosporidium hominis
NLCCNGRIVSVLEGGYNT

SEQ ID NO: 2178292 - protein, 26 aa, Cryptosporidium hominis
NLCHRRFTMKTILMIADQMLQRVEYI

SEQ ID NO: 2178293 - protein, 21 aa, Cryptosporidium hominis
NLCYDIKWNYFGNILATTNKD

SEQ ID NO: 2178294 - protein, 18 aa, Cryptosporidium hominis
NLDDFSIGNTDLRLNQVN

SEQ ID NO: 2178295 - protein, 18 aa, Cryptosporidium hominis
NLDIKRKASIDSYLQYYS

SEQ ID NO: 2178296 - protein, 24 aa, Cryptosporidium hominis
NLDNLWQLCIFKNQSIGLILSNHK

SEQ ID NO: 2178297 - protein, 22 aa, Cryptosporidium hominis
NLDSVYCFYNFNKSSKMIKLQG

SEQ ID NO: 2178298 - protein, 18 aa, Cryptosporidium hominis
NLEEEFRKLTLIRQETIM

SEQ ID NO: 2178299 - protein, 27 aa, Cryptosporidium hominis
NLEEFYYKNIESIPRCYDELIDMSESS

SEQ ID NO: 2178300 - protein, 24 aa, Cryptosporidium hominis
NLEEPFSCGVIFHAMPPSKRFRDI

SEQ ID NO: 2178301 - protein, 23 aa, Cryptosporidium hominis
NLEHILISLSICLLKRKFQSKTK

SEQ ID NO: 2178302 - protein, 20 aa, Cryptosporidium hominis
NLEHLCLRNNIILNNTTIDL

SEQ ID NO: 2178303 - protein, 18 aa, Cryptosporidium hominis
NLEIGSKIWIGTVEASYL

SEQ ID NO: 2178304 - protein, 27 aa, Cryptosporidium hominis
NLEKLKIDRFEPFSSLIKQLATQPCIR

SEQ ID NO: 2178305 - protein, 26 aa, Cryptosporidium hominis
NLELIYRAESPFGLEIPNSSDDNIQD

SEQ ID NO: 2178306 - protein, 18 aa, Cryptosporidium hominis
NLEMKLLNAVDPFKQKFH

SEQ ID NO: 2178307 - protein, 25 aa, Cryptosporidium hominis
NLENFPRILAIFIDIYGTSMSNDSL

SEQ ID NO: 2178308 - protein, 22 aa, Cryptosporidium hominis
NLFDTFFWKLLIYSYFKLNSTL

SEQ ID NO: 2178309 - protein, 24 aa, Cryptosporidium hominis
NLFEGSKYLLAWADKLTEIKTICR

SEQ ID NO: 2178310 - protein, 24 aa, Cryptosporidium hominis
NLFLPELINMMGPLLSGTLFPYNN

SEQ ID NO: 2178311 - protein, 18 aa, Cryptosporidium hominis
NLFNRTLFESEYVYTRNL

SEQ ID NO: 2178312 - protein, 19 aa, Cryptosporidium hominis
NLGGYYYIYQRTEFIDDSE

SEQ ID NO: 2178313 - protein, 21 aa, Cryptosporidium hominis
NLHGRKVFGLFDIKLVKNNKN

SEQ ID NO: 2178314 - protein, 17 aa, Cryptosporidium hominis
NLHGTLFVLGRANGGKS

SEQ ID NO: 2178315 - protein, 22 aa, Cryptosporidium hominis
NLHIYPRITGNLSEQRKFEIKE

SEQ ID NO: 2178316 - protein, 23 aa, Cryptosporidium hominis
NLHLKTLRTFKSFILENEEDFFS

SEQ ID NO: 2178317 - protein, 22 aa, Cryptosporidium hominis
NLHPYILIIICMLRERYQKAVK

SEQ ID NO: 2178318 - protein, 25 aa, Cryptosporidium hominis
NLIENWKHIFSIDFPYMQTLGGGLG

SEQ ID NO: 2178319 - protein, 17 aa, Cryptosporidium hominis
NLIKLSWNSSPINYYGK

SEQ ID NO: 2178320 - protein, 20 aa, Cryptosporidium hominis
NLINNFTFKFIPRLLSKPYS

SEQ ID NO: 2178321 - protein, 23 aa, Cryptosporidium hominis
NLIPELVKKVSYIVEDTYRRQIF

SEQ ID NO: 2178322 - protein, 25 aa, Cryptosporidium hominis
NLIPFNVKLEYWKRVLSDGCQEIVD

SEQ ID NO: 2178323 - protein, 44 aa, Cryptosporidium hominis
NLIRHLEYVVGSLFYRREMKQVKEEICIPPTFYGNTYLSLSSVE

SEQ ID NO: 2178324 - protein, 26 aa, Cryptosporidium hominis
NLIRIWRPALVVHCRERRRAKLKGSS

SEQ ID NO: 2178325 - protein, 20 aa, Cryptosporidium hominis
NLIRRCRKGKLCTFAHSKEE

SEQ ID NO: 2178326 - protein, 18 aa, Cryptosporidium hominis
NLISLKFVSSHNVESLKD

SEQ ID NO: 2178327 - protein, 17 aa, Cryptosporidium hominis
NLISLLLTREVFSMVLK

SEQ ID NO: 2178328 - protein, 28 aa, Cryptosporidium hominis
NLISTRIYRWYLFYKHIILPLRRQVEYR

SEQ ID NO: 2178329 - protein, 25 aa, Cryptosporidium hominis
NLIVKIGMPSIVFSLGLLISNIFGG

SEQ ID NO: 2178330 - protein, 21 aa, Cryptosporidium hominis
NLKAFSVKSAFIILNEDAIPF

SEQ ID NO: 2178331 - protein, 18 aa, Cryptosporidium hominis
NLKHSNKFLLIFNQSENL

SEQ ID NO: 2178332 - protein, 29 aa, Cryptosporidium hominis
NLKKHIGNFIKLRFSQSLKVEISVKIQDN

SEQ ID NO: 2178333 - protein, 31 aa, Cryptosporidium hominis
NLKLQLILKPSWYIRVVILFFSTREAFHGRP

SEQ ID NO: 2178334 - protein, 23 aa, Cryptosporidium hominis
NLKNSGFLRLDFFGNDKDEEDFV

SEQ ID NO: 2178335 - protein, 26 aa, Cryptosporidium hominis
NLKQPCLELLTFILIDIIMDNEIHFN

SEQ ID NO: 2178336 - protein, 27 aa, Cryptosporidium hominis
NLKRMLKGEMMIPMTPWYKSFKGKIFP

SEQ ID NO: 2178337 - protein, 22 aa, Cryptosporidium hominis
NLKSSEWIFFFFKHLLSENPCI

SEQ ID NO: 2178338 - protein, 22 aa, Cryptosporidium hominis
NLKTKIKHYFSNNIQEEINVCK

SEQ ID NO: 2178339 - protein, 29 aa, Cryptosporidium hominis
NLKYRDIIDWKGCNPLILISSFFCNGKKL

SEQ ID NO: 2178340 - protein, 24 aa, Cryptosporidium hominis
NLLHFVEAFPDVWTVENVGPDEFT

SEQ ID NO: 2178341 - protein, 25 aa, Cryptosporidium hominis
NLLLPFETASSYVIYGTQKYNLETF

SEQ ID NO: 2178342 - protein, 17 aa, Cryptosporidium hominis
NLLLSQRLERVFESIQI

SEQ ID NO: 2178343 - protein, 18 aa, Cryptosporidium hominis
NLLMKSPLVKNALRRLNK

SEQ ID NO: 2178344 - protein, 20 aa, Cryptosporidium hominis
NLLNSLCRLYYIYKSCLRDE

SEQ ID NO: 2178345 - protein, 30 aa, Cryptosporidium hominis
NLLRIVWISPQLISIKWCKANKINNSRLES

SEQ ID NO: 2178346 - protein, 27 aa, Cryptosporidium hominis
NLLRRLHSVLRPFLLRRLKKDVEKEMP

SEQ ID NO: 2178347 - protein, 23 aa, Cryptosporidium hominis
NLLVCKLCKKSSTTVIGYKYLIK

SEQ ID NO: 2178348 - protein, 24 aa, Cryptosporidium hominis
NLLVYRYLIENGFVHTAFSFNSEA

SEQ ID NO: 2178349 - protein, 21 aa, Cryptosporidium hominis
NLNLYRLRNGVQLSTTATANF

SEQ ID NO: 2178350 - protein, 24 aa, Cryptosporidium hominis
NLNMDYCISNGYGPNMNTNNLPAS

SEQ ID NO: 2178351 - protein, 23 aa, Cryptosporidium hominis
NLNNFRFIFSLATFSVSAPYIQR

SEQ ID NO: 2178352 - protein, 21 aa, Cryptosporidium hominis
NLNSLKIVLNLNISEGGIEQS

SEQ ID NO: 2178353 - protein, 18 aa, Cryptosporidium hominis
NLPFSVNLKKILKEYSLK

SEQ ID NO: 2178354 - protein, 23 aa, Cryptosporidium hominis
NLPGNDPLCWIWIDLDGTINNMN

SEQ ID NO: 2178355 - protein, 20 aa, Cryptosporidium hominis
NLPIKEIKSSFLTQPKNDIV

SEQ ID NO: 2178356 - protein, 26 aa, Cryptosporidium hominis
NLPILACGVEEYLFILVLKLPSICFA

SEQ ID NO: 2178357 - protein, 24 aa, Cryptosporidium hominis
NLPKREVIQNFKLKAPDQSEDSNS

SEQ ID NO: 2178358 - protein, 23 aa, Cryptosporidium hominis
NLPQLTSAISIYGHHHSNHQPQH

SEQ ID NO: 2178359 - protein, 18 aa, Cryptosporidium hominis
NLPWKAKWHDLKDHMRQA

SEQ ID NO: 2178360 - protein, 20 aa, Cryptosporidium hominis
NLQKRLRVLPPKHPGKDETM

SEQ ID NO: 2178361 - protein, 18 aa, Cryptosporidium hominis
NLQLELAQNYKATKLEKI

SEQ ID NO: 2178362 - protein, 21 aa, Cryptosporidium hominis
NLQQDISICRNIFLFYQSNKY

SEQ ID NO: 2178363 - protein, 22 aa, Cryptosporidium hominis
NLQRQLWDPLPMSPGNPLMMTY

SEQ ID NO: 2178364 - protein, 22 aa, Cryptosporidium hominis
NLQSIRTWRGWKPLKKLKKFFK

SEQ ID NO: 2178365 - protein, 17 aa, Cryptosporidium hominis
NLRKERELSGSKTNTGE

SEQ ID NO: 2178366 - protein, 21 aa, Cryptosporidium hominis
NLRQRIVCFVGSPLEDDLTEK

SEQ ID NO: 2178367 - protein, 17 aa, Cryptosporidium hominis
NLSEFTSRFSFFSSCEI

SEQ ID NO: 2178368 - protein, 18 aa, Cryptosporidium hominis
NLSEPLWLAEKVKKTEER

SEQ ID NO: 2178369 - protein, 22 aa, Cryptosporidium hominis
NLSHLFSLLRLHNIMEYYPKSV

SEQ ID NO: 2178370 - protein, 26 aa, Cryptosporidium hominis
NLSIDIKPAYTLSMVFKHFNEMKKMG

SEQ ID NO: 2178371 - protein, 18 aa, Cryptosporidium hominis
NLSIKLLYNKGIKDDERE

SEQ ID NO: 2178372 - protein, 33 aa, Cryptosporidium hominis
NLSKAICMKFAIKLCIACGIASKESIDHLKRQA

SEQ ID NO: 2178373 - protein, 24 aa, Cryptosporidium hominis
NLSKKLPDIFLIITGKGPNKNLWL

SEQ ID NO: 2178374 - protein, 19 aa, Cryptosporidium hominis
NLSKSRRGSYSLTDDSDNE

SEQ ID NO: 2178375 - protein, 17 aa, Cryptosporidium hominis
NLSRIAMNLIEKAENNE

SEQ ID NO: 2178376 - protein, 20 aa, Cryptosporidium hominis
NLSYLLSRCSSYYGYYTNYM

SEQ ID NO: 2178377 - protein, 25 aa, Cryptosporidium hominis
NLTDDGKCSLEFVHEMYLSPSMSEI

SEQ ID NO: 2178378 - protein, 23 aa, Cryptosporidium hominis
NLTEIKTDWLLEVAPHYYHTDDF

SEQ ID NO: 2178379 - protein, 23 aa, Cryptosporidium hominis
NLTGGSLMGNVLMMSGNGTNGGG

SEQ ID NO: 2178380 - protein, 23 aa, Cryptosporidium hominis
NLTGNPINEFFILNKSFPENIHI

SEQ ID NO: 2178381 - protein, 21 aa, Cryptosporidium hominis
NLTHKFCQGVAPSLSQSLLLD

SEQ ID NO: 2178382 - protein, 27 aa, Cryptosporidium hominis
NLTSLKIGITIGIKIAHLINNYVEALI

SEQ ID NO: 2178383 - protein, 19 aa, Cryptosporidium hominis
NLVGILSMAGERIELRVTP

SEQ ID NO: 2178384 - protein, 25 aa, Cryptosporidium hominis
NLVKRPMWLQLMINKCKKREYKSRK

SEQ ID NO: 2178385 - protein, 23 aa, Cryptosporidium hominis
NLVRKELKQIWDFSDLDEDGKLS

SEQ ID NO: 2178386 - protein, 18 aa, Cryptosporidium hominis
NLVVSFLLSCDYADIISN

SEQ ID NO: 2178387 - protein, 23 aa, Cryptosporidium hominis
NLYNTCFWSLVSINKLNEREATE

SEQ ID NO: 2178388 - protein, 25 aa, Cryptosporidium hominis
NLYPKVNLGIPIGVVLSKSDIGQRF

SEQ ID NO: 2178389 - protein, 17 aa, Cryptosporidium hominis
NLYQPGINVSSFNTTAP

SEQ ID NO: 2178390 - protein, 19 aa, Cryptosporidium hominis
NMCLLRSAIFEGINELLHE

SEQ ID NO: 2178391 - protein, 22 aa, Cryptosporidium hominis
  misc_feature (17)..(17): Xaa can be any naturally occurring amino acid
NMDEFTRWNIALQFGGXINGVT

SEQ ID NO: 2178392 - protein, 23 aa, Cryptosporidium hominis
NMEEYSNIFSFLLEVKRCSLFLN

SEQ ID NO: 2178393 - protein, 23 aa, Cryptosporidium hominis
NMGESKASIGIEALAYYELSEED

SEQ ID NO: 2178394 - protein, 34 aa, Cryptosporidium hominis
NMHITCSWSSNPFLCRKCCKKSSVQPSITYDIEY

SEQ ID NO: 2178395 - protein, 24 aa, Cryptosporidium hominis
NMHLTNVCSVCFNWETDTLKPFVE

SEQ ID NO: 2178396 - protein, 20 aa, Cryptosporidium hominis
NMINPGIYGAHAHFQPFVEP

SEQ ID NO: 2178397 - protein, 24 aa, Cryptosporidium hominis
NMKHSCKRCIVEVEMWKRKLKTQE

SEQ ID NO: 2178398 - protein, 23 aa, Cryptosporidium hominis
NMKNCFEGGCTRCANPNRVEGKS

SEQ ID NO: 2178399 - protein, 22 aa, Cryptosporidium hominis
NMKRAKVLLAQAYILEGKVLYL

SEQ ID NO: 2178400 - protein, 26 aa, Cryptosporidium hominis
NMLLLLKLVDNILIRIILLTIENIID

SEQ ID NO: 2178401 - protein, 29 aa, Cryptosporidium hominis
NMLYSCSVMYRCKLPFILIFNKIDVTDHL

SEQ ID NO: 2178402 - protein, 32 aa, Cryptosporidium hominis
NMMVYRIFYSWKLKMIELRSLKNSIFSFWNSG

SEQ ID NO: 2178403 - protein, 19 aa, Cryptosporidium hominis
NMNLIKGIIDQASQTVEIS

SEQ ID NO: 2178404 - protein, 24 aa, Cryptosporidium hominis
NMPGNSRFECLISYFEERCKSNSI

SEQ ID NO: 2178405 - protein, 21 aa, Cryptosporidium hominis
NMQEVCIFDETLSKNLFEEEI

SEQ ID NO: 2178406 - protein, 25 aa, Cryptosporidium hominis
NMRLRACNLFLHKIEDLMYDIPIIS

SEQ ID NO: 2178407 - protein, 25 aa, Cryptosporidium hominis
NMTERFAYEVLLFWQNSAGSSDFKS

SEQ ID NO: 2178408 - protein, 27 aa, Cryptosporidium hominis
NMTRMDRLLNFLSFVQDLFKNYCSPEI

SEQ ID NO: 2178409 - protein, 21 aa, Cryptosporidium hominis
NNAKEAVLIFGEKDLKINFLS

SEQ ID NO: 2178410 - protein, 24 aa, Cryptosporidium hominis
NNANRYQPPFLRTTSSSAFERGSN

SEQ ID NO: 2178411 - protein, 23 aa, Cryptosporidium hominis
NNCLPLLRRFTCSPENCGDVRLW

SEQ ID NO: 2178412 - protein, 18 aa, Cryptosporidium hominis
NNCNCGRADLEKEIGIEA

SEQ ID NO: 2178413 - protein, 23 aa, Cryptosporidium hominis
NNDCYRANSLRVISKIADGTMIG

SEQ ID NO: 2178414 - protein, 23 aa, Cryptosporidium hominis
NNDGFGGGVNRIVGGGISEEMNV

SEQ ID NO: 2178415 - protein, 24 aa, Cryptosporidium hominis
NNDMIKLIMEYRGNFPKRLLNQGV

SEQ ID NO: 2178416 - protein, 20 aa, Cryptosporidium hominis
NNEDLKLISLFYTAETNVPL

SEQ ID NO: 2178417 - protein, 24 aa, Cryptosporidium hominis
NNEGIDNKGRWSVDSFGSIDYHRA

SEQ ID NO: 2178418 - protein, 22 aa, Cryptosporidium hominis
NNEGIELWELVLEKDQQYGFAN

SEQ ID NO: 2178419 - protein, 23 aa, Cryptosporidium hominis
NNELINFIINWNKYSKYIPMPQI

SEQ ID NO: 2178420 - protein, 17 aa, Cryptosporidium hominis
NNELPCYNVDYDNFAPQ

SEQ ID NO: 2178421 - protein, 24 aa, Cryptosporidium hominis
NNELRLTLNQLRHELNFNFISSSN

SEQ ID NO: 2178422 - protein, 21 aa, Cryptosporidium hominis
NNERFPTINIAYSYFNIANTC

SEQ ID NO: 2178423 - protein, 24 aa, Cryptosporidium hominis
NNEYLEILLGLSFLGNDVKLLSAF

SEQ ID NO: 2178424 - protein, 18 aa, Cryptosporidium hominis
NNFVYAIEDVENGGEMKY

SEQ ID NO: 2178425 - protein, 18 aa, Cryptosporidium hominis
NNGGMIFENCCQSRSYTD

SEQ ID NO: 2178426 - protein, 20 aa, Cryptosporidium hominis
NNGSINWSLLETKGFSLSSL

SEQ ID NO: 2178427 - protein, 23 aa, Cryptosporidium hominis
NNHILLMKWSRMHKTKRDRDEND

SEQ ID NO: 2178428 - protein, 22 aa, Cryptosporidium hominis
NNHLKVLFCTSLHMMDSEIKAD

SEQ ID NO: 2178429 - protein, 24 aa, Cryptosporidium hominis
NNHLPMLTGFSVIWRDQVFVPRIN

SEQ ID NO: 2178430 - protein, 28 aa, Cryptosporidium hominis
NNICHRGKILVCNACYLRVSKENKIRQK

SEQ ID NO: 2178431 - protein, 20 aa, Cryptosporidium hominis
NNICRKRSLVSIGTHDLDMI

SEQ ID NO: 2178432 - protein, 26 aa, Cryptosporidium hominis
NNIFTNEDLIEWKAMIKEFYSNDPDY

SEQ ID NO: 2178433 - protein, 18 aa, Cryptosporidium hominis
NNIFVCCNQIKTNRKRVL

SEQ ID NO: 2178434 - protein, 20 aa, Cryptosporidium hominis
NNIGGLGIGRFQNFLYCIMG

SEQ ID NO: 2178435 - protein, 29 aa, Cryptosporidium hominis
NNIGPKCHNYWKFPDINVFVNNDSHLNNE

SEQ ID NO: 2178436 - protein, 17 aa, Cryptosporidium hominis
NNILCEFCGYLNENCIG

SEQ ID NO: 2178437 - protein, 28 aa, Cryptosporidium hominis
NNILKGTGWLLRTHLDLVDFINDNINAE

SEQ ID NO: 2178438 - protein, 17 aa, Cryptosporidium hominis
NNILLQCIFLLNLKDEF

SEQ ID NO: 2178439 - protein, 22 aa, Cryptosporidium hominis
NNIPLFRNRFFENFEKSRSKNN

SEQ ID NO: 2178440 - protein, 18 aa, Cryptosporidium hominis
NNIPSVMPYDQFGPPVNM

SEQ ID NO: 2178441 - protein, 18 aa, Cryptosporidium hominis
NNIQSIRILILVVHPLKS

SEQ ID NO: 2178442 - protein, 35 aa, Cryptosporidium hominis
NNKIIKYNRIELIMFKNEIKQLLNDRMRDNEEIIN

SEQ ID NO: 2178443 - protein, 18 aa, Cryptosporidium hominis
NNKKCWPRESRMRLVKND

SEQ ID NO: 2178444 - protein, 23 aa, Cryptosporidium hominis
NNLAACINLDWNVDEWVPAVAIR

SEQ ID NO: 2178445 - protein, 27 aa, Cryptosporidium hominis
NNLCRGRPPPPFEMVSHSLPVLCRLLY

SEQ ID NO: 2178446 - protein, 19 aa, Cryptosporidium hominis
NNLDEFLDELLILDYIVAK

SEQ ID NO: 2178447 - protein, 22 aa, Cryptosporidium hominis
NNLECALCPNGTIHSSEDSQEN

SEQ ID NO: 2178448 - protein, 24 aa, Cryptosporidium hominis
NNLEELWSLLHFLNPLRFQNYQEF

SEQ ID NO: 2178449 - protein, 23 aa, Cryptosporidium hominis
NNLPFRFACESIPLFPILTHFCV

SEQ ID NO: 2178450 - protein, 20 aa, Cryptosporidium hominis
NNLREGFIPLIYKGVQLISY

SEQ ID NO: 2178451 - protein, 19 aa, Cryptosporidium hominis
NNLSLPFIWEKKFEQEKKS

SEQ ID NO: 2178452 - protein, 20 aa, Cryptosporidium hominis
NNLTEMGISFACVKGKRINK

SEQ ID NO: 2178453 - protein, 17 aa, Cryptosporidium hominis
NNLVKPPFKSHNDPSVS

SEQ ID NO: 2178454 - protein, 24 aa, Cryptosporidium hominis
NNLWELFSSNFLLFKFYPSGNEIE

SEQ ID NO: 2178455 - protein, 25 aa, Cryptosporidium hominis
NNMIGIEKKEEWGLYDDLIYKFLFR

SEQ ID NO: 2178456 - protein, 25 aa, Cryptosporidium hominis
NNMRVDRLLSMVAQQDSERVLNVIA

SEQ ID NO: 2178457 - protein, 25 aa, Cryptosporidium hominis
NNMSSNIGMGFIPRGNIVAPIQIEW

SEQ ID NO: 2178458 - protein, 23 aa, Cryptosporidium hominis
NNNFGMRDFHAISRQSSFPPHYQ

SEQ ID NO: 2178459 - protein, 25 aa, Cryptosporidium hominis
NNNHIGRLLTLFGISLNHQLQFLDD

SEQ ID NO: 2178460 - protein, 25 aa, Cryptosporidium hominis
NNNIEWQGGIPIRNIPDLMTMLDLS

SEQ ID NO: 2178461 - protein, 26 aa, Cryptosporidium hominis
NNNIFGMLSCRPYSSSISTITSSNQS

SEQ ID NO: 2178462 - protein, 22 aa, Cryptosporidium hominis
NNNIKYSYILPIRSVGVQGDFR

SEQ ID NO: 2178463 - protein, 27 aa, Cryptosporidium hominis
NNNKLPFDFSDPWKMKLINKRGRKSLS

SEQ ID NO: 2178464 - protein, 18 aa, Cryptosporidium hominis
NNNNCYYMYQRNIPNISI

SEQ ID NO: 2178465 - protein, 22 aa, Cryptosporidium hominis
NNNPKWSQPILISSESNGIFYM

SEQ ID NO: 2178466 - protein, 24 aa, Cryptosporidium hominis
NNNRPKLYWAKHIATGFPVVIKVV

SEQ ID NO: 2178467 - protein, 20 aa, Cryptosporidium hominis
NNPGTLITCDYCYDSFHKYC

SEQ ID NO: 2178468 - protein, 25 aa, Cryptosporidium hominis
NNPPRILICNPLKYLILERDSQIII

SEQ ID NO: 2178469 - protein, 24 aa, Cryptosporidium hominis
NNPRFKYLTALGIVYLRLTESSIV

SEQ ID NO: 2178470 - protein, 24 aa, Cryptosporidium hominis
NNQDEILILGFNMTHLTLIDNQSS

SEQ ID NO: 2178471 - protein, 17 aa, Cryptosporidium hominis
NNQEPFEIHGCGHKLNE

SEQ ID NO: 2178472 - protein, 35 aa, Cryptosporidium hominis
NNQFIKEWMDSIIIPPRLAIEANILIHQKKYKMVI

SEQ ID NO: 2178473 - protein, 19 aa, Cryptosporidium hominis
NNQLRLARGGNLCLTSPGD

SEQ ID NO: 2178474 - protein, 27 aa, Cryptosporidium hominis
NNQNLLNLVALCISTPPPFTGLPQNNP

SEQ ID NO: 2178475 - protein, 19 aa, Cryptosporidium hominis
NNRDVCSAKSKPRADNTNI

SEQ ID NO: 2178476 - protein, 27 aa, Cryptosporidium hominis
NNSANPQLWCKISFIDLAGSERASATQ

SEQ ID NO: 2178477 - protein, 23 aa, Cryptosporidium hominis
NNSIYFKEIELIQEFEKTLKCEI

SEQ ID NO: 2178478 - protein, 23 aa, Cryptosporidium hominis
NNSLKRMNVILSFQGILENNSQT

SEQ ID NO: 2178479 - protein, 23 aa, Cryptosporidium hominis
NNSNSIFCYSVDLVYSLFSLLQN

SEQ ID NO: 2178480 - protein, 21 aa, Cryptosporidium hominis
NNSRVLKVWFEDSEFIFDSIN

SEQ ID NO: 2178481 - protein, 20 aa, Cryptosporidium hominis
NNSVLLSAVLQVIASIQKLK

SEQ ID NO: 2178482 - protein, 25 aa, Cryptosporidium hominis
NNSYEILKIRIARITKLLGDNITFL

SEQ ID NO: 2178483 - protein, 25 aa, Cryptosporidium hominis
NNTEKASVVNLDFPKKKKTKKDFEE

SEQ ID NO: 2178484 - protein, 17 aa, Cryptosporidium hominis
NNTLFQFCHAFYLSIIR

SEQ ID NO: 2178485 - protein, 23 aa, Cryptosporidium hominis
NNTLKLPTVHNWISNNPEHSESL

SEQ ID NO: 2178486 - protein, 19 aa, Cryptosporidium hominis
NNVGDLWKEEWREEIDTTN

SEQ ID NO: 2178487 - protein, 29 aa, Cryptosporidium hominis
NNVKNGYRFNICHCHDWLAAPVLTSLRRI

SEQ ID NO: 2178488 - protein, 25 aa, Cryptosporidium hominis
NNVNSNLLLPGFAGLGNFGNIPNFG

SEQ ID NO: 2178489 - protein, 22 aa, Cryptosporidium hominis
NNVQCIKPISFRSSPYSASSNL

SEQ ID NO: 2178490 - protein, 24 aa, Cryptosporidium hominis
NNVRITDIPFIWMNVVQRYQIVNS

SEQ ID NO: 2178491 - protein, 24 aa, Cryptosporidium hominis
NNVYICNFHGWKGGRNSQKCPECV

SEQ ID NO: 2178492 - protein, 25 aa, Cryptosporidium hominis
NNWGISVRLSEYFSGRVYAEHLFNS

SEQ ID NO: 2178493 - protein, 23 aa, Cryptosporidium hominis
NNYCSMNWATFRSSLESNSLNAT

SEQ ID NO: 2178494 - protein, 24 aa, Cryptosporidium hominis
NNYISCSGPYPNGNLIHIGSKLIW

SEQ ID NO: 2178495 - protein, 23 aa, Cryptosporidium hominis
NNYKHNWTLPLKDFTSSKKKENF

SEQ ID NO: 2178496 - protein, 36 aa, Cryptosporidium hominis
NNYLRWAGSAIKYPEKYLIMSIGFAFKRKITRNRST

SEQ ID NO: 2178497 - protein, 23 aa, Cryptosporidium hominis
NNYNYRYEFISSTNSNTGGGTLS

SEQ ID NO: 2178498 - protein, 21 aa, Cryptosporidium hominis
NPAAIKRLLKDNVAVVILLEY

SEQ ID NO: 2178499 - protein, 19 aa, Cryptosporidium hominis
NPACCLDVLNIKKSHSDLL

SEQ ID NO: 2178500 - protein, 17 aa, Cryptosporidium hominis
NPALYVLRERIRKGLQL

SEQ ID NO: 2178501 - protein, 21 aa, Cryptosporidium hominis
NPENFKTFVQILLRLFHDSPA

SEQ ID NO: 2178502 - protein, 20 aa, Cryptosporidium hominis
NPFQMICIALNKPCIEFYDL

SEQ ID NO: 2178503 - protein, 18 aa, Cryptosporidium hominis
NPGCVIKTVHPWFKSTAT

SEQ ID NO: 2178504 - protein, 20 aa, Cryptosporidium hominis
NPHIPQFIAKAPWYINQQES

SEQ ID NO: 2178505 - protein, 19 aa, Cryptosporidium hominis
NPIILQFPMVRSSSQSPGG

SEQ ID NO: 2178506 - protein, 19 aa, Cryptosporidium hominis
NPKNLWSSCHSNRTRHLGE

SEQ ID NO: 2178507 - protein, 17 aa, Cryptosporidium hominis
NPLFFPLDESIPIVLAL

SEQ ID NO: 2178508 - protein, 17 aa, Cryptosporidium hominis
NPLFKKNEESFSMYSIR

SEQ ID NO: 2178509 - protein, 21 aa, Cryptosporidium hominis
NPLHSLVICHPDLHLIEQRFF

SEQ ID NO: 2178510 - protein, 23 aa, Cryptosporidium hominis
NPLPELEVPSWVRYHSEIVGTNQ

SEQ ID NO: 2178511 - protein, 26 aa, Cryptosporidium hominis
NPLPGRPRCIWTLKNGIDPSLSGSQA

SEQ ID NO: 2178512 - protein, 27 aa, Cryptosporidium hominis
NPLSVIEFFKYPIPFFSKKNISKNEFS

SEQ ID NO: 2178513 - protein, 26 aa, Cryptosporidium hominis
NPMFPKWCKSRLFAWPVDKWLEIIRK

SEQ ID NO: 2178514 - protein, 17 aa, Cryptosporidium hominis
NPMNPSLIWRKNKENDD

SEQ ID NO: 2178515 - protein, 18 aa, Cryptosporidium hominis
NPMSWHCLGTLYNRIPAA

SEQ ID NO: 2178516 - protein, 24 aa, Cryptosporidium hominis
NPNCKFLFCSFIPYLTVPSQVCGI

SEQ ID NO: 2178517 - protein, 22 aa, Cryptosporidium hominis
NPNENPILCVWFAQKKGNYGFI

SEQ ID NO: 2178518 - protein, 24 aa, Cryptosporidium hominis
NPNFKLTDFMSFFEEYILPKFMES

SEQ ID NO: 2178519 - protein, 17 aa, Cryptosporidium hominis
NPPPIVSGIRINPHPTT

SEQ ID NO: 2178520 - protein, 19 aa, Cryptosporidium hominis
NPQFCYALLHSQFILGMVN

SEQ ID NO: 2178521 - protein, 37 aa, Cryptosporidium hominis
NPQIWDRRAVLIGELLQRIGLESEYMRFLSSELNLTK

SEQ ID NO: 2178522 - protein, 20 aa, Cryptosporidium hominis
NPRGFVCGLFNPSIPTDGVA

SEQ ID NO: 2178523 - protein, 25 aa, Cryptosporidium hominis
NPSKMCLIHSIRLLDPIRRLKVVNI

SEQ ID NO: 2178524 - protein, 27 aa, Cryptosporidium hominis
NPSSLYSISLLLIIGLALKGNGENETL

SEQ ID NO: 2178525 - protein, 24 aa, Cryptosporidium hominis
NPTLKRSQLLQMLQKNWKKSPENP

SEQ ID NO: 2178526 - protein, 17 aa, Cryptosporidium hominis
NPVCGFIVPGGDYTISG

SEQ ID NO: 2178527 - protein, 20 aa, Cryptosporidium hominis
NPYCPVDFRSKVWTCPFSLQ

SEQ ID NO: 2178528 - protein, 22 aa, Cryptosporidium hominis
NPYFKSGHKFSASNPYGVRDKN

SEQ ID NO: 2178529 - protein, 26 aa, Cryptosporidium hominis
NQAKLVCFYCDLLLKNSYSEIGNDFN

SEQ ID NO: 2178530 - protein, 18 aa, Cryptosporidium hominis
NQALLALKLGKYNDSIQS

SEQ ID NO: 2178531 - protein, 25 aa, Cryptosporidium hominis
NQDHDICPICLNKLKDDYSQVLLPC

SEQ ID NO: 2178532 - protein, 28 aa, Cryptosporidium hominis
NQDICLNLKLPIWVSSMAKQFYNAYNQI

SEQ ID NO: 2178533 - protein, 24 aa, Cryptosporidium hominis
NQDRPRLLPYLNRMLRELKKPYDC

SEQ ID NO: 2178534 - protein, 26 aa, Cryptosporidium hominis
NQEFLKGIVKRSGRPGITLIDKKFNW

SEQ ID NO: 2178535 - protein, 26 aa, Cryptosporidium hominis
NQEILCYSCESWSTLDLILNKTKGAC

SEQ ID NO: 2178536 - protein, 25 aa, Cryptosporidium hominis
NQFFPNIRTPVVITRCGHHFCLNCA

SEQ ID NO: 2178537 - protein, 21 aa, Cryptosporidium hominis
NQGLTYLMGFIFLNMASEVDN

SEQ ID NO: 2178538 - protein, 31 aa, Cryptosporidium hominis
NQGSCLKRNWRIEFWSNFMANCINFCPILDS

SEQ ID NO: 2178539 - protein, 18 aa, Cryptosporidium hominis
NQHLFISIIDNWRKSVGF

SEQ ID NO: 2178540 - protein, 20 aa, Cryptosporidium hominis
NQIAQEFSFILGDELYNTGL

SEQ ID NO: 2178541 - protein, 18 aa, Cryptosporidium hominis
NQIEELYKPLEYPKLCNR

SEQ ID NO: 2178542 - protein, 23 aa, Cryptosporidium hominis
NQIELPFSFSYWPLDAGNGYTNV

SEQ ID NO: 2178543 - protein, 22 aa, Cryptosporidium hominis
NQIETMGSYAIMINWSDDHTSI

SEQ ID NO: 2178544 - protein, 21 aa, Cryptosporidium hominis
NQIHCQYIFLCHGQIQNSSDR

SEQ ID NO: 2178545 - protein, 18 aa, Cryptosporidium hominis
NQIIPLISSYFIFDNLSI

SEQ ID NO: 2178546 - protein, 24 aa, Cryptosporidium hominis
NQIPNRRFTLWWSPTINRANVYIG

SEQ ID NO: 2178547 - protein, 23 aa, Cryptosporidium hominis
NQISNYWLLLVLAYEQLFGNLKI

SEQ ID NO: 2178548 - protein, 24 aa, Cryptosporidium hominis
NQKGKWRVKLRNGIAQIANQEIPF

SEQ ID NO: 2178549 - protein, 23 aa, Cryptosporidium hominis
NQKSYEHFNLLSPGRGDTRHTQL

SEQ ID NO: 2178550 - protein, 26 aa, Cryptosporidium hominis
NQLLCSLLERDPCRLNSSGLYSYNSN

SEQ ID NO: 2178551 - protein, 26 aa, Cryptosporidium hominis
NQMESLDWWWWLNIKDNFEGLLTQNM

SEQ ID NO: 2178552 - protein, 21 aa, Cryptosporidium hominis
NQNCTWSKLFPNINKVTEIFS

SEQ ID NO: 2178553 - protein, 20 aa, Cryptosporidium hominis
NQNSELYINFVFSTKIPPHL

SEQ ID NO: 2178554 - protein, 24 aa, Cryptosporidium hominis
NQQFSIRWDGFLLAPESGRYYFSI

SEQ ID NO: 2178555 - protein, 18 aa, Cryptosporidium hominis
NQRLEAVDSMLKSHHSAS

SEQ ID NO: 2178556 - protein, 20 aa, Cryptosporidium hominis
NQRRRLASLGKFRSKTSKLL

SEQ ID NO: 2178557 - protein, 25 aa, Cryptosporidium hominis
NQSLGCSLIRVGGKKVYKSNKNIDE

SEQ ID NO: 2178558 - protein, 24 aa, Cryptosporidium hominis
NQSTLLDSLKFGGGLEPPQVSQYG

SEQ ID NO: 2178559 - protein, 20 aa, Cryptosporidium hominis
NQTGCSRAKAIKALKSNNND

SEQ ID NO: 2178560 - protein, 25 aa, Cryptosporidium hominis
NQVKSDYILSPAIEQIIKVEPCRIP

SEQ ID NO: 2178561 - protein, 26 aa, Cryptosporidium hominis
NQYAGLMRPEGFPVYTTQWPSAFNGG

SEQ ID NO: 2178562 - protein, 18 aa, Cryptosporidium hominis
NQYKPCQSMIQFKYYCNS

SEQ ID NO: 2178563 - protein, 21 aa, Cryptosporidium hominis
NQYKTNCETNMTSEQTKKRPS

SEQ ID NO: 2178564 - protein, 18 aa, Cryptosporidium hominis
NRASSRLSPNNRRSTESL

SEQ ID NO: 2178565 - protein, 23 aa, Cryptosporidium hominis
NRDISLIVIKSFLALRRKNLSEK

SEQ ID NO: 2178566 - protein, 17 aa, Cryptosporidium hominis
NREHALEAVNYSITCAF

SEQ ID NO: 2178567 - protein, 19 aa, Cryptosporidium hominis
NRESFDVAKEHYLRGQQEW

SEQ ID NO: 2178568 - protein, 22 aa, Cryptosporidium hominis
NRFDDEFMRRMETPEMLVNRLN

SEQ ID NO: 2178569 - protein, 19 aa, Cryptosporidium hominis
NRFNIDDLVVWKYSNPYYT

SEQ ID NO: 2178570 - protein, 20 aa, Cryptosporidium hominis
NRFREYPAHSSFTQRNRIGI

SEQ ID NO: 2178571 - protein, 20 aa, Cryptosporidium hominis
NRFSEINIRCSDQNTIYTLF

SEQ ID NO: 2178572 - protein, 19 aa, Cryptosporidium hominis
NRGLHSFGSVDIRSNQGGS

SEQ ID NO: 2178573 - protein, 20 aa, Cryptosporidium hominis
NRGSASLGLNNGFSENYYSG

SEQ ID NO: 2178574 - protein, 17 aa, Cryptosporidium hominis
NRHPNILNLIGGIRINE

SEQ ID NO: 2178575 - protein, 25 aa, Cryptosporidium hominis
NRICKSYFQLCQRLKEYLKNMSPYF

SEQ ID NO: 2178576 - protein, 22 aa, Cryptosporidium hominis
NRIGEGIGSIGNIVGSDNNTGN

SEQ ID NO: 2178577 - protein, 24 aa, Cryptosporidium hominis
NRIKLFKDEVCWSINKSQDSMSTQ

SEQ ID NO: 2178578 - protein, 19 aa, Cryptosporidium hominis
NRITMCFEDNSGILSSKEC

SEQ ID NO: 2178579 - protein, 23 aa, Cryptosporidium hominis
NRIYIGSVPYSFTTDDLRHIFKT

SEQ ID NO: 2178580 - protein, 19 aa, Cryptosporidium hominis
NRIYIILKESLDLLYSYLG

SEQ ID NO: 2178581 - protein, 26 aa, Cryptosporidium hominis
NRKKLLEEWGLPGTYVTLWLKEELGE

SEQ ID NO: 2178582 - protein, 24 aa, Cryptosporidium hominis
NRKKRYILGQNVGKWTDEEHNRFV

SEQ ID NO: 2178583 - protein, 23 aa, Cryptosporidium hominis
NRKPRVAHAVSMLSDHLYKYQGY

SEQ ID NO: 2178584 - protein, 17 aa, Cryptosporidium hominis
NRKRVSLIHTYRRRSNI

SEQ ID NO: 2178585 - protein, 19 aa, Cryptosporidium hominis
NRKSDLSLSSSSIGKKLND

SEQ ID NO: 2178586 - protein, 28 aa, Cryptosporidium hominis
NRKYLCYKYKFMLVPSILILVIKNEITF

SEQ ID NO: 2178587 - protein, 18 aa, Cryptosporidium hominis
NRLAPQIFIETSISSFLS

SEQ ID NO: 2178588 - protein, 21 aa, Cryptosporidium hominis
NRLASGYARLIHSFIMDQNPI

SEQ ID NO: 2178589 - protein, 17 aa, Cryptosporidium hominis
NRLDDRFITNFQILENV

SEQ ID NO: 2178590 - protein, 34 aa, Cryptosporidium hominis
NRLKCINTFSGTCFSLFVRWNLGIDDVLYPNIPK

SEQ ID NO: 2178591 - protein, 18 aa, Cryptosporidium hominis
NRLNGCFLECLFNNENNN

SEQ ID NO: 2178592 - protein, 23 aa, Cryptosporidium hominis
NRLNLRGLNEFDLKESKLSMSFD

SEQ ID NO: 2178593 - protein, 20 aa, Cryptosporidium hominis
NRLNRWLLKRIIASESHENT

SEQ ID NO: 2178594 - protein, 29 aa, Cryptosporidium hominis
NRLPIATTCGFRLSLPRYSSIEILRSRLL

SEQ ID NO: 2178595 - protein, 17 aa, Cryptosporidium hominis
NRLPIGKYVCVIFDKIG

SEQ ID NO: 2178596 - protein, 18 aa, Cryptosporidium hominis
NRLQLCTYFIKGRCKNGS

SEQ ID NO: 2178597 - protein, 18 aa, Cryptosporidium hominis
NRPESGCIIRIHDEIANT

SEQ ID NO: 2178598 - protein, 17 aa, Cryptosporidium hominis
NRPHLLGLEALKSNQNY

SEQ ID NO: 2178599 - protein, 29 aa, Cryptosporidium hominis
NRPKWWQLCFCKPIISVTLFARIISDEIL

SEQ ID NO: 2178600 - protein, 26 aa, Cryptosporidium hominis
NRQEKLNVLESFTFELFCSIRQHFLS

SEQ ID NO: 2178601 - protein, 25 aa, Cryptosporidium hominis
NRQGSSNLVYWRLKGGVSTSINIPN

SEQ ID NO: 2178602 - protein, 31 aa, Cryptosporidium hominis
NRQRDCKSFYSCGYDKQILFWDAEYGKTKWK

SEQ ID NO: 2178603 - protein, 24 aa, Cryptosporidium hominis
NRQREYGRRIGFNIEESGKNIINS

SEQ ID NO: 2178604 - protein, 23 aa, Cryptosporidium hominis
NRRCILNRLQAWNGAPLSGAGHP

SEQ ID NO: 2178605 - protein, 22 aa, Cryptosporidium hominis
NRRITDAMILRPNLDDNQEKGN

SEQ ID NO: 2178606 - protein, 21 aa, Cryptosporidium hominis
NRRLSESYKLFLNGQNDGGLL

SEQ ID NO: 2178607 - protein, 20 aa, Cryptosporidium hominis
NRRLSTCNSIRSDKDNDPNI

SEQ ID NO: 2178608 - protein, 17 aa, Cryptosporidium hominis
NRRMCKNNIDHLFNQLQ

SEQ ID NO: 2178609 - protein, 22 aa, Cryptosporidium hominis
NRRVGLGCLTRGPSNVVENSIL

SEQ ID NO: 2178610 - protein, 20 aa, Cryptosporidium hominis
NRRYVPCLYVHNKIDNLNLS

SEQ ID NO: 2178611 - protein, 20 aa, Cryptosporidium hominis
NRTSMDFIRYYQGILQYEDY

SEQ ID NO: 2178612 - protein, 20 aa, Cryptosporidium hominis
NRVLPRKGVEVRLLDRSGRG

SEQ ID NO: 2178613 - protein, 26 aa, Cryptosporidium hominis
NRVNKCKTRYGAILNFLIANSSAIPI

SEQ ID NO: 2178614 - protein, 26 aa, Cryptosporidium hominis
NRVRLLFRKGMKCYRPRRTGEMKRKS

SEQ ID NO: 2178615 - protein, 17 aa, Cryptosporidium hominis
NRYDYNLQFGIDKDNSN

SEQ ID NO: 2178616 - protein, 20 aa, Cryptosporidium hominis
NRYGFNFLKNPSLDFCLGFG

SEQ ID NO: 2178617 - protein, 18 aa, Cryptosporidium hominis
NRYKICIGIPYTTFINIL

SEQ ID NO: 2178618 - protein, 17 aa, Cryptosporidium hominis
NSALRSAIETIRRTKND

SEQ ID NO: 2178619 - protein, 19 aa, Cryptosporidium hominis
NSARVCLYDTLTFTLVSTV

SEQ ID NO: 2178620 - protein, 22 aa, Cryptosporidium hominis
NSCCKLISDHYIKMSIHRDKSK

SEQ ID NO: 2178621 - protein, 26 aa, Cryptosporidium hominis
NSCISVPTGSFLIRAFYSNNGVNNNN

SEQ ID NO: 2178622 - protein, 23 aa, Cryptosporidium hominis
NSDDWKYGGAMFGPGNNSTVHAS

SEQ ID NO: 2178623 - protein, 22 aa, Cryptosporidium hominis
NSDFFLKRPPKVSITNSGGIDV

SEQ ID NO: 2178624 - protein, 21 aa, Cryptosporidium hominis
NSECYKIPPIFNEQAEGVEME

SEQ ID NO: 2178625 - protein, 29 aa, Cryptosporidium hominis
NSEKGYKSWWALKSEIFNLIQMTKQSCNK

SEQ ID NO: 2178626 - protein, 18 aa, Cryptosporidium hominis
NSELAMLHMERMRRKNSE

SEQ ID NO: 2178627 - protein, 18 aa, Cryptosporidium hominis
NSFINLSLPLFVITEPLP

SEQ ID NO: 2178628 - protein, 26 aa, Cryptosporidium hominis
NSFIRWKREEPFRVYDMWYDAVKERK

SEQ ID NO: 2178629 - protein, 24 aa, Cryptosporidium hominis
NSFMSMGGSIPGGFDFSTISKQLS

SEQ ID NO: 2178630 - protein, 21 aa, Cryptosporidium hominis
  misc_feature (17)..(17): Xaa can be any naturally occurring amino acid
NSFVIPSIGSWYLWEIXSEKK

SEQ ID NO: 2178631 - protein, 18 aa, Cryptosporidium hominis
NSGFKKSIILSYLVSSGY

SEQ ID NO: 2178632 - protein, 19 aa, Cryptosporidium hominis
NSGILAFDMNFRYNQNNPY

SEQ ID NO: 2178633 - protein, 23 aa, Cryptosporidium hominis
NSGRLHWLRVMYHYLDTVDARKI

SEQ ID NO: 2178634 - protein, 31 aa, Cryptosporidium hominis
NSGRMESILNFLKLRCKEIGLDLRGNEKMIK

SEQ ID NO: 2178635 - protein, 20 aa, Cryptosporidium hominis
NSHFKYKVHDNIIIEYIIIL

SEQ ID NO: 2178636 - protein, 27 aa, Cryptosporidium hominis
NSHQYKLQIFKFLNLKIPIKCDDQIYL

SEQ ID NO: 2178637 - protein, 25 aa, Cryptosporidium hominis
NSIDRAPCVFECLYSKREVLTLLRR

SEQ ID NO: 2178638 - protein, 22 aa, Cryptosporidium hominis
NSIEARSGLISDRIANAEVING

SEQ ID NO: 2178639 - protein, 18 aa, Cryptosporidium hominis
NSIIAYWPPNEALKIPTA

SEQ ID NO: 2178640 - protein, 19 aa, Cryptosporidium hominis
NSIIKGCFEKVEILNSNKL

SEQ ID NO: 2178641 - protein, 18 aa, Cryptosporidium hominis
NSIIKVAIWFINHLSKSN

SEQ ID NO: 2178642 - protein, 24 aa, Cryptosporidium hominis
NSIIRYMRRWNYLSLVMLPPNNST

SEQ ID NO: 2178643 - protein, 17 aa, Cryptosporidium hominis
NSINEFQASNNIEKNIN

SEQ ID NO: 2178644 - protein, 17 aa, Cryptosporidium hominis
NSIPNRRSLGSVSSTAG

SEQ ID NO: 2178645 - protein, 22 aa, Cryptosporidium hominis
NSIRLKNQFLQMIDGVQSDLSK

SEQ ID NO: 2178646 - protein, 29 aa, Cryptosporidium hominis
NSITELWSLLNFLLPQVFHSVEDFQVWFS

SEQ ID NO: 2178647 - protein, 25 aa, Cryptosporidium hominis
NSKDFLKVMFLQSMLGEYGTNNINR

SEQ ID NO: 2178648 - protein, 22 aa, Cryptosporidium hominis
NSKISFLLNRPLIMSIQDFIAT

SEQ ID NO: 2178649 - protein, 26 aa, Cryptosporidium hominis
NSKKLVNKFCRLFSGMPFELPPLPYD

SEQ ID NO: 2178650 - protein, 20 aa, Cryptosporidium hominis
NSKLDHIQILLGFNTKSEII

SEQ ID NO: 2178651 - protein, 22 aa, Cryptosporidium hominis
NSKNWFKECLDQREATQNVELT

SEQ ID NO: 2178652 - protein, 24 aa, Cryptosporidium hominis
NSKPPIKICVVSDIMEPFLPCPLS

SEQ ID NO: 2178653 - protein, 19 aa, Cryptosporidium hominis
NSLDLSFAFGQSISNNIMV

SEQ ID NO: 2178654 - protein, 20 aa, Cryptosporidium hominis
NSLEAYCLIISSLSHDLDHP

SEQ ID NO: 2178655 - protein, 24 aa, Cryptosporidium hominis
NSLFEIFKLFLTTYFHNRKNKNIL

SEQ ID NO: 2178656 - protein, 29 aa, Cryptosporidium hominis
NSLFEYKNFPIYTLLALRTISSEFKNLDT

SEQ ID NO: 2178657 - protein, 18 aa, Cryptosporidium hominis
NSLFKRKSGKHMASETNR

SEQ ID NO: 2178658 - protein, 18 aa, Cryptosporidium hominis
NSLFPYPGSQIEWNNTMN

SEQ ID NO: 2178659 - protein, 26 aa, Cryptosporidium hominis
NSLGFKLFVDKCCDYYRYIRRKSWLI

SEQ ID NO: 2178660 - protein, 19 aa, Cryptosporidium hominis
NSLILLLTSYCNWDEQIAD

SEQ ID NO: 2178661 - protein, 19 aa, Cryptosporidium hominis
NSLKEARDLGVSDLQNVKK

SEQ ID NO: 2178662 - protein, 24 aa, Cryptosporidium hominis
NSLKELFTLLNFLYPDILQDSEIF

SEQ ID NO: 2178663 - protein, 22 aa, Cryptosporidium hominis
NSLLEVLEKIIFHVNNTEFSQN

SEQ ID NO: 2178664 - protein, 17 aa, Cryptosporidium hominis
NSLLFLKINLGFNPQTL

SEQ ID NO: 2178665 - protein, 21 aa, Cryptosporidium hominis
NSLLNPSILGWGLFSYSSLFN

SEQ ID NO: 2178666 - protein, 17 aa, Cryptosporidium hominis
NSLLSGVHRMLTRDSSE

SEQ ID NO: 2178667 - protein, 22 aa, Cryptosporidium hominis
NSLPKFISCNINDISCECPDSK

SEQ ID NO: 2178668 - protein, 17 aa, Cryptosporidium hominis
NSLPYFIQAERIISKTL

SEQ ID NO: 2178669 - protein, 17 aa, Cryptosporidium hominis
NSLVYPILGTKIIFEDD

SEQ ID NO: 2178670 - protein, 23 aa, Cryptosporidium hominis
NSLYCFLDSMKLWLSEYDSDALI

SEQ ID NO: 2178671 - protein, 27 aa, Cryptosporidium hominis
NSLYKHWLRKKCNNYLVMIRCSIKFFS

SEQ ID NO: 2178672 - protein, 22 aa, Cryptosporidium hominis
NSLYSNDHWWYIFKKKFNMSTK

SEQ ID NO: 2178673 - protein, 21 aa, Cryptosporidium hominis
NSMEFCSPRFGELNYSEENSG

SEQ ID NO: 2178674 - protein, 18 aa, Cryptosporidium hominis
NSMGRLTGRGGLGLGTAG

SEQ ID NO: 2178675 - protein, 23 aa, Cryptosporidium hominis
NSMRCKMNFLYLKVSTFEEYDVE

SEQ ID NO: 2178676 - protein, 25 aa, Cryptosporidium hominis
NSNAIMMITFLYKLIEILKDYFKVL

SEQ ID NO: 2178677 - protein, 24 aa, Cryptosporidium hominis
NSNELWKLDIAYFSFQKFGMDKSC

SEQ ID NO: 2178678 - protein, 19 aa, Cryptosporidium hominis
NSNLISLKFQERLIDNHGR

SEQ ID NO: 2178679 - protein, 23 aa, Cryptosporidium hominis
NSNLMEWDKLWTINKQLMDPVVP

SEQ ID NO: 2178680 - protein, 18 aa, Cryptosporidium hominis
NSNLRGMLDLSVLPIEEV

SEQ ID NO: 2178681 - protein, 21 aa, Cryptosporidium hominis
NSNMCLVFEKLGPSLFDFLDG

SEQ ID NO: 2178682 - protein, 23 aa, Cryptosporidium hominis
NSNPDLWLSWLLMSRNNSKEDDT

SEQ ID NO: 2178683 - protein, 21 aa, Cryptosporidium hominis
NSNRLNLRYGDNEKINSLLDE

SEQ ID NO: 2178684 - protein, 24 aa, Cryptosporidium hominis
NSPDAPCYFALIFSGMNSEGLDVR

SEQ ID NO: 2178685 - protein, 19 aa, Cryptosporidium hominis
NSPFHFIWDSIIFNKTKKI

SEQ ID NO: 2178686 - protein, 34 aa, Cryptosporidium hominis
NSPKKKLDCSVHWMYKSERGWMPFSERNNVYIES

SEQ ID NO: 2178687 - protein, 21 aa, Cryptosporidium hominis
NSPKYRFVVRLTNTKVICQII

SEQ ID NO: 2178688 - protein, 20 aa, Cryptosporidium hominis
NSPLCRNIAFAVERRLLDSN

SEQ ID NO: 2178689 - protein, 18 aa, Cryptosporidium hominis
NSPLRIVEEGQIDDEEHI

SEQ ID NO: 2178690 - protein, 22 aa, Cryptosporidium hominis
NSQCEIKFLVTKTFMRMDSACV

SEQ ID NO: 2178691 - protein, 23 aa, Cryptosporidium hominis
NSRENKILFTRVKQGTYVYGRLM

SEQ ID NO: 2178692 - protein, 21 aa, Cryptosporidium hominis
NSRHLLEFLFRSEDELQNNEK

SEQ ID NO: 2178693 - protein, 18 aa, Cryptosporidium hominis
NSRILKVIMHEYGHLMKL

SEQ ID NO: 2178694 - protein, 21 aa, Cryptosporidium hominis
NSRIVRYETELDILKEFIPIR

SEQ ID NO: 2178695 - protein, 25 aa, Cryptosporidium hominis
NSRVKGMLVLGELLISWDKETIIVS

SEQ ID NO: 2178696 - protein, 18 aa, Cryptosporidium hominis
NSSHPAFGFEQEKHYNSH

SEQ ID NO: 2178697 - protein, 22 aa, Cryptosporidium hominis
NSSKWPRLSYKDSPLKKTSATS

SEQ ID NO: 2178698 - protein, 22 aa, Cryptosporidium hominis
NSSLCLDEKPVGLIEDKKMSKI

SEQ ID NO: 2178699 - protein, 27 aa, Cryptosporidium hominis
NSSLILEKFHPIWIRKIIDERRNLVLK

SEQ ID NO: 2178700 - protein, 18 aa, Cryptosporidium hominis
NSSLKWNGLPLINLKFVH

SEQ ID NO: 2178701 - protein, 34 aa, Cryptosporidium hominis
NSSLLRVGIKSEHPIASLLSVLSMNKGIQSIHNR

SEQ ID NO: 2178702 - protein, 18 aa, Cryptosporidium hominis
NSSLRPNRERRPSSHNTE

SEQ ID NO: 2178703 - protein, 18 aa, Cryptosporidium hominis
NSSLTITTPVKFKKLYND

SEQ ID NO: 2178704 - protein, 30 aa, Cryptosporidium hominis
NSSNWSFGYYKLRPGVINMLRTLSKDKYEI

SEQ ID NO: 2178705 - protein, 25 aa, Cryptosporidium hominis
NSSRFGRFIKLCLERSNGIVGGAIS

SEQ ID NO: 2178706 - protein, 26 aa, Cryptosporidium hominis
NSSYLYRLIIVIAEISLVLCKSGEVD

SEQ ID NO: 2178707 - protein, 37 aa, Cryptosporidium hominis
NSSYMSMSGFIPQFIQASKYFTCFYGSNNIENSSLVN

SEQ ID NO: 2178708 - protein, 24 aa, Cryptosporidium hominis
NSTEDLRVLSAMNILKFDKELEPA

SEQ ID NO: 2178709 - protein, 19 aa, Cryptosporidium hominis
NSTEKVWQSAFIRPDGGSF

SEQ ID NO: 2178710 - protein, 24 aa, Cryptosporidium hominis
NSTIPSIVNQGNLFWIDSNIAYYS

SEQ ID NO: 2178711 - protein, 17 aa, Cryptosporidium hominis
NSTLVSCIECCISYFSR

SEQ ID NO: 2178712 - protein, 20 aa, Cryptosporidium hominis
NSTSSILFSVWNQLFRGNSR

SEQ ID NO: 2178713 - protein, 32 aa, Cryptosporidium hominis
NSTTLETMWDCLGRSALLHGFINVAEKCLQVT

SEQ ID NO: 2178714 - protein, 28 aa, Cryptosporidium hominis
NSVCCITCLKKSFNIIFGINKKFDYPFS

SEQ ID NO: 2178715 - protein, 23 aa, Cryptosporidium hominis
NSVESLSSYGSRKHFSEEPNSAD

SEQ ID NO: 2178716 - protein, 21 aa, Cryptosporidium hominis
NSVMVKSEILSGSKKEKDQMI

SEQ ID NO: 2178717 - protein, 19 aa, Cryptosporidium hominis
NSYAAFPLPQGVGMSPHML

SEQ ID NO: 2178718 - protein, 23 aa, Cryptosporidium hominis
NSYKFAQKVCSMIFEQPIHNILS

SEQ ID NO: 2178719 - protein, 18 aa, Cryptosporidium hominis
NSYLNCLDSFSGDTSHVI

SEQ ID NO: 2178720 - protein, 19 aa, Cryptosporidium hominis
NSYNSSPIRKWVKKKRVNY

SEQ ID NO: 2178721 - protein, 20 aa, Cryptosporidium hominis
NSYRLAGYETSEPVKVEIPL

SEQ ID NO: 2178722 - protein, 22 aa, Cryptosporidium hominis
NSYSSRSHLIFMLQLQQKNVFD

SEQ ID NO: 2178723 - protein, 51 aa, Cryptosporidium hominis
NTCPACDKIYKRDWQQVCLDWIYCDLCNNWYHWYCLGLHKDNIPSENEPFH

SEQ ID NO: 2178724 - protein, 21 aa, Cryptosporidium hominis
NTCSLKELFNEMIITAKNNNC

SEQ ID NO: 2178725 - protein, 22 aa, Cryptosporidium hominis
NTCSWLDNKHVVFGQLLGHDSF

SEQ ID NO: 2178726 - protein, 23 aa, Cryptosporidium hominis
NTDIYGKCLLVPELCSKGDEPLV

SEQ ID NO: 2178727 - protein, 20 aa, Cryptosporidium hominis
NTDKVILLWTGCTPTSKDIE

SEQ ID NO: 2178728 - protein, 33 aa, Cryptosporidium hominis
NTDPPIWKYWSLPNIEFHGLWDVLHYENNLKQQ

SEQ ID NO: 2178729 - protein, 23 aa, Cryptosporidium hominis
NTDRRIPLNLEFKEENNAFDENN

SEQ ID NO: 2178730 - protein, 24 aa, Cryptosporidium hominis
NTEELWPLLNYIEPIKFASIEAFT

SEQ ID NO: 2178731 - protein, 25 aa, Cryptosporidium hominis
NTEQFGDLCCITFTPSGEHIFATSK

SEQ ID NO: 2178732 - protein, 24 aa, Cryptosporidium hominis
NTFECDYPTFGFAITNGDPILNTT

SEQ ID NO: 2178733 - protein, 25 aa, Cryptosporidium hominis
NTFPNCKRFYCPFIHDSETNLINFN

SEQ ID NO: 2178734 - protein, 18 aa, Cryptosporidium hominis
NTGYKVSTSMLFDIQVKR

SEQ ID NO: 2178735 - protein, 30 aa, Cryptosporidium hominis
NTIDSWVFSCIDFNNAEKWISMLKGEDSDV

SEQ ID NO: 2178736 - protein, 25 aa, Cryptosporidium hominis
NTIFWSIKDVESFDKVQNKRIINKM

SEQ ID NO: 2178737 - protein, 25 aa, Cryptosporidium hominis
NTIKGYCPHCSTVISIADLEPNNPI

SEQ ID NO: 2178738 - protein, 19 aa, Cryptosporidium hominis
NTILCPWVHIEGIVEEITL

SEQ ID NO: 2178739 - protein, 33 aa, Cryptosporidium hominis
NTINSCLSWKTFGYFNLISCYSVLVNSGTCESK

SEQ ID NO: 2178740 - protein, 18 aa, Cryptosporidium hominis
NTLDLLWNNFLIFENSAF

SEQ ID NO: 2178741 - protein, 19 aa, Cryptosporidium hominis
NTLGDWVSKIGLRQESRKA

SEQ ID NO: 2178742 - protein, 23 aa, Cryptosporidium hominis
NTLGFLFYRKFVVLINLITHEQC

SEQ ID NO: 2178743 - protein, 17 aa, Cryptosporidium hominis
NTLGTAIKKAFQANSSS

SEQ ID NO: 2178744 - protein, 17 aa, Cryptosporidium hominis
NTLISIESEVAFGSVSS

SEQ ID NO: 2178745 - protein, 17 aa, Cryptosporidium hominis
NTLKGPYNMAIEFFTLE

SEQ ID NO: 2178746 - protein, 29 aa, Cryptosporidium hominis
NTLLLMYIGYLCYYMMLKTSPDINIKEHP

SEQ ID NO: 2178747 - protein, 32 aa, Cryptosporidium hominis
NTLNGFPGGYAWTICVIYFFQKIGILPVIDAN

SEQ ID NO: 2178748 - protein, 24 aa, Cryptosporidium hominis
NTLSAIKWNFSRFLIDKNGKVVAF

SEQ ID NO: 2178749 - protein, 25 aa, Cryptosporidium hominis
NTNRKELMHAISLSAGMSEVLNLSI

SEQ ID NO: 2178750 - protein, 22 aa, Cryptosporidium hominis
NTNSIRILLDYFINSNDLIASI

SEQ ID NO: 2178751 - protein, 30 aa, Cryptosporidium hominis
NTNYRKISVIFWRKIWINIYKIVHGKLELA

SEQ ID NO: 2178752 - protein, 22 aa, Cryptosporidium hominis
NTPFFELSWIPGLAEDKTGQVK

SEQ ID NO: 2178753 - protein, 26 aa, Cryptosporidium hominis
NTPGPKPSKSIGCLEYVPESNNKNNN

SEQ ID NO: 2178754 - protein, 24 aa, Cryptosporidium hominis
NTPIRKGYEVKEIRSNTPTESQSN

SEQ ID NO: 2178755 - protein, 23 aa, Cryptosporidium hominis
NTPLCGVCALPVSTESTVNTHYF

SEQ ID NO: 2178756 - protein, 17 aa, Cryptosporidium hominis
NTPYKVFNFRKSISTLK

SEQ ID NO: 2178757 - protein, 33 aa, Cryptosporidium hominis
NTPYYLKLRPGVREFLNTIAPYYIMGICTNATR

SEQ ID NO: 2178758 - protein, 18 aa, Cryptosporidium hominis
NTQVPFQLVEYVHRASGG

SEQ ID NO: 2178759 - protein, 39 aa, Cryptosporidium hominis
NTRPRIEKLALITGFGNWIPFGWCEFFVKLFETNSKHYL

SEQ ID NO: 2178760 - protein, 23 aa, Cryptosporidium hominis
NTRRKRGTGGIDVGTFELNSTRS

SEQ ID NO: 2178761 - protein, 26 aa, Cryptosporidium hominis
NTSCILCPRRGGALIEAQGIPQNHTG

SEQ ID NO: 2178762 - protein, 31 aa, Cryptosporidium hominis
NTSDIPTCISWSMDGTRLFIGYMNGNVIMCN

SEQ ID NO: 2178763 - protein, 20 aa, Cryptosporidium hominis
NTSFRWGEIQNKISNVDPAL

SEQ ID NO: 2178764 - protein, 35 aa, Cryptosporidium hominis
NTSRSNLRLPPKVPGISSNNAFKFNISQPAQNNQI

SEQ ID NO: 2178765 - protein, 24 aa, Cryptosporidium hominis
NTSSEPIKGIGITIAQIHLIILEI

SEQ ID NO: 2178766 - protein, 19 aa, Cryptosporidium hominis
NTSSLPYLVRYQLESSTIN

SEQ ID NO: 2178767 - protein, 20 aa, Cryptosporidium hominis
NTVICFAKLMNVLPEQYHAT

SEQ ID NO: 2178768 - protein, 18 aa, Cryptosporidium hominis
NTVILQLYMRVVEEYSSR

SEQ ID NO: 2178769 - protein, 19 aa, Cryptosporidium hominis
NTVTCKYYFQSESSKSQLR

SEQ ID NO: 2178770 - protein, 22 aa, Cryptosporidium hominis
NTYQACILLQFNDFISLSLLEL

SEQ ID NO: 2178771 - protein, 17 aa, Cryptosporidium hominis
NTYRSGNLPILYNENNM

SEQ ID NO: 2178772 - protein, 19 aa, Cryptosporidium hominis
NVAPYNRFLILLKDKTCSD

SEQ ID NO: 2178773 - protein, 20 aa, Cryptosporidium hominis
NVDIKIRFFPLRTLTLYLLY

SEQ ID NO: 2178774 - protein, 23 aa, Cryptosporidium hominis
NVDILYICEFCLSFFAHSDEYTR

SEQ ID NO: 2178775 - protein, 19 aa, Cryptosporidium hominis
NVDLIPKFVMASGDLVKIL

SEQ ID NO: 2178776 - protein, 18 aa, Cryptosporidium hominis
NVEFLPRNGTGVIVISPT

SEQ ID NO: 2178777 - protein, 23 aa, Cryptosporidium hominis
NVEKAMWSAFVSVRHTLAKYCDR

SEQ ID NO: 2178778 - protein, 28 aa, Cryptosporidium hominis
NVESIPPRSVHILMGKTFSRDNNIDKKI

SEQ ID NO: 2178779 - protein, 19 aa, Cryptosporidium hominis
NVGHVFKISPRYINHDKIR

SEQ ID NO: 2178780 - protein, 23 aa, Cryptosporidium hominis
NVGIPGMCRNNPMNVGTSPNGRL

SEQ ID NO: 2178781 - protein, 18 aa, Cryptosporidium hominis
NVICKAWMVSRELKGNRA

SEQ ID NO: 2178782 - protein, 17 aa, Cryptosporidium hominis
NVIKPSFTTGKYTLSNL

SEQ ID NO: 2178783 - protein, 26 aa, Cryptosporidium hominis
NVIRKSVIFPKNWFNGIKSTENPLKK

SEQ ID NO: 2178784 - protein, 17 aa, Cryptosporidium hominis
NVIRLNERLNLLKDQEI

SEQ ID NO: 2178785 - protein, 17 aa, Cryptosporidium hominis
NVIRPKRAAAIKAEESI

SEQ ID NO: 2178786 - protein, 27 aa, Cryptosporidium hominis
NVITLRKLYAILSICFNINLLNIDIQN

SEQ ID NO: 2178787 - protein, 35 aa, Cryptosporidium hominis
NVKAHCPFCQIELDWNRVKPFIVLFKPKSEANIEE

SEQ ID NO: 2178788 - protein, 26 aa, Cryptosporidium hominis
NVKALYRRGLARLGFGMYEESKEDFQ

SEQ ID NO: 2178789 - protein, 23 aa, Cryptosporidium hominis
NVKECLALFPIKKFKRFLRLQGF

SEQ ID NO: 2178790 - protein, 28 aa, Cryptosporidium hominis
NVKIVHTLWLWACDGQWQRVSEDLFEGE

SEQ ID NO: 2178791 - protein, 23 aa, Cryptosporidium hominis
NVKWDILQTLDLSYYQFKYIERY

SEQ ID NO: 2178792 - protein, 34 aa, Cryptosporidium hominis
NVLLFPCSHSFHFGCMLLKYTSLMNHDEINKTTR

SEQ ID NO: 2178793 - protein, 24 aa, Cryptosporidium hominis
NVMNMLKFEIDKFLADNPLFYTVV

SEQ ID NO: 2178794 - protein, 25 aa, Cryptosporidium hominis
NVNCWFSLGCVALRLEKWEIAQQAF

SEQ ID NO: 2178795 - protein, 18 aa, Cryptosporidium hominis
NVNLIDIDGAFFGTSFPH

SEQ ID NO: 2178796 - protein, 26 aa, Cryptosporidium hominis
NVNRKRWKVLGDIALEKGRFSMAIAC

SEQ ID NO: 2178797 - protein, 27 aa, Cryptosporidium hominis
NVPRIKKLRAQYWFEKFYWFISSDGYL

SEQ ID NO: 2178798 - protein, 23 aa, Cryptosporidium hominis
NVQGTSWRTVWPNSNLMSNGGIG

SEQ ID NO: 2178799 - protein, 32 aa, Cryptosporidium hominis
NVQLFPTASCLVHLLEFPPFVLSLDEIEVVSF

SEQ ID NO: 2178800 - protein, 20 aa, Cryptosporidium hominis
NVSGKKPCDSNCMPESPSEH

SEQ ID NO: 2178801 - protein, 25 aa, Cryptosporidium hominis
NVSLDITRLLSFYTHEQLSKNKYLN

SEQ ID NO: 2178802 - protein, 24 aa, Cryptosporidium hominis
NVSLELPTICGFTGNPNHSNFVSN

SEQ ID NO: 2178803 - protein, 23 aa, Cryptosporidium hominis
NVSSAAQHFVQWLLESDPKKRPT

SEQ ID NO: 2178804 - protein, 34 aa, Cryptosporidium hominis
NVTCFSPRMLPDWQLNWLRDVTRSLSSVPKSPMT

SEQ ID NO: 2178805 - protein, 50 aa, Cryptosporidium hominis
NVTGKNYTVCYIKNLNQFGGGFKYLSPLGYKPNYSRFIQEISPKFQDGGY

SEQ ID NO: 2178806 - protein, 19 aa, Cryptosporidium hominis
NVTLILYSREILLFPYQNL

SEQ ID NO: 2178807 - protein, 18 aa, Cryptosporidium hominis
NVTYKYDQRWYITEQNKM

SEQ ID NO: 2178808 - protein, 20 aa, Cryptosporidium hominis
NVVFKKVRYNALLKQKQYIS

SEQ ID NO: 2178809 - protein, 24 aa, Cryptosporidium hominis
NVVLRGAIRPEKLSDPCIYIKQLL

SEQ ID NO: 2178810 - protein, 17 aa, Cryptosporidium hominis
NVVYIGGPDNQWLTYNY

SEQ ID NO: 2178811 - protein, 18 aa, Cryptosporidium hominis
NVYRFVPIPFENRLHWNH

SEQ ID NO: 2178812 - protein, 25 aa, Cryptosporidium hominis
NWEVGDANVSIPFFGIHGNHDDPGE

SEQ ID NO: 2178813 - protein, 30 aa, Cryptosporidium hominis
NWHSILCICIYYKYISGVFYISQHCNLHQF

SEQ ID NO: 2178814 - protein, 21 aa, Cryptosporidium hominis
NWIRVLISQRVLNIYKQRELQ

SEQ ID NO: 2178815 - protein, 26 aa, Cryptosporidium hominis
NWLREFKKWLPDANVVLYHGNAYARE

SEQ ID NO: 2178816 - protein, 32 aa, Cryptosporidium hominis
NWNRYYPMNSLRVGLFMTLKISTVNLFKMNPG

SEQ ID NO: 2178817 - protein, 23 aa, Cryptosporidium hominis
NWPDEVVPLLMRRLADIEYRLSR

SEQ ID NO: 2178818 - protein, 17 aa, Cryptosporidium hominis
NWPKADCILILRNMPFD

SEQ ID NO: 2178819 - protein, 23 aa, Cryptosporidium hominis
NWPTARTPLKYVTSMDFSEYGGY

SEQ ID NO: 2178820 - protein, 19 aa, Cryptosporidium hominis
NWSTKVKSWGEKWENNNIT

SEQ ID NO: 2178821 - protein, 28 aa, Cryptosporidium hominis
NYAMRLKEWYGWHFPELGKIISDRDVYA

SEQ ID NO: 2178822 - protein, 18 aa, Cryptosporidium hominis
NYCVKRQILSIAPTLAQQ

SEQ ID NO: 2178823 - protein, 25 aa, Cryptosporidium hominis
NYEPELFPGLVYRYHPDNSPTKAVL

SEQ ID NO: 2178824 - protein, 24 aa, Cryptosporidium hominis
NYERKLKPILKFMGHEKSVQDISW

SEQ ID NO: 2178825 - protein, 18 aa, Cryptosporidium hominis
NYFKFSYLQDWMPEWTRN

SEQ ID NO: 2178826 - protein, 17 aa, Cryptosporidium hominis
NYFNYLWQVGDEFSEIH

SEQ ID NO: 2178827 - protein, 19 aa, Cryptosporidium hominis
NYHVVGLGWGCKVEMNRGG

SEQ ID NO: 2178828 - protein, 25 aa, Cryptosporidium hominis
NYIARKCTICGYISSSTICNGCNLV

SEQ ID NO: 2178829 - protein, 20 aa, Cryptosporidium hominis
NYIEPIKFASIEAFTQEFGE

SEQ ID NO: 2178830 - protein, 20 aa, Cryptosporidium hominis
NYITGLKWADFDNDLEENSL

SEQ ID NO: 2178831 - protein, 24 aa, Cryptosporidium hominis
NYKHKRKFPFLYYYGRQPSINNDY

SEQ ID NO: 2178832 - protein, 24 aa, Cryptosporidium hominis
NYKRLRKANTLSLVGIINFCTTIK

SEQ ID NO: 2178833 - protein, 27 aa, Cryptosporidium hominis
NYKSFLLSYPKLFRIFGKDDNHSIQWI

SEQ ID NO: 2178834 - protein, 24 aa, Cryptosporidium hominis
NYLGIKRSGCKNATFEKKSESKME

SEQ ID NO: 2178835 - protein, 25 aa, Cryptosporidium hominis
NYLKSLCLKCHIPASPIFQTYIEIR

SEQ ID NO: 2178836 - protein, 26 aa, Cryptosporidium hominis
NYLLSEYILLCICSRQKLEFKAYEEN

SEQ ID NO: 2178837 - protein, 22 aa, Cryptosporidium hominis
NYLPELRCICYTGEFKNVSHIV

SEQ ID NO: 2178838 - protein, 24 aa, Cryptosporidium hominis
NYMDPRISVAFCKKYDLPIDKIFN

SEQ ID NO: 2178839 - protein, 17 aa, Cryptosporidium hominis
NYMPLSDCESSQCKNNK

SEQ ID NO: 2178840 - protein, 17 aa, Cryptosporidium hominis
NYNFKMIPLRTCSASIH

SEQ ID NO: 2178841 - protein, 17 aa, Cryptosporidium hominis
NYNSMIWHKSVDLEELE

SEQ ID NO: 2178842 - protein, 28 aa, Cryptosporidium hominis
NYPIGLKRPRFATFDSFGSEYAVLMRSL

SEQ ID NO: 2178843 - protein, 20 aa, Cryptosporidium hominis
NYPKKGMEWDIYTKTVNTKL

SEQ ID NO: 2178844 - protein, 26 aa, Cryptosporidium hominis
NYPYKYKICEEAAKYVFNMLVQVNSN

SEQ ID NO: 2178845 - protein, 18 aa, Cryptosporidium hominis
NYQILKIKSLKEMLEIAL

SEQ ID NO: 2178846 - protein, 24 aa, Cryptosporidium hominis
NYQLEVLSNMGFTDTEACIKALTE

SEQ ID NO: 2178847 - protein, 20 aa, Cryptosporidium hominis
NYRHSIFGNFRWNNKRRRLG

SEQ ID NO: 2178848 - protein, 26 aa, Cryptosporidium hominis
NYSKKWKFGTYWNLIYRNILNRRISI

SEQ ID NO: 2178849 - protein, 19 aa, Cryptosporidium hominis
NYSRLTSCYIQLGEYNNAL

SEQ ID NO: 2178850 - protein, 26 aa, Cryptosporidium hominis
NYSRRFILRLFRQFWGFLDYMDLSLI

SEQ ID NO: 2178851 - protein, 19 aa, Cryptosporidium hominis
NYSSFKFNSNFDNYSKVSK

SEQ ID NO: 2178852 - protein, 30 aa, Cryptosporidium hominis
NYSSKYCLLKNKYLFLGIEFLNETLEKIIS

SEQ ID NO: 2178853 - protein, 20 aa, Cryptosporidium hominis
NYSSNCIRGRMDYISTDVFV

SEQ ID NO: 2178854 - protein, 22 aa, Cryptosporidium hominis
NYTCEVCGSSIWQSVEGTNYMP

SEQ ID NO: 2178855 - protein, 20 aa, Cryptosporidium hominis
NYTTIKWRHIVDIHPSSTLF

SEQ ID NO: 2178856 - protein, 18 aa, Cryptosporidium hominis
NYVAKSPFFLSVKNKYRD

SEQ ID NO: 2178857 - protein, 25 aa, Cryptosporidium hominis
NYVIGVAWHPVHPGIFAAIDADSKL

SEQ ID NO: 2178858 - protein, 22 aa, Cryptosporidium hominis
NYVKTRQYEIVFKKIKDSEIVV

SEQ ID NO: 2178859 - protein, 25 aa, Cryptosporidium hominis
NYYDKYGRFCGFFNNGIFHSFHYHY

SEQ ID NO: 2178860 - protein, 25 aa, Cryptosporidium hominis
NYYSLRPSEVASMFPQQHIADQSPV

SEQ ID NO: 2178861 - protein, 24 aa, Cryptosporidium hominis
NYYYPCRSIFKKKLLDIHVSQLKN

SEQ ID NO: 2178862 - protein, 17 aa, Cryptosporidium hominis
PADSWWNFHKKTCGGCF

SEQ ID NO: 2178863 - protein, 25 aa, Cryptosporidium hominis
PAFLNDLRISSNLLRILFDANKERG

SEQ ID NO: 2178864 - protein, 35 aa, Cryptosporidium hominis
PAGISRLKLVFSYYDWGWKGYLDEFDWKRLRSDIL

SEQ ID NO: 2178865 - protein, 21 aa, Cryptosporidium hominis
PAGNLNGMWYIKGIVTKGIWP

SEQ ID NO: 2178866 - protein, 26 aa, Cryptosporidium hominis
PAILPKSEDGFSMQLHALPHGQAGNA

SEQ ID NO: 2178867 - protein, 18 aa, Cryptosporidium hominis
PAILRPQPLWTGKQIITV

SEQ ID NO: 2178868 - protein, 19 aa, Cryptosporidium hominis
PAKYLKYKCKFEEILSSGF

SEQ ID NO: 2178869 - protein, 20 aa, Cryptosporidium hominis
PALLKRRRNTFETKFNLNQN

SEQ ID NO: 2178870 - protein, 20 aa, Cryptosporidium hominis
PASCANAQFSTHFKNGKSIE

SEQ ID NO: 2178871 - protein, 17 aa, Cryptosporidium hominis
PASRCPEPIKLDNKGLN

SEQ ID NO: 2178872 - protein, 20 aa, Cryptosporidium hominis
PASSPRFVRVNTNLVESSIN

SEQ ID NO: 2178873 - protein, 27 aa, Cryptosporidium hominis
PASSTVFEMIVFRGSDITDLAVCQPAA

SEQ ID NO: 2178874 - protein, 37 aa, Cryptosporidium hominis
PATERCSRSFIWKSNNVFMFPIPIWKSPTQKKNINGR

SEQ ID NO: 2178875 - protein, 17 aa, Cryptosporidium hominis
PATKLPIPGSVAGDEIL

SEQ ID NO: 2178876 - protein, 18 aa, Cryptosporidium hominis
PATMASLMHGNPHAMMMD

SEQ ID NO: 2178877 - protein, 20 aa, Cryptosporidium hominis
PATSTPLIFQNRYQEHHLPS

SEQ ID NO: 2178878 - protein, 18 aa, Cryptosporidium hominis
PAVMQGVELVLLRLGISF

SEQ ID NO: 2178879 - protein, 19 aa, Cryptosporidium hominis
PCDKSRYGVQEFHQELPTE

SEQ ID NO: 2178880 - protein, 20 aa, Cryptosporidium hominis
PCDVHLFLIGIRLRNQNDTN

SEQ ID NO: 2178881 - protein, 20 aa, Cryptosporidium hominis
PCFDEVLFENTFRIHPDKNR

SEQ ID NO: 2178882 - protein, 17 aa, Cryptosporidium hominis
PCGGMIISASFDSSISV

SEQ ID NO: 2178883 - protein, 20 aa, Cryptosporidium hominis
PCIEFYDLRSGLSHFEITIP

SEQ ID NO: 2178884 - protein, 21 aa, Cryptosporidium hominis
PCISCSMALVHSRISKVFYMY

SEQ ID NO: 2178885 - protein, 18 aa, Cryptosporidium hominis
PCISRVPELEGFKFTSIE

SEQ ID NO: 2178886 - protein, 19 aa, Cryptosporidium hominis
PCITTSFDLWIKNEDREFR

SEQ ID NO: 2178887 - protein, 25 aa, Cryptosporidium hominis
PCKNLLMGLTCYGWIYIWNIEQLGN

SEQ ID NO: 2178888 - protein, 20 aa, Cryptosporidium hominis
PCNGDFMFHYIYKYEKSLSL

SEQ ID NO: 2178889 - protein, 18 aa, Cryptosporidium hominis
PCNKELEAIFFDWKEFKI

SEQ ID NO: 2178890 - protein, 20 aa, Cryptosporidium hominis
PCNLSSLNSPKCNTDFNSLS

SEQ ID NO: 2178891 - protein, 23 aa, Cryptosporidium hominis
PCNYWLCAATDKCIRIWELEHKL

SEQ ID NO: 2178892 - protein, 26 aa, Cryptosporidium hominis
PCRRYHKRLKLLPPVNPDECYMLTDS

SEQ ID NO: 2178893 - protein, 23 aa, Cryptosporidium hominis
PCRTARFGTAMVHNGLLKLKLSK

SEQ ID NO: 2178894 - protein, 18 aa, Cryptosporidium hominis
PDAPLCMFVSKMVPTSDK

SEQ ID NO: 2178895 - protein, 19 aa, Cryptosporidium hominis
PDCIIPFAEWAAALLSQMD

SEQ ID NO: 2178896 - protein, 17 aa, Cryptosporidium hominis
PDDCLWSIIDGKTIQIV

SEQ ID NO: 2178897 - protein, 19 aa, Cryptosporidium hominis
PDDIFKRSILRKFNSHDQS

SEQ ID NO: 2178898 - protein, 23 aa, Cryptosporidium hominis
PDDRFRALCKHFSPKSEVPATLT

SEQ ID NO: 2178899 - protein, 21 aa, Cryptosporidium hominis
PDDVGICRSIIGYLRNNGNEE

SEQ ID NO: 2178900 - protein, 20 aa, Cryptosporidium hominis
PDDYIDAAVRQCLKIHCTNP

SEQ ID NO: 2178901 - protein, 19 aa, Cryptosporidium hominis
PDEAVAMGAAIQAGVLKGE

SEQ ID NO: 2178902 - protein, 21 aa, Cryptosporidium hominis
PDEDPPFFLNIRIISDKWVNL

SEQ ID NO: 2178903 - protein, 19 aa, Cryptosporidium hominis
PDEESRVLLIKNGLKSINH

SEQ ID NO: 2178904 - protein, 27 aa, Cryptosporidium hominis
PDEQSCIRYRISWFEFLIGKRDRSYSE

SEQ ID NO: 2178905 - protein, 23 aa, Cryptosporidium hominis
PDFKDQSFCYVRKQLIIGNEANV

SEQ ID NO: 2178906 - protein, 34 aa, Cryptosporidium hominis
PDFSEMYADLCQILKWRSPVLVNKDGKSTIAFSK

SEQ ID NO: 2178907 - protein, 18 aa, Cryptosporidium hominis
PDIDDAIYNTNWRDDAGR

SEQ ID NO: 2178908 - protein, 18 aa, Cryptosporidium hominis
PDIIERMDFGSYNNFLIE

SEQ ID NO: 2178909 - protein, 25 aa, Cryptosporidium hominis
PDKLDDFRKLYAMWNRCMLSDEDFI

SEQ ID NO: 2178910 - protein, 20 aa, Cryptosporidium hominis
PDKRNGIILTGYAVRGTPAY

SEQ ID NO: 2178911 - protein, 19 aa, Cryptosporidium hominis
PDKVLSLDFSYSGCVNESM

SEQ ID NO: 2178912 - protein, 19 aa, Cryptosporidium hominis
PDLFPCVILNSIYTLNMLR

SEQ ID NO: 2178913 - protein, 27 aa, Cryptosporidium hominis
PDLLDSALLRPGRLDRIIYIGLPDSKA

SEQ ID NO: 2178914 - protein, 18 aa, Cryptosporidium hominis
PDLLKGIYNKGFNRPSKI

SEQ ID NO: 2178915 - protein, 18 aa, Cryptosporidium hominis
PDLLSPNCNGLFGPDLNN

SEQ ID NO: 2178916 - protein, 17 aa, Cryptosporidium hominis
PDLYESYGIKSYKYEKI

SEQ ID NO: 2178917 - protein, 27 aa, Cryptosporidium hominis
PDPHLKWQIPSFIIGGNPRLQGSTIID

SEQ ID NO: 2178918 - protein, 25 aa, Cryptosporidium hominis
PDPIKFKIVFIAPMKSLVSEITRKY

SEQ ID NO: 2178919 - protein, 24 aa, Cryptosporidium hominis
PDPNLRPTPEMALRHEFFRYKFEE

SEQ ID NO: 2178920 - protein, 19 aa, Cryptosporidium hominis
PDPPPCITTSFDLWIKNED

SEQ ID NO: 2178921 - protein, 17 aa, Cryptosporidium hominis
PDQLVPLPIGYFKHDFR

SEQ ID NO: 2178922 - protein, 34 aa, Cryptosporidium hominis
PDQLYEESIIDFLKKNGRTNMAMIGNKIKRPEGV

SEQ ID NO: 2178923 - protein, 23 aa, Cryptosporidium hominis
PDSARFMILIRNAMEDLQHQVET

SEQ ID NO: 2178924 - protein, 20 aa, Cryptosporidium hominis
PDSLKSLGWDNSIIVRVLNI

SEQ ID NO: 2178925 - protein, 24 aa, Cryptosporidium hominis
PDSLLSRFDLIFIVKDSRNSQQDR

SEQ ID NO: 2178926 - protein, 19 aa, Cryptosporidium hominis
PDTKLEEFCETISQRKEGR

SEQ ID NO: 2178927 - protein, 23 aa, Cryptosporidium hominis
PDVGYCQGMNFIAALLLITSNFD

SEQ ID NO: 2178928 - protein, 32 aa, Cryptosporidium hominis
PDVPRPTYKQVIWCCFGLLSGELELSLFEDIC

SEQ ID NO: 2178929 - protein, 17 aa, Cryptosporidium hominis
PDVRFLSKMFHPNIYPD

SEQ ID NO: 2178930 - protein, 21 aa, Cryptosporidium hominis
PDYIQLCKLREEFPNVPIIAL

SEQ ID NO: 2178931 - protein, 19 aa, Cryptosporidium hominis
PEALKPLFDAVRESSSIDS

SEQ ID NO: 2178932 - protein, 19 aa, Cryptosporidium hominis
PECNNILCPKENIERRKLL

SEQ ID NO: 2178933 - protein, 28 aa, Cryptosporidium hominis
PEDERACEILKKLMEIEPKFNYDPPGTI

SEQ ID NO: 2178934 - protein, 25 aa, Cryptosporidium hominis
PEDIHGMAVVLILGSYRNEEFIRIG

SEQ ID NO: 2178935 - protein, 27 aa, Cryptosporidium hominis
PEDKYGESYPFFPPGIKPAPIDGDENN

SEQ ID NO: 2178936 - protein, 19 aa, Cryptosporidium hominis
PEEKMKFAFDIYDVNSDGW

SEQ ID NO: 2178937 - protein, 17 aa, Cryptosporidium hominis
PEEPCWDSPWGKGRPGW

SEQ ID NO: 2178938 - protein, 19 aa, Cryptosporidium hominis
PEFATYLHYCRVLRFEDRP

SEQ ID NO: 2178939 - protein, 24 aa, Cryptosporidium hominis
PEFEELKFDPGEIPLIDYQEHEDR

SEQ ID NO: 2178940 - protein, 22 aa, Cryptosporidium hominis
PEFEIKPKFESELEPELEPELE

SEQ ID NO: 2178941 - protein, 20 aa, Cryptosporidium hominis
PEFILDLYGNELFQNMTKDF

SEQ ID NO: 2178942 - protein, 19 aa, Cryptosporidium hominis
PEFLSFRPNFSREVVGPPG

SEQ ID NO: 2178943 - protein, 17 aa, Cryptosporidium hominis
PEFMKFYSLKLPMKLAN

SEQ ID NO: 2178944 - protein, 24 aa, Cryptosporidium hominis
PEFVNNHIFKNCYSFIIEENNNHN

SEQ ID NO: 2178945 - protein, 20 aa, Cryptosporidium hominis
PEGCRSIRSLLLGDDEGINK

SEQ ID NO: 2178946 - protein, 20 aa, Cryptosporidium hominis
PEHIKRTLLQLLSHKAISIS

SEQ ID NO: 2178947 - protein, 20 aa, Cryptosporidium hominis
PEIKTCIVFRHLNGPIEFVK

SEQ ID NO: 2178948 - protein, 17 aa, Cryptosporidium hominis
PEILVRIYSLLIDSKEE

SEQ ID NO: 2178949 - protein, 25 aa, Cryptosporidium hominis
PEIPSFFPPCLKKLCSKCLQTDPNL

SEQ ID NO: 2178950 - protein, 26 aa, Cryptosporidium hominis
PEIQKLILEFLFSFKTSKKLSLVNKE

SEQ ID NO: 2178951 - protein, 17 aa, Cryptosporidium hominis
PEIQNSVSIFGSNIANM

SEQ ID NO: 2178952 - protein, 17 aa, Cryptosporidium hominis
PEIRVVDKIVEIPTIKH

SEQ ID NO: 2178953 - protein, 17 aa, Cryptosporidium hominis
PEIVAGVAPGIPGPSGV

SEQ ID NO: 2178954 - protein, 25 aa, Cryptosporidium hominis
PEKEAISSFLLGRNSLYSPTSVLSL

SEQ ID NO: 2178955 - protein, 20 aa, Cryptosporidium hominis
PEKIDTMIIQAVALLDDLDR

SEQ ID NO: 2178956 - protein, 21 aa, Cryptosporidium hominis
PEKKANIEIIKDSNITDKKVD

SEQ ID NO: 2178957 - protein, 27 aa, Cryptosporidium hominis
PELFTPNLLKVIYRIFLFNNLLNNTNL

SEQ ID NO: 2178958 - protein, 35 aa, Cryptosporidium hominis
PELLCIECKEELFSFEGFRYQCKQVKNSVSNLESI

SEQ ID NO: 2178959 - protein, 19 aa, Cryptosporidium hominis
PELSFKLFNIHDMSFSRKK

SEQ ID NO: 2178960 - protein, 26 aa, Cryptosporidium hominis
PEMCLKGHLNWVLTLAWSPDSTLLAS

SEQ ID NO: 2178961 - protein, 22 aa, Cryptosporidium hominis
PEMFASEIPQNFPIETNPEAIL

SEQ ID NO: 2178962 - protein, 27 aa, Cryptosporidium hominis
PENCGDVRLWICIGDCYLAKNEVANNY

SEQ ID NO: 2178963 - protein, 28 aa, Cryptosporidium hominis
PENEFKFVLLILNWAASVLMVTKAFEVK

SEQ ID NO: 2178964 - protein, 27 aa, Cryptosporidium hominis
PENEVFSLYCVFAFKKIEDSNINLDEQ

SEQ ID NO: 2178965 - protein, 25 aa, Cryptosporidium hominis
PENFKFDVDRGIKLKLGQIIGKVLD

SEQ ID NO: 2178966 - protein, 23 aa, Cryptosporidium hominis
PENRLHRKYAYMIVYDLIQVLKE

SEQ ID NO: 2178967 - protein, 26 aa, Cryptosporidium hominis
PENRTLIYRILTLMIPYFSNITSNLI

SEQ ID NO: 2178968 - protein, 24 aa, Cryptosporidium hominis
PEPITRYLIMFGYVIRTQKKYESS

SEQ ID NO: 2178969 - protein, 24 aa, Cryptosporidium hominis
PERLDYYALCSLQILELPNSQNYL

SEQ ID NO: 2178970 - protein, 28 aa, Cryptosporidium hominis
PESDIIKLCTMYPYLNPRYFLNKNAKKG

SEQ ID NO: 2178971 - protein, 17 aa, Cryptosporidium hominis
PESESEFIKSLLEEYKA

SEQ ID NO: 2178972 - protein, 24 aa, Cryptosporidium hominis
PESHELPIFMSIIDFGRSLDIGEI

SEQ ID NO: 2178973 - protein, 22 aa, Cryptosporidium hominis
PESKDNFCLKSLIKNTNEIYKD

SEQ ID NO: 2178974 - protein, 22 aa, Cryptosporidium hominis
PESRLSSSRITYFGGKSRTGSD

SEQ ID NO: 2178975 - protein, 19 aa, Cryptosporidium hominis
PETAQGIFVNFKRLYEYNG

SEQ ID NO: 2178976 - protein, 32 aa, Cryptosporidium hominis
PETGTIVGFVQPRFADYASYYFPDGTPSWFPP

SEQ ID NO: 2178977 - protein, 17 aa, Cryptosporidium hominis
PETKFLFPVTIEDHTCS

SEQ ID NO: 2178978 - protein, 21 aa, Cryptosporidium hominis
PETKFPLSKIEFYSNWKNIIN

SEQ ID NO: 2178979 - protein, 24 aa, Cryptosporidium hominis
PETTISGFILFKGLENSFKPRIYL

SEQ ID NO: 2178980 - protein, 19 aa, Cryptosporidium hominis
PEVESLMAVGFFDGDIAYY

SEQ ID NO: 2178981 - protein, 22 aa, Cryptosporidium hominis
PEVESSRKFGFVGFYSEEDAKK

SEQ ID NO: 2178982 - protein, 18 aa, Cryptosporidium hominis
PEYSRLWLDSTLGTGTCL

SEQ ID NO: 2178983 - protein, 19 aa, Cryptosporidium hominis
PFADFACEVCRLNDHEEVL

SEQ ID NO: 2178984 - protein, 19 aa, Cryptosporidium hominis
PFEGMPSLVSSIFNTESSK

SEQ ID NO: 2178985 - protein, 18 aa, Cryptosporidium hominis
PFGAWKTSVGNTIGENII

SEQ ID NO: 2178986 - protein, 18 aa, Cryptosporidium hominis
PFGGFGMDDLNESGGFMI

SEQ ID NO: 2178987 - protein, 20 aa, Cryptosporidium hominis
PFGIPNFIANMYLKKGSISN

SEQ ID NO: 2178988 - protein, 26 aa, Cryptosporidium hominis
PFHLYYKKRIEDFKNGVSIDSSGPTI

SEQ ID NO: 2178989 - protein, 26 aa, Cryptosporidium hominis
PFIKLLTNFVNLVFGITLFLNNKKPN

SEQ ID NO: 2178990 - protein, 18 aa, Cryptosporidium hominis
PFISCGSRSSAIISPTGK

SEQ ID NO: 2178991 - protein, 20 aa, Cryptosporidium hominis
PFKILVKFSRSSVTSSKITL

SEQ ID NO: 2178992 - protein, 28 aa, Cryptosporidium hominis
PFLDVYWKGDITFRISIFHPTELEQIAK

SEQ ID NO: 2178993 - protein, 19 aa, Cryptosporidium hominis
PFLGICLGMQLSVVEFCKN

SEQ ID NO: 2178994 - protein, 21 aa, Cryptosporidium hominis
PFLLNLRHFYQFNFITQRHRR

SEQ ID NO: 2178995 - protein, 18 aa, Cryptosporidium hominis
PFMLRRLKADVERDLPPK

SEQ ID NO: 2178996 - protein, 18 aa, Cryptosporidium hominis
PFPGPGLSINVICYDGKS

SEQ ID NO: 2178997 - protein, 22 aa, Cryptosporidium hominis
PFPGPPACRPIFDENNKKHLRN

SEQ ID NO: 2178998 - protein, 25 aa, Cryptosporidium hominis
PFPKDLKPKIFKGTSNFQFPYLRSL

SEQ ID NO: 2178999 - protein, 26 aa, Cryptosporidium hominis
PFPPFQVKITQRFRRNRNNSVPPPRP

SEQ ID NO: 2179000 - protein, 21 aa, Cryptosporidium hominis
PFRKLIRYFRDVAAIHEGIID

SEQ ID NO: 2179001 - protein, 22 aa, Cryptosporidium hominis
PFSHIERFTRILLYSPKLNEYV

SEQ ID NO: 2179002 - protein, 23 aa, Cryptosporidium hominis
PFSPEIEDGGIIPPEVAAANADK

SEQ ID NO: 2179003 - protein, 20 aa, Cryptosporidium hominis
PFSSMMNFTFFDQAKKILQS

SEQ ID NO: 2179004 - protein, 25 aa, Cryptosporidium hominis
PFVECVRCGVVSHVACYGVNIPLNE

SEQ ID NO: 2179005 - protein, 32 aa, Cryptosporidium hominis
PFVIPSKRIIIEWPLYLLKNLKALDFENNDFS

SEQ ID NO: 2179006 - protein, 18 aa, Cryptosporidium hominis
PFYIPVIVGLIGKDSCKE

SEQ ID NO: 2179007 - protein, 18 aa, Cryptosporidium hominis
PGAGLGHLNGHRIQSTNL

SEQ ID NO: 2179008 - protein, 19 aa, Cryptosporidium hominis
PGCRKCVIATNIAEASLTI

SEQ ID NO: 2179009 - protein, 24 aa, Cryptosporidium hominis
PGDTRFHFGCHCGNPIVLNHFCQG

SEQ ID NO: 2179010 - protein, 18 aa, Cryptosporidium hominis
PGEMFLKTSNSIKYEFPK

SEQ ID NO: 2179011 - protein, 22 aa, Cryptosporidium hominis
PGENGICGGINNYSICTNNHMG

SEQ ID NO: 2179012 - protein, 19 aa, Cryptosporidium hominis
PGGFGKRGINGKIEAINYS

SEQ ID NO: 2179013 - protein, 17 aa, Cryptosporidium hominis
PGGKCLLFGGYDGNCWK

SEQ ID NO: 2179014 - protein, 21 aa, Cryptosporidium hominis
PGIDEALGFATLMQSVKSMSY

SEQ ID NO: 2179015 - protein, 17 aa, Cryptosporidium hominis
PGIVSLKKDIDIYFISL

SEQ ID NO: 2179016 - protein, 20 aa, Cryptosporidium hominis
PGKNKFGSLFGKMQNNIIAL

SEQ ID NO: 2179017 - protein, 18 aa, Cryptosporidium hominis
PGLADRVSKSLAEDDKLS

SEQ ID NO: 2179018 - protein, 19 aa, Cryptosporidium hominis
PGLFDAKLINFTGSTNSSS

SEQ ID NO: 2179019 - protein, 17 aa, Cryptosporidium hominis
PGLGIGMGMGIGMGMGV

SEQ ID NO: 2179020 - protein, 21 aa, Cryptosporidium hominis
PGLIRCLPQLLIHVDTSMRDA

SEQ ID NO: 2179021 - protein, 20 aa, Cryptosporidium hominis
PGMRLVEIMSRITISFGSVL

SEQ ID NO: 2179022 - protein, 26 aa, Cryptosporidium hominis
PGNTCIKNILLYPSFSLLNLSPAIMD

SEQ ID NO: 2179023 - protein, 31 aa, Cryptosporidium hominis
PGPEERLRLVFSVNYPNIWEAKKELGIRMMR

SEQ ID NO: 2179024 - protein, 22 aa, Cryptosporidium hominis
PGQIQSILWYFRYVVRDFIQFL

SEQ ID NO: 2179025 - protein, 24 aa, Cryptosporidium hominis
PGQNSWAAFCARNDIPRKKNADLN

SEQ ID NO: 2179026 - protein, 18 aa, Cryptosporidium hominis
PGSGTGIGIGIGIGTGIG

SEQ ID NO: 2179027 - protein, 18 aa, Cryptosporidium hominis
PGSKFQIGELVWVNYKCT

SEQ ID NO: 2179028 - protein, 18 aa, Cryptosporidium hominis
PGSSREGITYSVKSGLVA

SEQ ID NO: 2179029 - protein, 26 aa, Cryptosporidium hominis
PGSYSIWKKLCLKLLNLPYHPNVMKI

SEQ ID NO: 2179030 - protein, 19 aa, Cryptosporidium hominis
PGTGKYSLVKDMLKKNDSI

SEQ ID NO: 2179031 - protein, 19 aa, Cryptosporidium hominis
PGTHRGYGFIEFGTADQAK

SEQ ID NO: 2179032 - protein, 21 aa, Cryptosporidium hominis
PGTPVTFETFMEWKKKKEKEE

SEQ ID NO: 2179033 - protein, 21 aa, Cryptosporidium hominis
PGVGVNPQIAPGVGVNSQITP

SEQ ID NO: 2179034 - protein, 18 aa, Cryptosporidium hominis
PGVSCWNGSDGILVQTES

SEQ ID NO: 2179035 - protein, 19 aa, Cryptosporidium hominis
PGWICYSEKSLNSSVLPLL

SEQ ID NO: 2179036 - protein, 28 aa, Cryptosporidium hominis
PGYISYYLVRQFPEYQLKLHGGDFDVWN

SEQ ID NO: 2179037 - protein, 17 aa, Cryptosporidium hominis
PHAPPLVNRTRNIYIVT

SEQ ID NO: 2179038 - protein, 21 aa, Cryptosporidium hominis
PHFEYAFKLCEELLTPIEKIT

SEQ ID NO: 2179039 - protein, 17 aa, Cryptosporidium hominis
PHICFNFSFENKMTEKE

SEQ ID NO: 2179040 - protein, 24 aa, Cryptosporidium hominis
PHIRCQRGVIGIHYLLQIPQFRHR

SEQ ID NO: 2179041 - protein, 32 aa, Cryptosporidium hominis
PHLEHVNGFMFSMVVSYTWNNVYLLGRYIKFS

SEQ ID NO: 2179042 - protein, 24 aa, Cryptosporidium hominis
PHNKVCGMAGVLDSSRFRTFIAQH

SEQ ID NO: 2179043 - protein, 29 aa, Cryptosporidium hominis
PHNNKSCPCCDQLSKRSKCRCHYADASVN

SEQ ID NO: 2179044 - protein, 22 aa, Cryptosporidium hominis
PHPRPKLGMEIGNWDTPEYEPH

SEQ ID NO: 2179045 - protein, 19 aa, Cryptosporidium hominis
PHSGFGLGFERLIMMVTGV

SEQ ID NO: 2179046 - protein, 20 aa, Cryptosporidium hominis
PHYFTLIRFLGLISNTSMAI

SEQ ID NO: 2179047 - protein, 20 aa, Cryptosporidium hominis
PIASFPGIESILSTQNNLLS

SEQ ID NO: 2179048 - protein, 26 aa, Cryptosporidium hominis
PIASNSYVWRCLKSNLRGCEGLIERI

SEQ ID NO: 2179049 - protein, 19 aa, Cryptosporidium hominis
PICEIHKICFNDRTSNNFP

SEQ ID NO: 2179050 - protein, 19 aa, Cryptosporidium hominis
PICSGSSASFCTIQAEYPS

SEQ ID NO: 2179051 - protein, 21 aa, Cryptosporidium hominis
PIDIWSIGCVLYECFTGDIMF

SEQ ID NO: 2179052 - protein, 23 aa, Cryptosporidium hominis
PIDQKLLCKYIRYARKYCKPQIR

SEQ ID NO: 2179053 - protein, 26 aa, Cryptosporidium hominis
PIEDYCMFPLDSVYRLSTTNTNGIPT

SEQ ID NO: 2179054 - protein, 24 aa, Cryptosporidium hominis
PIFIKVPIIISNYFLQESSQILFI

SEQ ID NO: 2179055 - protein, 25 aa, Cryptosporidium hominis
PIFIQWLDCVYQCYNQFPTEFQFHP

SEQ ID NO: 2179056 - protein, 17 aa, Cryptosporidium hominis
PIFKIIKAVSRFIIDSS

SEQ ID NO: 2179057 - protein, 18 aa, Cryptosporidium hominis
PIFKNGYQLFDYQLAGLN

SEQ ID NO: 2179058 - protein, 20 aa, Cryptosporidium hominis
PIFRFKSMTSLLCKPLSQQI

SEQ ID NO: 2179059 - protein, 20 aa, Cryptosporidium hominis
PIFSPLMIRNINALRIYWDY

SEQ ID NO: 2179060 - protein, 30 aa, Cryptosporidium hominis
PIGGFKNLMGMRGPQRFSIHKSFGENRLPS

SEQ ID NO: 2179061 - protein, 17 aa, Cryptosporidium hominis
PIGIPGNMFILNPYLEV

SEQ ID NO: 2179062 - protein, 17 aa, Cryptosporidium hominis
PIGVILVIFEARPEVAI

SEQ ID NO: 2179063 - protein, 18 aa, Cryptosporidium hominis
PIHIPDICVNEYIKQGHD

SEQ ID NO: 2179064 - protein, 23 aa, Cryptosporidium hominis
PIHSEVYIRYGILSSSECLFGYG

SEQ ID NO: 2179065 - protein, 17 aa, Cryptosporidium hominis
PIHTFKRGLIFAQNQNS

SEQ ID NO: 2179066 - protein, 19 aa, Cryptosporidium hominis
PIIAFRAARKITQITDKVF

SEQ ID NO: 2179067 - protein, 17 aa, Cryptosporidium hominis
PIIDKFSGIILAGNILR

SEQ ID NO: 2179068 - protein, 19 aa, Cryptosporidium hominis
PIIKCGPLLETERSFEEYI

SEQ ID NO: 2179069 - protein, 26 aa, Cryptosporidium hominis
PIIKEMTEILFTRGLIKVLFATETIS

SEQ ID NO: 2179070 - protein, 24 aa, Cryptosporidium hominis
PIIQSRLGILTWYARMDPRVVHVV

SEQ ID NO: 2179071 - protein, 19 aa, Cryptosporidium hominis
PIIRMLHIHTDIVLDISIA

SEQ ID NO: 2179072 - protein, 25 aa, Cryptosporidium hominis
PIKIEEVDHFFTFMEQLLYNEIVGS

SEQ ID NO: 2179073 - protein, 17 aa, Cryptosporidium hominis
PILESGLSPDVRYNNYM

SEQ ID NO: 2179074 - protein, 21 aa, Cryptosporidium hominis
PILFCTPHNFGAGYFTVPNAY

SEQ ID NO: 2179075 - protein, 22 aa, Cryptosporidium hominis
PILRYYVSEISKFYKGFKNIWE

SEQ ID NO: 2179076 - protein, 22 aa, Cryptosporidium hominis
PINILKYRLSYYNRKFNAQINY

SEQ ID NO: 2179077 - protein, 24 aa, Cryptosporidium hominis
PINPRAPIEWHWTFHTPEDLTFLR

SEQ ID NO: 2179078 - protein, 20 aa, Cryptosporidium hominis
PINSRYGSKIFLYLLTRLQG

SEQ ID NO: 2179079 - protein, 19 aa, Cryptosporidium hominis
PIPRILQGLEVFNLTGRDL

SEQ ID NO: 2179080 - protein, 18 aa, Cryptosporidium hominis
PIPSMISLGGLNGNLTRN

SEQ ID NO: 2179081 - protein, 24 aa, Cryptosporidium hominis
PIPVRKRVVPKFKMTEEVYEVECV

SEQ ID NO: 2179082 - protein, 34 aa, Cryptosporidium hominis
PIQFKISRYFLEVMKAIILSGGYGSRLRPLTLTK

SEQ ID NO: 2179083 - protein, 18 aa, Cryptosporidium hominis
PIQMAFFIISACELSDKK

SEQ ID NO: 2179084 - protein, 18 aa, Cryptosporidium hominis
PIQRGLVSYIILDPNEED

SEQ ID NO: 2179085 - protein, 24 aa, Cryptosporidium hominis
PIRDPRYQCHICHALYSTHPAMIS

SEQ ID NO: 2179086 - protein, 24 aa, Cryptosporidium hominis
PIREMPIPFFTASLPLIGQLAANA

SEQ ID NO: 2179087 - protein, 30 aa, Cryptosporidium hominis
PISNDGYYWMGYNFMKDNDPVFTLLFNETY

SEQ ID NO: 2179088 - protein, 25 aa, Cryptosporidium hominis
PISSLHTPLAWSFYLVSGNMLPIDG

SEQ ID NO: 2179089 - protein, 32 aa, Cryptosporidium hominis
PITERWDKERVAICGEKGVYIWSFEYNGNHKK

SEQ ID NO: 2179090 - protein, 30 aa, Cryptosporidium hominis
PITHPLRYIKGLKQCFEYVKSIEEENIILI

SEQ ID NO: 2179091 - protein, 23 aa, Cryptosporidium hominis
PITKLCQAYHSLYDLLLGGINNN

SEQ ID NO: 2179092 - protein, 18 aa, Cryptosporidium hominis
PITLAPSISSISCRLFIN

SEQ ID NO: 2179093 - protein, 20 aa, Cryptosporidium hominis
PIVHTFLHLLSIAKTYKDDV

SEQ ID NO: 2179094 - protein, 25 aa, Cryptosporidium hominis
PIVKQWKKGHFFKLFEDSESPPICT

SEQ ID NO: 2179095 - protein, 18 aa, Cryptosporidium hominis
PKCISIIASLLSDIKTER

SEQ ID NO: 2179096 - protein, 21 aa, Cryptosporidium hominis
PKDGRSLGICLIEYVNSDSAP

SEQ ID NO: 2179097 - protein, 19 aa, Cryptosporidium hominis
PKDIFPIMIVGTRVTNETV

SEQ ID NO: 2179098 - protein, 18 aa, Cryptosporidium hominis
PKDYPIASCTGRIKSDKE

SEQ ID NO: 2179099 - protein, 22 aa, Cryptosporidium hominis
PKEAWKNDQFLSILQNVTNVDI

SEQ ID NO: 2179100 - protein, 24 aa, Cryptosporidium hominis
PKEKINDVILVGGMTRMPKVSETV

SEQ ID NO: 2179101 - protein, 18 aa, Cryptosporidium hominis
PKEVRDFLSHGGNDFGSR

SEQ ID NO: 2179102 - protein, 17 aa, Cryptosporidium hominis
PKFESNIAFSEHDLREI

SEQ ID NO: 2179103 - protein, 18 aa, Cryptosporidium hominis
PKFFWKRKSNFSFISEIN

SEQ ID NO: 2179104 - protein, 20 aa, Cryptosporidium hominis
PKFQIEVGFWKAASTLKYDV

SEQ ID NO: 2179105 - protein, 18 aa, Cryptosporidium hominis
PKGAVLTHRAWISCAAAF

SEQ ID NO: 2179106 - protein, 24 aa, Cryptosporidium hominis
PKGKRGRPRLRPLEPEEKVEPEAA

SEQ ID NO: 2179107 - protein, 17 aa, Cryptosporidium hominis
PKGSHLIRSPGMVPQDL

SEQ ID NO: 2179108 - protein, 21 aa, Cryptosporidium hominis
PKGWIPSSVTKMIAAKMVPGS

SEQ ID NO: 2179109 - protein, 20 aa, Cryptosporidium hominis
PKHIKEWFLSNSICPSGCGH

SEQ ID NO: 2179110 - protein, 24 aa, Cryptosporidium hominis
PKHILKKIVEEIAVQAGRGGRRHI

SEQ ID NO: 2179111 - protein, 26 aa, Cryptosporidium hominis
PKIAEWVKEHIDGVIIPYSAEFETAL

SEQ ID NO: 2179112 - protein, 20 aa, Cryptosporidium hominis
PKIEAIIFCKFDEELGPIVL

SEQ ID NO: 2179113 - protein, 27 aa, Cryptosporidium hominis
PKIISELPTGIKSELIAILSNKKANPT

SEQ ID NO: 2179114 - protein, 17 aa, Cryptosporidium hominis
PKIKYKFIKSCSIGKFS

SEQ ID NO: 2179115 - protein, 27 aa, Cryptosporidium hominis
PKIQKSSFPHGSFRPSSSNISINNGIN

SEQ ID NO: 2179116 - protein, 23 aa, Cryptosporidium hominis
PKIQTRIGAVIKPLVYSKHLKNI

SEQ ID NO: 2179117 - protein, 19 aa, Cryptosporidium hominis
PKISFIKHLASYSVTIPSL

SEQ ID NO: 2179118 - protein, 25 aa, Cryptosporidium hominis
PKISKFRGNALIKNCRKITKEGKCK

SEQ ID NO: 2179119 - protein, 18 aa, Cryptosporidium hominis
PKKCVDTGMGLERLVSIL

SEQ ID NO: 2179120 - protein, 20 aa, Cryptosporidium hominis
PKKEFKVIIRFLYTSYLDET

SEQ ID NO: 2179121 - protein, 17 aa, Cryptosporidium hominis
PKKEILLYVPLTNMQRR

SEQ ID NO: 2179122 - protein, 18 aa, Cryptosporidium hominis
PKKFANVTTLGFENGKKL

SEQ ID NO: 2179123 - protein, 21 aa, Cryptosporidium hominis
PKKHTFIEFCELTKIQKKQYD

SEQ ID NO: 2179124 - protein, 19 aa, Cryptosporidium hominis
PKKIFKIEEIFFKSQKMIY

SEQ ID NO: 2179125 - protein, 17 aa, Cryptosporidium hominis
PKLAEKWYVNKYLELRT

SEQ ID NO: 2179126 - protein, 18 aa, Cryptosporidium hominis
PKLEYEIGPIDHWINGYV

SEQ ID NO: 2179127 - protein, 17 aa, Cryptosporidium hominis
PKLGDEISIDIPKNTDS

SEQ ID NO: 2179128 - protein, 35 aa, Cryptosporidium hominis
PKLKKMSLSNNCLKQFPFSLNFNMVQELRLNNNKI

SEQ ID NO: 2179129 - protein, 22 aa, Cryptosporidium hominis
PKLNYIHYILAIIQRINEIDFK

SEQ ID NO: 2179130 - protein, 20 aa, Cryptosporidium hominis
PKLSCFARDALRQIKQKKLS

SEQ ID NO: 2179131 - protein, 18 aa, Cryptosporidium hominis
PKLSERVVEFYGFNQDEI

SEQ ID NO: 2179132 - protein, 17 aa, Cryptosporidium hominis
PKLSLSHETKFNESLEK

SEQ ID NO: 2179133 - protein, 22 aa, Cryptosporidium hominis
PKMLQFHLLLAIRSVVANLGVQ

SEQ ID NO: 2179134 - protein, 19 aa, Cryptosporidium hominis
PKNHCPKLKKMSLSNNCLK

SEQ ID NO: 2179135 - protein, 19 aa, Cryptosporidium hominis
PKNSWAIGKTMVFLSKDAA

SEQ ID NO: 2179136 - protein, 33 aa, Cryptosporidium hominis
PKNTRKLLWTHLGWCILVYPNGDIKAIKPDKNI

SEQ ID NO: 2179137 - protein, 19 aa, Cryptosporidium hominis
PKPLQMLFHFALKQKEKSN

SEQ ID NO: 2179138 - protein, 20 aa, Cryptosporidium hominis
PKPYLKRKSKSIVPSKGTDI

SEQ ID NO: 2179139 - protein, 17 aa, Cryptosporidium hominis
PKQAEKLLGIFKGGHHF

SEQ ID NO: 2179140 - protein, 29 aa, Cryptosporidium hominis
PKQEIKGDLYFRCLLALEYSKSKDLSVDC

SEQ ID NO: 2179141 - protein, 22 aa, Cryptosporidium hominis
PKQSLRLLLFINEQEKQSKKST

SEQ ID NO: 2179142 - protein, 18 aa, Cryptosporidium hominis
PKQVLPVHGKNVIDDFDD

SEQ ID NO: 2179143 - protein, 18 aa, Cryptosporidium hominis
PKRISGKEAVSCVNGSII

SEQ ID NO: 2179144 - protein, 23 aa, Cryptosporidium hominis
PKRPHNAYTLWCEHIRQKVREKD

SEQ ID NO: 2179145 - protein, 23 aa, Cryptosporidium hominis
PKRRLGIWRKVFGEKGESKKCFV

SEQ ID NO: 2179146 - protein, 24 aa, Cryptosporidium hominis
PKSEIWAKLILERLIRIDNSENWH

SEQ ID NO: 2179147 - protein, 21 aa, Cryptosporidium hominis
PKSGISTPFVYEGQARAIKKQ

SEQ ID NO: 2179148 - protein, 24 aa, Cryptosporidium hominis
PKSNEFLLCKGIIPPELTLNSGID

SEQ ID NO: 2179149 - protein, 33 aa, Cryptosporidium hominis
PKSPFFDLDYGKFYYTRALELLSNIEYIVRVSG

SEQ ID NO: 2179150 - protein, 18 aa, Cryptosporidium hominis
PKSSGLIFSPIKRSGTYH

SEQ ID NO: 2179151 - protein, 26 aa, Cryptosporidium hominis
PKSYNLWSNRAWLLEFIVNLKNADKI

SEQ ID NO: 2179152 - protein, 20 aa, Cryptosporidium hominis
PKTGILNNIIVNGAGNINNN

SEQ ID NO: 2179153 - protein, 20 aa, Cryptosporidium hominis
PKTLHLKLVLLGDASVGKSC

SEQ ID NO: 2179154 - protein, 19 aa, Cryptosporidium hominis
PKTPIPIRRQRVDEPHIKL

SEQ ID NO: 2179155 - protein, 32 aa, Cryptosporidium hominis
PKTPPASPVEFEWLLHLVLHSALSQLGPMVSH

SEQ ID NO: 2179156 - protein, 22 aa, Cryptosporidium hominis
PKVFKLRIPYISKAVEGSLRSN

SEQ ID NO: 2179157 - protein, 24 aa, Cryptosporidium hominis
PKVICKEMVHTLYIFDTSQKLFKP

SEQ ID NO: 2179158 - protein, 23 aa, Cryptosporidium hominis
PKVKVLLCNVIDLISPFHGITTR

SEQ ID NO: 2179159 - protein, 19 aa, Cryptosporidium hominis
PKYGELKCLDIFKYNNNTQ

SEQ ID NO: 2179160 - protein, 17 aa, Cryptosporidium hominis
PKYYPPLHFSIYKPKVT

SEQ ID NO: 2179161 - protein, 21 aa, Cryptosporidium hominis
PLCYTGSFFHRIIPQFMIQGG

SEQ ID NO: 2179162 - protein, 25 aa, Cryptosporidium hominis
PLDELLCAIRTLFQMTIEISPINDE

SEQ ID NO: 2179163 - protein, 25 aa, Cryptosporidium hominis
PLDKYPDYNFMGLIIGPRGYNHRRL

SEQ ID NO: 2179164 - protein, 20 aa, Cryptosporidium hominis
PLEAYTSITKYSWDQSDKSV

SEQ ID NO: 2179165 - protein, 21 aa, Cryptosporidium hominis
PLEICDTLRWCECLFNLADYS

SEQ ID NO: 2179166 - protein, 21 aa, Cryptosporidium hominis
PLEIDEIMNLYIIGALIGLDG

SEQ ID NO: 2179167 - protein, 19 aa, Cryptosporidium hominis
PLELKVLLKKTIRSPQRIL

SEQ ID NO: 2179168 - protein, 24 aa, Cryptosporidium hominis
PLEPTFLCVARMALQKGVDLLIEA

SEQ ID NO: 2179169 - protein, 18 aa, Cryptosporidium hominis
PLETFIFHREPILSVDWH

SEQ ID NO: 2179170 - protein, 28 aa, Cryptosporidium hominis
PLETRISWLSKWLRISKSGGRREKDELV

SEQ ID NO: 2179171 - protein, 20 aa, Cryptosporidium hominis
PLFMPCNGRAAWGKEHGKVF

SEQ ID NO: 2179172 - protein, 28 aa, Cryptosporidium hominis
PLFRVPRPRFPYLVLVPLEGDFSSKIGQ

SEQ ID NO: 2179173 - protein, 19 aa, Cryptosporidium hominis
PLGGPRAAIVVKKCKNAIQ

SEQ ID NO: 2179174 - protein, 18 aa, Cryptosporidium hominis
PLGRMRMLFNYQKIEYLI

SEQ ID NO: 2179175 - protein, 18 aa, Cryptosporidium hominis
PLHTSSCFIHLLRHNDHK

SEQ ID NO: 2179176 - protein, 22 aa, Cryptosporidium hominis
PLIDLLIALPRPKVFEKVLQNA

SEQ ID NO: 2179177 - protein, 24 aa, Cryptosporidium hominis
PLIRQIENRLGILVDSSNLYMEPI

SEQ ID NO: 2179178 - protein, 17 aa, Cryptosporidium hominis
PLISFSIFQELEDAKRK

SEQ ID NO: 2179179 - protein, 24 aa, Cryptosporidium hominis
PLKLEMGCALYFIKSKQNFNQVDS

SEQ ID NO: 2179180 - protein, 20 aa, Cryptosporidium hominis
PLKLPDIYKAVGVNSPCGVL

SEQ ID NO: 2179181 - protein, 25 aa, Cryptosporidium hominis
PLLERLKLAYLKVVIPKCKYDQNRS

SEQ ID NO: 2179182 - protein, 17 aa, Cryptosporidium hominis
PLLKYRSVKELKETILH

SEQ ID NO: 2179183 - protein, 18 aa, Cryptosporidium hominis
PLLPNFLVDSALSFIKST

SEQ ID NO: 2179184 - protein, 21 aa, Cryptosporidium hominis
PLLVIVKHLQYQNGLKHKDFA

SEQ ID NO: 2179185 - protein, 20 aa, Cryptosporidium hominis
PLLYAEKLLIWVEFWAQVKC

SEQ ID NO: 2179186 - protein, 18 aa, Cryptosporidium hominis
PLMYKTKICEQFQRGDCN

SEQ ID NO: 2179187 - protein, 19 aa, Cryptosporidium hominis
PLNIEILGWTNLLHFVEAF

SEQ ID NO: 2179188 - protein, 17 aa, Cryptosporidium hominis
PLNKFRTTQVLTPSSPI

SEQ ID NO: 2179189 - protein, 36 aa, Cryptosporidium hominis
PLNKRIIIKKFFKLIERLKILLLYLKQEIIGKSSSS

SEQ ID NO: 2179190 - protein, 19 aa, Cryptosporidium hominis
PLNKSGRLLVYIRTMSNVL

SEQ ID NO: 2179191 - protein, 19 aa, Cryptosporidium hominis
PLNKVRRWISSKTEQILGK

SEQ ID NO: 2179192 - protein, 17 aa, Cryptosporidium hominis
PLNSFVFPQASNVQVFN

SEQ ID NO: 2179193 - protein, 19 aa, Cryptosporidium hominis
PLPSLFPSPSFPLPLSPLP

SEQ ID NO: 2179194 - protein, 25 aa, Cryptosporidium hominis
PLRARPEGFTAWDKLVIEQKDGTVQ

SEQ ID NO: 2179195 - protein, 25 aa, Cryptosporidium hominis
PLRELYKDEVRMIGKKIGLNDELIM

SEQ ID NO: 2179196 - protein, 20 aa, Cryptosporidium hominis
PLRHPGLFKALGVKPPRGVL

SEQ ID NO: 2179197 - protein, 18 aa, Cryptosporidium hominis
PLRLPLQDVYKIGGVGTV

SEQ ID NO: 2179198 - protein, 20 aa, Cryptosporidium hominis
PLSGESRCFGFVTMGNEEEA

SEQ ID NO: 2179199 - protein, 26 aa, Cryptosporidium hominis
PLTENEARWLFSQIFNAVINLHNKNM

SEQ ID NO: 2179200 - protein, 21 aa, Cryptosporidium hominis
PLTHPELYDDIGIKPPKGVIL

SEQ ID NO: 2179201 - protein, 24 aa, Cryptosporidium hominis
PLVFSRKLVQFALEKEYEETKRLS

SEQ ID NO: 2179202 - protein, 19 aa, Cryptosporidium hominis
PLVRHIFSNLQVVYCLLSK

SEQ ID NO: 2179203 - protein, 28 aa, Cryptosporidium hominis
PLYFMDEVDAALDFRNVSIIATFIKEKT

SEQ ID NO: 2179204 - protein, 17 aa, Cryptosporidium hominis
PLYKMKMLVLKHSNIPT

SEQ ID NO: 2179205 - protein, 18 aa, Cryptosporidium hominis
PMFLIPKKVKKNFKNEVC

SEQ ID NO: 2179206 - protein, 17 aa, Cryptosporidium hominis
PMHDWQFYDKKRIMELH

SEQ ID NO: 2179207 - protein, 19 aa, Cryptosporidium hominis
PMHRFIRIMGPEICNYIVP

SEQ ID NO: 2179208 - protein, 30 aa, Cryptosporidium hominis
PMIHSVFQNILWRDWLIRYAPLVGNNGNFV

SEQ ID NO: 2179209 - protein, 17 aa, Cryptosporidium hominis
PMLKPLNWLLFEFKNHD

SEQ ID NO: 2179210 - protein, 26 aa, Cryptosporidium hominis
PMQVNSYLLKIGRILNRDFVAVSDVS

SEQ ID NO: 2179211 - protein, 19 aa, Cryptosporidium hominis
PNAPMVILYRGELSVMQTG

SEQ ID NO: 2179212 - protein, 23 aa, Cryptosporidium hominis
PNAQEFIPRGWVNPTNEPFINHL

SEQ ID NO: 2179213 - protein, 17 aa, Cryptosporidium hominis
PNCAYVHEIVDPNDCIS

SEQ ID NO: 2179214 - protein, 24 aa, Cryptosporidium hominis
PNEILRLSTTLAVSSLGVEDTANT

SEQ ID NO: 2179215 - protein, 19 aa, Cryptosporidium hominis
PNELTECLQSCPLETPKLD

SEQ ID NO: 2179216 - protein, 19 aa, Cryptosporidium hominis
PNEMGRLDILMKVSKKTPL

SEQ ID NO: 2179217 - protein, 26 aa, Cryptosporidium hominis
PNFKAVKIQAVFRGWLVRKKFCKLFM

SEQ ID NO: 2179218 - protein, 18 aa, Cryptosporidium hominis
PNFLNRLALKQSTQLARY

SEQ ID NO: 2179219 - protein, 21 aa, Cryptosporidium hominis
PNFMTGSLIHNFPLFQNQDTS

SEQ ID NO: 2179220 - protein, 18 aa, Cryptosporidium hominis
PNFPGVVIANRVNKPFVA

SEQ ID NO: 2179221 - protein, 19 aa, Cryptosporidium hominis
PNGALVYCMEYLQVNIDWL

SEQ ID NO: 2179222 - protein, 18 aa, Cryptosporidium hominis
PNGSAPMSMGSGAFASVG

SEQ ID NO: 2179223 - protein, 21 aa, Cryptosporidium hominis
PNINIAIPIGNSVVNHVSSVG

SEQ ID NO: 2179224 - protein, 24 aa, Cryptosporidium hominis
PNIPCSIAKQLFRKVVSDISQRAT

SEQ ID NO: 2179225 - protein, 27 aa, Cryptosporidium hominis
PNISCMIGVICLLEISSIGYANSKSNN

SEQ ID NO: 2179226 - protein, 21 aa, Cryptosporidium hominis
PNKEFRLKVSSVVNDLRNWLE

SEQ ID NO: 2179227 - protein, 17 aa, Cryptosporidium hominis
PNKLSWKLVRNNKYGKI

SEQ ID NO: 2179228 - protein, 19 aa, Cryptosporidium hominis
PNKRNILTAINWLTRDAEA

SEQ ID NO: 2179229 - protein, 21 aa, Cryptosporidium hominis
PNKVQHEIMVPLGPLAFSPGY

SEQ ID NO: 2179230 - protein, 24 aa, Cryptosporidium hominis
PNKVRFFIMDGTDPIAFLSYYTKS

SEQ ID NO: 2179231 - protein, 17 aa, Cryptosporidium hominis
PNLAENIAMIIEDSQSF

SEQ ID NO: 2179232 - protein, 21 aa, Cryptosporidium hominis
PNLHTKIARFLEIQGYKEKAL

SEQ ID NO: 2179233 - protein, 25 aa, Cryptosporidium hominis
PNLRDIGLWLDAVVYQSNFRPVPLR

SEQ ID NO: 2179234 - protein, 25 aa, Cryptosporidium hominis
PNMGYSKICLREGRGYMLSESSSIV

SEQ ID NO: 2179235 - protein, 41 aa, Cryptosporidium hominis
PNNPEMIDLKLAEFHNSRSSLIRWSKVSSTIYLFGTTQVQL

SEQ ID NO: 2179236 - protein, 23 aa, Cryptosporidium hominis
PNNQPCRGFNSTIPSIVNQGNLF

SEQ ID NO: 2179237 - protein, 21 aa, Cryptosporidium hominis
PNPNTRWSIKKALFHPDCIQQ

SEQ ID NO: 2179238 - protein, 25 aa, Cryptosporidium hominis
PNQFLKFSNLVLVPGKPRKWKRVQR

SEQ ID NO: 2179239 - protein, 18 aa, Cryptosporidium hominis
PNQLFNFEFIQTLGGTNQ

SEQ ID NO: 2179240 - protein, 21 aa, Cryptosporidium hominis
PNRGSIWMVFEYLPYDLSGYI

SEQ ID NO: 2179241 - protein, 17 aa, Cryptosporidium hominis
PNRLIKLSIKLALLTKK

SEQ ID NO: 2179242 - protein, 21 aa, Cryptosporidium hominis
PNRRLKRSDLDNVTNLESASK

SEQ ID NO: 2179243 - protein, 23 aa, Cryptosporidium hominis
PNSEALPNPWSINRNSSNNSNNS

SEQ ID NO: 2179244 - protein, 27 aa, Cryptosporidium hominis
PNVFREMIKWCKLKLNIPILEGTSKKD

SEQ ID NO: 2179245 - protein, 20 aa, Cryptosporidium hominis
PNVGKSSIVNALFGSQKSSI

SEQ ID NO: 2179246 - protein, 24 aa, Cryptosporidium hominis
PNVPYEYLKSVILSSFDTRSEEDN

SEQ ID NO: 2179247 - protein, 18 aa, Cryptosporidium hominis
PNVWRQLNIESSTEDRLS

SEQ ID NO: 2179248 - protein, 22 aa, Cryptosporidium hominis
PNYEWLANWMKIILSAICMPLI

SEQ ID NO: 2179249 - protein, 20 aa, Cryptosporidium hominis
PNYHCPSCQQSIENPIKKYI

SEQ ID NO: 2179250 - protein, 20 aa, Cryptosporidium hominis
PNYLDPVWQLNFDPIKHYTQ

SEQ ID NO: 2179251 - protein, 24 aa, Cryptosporidium hominis
PPAEESSWFSGWFGTSAPEEPPKE

SEQ ID NO: 2179252 - protein, 22 aa, Cryptosporidium hominis
PPAIPGNSLFQLSNSQSGISNS

SEQ ID NO: 2179253 - protein, 24 aa, Cryptosporidium hominis
PPCCDPSLLEPVKLPFGESNELND

SEQ ID NO: 2179254 - protein, 27 aa, Cryptosporidium hominis
PPDITFPSTFCFPSLSDGRSFTAEILH

SEQ ID NO: 2179255 - protein, 17 aa, Cryptosporidium hominis
PPDKRVSFSPQRTSRNA

SEQ ID NO: 2179256 - protein, 23 aa, Cryptosporidium hominis
PPDLHRLDAPWIHLLKVQVQRDK

SEQ ID NO: 2179257 - protein, 25 aa, Cryptosporidium hominis
PPEEWPLSLLTIWKPILETEKDYEA

SEQ ID NO: 2179258 - protein, 24 aa, Cryptosporidium hominis
PPEIRPVPCTVYISGFQEKNYCPR

SEQ ID NO: 2179259 - protein, 22 aa, Cryptosporidium hominis
PPEKIPGYDVWQPPPPQKVDQK

SEQ ID NO: 2179260 - protein, 25 aa, Cryptosporidium hominis
PPFNAPSEFLVFCRVFQNGLRFPPD

SEQ ID NO: 2179261 - protein, 19 aa, Cryptosporidium hominis
PPGCKDIDDALSIELINPN

SEQ ID NO: 2179262 - protein, 20 aa, Cryptosporidium hominis
PPHGIQIGGVIDYKSHGIGV

SEQ ID NO: 2179263 - protein, 17 aa, Cryptosporidium hominis
PPHGQIFMKWGKVASKV

SEQ ID NO: 2179264 - protein, 21 aa, Cryptosporidium hominis
PPIGICLHSLLYILPPSVPTE

SEQ ID NO: 2179265 - protein, 17 aa, Cryptosporidium hominis
PPILPATLLLHLSTKLR

SEQ ID NO: 2179266 - protein, 17 aa, Cryptosporidium hominis
PPIRVVSAIAPKSNQFS

SEQ ID NO: 2179267 - protein, 19 aa, Cryptosporidium hominis
PPKIRLMSVKAIFSENFLS

SEQ ID NO: 2179268 - protein, 18 aa, Cryptosporidium hominis
PPKKHLVKKSSSVKKDDG

SEQ ID NO: 2179269 - protein, 17 aa, Cryptosporidium hominis
PPLALIEEFQSDRKRSL

SEQ ID NO: 2179270 - protein, 25 aa, Cryptosporidium hominis
PPLDDHGKPIWGLLPPIEDDDSNNS

SEQ ID NO: 2179271 - protein, 24 aa, Cryptosporidium hominis
PPLEACTAMSSFGCPLKVYIKNSG

SEQ ID NO: 2179272 - protein, 17 aa, Cryptosporidium hominis
PPLKPPPKRGATSQGFG

SEQ ID NO: 2179273 - protein, 18 aa, Cryptosporidium hominis
PPLNDFLLGKIVFLDSIY

SEQ ID NO: 2179274 - protein, 23 aa, Cryptosporidium hominis
PPLPPKRNGPGWNSHSTGNKLED

SEQ ID NO: 2179275 - protein, 25 aa, Cryptosporidium hominis
PPLSSLPLFVRVKFNANEGRGQPSS

SEQ ID NO: 2179276 - protein, 22 aa, Cryptosporidium hominis
PPLSSLQKFFALLISSRPIANN

SEQ ID NO: 2179277 - protein, 19 aa, Cryptosporidium hominis
PPMRRYLDERIKLQETRVQ

SEQ ID NO: 2179278 - protein, 20 aa, Cryptosporidium hominis
PPNGISCFESSFLPYYCTQQ

SEQ ID NO: 2179279 - protein, 21 aa, Cryptosporidium hominis
PPNRKGRYSVASSYGTNNPKF

SEQ ID NO: 2179280 - protein, 17 aa, Cryptosporidium hominis
PPPKVPREKCSYLLFIL

SEQ ID NO: 2179281 - protein, 24 aa, Cryptosporidium hominis
PPRFTRGILNRHCYVLFDNMKNRD

SEQ ID NO: 2179282 - protein, 29 aa, Cryptosporidium hominis
PPSALKLPWQKVCIDIATSVSFLQKPPRF

SEQ ID NO: 2179283 - protein, 17 aa, Cryptosporidium hominis
PPSALSNVISWRPEGIK

SEQ ID NO: 2179284 - protein, 17 aa, Cryptosporidium hominis
PPSFMLMALQGNKVVLY

SEQ ID NO: 2179285 - protein, 22 aa, Cryptosporidium hominis
PPSQRPAMAGTEIKGQDLKSMH

SEQ ID NO: 2179286 - protein, 19 aa, Cryptosporidium hominis
PPVAEYMPVTTPIIMARQP

SEQ ID NO: 2179287 - protein, 18 aa, Cryptosporidium hominis
PPVIPKNADLVFEITLLS

SEQ ID NO: 2179288 - protein, 19 aa, Cryptosporidium hominis
PPYPCRRSTTNFSDHEIEI

SEQ ID NO: 2179289 - protein, 19 aa, Cryptosporidium hominis
PPYYPIKAFYPVITSIIAF

SEQ ID NO: 2179290 - protein, 18 aa, Cryptosporidium hominis
PQAPRPLPQLGSFFTPRP

SEQ ID NO: 2179291 - protein, 20 aa, Cryptosporidium hominis
PQCGPYCSTYPKGYFAFWVT

SEQ ID NO: 2179292 - protein, 33 aa, Cryptosporidium hominis
PQDLTRTGFIIFWGGRELDSFNIGNNITNNNST

SEQ ID NO: 2179293 - protein, 23 aa, Cryptosporidium hominis
PQESHSGCNNCNSSIKYRFDTKD

SEQ ID NO: 2179294 - protein, 17 aa, Cryptosporidium hominis
PQGYHPAPITNYPYSFG

SEQ ID NO: 2179295 - protein, 24 aa, Cryptosporidium hominis
PQIAPGVGVNSQITPGVGVNSQIT

SEQ ID NO: 2179296 - protein, 26 aa, Cryptosporidium hominis
PQIYGEKWSIIVIIGILQILKPCKDI

SEQ ID NO: 2179297 - protein, 21 aa, Cryptosporidium hominis
PQKLMECLVVIKSPNSDITQK

SEQ ID NO: 2179298 - protein, 21 aa, Cryptosporidium hominis
PQLPNLMNLYSPFANSNPNTI

SEQ ID NO: 2179299 - protein, 22 aa, Cryptosporidium hominis
PQMHLHVLKRLTLLPPESKFTK

SEQ ID NO: 2179300 - protein, 24 aa, Cryptosporidium hominis
PQMSAAYASYGFVPSQNLGYTTVG

SEQ ID NO: 2179301 - protein, 20 aa, Cryptosporidium hominis
PQPPRIVREQCITMVAVIAG

SEQ ID NO: 2179302 - protein, 21 aa, Cryptosporidium hominis
PQQLLPMSRFLPKTSAQKTTK

SEQ ID NO: 2179303 - protein, 21 aa, Cryptosporidium hominis
PQRLYCSFCEIYLDIPQRGTI

SEQ ID NO: 2179304 - protein, 24 aa, Cryptosporidium hominis
PQSEELWLRYARLSEYCDAQKILN

SEQ ID NO: 2179305 - protein, 26 aa, Cryptosporidium hominis
PQSSIPFHLVCHVFESMKASLQKNET

SEQ ID NO: 2179306 - protein, 19 aa, Cryptosporidium hominis
PQVKYAKKELDRWMNSENN

SEQ ID NO: 2179307 - protein, 19 aa, Cryptosporidium hominis
PQYDYSFNHVKQLLYDNQV

SEQ ID NO: 2179308 - protein, 20 aa, Cryptosporidium hominis
PQYRDLQCNSCGTRMRFLLQ

SEQ ID NO: 2179309 - protein, 19 aa, Cryptosporidium hominis
PRCRNGHCAISSSKGIIFF

SEQ ID NO: 2179310 - protein, 19 aa, Cryptosporidium hominis
PREAPFIAKVTNLDYSLQL

SEQ ID NO: 2179311 - protein, 32 aa, Cryptosporidium hominis
PRELLYKYEVIFRLVFHLKYINYLLNNIWILH

SEQ ID NO: 2179312 - protein, 19 aa, Cryptosporidium hominis
PRENYTCICADARKLLSLS

SEQ ID NO: 2179313 - protein, 18 aa, Cryptosporidium hominis
PRFNLWASIKESITKDIS

SEQ ID NO: 2179314 - protein, 21 aa, Cryptosporidium hominis
PRGEKGFSWDPIFNPMVILCK

SEQ ID NO: 2179315 - protein, 21 aa, Cryptosporidium hominis
PRGIFSIKVKGLSAFWDDESA

SEQ ID NO: 2179316 - protein, 26 aa, Cryptosporidium hominis
PRGNIVAPIQIEWPKTPPASPVEFEW

SEQ ID NO: 2179317 - protein, 27 aa, Cryptosporidium hominis
PRHGRYLTASVMFRGRMSTKEVDEQML

SEQ ID NO: 2179318 - protein, 20 aa, Cryptosporidium hominis
PRHIRMLFLLHKWDAPMNYS

SEQ ID NO: 2179319 - protein, 19 aa, Cryptosporidium hominis
PRIEDSFSQIEYVNQTSQM

SEQ ID NO: 2179320 - protein, 17 aa, Cryptosporidium hominis
PRISFKKDGELKMNKIR

SEQ ID NO: 2179321 - protein, 20 aa, Cryptosporidium hominis
PRISLECILELVSYSESANW

SEQ ID NO: 2179322 - protein, 19 aa, Cryptosporidium hominis
PRIYLRFKSLRDPSSTGFE

SEQ ID NO: 2179323 - protein, 18 aa, Cryptosporidium hominis
PRKIKSFYNKYLDYYNEK

SEQ ID NO: 2179324 - protein, 21 aa, Cryptosporidium hominis
PRLHSALTRLYWKNMLKSIKC

SEQ ID NO: 2179325 - protein, 20 aa, Cryptosporidium hominis
PRLYCSLGDLTQDLSFYEKS

SEQ ID NO: 2179326 - protein, 21 aa, Cryptosporidium hominis
PRNCTTCRACIEKFPNKIKLL

SEQ ID NO: 2179327 - protein, 19 aa, Cryptosporidium hominis
PRNHSSLLLNLLGNNINDN

SEQ ID NO: 2179328 - protein, 19 aa, Cryptosporidium hominis
PRNISLMIHRSGRTARASR

SEQ ID NO: 2179329 - protein, 26 aa, Cryptosporidium hominis
PRNLTKIRLKNCIPVESIMELRYNKA

SEQ ID NO: 2179330 - protein, 25 aa, Cryptosporidium hominis
PRPDKEPCIRIIKRIKQRISEVNGL

SEQ ID NO: 2179331 - protein, 19 aa, Cryptosporidium hominis
PRPINWWFNHSVRHITVKF

SEQ ID NO: 2179332 - protein, 23 aa, Cryptosporidium hominis
PRPNARVCVMGDAADCERAQKLG

SEQ ID NO: 2179333 - protein, 19 aa, Cryptosporidium hominis
PRPPCPLLPSLPGRGSFVL

SEQ ID NO: 2179334 - protein, 19 aa, Cryptosporidium hominis
PRPRGRPKREQVCVEKNES

SEQ ID NO: 2179335 - protein, 20 aa, Cryptosporidium hominis
PRPRPQFANSSALGGLEFDQ

SEQ ID NO: 2179336 - protein, 26 aa, Cryptosporidium hominis
PRQPKLRLLYRDHVTTFVDTRIRHFR

SEQ ID NO: 2179337 - protein, 18 aa, Cryptosporidium hominis
PRSCFPICVDFANHVCIR

SEQ ID NO: 2179338 - protein, 22 aa, Cryptosporidium hominis
PRSDEELAFLFAFDTDEYNRFD

SEQ ID NO: 2179339 - protein, 27 aa, Cryptosporidium hominis
PRSDIPRKYVLLCLVDSIVRKCRSGSI

SEQ ID NO: 2179340 - protein, 18 aa, Cryptosporidium hominis
PRSESVFDASYSLNNEYR

SEQ ID NO: 2179341 - protein, 17 aa, Cryptosporidium hominis
PRSSLQYSASATDLSFD

SEQ ID NO: 2179342 - protein, 26 aa, Cryptosporidium hominis
PRTARIPINTGYNFKIIPQNDSSSIE

SEQ ID NO: 2179343 - protein, 18 aa, Cryptosporidium hominis
PRTLGDAVVAWEVSSTLL

SEQ ID NO: 2179344 - protein, 18 aa, Cryptosporidium hominis
PRTLLCTLKTTPRPYLVW

SEQ ID NO: 2179345 - protein, 29 aa, Cryptosporidium hominis
PRTPECKARILCAFELVKIGDMMGNVLFS

SEQ ID NO: 2179346 - protein, 18 aa, Cryptosporidium hominis
PRTPLVLDSRYFPSKFGG

SEQ ID NO: 2179347 - protein, 20 aa, Cryptosporidium hominis
PRTPQFRATYILPTSPHFSD

SEQ ID NO: 2179348 - protein, 25 aa, Cryptosporidium hominis
PRTRFDCLKELLLVCKNSSGAGGLV

SEQ ID NO: 2179349 - protein, 18 aa, Cryptosporidium hominis
PRVFGFKDIKSLREHVIS

SEQ ID NO: 2179350 - protein, 19 aa, Cryptosporidium hominis
PRVLCNGYKVLPVGITNEL

SEQ ID NO: 2179351 - protein, 19 aa, Cryptosporidium hominis
PRVLDKMMPFFTEKFGNSH

SEQ ID NO: 2179352 - protein, 17 aa, Cryptosporidium hominis
PRVPFSPDYWQKQILDI

SEQ ID NO: 2179353 - protein, 17 aa, Cryptosporidium hominis
PRYGVPVGLANFSAAYC

SEQ ID NO: 2179354 - protein, 27 aa, Cryptosporidium hominis
PRYSDTGKMRGFAMVEFENDEQIQNAL

SEQ ID NO: 2179355 - protein, 21 aa, Cryptosporidium hominis
PSAGRMGKRFTSLEGSNTLIL

SEQ ID NO: 2179356 - protein, 26 aa, Cryptosporidium hominis
PSAHQGAVWGVAWHPLGHLVVSSGQD

SEQ ID NO: 2179357 - protein, 17 aa, Cryptosporidium hominis
PSALLTVLHNSRQICLK

SEQ ID NO: 2179358 - protein, 20 aa, Cryptosporidium hominis
PSAPVLPGINGFHATIITNS

SEQ ID NO: 2179359 - protein, 20 aa, Cryptosporidium hominis
PSARKGHSLALLDDVSAVMF

SEQ ID NO: 2179360 - protein, 20 aa, Cryptosporidium hominis
PSCDIISFFDIFLLSLFRSK

SEQ ID NO: 2179361 - protein, 18 aa, Cryptosporidium hominis
PSDIPGVLEVGWVEKIID

SEQ ID NO: 2179362 - protein, 20 aa, Cryptosporidium hominis
PSDRSNLLTSIFSTLNMEEK

SEQ ID NO: 2179363 - protein, 24 aa, Cryptosporidium hominis
PSEKKCCIRPLIAPYDNQTTVQPH

SEQ ID NO: 2179364 - protein, 18 aa, Cryptosporidium hominis
PSFERMNSGFLGFGRKPS

SEQ ID NO: 2179365 - protein, 25 aa, Cryptosporidium hominis
PSGDFMMCKVCGFKSAVLGKTGLPV

SEQ ID NO: 2179366 - protein, 25 aa, Cryptosporidium hominis
PSGDLIPWTLCNHLARDDFGKLTGL

SEQ ID NO: 2179367 - protein, 18 aa, Cryptosporidium hominis
PSGIVPRPRRIWSILASK

SEQ ID NO: 2179368 - protein, 18 aa, Cryptosporidium hominis
PSGNCFEYYSIAIGSRSQ

SEQ ID NO: 2179369 - protein, 24 aa, Cryptosporidium hominis
PSKFDCLRRVPAYDKLITERFERC

SEQ ID NO: 2179370 - protein, 18 aa, Cryptosporidium hominis
PSKILFRAVRGMIPHKTP

SEQ ID NO: 2179371 - protein, 17 aa, Cryptosporidium hominis
PSKRLGGRAHVFSLSST

SEQ ID NO: 2179372 - protein, 26 aa, Cryptosporidium hominis
PSKYKDSICWATIKAVKEVYEPQVKY

SEQ ID NO: 2179373 - protein, 17 aa, Cryptosporidium hominis
PSLEETFEFFSQDVCLD

SEQ ID NO: 2179374 - protein, 19 aa, Cryptosporidium hominis
PSLGLIWSNSINWRIFLSK

SEQ ID NO: 2179375 - protein, 25 aa, Cryptosporidium hominis
PSLGLSWNSLICERLILKREKDLKA

SEQ ID NO: 2179376 - protein, 24 aa, Cryptosporidium hominis
PSLPEIKAILKWADNISQDTLNDN

SEQ ID NO: 2179377 - protein, 20 aa, Cryptosporidium hominis
PSNAGLFSPFSINITIGDDF

SEQ ID NO: 2179378 - protein, 25 aa, Cryptosporidium hominis
PSPRKDWPFDEAILYPPHPRIGSPV

SEQ ID NO: 2179379 - protein, 23 aa, Cryptosporidium hominis
PSPRLLKHIIRCYLRLSENSKVR

SEQ ID NO: 2179380 - protein, 18 aa, Cryptosporidium hominis
PSREIMKIIQNIDGKNGL

SEQ ID NO: 2179381 - protein, 19 aa, Cryptosporidium hominis
PSRGIKRRGSLKSQTDITM

SEQ ID NO: 2179382 - protein, 22 aa, Cryptosporidium hominis
PSRTCKLLERLVKYKCPNLNGI

SEQ ID NO: 2179383 - protein, 23 aa, Cryptosporidium hominis
PSSAIIKFLWTVRTTNFIQYFIE

SEQ ID NO: 2179384 - protein, 21 aa, Cryptosporidium hominis
PSSAKAALFSSVPGQKQAQRD

SEQ ID NO: 2179385 - protein, 18 aa, Cryptosporidium hominis
PSSCCGYIINSSEHWTSI

SEQ ID NO: 2179386 - protein, 23 aa, Cryptosporidium hominis
PSSFSLKTSRGMIDSSGGGTIGS

SEQ ID NO: 2179387 - protein, 30 aa, Cryptosporidium hominis
PSSVKSYQAYECWLCVREFANVLIHQPTHT

SEQ ID NO: 2179388 - protein, 21 aa, Cryptosporidium hominis
PSSYIKWNVSFMCFITAEIPN

SEQ ID NO: 2179389 - protein, 20 aa, Cryptosporidium hominis
PSTIPKIEINPHPTTTFGTG

SEQ ID NO: 2179390 - protein, 23 aa, Cryptosporidium hominis
PSVSRDLLFHLYCLFSENIQNGD

SEQ ID NO: 2179391 - protein, 18 aa, Cryptosporidium hominis
PSVYLRDYMYLKLNNGIK

SEQ ID NO: 2179392 - protein, 21 aa, Cryptosporidium hominis
PSWILCIDIAAILLTNTDNKM

SEQ ID NO: 2179393 - protein, 17 aa, Cryptosporidium hominis
PSYPIRYISALKDSNCE

SEQ ID NO: 2179394 - protein, 17 aa, Cryptosporidium hominis
PSYWSIKKIPHFWEGFS

SEQ ID NO: 2179395 - protein, 24 aa, Cryptosporidium hominis
PTDLECFNDLSVIGFNLYPSLAKF

SEQ ID NO: 2179396 - protein, 25 aa, Cryptosporidium hominis
PTDLRPFWFQDWGERAISYYSSQID

SEQ ID NO: 2179397 - protein, 22 aa, Cryptosporidium hominis
PTDPESPAFWFAEASYLRDEKE

SEQ ID NO: 2179398 - protein, 25 aa, Cryptosporidium hominis
PTESSCPSSLWVRFNDTKVYLSKED

SEQ ID NO: 2179399 - protein, 24 aa, Cryptosporidium hominis
PTHEICSPKIFLDASVNTEIIQKF

SEQ ID NO: 2179400 - protein, 21 aa, Cryptosporidium hominis
PTHPIRLGLALNFSVFHYEIL

SEQ ID NO: 2179401 - protein, 22 aa, Cryptosporidium hominis
PTIEEIKRFFGVSDLSEVNIDS

SEQ ID NO: 2179402 - protein, 17 aa, Cryptosporidium hominis
PTIISSLLRPSAPPTAP

SEQ ID NO: 2179403 - protein, 24 aa, Cryptosporidium hominis
PTINRANVYIGFQVQLDLTGIFMH

SEQ ID NO: 2179404 - protein, 26 aa, Cryptosporidium hominis
PTIQRICELLLFPDCYNNTKSFLYAL

SEQ ID NO: 2179405 - protein, 17 aa, Cryptosporidium hominis
PTKGLKESEKENQSKLV

SEQ ID NO: 2179406 - protein, 24 aa, Cryptosporidium hominis
PTKSELDYIFGILSRESFSSGFSA

SEQ ID NO: 2179407 - protein, 18 aa, Cryptosporidium hominis
PTLYTRRYIGYSLSMICL

SEQ ID NO: 2179408 - protein, 22 aa, Cryptosporidium hominis
PTMQQIFIIWSIIQKTEIIEDQ

SEQ ID NO: 2179409 - protein, 19 aa, Cryptosporidium hominis
PTNAIRTVKVCPLPSAGSS

SEQ ID NO: 2179410 - protein, 22 aa, Cryptosporidium hominis
PTNWIMQTWRNIQCEMGNEGDS

SEQ ID NO: 2179411 - protein, 23 aa, Cryptosporidium hominis
PTPDELFKQLSLINTKFEDICLN

SEQ ID NO: 2179412 - protein, 24 aa, Cryptosporidium hominis
PTPIPSTFVSPAFSVYSAQNHSQY

SEQ ID NO: 2179413 - protein, 18 aa, Cryptosporidium hominis
PTREYRKIFSRFSTQNLC

SEQ ID NO: 2179414 - protein, 23 aa, Cryptosporidium hominis
PTSGRPAIYRVMTSTTVAFPPYN

SEQ ID NO: 2179415 - protein, 17 aa, Cryptosporidium hominis
PTSISIQLWNKSWSVPY

SEQ ID NO: 2179416 - protein, 22 aa, Cryptosporidium hominis
PTSRDPKLWLVKVDRAGLEKDI

SEQ ID NO: 2179417 - protein, 25 aa, Cryptosporidium hominis
PTSRGASEFGTPNAFSHRNNQVPQY

SEQ ID NO: 2179418 - protein, 18 aa, Cryptosporidium hominis
PTSSIAISAISKISELPK

SEQ ID NO: 2179419 - protein, 21 aa, Cryptosporidium hominis
PTTYFALKFQKGAQEYRQAAY

SEQ ID NO: 2179420 - protein, 19 aa, Cryptosporidium hominis
PTVAPRIGVNSQIAPGVGA

SEQ ID NO: 2179421 - protein, 20 aa, Cryptosporidium hominis
PTVIKELICSKIDNKYKKIS

SEQ ID NO: 2179422 - protein, 27 aa, Cryptosporidium hominis
PTYQPLVYWRVYKGLSPSISFPSDEIS

SEQ ID NO: 2179423 - protein, 18 aa, Cryptosporidium hominis
PVARYFGLAKGQVVKIIR

SEQ ID NO: 2179424 - protein, 17 aa, Cryptosporidium hominis
PVDKFPLTIDEILGLFN

SEQ ID NO: 2179425 - protein, 17 aa, Cryptosporidium hominis
PVDLTLCYNNINSLCLN

SEQ ID NO: 2179426 - protein, 23 aa, Cryptosporidium hominis
PVEERWPHLDVVTDIGTTITDLK

SEQ ID NO: 2179427 - protein, 20 aa, Cryptosporidium hominis
PVEIIKDEFESLINPENSSK

SEQ ID NO: 2179428 - protein, 20 aa, Cryptosporidium hominis
PVEPLEILKEPEVEVKQSYI

SEQ ID NO: 2179429 - protein, 19 aa, Cryptosporidium hominis
PVESCELQPIVILRDKMGK

SEQ ID NO: 2179430 - protein, 18 aa, Cryptosporidium hominis
PVFSCDYSSENKRATPQQ

SEQ ID NO: 2179431 - protein, 18 aa, Cryptosporidium hominis
PVHYHFRSKKGIPIYKYN

SEQ ID NO: 2179432 - protein, 20 aa, Cryptosporidium hominis
PVITCQSFNWNVYMRQLYYN

SEQ ID NO: 2179433 - protein, 17 aa, Cryptosporidium hominis
PVKEMTRVFSVDMQEKE

SEQ ID NO: 2179434 - protein, 24 aa, Cryptosporidium hominis
PVKKFKFNIGQIFTNRIISKQNDH

SEQ ID NO: 2179435 - protein, 22 aa, Cryptosporidium hominis
PVKRTIEKPVPIGLYDQPELLQ

SEQ ID NO: 2179436 - protein, 19 aa, Cryptosporidium hominis
PVKSIEDIEINGCKASHIY

SEQ ID NO: 2179437 - protein, 24 aa, Cryptosporidium hominis
PVKTLRILAIRLWDKRIMLKGDLG

SEQ ID NO: 2179438 - protein, 19 aa, Cryptosporidium hominis
PVLEEREVIVARREVQERI

SEQ ID NO: 2179439 - protein, 26 aa, Cryptosporidium hominis
PVMEASRLKLIFAGRILNDSQTVQDV

SEQ ID NO: 2179440 - protein, 26 aa, Cryptosporidium hominis
PVNHFWNYIFYCRWVLQVTIGEYYSF

SEQ ID NO: 2179441 - protein, 23 aa, Cryptosporidium hominis
PVNKNEVRLVYRIKNSSVSGENG

SEQ ID NO: 2179442 - protein, 18 aa, Cryptosporidium hominis
PVNRLRFGILERKKDYKI

SEQ ID NO: 2179443 - protein, 21 aa, Cryptosporidium hominis
PVNSVCFHPQFANVLATGGSD

SEQ ID NO: 2179444 - protein, 31 aa, Cryptosporidium hominis
PVNVCYIKLTFNWPGARLVRDLWALDCELLV

SEQ ID NO: 2179445 - protein, 25 aa, Cryptosporidium hominis
PVPKKFKPSELITELVGNVYKYGDS

SEQ ID NO: 2179446 - protein, 24 aa, Cryptosporidium hominis
PVPPNCIRPSVTMGESGSNEDDLT

SEQ ID NO: 2179447 - protein, 23 aa, Cryptosporidium hominis
PVRCHFCDCWSAWNSHLLCDRCS

SEQ ID NO: 2179448 - protein, 32 aa, Cryptosporidium hominis
PVREELLRSILMADLIGFHFFPYAKQFLSSCK

SEQ ID NO: 2179449 - protein, 17 aa, Cryptosporidium hominis
PVSFKKFNVFQHCNIQG

SEQ ID NO: 2179450 - protein, 20 aa, Cryptosporidium hominis
PVSGCQWLGYNRVHIRESRT

SEQ ID NO: 2179451 - protein, 22 aa, Cryptosporidium hominis
PVSHIQSGLGRFGMSSVGGSVP

SEQ ID NO: 2179452 - protein, 19 aa, Cryptosporidium hominis
PVSIDRFNSGYSIEIGNII

SEQ ID NO: 2179453 - protein, 20 aa, Cryptosporidium hominis
PVSLSLKFAKAMVDHYPERL

SEQ ID NO: 2179454 - protein, 20 aa, Cryptosporidium hominis
PVYMSFPYNQGRNINVPYTV

SEQ ID NO: 2179455 - protein, 19 aa, Cryptosporidium hominis
PVYSRGIQSILKWGSNTYR

SEQ ID NO: 2179456 - protein, 23 aa, Cryptosporidium hominis
PWCDECQDSPAILWCQADTARLC

SEQ ID NO: 2179457 - protein, 21 aa, Cryptosporidium hominis
PWCGHCKTFDPIYNEVANIVT

SEQ ID NO: 2179458 - protein, 24 aa, Cryptosporidium hominis
PWESFCGLASKVGLELVQYSDFPS

SEQ ID NO: 2179459 - protein, 19 aa, Cryptosporidium hominis
PWIFEFIAIITKRITNCIL

SEQ ID NO: 2179460 - protein, 23 aa, Cryptosporidium hominis
PWITRFADDILFLSPRNYFYSND

SEQ ID NO: 2179461 - protein, 17 aa, Cryptosporidium hominis
PWIWGLSFSGIDHHNVN

SEQ ID NO: 2179462 - protein, 17 aa, Cryptosporidium hominis
PWKLWKNKPREILSPKI

SEQ ID NO: 2179463 - protein, 23 aa, Cryptosporidium hominis
PWLKYHAGIVLLELERYEEALTM

SEQ ID NO: 2179464 - protein, 17 aa, Cryptosporidium hominis
PWNGNRFMFPRGKMDEM

SEQ ID NO: 2179465 - protein, 24 aa, Cryptosporidium hominis
PWNMQGHPYPAYAPDGASHHFHPG

SEQ ID NO: 2179466 - protein, 23 aa, Cryptosporidium hominis
PWSAGYRLVEWLIHSVNLGRNVA

SEQ ID NO: 2179467 - protein, 26 aa, Cryptosporidium hominis
PYDIPFWLPETITFLANYSGSRDISQ

SEQ ID NO: 2179468 - protein, 20 aa, Cryptosporidium hominis
PYDLSGYIEGLKLEGRVIKV

SEQ ID NO: 2179469 - protein, 19 aa, Cryptosporidium hominis
PYEILVIGSHGGFIEYIQD

SEQ ID NO: 2179470 - protein, 19 aa, Cryptosporidium hominis
PYERFIGQPILVWGDSQLF

SEQ ID NO: 2179471 - protein, 19 aa, Cryptosporidium hominis
PYGKSGCRRIVPGHYLAVD

SEQ ID NO: 2179472 - protein, 24 aa, Cryptosporidium hominis
PYGSRPALKFAQHTGAHAMVGRFT

SEQ ID NO: 2179473 - protein, 19 aa, Cryptosporidium hominis
PYGVIPFNCKIESRTFSKI

SEQ ID NO: 2179474 - protein, 21 aa, Cryptosporidium hominis
PYIDESFNIGKFHCLVTEFCK

SEQ ID NO: 2179475 - protein, 18 aa, Cryptosporidium hominis
PYILRNALDYILTGDCRL

SEQ ID NO: 2179476 - protein, 25 aa, Cryptosporidium hominis
PYKNELDFFYSRQFLSGQFFVDNII

SEQ ID NO: 2179477 - protein, 20 aa, Cryptosporidium hominis
PYLASRYGIREWINMNRTKD

SEQ ID NO: 2179478 - protein, 18 aa, Cryptosporidium hominis
PYLDPLVRRVISMSMESI

SEQ ID NO: 2179479 - protein, 18 aa, Cryptosporidium hominis
PYLEELYKRFKTMLFEKN

SEQ ID NO: 2179480 - protein, 24 aa, Cryptosporidium hominis
PYLEVGEIKTIIEVEIMNASSIKQ

SEQ ID NO: 2179481 - protein, 18 aa, Cryptosporidium hominis
PYLLKLTKFQIIRNEFSL

SEQ ID NO: 2179482 - protein, 17 aa, Cryptosporidium hominis
PYLPTKNSRRLILEQLK

SEQ ID NO: 2179483 - protein, 17 aa, Cryptosporidium hominis
PYLRAPRMYSISDLALA

SEQ ID NO: 2179484 - protein, 18 aa, Cryptosporidium hominis
PYMKKLSVQISKRCMACK

SEQ ID NO: 2179485 - protein, 20 aa, Cryptosporidium hominis
PYNPTRIVQALVWSIYDDEE

SEQ ID NO: 2179486 - protein, 18 aa, Cryptosporidium hominis
PYNTIGIRIPNIELIKQR

SEQ ID NO: 2179487 - protein, 40 aa, Cryptosporidium hominis
PYNYKRALCRHWMRGYCWLEADCKFAHGEAELRTRDGKLR

SEQ ID NO: 2179488 - protein, 17 aa, Cryptosporidium hominis
PYRNFAFLFRNPSYKGK

SEQ ID NO: 2179489 - protein, 26 aa, Cryptosporidium hominis
PYSIIALKYCVENGILMGAKHTSAYK

SEQ ID NO: 2179490 - protein, 18 aa, Cryptosporidium hominis
PYSNLVLLYNMYKLQWEI

SEQ ID NO: 2179491 - protein, 25 aa, Cryptosporidium hominis
PYTNMTFPTIEVWCPGLNEHGEFPS

SEQ ID NO: 2179492 - protein, 25 aa, Cryptosporidium hominis
QAALMAANPFFMFGAAAAAAAAAVG

SEQ ID NO: 2179493 - protein, 22 aa, Cryptosporidium hominis
QADFYYSYIVLFKYLNHCLEKY

SEQ ID NO: 2179494 - protein, 23 aa, Cryptosporidium hominis
QAFKEGRYRCLVATDVAARGLHI

SEQ ID NO: 2179495 - protein, 25 aa, Cryptosporidium hominis
QAFRTARQKVKICILPGKIKELDQF

SEQ ID NO: 2179496 - protein, 21 aa, Cryptosporidium hominis
QAGSLYWARKIIIKAIELGFL

SEQ ID NO: 2179497 - protein, 17 aa, Cryptosporidium hominis
QAHPSSGYYRLEVDQAP

SEQ ID NO: 2179498 - protein, 22 aa, Cryptosporidium hominis
QAHSNAIISLHWENNEGSHRFL

SEQ ID NO: 2179499 - protein, 20 aa, Cryptosporidium hominis
QAIFCCKLIEGFGMSECIGT

SEQ ID NO: 2179500 - protein, 35 aa, Cryptosporidium hominis
QAIKRLQVSLADFRRLCILKGVYPREPKKKLSGLD

SEQ ID NO: 2179501 - protein, 20 aa, Cryptosporidium hominis
QAKDLKEWIKAHSPNRDSNY

SEQ ID NO: 2179502 - protein, 19 aa, Cryptosporidium hominis
QAKPPFIVLENIYGNVHRG

SEQ ID NO: 2179503 - protein, 28 aa, Cryptosporidium hominis
QALLKERNLRLVSIDDWEEAPDVDEDGF

SEQ ID NO: 2179504 - protein, 20 aa, Cryptosporidium hominis
QAMNCLKIPPMEAESVPPIK

SEQ ID NO: 2179505 - protein, 22 aa, Cryptosporidium hominis
QANQRFLLLYTFLKKNRDKKVM

SEQ ID NO: 2179506 - protein, 21 aa, Cryptosporidium hominis
QANTQFIAGFHILQSQSIGHT

SEQ ID NO: 2179507 - protein, 19 aa, Cryptosporidium hominis
QARHSEFISGFKIIASQLK

SEQ ID NO: 2179508 - protein, 28 aa, Cryptosporidium hominis
QCASCEHCSIGGYPYYCNCYKMPSESAA

SEQ ID NO: 2179509 - protein, 22 aa, Cryptosporidium hominis
QCDGRGGTYVNVIGNGGRIGNG

SEQ ID NO: 2179510 - protein, 17 aa, Cryptosporidium hominis
QCGKQDRLLPALPQSSN

SEQ ID NO: 2179511 - protein, 21 aa, Cryptosporidium hominis
QCIDRYKYCRSLVVNKESEKK

SEQ ID NO: 2179512 - protein, 21 aa, Cryptosporidium hominis
QCIPMAVLGAAPLSMPKDIIP

SEQ ID NO: 2179513 - protein, 23 aa, Cryptosporidium hominis
QCKTIFELGIRFGSYSTLENLFN

SEQ ID NO: 2179514 - protein, 30 aa, Cryptosporidium hominis
QCKYSQIMLGTSWKGYEFVSKSGKEKVISK

SEQ ID NO: 2179515 - protein, 18 aa, Cryptosporidium hominis
QCLINLEITFTVSKTTSD

SEQ ID NO: 2179516 - protein, 17 aa, Cryptosporidium hominis
QCNFGHIVPPPPDYFPD

SEQ ID NO: 2179517 - protein, 29 aa, Cryptosporidium hominis
QCPRISICLRELFSYFANTRWKNNETQMS

SEQ ID NO: 2179518 - protein, 26 aa, Cryptosporidium hominis
QCQARLKELYSLGIVEFEGSNREEFL

SEQ ID NO: 2179519 - protein, 20 aa, Cryptosporidium hominis
QCRCKALFSHIIYYFDENDH

SEQ ID NO: 2179520 - protein, 19 aa, Cryptosporidium hominis
QCVECADIALNVEPNNVVF

SEQ ID NO: 2179521 - protein, 23 aa, Cryptosporidium hominis
QDALIAWKKICEVSRVEFQKIYD

SEQ ID NO: 2179522 - protein, 25 aa, Cryptosporidium hominis
QDDIYGWLKRCGKFKATQRTKGVST

SEQ ID NO: 2179523 - protein, 21 aa, Cryptosporidium hominis
QDDLSALIWTDIRHFAFILFK

SEQ ID NO: 2179524 - protein, 24 aa, Cryptosporidium hominis
QDDLSYLDYRMCDVDLPEMEVDPT

SEQ ID NO: 2179525 - protein, 23 aa, Cryptosporidium hominis
QDEAAKCLQEFYSEWAQNKGMVS

SEQ ID NO: 2179526 - protein, 22 aa, Cryptosporidium hominis
QDFPLMIYGVNLVRPIRKLSGF

SEQ ID NO: 2179527 - protein, 23 aa, Cryptosporidium hominis
QDFRKSIWFPIVDIPLRYEKVSS

SEQ ID NO: 2179528 - protein, 20 aa, Cryptosporidium hominis
QDILASFGWEDDIILCSETI

SEQ ID NO: 2179529 - protein, 20 aa, Cryptosporidium hominis
QDKILRLLLPLFDTGSRDKY

SEQ ID NO: 2179530 - protein, 25 aa, Cryptosporidium hominis
QDKKLKSMIWSNGIYMIGPLEVNLL

SEQ ID NO: 2179531 - protein, 21 aa, Cryptosporidium hominis
QDKYKFFGLDLINGTVRDNVQ

SEQ ID NO: 2179532 - protein, 21 aa, Cryptosporidium hominis
QDLLEIYSKYFIQKTRPRESI

SEQ ID NO: 2179533 - protein, 17 aa, Cryptosporidium hominis
QDLPLMLRGLELLSRSD

SEQ ID NO: 2179534 - protein, 19 aa, Cryptosporidium hominis
QDLTGGLVRSFSKAQNGNN

SEQ ID NO: 2179535 - protein, 20 aa, Cryptosporidium hominis
QDNLEFLQWMKGLFDESGAI

SEQ ID NO: 2179536 - protein, 28 aa, Cryptosporidium hominis
QDNTHLRKVCNWPAIEFSKQTSPPTVPI

SEQ ID NO: 2179537 - protein, 30 aa, Cryptosporidium hominis
QDPLLRKKLHKVPGVPLIYLNNQVPILEQP

SEQ ID NO: 2179538 - protein, 17 aa, Cryptosporidium hominis
QDSEAFLEPVNWKKLGL

SEQ ID NO: 2179539 - protein, 17 aa, Cryptosporidium hominis
QDSFKNIYIKMEYAEYE

SEQ ID NO: 2179540 - protein, 17 aa, Cryptosporidium hominis
QDSSLLIDKMTKWWHQL

SEQ ID NO: 2179541 - protein, 19 aa, Cryptosporidium hominis
QDTEIWLPSYNRIEKNKGF

SEQ ID NO: 2179542 - protein, 19 aa, Cryptosporidium hominis
QDVFDCILVLISTINGRTF

SEQ ID NO: 2179543 - protein, 18 aa, Cryptosporidium hominis
QDWLLLPICTGSRSMLIQ

SEQ ID NO: 2179544 - protein, 22 aa, Cryptosporidium hominis
QDYEILMGKGFFEQLKGLFLMK

SEQ ID NO: 2179545 - protein, 19 aa, Cryptosporidium hominis
QDYILDFTKKLELSGMNLD

SEQ ID NO: 2179546 - protein, 19 aa, Cryptosporidium hominis
QDYISLAFWNVIRKSVIFP

SEQ ID NO: 2179547 - protein, 24 aa, Cryptosporidium hominis
QDYRLRTVYKYKSIKSGMHSNMSN

SEQ ID NO: 2179548 - protein, 24 aa, Cryptosporidium hominis
QEAEFSRLGFGFDIGLGLGPGPGP

SEQ ID NO: 2179549 - protein, 20 aa, Cryptosporidium hominis
QEAFKPLEYDSFKQNEIFEQ

SEQ ID NO: 2179550 - protein, 33 aa, Cryptosporidium hominis
QEAFPHCDAYMLSWSYRKTRIIVEILSHQPDIV

SEQ ID NO: 2179551 - protein, 18 aa, Cryptosporidium hominis
QECLEILKYSSRTRQTML

SEQ ID NO: 2179552 - protein, 25 aa, Cryptosporidium hominis
QEDLKLNYLQGVYSFNGIFNGRPSY

SEQ ID NO: 2179553 - protein, 22 aa, Cryptosporidium hominis
QEEKKMIINEFVTAHKREVEIL

SEQ ID NO: 2179554 - protein, 25 aa, Cryptosporidium hominis
QEEYKLEWWLGIIEKLCDKNKSLLI

SEQ ID NO: 2179555 - protein, 22 aa, Cryptosporidium hominis
QEFDFLKQYFAKILQNHINSSQ

SEQ ID NO: 2179556 - protein, 24 aa, Cryptosporidium hominis
QEFPKEPMVLLIQSMVRLEELKTH

SEQ ID NO: 2179557 - protein, 20 aa, Cryptosporidium hominis
QEFTLCSGYDIHKQKISIKT

SEQ ID NO: 2179558 - protein, 17 aa, Cryptosporidium hominis
QEGAWIFDKPVDEKAWN

SEQ ID NO: 2179559 - protein, 23 aa, Cryptosporidium hominis
QEGLCSLIKVVQAFPQNTLFSTI

SEQ ID NO: 2179560 - protein, 26 aa, Cryptosporidium hominis
QEHFKRASQTILSRIDEMGSRIDQLE

SEQ ID NO: 2179561 - protein, 20 aa, Cryptosporidium hominis
QEHPELLNSLLMLTLKPKKS

SEQ ID NO: 2179562 - protein, 19 aa, Cryptosporidium hominis
QEIEPLPSCYSSNLFKLIQ

SEQ ID NO: 2179563 - protein, 21 aa, Cryptosporidium hominis
QEIKFLKYMIGYSHELKQHLD

SEQ ID NO: 2179564 - protein, 19 aa, Cryptosporidium hominis
QEILPKLLNVVLSCEDVLA

SEQ ID NO: 2179565 - protein, 17 aa, Cryptosporidium hominis
QEIQGLILNNTRLLKSG

SEQ ID NO: 2179566 - protein, 25 aa, Cryptosporidium hominis
QEIYNKGLIKLREMCFVFNELIKEY

SEQ ID NO: 2179567 - protein, 22 aa, Cryptosporidium hominis
QEKKAVSYWSNFLSTQFGILNN

SEQ ID NO: 2179568 - protein, 25 aa, Cryptosporidium hominis
QEKPDCIEIKFGKDNVEMYVKNLDN

SEQ ID NO: 2179569 - protein, 18 aa, Cryptosporidium hominis
QELHSMGYVNLKHILIQT

SEQ ID NO: 2179570 - protein, 24 aa, Cryptosporidium hominis
QELKEVWYSLFGKDPNTNRKELMH

SEQ ID NO: 2179571 - protein, 22 aa, Cryptosporidium hominis
QELKPTILVCVPQVLTRIIQTV

SEQ ID NO: 2179572 - protein, 17 aa, Cryptosporidium hominis
QELNIPTIFALNRHRIG

SEQ ID NO: 2179573 - protein, 18 aa, Cryptosporidium hominis
QEMHLSKLVPDILSSICG

SEQ ID NO: 2179574 - protein, 23 aa, Cryptosporidium hominis
QEMKDFKTNLNIIKESQGKNTKT

SEQ ID NO: 2179575 - protein, 24 aa, Cryptosporidium hominis
QEPPRSGLYCDILWADPFDEKDET

SEQ ID NO: 2179576 - protein, 26 aa, Cryptosporidium hominis
QEQRVFSTVFMRYFIEKAQTYTPLVP

SEQ ID NO: 2179577 - protein, 18 aa, Cryptosporidium hominis
QERSIGLLDIYGFEVFDC

SEQ ID NO: 2179578 - protein, 18 aa, Cryptosporidium hominis
QERSSEGFISFTVDIGPL

SEQ ID NO: 2179579 - protein, 18 aa, Cryptosporidium hominis
QESKQLRNIFQGMENYSM

SEQ ID NO: 2179580 - protein, 18 aa, Cryptosporidium hominis
QESKSEWNTFCMQMQQDQ

SEQ ID NO: 2179581 - protein, 24 aa, Cryptosporidium hominis
QESSEFIDAISFDLQEYIECKKKA

SEQ ID NO: 2179582 - protein, 24 aa, Cryptosporidium hominis
QEVISIELHDRFYNHFKTLFDVLD

SEQ ID NO: 2179583 - protein, 28 aa, Cryptosporidium hominis
QEVKKLRIPDCSICREYLTRNLTVITVC

SEQ ID NO: 2179584 - protein, 18 aa, Cryptosporidium hominis
QEVPEFVQNLTLDCSVLE

SEQ ID NO: 2179585 - protein, 17 aa, Cryptosporidium hominis
QEVYLSFIHEIGLIELE

SEQ ID NO: 2179586 - protein, 20 aa, Cryptosporidium hominis
QEWIEFAKMALGFDNSNYPY

SEQ ID NO: 2179587 - protein, 22 aa, Cryptosporidium hominis
QFAELIWRNISELRGWWIKVGQ

SEQ ID NO: 2179588 - protein, 21 aa, Cryptosporidium hominis
QFANSSALGGLEFDQKQISST

SEQ ID NO: 2179589 - protein, 20 aa, Cryptosporidium hominis
QFEILCLSILLLNIYMQSNW

SEQ ID NO: 2179590 - protein, 19 aa, Cryptosporidium hominis
QFFEPKLTFFSSVTGNIES

SEQ ID NO: 2179591 - protein, 28 aa, Cryptosporidium hominis
QFGEPLPCDMCRKSCAFDRGEEARKKLD

SEQ ID NO: 2179592 - protein, 27 aa, Cryptosporidium hominis
QFGGLRPFGVSFLFAGYDKNYGYQLYQ

SEQ ID NO: 2179593 - protein, 26 aa, Cryptosporidium hominis
QFIDLCILSGCDYCGTIRGIGTSTAY

SEQ ID NO: 2179594 - protein, 24 aa, Cryptosporidium hominis
QFILDPKLFRPLYESDNPDKCDRS

SEQ ID NO: 2179595 - protein, 21 aa, Cryptosporidium hominis
QFKLKLEAPKLGKKSKSSPDL

SEQ ID NO: 2179596 - protein, 24 aa, Cryptosporidium hominis
QFPTEFQFHPNLLIIIADHLNNSL

SEQ ID NO: 2179597 - protein, 18 aa, Cryptosporidium hominis
QFQFWTQVRRFRPIERPG

SEQ ID NO: 2179598 - protein, 20 aa, Cryptosporidium hominis
QFQIILGKRNVEFSNVKDEL

SEQ ID NO: 2179599 - protein, 18 aa, Cryptosporidium hominis
QFVHIICSLYTPGIYRLA

SEQ ID NO: 2179600 - protein, 26 aa, Cryptosporidium hominis
QFVNYRAAAALGVWDLCRGTGKGLKN

SEQ ID NO: 2179601 - protein, 25 aa, Cryptosporidium hominis
QFVVGKARWRPGFPSQIAFCCSAID

SEQ ID NO: 2179602 - protein, 23 aa, Cryptosporidium hominis
QFYHFRDLWRLNLKNYSWQEVKT

SEQ ID NO: 2179603 - protein, 21 aa, Cryptosporidium hominis
QGDIPYCDTILYLDNPKPKKY

SEQ ID NO: 2179604 - protein, 24 aa, Cryptosporidium hominis
QGEILHLSQACLSEPKDNGRVYVQ

SEQ ID NO: 2179605 - protein, 26 aa, Cryptosporidium hominis
QGELEVLEPYEILIIPKRDNTVTIRD

SEQ ID NO: 2179606 - protein, 18 aa, Cryptosporidium hominis
QGELKNILKACGLKSSTN

SEQ ID NO: 2179607 - protein, 23 aa, Cryptosporidium hominis
QGELQVLNLLSLVKIEQPESDET

SEQ ID NO: 2179608 - protein, 19 aa, Cryptosporidium hominis
QGEVARITEQLSLRELDME

SEQ ID NO: 2179609 - protein, 25 aa, Cryptosporidium hominis
QGGKRLESIFELLSDIHLQVLKMQQ

SEQ ID NO: 2179610 - protein, 24 aa, Cryptosporidium hominis
QGIKAVNCDLVFDFGISLLEYIHG

SEQ ID NO: 2179611 - protein, 17 aa, Cryptosporidium hominis
QGINMIYGMGGSYSDII

SEQ ID NO: 2179612 - protein, 18 aa, Cryptosporidium hominis
QGKFALSPLNGTEVAPLF

SEQ ID NO: 2179613 - protein, 18 aa, Cryptosporidium hominis
QGKLGFLSFSQKILAHYG

SEQ ID NO: 2179614 - protein, 19 aa, Cryptosporidium hominis
QGKTFATKWYKSSEQTIEL

SEQ ID NO: 2179615 - protein, 17 aa, Cryptosporidium hominis
QGLYWEDEFILPPTQFP

SEQ ID NO: 2179616 - protein, 29 aa, Cryptosporidium hominis
QGNHGFMPPMYPYGSSYAPYVPGAKNGIP

SEQ ID NO: 2179617 - protein, 20 aa, Cryptosporidium hominis
QGNLFWIDSNIAYYSPKNYN

SEQ ID NO: 2179618 - protein, 27 aa, Cryptosporidium hominis
QGNMFCSCCTCPMQQQFPSCQCGTNYF

SEQ ID NO: 2179619 - protein, 27 aa, Cryptosporidium hominis
QGNSGKKEWKNICVASIKELEKEIKEI

SEQ ID NO: 2179620 - protein, 18 aa, Cryptosporidium hominis
QGSKKCKMHKILIFTQFQ

SEQ ID NO: 2179621 - protein, 26 aa, Cryptosporidium hominis
QGVGNMGCGTIHGILGQTNCPMDISN

SEQ ID NO: 2179622 - protein, 22 aa, Cryptosporidium hominis
QGYIFRKTRLVSWCSYLRTALS

SEQ ID NO: 2179623 - protein, 23 aa, Cryptosporidium hominis
QHDGQLAPFCPIIDDENAFFSKN

SEQ ID NO: 2179624 - protein, 20 aa, Cryptosporidium hominis
QHDICKDFKETGYCGFGDTC

SEQ ID NO: 2179625 - protein, 25 aa, Cryptosporidium hominis
QHHILRYTEKMNFLFCSEQDDILTV

SEQ ID NO: 2179626 - protein, 17 aa, Cryptosporidium hominis
QHIPYQIPVNVPYQQMP

SEQ ID NO: 2179627 - protein, 24 aa, Cryptosporidium hominis
QHNFEIPIPFCLDNKATTVRLAIF

SEQ ID NO: 2179628 - protein, 26 aa, Cryptosporidium hominis
QHNLFKSFHWLLNHLCAVFLDDTIWF

SEQ ID NO: 2179629 - protein, 24 aa, Cryptosporidium hominis
QHNSCPVCRFELPTDDEFYESRRR

SEQ ID NO: 2179630 - protein, 30 aa, Cryptosporidium hominis
QHQLVYGCGKLCLLDKLLSRLREKGSRVLI

SEQ ID NO: 2179631 - protein, 19 aa, Cryptosporidium hominis
QHRGNIITTRYYKMASQLR

SEQ ID NO: 2179632 - protein, 17 aa, Cryptosporidium hominis
QHVIKRREKILAMEQAK

SEQ ID NO: 2179633 - protein, 23 aa, Cryptosporidium hominis
QIAEFKEAFSLFDKDGDGSITTK

SEQ ID NO: 2179634 - protein, 18 aa, Cryptosporidium hominis
QIARRIIGTRGINMKRIF

SEQ ID NO: 2179635 - protein, 22 aa, Cryptosporidium hominis
QICAELAALGCGYDIKIYRGSD

SEQ ID NO: 2179636 - protein, 17 aa, Cryptosporidium hominis
QICKLFENYFMKYKDIS

SEQ ID NO: 2179637 - protein, 22 aa, Cryptosporidium hominis
QICSALKALHSIGIMHGDIKAE

SEQ ID NO: 2179638 - protein, 22 aa, Cryptosporidium hominis
QICSYLPLKDFSNFRLVCRTHC

SEQ ID NO: 2179639 - protein, 17 aa, Cryptosporidium hominis
QIDWYSVKFYLKLKQIE

SEQ ID NO: 2179640 - protein, 22 aa, Cryptosporidium hominis
QIECIKCDVSILSQVENAFREI

SEQ ID NO: 2179641 - protein, 23 aa, Cryptosporidium hominis
QIECYLRYLRINQEIERLKVRMA

SEQ ID NO: 2179642 - protein, 17 aa, Cryptosporidium hominis
QIENCKGNLLSDSTINT

SEQ ID NO: 2179643 - protein, 19 aa, Cryptosporidium hominis
QIEYLKCDLKELSKTNNEI

SEQ ID NO: 2179644 - protein, 27 aa, Cryptosporidium hominis
QIFWISCKSIKCFMQPVLLEYESILND

SEQ ID NO: 2179645 - protein, 29 aa, Cryptosporidium hominis
QIGDSLLRKVCTDINLSLNYPIQSFEEKY

SEQ ID NO: 2179646 - protein, 23 aa, Cryptosporidium hominis
QIGKKELLAWGSSLLGEELNWKS

SEQ ID NO: 2179647 - protein, 19 aa, Cryptosporidium hominis
QIGLFGSNPCSYRGNYENV

SEQ ID NO: 2179648 - protein, 18 aa, Cryptosporidium hominis
QIGNACWELFCLEHGINP

SEQ ID NO: 2179649 - protein, 28 aa, Cryptosporidium hominis
QIHLMKRVPIEFIPSERMVRIYASSYDT

SEQ ID NO: 2179650 - protein, 27 aa, Cryptosporidium hominis
QIIDTWPYAFPRYKYDIDDQLEISIYY

SEQ ID NO: 2179651 - protein, 32 aa, Cryptosporidium hominis
QIIRNEFSLNYGWRPICNVPTPIQESILKERK

SEQ ID NO: 2179652 - protein, 30 aa, Cryptosporidium hominis
QIKFVTRRRLRQLVKSGLSKGFSEGVPPFT

SEQ ID NO: 2179653 - protein, 20 aa, Cryptosporidium hominis
QIKLELSDKFEVEIINIAIH

SEQ ID NO: 2179654 - protein, 27 aa, Cryptosporidium hominis
QILAIQYFVPYVIKHSYKLEDDEIPDN

SEQ ID NO: 2179655 - protein, 17 aa, Cryptosporidium hominis
QILFDGRLPKENPFNKL

SEQ ID NO: 2179656 - protein, 26 aa, Cryptosporidium hominis
QILHFYCIKFLWKFLPLTSTKDFLEQ

SEQ ID NO: 2179657 - protein, 26 aa, Cryptosporidium hominis
QILHRRIEWFLHWYIESASSIDQEDR

SEQ ID NO: 2179658 - protein, 21 aa, Cryptosporidium hominis
QILKHLFTFYSKVLLLDLDEL

SEQ ID NO: 2179659 - protein, 20 aa, Cryptosporidium hominis
QILKSGLRFFHLDIIDKDND

SEQ ID NO: 2179660 - protein, 23 aa, Cryptosporidium hominis
QILLRLYFELLRQGGSSEESILS

SEQ ID NO: 2179661 - protein, 25 aa, Cryptosporidium hominis
QILYNRSLVQLGLSAFRLGQISEAQ

SEQ ID NO: 2179662 - protein, 25 aa, Cryptosporidium hominis
QIMKHKYDKGCFGKCPRVLCNGYKV

SEQ ID NO: 2179663 - protein, 19 aa, Cryptosporidium hominis
QINGFGIYHWNDGRVYTGY

SEQ ID NO: 2179664 - protein, 18 aa, Cryptosporidium hominis
QINTFLRKLGFFVSSRLN

SEQ ID NO: 2179665 - protein, 30 aa, Cryptosporidium hominis
QIPNGCEFGFRPGEWGKPPLDDHGKPIWGL

SEQ ID NO: 2179666 - protein, 19 aa, Cryptosporidium hominis
QIQEREWGLLIFDEVQFAP

SEQ ID NO: 2179667 - protein, 17 aa, Cryptosporidium hominis
QIQRLFECHIFKINNKD

SEQ ID NO: 2179668 - protein, 17 aa, Cryptosporidium hominis
QIRFCILPDMLKNAPMF

SEQ ID NO: 2179669 - protein, 20 aa, Cryptosporidium hominis
QIRHKLGLKSQMNSKSYFES

SEQ ID NO: 2179670 - protein, 19 aa, Cryptosporidium hominis
QIRKASFSIQSRWRSFQIR

SEQ ID NO: 2179671 - protein, 20 aa, Cryptosporidium hominis
QIRKMVALAIEIFRGTAPSN

SEQ ID NO: 2179672 - protein, 22 aa, Cryptosporidium hominis
QISGIRDVASWEIDRPQETRPN

SEQ ID NO: 2179673 - protein, 24 aa, Cryptosporidium hominis
QISIADCQIYMTIFVDSASLRDNI

SEQ ID NO: 2179674 - protein, 19 aa, Cryptosporidium hominis
QISNIEFLKVMSLSSKAKK

SEQ ID NO: 2179675 - protein, 17 aa, Cryptosporidium hominis
QISSFQIVDGMNISSSS

SEQ ID NO: 2179676 - protein, 20 aa, Cryptosporidium hominis
QITPGVGVNSQITPGVEVNS

SEQ ID NO: 2179677 - protein, 21 aa, Cryptosporidium hominis
QITSRISIFNVLREIKPSLKK

SEQ ID NO: 2179678 - protein, 30 aa, Cryptosporidium hominis
QIVNPEVYCVPGTKSYIVFGDAKLEDRNTA

SEQ ID NO: 2179679 - protein, 25 aa, Cryptosporidium hominis
QIVSKFPNCCLLRRHPEPKYDQLEK

SEQ ID NO: 2179680 - protein, 32 aa, Cryptosporidium hominis
QIYKLENFISIELFNKIKMEWTKSTISIYSGQ

SEQ ID NO: 2179681 - protein, 22 aa, Cryptosporidium hominis
QKARILHAVAQWRERFKTIDDF

SEQ ID NO: 2179682 - protein, 23 aa, Cryptosporidium hominis
QKDLLCSKYSVILIDEAHERTVN

SEQ ID NO: 2179683 - protein, 30 aa, Cryptosporidium hominis
QKDRHTLAYDKGWRIRQIFRQFQILRNNPF

SEQ ID NO: 2179684 - protein, 25 aa, Cryptosporidium hominis
QKEKMFLLIKLISKIYYYDTQLKEK

SEQ ID NO: 2179685 - protein, 25 aa, Cryptosporidium hominis
QKELKRLKLVVIDPITSLLGSHNFI

SEQ ID NO: 2179686 - protein, 22 aa, Cryptosporidium hominis
QKFRIPEKYGYSIYLKVPSSNT

SEQ ID NO: 2179687 - protein, 17 aa, Cryptosporidium hominis
QKGDMLCDYDDGHEGAS

SEQ ID NO: 2179688 - protein, 18 aa, Cryptosporidium hominis
QKGFWEMCNSDSLHKSYM

SEQ ID NO: 2179689 - protein, 22 aa, Cryptosporidium hominis
QKGVDFIKAFLLGFELQDAIAL

SEQ ID NO: 2179690 - protein, 22 aa, Cryptosporidium hominis
QKHFDMLYSIIAREMNDTECML

SEQ ID NO: 2179691 - protein, 21 aa, Cryptosporidium hominis
QKIFLSILFFTVYHLLSNGKY

SEQ ID NO: 2179692 - protein, 29 aa, Cryptosporidium hominis
QKIQLLFRDCFRVGLQLLDLSGADFNQIN

SEQ ID NO: 2179693 - protein, 17 aa, Cryptosporidium hominis
QKKRQALENTWKTVNSS

SEQ ID NO: 2179694 - protein, 24 aa, Cryptosporidium hominis
QKKYLRFPLCEKIIKSHKYVKQMK

SEQ ID NO: 2179695 - protein, 21 aa, Cryptosporidium hominis
QKLALEEIFAKYGKIESIKMF

SEQ ID NO: 2179696 - protein, 20 aa, Cryptosporidium hominis
QKLDIPIVIKLLHNKLIDLS

SEQ ID NO: 2179697 - protein, 19 aa, Cryptosporidium hominis
QKLHAAGIASKLVDKNIID

SEQ ID NO: 2179698 - protein, 29 aa, Cryptosporidium hominis
QKLHFFELRLARYLSYCVDGGLLGAKFII

SEQ ID NO: 2179699 - protein, 23 aa, Cryptosporidium hominis
QKLLEIIYFEIHFSESNTRNYQD

SEQ ID NO: 2179700 - protein, 24 aa, Cryptosporidium hominis
QKLNIKSGFPILGTQILCNNIEKK

SEQ ID NO: 2179701 - protein, 25 aa, Cryptosporidium hominis
QKLSFFFNKFRVVDEDLSWPIIDQG

SEQ ID NO: 2179702 - protein, 26 aa, Cryptosporidium hominis
QKMDLGGSVPLMLQRIVLATQLQSLN

SEQ ID NO: 2179703 - protein, 25 aa, Cryptosporidium hominis
QKNETFSSFFAYECSSAFEQQASHD

SEQ ID NO: 2179704 - protein, 23 aa, Cryptosporidium hominis
QKNKFKINHCIKSLENEFEKDNF

SEQ ID NO: 2179705 - protein, 20 aa, Cryptosporidium hominis
QKNKFLPKIAEWVKEHIDGV

SEQ ID NO: 2179706 - protein, 28 aa, Cryptosporidium hominis
QKNMMYRQKLSLIISGFISKLSDKRKLS

SEQ ID NO: 2179707 - protein, 18 aa, Cryptosporidium hominis
QKPISNWEWVKFRNSARN

SEQ ID NO: 2179708 - protein, 26 aa, Cryptosporidium hominis
QKPQGWRVVYYTGKDREFEYFKVPAN

SEQ ID NO: 2179709 - protein, 23 aa, Cryptosporidium hominis
QKQEIKEAFELFDTEKTGRIDYH

SEQ ID NO: 2179710 - protein, 25 aa, Cryptosporidium hominis
QKQYSCPLCMTSTYYKNDIKMYYGD

SEQ ID NO: 2179711 - protein, 22 aa, Cryptosporidium hominis
QKRFSFVRDNIRGVAEEIESWT

SEQ ID NO: 2179712 - protein, 19 aa, Cryptosporidium hominis
QKRKANCEYSASMRAPSTK

SEQ ID NO: 2179713 - protein, 17 aa, Cryptosporidium hominis
QKSDIMIDGTRIKTDNH

SEQ ID NO: 2179714 - protein, 26 aa, Cryptosporidium hominis
QKSIIFEFGKKLGMNSLSFKLVYIHK

SEQ ID NO: 2179715 - protein, 18 aa, Cryptosporidium hominis
QKSMRWQPISVIHNQLAL

SEQ ID NO: 2179716 - protein, 20 aa, Cryptosporidium hominis
QKSRVAIAIMAYLNPHLLIL

SEQ ID NO: 2179717 - protein, 18 aa, Cryptosporidium hominis
QKTAPRVLIFSENKKDVD

SEQ ID NO: 2179718 - protein, 28 aa, Cryptosporidium hominis
QKTLKCCFEWFKTFKIMESDGVVCDDVF

SEQ ID NO: 2179719 - protein, 23 aa, Cryptosporidium hominis
QKVNLPRSWYFLGEKIDEIYVSV

SEQ ID NO: 2179720 - protein, 21 aa, Cryptosporidium hominis
QKWPDGAVFEGNFVNGTANGY

SEQ ID NO: 2179721 - protein, 20 aa, Cryptosporidium hominis
QKYFKRFSIDSGDQDTLFHP

SEQ ID NO: 2179722 - protein, 17 aa, Cryptosporidium hominis
QKYKRIERIVAREREEF

SEQ ID NO: 2179723 - protein, 19 aa, Cryptosporidium hominis
QKYLKKAIQGYEFNLDEIE

SEQ ID NO: 2179724 - protein, 38 aa, Cryptosporidium hominis
QKYVIPLIMSYPIAGIVFFNTNMGIKWFNAKNPIINDH

SEQ ID NO: 2179725 - protein, 19 aa, Cryptosporidium hominis
QLALKHRLNKNLRQRIVCF

SEQ ID NO: 2179726 - protein, 18 aa, Cryptosporidium hominis
QLATIAFYVQDEFDEIPQ

SEQ ID NO: 2179727 - protein, 22 aa, Cryptosporidium hominis
QLCLECIEWCLEEKRTFLRHRI

SEQ ID NO: 2179728 - protein, 23 aa, Cryptosporidium hominis
QLCNLKRAEGFDAKKFESGFLGK

SEQ ID NO: 2179729 - protein, 19 aa, Cryptosporidium hominis
QLCSAYCAISELFMTDLCY

SEQ ID NO: 2179730 - protein, 24 aa, Cryptosporidium hominis
QLCVRVCPFYNSIIVRSILDTAFS

SEQ ID NO: 2179731 - protein, 28 aa, Cryptosporidium hominis
QLDRMRNEFSYFYPLDCRVSGKDLIFNH

SEQ ID NO: 2179732 - protein, 34 aa, Cryptosporidium hominis
QLELANQEILSWKYRLQRHSILLNDTRRKLFNEL

SEQ ID NO: 2179733 - protein, 18 aa, Cryptosporidium hominis
QLENDFLLLDGILNYGIA

SEQ ID NO: 2179734 - protein, 18 aa, Cryptosporidium hominis
QLEQFLSRFSHISNPMTR

SEQ ID NO: 2179735 - protein, 24 aa, Cryptosporidium hominis
QLFLRPFMQCCAPRSRSGKKIKIN

SEQ ID NO: 2179736 - protein, 25 aa, Cryptosporidium hominis
QLFQALSRLSLELSNTNLALDQCLK

SEQ ID NO: 2179737 - protein, 19 aa, Cryptosporidium hominis
QLFSPKISLISSYITQEEE

SEQ ID NO: 2179738 - protein, 25 aa, Cryptosporidium hominis
QLFWEVDSVYPLREFQFGVMNEQTL

SEQ ID NO: 2179739 - protein, 23 aa, Cryptosporidium hominis
QLGNWEFLEIIISDNKNNVEQKI

SEQ ID NO: 2179740 - protein, 23 aa, Cryptosporidium hominis
QLHEISSLMSFFSSKIQEQSEIC

SEQ ID NO: 2179741 - protein, 22 aa, Cryptosporidium hominis
QLIEFLFLDFLDYIHIDKGLIK

SEQ ID NO: 2179742 - protein, 22 aa, Cryptosporidium hominis
QLKFSCLTLPPKGLNASSEDII

SEQ ID NO: 2179743 - protein, 23 aa, Cryptosporidium hominis
QLKKENIFNFPILIQEYNFDNLI

SEQ ID NO: 2179744 - protein, 22 aa, Cryptosporidium hominis
QLKKVLCLGVAIGNVNMTEEEI

SEQ ID NO: 2179745 - protein, 24 aa, Cryptosporidium hominis
QLKNKIFLNSEFSKCINIDSNNNS

SEQ ID NO: 2179746 - protein, 26 aa, Cryptosporidium hominis
QLKSIEKGDCSIIWIKDDGEQLSQIP

SEQ ID NO: 2179747 - protein, 24 aa, Cryptosporidium hominis
QLLGERLFPIIAQFQPELAGKITG

SEQ ID NO: 2179748 - protein, 22 aa, Cryptosporidium hominis
QLLKFLCSFNIDDIIKLNELCN

SEQ ID NO: 2179749 - protein, 18 aa, Cryptosporidium hominis
QLLLSLNVLACFQNSNKI

SEQ ID NO: 2179750 - protein, 21 aa, Cryptosporidium hominis
QLLNLCKLLSVLSSEIPNGVC

SEQ ID NO: 2179751 - protein, 18 aa, Cryptosporidium hominis
QLLQRILFTWTRENPELG

SEQ ID NO: 2179752 - protein, 19 aa, Cryptosporidium hominis
QLMPSIPGVYFDRRQIGYR

SEQ ID NO: 2179753 - protein, 24 aa, Cryptosporidium hominis
QLMYWNRYGKFYSVINNSRRIMVY

SEQ ID NO: 2179754 - protein, 18 aa, Cryptosporidium hominis
QLNLKVCAVKAPGFGDHR

SEQ ID NO: 2179755 - protein, 31 aa, Cryptosporidium hominis
QLNRIFCYFKNLPYLISFPLSQCKFEKYLAC

SEQ ID NO: 2179756 - protein, 18 aa, Cryptosporidium hominis
QLPKGVAFVKFKNIESVE

SEQ ID NO: 2179757 - protein, 20 aa, Cryptosporidium hominis
QLPPGIAGYVIIKIDEVREF

SEQ ID NO: 2179758 - protein, 20 aa, Cryptosporidium hominis
QLPRKLLRIATRPFHKIFSI

SEQ ID NO: 2179759 - protein, 26 aa, Cryptosporidium hominis
QLQKVDFLFGKSFRPPEAYETGSLYD

SEQ ID NO: 2179760 - protein, 27 aa, Cryptosporidium hominis
QLQYCRKTCPPNCTIPTHINGNMFRRK

SEQ ID NO: 2179761 - protein, 23 aa, Cryptosporidium hominis
QLRFKPKIIRDQIILLVDSIIQI

SEQ ID NO: 2179762 - protein, 19 aa, Cryptosporidium hominis
QLRRIHLHIMKKISDEVYK

SEQ ID NO: 2179763 - protein, 20 aa, Cryptosporidium hominis
QLRVQLPFVKNIGGNYIMDE

SEQ ID NO: 2179764 - protein, 20 aa, Cryptosporidium hominis
QLRVRKLIQSILWKIIKFAH

SEQ ID NO: 2179765 - protein, 24 aa, Cryptosporidium hominis
QLSCSFGITSMDHWELGPDPLEGP

SEQ ID NO: 2179766 - protein, 24 aa, Cryptosporidium hominis
QLSKLCYEPIASISPEFDPQNGIG

SEQ ID NO: 2179767 - protein, 24 aa, Cryptosporidium hominis
QLSSCKQFSEKIIFTVEDKDDAIK

SEQ ID NO: 2179768 - protein, 27 aa, Cryptosporidium hominis
QLTGIYRYKYRIMRQVRMCKDIKHIVY

SEQ ID NO: 2179769 - protein, 23 aa, Cryptosporidium hominis
QLTNKCILACSGMLADINALRKT

SEQ ID NO: 2179770 - protein, 31 aa, Cryptosporidium hominis
QLVKDCIFGRIFDLRIIRFIKINDIHALTGS

SEQ ID NO: 2179771 - protein, 19 aa, Cryptosporidium hominis
QLVLNCLGITPDLEPAQYI

SEQ ID NO: 2179772 - protein, 23 aa, Cryptosporidium hominis
QLWSEGRNGILADEMGLGKTMQT

SEQ ID NO: 2179773 - protein, 25 aa, Cryptosporidium hominis
QLYYDWQGYFFPNISYVNIYWIPYS

SEQ ID NO: 2179774 - protein, 17 aa, Cryptosporidium hominis
QMAWRRKQNYSFECEEL

SEQ ID NO: 2179775 - protein, 27 aa, Cryptosporidium hominis
QMCDRFIRDIPRGFFYAYFLNPLILLA

SEQ ID NO: 2179776 - protein, 24 aa, Cryptosporidium hominis
QMKSYKPDCIIGMGGGHCMDIAKV

SEQ ID NO: 2179777 - protein, 25 aa, Cryptosporidium hominis
QMMRFDMRESFPLLTTKKVAIRSIF

SEQ ID NO: 2179778 - protein, 18 aa, Cryptosporidium hominis
QMNLPMSFNNNGGSNEFG

SEQ ID NO: 2179779 - protein, 25 aa, Cryptosporidium hominis
QMQRAGGLHPGFQPVLHHLQQQLQL

SEQ ID NO: 2179780 - protein, 19 aa, Cryptosporidium hominis
QMRTYKWFRPPFGRLTKQQ

SEQ ID NO: 2179781 - protein, 17 aa, Cryptosporidium hominis
QMSHNLTGIISFEETNA

SEQ ID NO: 2179782 - protein, 23 aa, Cryptosporidium hominis
QMSSRRLLVFNVGYNKEYGKDTL

SEQ ID NO: 2179783 - protein, 18 aa, Cryptosporidium hominis
QMVDIFSLLHLNRGFNYL

SEQ ID NO: 2179784 - protein, 18 aa, Cryptosporidium hominis
QNARIGLIQFCLSAPKTD

SEQ ID NO: 2179785 - protein, 25 aa, Cryptosporidium hominis
QNDEEIKEEIDLMINRIKEIDEIEL

SEQ ID NO: 2179786 - protein, 23 aa, Cryptosporidium hominis
QNDPHCWLWSYNIVNRQCSFHMN

SEQ ID NO: 2179787 - protein, 18 aa, Cryptosporidium hominis
QNEDMPGEMFLKTSNSIK

SEQ ID NO: 2179788 - protein, 29 aa, Cryptosporidium hominis
QNFLYCIMGEISIELIINQVCEKAKKYRS

SEQ ID NO: 2179789 - protein, 22 aa, Cryptosporidium hominis
QNFRSLETFKSLISDNNGSIKN

SEQ ID NO: 2179790 - protein, 19 aa, Cryptosporidium hominis
QNIMSFVGSSSFKSNNKAD

SEQ ID NO: 2179791 - protein, 25 aa, Cryptosporidium hominis
QNKAVAVKPCPSCGQRFRGSVPNKS

SEQ ID NO: 2179792 - protein, 18 aa, Cryptosporidium hominis
QNKHLNIRGELAHQKKAL

SEQ ID NO: 2179793 - protein, 25 aa, Cryptosporidium hominis
QNKLPPWKRKPISLDNDILKRAKNF

SEQ ID NO: 2179794 - protein, 24 aa, Cryptosporidium hominis
QNKRTILLAIEMRKIITPILEEFD

SEQ ID NO: 2179795 - protein, 18 aa, Cryptosporidium hominis
QNKVFKTKGNEWIYKARK

SEQ ID NO: 2179796 - protein, 24 aa, Cryptosporidium hominis
QNLCGLKPIIKCTGKIIIKMSVTS

SEQ ID NO: 2179797 - protein, 21 aa, Cryptosporidium hominis
QNLIKIIKFVIILKSYQKLDL

SEQ ID NO: 2179798 - protein, 17 aa, Cryptosporidium hominis
QNLKIDLNNTVLILDEA

SEQ ID NO: 2179799 - protein, 17 aa, Cryptosporidium hominis
QNLKISKSMMGAELSSL

SEQ ID NO: 2179800 - protein, 17 aa, Cryptosporidium hominis
QNLKVPFNKSIEYSLNL

SEQ ID NO: 2179801 - protein, 17 aa, Cryptosporidium hominis
QNLQEWELNAFKSSTFE

SEQ ID NO: 2179802 - protein, 17 aa, Cryptosporidium hominis
QNLRKVIWNSILGLERF

SEQ ID NO: 2179803 - protein, 28 aa, Cryptosporidium hominis
QNLYQAGSMPILLDMEFDDFINNEENED

SEQ ID NO: 2179804 - protein, 25 aa, Cryptosporidium hominis
QNNILKLIDHLSINIGKISFEGLKN

SEQ ID NO: 2179805 - protein, 17 aa, Cryptosporidium hominis
QNNPLSHVIRRLTEEIF

SEQ ID NO: 2179806 - protein, 18 aa, Cryptosporidium hominis
QNRDVFCTRMGYSSMTIR

SEQ ID NO: 2179807 - protein, 17 aa, Cryptosporidium hominis
QNSLILKASKIGNLQLV

SEQ ID NO: 2179808 - protein, 20 aa, Cryptosporidium hominis
QNSTLDWTRDERKMFRLESS

SEQ ID NO: 2179809 - protein, 22 aa, Cryptosporidium hominis
QNTRKGYVNKMYQYLADSSQFP

SEQ ID NO: 2179810 - protein, 17 aa, Cryptosporidium hominis
QNVAYDCTFKLRCSRGI

SEQ ID NO: 2179811 - protein, 25 aa, Cryptosporidium hominis
QNYKNLRCLLLGGNKIKDFSELIVL

SEQ ID NO: 2179812 - protein, 17 aa, Cryptosporidium hominis
QNYLVWIKDLEQIDLGI

SEQ ID NO: 2179813 - protein, 23 aa, Cryptosporidium hominis
QPAEFASLLGLCYLPPQIDNRTK

SEQ ID NO: 2179814 - protein, 17 aa, Cryptosporidium hominis
QPCCVNLSKVFLGGNPI

SEQ ID NO: 2179815 - protein, 23 aa, Cryptosporidium hominis
QPCIPLHPRCRIIEDTGNKKSFT

SEQ ID NO: 2179816 - protein, 24 aa, Cryptosporidium hominis
QPEIGESIVDAWGVGNTFESFIKG

SEQ ID NO: 2179817 - protein, 25 aa, Cryptosporidium hominis
QPGDSICLAIQFSERLKNTKLMYDD

SEQ ID NO: 2179818 - protein, 31 aa, Cryptosporidium hominis
QPHSPNPMGLQPFPMHSILLPTLLQAQIQAQ

SEQ ID NO: 2179819 - protein, 25 aa, Cryptosporidium hominis
QPKEDLKILVTKGVANISPKIVPKV

SEQ ID NO: 2179820 - protein, 29 aa, Cryptosporidium hominis
QPKTFVPVDCRVMPGYPFASLAGVPCVIP

SEQ ID NO: 2179821 - protein, 21 aa, Cryptosporidium hominis
QPMRFGNKAFQTWYDKTNQTC

SEQ ID NO: 2179822 - protein, 20 aa, Cryptosporidium hominis
QPNECNIAFVLKTQDVSDLI

SEQ ID NO: 2179823 - protein, 27 aa, Cryptosporidium hominis
QPQKLPKLRGFLSMNSLAHLGRQSFGT

SEQ ID NO: 2179824 - protein, 19 aa, Cryptosporidium hominis
QPRIIFRQKGIYKVLLNSP

SEQ ID NO: 2179825 - protein, 21 aa, Cryptosporidium hominis
QPSPFGGVLNDGFWNHSHNSV

SEQ ID NO: 2179826 - protein, 25 aa, Cryptosporidium hominis
QPSYKEWRTAYATFKTWSCAQKVIQ

SEQ ID NO: 2179827 - protein, 23 aa, Cryptosporidium hominis
QQALKHPWLVDSFKYNPIGPIYK

SEQ ID NO: 2179828 - protein, 17 aa, Cryptosporidium hominis
QQALLIYKYWRMRRHKL

SEQ ID NO: 2179829 - protein, 19 aa, Cryptosporidium hominis
QQCMLRFQNESDLIDFTDK

SEQ ID NO: 2179830 - protein, 30 aa, Cryptosporidium hominis
QQEHIQAIELLKYFWGLSLSPKDNDERRKT

SEQ ID NO: 2179831 - protein, 18 aa, Cryptosporidium hominis
QQEILWLPCTHCFCRNCI

SEQ ID NO: 2179832 - protein, 20 aa, Cryptosporidium hominis
QQFLILFLFICTFREFSGLS

SEQ ID NO: 2179833 - protein, 23 aa, Cryptosporidium hominis
QQIDFSRKLIVERFNQITLELQK

SEQ ID NO: 2179834 - protein, 17 aa, Cryptosporidium hominis
QQILAYYLFIVLKFIIP

SEQ ID NO: 2179835 - protein, 21 aa, Cryptosporidium hominis
QQIQLAMSFPMLSKENFELIK

SEQ ID NO: 2179836 - protein, 25 aa, Cryptosporidium hominis
QQKMEIKEAFELFDGDSIGYIDIKE

SEQ ID NO: 2179837 - protein, 18 aa, Cryptosporidium hominis
QQKPRFNLWASIKESITK

SEQ ID NO: 2179838 - protein, 26 aa, Cryptosporidium hominis
QQLHALQNLAPIQGMPHMQSFPHIGA

SEQ ID NO: 2179839 - protein, 19 aa, Cryptosporidium hominis
QQNNYRWVRYVTQSNSYIY

SEQ ID NO: 2179840 - protein, 36 aa, Cryptosporidium hominis
QQPPGDFKRLFIGGSVRLKYSYAITCKNAIIDTDTK

SEQ ID NO: 2179841 - protein, 17 aa, Cryptosporidium hominis
QQQSISFRENRNIHPCA

SEQ ID NO: 2179842 - protein, 17 aa, Cryptosporidium hominis
QQQTFILDGVWETPVAS

SEQ ID NO: 2179843 - protein, 24 aa, Cryptosporidium hominis
QQSESSFKFGRIIDSTLSTPSTAD

SEQ ID NO: 2179844 - protein, 23 aa, Cryptosporidium hominis
QQYKLADEVLLKMKKMLEFLRSY

SEQ ID NO: 2179845 - protein, 20 aa, Cryptosporidium hominis
QRALLLKWITEILKTSEASS

SEQ ID NO: 2179846 - protein, 26 aa, Cryptosporidium hominis
QRASEYARSLGIPRIFIAANSGARMG

SEQ ID NO: 2179847 - protein, 29 aa, Cryptosporidium hominis
QRDGPWFPTLRLLHKYPDMMPTMQVDKGA

SEQ ID NO: 2179848 - protein, 20 aa, Cryptosporidium hominis
QREIYKKELVASGIVVKKRP

SEQ ID NO: 2179849 - protein, 20 aa, Cryptosporidium hominis
QRFPPVVQFHLKRFQFNIQS

SEQ ID NO: 2179850 - protein, 21 aa, Cryptosporidium hominis
QRGHLTLKYRRDNNETKKNES

SEQ ID NO: 2179851 - protein, 19 aa, Cryptosporidium hominis
QRIPPELFKLSPQNKRMHP

SEQ ID NO: 2179852 - protein, 21 aa, Cryptosporidium hominis
QRISEVNGLLIRKRELQEKLK

SEQ ID NO: 2179853 - protein, 17 aa, Cryptosporidium hominis
QRKCLLEVKSLIIFNYL

SEQ ID NO: 2179854 - protein, 24 aa, Cryptosporidium hominis
QRKGLPTQHKIVMAAEKQRTLNKK

SEQ ID NO: 2179855 - protein, 36 aa, Cryptosporidium hominis
QRKLVLHVISFKRISNFSSIFCKEIEYYGFLGEFYS

SEQ ID NO: 2179856 - protein, 27 aa, Cryptosporidium hominis
QRKNLEAFECTECSKFYKAINNNRTSN

SEQ ID NO: 2179857 - protein, 23 aa, Cryptosporidium hominis
QRKSSILLECIQGFVKMMKGLPN

SEQ ID NO: 2179858 - protein, 22 aa, Cryptosporidium hominis
QRLKETLRRNVDLMTELQKARG

SEQ ID NO: 2179859 - protein, 22 aa, Cryptosporidium hominis
QRLKFERKSLREENEVLQKRLS

SEQ ID NO: 2179860 - protein, 24 aa, Cryptosporidium hominis
QRLRSKYGAPFTWAQNKSRDKTEV

SEQ ID NO: 2179861 - protein, 19 aa, Cryptosporidium hominis
QRLWGDNFFNPETKKFTKT

SEQ ID NO: 2179862 - protein, 26 aa, Cryptosporidium hominis
QRMARIGWDLGILFNHYSMRKEMEDL

SEQ ID NO: 2179863 - protein, 18 aa, Cryptosporidium hominis
QRNAFYWQPSGGESLANL

SEQ ID NO: 2179864 - protein, 23 aa, Cryptosporidium hominis
QRNEYNIGISIQEEFESLKELIQ

SEQ ID NO: 2179865 - protein, 20 aa, Cryptosporidium hominis
QRNGNIIGIGFEGSMSSVPY

SEQ ID NO: 2179866 - protein, 31 aa, Cryptosporidium hominis
QRPPRIKYNLCRWICRAYIFQAIRLPVVEST

SEQ ID NO: 2179867 - protein, 19 aa, Cryptosporidium hominis
QRPSIIFNNSVSFQKSNYK

SEQ ID NO: 2179868 - protein, 24 aa, Cryptosporidium hominis
QRQFACLLWGIKNEYGLVTTEKSI

SEQ ID NO: 2179869 - protein, 17 aa, Cryptosporidium hominis
QRQLCKDGLSAMLVTSG

SEQ ID NO: 2179870 - protein, 20 aa, Cryptosporidium hominis
QRQLFKEFIAKQILKDPKSQ

SEQ ID NO: 2179871 - protein, 19 aa, Cryptosporidium hominis
QRSQLRISILQQVLHATGD

SEQ ID NO: 2179872 - protein, 22 aa, Cryptosporidium hominis
QRSRKITSFVLFNKVKKDKEEI

SEQ ID NO: 2179873 - protein, 23 aa, Cryptosporidium hominis
QRTFREIMILTELSGHENIVNLL

SEQ ID NO: 2179874 - protein, 21 aa, Cryptosporidium hominis
QRVGLHLSLTRNHHISKKLSI

SEQ ID NO: 2179875 - protein, 26 aa, Cryptosporidium hominis
QRYDLIFKDILLRDMNRMDAMYNRDI

SEQ ID NO: 2179876 - protein, 17 aa, Cryptosporidium hominis
QSAFNFQASPAYFIIPN

SEQ ID NO: 2179877 - protein, 24 aa, Cryptosporidium hominis
QSCNSRLAMNLTVLIRNLFSPEDQ

SEQ ID NO: 2179878 - protein, 23 aa, Cryptosporidium hominis
QSDIKRLIEFAIDRSSVQGENSP

SEQ ID NO: 2179879 - protein, 27 aa, Cryptosporidium hominis
QSDLIPYAALFARCYYPSKLEEIVIKW

SEQ ID NO: 2179880 - protein, 24 aa, Cryptosporidium hominis
QSEHSLQVSFCMGTMLGRKQMNIL

SEQ ID NO: 2179881 - protein, 25 aa, Cryptosporidium hominis
QSELEIVEGLKLDKGYISPYFITNQ

SEQ ID NO: 2179882 - protein, 23 aa, Cryptosporidium hominis
QSFDLPSIKVIKRFEALNKSGKQ

SEQ ID NO: 2179883 - protein, 20 aa, Cryptosporidium hominis
QSFIPIDILYSIWTEFIAEI

SEQ ID NO: 2179884 - protein, 25 aa, Cryptosporidium hominis
QSGLITRLSLFKNIHPLYESSDPSL

SEQ ID NO: 2179885 - protein, 21 aa, Cryptosporidium hominis
QSGPKLMGFDHSFSMENTQKR

SEQ ID NO: 2179886 - protein, 28 aa, Cryptosporidium hominis
QSGSLNIYISWSSYRLMESEKNNSDEIL

SEQ ID NO: 2179887 - protein, 19 aa, Cryptosporidium hominis
QSHPHTGDKWVIYPMYDFA

SEQ ID NO: 2179888 - protein, 18 aa, Cryptosporidium hominis
QSILPGAAFVDFMATVAL

SEQ ID NO: 2179889 - protein, 17 aa, Cryptosporidium hominis
QSISRLFLLPRPGTSLV

SEQ ID NO: 2179890 - protein, 22 aa, Cryptosporidium hominis
QSKLKSVPCLALSSTGNTNTVE

SEQ ID NO: 2179891 - protein, 18 aa, Cryptosporidium hominis
QSKMEALQLSHKMELMKL

SEQ ID NO: 2179892 - protein, 48 aa, Cryptosporidium hominis
QSLIRMRFVCILWRKILPYRQFICGLALLIHLAIPWVKTSTIFDKLEE

SEQ ID NO: 2179893 - protein, 18 aa, Cryptosporidium hominis
QSLKWDTFMRRYNTIPTF

SEQ ID NO: 2179894 - protein, 34 aa, Cryptosporidium hominis
QSLLFLSVLMGPKWERELKRYTQLSIKYFPYSGE

SEQ ID NO: 2179895 - protein, 17 aa, Cryptosporidium hominis
QSLPQYILIKGILSEYS

SEQ ID NO: 2179896 - protein, 19 aa, Cryptosporidium hominis
QSLSPCSKSHCNNKQENTK

SEQ ID NO: 2179897 - protein, 17 aa, Cryptosporidium hominis
QSLWMIPKELTIEEYKK

SEQ ID NO: 2179898 - protein, 31 aa, Cryptosporidium hominis
QSNISGCLFCQRLQHCCICDFSRRTGTGMMN

SEQ ID NO: 2179899 - protein, 18 aa, Cryptosporidium hominis
QSNIYILNFINSFLNTCN

SEQ ID NO: 2179900 - protein, 26 aa, Cryptosporidium hominis
QSNLRIPIEFCNWIIDSFLSKYQTEN

SEQ ID NO: 2179901 - protein, 23 aa, Cryptosporidium hominis
QSNPPALALRWLMNLYSLTNSYV

SEQ ID NO: 2179902 - protein, 23 aa, Cryptosporidium hominis
QSPCNPCKGTGKTIPVTKQCKKC

SEQ ID NO: 2179903 - protein, 18 aa, Cryptosporidium hominis
QSPNEFSSMILNRDIWND

SEQ ID NO: 2179904 - protein, 23 aa, Cryptosporidium hominis
QSPNFESHEPFTVEDNFDDNCSS

SEQ ID NO: 2179905 - protein, 25 aa, Cryptosporidium hominis
QSQKILFKLFNYWNLNIDFKQSSFF

SEQ ID NO: 2179906 - protein, 19 aa, Cryptosporidium hominis
QSQTRFPLINFQNSEEKGL

SEQ ID NO: 2179907 - protein, 19 aa, Cryptosporidium hominis
QSRKSWTTRIEKILKAAAF

SEQ ID NO: 2179908 - protein, 23 aa, Cryptosporidium hominis
QSSEFILSLMIERIVQKIEHIVI

SEQ ID NO: 2179909 - protein, 22 aa, Cryptosporidium hominis
QSSKILLNFNRNGVFALFDPIS

SEQ ID NO: 2179910 - protein, 22 aa, Cryptosporidium hominis
QSSLLFRDYVEAMLQIGRNFSL

SEQ ID NO: 2179911 - protein, 23 aa, Cryptosporidium hominis
QSSNFQILWPSLQDWIYSSDKNI

SEQ ID NO: 2179912 - protein, 23 aa, Cryptosporidium hominis
QSSSQSWYLSRITSFSTNYRELS

SEQ ID NO: 2179913 - protein, 24 aa, Cryptosporidium hominis
QSYCFNGRIGKKCDVCYSWWVFAS

SEQ ID NO: 2179914 - protein, 18 aa, Cryptosporidium hominis
QSYTLKRIGFITSSGSTI

SEQ ID NO: 2179915 - protein, 20 aa, Cryptosporidium hominis
QTAFKLLGLEVGASTKEIKS

SEQ ID NO: 2179916 - protein, 21 aa, Cryptosporidium hominis
QTCHLAHRMGLAPSKSDLEKL

SEQ ID NO: 2179917 - protein, 27 aa, Cryptosporidium hominis
QTCINFEKLRILICKLKKSLYSDTLSK

SEQ ID NO: 2179918 - protein, 17 aa, Cryptosporidium hominis
QTCNLMSLIKALICITS

SEQ ID NO: 2179919 - protein, 17 aa, Cryptosporidium hominis
QTDRFLLDIGLRVQDQK

SEQ ID NO: 2179920 - protein, 26 aa, Cryptosporidium hominis
QTDSGQRWCMLMGLCPVTNESTGSIS

SEQ ID NO: 2179921 - protein, 26 aa, Cryptosporidium hominis
QTENEFLVPLSLSFMSNWAENKNKDC

SEQ ID NO: 2179922 - protein, 17 aa, Cryptosporidium hominis
QTFVKYLLERFDDLEFY

SEQ ID NO: 2179923 - protein, 19 aa, Cryptosporidium hominis
QTHACILHAILNCAGNRGI

SEQ ID NO: 2179924 - protein, 26 aa, Cryptosporidium hominis
QTHAHGRIAYKHGYPPSLGSGPGSGT

SEQ ID NO: 2179925 - protein, 27 aa, Cryptosporidium hominis
QTHLYSSVIVREFSNMIASFGQDQTIS

SEQ ID NO: 2179926 - protein, 25 aa, Cryptosporidium hominis
QTHSKIRVGPEYQAVLPDLIVPEKK

SEQ ID NO: 2179927 - protein, 28 aa, Cryptosporidium hominis
QTIEYCKSCGLPTDYCEYGQCTKNKILG

SEQ ID NO: 2179928 - protein, 30 aa, Cryptosporidium hominis
QTKNFKSCTMWRVRVKELIKDIIQDCISNL

SEQ ID NO: 2179929 - protein, 22 aa, Cryptosporidium hominis
QTKYIECMEKLKKLLHSIHSAC

SEQ ID NO: 2179930 - protein, 22 aa, Cryptosporidium hominis
QTMKVPKYVGGLVKNKLPHYGF

SEQ ID NO: 2179931 - protein, 25 aa, Cryptosporidium hominis
QTNCSRFEICLGTILNCIQVFGLDA

SEQ ID NO: 2179932 - protein, 28 aa, Cryptosporidium hominis
QTNQVRGTLRFVVKLVPNQQNPNYRFDQ

SEQ ID NO: 2179933 - protein, 21 aa, Cryptosporidium hominis
QTPESWLKYEGYIPKLTGDHD

SEQ ID NO: 2179934 - protein, 20 aa, Cryptosporidium hominis
QTPSLTLGCGSWGHTSTAEG

SEQ ID NO: 2179935 - protein, 22 aa, Cryptosporidium hominis
QTRIKIGLNSKMPTRFPPVVFY

SEQ ID NO: 2179936 - protein, 19 aa, Cryptosporidium hominis
QTRITAMSLSHMCYCEGQP

SEQ ID NO: 2179937 - protein, 23 aa, Cryptosporidium hominis
QTRKRYRFDIVITTPSILNSQVD

SEQ ID NO: 2179938 - protein, 19 aa, Cryptosporidium hominis
QTRRPELGDKFSSRHGQKG

SEQ ID NO: 2179939 - protein, 26 aa, Cryptosporidium hominis
QTRSYCSLCGLSGRMHTRRSCPLLPD

SEQ ID NO: 2179940 - protein, 18 aa, Cryptosporidium hominis
QTSNLKHQFILDPKLFRP

SEQ ID NO: 2179941 - protein, 20 aa, Cryptosporidium hominis
QTYPGLISFGNQILKQVNKD

SEQ ID NO: 2179942 - protein, 18 aa, Cryptosporidium hominis
QVAALCFQLKQVVSASWV

SEQ ID NO: 2179943 - protein, 17 aa, Cryptosporidium hominis
QVAEALFQMDLFTHYDK

SEQ ID NO: 2179944 - protein, 18 aa, Cryptosporidium hominis
QVAPGVGVNPQIAPGVGV

SEQ ID NO: 2179945 - protein, 20 aa, Cryptosporidium hominis
QVCEKAKKYRSEFVNTGGYI

SEQ ID NO: 2179946 - protein, 19 aa, Cryptosporidium hominis
QVDDDCCLCLDALNRDLVK

SEQ ID NO: 2179947 - protein, 21 aa, Cryptosporidium hominis
QVECLKLIASNKFCEKRIGYL

SEQ ID NO: 2179948 - protein, 20 aa, Cryptosporidium hominis
QVEWSEGFLQYLQSILPPAD

SEQ ID NO: 2179949 - protein, 22 aa, Cryptosporidium hominis
QVHGFPRVLGVLTHLDKIEDNK

SEQ ID NO: 2179950 - protein, 18 aa, Cryptosporidium hominis
QVIARISKIGSINVNQQV

SEQ ID NO: 2179951 - protein, 23 aa, Cryptosporidium hominis
QVIKLGLPRPYLLKENIFSRIDQ

SEQ ID NO: 2179952 - protein, 24 aa, Cryptosporidium hominis
QVILPPKLLFKLPKHHVLKSLPLF

SEQ ID NO: 2179953 - protein, 19 aa, Cryptosporidium hominis
QVILWKWPSMQKIATLTGH

SEQ ID NO: 2179954 - protein, 17 aa, Cryptosporidium hominis
QVISLFGKYTWSWISPR

SEQ ID NO: 2179955 - protein, 20 aa, Cryptosporidium hominis
QVKPGITFEVFLHKTDNETF

SEQ ID NO: 2179956 - protein, 22 aa, Cryptosporidium hominis
QVKQSIEWNEIYFTVLHSDAFC

SEQ ID NO: 2179957 - protein, 24 aa, Cryptosporidium hominis
QVKRIEGDIPYRVFIKGKMYPGLA

SEQ ID NO: 2179958 - protein, 26 aa, Cryptosporidium hominis
QVLDLWKLSILIGGGISQIGSSSNNI

SEQ ID NO: 2179959 - protein, 18 aa, Cryptosporidium hominis
QVNISLCDQIQILEFKLK

SEQ ID NO: 2179960 - protein, 25 aa, Cryptosporidium hominis
QVPEARGYFSFTMCMENIYKELFMN

SEQ ID NO: 2179961 - protein, 23 aa, Cryptosporidium hominis
QVQEFNIPITLLKSESSETLNSN

SEQ ID NO: 2179962 - protein, 17 aa, Cryptosporidium hominis
QVRIRKRQTEISRYFSA

SEQ ID NO: 2179963 - protein, 24 aa, Cryptosporidium hominis
QVRMCKDIKHIVYYRFNTGSVGKG

SEQ ID NO: 2179964 - protein, 33 aa, Cryptosporidium hominis
QVRTSFLEVINWLREWACSRSYGLGTYLPWDTE

SEQ ID NO: 2179965 - protein, 21 aa, Cryptosporidium hominis
QVSNELVHWGKFDDDYCSRLS

SEQ ID NO: 2179966 - protein, 29 aa, Cryptosporidium hominis
QVTFRNIYRLILFISEIKLSKNYNYFSLD

SEQ ID NO: 2179967 - protein, 23 aa, Cryptosporidium hominis
QVTGFSVGYPFKTDQWREQQQSI

SEQ ID NO: 2179968 - protein, 19 aa, Cryptosporidium hominis
QVYDFKTKYILEVNNSLKG

SEQ ID NO: 2179969 - protein, 24 aa, Cryptosporidium hominis
QVYRKLKFFTEFKLWKIFKDEYSN

SEQ ID NO: 2179970 - protein, 19 aa, Cryptosporidium hominis
QWAPSVVRGISKVAFFSSM

SEQ ID NO: 2179971 - protein, 18 aa, Cryptosporidium hominis
QWCTWEFTYSNIKQSVLH

SEQ ID NO: 2179972 - protein, 19 aa, Cryptosporidium hominis
QWEPAGCPLTYMMNIELRK

SEQ ID NO: 2179973 - protein, 22 aa, Cryptosporidium hominis
QWETIIYNFDCELSDLELNFDF

SEQ ID NO: 2179974 - protein, 19 aa, Cryptosporidium hominis
QWLIGPKLYEANWMELQDR

SEQ ID NO: 2179975 - protein, 24 aa, Cryptosporidium hominis
QYEILIQLRDAWINALRSNAVDTK

SEQ ID NO: 2179976 - protein, 25 aa, Cryptosporidium hominis
QYFLSCFLFYPNIIHCMVRIILSLN

SEQ ID NO: 2179977 - protein, 25 aa, Cryptosporidium hominis
QYFPPGWKNTLLLLLSNCIAIDSIQ

SEQ ID NO: 2179978 - protein, 19 aa, Cryptosporidium hominis
QYKISTPKLLTFGNNKETS

SEQ ID NO: 2179979 - protein, 20 aa, Cryptosporidium hominis
QYKIVLRFLSYLDHLLNFMS

SEQ ID NO: 2179980 - protein, 24 aa, Cryptosporidium hominis
QYKQELLRRSDLEELKRTIKDQKL

SEQ ID NO: 2179981 - protein, 25 aa, Cryptosporidium hominis
QYLCPTAYQHCLPWIQHILEGINDP

SEQ ID NO: 2179982 - protein, 24 aa, Cryptosporidium hominis
QYLGKIDTFLGIGGKYAKFQAKTR

SEQ ID NO: 2179983 - protein, 23 aa, Cryptosporidium hominis
QYLTEIDVSFDFKKTGIQGFDLY

SEQ ID NO: 2179984 - protein, 31 aa, Cryptosporidium hominis
QYMAPEIFLRQGYTHLVDWWSVGILMYECLY

SEQ ID NO: 2179985 - protein, 22 aa, Cryptosporidium hominis
QYMCLKALVSRKAGKKAKKEYT

SEQ ID NO: 2179986 - protein, 17 aa, Cryptosporidium hominis
QYNEKWDIWSLGCVLQE

SEQ ID NO: 2179987 - protein, 23 aa, Cryptosporidium hominis
QYRRKISTGVLDIWVSFTEKHQI

SEQ ID NO: 2179988 - protein, 22 aa, Cryptosporidium hominis
QYSEFICDLLLTKLGHDKELKL

SEQ ID NO: 2179989 - protein, 17 aa, Cryptosporidium hominis
QYSESSIVLGYLIQSSI

SEQ ID NO: 2179990 - protein, 19 aa, Cryptosporidium hominis
QYSHAAWRRTPLEQGGIGP

SEQ ID NO: 2179991 - protein, 18 aa, Cryptosporidium hominis
QYSLRSLFFLKKSNSDFG

SEQ ID NO: 2179992 - protein, 31 aa, Cryptosporidium hominis
QYSNRFLLEISHKILFKFSMENLKTSLGQFK

SEQ ID NO: 2179993 - protein, 18 aa, Cryptosporidium hominis
QYTISWLKMGIFALNDIK

SEQ ID NO: 2179994 - protein, 25 aa, Cryptosporidium hominis
QYTLCLSPYALLCLWHPHSKSCSMY

SEQ ID NO: 2179995 - protein, 23 aa, Cryptosporidium hominis
QYVKPCIMEEPIIDTVGENAVNT

SEQ ID NO: 2179996 - protein, 26 aa, Cryptosporidium hominis
RADAQEFKPTFGITGSNVIPNSGIYY

SEQ ID NO: 2179997 - protein, 24 aa, Cryptosporidium hominis
RAETRHNICYGIPAISEITCVSNA

SEQ ID NO: 2179998 - protein, 20 aa, Cryptosporidium hominis
RAFGNWDMYSGMKLQGLSST

SEQ ID NO: 2179999 - protein, 20 aa, Cryptosporidium hominis
RAGLQFPVGRIQRMLKHRIP

SEQ ID NO: 2180000 - protein, 31 aa, Cryptosporidium hominis
RAGYPVRFPHFEFLLDYMILFSPCGQLSISK

SEQ ID NO: 2180001 - protein, 21 aa, Cryptosporidium hominis
RAIANNFMSLFGYGDTVQSVN

SEQ ID NO: 2180002 - protein, 23 aa, Cryptosporidium hominis
RAIFNLAIKRRWSTLARRSLKIA

SEQ ID NO: 2180003 - protein, 27 aa, Cryptosporidium hominis
RAINERINNLWLPRKNKTTQFDKDKIR

SEQ ID NO: 2180004 - protein, 25 aa, Cryptosporidium hominis
RAITHLKIQILYRLGQFEECERLYS

SEQ ID NO: 2180005 - protein, 18 aa, Cryptosporidium hominis
RAKDWLNQIEELYKPLEY

SEQ ID NO: 2180006 - protein, 18 aa, Cryptosporidium hominis
RAKEMGIFKGEKSRSNGE

SEQ ID NO: 2180007 - protein, 18 aa, Cryptosporidium hominis
RAKFRKSVEEYRDQMDDC

SEQ ID NO: 2180008 - protein, 28 aa, Cryptosporidium hominis
RAKGLEWKVVFIPKFVDKVFPLYRESEN

SEQ ID NO: 2180009 - protein, 20 aa, Cryptosporidium hominis
RAKTRLEIGDEITISYISDD

SEQ ID NO: 2180010 - protein, 18 aa, Cryptosporidium hominis
RAKYKFPGRQKVVVSDKW

SEQ ID NO: 2180011 - protein, 21 aa, Cryptosporidium hominis
RALEFEVCRIRYESGIKGKFW

SEQ ID NO: 2180012 - protein, 25 aa, Cryptosporidium hominis
RALGKYTGLGIHAFVGGLSLEKQER

SEQ ID NO: 2180013 - protein, 20 aa, Cryptosporidium hominis
RALLKGWPIGMEALNGNWDL

SEQ ID NO: 2180014 - protein, 17 aa, Cryptosporidium hominis
RALNYLLEKKMIMNREK

SEQ ID NO: 2180015 - protein, 24 aa, Cryptosporidium hominis
RALRAFRFTSRLHFRVDEELLSAC

SEQ ID NO: 2180016 - protein, 20 aa, Cryptosporidium hominis
RALSLLRHLLIQGVVNSEYI

SEQ ID NO: 2180017 - protein, 19 aa, Cryptosporidium hominis
RANEWGERLLSYFQFERNA

SEQ ID NO: 2180018 - protein, 23 aa, Cryptosporidium hominis
RANNIKVSASMFVGDLATGLKGM

SEQ ID NO: 2180019 - protein, 18 aa, Cryptosporidium hominis
RANRCISSTLPLSSKSHI

SEQ ID NO: 2180020 - protein, 19 aa, Cryptosporidium hominis
RANVRYRIGPEDGITDVDI

SEQ ID NO: 2180021 - protein, 32 aa, Cryptosporidium hominis
RAPASSILTRPGYVMRYPRSFKEQETFTNGGV

SEQ ID NO: 2180022 - protein, 17 aa, Cryptosporidium hominis
RAPEILLGIDKYSPSVD

SEQ ID NO: 2180023 - protein, 26 aa, Cryptosporidium hominis
RAPIFKDPTLIIALHLKDTGNCIPLK

SEQ ID NO: 2180024 - protein, 18 aa, Cryptosporidium hominis
RAPSIIFIDEIDSLCSSR

SEQ ID NO: 2180025 - protein, 28 aa, Cryptosporidium hominis
RAPVGVPQNLGYRLVRTVKNYVGSSKAP

SEQ ID NO: 2180026 - protein, 17 aa, Cryptosporidium hominis
RAQARIAGEYIKNNIGF

SEQ ID NO: 2180027 - protein, 18 aa, Cryptosporidium hominis
RAQFEAVAKFKRGLKHKD

SEQ ID NO: 2180028 - protein, 22 aa, Cryptosporidium hominis
RASEGLFTFSTEMNISLNLKSP

SEQ ID NO: 2180029 - protein, 28 aa, Cryptosporidium hominis
RASLEICEKLKLHGLVVIGGDDSNTNAA

SEQ ID NO: 2180030 - protein, 27 aa, Cryptosporidium hominis
RASTHIFGFRFDLIRVFADKMFMDTKD

SEQ ID NO: 2180031 - protein, 28 aa, Cryptosporidium hominis
RASYLKHRSIVLGEQMKAYTLGHPLPTH

SEQ ID NO: 2180032 - protein, 19 aa, Cryptosporidium hominis
RAVFREVSELLLVGNPFIK

SEQ ID NO: 2180033 - protein, 20 aa, Cryptosporidium hominis
RAYDIMRYRNFRTLTAEEDT

SEQ ID NO: 2180034 - protein, 17 aa, Cryptosporidium hominis
RAYNISIALSKFSAYTF

SEQ ID NO: 2180035 - protein, 20 aa, Cryptosporidium hominis
RAYNLKFWKILLSKDKTQFE

SEQ ID NO: 2180036 - protein, 17 aa, Cryptosporidium hominis
RCAAGFCYTFSGNLLIF

SEQ ID NO: 2180037 - protein, 17 aa, Cryptosporidium hominis
RCDNCKNHHLVSDKLGW

SEQ ID NO: 2180038 - protein, 22 aa, Cryptosporidium hominis
RCERARSGFEKNLLVYAPSPAL

SEQ ID NO: 2180039 - protein, 18 aa, Cryptosporidium hominis
RCFDMLQQSFVRRRKLDE

SEQ ID NO: 2180040 - protein, 25 aa, Cryptosporidium hominis
RCGHHFCLNCAGNLVQRKQKCPRCR

SEQ ID NO: 2180041 - protein, 21 aa, Cryptosporidium hominis
RCIIDLKVAKNNIYLIISEAK

SEQ ID NO: 2180042 - protein, 26 aa, Cryptosporidium hominis
RCIISPRVPLLFIQKNLFRLGWFEPN

SEQ ID NO: 2180043 - protein, 21 aa, Cryptosporidium hominis
RCIQQLKILFWRHPGDPLLGK

SEQ ID NO: 2180044 - protein, 21 aa, Cryptosporidium hominis
RCISSTLPLSSKSHIQGCLTA

SEQ ID NO: 2180045 - protein, 22 aa, Cryptosporidium hominis
RCKIDQLVKFCVDFASCHVDVL

SEQ ID NO: 2180046 - protein, 21 aa, Cryptosporidium hominis
RCKIILGCRDLMFPPLNLQDR

SEQ ID NO: 2180047 - protein, 17 aa, Cryptosporidium hominis
RCLDEINELNILLESKR

SEQ ID NO: 2180048 - protein, 23 aa, Cryptosporidium hominis
RCLDLVQKYCIEFPEVSFNVRKF

SEQ ID NO: 2180049 - protein, 23 aa, Cryptosporidium hominis
RCNKCSVEYLLDVTCEGGATRNV

SEQ ID NO: 2180050 - protein, 19 aa, Cryptosporidium hominis
RCQTFPAIGEVTMMKKDGT

SEQ ID NO: 2180051 - protein, 25 aa, Cryptosporidium hominis
RCRGGRGGGYVGMFVDGKGNGRGGG

SEQ ID NO: 2180052 - protein, 19 aa, Cryptosporidium hominis
RCRQYIDGCCNRGGYCNFM

SEQ ID NO: 2180053 - protein, 23 aa, Cryptosporidium hominis
RCSNDDMLLWSRLMEDFIAIHKN

SEQ ID NO: 2180054 - protein, 18 aa, Cryptosporidium hominis
RCVFCRNDNTFGLVGCDH

SEQ ID NO: 2180055 - protein, 21 aa, Cryptosporidium hominis
RCYNCSVDLWSVGCIMVEMIS

SEQ ID NO: 2180056 - protein, 22 aa, Cryptosporidium hominis
RDAFSGWGCKVYLLTPEKLVTK

SEQ ID NO: 2180057 - protein, 21 aa, Cryptosporidium hominis
RDAPNRCPIPIVQSIDDLGKE

SEQ ID NO: 2180058 - protein, 20 aa, Cryptosporidium hominis
RDAYLPGCIITASNGKTIEV

SEQ ID NO: 2180059 - protein, 22 aa, Cryptosporidium hominis
RDCKRCYYLSLEFLLGRAMQNA

SEQ ID NO: 2180060 - protein, 18 aa, Cryptosporidium hominis
RDDLDSWLPYKGSTENAR

SEQ ID NO: 2180061 - protein, 23 aa, Cryptosporidium hominis
RDDTRTVIFLTRLLSRSNTINGI

SEQ ID NO: 2180062 - protein, 18 aa, Cryptosporidium hominis
RDDVRNWLMGPRCREQFV

SEQ ID NO: 2180063 - protein, 20 aa, Cryptosporidium hominis
RDEECFPSKISLKVLKGSLL

SEQ ID NO: 2180064 - protein, 18 aa, Cryptosporidium hominis
RDEEIPVLSRWFPKDSPP

SEQ ID NO: 2180065 - protein, 18 aa, Cryptosporidium hominis
RDEILDFGNEIDFSNIIS

SEQ ID NO: 2180066 - protein, 25 aa, Cryptosporidium hominis
RDEQPRGSINLKIVENVFADGPLGI

SEQ ID NO: 2180067 - protein, 20 aa, Cryptosporidium hominis
RDEYKIECIVAPYEADAQLS

SEQ ID NO: 2180068 - protein, 18 aa, Cryptosporidium hominis
RDGNGFFKMVECYIRGNN

SEQ ID NO: 2180069 - protein, 26 aa, Cryptosporidium hominis
RDHVCDFKYCNIEGVSFISDNMIVTV

SEQ ID NO: 2180070 - protein, 19 aa, Cryptosporidium hominis
RDIIGPKFARHLNQYFIIP

SEQ ID NO: 2180071 - protein, 23 aa, Cryptosporidium hominis
RDIKEKLCYIALDYEEEMKKSQE

SEQ ID NO: 2180072 - protein, 18 aa, Cryptosporidium hominis
RDILPYFIEYIKPERVIH

SEQ ID NO: 2180073 - protein, 27 aa, Cryptosporidium hominis
RDINYIRDLLCILSRDIWSLLLSCHQN

SEQ ID NO: 2180074 - protein, 20 aa, Cryptosporidium hominis
RDIRLAFLRLVRKFHPDKNI

SEQ ID NO: 2180075 - protein, 29 aa, Cryptosporidium hominis
RDISVLLKYPLLSIQGKLPVNIDLICQYD

SEQ ID NO: 2180076 - protein, 27 aa, Cryptosporidium hominis
RDITCLKCIKRKSLQYLFMKSKQKAQQ

SEQ ID NO: 2180077 - protein, 18 aa, Cryptosporidium hominis
RDIVNIRYLHGYNIKNGF

SEQ ID NO: 2180078 - protein, 26 aa, Cryptosporidium hominis
RDKFLQLLLCIPYWNGNIPPPAILRP

SEQ ID NO: 2180079 - protein, 18 aa, Cryptosporidium hominis
RDKLCSLIRKYQTLIEAH

SEQ ID NO: 2180080 - protein, 24 aa, Cryptosporidium hominis
RDLFEMELRSKFGRILLKQLNSLE

SEQ ID NO: 2180081 - protein, 18 aa, Cryptosporidium hominis
RDLFPALWVPDLFMERVE

SEQ ID NO: 2180082 - protein, 23 aa, Cryptosporidium hominis
RDLKPSNILLHITFDKFLEQPIC

SEQ ID NO: 2180083 - protein, 33 aa, Cryptosporidium hominis
RDLLALPKRPIMYFAKWKHLSFADNTWEHEVDI

SEQ ID NO: 2180084 - protein, 27 aa, Cryptosporidium hominis
RDLNFTWGCLPLRAIDHPDQLVPLPIG

SEQ ID NO: 2180085 - protein, 25 aa, Cryptosporidium hominis
RDLPPKRELYVYIGLSKLQKKIYSE

SEQ ID NO: 2180086 - protein, 21 aa, Cryptosporidium hominis
RDLSAEINIGIINTINMNTDI

SEQ ID NO: 2180087 - protein, 27 aa, Cryptosporidium hominis
RDLVLRAGALPPILQLIALEIGPLDNS

SEQ ID NO: 2180088 - protein, 20 aa, Cryptosporidium hominis
RDMLFPSISKKIHKRKYEYD

SEQ ID NO: 2180089 - protein, 22 aa, Cryptosporidium hominis
RDNQQIRKDLCIKVNSLQNDLE

SEQ ID NO: 2180090 - protein, 19 aa, Cryptosporidium hominis
RDNWMMWDSSLKIAIKRED

SEQ ID NO: 2180091 - protein, 24 aa, Cryptosporidium hominis
RDPEIFKIIINYLRDSAKCLPSPS

SEQ ID NO: 2180092 - protein, 21 aa, Cryptosporidium hominis
RDPRRSLLIRSLRFDTPTSLV

SEQ ID NO: 2180093 - protein, 21 aa, Cryptosporidium hominis
RDRQRISSSLYYRDLNDGTGH

SEQ ID NO: 2180094 - protein, 20 aa, Cryptosporidium hominis
RDRVGCSINSNIVRNTYGKG

SEQ ID NO: 2180095 - protein, 17 aa, Cryptosporidium hominis
RDRYSIRDLGPMRFAIG

SEQ ID NO: 2180096 - protein, 17 aa, Cryptosporidium hominis
RDSHELFDYEAQHINNK

SEQ ID NO: 2180097 - protein, 19 aa, Cryptosporidium hominis
RDSKWVLYRHEHIGNVNQA

SEQ ID NO: 2180098 - protein, 28 aa, Cryptosporidium hominis
RDSLTCPICARLFRYAVLTPCCGETYCQ

SEQ ID NO: 2180099 - protein, 28 aa, Cryptosporidium hominis
RDSRVLHPKRRFKLFRSILKFGDPYRRL

SEQ ID NO: 2180100 - protein, 24 aa, Cryptosporidium hominis
RDSSPDFTIVRRMNPTKSDESNPK

SEQ ID NO: 2180101 - protein, 26 aa, Cryptosporidium hominis
RDVCIWKLVTEWSVEERMVFGREQKL

SEQ ID NO: 2180102 - protein, 22 aa, Cryptosporidium hominis
RDVKVYRLITARTYEAEMFERA

SEQ ID NO: 2180103 - protein, 18 aa, Cryptosporidium hominis
RDWHAIRLRLHLWGRFYD

SEQ ID NO: 2180104 - protein, 23 aa, Cryptosporidium hominis
RDYLNKEFCSYDDFFQLVNNGIL

SEQ ID NO: 2180105 - protein, 20 aa, Cryptosporidium hominis
RDYWSGKLLYCHTPPSNTKN

SEQ ID NO: 2180106 - protein, 27 aa, Cryptosporidium hominis
REAELAAMEICKTASTLFDTTDGTTPV

SEQ ID NO: 2180107 - protein, 19 aa, Cryptosporidium hominis
REAEWKLKILSRLLGHEKE

SEQ ID NO: 2180108 - protein, 17 aa, Cryptosporidium hominis
REAFREMADEAARGGAI

SEQ ID NO: 2180109 - protein, 17 aa, Cryptosporidium hominis
REAINLKRDMMINKQRL

SEQ ID NO: 2180110 - protein, 27 aa, Cryptosporidium hominis
REAMRCLRHKKLKALIVAPDIEGDGVE

SEQ ID NO: 2180111 - protein, 17 aa, Cryptosporidium hominis
RECLKSYFFGTPEFPLK

SEQ ID NO: 2180112 - protein, 38 aa, Cryptosporidium hominis
REDFAKEIIKSIGLKPIYFDCIKNLLKHIESKSEHVEN

SEQ ID NO: 2180113 - protein, 17 aa, Cryptosporidium hominis
REDIVLVGATIGGGQAS

SEQ ID NO: 2180114 - protein, 23 aa, Cryptosporidium hominis
REEAIQCLKSIFSSNNRSDESIK

SEQ ID NO: 2180115 - protein, 19 aa, Cryptosporidium hominis
REEILKAFKLFDDDNTGKI

SEQ ID NO: 2180116 - protein, 21 aa, Cryptosporidium hominis
REFFSRSNLELIYRAESPFGL

SEQ ID NO: 2180117 - protein, 24 aa, Cryptosporidium hominis
REFLSYMNRIFLRGMEELYSSCNL

SEQ ID NO: 2180118 - protein, 17 aa, Cryptosporidium hominis
REFPDLLRPKARYSEKV

SEQ ID NO: 2180119 - protein, 22 aa, Cryptosporidium hominis
REFPLGDVLTGSTLSNLVESME

SEQ ID NO: 2180120 - protein, 22 aa, Cryptosporidium hominis
REIARLSTEITSFEKKKEELET

SEQ ID NO: 2180121 - protein, 30 aa, Cryptosporidium hominis
REIDNELYIQNDCIYGDGDGDGDEDVKLYN

SEQ ID NO: 2180122 - protein, 17 aa, Cryptosporidium hominis
REIESVCNVVLLPYNYL

SEQ ID NO: 2180123 - protein, 23 aa, Cryptosporidium hominis
REIKIILDIHGKKYRCRYISGKI

SEQ ID NO: 2180124 - protein, 25 aa, Cryptosporidium hominis
REIKRKIMSMFLLEFEVSNSKDYIK

SEQ ID NO: 2180125 - protein, 17 aa, Cryptosporidium hominis
REIKRMEHILNMRILEG

SEQ ID NO: 2180126 - protein, 25 aa, Cryptosporidium hominis
REIKSNMLLCRKCNIQLMDHNAFKQ

SEQ ID NO: 2180127 - protein, 19 aa, Cryptosporidium hominis
REILRCYINQRGIRGKFMS

SEQ ID NO: 2180128 - protein, 24 aa, Cryptosporidium hominis
REIYMKVLRDLVKLASLQTAFFSL

SEQ ID NO: 2180129 - protein, 17 aa, Cryptosporidium hominis
REKCKILKPKLLLVPSD

SEQ ID NO: 2180130 - protein, 22 aa, Cryptosporidium hominis
REKELDGREALLNNQRAALSES

SEQ ID NO: 2180131 - protein, 20 aa, Cryptosporidium hominis
REKEVSFSKPHHGNITYIEV

SEQ ID NO: 2180132 - protein, 18 aa, Cryptosporidium hominis
REKINYAYLFEKIMFAHE

SEQ ID NO: 2180133 - protein, 17 aa, Cryptosporidium hominis
REKRASERLIYYPYESS

SEQ ID NO: 2180134 - protein, 20 aa, Cryptosporidium hominis
REKTRWEKFAELKGIKKRKR

SEQ ID NO: 2180135 - protein, 21 aa, Cryptosporidium hominis
RELFKQYVVPIVDEVLLGFNC

SEQ ID NO: 2180136 - protein, 18 aa, Cryptosporidium hominis
RELFSPYGQINEIFIMRE

SEQ ID NO: 2180137 - protein, 21 aa, Cryptosporidium hominis
RELIASIILCSRGTLSEKANL

SEQ ID NO: 2180138 - protein, 25 aa, Cryptosporidium hominis
RELIPNGDAKLILRLSNDARSIADE

SEQ ID NO: 2180139 - protein, 20 aa, Cryptosporidium hominis
RELKSSGISDGFTIELFDTD

SEQ ID NO: 2180140 - protein, 24 aa, Cryptosporidium hominis
RELLEILCDSFAYQIHIHGFFHGD

SEQ ID NO: 2180141 - protein, 24 aa, Cryptosporidium hominis
RELWRISEIYFMGKILILTSKMTN

SEQ ID NO: 2180142 - protein, 18 aa, Cryptosporidium hominis
RELYALASTHKISFKSKR

SEQ ID NO: 2180143 - protein, 27 aa, Cryptosporidium hominis
REMLTRLKNCFDIISFLNIVYDLSPML

SEQ ID NO: 2180144 - protein, 21 aa, Cryptosporidium hominis
RENKKRFTLGSTINKRGKIGF

SEQ ID NO: 2180145 - protein, 22 aa, Cryptosporidium hominis
RENLKKCLNILELLSMDIEEQA

SEQ ID NO: 2180146 - protein, 18 aa, Cryptosporidium hominis
REPIRVATDLPQIKVTNI

SEQ ID NO: 2180147 - protein, 23 aa, Cryptosporidium hominis
REQKAKLSLYRPNGNSNKGENSS

SEQ ID NO: 2180148 - protein, 23 aa, Cryptosporidium hominis
REREMDGKKHGLPRKTGEGSSSS

SEQ ID NO: 2180149 - protein, 18 aa, Cryptosporidium hominis
RERIRKGLQLYCSEPTEP

SEQ ID NO: 2180150 - protein, 21 aa, Cryptosporidium hominis
RERLARLTGRVALIKIGGYSD

SEQ ID NO: 2180151 - protein, 20 aa, Cryptosporidium hominis
RERLRRLALESIDLSKDPYY

SEQ ID NO: 2180152 - protein, 26 aa, Cryptosporidium hominis
RESCLSSKLVSDCLLGSGILNEEEIT

SEQ ID NO: 2180153 - protein, 28 aa, Cryptosporidium hominis
RESDYLQRFPTLTGFNRAGLSGNERIIV

SEQ ID NO: 2180154 - protein, 19 aa, Cryptosporidium hominis
RESINLSQIKTCLEMESQE

SEQ ID NO: 2180155 - protein, 21 aa, Cryptosporidium hominis
RESLKLIPRKSKIEFEQNRNP

SEQ ID NO: 2180156 - protein, 18 aa, Cryptosporidium hominis
RESLNRHLESCIENFTRP

SEQ ID NO: 2180157 - protein, 17 aa, Cryptosporidium hominis
RETAILIATKRRALNLN

SEQ ID NO: 2180158 - protein, 18 aa, Cryptosporidium hominis
RETFPDLAPLMWHSFGCI

SEQ ID NO: 2180159 - protein, 17 aa, Cryptosporidium hominis
RETFSLLDINGDGYITP

SEQ ID NO: 2180160 - protein, 19 aa, Cryptosporidium hominis
REVGWREVENTDLLVRLND

SEQ ID NO: 2180161 - protein, 29 aa, Cryptosporidium hominis
REVLELKLRIGWISVSYGDGWLDSYKIDL

SEQ ID NO: 2180162 - protein, 23 aa, Cryptosporidium hominis
REVLLSFDDFFLFKSSSDSKIEK

SEQ ID NO: 2180163 - protein, 17 aa, Cryptosporidium hominis
REVPYFVYEDIIKPVPV

SEQ ID NO: 2180164 - protein, 21 aa, Cryptosporidium hominis
REVSAPIFGSSDMESKNPASD

SEQ ID NO: 2180165 - protein, 27 aa, Cryptosporidium hominis
REVVEMPLLHPERFVQLGIDPPKGVLL

SEQ ID NO: 2180166 - protein, 17 aa, Cryptosporidium hominis
REYELILLRAYLLNSDS

SEQ ID NO: 2180167 - protein, 19 aa, Cryptosporidium hominis
REYRLNFSVGTKLKKLSFY

SEQ ID NO: 2180168 - protein, 30 aa, Cryptosporidium hominis
REYSTSPCYYYLPTGYERIGNCFNEIRFRR

SEQ ID NO: 2180169 - protein, 18 aa, Cryptosporidium hominis
RFAERIIKVVERPKDPLE

SEQ ID NO: 2180170 - protein, 26 aa, Cryptosporidium hominis
RFAFYKGELPILITTERFLFFRRYLL

SEQ ID NO: 2180171 - protein, 26 aa, Cryptosporidium hominis
RFAIGKSIFKRSDFTLRNRRFQALHC

SEQ ID NO: 2180172 - protein, 26 aa, Cryptosporidium hominis
RFAILKERILLPVTWIPPEYRWLHFL

SEQ ID NO: 2180173 - protein, 19 aa, Cryptosporidium hominis
RFALVSSLENQHLLKSNQN

SEQ ID NO: 2180174 - protein, 21 aa, Cryptosporidium hominis
RFCIESGLIISRTFSSVICDQ

SEQ ID NO: 2180175 - protein, 20 aa, Cryptosporidium hominis
RFDDFMEIMRHLKLNIKPGS

SEQ ID NO: 2180176 - protein, 31 aa, Cryptosporidium hominis
RFDKAVKVWHVLSGRLLRCFSTPTMTLNNNG

SEQ ID NO: 2180177 - protein, 21 aa, Cryptosporidium hominis
RFEAVKLLLDKGAEPNLSDNV

SEQ ID NO: 2180178 - protein, 26 aa, Cryptosporidium hominis
RFEQCVDELKILHGFFPQISSSVDSI

SEQ ID NO: 2180179 - protein, 23 aa, Cryptosporidium hominis
RFERCLDLYLCPRAMKMRMNVDP

SEQ ID NO: 2180180 - protein, 25 aa, Cryptosporidium hominis
RFFILRSDGALIWCHHPNDTVYCET

SEQ ID NO: 2180181 - protein, 28 aa, Cryptosporidium hominis
RFFKDLDYKAIFTWRRFNQIKYVLDTRS

SEQ ID NO: 2180182 - protein, 19 aa, Cryptosporidium hominis
RFFPLRTLTLYLLYKRSLE

SEQ ID NO: 2180183 - protein, 24 aa, Cryptosporidium hominis
RFFSEKKIVWSPIMFTIMQPSLNM

SEQ ID NO: 2180184 - protein, 18 aa, Cryptosporidium hominis
RFGLETPSGVLLYGPPGC

SEQ ID NO: 2180185 - protein, 19 aa, Cryptosporidium hominis
RFIDRFRYNASRASLVQSR

SEQ ID NO: 2180186 - protein, 27 aa, Cryptosporidium hominis
RFILEEQNFCLKKYISHFPESLTQELK

SEQ ID NO: 2180187 - protein, 20 aa, Cryptosporidium hominis
RFLCNLIISQIFKFPTVFRT

SEQ ID NO: 2180188 - protein, 17 aa, Cryptosporidium hominis
RFLEISNLLSIRNPNLL

SEQ ID NO: 2180189 - protein, 19 aa, Cryptosporidium hominis
RFLNLGLLQIHRGINYNDN

SEQ ID NO: 2180190 - protein, 22 aa, Cryptosporidium hominis
RFNSDQEMCFSLKNCLRNLLLS

SEQ ID NO: 2180191 - protein, 20 aa, Cryptosporidium hominis
RFNSGYSIEIGNIITTENKG

SEQ ID NO: 2180192 - protein, 19 aa, Cryptosporidium hominis
RFPEKSCRFLLDLLQNAES

SEQ ID NO: 2180193 - protein, 25 aa, Cryptosporidium hominis
RFRAPELLFQPSLIGYEYPGIHEVL

SEQ ID NO: 2180194 - protein, 21 aa, Cryptosporidium hominis
RFSELGRSRVHSVTESSIEAS

SEQ ID NO: 2180195 - protein, 25 aa, Cryptosporidium hominis
RFSEYVDGYVLFFKICDDMKIELSS

SEQ ID NO: 2180196 - protein, 21 aa, Cryptosporidium hominis
RFSGGSIMTWSYIDISTFGPN

SEQ ID NO: 2180197 - protein, 25 aa, Cryptosporidium hominis
RFSMQNVIAHPWLKISSNKASKYFT

SEQ ID NO: 2180198 - protein, 31 aa, Cryptosporidium hominis
RFTEPKILRFIRVGNQLRRSITVTPLVEDLQ

SEQ ID NO: 2180199 - protein, 20 aa, Cryptosporidium hominis
RFVHRSRLLAHKEVVPQAVW

SEQ ID NO: 2180200 - protein, 18 aa, Cryptosporidium hominis
RFVLKGRPIRVGRPTNAA

SEQ ID NO: 2180201 - protein, 19 aa, Cryptosporidium hominis
RFVLSFKKRLGELLEIDYK

SEQ ID NO: 2180202 - protein, 23 aa, Cryptosporidium hominis
RFVNSGYCARLIPAGKETLYIEF

SEQ ID NO: 2180203 - protein, 19 aa, Cryptosporidium hominis
RFVPIVLDRLKSEWQNLMI

SEQ ID NO: 2180204 - protein, 24 aa, Cryptosporidium hominis
RFYGEAYGSMSYKEYIDYYQFDNI

SEQ ID NO: 2180205 - protein, 17 aa, Cryptosporidium hominis
RFYSIKISKLPGNVKNL

SEQ ID NO: 2180206 - protein, 19 aa, Cryptosporidium hominis
RGAGRVRRVLHSAFFSGKS

SEQ ID NO: 2180207 - protein, 20 aa, Cryptosporidium hominis
RGCRASMCMQLYRQALNFAL

SEQ ID NO: 2180208 - protein, 20 aa, Cryptosporidium hominis
RGDALRWIMMDRIRESSYKL

SEQ ID NO: 2180209 - protein, 30 aa, Cryptosporidium hominis
RGDTHYLLYIYDIMKNLLLLHRHKNTEPPV

SEQ ID NO: 2180210 - protein, 20 aa, Cryptosporidium hominis
RGECKKLKDKLKELSPSLAV

SEQ ID NO: 2180211 - protein, 19 aa, Cryptosporidium hominis
RGEEVVKGIPRTIENTREI

SEQ ID NO: 2180212 - protein, 20 aa, Cryptosporidium hominis
RGESSFKGGGFNSSKASRSS

SEQ ID NO: 2180213 - protein, 24 aa, Cryptosporidium hominis
RGFPEMAVILAFDIKVDAEAEVEA

SEQ ID NO: 2180214 - protein, 30 aa, Cryptosporidium hominis
RGGAYNIIHGVFTWSFCKAISDIATGILQQ

SEQ ID NO: 2180215 - protein, 25 aa, Cryptosporidium hominis
RGGEFGRHPPYPGGVPGQVHQNTKP

SEQ ID NO: 2180216 - protein, 17 aa, Cryptosporidium hominis
RGGSIGRGGGPQHLAIL

SEQ ID NO: 2180217 - protein, 23 aa, Cryptosporidium hominis
RGHSEIRESGLLSANKETYYNIE

SEQ ID NO: 2180218 - protein, 21 aa, Cryptosporidium hominis
RGHTGLNHLLFTSVGVLNDKN

SEQ ID NO: 2180219 - protein, 20 aa, Cryptosporidium hominis
RGIAEIVLLAADAEPLEILL

SEQ ID NO: 2180220 - protein, 20 aa, Cryptosporidium hominis
RGIDKLPPMHDWQFYDKKRI

SEQ ID NO: 2180221 - protein, 19 aa, Cryptosporidium hominis
RGIDTFGNVFIFNSSHETI

SEQ ID NO: 2180222 - protein, 26 aa, Cryptosporidium hominis
RGIHIPLSLAGKYFGLLRNERTKGDK

SEQ ID NO: 2180223 - protein, 22 aa, Cryptosporidium hominis
RGIIPILERWIGNLLSRQFTGR

SEQ ID NO: 2180224 - protein, 18 aa, Cryptosporidium hominis
RGILGKGCSSDFSVSQSL

SEQ ID NO: 2180225 - protein, 19 aa, Cryptosporidium hominis
RGIQASRMMRLSKEDFGMD

SEQ ID NO: 2180226 - protein, 20 aa, Cryptosporidium hominis
RGISKVAFFSSMSSIAKKRP

SEQ ID NO: 2180227 - protein, 17 aa, Cryptosporidium hominis
RGKGSGYLEGYNKQEAD

SEQ ID NO: 2180228 - protein, 17 aa, Cryptosporidium hominis
RGKSSKYGSGAVGGGSS

SEQ ID NO: 2180229 - protein, 24 aa, Cryptosporidium hominis
RGKVNLKLIKFLILDEADRMLDMG

SEQ ID NO: 2180230 - protein, 21 aa, Cryptosporidium hominis
RGLFEECGSIERVSVLSDKGC

SEQ ID NO: 2180231 - protein, 18 aa, Cryptosporidium hominis
RGLFLSEFIMDYPISPEF

SEQ ID NO: 2180232 - protein, 19 aa, Cryptosporidium hominis
RGLIELIVHPLCIDDPAPW

SEQ ID NO: 2180233 - protein, 24 aa, Cryptosporidium hominis
RGLKCASCGVGSMFFKEDENGVTR

SEQ ID NO: 2180234 - protein, 22 aa, Cryptosporidium hominis
RGLKDYFREVALIKSYFLHNSR

SEQ ID NO: 2180235 - protein, 17 aa, Cryptosporidium hominis
RGLLKIRGNSVCKGYFR

SEQ ID NO: 2180236 - protein, 25 aa, Cryptosporidium hominis
RGLLMVWKAKLDQVSAEAWITSLCG

SEQ ID NO: 2180237 - protein, 18 aa, Cryptosporidium hominis
RGLSKLQLLTLEQLSGID

SEQ ID NO: 2180238 - protein, 17 aa, Cryptosporidium hominis
RGLYNVICKAWMVSREL

SEQ ID NO: 2180239 - protein, 20 aa, Cryptosporidium hominis
RGNFPKRLLNQGVFTKSHFS

SEQ ID NO: 2180240 - protein, 22 aa, Cryptosporidium hominis
RGNPILAHVCNVPYDFQNIVPD

SEQ ID NO: 2180241 - protein, 17 aa, Cryptosporidium hominis
RGPFLVVAPLSTLDHWK

SEQ ID NO: 2180242 - protein, 23 aa, Cryptosporidium hominis
RGPSRCPITLWFDQYNMKVVLED

SEQ ID NO: 2180243 - protein, 25 aa, Cryptosporidium hominis
RGQQEWSLRKPLEMRVQTDNVSNLQ

SEQ ID NO: 2180244 - protein, 21 aa, Cryptosporidium hominis
RGQRVPRNEMSGTVGYNNGVG

SEQ ID NO: 2180245 - protein, 17 aa, Cryptosporidium hominis
RGRGRFSRNDWFSKVHK

SEQ ID NO: 2180246 - protein, 18 aa, Cryptosporidium hominis
RGRKLFSFNKDSVESILT

SEQ ID NO: 2180247 - protein, 20 aa, Cryptosporidium hominis
RGRKLNGRIIHLSKSSHSIL

SEQ ID NO: 2180248 - protein, 23 aa, Cryptosporidium hominis
RGRKTMKAQKLWFLILQAQIETG

SEQ ID NO: 2180249 - protein, 24 aa, Cryptosporidium hominis
RGSHLRYVEGLSREFSVKVESVVD

SEQ ID NO: 2180250 - protein, 27 aa, Cryptosporidium hominis
RGSNQICPVCHGFVKYIADFEYGETDF

SEQ ID NO: 2180251 - protein, 24 aa, Cryptosporidium hominis
RGTRRFLFDFSVTLKCDYTLDNNE

SEQ ID NO: 2180252 - protein, 22 aa, Cryptosporidium hominis
RGVIDKSIKIWDIRKANNPLKT

SEQ ID NO: 2180253 - protein, 17 aa, Cryptosporidium hominis
RGVMLLLPGMLTFIMHK

SEQ ID NO: 2180254 - protein, 17 aa, Cryptosporidium hominis
RGYKILVPENFDVFRDQ

SEQ ID NO: 2180255 - protein, 18 aa, Cryptosporidium hominis
RGYLKSKNPRKMVTQWCE

SEQ ID NO: 2180256 - protein, 21 aa, Cryptosporidium hominis
RGYNLNGAVVPQSVIPVSGIP

SEQ ID NO: 2180257 - protein, 18 aa, Cryptosporidium hominis
RHASALAKWGTRTKSVKK

SEQ ID NO: 2180258 - protein, 28 aa, Cryptosporidium hominis
RHFKNAPFHRLVACISPIPPPSVLSSSF

SEQ ID NO: 2180259 - protein, 18 aa, Cryptosporidium hominis
RHGCCTMLLYEIIRRLSI

SEQ ID NO: 2180260 - protein, 17 aa, Cryptosporidium hominis
RHIIISLITIYRCGFAS

SEQ ID NO: 2180261 - protein, 25 aa, Cryptosporidium hominis
RHLQKRGIRCFAWVCNNEKEMNICK

SEQ ID NO: 2180262 - protein, 19 aa, Cryptosporidium hominis
RHLTLHIGVGYGRTTILQV

SEQ ID NO: 2180263 - protein, 20 aa, Cryptosporidium hominis
RHLVKLTEYVILFWNKLSEE

SEQ ID NO: 2180264 - protein, 26 aa, Cryptosporidium hominis
RHNLEHPRWGSSWSGVQPSLIKNLQF

SEQ ID NO: 2180265 - protein, 21 aa, Cryptosporidium hominis
RHPYVIFGTGIFKKSSIETDI

SEQ ID NO: 2180266 - protein, 23 aa, Cryptosporidium hominis
RHQEMPCIPRQKIIESIQHSMNT

SEQ ID NO: 2180267 - protein, 18 aa, Cryptosporidium hominis
RHSLLPKHFKSHKRNSTY

SEQ ID NO: 2180268 - protein, 19 aa, Cryptosporidium hominis
RIAETLCMEYYRSHGVDVR

SEQ ID NO: 2180269 - protein, 17 aa, Cryptosporidium hominis
RIAKATGATICLTMAQL

SEQ ID NO: 2180270 - protein, 20 aa, Cryptosporidium hominis
RIAPELYLKQLIVGGLDKVY

SEQ ID NO: 2180271 - protein, 18 aa, Cryptosporidium hominis
RICMHCWISKSTLYCSTC

SEQ ID NO: 2180272 - protein, 17 aa, Cryptosporidium hominis
RIDEIKKTLLLPDSLSS

SEQ ID NO: 2180273 - protein, 21 aa, Cryptosporidium hominis
RIDGLELIFIFSKLLQVVATC

SEQ ID NO: 2180274 - protein, 19 aa, Cryptosporidium hominis
RIDQLEFMLNDLISEVESS

SEQ ID NO: 2180275 - protein, 17 aa, Cryptosporidium hominis
RIEISHTIPNSGEDSTI

SEQ ID NO: 2180276 - protein, 20 aa, Cryptosporidium hominis
RIELDFGGLGKGYLWDMEIT

SEQ ID NO: 2180277 - protein, 20 aa, Cryptosporidium hominis
RIESDFETFQGRKSRTGYNR

SEQ ID NO: 2180278 - protein, 20 aa, Cryptosporidium hominis
RIETLRFIKEICIVGVGKGL

SEQ ID NO: 2180279 - protein, 18 aa, Cryptosporidium hominis
RIGAMDWCGPILATGGRD

SEQ ID NO: 2180280 - protein, 20 aa, Cryptosporidium hominis
RIGTQYSCINIHYLIAEETL

SEQ ID NO: 2180281 - protein, 17 aa, Cryptosporidium hominis
RIGVFDLLEGKINFLPG

SEQ ID NO: 2180282 - protein, 18 aa, Cryptosporidium hominis
RIHKQVGLNFSILDLSFL

SEQ ID NO: 2180283 - protein, 25 aa, Cryptosporidium hominis
RIHVLPFDDCLEGITGNLFETYLKP

SEQ ID NO: 2180284 - protein, 17 aa, Cryptosporidium hominis
RIICYFADESKKTGVKP

SEQ ID NO: 2180285 - protein, 18 aa, Cryptosporidium hominis
RIIISILKIFEGIQGYLE

SEQ ID NO: 2180286 - protein, 17 aa, Cryptosporidium hominis
RIIQTYYQICDELEAQV

SEQ ID NO: 2180287 - protein, 23 aa, Cryptosporidium hominis
RIIWKIKKIHGGTEIILKSKICL

SEQ ID NO: 2180288 - protein, 36 aa, Cryptosporidium hominis
RIKEIIPKYKFCCCYSKNCLCDFSVRYKSHDSNGIY

SEQ ID NO: 2180289 - protein, 22 aa, Cryptosporidium hominis
RIKGQQIVEVFSPVIDDLKIKY

SEQ ID NO: 2180290 - protein, 30 aa, Cryptosporidium hominis
RIKSAKEALKHPFFKGMDFTKIRLQKPPIV

SEQ ID NO: 2180291 - protein, 20 aa, Cryptosporidium hominis
RILEYLGFEVLRVNHVGDWG

SEQ ID NO: 2180292 - protein, 17 aa, Cryptosporidium hominis
RILICGAGSASIGIVNL

SEQ ID NO: 2180293 - protein, 21 aa, Cryptosporidium hominis
RILIQEAKYHLSLNSKTRKGS

SEQ ID NO: 2180294 - protein, 20 aa, Cryptosporidium hominis
RILREIKLLRQLQHENILGI

SEQ ID NO: 2180295 - protein, 22 aa, Cryptosporidium hominis
RILREWKLLAKINHPNIIGFKG

SEQ ID NO: 2180296 - protein, 29 aa, Cryptosporidium hominis
RILRNLELFSNLIIYSGFYLPPNSNISNN

SEQ ID NO: 2180297 - protein, 29 aa, Cryptosporidium hominis
RILTNTFYGRYISDLGCYLQPATTENTAL

SEQ ID NO: 2180298 - protein, 22 aa, Cryptosporidium hominis
RILTQCYRMLSRGLIPGEKLLG

SEQ ID NO: 2180299 - protein, 20 aa, Cryptosporidium hominis
RIMGPEICNYIVPICSSFLA

SEQ ID NO: 2180300 - protein, 24 aa, Cryptosporidium hominis
RIMLCTDGWYIVKILTNITLIKSL

SEQ ID NO: 2180301 - protein, 26 aa, Cryptosporidium hominis
RIMLEKKSRFSLILISDLKEWQVIDA

SEQ ID NO: 2180302 - protein, 17 aa, Cryptosporidium hominis
RINKIVSSIEKFINNNQ

SEQ ID NO: 2180303 - protein, 19 aa, Cryptosporidium hominis
RINLRSKILKEYKDEKEYS

SEQ ID NO: 2180304 - protein, 23 aa, Cryptosporidium hominis
RINNGYKSYCPVQIFNSDTIFKK

SEQ ID NO: 2180305 - protein, 19 aa, Cryptosporidium hominis
RINQPKGFFHELFKRQTKS

SEQ ID NO: 2180306 - protein, 24 aa, Cryptosporidium hominis
RIPPIAIQCLAAYTPKVKKMIFTN

SEQ ID NO: 2180307 - protein, 25 aa, Cryptosporidium hominis
RIPRGKIPYEYLVKYHHQSYSQCKW

SEQ ID NO: 2180308 - protein, 25 aa, Cryptosporidium hominis
RIQKFLMENSGSFGFELSPEPVVDS

SEQ ID NO: 2180309 - protein, 27 aa, Cryptosporidium hominis
RIQKLLCFCLEFFLKYLQVAGRVENWN

SEQ ID NO: 2180310 - protein, 23 aa, Cryptosporidium hominis
RIRDSNSKHCIGRQLSQKNSNYA

SEQ ID NO: 2180311 - protein, 27 aa, Cryptosporidium hominis
RIRNPRLRLKKILEMRSSSSRCIISSD

SEQ ID NO: 2180312 - protein, 19 aa, Cryptosporidium hominis
RIRPRKSEAVEHVREQLRI

SEQ ID NO: 2180313 - protein, 20 aa, Cryptosporidium hominis
RIRRDEIESLFSTFGKVNKI

SEQ ID NO: 2180314 - protein, 21 aa, Cryptosporidium hominis
RIRTLVLPKLYTYINYSLINQ

SEQ ID NO: 2180315 - protein, 19 aa, Cryptosporidium hominis
RISEFLSKHLSFISKLSED

SEQ ID NO: 2180316 - protein, 19 aa, Cryptosporidium hominis
RISEWLPYRQGVIVPGPKF

SEQ ID NO: 2180317 - protein, 23 aa, Cryptosporidium hominis
RISPELVKNLSFQIVNGLSALHS

SEQ ID NO: 2180318 - protein, 23 aa, Cryptosporidium hominis
RISRLSKIRINEILNDSGSSEIK

SEQ ID NO: 2180319 - protein, 18 aa, Cryptosporidium hominis
RITHGFSARVYGFEDAKQ

SEQ ID NO: 2180320 - protein, 19 aa, Cryptosporidium hominis
RIVMEMIPLIYSKADMVCP

SEQ ID NO: 2180321 - protein, 19 aa, Cryptosporidium hominis
RIVNACERISYLVSNKYIT

SEQ ID NO: 2180322 - protein, 22 aa, Cryptosporidium hominis
RIYEIYLNLVIYCEQSVLGKVY

SEQ ID NO: 2180323 - protein, 21 aa, Cryptosporidium hominis
RIYPHLNNMDGFFVAKLKKIS

SEQ ID NO: 2180324 - protein, 22 aa, Cryptosporidium hominis
RIYPSFLLELWENIRDAVEIKY

SEQ ID NO: 2180325 - protein, 26 aa, Cryptosporidium hominis
RKACDIGRGAIFFSIARGKVAEGIDF

SEQ ID NO: 2180326 - protein, 22 aa, Cryptosporidium hominis
RKAHIELLKDYRVVTIRVACRL

SEQ ID NO: 2180327 - protein, 26 aa, Cryptosporidium hominis
RKAKLTGDVKFRWYVNENCANLGLDP

SEQ ID NO: 2180328 - protein, 21 aa, Cryptosporidium hominis
RKAWNDTRVRAALEPYSKYSA

SEQ ID NO: 2180329 - protein, 18 aa, Cryptosporidium hominis
RKCYARLPPRATNCRKRK

SEQ ID NO: 2180330 - protein, 27 aa, Cryptosporidium hominis
RKDEINCLKLEMRLEKILELVTEQMRK

SEQ ID NO: 2180331 - protein, 19 aa, Cryptosporidium hominis
RKDEKFIFESNTTVNSKAD

SEQ ID NO: 2180332 - protein, 26 aa, Cryptosporidium hominis
RKDFVHAFIVWFDIIFGCGHKPVTFT

SEQ ID NO: 2180333 - protein, 23 aa, Cryptosporidium hominis
RKDGKYTMDGCATFYKTNKFIAK

SEQ ID NO: 2180334 - protein, 18 aa, Cryptosporidium hominis
RKDMRLMELAQLLNQRMS

SEQ ID NO: 2180335 - protein, 18 aa, Cryptosporidium hominis
RKDYSFNSIAEMNIATNS

SEQ ID NO: 2180336 - protein, 20 aa, Cryptosporidium hominis
RKEEEFKRKVQQGIQETYLE

SEQ ID NO: 2180337 - protein, 17 aa, Cryptosporidium hominis
RKEELTQGETIWKKIAS

SEQ ID NO: 2180338 - protein, 36 aa, Cryptosporidium hominis
RKEIDLRVGSSFTRFLTLRYSRLFPIPERTLSYGTC

SEQ ID NO: 2180339 - protein, 25 aa, Cryptosporidium hominis
RKEIEPSGFCLVCASDVQQRSYGFF

SEQ ID NO: 2180340 - protein, 26 aa, Cryptosporidium hominis
RKEIYKLPDGFSWFDCNLWDIESQDF

SEQ ID NO: 2180341 - protein, 19 aa, Cryptosporidium hominis
RKEKLFVFGNDWPTRDGTG

SEQ ID NO: 2180342 - protein, 18 aa, Cryptosporidium hominis
RKEMLFDINRLWIRNLGR

SEQ ID NO: 2180343 - protein, 19 aa, Cryptosporidium hominis
RKESEALARKKRRYEKVMK

SEQ ID NO: 2180344 - protein, 21 aa, Cryptosporidium hominis
RKESTSGLVFVGHDISNDFQV

SEQ ID NO: 2180345 - protein, 22 aa, Cryptosporidium hominis
RKETSLLYKNEYVKDFLENYHL

SEQ ID NO: 2180346 - protein, 24 aa, Cryptosporidium hominis
RKFCGKCGNATLDRVPIKVSSDGT

SEQ ID NO: 2180347 - protein, 20 aa, Cryptosporidium hominis
RKFDAHWLIVRINESAPIQP

SEQ ID NO: 2180348 - protein, 17 aa, Cryptosporidium hominis
RKFEAYIDILRDQMMGM

SEQ ID NO: 2180349 - protein, 19 aa, Cryptosporidium hominis
RKGASIGFDKLRDGVTSSI

SEQ ID NO: 2180350 - protein, 30 aa, Cryptosporidium hominis
RKGNCPSSKGLRLSGYLDLIYFKATTPLLD

SEQ ID NO: 2180351 - protein, 20 aa, Cryptosporidium hominis
RKGTGKKRTRGMPSDIVTEI

SEQ ID NO: 2180352 - protein, 18 aa, Cryptosporidium hominis
RKGYPPQSLWDFCDKIGA

SEQ ID NO: 2180353 - protein, 20 aa, Cryptosporidium hominis
RKHFKRIRFPPFDDEEPPID

SEQ ID NO: 2180354 - protein, 25 aa, Cryptosporidium hominis
RKHFPSVNWNTSFSKYSRVLEPYFD

SEQ ID NO: 2180355 - protein, 17 aa, Cryptosporidium hominis
RKHKWVKKVHKQKAKAL

SEQ ID NO: 2180356 - protein, 18 aa, Cryptosporidium hominis
RKHNCPRVLTQKRIFGSP

SEQ ID NO: 2180357 - protein, 17 aa, Cryptosporidium hominis
RKIASAFKSKCPYCDRS

SEQ ID NO: 2180358 - protein, 21 aa, Cryptosporidium hominis
RKIIEFKGIKIQRAINSANKI

SEQ ID NO: 2180359 - protein, 18 aa, Cryptosporidium hominis
RKILGCVVKELSRPLTLS

SEQ ID NO: 2180360 - protein, 21 aa, Cryptosporidium hominis
RKIQESELINMISMMNETTEK

SEQ ID NO: 2180361 - protein, 19 aa, Cryptosporidium hominis
RKISDIYTNHMDNNSDHQL

SEQ ID NO: 2180362 - protein, 19 aa, Cryptosporidium hominis
RKIVRGLLMVWKAKLDQVS

SEQ ID NO: 2180363 - protein, 23 aa, Cryptosporidium hominis
RKIYLWPSYCEYKTNLTQQNDNQ

SEQ ID NO: 2180364 - protein, 23 aa, Cryptosporidium hominis
RKKCSDSSFMPGLLKNSYGLSGI

SEQ ID NO: 2180365 - protein, 19 aa, Cryptosporidium hominis
RKKDCEKLSGGKQCETNYC

SEQ ID NO: 2180366 - protein, 26 aa, Cryptosporidium hominis
RKKDVVFKLCEYYNKINLGLISHDPL

SEQ ID NO: 2180367 - protein, 21 aa, Cryptosporidium hominis
RKKIVGLKKSHVEVGKNAFSV

SEQ ID NO: 2180368 - protein, 18 aa, Cryptosporidium hominis
RKKKEKTLVVQEENVIES

SEQ ID NO: 2180369 - protein, 28 aa, Cryptosporidium hominis
RKKKLLNIRMLYPFTIRCNGCEVYHYVG

SEQ ID NO: 2180370 - protein, 17 aa, Cryptosporidium hominis
RKKNMLLPKGFEIGGGI

SEQ ID NO: 2180371 - protein, 20 aa, Cryptosporidium hominis
RKKQVMMFSATMTKEIRDVC

SEQ ID NO: 2180372 - protein, 18 aa, Cryptosporidium hominis
RKKVNLRGTIYSIPKPKR

SEQ ID NO: 2180373 - protein, 21 aa, Cryptosporidium hominis
RKLDKGIAFPTCISVNEICGN

SEQ ID NO: 2180374 - protein, 18 aa, Cryptosporidium hominis
RKLHALNFAREIIMRDDP

SEQ ID NO: 2180375 - protein, 18 aa, Cryptosporidium hominis
RKLIEGFADFSKIRNEQF

SEQ ID NO: 2180376 - protein, 17 aa, Cryptosporidium hominis
RKLKVLKTFVKLDHFDI

SEQ ID NO: 2180377 - protein, 21 aa, Cryptosporidium hominis
RKLKYANGRIEWRVIGDVSLV

SEQ ID NO: 2180378 - protein, 28 aa, Cryptosporidium hominis
RKLLIDSFFGYCIFEFLERVLNLLENVV

SEQ ID NO: 2180379 - protein, 26 aa, Cryptosporidium hominis
RKLLSECGTILRWSRQEDPTTKKLSS

SEQ ID NO: 2180380 - protein, 24 aa, Cryptosporidium hominis
RKLLTLPSPQLFTGLETLMSSGTL

SEQ ID NO: 2180381 - protein, 31 aa, Cryptosporidium hominis
RKLSGFKLGFHLKPLLFRISKLVNSSEISVI

SEQ ID NO: 2180382 - protein, 23 aa, Cryptosporidium hominis
RKLSGLFKHIGARFVMNSTISEY

SEQ ID NO: 2180383 - protein, 24 aa, Cryptosporidium hominis
RKLTWIYWYGECVLDYKLPTPNGT

SEQ ID NO: 2180384 - protein, 32 aa, Cryptosporidium hominis
RKLWVCNPNKLRVCEFLIRWHEQRGDKILVFS

SEQ ID NO: 2180385 - protein, 25 aa, Cryptosporidium hominis
RKMGPRKLLVCAPSNAAIDAIVRKL

SEQ ID NO: 2180386 - protein, 20 aa, Cryptosporidium hominis
RKMGVFRLSFDPRRLNEWIL

SEQ ID NO: 2180387 - protein, 17 aa, Cryptosporidium hominis
RKMLTFHPSLRITATQC

SEQ ID NO: 2180388 - protein, 19 aa, Cryptosporidium hominis
RKNFSPGYRSNSLYNNYRH

SEQ ID NO: 2180389 - protein, 19 aa, Cryptosporidium hominis
RKNIFKKYLYEASQTNCSR

SEQ ID NO: 2180390 - protein, 30 aa, Cryptosporidium hominis
RKNIPSIDIIKRLAGRLKNKDSDTISELNF

SEQ ID NO: 2180391 - protein, 23 aa, Cryptosporidium hominis
RKNKPEQTCSVFVFDKTQNSGNE

SEQ ID NO: 2180392 - protein, 26 aa, Cryptosporidium hominis
RKNLFKIFLRYFIYPAYLDLYSYGNI

SEQ ID NO: 2180393 - protein, 18 aa, Cryptosporidium hominis
RKNLLKSYSRITSYKFVK

SEQ ID NO: 2180394 - protein, 20 aa, Cryptosporidium hominis
RKNLNKCAPYESFEGKISSK

SEQ ID NO: 2180395 - protein, 18 aa, Cryptosporidium hominis
RKNSEHSHGHFVMSPAQS

SEQ ID NO: 2180396 - protein, 22 aa, Cryptosporidium hominis
RKNVKCTIWLSFTSNMISSGLR

SEQ ID NO: 2180397 - protein, 17 aa, Cryptosporidium hominis
RKPIFRKMEEDNSEPQT

SEQ ID NO: 2180398 - protein, 24 aa, Cryptosporidium hominis
RKPIILGTYAFMLSIAEQKKRGDN

SEQ ID NO: 2180399 - protein, 17 aa, Cryptosporidium hominis
RKQLKMELLLSQEEASE

SEQ ID NO: 2180400 - protein, 20 aa, Cryptosporidium hominis
RKQNYSFECEELLSNVMSKL

SEQ ID NO: 2180401 - protein, 17 aa, Cryptosporidium hominis
RKQSSNFQILWPSLQDW

SEQ ID NO: 2180402 - protein, 17 aa, Cryptosporidium hominis
RKQYIIRKKNCSLRKPH

SEQ ID NO: 2180403 - protein, 20 aa, Cryptosporidium hominis
RKRFSEHDAARIIKQVFSGI

SEQ ID NO: 2180404 - protein, 20 aa, Cryptosporidium hominis
RKRMKRYFLNILRSNNAKFK

SEQ ID NO: 2180405 - protein, 20 aa, Cryptosporidium hominis
RKRQSNSFPGAKKSSSGDLY

SEQ ID NO: 2180406 - protein, 20 aa, Cryptosporidium hominis
RKRRGSAKSSYNFSPPPIPV

SEQ ID NO: 2180407 - protein, 20 aa, Cryptosporidium hominis
RKRSILELYDLIANGSEVYD

SEQ ID NO: 2180408 - protein, 24 aa, Cryptosporidium hominis
RKRTESFALYIYKVLKQVHPETGI

SEQ ID NO: 2180409 - protein, 17 aa, Cryptosporidium hominis
RKRVRGTENGFNSSNNN

SEQ ID NO: 2180410 - protein, 19 aa, Cryptosporidium hominis
RKRYTPLGWTKFYDFSEAD

SEQ ID NO: 2180411 - protein, 18 aa, Cryptosporidium hominis
RKSDLYFKNELLRKDELI

SEQ ID NO: 2180412 - protein, 19 aa, Cryptosporidium hominis
RKSIVMLAFIIKLFGLKNM

SEQ ID NO: 2180413 - protein, 20 aa, Cryptosporidium hominis
RKSKFSFNPNAKEFLPRAIS

SEQ ID NO: 2180414 - protein, 19 aa, Cryptosporidium hominis
RKSNELLDSKPSIQESKIS

SEQ ID NO: 2180415 - protein, 25 aa, Cryptosporidium hominis
RKSQQIIWFWECLKEFDQNRLATFV

SEQ ID NO: 2180416 - protein, 20 aa, Cryptosporidium hominis
RKSRRECLTERKIINQRHKE

SEQ ID NO: 2180417 - protein, 17 aa, Cryptosporidium hominis
RKSVAPFKLANMHKDFE

SEQ ID NO: 2180418 - protein, 18 aa, Cryptosporidium hominis
RKTLEFSLIEYQKGGWFS

SEQ ID NO: 2180419 - protein, 17 aa, Cryptosporidium hominis
RKTLLSFLELVSEKDNE

SEQ ID NO: 2180420 - protein, 20 aa, Cryptosporidium hominis
RKTNEFGRFRGLSKLFKLPK

SEQ ID NO: 2180421 - protein, 36 aa, Cryptosporidium hominis
RKTNILSIKLGWPVIRCPHYIDFLPVLKNCILRTNI

SEQ ID NO: 2180422 - protein, 20 aa, Cryptosporidium hominis
RKTSFDKIMRIHSSLIGSLS

SEQ ID NO: 2180423 - protein, 19 aa, Cryptosporidium hominis
RKTTSISMNAIKKKGIEDE

SEQ ID NO: 2180424 - protein, 17 aa, Cryptosporidium hominis
RKVIDLIIKLGEDELIL

SEQ ID NO: 2180425 - protein, 19 aa, Cryptosporidium hominis
RKVIPPTLILIDHSLETLK

SEQ ID NO: 2180426 - protein, 24 aa, Cryptosporidium hominis
RKWRTLWCWTHIYVHYKRAQIYTR

SEQ ID NO: 2180427 - protein, 18 aa, Cryptosporidium hominis
RKWVKRVSTPLLLNDAIV

SEQ ID NO: 2180428 - protein, 21 aa, Cryptosporidium hominis
RKYLIQRIKKYFSLQANVELG

SEQ ID NO: 2180429 - protein, 24 aa, Cryptosporidium hominis
RKYYPGEEIPILSIMGDGNMTNSR

SEQ ID NO: 2180430 - protein, 17 aa, Cryptosporidium hominis
RLAPVLIKEITRRIRCE

SEQ ID NO: 2180431 - protein, 18 aa, Cryptosporidium hominis
RLCIPIDTSQNFNFNPKT

SEQ ID NO: 2180432 - protein, 24 aa, Cryptosporidium hominis
RLCSKGKIAFNRQVLFITPHSEIV

SEQ ID NO: 2180433 - protein, 19 aa, Cryptosporidium hominis
RLDEMPEIDTNLFSMPIQI

SEQ ID NO: 2180434 - protein, 19 aa, Cryptosporidium hominis
RLDNFPLLENLKVLEIQDN

SEQ ID NO: 2180435 - protein, 20 aa, Cryptosporidium hominis
RLDNLGGVFSCFTALIDASE

SEQ ID NO: 2180436 - protein, 19 aa, Cryptosporidium hominis
RLDTLSSRLSRIPSPNVLI

SEQ ID NO: 2180437 - protein, 18 aa, Cryptosporidium hominis
RLEHACKGYMQLSHASAS

SEQ ID NO: 2180438 - protein, 24 aa, Cryptosporidium hominis
RLEKHLFDLFNFYISDGINNKIIV

SEQ ID NO: 2180439 - protein, 30 aa, Cryptosporidium hominis
RLEKNKFVFGRKGDCSIRLKDQSISGHHCT

SEQ ID NO: 2180440 - protein, 22 aa, Cryptosporidium hominis
RLELQISNGIPLKALTPDNSIA

SEQ ID NO: 2180441 - protein, 23 aa, Cryptosporidium hominis
RLENFSKFKSGQVDILFASELAA

SEQ ID NO: 2180442 - protein, 31 aa, Cryptosporidium hominis
RLESQMILFYPRMFCLSSWNLQQQETDQSLV

SEQ ID NO: 2180443 - protein, 21 aa, Cryptosporidium hominis
RLFKSWDILRNLVLNETRKKT

SEQ ID NO: 2180444 - protein, 21 aa, Cryptosporidium hominis
RLFLLPRPGTSLVNLVIALET

SEQ ID NO: 2180445 - protein, 26 aa, Cryptosporidium hominis
RLFSTCKEFKFLLVRNEEKIELEKLV

SEQ ID NO: 2180446 - protein, 19 aa, Cryptosporidium hominis
RLGIEKSVIEEELDWKLQN

SEQ ID NO: 2180447 - protein, 25 aa, Cryptosporidium hominis
RLGRCIPANPIALVGLLSNFGQFKS

SEQ ID NO: 2180448 - protein, 18 aa, Cryptosporidium hominis
RLHEETIPLSAARALTHV

SEQ ID NO: 2180449 - protein, 22 aa, Cryptosporidium hominis
RLHNTLELKEFVSLIETCDQLP

SEQ ID NO: 2180450 - protein, 23 aa, Cryptosporidium hominis
RLHVPNIDPSMFMERFAAQMKLG

SEQ ID NO: 2180451 - protein, 19 aa, Cryptosporidium hominis
RLIGESIERILFLILNNGF

SEQ ID NO: 2180452 - protein, 26 aa, Cryptosporidium hominis
RLIIQSSRFSFFVNRNQFLNVRSQVS

SEQ ID NO: 2180453 - protein, 20 aa, Cryptosporidium hominis
RLIWDQRPFLTGSIDDDTQL

SEQ ID NO: 2180454 - protein, 18 aa, Cryptosporidium hominis
RLKNSILDLNKLVFELYN

SEQ ID NO: 2180455 - protein, 23 aa, Cryptosporidium hominis
RLKRSDFLNLSFSIQVIEGGACI

SEQ ID NO: 2180456 - protein, 24 aa, Cryptosporidium hominis
RLKSLSCLQLRFLDDVEVNNLLSS

SEQ ID NO: 2180457 - protein, 22 aa, Cryptosporidium hominis
RLLEPELNKSASSWKKYHSKVF

SEQ ID NO: 2180458 - protein, 19 aa, Cryptosporidium hominis
RLLFYISVYGFEELGFKCI

SEQ ID NO: 2180459 - protein, 19 aa, Cryptosporidium hominis
RLLGPGLNKAGKFPTVITP

SEQ ID NO: 2180460 - protein, 19 aa, Cryptosporidium hominis
RLLKDPKLYSSPHNISKAL

SEQ ID NO: 2180461 - protein, 18 aa, Cryptosporidium hominis
RLLKLCSYSRVYSTQVPV

SEQ ID NO: 2180462 - protein, 18 aa, Cryptosporidium hominis
RLLQCGLDDVAIIPLPRW

SEQ ID NO: 2180463 - protein, 17 aa, Cryptosporidium hominis
RLLQPVKIEKVSELDCF

SEQ ID NO: 2180464 - protein, 23 aa, Cryptosporidium hominis
RLLSELMAIITVGRKGNCPSSKG

SEQ ID NO: 2180465 - protein, 20 aa, Cryptosporidium hominis
RLMDGLCIFMEAQLILEEAE

SEQ ID NO: 2180466 - protein, 24 aa, Cryptosporidium hominis
RLNESISAMTLRISSIDEEIAKRE

SEQ ID NO: 2180467 - protein, 19 aa, Cryptosporidium hominis
RLNKEAFLLNNQVQLNKEG

SEQ ID NO: 2180468 - protein, 27 aa, Cryptosporidium hominis
RLNNRLRANGFLSIPFLPDLTSPARSL

SEQ ID NO: 2180469 - protein, 24 aa, Cryptosporidium hominis
RLNSCEVFDPFATVPLRSVSMDPA

SEQ ID NO: 2180470 - protein, 25 aa, Cryptosporidium hominis
RLNSRRSCELEFISLPPPEYSYNIL

SEQ ID NO: 2180471 - protein, 24 aa, Cryptosporidium hominis
RLQTLRPEEIIIVFDFPEHEVEAR

SEQ ID NO: 2180472 - protein, 17 aa, Cryptosporidium hominis
RLRCKKRPWYVIYEGEG

SEQ ID NO: 2180473 - protein, 17 aa, Cryptosporidium hominis
RLREFHQNKVFKTKGNE

SEQ ID NO: 2180474 - protein, 20 aa, Cryptosporidium hominis
RLRMPKTVNKFGNLDNNNNY

SEQ ID NO: 2180475 - protein, 18 aa, Cryptosporidium hominis
RLRQYRAILNKLTIEKFD

SEQ ID NO: 2180476 - protein, 20 aa, Cryptosporidium hominis
RLRTIRILLNTCIQESKQLR

SEQ ID NO: 2180477 - protein, 17 aa, Cryptosporidium hominis
RLSEIYTSISRTIIKKC

SEQ ID NO: 2180478 - protein, 19 aa, Cryptosporidium hominis
RLSKISFLPIKVEEEHDFV

SEQ ID NO: 2180479 - protein, 20 aa, Cryptosporidium hominis
RLSSCPTFSSIATSWGTPVP

SEQ ID NO: 2180480 - protein, 21 aa, Cryptosporidium hominis
RLSTPPFLKLHLKPMPSDPTH

SEQ ID NO: 2180481 - protein, 22 aa, Cryptosporidium hominis
RLTDCHHLLAIFCEKNRIEYPK

SEQ ID NO: 2180482 - protein, 18 aa, Cryptosporidium hominis
RLTICLDKNNPKLSNNSI

SEQ ID NO: 2180483 - protein, 26 aa, Cryptosporidium hominis
RLTQKKSYKFAVLSPFNISHRLYNLD

SEQ ID NO: 2180484 - protein, 24 aa, Cryptosporidium hominis
RLVLLEFQGSLSISKLNTETGEMI

SEQ ID NO: 2180485 - protein, 24 aa, Cryptosporidium hominis
RLVSCLKETVLILFKSNKLEFLEN

SEQ ID NO: 2180486 - protein, 19 aa, Cryptosporidium hominis
RLVSWCSYLRTALSDIEVD

SEQ ID NO: 2180487 - protein, 20 aa, Cryptosporidium hominis
RLWDLRFAQQPFLYMNSNLT

SEQ ID NO: 2180488 - protein, 25 aa, Cryptosporidium hominis
RLWENKTPKLSSIWRRNEESKNLIV

SEQ ID NO: 2180489 - protein, 18 aa, Cryptosporidium hominis
RLWQERFFILRSDGALIW

SEQ ID NO: 2180490 - protein, 32 aa, Cryptosporidium hominis
RLYDITNVLEGIGILKKMGRNAFMCSASVPEV

SEQ ID NO: 2180491 - protein, 19 aa, Cryptosporidium hominis
RLYFGNLPINLGLTESSFQ

SEQ ID NO: 2180492 - protein, 20 aa, Cryptosporidium hominis
RLYLENKFEHCQSIDSYSIG

SEQ ID NO: 2180493 - protein, 19 aa, Cryptosporidium hominis
RLYLNSVKMGVKFGNGNTM

SEQ ID NO: 2180494 - protein, 32 aa, Cryptosporidium hominis
RLYQGSINFIKLKLLIYIEEPEILLANTCGPQ

SEQ ID NO: 2180495 - protein, 23 aa, Cryptosporidium hominis
RLYRLKENLKRLKIDKNAIELKI

SEQ ID NO: 2180496 - protein, 19 aa, Cryptosporidium hominis
RMDLSIGSYMAIPIKTPFG

SEQ ID NO: 2180497 - protein, 29 aa, Cryptosporidium hominis
RMDPRVVHVVVLTKVWTRFRGLRNTLNGF

SEQ ID NO: 2180498 - protein, 26 aa, Cryptosporidium hominis
RMELEPERFQSLMIVQSLNDKIVPTR

SEQ ID NO: 2180499 - protein, 25 aa, Cryptosporidium hominis
RMGDKGTGIIFLRPTEEGYLEILKN

SEQ ID NO: 2180500 - protein, 20 aa, Cryptosporidium hominis
RMKDILKFHIHSSEYILNII

SEQ ID NO: 2180501 - protein, 20 aa, Cryptosporidium hominis
RMPTLSAVRRKGYPPQSLWD

SEQ ID NO: 2180502 - protein, 19 aa, Cryptosporidium hominis
RMQDCLEKTLTVLVQCSYV

SEQ ID NO: 2180503 - protein, 21 aa, Cryptosporidium hominis
RMQFPGSVGFICYSHNGNYIA

SEQ ID NO: 2180504 - protein, 20 aa, Cryptosporidium hominis
RMSESIFWQSYFNAIRNIII

SEQ ID NO: 2180505 - protein, 20 aa, Cryptosporidium hominis
RMSPPCRVFLSDNFKSSKLS

SEQ ID NO: 2180506 - protein, 18 aa, Cryptosporidium hominis
RMVIKWMGIICTSNEDKS

SEQ ID NO: 2180507 - protein, 25 aa, Cryptosporidium hominis
RMYINDRCLWYEKPLLESGTLGTKA

SEQ ID NO: 2180508 - protein, 18 aa, Cryptosporidium hominis
RNAIVKWYIDDDNEGDTR

SEQ ID NO: 2180509 - protein, 22 aa, Cryptosporidium hominis
RNAMKVRFSRAYQANFYFSNKR

SEQ ID NO: 2180510 - protein, 19 aa, Cryptosporidium hominis
RNAVMCIYSIIKTFGVDII

SEQ ID NO: 2180511 - protein, 24 aa, Cryptosporidium hominis
RNDLFNLLCDAIGLSQDERSNLFI

SEQ ID NO: 2180512 - protein, 28 aa, Cryptosporidium hominis
RNDPKVKFKALRLIKHLCENGNPTFKML

SEQ ID NO: 2180513 - protein, 21 aa, Cryptosporidium hominis
RNEFSRLSKLYGANVIAEELV

SEQ ID NO: 2180514 - protein, 18 aa, Cryptosporidium hominis
RNEISVFELIKFENQKFI

SEQ ID NO: 2180515 - protein, 21 aa, Cryptosporidium hominis
RNELYFVTIFYGLQFALNRIF

SEQ ID NO: 2180516 - protein, 25 aa, Cryptosporidium hominis
RNEPFGIVVLEGWTAGKPVVATTSG

SEQ ID NO: 2180517 - protein, 25 aa, Cryptosporidium hominis
RNFGSKELDRDGGHRGRGWSGNLSH

SEQ ID NO: 2180518 - protein, 18 aa, Cryptosporidium hominis
RNFKESKKNVKIMSGLIN

SEQ ID NO: 2180519 - protein, 19 aa, Cryptosporidium hominis
RNFLQRFVRSLFLQTGYGS

SEQ ID NO: 2180520 - protein, 20 aa, Cryptosporidium hominis
RNFPDIDIFCFFGCSEYFLS

SEQ ID NO: 2180521 - protein, 21 aa, Cryptosporidium hominis
RNFRLPVYFVPSSSDYFYVSE

SEQ ID NO: 2180522 - protein, 19 aa, Cryptosporidium hominis
RNFSLPSWVQLRNIRDSKG

SEQ ID NO: 2180523 - protein, 20 aa, Cryptosporidium hominis
RNFTQYEYWALSLESFTSLK

SEQ ID NO: 2180524 - protein, 17 aa, Cryptosporidium hominis
RNGHINHRFSNRPRFVS

SEQ ID NO: 2180525 - protein, 20 aa, Cryptosporidium hominis
RNGNSYSFRNVYRFVPIPFE

SEQ ID NO: 2180526 - protein, 21 aa, Cryptosporidium hominis
RNGTNIILRFLMIPNGDIKCI

SEQ ID NO: 2180527 - protein, 22 aa, Cryptosporidium hominis
RNGYIKGGLRYCRSKRRSISSS

SEQ ID NO: 2180528 - protein, 19 aa, Cryptosporidium hominis
RNHQEWEDFVGVCWPGKVK

SEQ ID NO: 2180529 - protein, 17 aa, Cryptosporidium hominis
RNIPIQIGQLLAKKSTS

SEQ ID NO: 2180530 - protein, 24 aa, Cryptosporidium hominis
RNKCTRLENDLKRLSSQVQAQNQN

SEQ ID NO: 2180531 - protein, 19 aa, Cryptosporidium hominis
RNKEKLLFLNGIDESFNQI

SEQ ID NO: 2180532 - protein, 18 aa, Cryptosporidium hominis
RNKELIISYDIGSISNLY

SEQ ID NO: 2180533 - protein, 25 aa, Cryptosporidium hominis
RNKGMCGTSIQWGPWIEQGMAANLK

SEQ ID NO: 2180534 - protein, 26 aa, Cryptosporidium hominis
RNKGMCGTSIQWGPWIEQGMAMNIKQ

SEQ ID NO: 2180535 - protein, 20 aa, Cryptosporidium hominis
RNKKFEFVLKIFPVSIDVFL

SEQ ID NO: 2180536 - protein, 17 aa, Cryptosporidium hominis
RNKTIAFDVKWPIIANI

SEQ ID NO: 2180537 - protein, 26 aa, Cryptosporidium hominis
RNKVHNCLWSYVAKCTVFQPHDIEKI

SEQ ID NO: 2180538 - protein, 20 aa, Cryptosporidium hominis
RNKVMNWDKHFYLPSEHHKY

SEQ ID NO: 2180539 - protein, 17 aa, Cryptosporidium hominis
RNKVRTIESKVRDYEKE

SEQ ID NO: 2180540 - protein, 21 aa, Cryptosporidium hominis
RNKYLLSVKVNDFINKLITIE

SEQ ID NO: 2180541 - protein, 17 aa, Cryptosporidium hominis
RNLAVFWAKCEAGTYIR

SEQ ID NO: 2180542 - protein, 17 aa, Cryptosporidium hominis
RNLEFLPNINRLSNEPI

SEQ ID NO: 2180543 - protein, 17 aa, Cryptosporidium hominis
RNLEKKLLKKTGITTSG

SEQ ID NO: 2180544 - protein, 19 aa, Cryptosporidium hominis
RNLIPRIWSIFIEEPLDIN

SEQ ID NO: 2180545 - protein, 30 aa, Cryptosporidium hominis
RNLLQKGFKLWTRREFNLLLRCLETNGVEN

SEQ ID NO: 2180546 - protein, 17 aa, Cryptosporidium hominis
RNLQTLYLERNPIQNQL

SEQ ID NO: 2180547 - protein, 20 aa, Cryptosporidium hominis
RNLRRLKKVVLEDEEDEDDD

SEQ ID NO: 2180548 - protein, 17 aa, Cryptosporidium hominis
RNLSRFIAVQKFENLSW

SEQ ID NO: 2180549 - protein, 19 aa, Cryptosporidium hominis
RNMCINPRVSVHADRDKID

SEQ ID NO: 2180550 - protein, 19 aa, Cryptosporidium hominis
RNMEFSEIMLFLQNSPTKN

SEQ ID NO: 2180551 - protein, 20 aa, Cryptosporidium hominis
RNNIKDILTLNVTFSELEPC

SEQ ID NO: 2180552 - protein, 24 aa, Cryptosporidium hominis
RNNIKLYVRRVFIMDDCEELIPEF

SEQ ID NO: 2180553 - protein, 24 aa, Cryptosporidium hominis
RNNSAWCYRHFIFTNLKKMNALKE

SEQ ID NO: 2180554 - protein, 24 aa, Cryptosporidium hominis
RNQVYLNNIIKYMNLEKMGTNLMN

SEQ ID NO: 2180555 - protein, 24 aa, Cryptosporidium hominis
RNRAFLCKNVGLGGKRSGSNAPIP

SEQ ID NO: 2180556 - protein, 32 aa, Cryptosporidium hominis
RNRDFKYPLPRCVLKPRLGGSLKQNKDSIFDS

SEQ ID NO: 2180557 - protein, 18 aa, Cryptosporidium hominis
RNREFKPKISFIKHLASY

SEQ ID NO: 2180558 - protein, 19 aa, Cryptosporidium hominis
RNRLTKKVCINKESQQNET

SEQ ID NO: 2180559 - protein, 20 aa, Cryptosporidium hominis
RNSDYLYIWDVRKPNNILFK

SEQ ID NO: 2180560 - protein, 20 aa, Cryptosporidium hominis
RNSIRFCDQIIFFFKKNWGI

SEQ ID NO: 2180561 - protein, 21 aa, Cryptosporidium hominis
RNSKMELKELIKDYSNLYAEY

SEQ ID NO: 2180562 - protein, 25 aa, Cryptosporidium hominis
RNSNIRKGYAVNFIAVGPESEIQQC

SEQ ID NO: 2180563 - protein, 18 aa, Cryptosporidium hominis
RNSPYLRAPRMYSISDLA

SEQ ID NO: 2180564 - protein, 17 aa, Cryptosporidium hominis
RNSRWRGASEDNFNTIK

SEQ ID NO: 2180565 - protein, 21 aa, Cryptosporidium hominis
RNSWMHIFSFDSAIPRSNQRE

SEQ ID NO: 2180566 - protein, 20 aa, Cryptosporidium hominis
RNTKKIPIDRSKFHPSISNL

SEQ ID NO: 2180567 - protein, 22 aa, Cryptosporidium hominis
RNTLHPRSDLVMMSTLTESNSK

SEQ ID NO: 2180568 - protein, 18 aa, Cryptosporidium hominis
RNTNEWGGEVELVALSNS

SEQ ID NO: 2180569 - protein, 17 aa, Cryptosporidium hominis
RNVKRKKKLPISPISLY

SEQ ID NO: 2180570 - protein, 17 aa, Cryptosporidium hominis
RNYFDRLGFLEVETPML

SEQ ID NO: 2180571 - protein, 24 aa, Cryptosporidium hominis
RNYGERFLDVVLPGVCSRIACLIP

SEQ ID NO: 2180572 - protein, 24 aa, Cryptosporidium hominis
RNYNFKSSCNFDFRKSFTSLNLIL

SEQ ID NO: 2180573 - protein, 18 aa, Cryptosporidium hominis
RNYSCDDIFRKGECFSNS

SEQ ID NO: 2180574 - protein, 22 aa, Cryptosporidium hominis
RPAEPKVVFVIRLKGINKLSPK

SEQ ID NO: 2180575 - protein, 19 aa, Cryptosporidium hominis
RPAISDHKYRYGSPAEDYH

SEQ ID NO: 2180576 - protein, 25 aa, Cryptosporidium hominis
RPCEACSSLKGVVLYPLTENVGIEE

SEQ ID NO: 2180577 - protein, 26 aa, Cryptosporidium hominis
RPDKYSILLSRVLWLLPHDSPDGKYL

SEQ ID NO: 2180578 - protein, 20 aa, Cryptosporidium hominis
RPDLHDALCFSTLCDEKKSR

SEQ ID NO: 2180579 - protein, 19 aa, Cryptosporidium hominis
RPDLHVGLHSAPRGILLFG

SEQ ID NO: 2180580 - protein, 19 aa, Cryptosporidium hominis
RPDLLLTLIKLHEHLRDVL

SEQ ID NO: 2180581 - protein, 19 aa, Cryptosporidium hominis
RPDSPVLSIAWRTDSEHIL

SEQ ID NO: 2180582 - protein, 24 aa, Cryptosporidium hominis
RPEHILKKSLDFVYNNYIKYSSSK

SEQ ID NO: 2180583 - protein, 19 aa, Cryptosporidium hominis
RPELTPMSACIPKIDDFGE

SEQ ID NO: 2180584 - protein, 21 aa, Cryptosporidium hominis
RPFAIEIGNILSHHYLFYPKN

SEQ ID NO: 2180585 - protein, 26 aa, Cryptosporidium hominis
RPFFQRLTDSIYRRLIIGSSNQIKLV

SEQ ID NO: 2180586 - protein, 19 aa, Cryptosporidium hominis
RPFPQLKFKRKVENIEDFK

SEQ ID NO: 2180587 - protein, 20 aa, Cryptosporidium hominis
RPFSISSFYSGFFDFSISPI

SEQ ID NO: 2180588 - protein, 17 aa, Cryptosporidium hominis
RPGTSLVNLVIALETPM

SEQ ID NO: 2180589 - protein, 25 aa, Cryptosporidium hominis
RPHDLKEIILSFANKPGCNLKIRET

SEQ ID NO: 2180590 - protein, 18 aa, Cryptosporidium hominis
RPIDGIILTKFDTVDDKV

SEQ ID NO: 2180591 - protein, 18 aa, Cryptosporidium hominis
RPIIKCRELALMGVKEVF

SEQ ID NO: 2180592 - protein, 18 aa, Cryptosporidium hominis
RPILKRYQSIVLTSGTLS

SEQ ID NO: 2180593 - protein, 17 aa, Cryptosporidium hominis
RPIRLLYYNDLHYDSLF

SEQ ID NO: 2180594 - protein, 18 aa, Cryptosporidium hominis
RPIYVGKFQKKAERFSEK

SEQ ID NO: 2180595 - protein, 20 aa, Cryptosporidium hominis
RPKDVAKICDLVMADPENNI

SEQ ID NO: 2180596 - protein, 18 aa, Cryptosporidium hominis
RPKGILVTVSGAFRDQLN

SEQ ID NO: 2180597 - protein, 23 aa, Cryptosporidium hominis
RPKYMNCCVCGVATEINPSRMCI

SEQ ID NO: 2180598 - protein, 17 aa, Cryptosporidium hominis
RPLGIGIQGLADCFMML

SEQ ID NO: 2180599 - protein, 17 aa, Cryptosporidium hominis
RPLKLIWIVPKTELQKM

SEQ ID NO: 2180600 - protein, 24 aa, Cryptosporidium hominis
RPLPPLPFTICDWPLPIQSNERGE

SEQ ID NO: 2180601 - protein, 27 aa, Cryptosporidium hominis
RPLPQLGSFFTPRPWKGGNQSSSRLKD

SEQ ID NO: 2180602 - protein, 29 aa, Cryptosporidium hominis
RPLTENIFTPGFKCSCFAYGQTGSGKTYT

SEQ ID NO: 2180603 - protein, 25 aa, Cryptosporidium hominis
RPMGRRFSVKVVDYIVERFGTERTL

SEQ ID NO: 2180604 - protein, 19 aa, Cryptosporidium hominis
RPNFSREVVGPPGANIFIF

SEQ ID NO: 2180605 - protein, 18 aa, Cryptosporidium hominis
RPPLPYVPYPNRRPHKPY

SEQ ID NO: 2180606 - protein, 25 aa, Cryptosporidium hominis
RPPPNRSPAIPFSRLTDAELKESAL

SEQ ID NO: 2180607 - protein, 18 aa, Cryptosporidium hominis
RPRGFGFVTFESVDAVNN

SEQ ID NO: 2180608 - protein, 20 aa, Cryptosporidium hominis
RPRLVPWRAVAKMGVSWGLV

SEQ ID NO: 2180609 - protein, 17 aa, Cryptosporidium hominis
RPSIKYQSSVRRKNNSR

SEQ ID NO: 2180610 - protein, 24 aa, Cryptosporidium hominis
RPSMLKLDSFVKMIIRSPTIPREN

SEQ ID NO: 2180611 - protein, 18 aa, Cryptosporidium hominis
RPSSFLVSNGGLWDSSPL

SEQ ID NO: 2180612 - protein, 17 aa, Cryptosporidium hominis
RPVRPPIQFPIDKVVDL

SEQ ID NO: 2180613 - protein, 18 aa, Cryptosporidium hominis
RPWNVHWEILAQKEGKTG

SEQ ID NO: 2180614 - protein, 18 aa, Cryptosporidium hominis
RQEIELLKSQKAELKSEL

SEQ ID NO: 2180615 - protein, 22 aa, Cryptosporidium hominis
RQEWLIPFWPLLMAVGSIYDSN

SEQ ID NO: 2180616 - protein, 25 aa, Cryptosporidium hominis
RQFGHALILICILIKKYSNIIRLKY

SEQ ID NO: 2180617 - protein, 22 aa, Cryptosporidium hominis
RQFKGETELFFAQKMDLGGSVP

SEQ ID NO: 2180618 - protein, 17 aa, Cryptosporidium hominis
RQFQGLMSIIGTLVGRI

SEQ ID NO: 2180619 - protein, 25 aa, Cryptosporidium hominis
RQGKLCNFIDWKGHTLVVKRYASLY

SEQ ID NO: 2180620 - protein, 20 aa, Cryptosporidium hominis
RQGVTFIFECLMGLRDFDGN

SEQ ID NO: 2180621 - protein, 17 aa, Cryptosporidium hominis
RQICSGNFSYPYNISSV

SEQ ID NO: 2180622 - protein, 21 aa, Cryptosporidium hominis
RQIEFARLNMTYLVLSKRKLL

SEQ ID NO: 2180623 - protein, 27 aa, Cryptosporidium hominis
RQIFETICLINLTFLQICDSHLHTNIT

SEQ ID NO: 2180624 - protein, 19 aa, Cryptosporidium hominis
RQIFHSVRMSLQEQARATK

SEQ ID NO: 2180625 - protein, 18 aa, Cryptosporidium hominis
RQIGTLGLEAMGKLIKLR

SEQ ID NO: 2180626 - protein, 24 aa, Cryptosporidium hominis
RQIQKSIFLALNFIDHNLYIYNDK

SEQ ID NO: 2180627 - protein, 30 aa, Cryptosporidium hominis
RQIQPLRFPLPIFEFFCENMAKKCKGIEEI

SEQ ID NO: 2180628 - protein, 22 aa, Cryptosporidium hominis
RQISAFGLSFMRLDIRQEASKH

SEQ ID NO: 2180629 - protein, 26 aa, Cryptosporidium hominis
RQIWYNRLMWVLKHEIIISILSLSQI

SEQ ID NO: 2180630 - protein, 17 aa, Cryptosporidium hominis
RQKARDFIERRMYEKLC

SEQ ID NO: 2180631 - protein, 18 aa, Cryptosporidium hominis
RQKGDFSALHIIILDELD

SEQ ID NO: 2180632 - protein, 24 aa, Cryptosporidium hominis
RQKLERFGLRFISKVRDFVDSKST

SEQ ID NO: 2180633 - protein, 19 aa, Cryptosporidium hominis
RQKLYGIHMRKVCDLDQIA

SEQ ID NO: 2180634 - protein, 18 aa, Cryptosporidium hominis
RQKMLLLTTGILEYIYQD

SEQ ID NO: 2180635 - protein, 25 aa, Cryptosporidium hominis
RQLILKLRWYGAKTLDYYSSRADYV

SEQ ID NO: 2180636 - protein, 19 aa, Cryptosporidium hominis
RQLIPKKVWLIVRDLPSKS

SEQ ID NO: 2180637 - protein, 20 aa, Cryptosporidium hominis
RQLIQRSGVVPASMDELKRQ

SEQ ID NO: 2180638 - protein, 39 aa, Cryptosporidium hominis
RQLNEGVQCLNRFIQQLIKSCNIMRDHMLRKQNNSVGYS

SEQ ID NO: 2180639 - protein, 25 aa, Cryptosporidium hominis
RQLQIKEWALAAAYLTQQQQQQQQQ

SEQ ID NO: 2180640 - protein, 25 aa, Cryptosporidium hominis
RQMYLFLNHRVRLVYLHYILSNVHF

SEQ ID NO: 2180641 - protein, 17 aa, Cryptosporidium hominis
RQNLNWNAVLKTILSDI

SEQ ID NO: 2180642 - protein, 20 aa, Cryptosporidium hominis
RQNTGVLGYLAPYIDESFNI

SEQ ID NO: 2180643 - protein, 20 aa, Cryptosporidium hominis
RQPLKLSGVNPVFYEISTLR

SEQ ID NO: 2180644 - protein, 20 aa, Cryptosporidium hominis
RQPLRKMDCIYFVTNEKRNL

SEQ ID NO: 2180645 - protein, 18 aa, Cryptosporidium hominis
RQRDEKKLLLAELDTCIF

SEQ ID NO: 2180646 - protein, 34 aa, Cryptosporidium hominis
RQRRVCKIVDKVKCRRKLDEIDHEVEILKQLDHP

SEQ ID NO: 2180647 - protein, 18 aa, Cryptosporidium hominis
RQSCGARIWSPREVVTLV

SEQ ID NO: 2180648 - protein, 18 aa, Cryptosporidium hominis
RQTLLWSATWPKEVQKLA

SEQ ID NO: 2180649 - protein, 17 aa, Cryptosporidium hominis
RQTMLFSATLSRSVTDL

SEQ ID NO: 2180650 - protein, 19 aa, Cryptosporidium hominis
RQTVMFSATFPREIQQLAK

SEQ ID NO: 2180651 - protein, 24 aa, Cryptosporidium hominis
RQVYILGWLIHLRILNRIVDNIFI

SEQ ID NO: 2180652 - protein, 26 aa, Cryptosporidium hominis
RQYRAPEVILDLGWDMSSDMWGFGCI

SEQ ID NO: 2180653 - protein, 21 aa, Cryptosporidium hominis
RRADLALDRMKSEKSQGKQTE

SEQ ID NO: 2180654 - protein, 26 aa, Cryptosporidium hominis
RRALLRELRTVISFDGSYVNYRHLAL

SEQ ID NO: 2180655 - protein, 20 aa, Cryptosporidium hominis
RRALMHLGDTSKLFGLDLEA

SEQ ID NO: 2180656 - protein, 17 aa, Cryptosporidium hominis
RRCKLNIPPCSRVPEPD

SEQ ID NO: 2180657 - protein, 33 aa, Cryptosporidium hominis
RRDDPKLCWRCHKRDATPHMRSCEPCRVADRQR

SEQ ID NO: 2180658 - protein, 21 aa, Cryptosporidium hominis
RRDHKNWTALHIGVSKKFPEV

SEQ ID NO: 2180659 - protein, 20 aa, Cryptosporidium hominis
RRDLKLGTLLFGVIDHVSEK

SEQ ID NO: 2180660 - protein, 21 aa, Cryptosporidium hominis
RRDSVVKWIGRLSMNSSSEEK

SEQ ID NO: 2180661 - protein, 18 aa, Cryptosporidium hominis
RRDVNLYWDPRIQESSRE

SEQ ID NO: 2180662 - protein, 24 aa, Cryptosporidium hominis
RREGLKTILTFLSKRGYPNQINPK

SEQ ID NO: 2180663 - protein, 17 aa, Cryptosporidium hominis
RREKIEQTREDWRKTYT

SEQ ID NO: 2180664 - protein, 23 aa, Cryptosporidium hominis
RRFAGARPRACVVSRRSRVGCVW

SEQ ID NO: 2180665 - protein, 21 aa, Cryptosporidium hominis
RRFERNCGLRPHISSNSGANN

SEQ ID NO: 2180666 - protein, 17 aa, Cryptosporidium hominis
RRGGSPGRHHTMDGTGM

SEQ ID NO: 2180667 - protein, 25 aa, Cryptosporidium hominis
RRGRGGRIWFDRHLLFQDNFEPHFT

SEQ ID NO: 2180668 - protein, 25 aa, Cryptosporidium hominis
RRGVRKVSCIGAWHPARVQFQVPRA

SEQ ID NO: 2180669 - protein, 18 aa, Cryptosporidium hominis
RRGYPGYMYTDLSTIYER

SEQ ID NO: 2180670 - protein, 25 aa, Cryptosporidium hominis
RRHYERCGLSFYAIKSRGEAWDSSV

SEQ ID NO: 2180671 - protein, 25 aa, Cryptosporidium hominis
RRIAGFFIICSRLGAAINSHKIFNQ

SEQ ID NO: 2180672 - protein, 20 aa, Cryptosporidium hominis
RRIEVIKAKLKVLQSRSKPK

SEQ ID NO: 2180673 - protein, 17 aa, Cryptosporidium hominis
RRIFARLALNRTEIANI

SEQ ID NO: 2180674 - protein, 19 aa, Cryptosporidium hominis
RRIKASYSQRVEIKNVIEQ

SEQ ID NO: 2180675 - protein, 20 aa, Cryptosporidium hominis
RRILRCDKNNLSINSNKVNK

SEQ ID NO: 2180676 - protein, 21 aa, Cryptosporidium hominis
RRINDDLAFIYQQRINKFDTK

SEQ ID NO: 2180677 - protein, 22 aa, Cryptosporidium hominis
RRIRGVKFLFGQDIKVINAYND

SEQ ID NO: 2180678 - protein, 20 aa, Cryptosporidium hominis
RRIRWVGCGSDHSMAITADG

SEQ ID NO: 2180679 - protein, 17 aa, Cryptosporidium hominis
RRITFFLDRPDVMCKFR

SEQ ID NO: 2180680 - protein, 17 aa, Cryptosporidium hominis
RRIVYTKVLEFMSNNES

SEQ ID NO: 2180681 - protein, 19 aa, Cryptosporidium hominis
RRIYIPLPDEESRVLLIKN

SEQ ID NO: 2180682 - protein, 19 aa, Cryptosporidium hominis
RRKGAGLGSLIAAEVNSRR

SEQ ID NO: 2180683 - protein, 18 aa, Cryptosporidium hominis
RRKHELQDILKLPSQAEH

SEQ ID NO: 2180684 - protein, 28 aa, Cryptosporidium hominis
RRKHSRICLFCKGFKRPIQHISKDTLYL

SEQ ID NO: 2180685 - protein, 25 aa, Cryptosporidium hominis
RRKIKRAGLKLEQRFIESLIHIQIV

SEQ ID NO: 2180686 - protein, 23 aa, Cryptosporidium hominis
RRKLFTVKGGGCFVLVSDVIDKK

SEQ ID NO: 2180687 - protein, 24 aa, Cryptosporidium hominis
RRKRWKISLYLSYAKWESLQNNIK

SEQ ID NO: 2180688 - protein, 19 aa, Cryptosporidium hominis
RRLAFETQLSRSWQSNMHT

SEQ ID NO: 2180689 - protein, 21 aa, Cryptosporidium hominis
RRLDLAHLTSVFQDVKIYKYD

SEQ ID NO: 2180690 - protein, 20 aa, Cryptosporidium hominis
RRLKEEVLDKVLLRRTKVQR

SEQ ID NO: 2180691 - protein, 21 aa, Cryptosporidium hominis
RRLNKSDILFDNQLRDSYSYK

SEQ ID NO: 2180692 - protein, 35 aa, Cryptosporidium hominis
RRLNLEVSELRDEVKFWRCRAEASSKEQGKVLIRS

SEQ ID NO: 2180693 - protein, 21 aa, Cryptosporidium hominis
RRLVSLLSCLQKTAPRVLIFS

SEQ ID NO: 2180694 - protein, 18 aa, Cryptosporidium hominis
RRLWCKRCNTHFIPGITC

SEQ ID NO: 2180695 - protein, 20 aa, Cryptosporidium hominis
RRMKGSILNPLMFSFSDTET

SEQ ID NO: 2180696 - protein, 17 aa, Cryptosporidium hominis
RRNELMRELDILLILEF

SEQ ID NO: 2180697 - protein, 30 aa, Cryptosporidium hominis
RRNEVRSFLLGAAYHWLRRYHIDGLRIDAV

SEQ ID NO: 2180698 - protein, 33 aa, Cryptosporidium hominis
RRNLVLKRIEVFSLKLKRGGFRKVNKTNNDIEK

SEQ ID NO: 2180699 - protein, 18 aa, Cryptosporidium hominis
RRPCPLCLEDLFYSIKTV

SEQ ID NO: 2180700 - protein, 21 aa, Cryptosporidium hominis
RRPFKCILDVGLTRTTSGNRV

SEQ ID NO: 2180701 - protein, 20 aa, Cryptosporidium hominis
RRPIYTIPRSVIVDRNKRMY

SEQ ID NO: 2180702 - protein, 21 aa, Cryptosporidium hominis
RRPQMKHKEKEGAEHDKAKNT

SEQ ID NO: 2180703 - protein, 22 aa, Cryptosporidium hominis
RRPSSRIPHRNEFGNMNIEGKH

SEQ ID NO: 2180704 - protein, 19 aa, Cryptosporidium hominis
RRPTFPFVSILATSHLCKG

SEQ ID NO: 2180705 - protein, 23 aa, Cryptosporidium hominis
RRPVLSCFACGRTSGIVVDIGAS
